United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 54

SEQ ID NO: 2435570 - RNA, 15 nt, Human
cagaaucucgcucug

SEQ ID NO: 2435571 - RNA, 18 nt, Human
cagaaucuacccaaagga

SEQ ID NO: 2435572 - RNA, 17 nt, Human
cagaauguuuuuaaaau

SEQ ID NO: 2435573 - RNA, 20 nt, Human
cagaauguuuuacugugaaa

SEQ ID NO: 2435574 - RNA, 16 nt, Human
cagaauguuuuacugu

SEQ ID NO: 2435575 - RNA, 14 nt, Human
cagaaugugauuuc

SEQ ID NO: 2435576 - RNA, 11 nt, Human
cagaaugcugu

SEQ ID NO: 2435577 - RNA, 16 nt, Human
cagaaugcuguacauc

SEQ ID NO: 2435578 - RNA, 17 nt, Human
cagaaugcuguacaucu

SEQ ID NO: 2435579 - RNA, 18 nt, Human
cagaaugcuguacaucua

SEQ ID NO: 2435580 - RNA, 21 nt, Human
cagaaugcuguacaucuauuu

SEQ ID NO: 2435581 - RNA, 18 nt, Human
cagaauggggugcaugaa

SEQ ID NO: 2435582 - RNA, 20 nt, Human
cagccuggcccagcuccccc

SEQ ID NO: 2435583 - RNA, 19 nt, Human
cagccuggcccagcucccc

SEQ ID NO: 2435584 - RNA, 18 nt, Human
cagccuggcccagcuccc

SEQ ID NO: 2435585 - RNA, 17 nt, Human
cagccuggcccagcucc

SEQ ID NO: 2435586 - RNA, 16 nt, Human
cagccuggcccagcuc

SEQ ID NO: 2435587 - RNA, 15 nt, Human
cagccuggcccagcu

SEQ ID NO: 2435588 - RNA, 14 nt, Human
cagccuggcccagc

SEQ ID NO: 2435589 - RNA, 11 nt, Human
cagccuggccc

SEQ ID NO: 2435590 - RNA, 13 nt, Human
cagccuggcccag

SEQ ID NO: 2435591 - RNA, 12 nt, Human
cagccuggccca

SEQ ID NO: 2435592 - RNA, 13 nt, Human
cagccuggccaga

SEQ ID NO: 2435593 - RNA, 14 nt, Human
cagccuggccagac

SEQ ID NO: 2435594 - RNA, 15 nt, Human
cagccuggccagaca

SEQ ID NO: 2435595 - RNA, 17 nt, Human
cagccuggccagacaca

SEQ ID NO: 2435596 - RNA, 18 nt, Human
cagccuggccagacacag

SEQ ID NO: 2435597 - RNA, 20 nt, Human
cagccuggccagacacaggc

SEQ ID NO: 2435598 - RNA, 14 nt, Human
cagccuggcuucug

SEQ ID NO: 2435599 - RNA, 15 nt, Human
cagccuggcuucugg

SEQ ID NO: 2435600 - RNA, 16 nt, Human
cagccuggcuucugga

SEQ ID NO: 2435601 - RNA, 17 nt, Human
cagccuggcuucuggag

SEQ ID NO: 2435602 - RNA, 19 nt, Human
cagccuggcuucuggagcc

SEQ ID NO: 2435603 - RNA, 23 nt, Human
cagccuggcucccacaggcagcu

SEQ ID NO: 2435604 - RNA, 22 nt, Human
cagccuggcucccacaggcagc

SEQ ID NO: 2435605 - RNA, 21 nt, Human
cagccuggcucccacaggcag

SEQ ID NO: 2435606 - RNA, 12 nt, Human
cagccuggcucc

SEQ ID NO: 2435607 - RNA, 23 nt, Human
cagccuggcgaaaccccaucucu

SEQ ID NO: 2435608 - RNA, 10 nt, Human
cagccuggca

SEQ ID NO: 2435609 - RNA, 13 nt, Human
cagccuggaggcc

SEQ ID NO: 2435610 - RNA, 16 nt, Human
cagccuggagaugaaa

SEQ ID NO: 2435611 - RNA, 18 nt, Human
cagccuggacccccagcu

SEQ ID NO: 2435612 - RNA, 17 nt, Human
cagccuggacccccagc

SEQ ID NO: 2435613 - RNA, 17 nt, Human
cagccuggaucuccuca

SEQ ID NO: 2435614 - RNA, 12 nt, Human
cagccuggaggc

SEQ ID NO: 2435615 - RNA, 20 nt, Human
cagccuggcacagggcagug

SEQ ID NO: 2435616 - RNA, 13 nt, Human
cagccuggcacag

SEQ ID NO: 2435617 - RNA, 21 nt, Human
cagccuggcacagggcagugg

SEQ ID NO: 2435618 - RNA, 21 nt, Human
cagccugcuccuucccaggag

SEQ ID NO: 2435619 - RNA, 20 nt, Human
cagccugcuccuucccagga

SEQ ID NO: 2435620 - RNA, 21 nt, Human
cagccucuagggaccccuccu

SEQ ID NO: 2435621 - RNA, 16 nt, Human
cagccuggacccccag

SEQ ID NO: 2435622 - RNA, 15 nt, Human
cagccuggaccccca

SEQ ID NO: 2435623 - RNA, 13 nt, Human
cagccuggacccc

SEQ ID NO: 2435624 - RNA, 16 nt, Human
cagccuggacauagag

SEQ ID NO: 2435625 - RNA, 22 nt, Human
cagccugcuccuucccaggagu

SEQ ID NO: 2435626 - RNA, 15 nt, Human
cagccuggacccugu

SEQ ID NO: 2435627 - RNA, 19 nt, Human
cagccuggacccuguggau

SEQ ID NO: 2435628 - RNA, 21 nt, Human
cagccucccuauuuuuuuucu

SEQ ID NO: 2435629 - RNA, 13 nt, Human
cagccucccucug

SEQ ID NO: 2435630 - RNA, 14 nt, Human
cagccucccucuga

SEQ ID NO: 2435631 - RNA, 15 nt, Human
cagccucccucugac

SEQ ID NO: 2435632 - RNA, 21 nt, Human
cagccucccucugaccugcag

SEQ ID NO: 2435633 - RNA, 22 nt, Human
cagccucccucugaccugcagg

SEQ ID NO: 2435634 - RNA, 23 nt, Human
cagccucccucugaccugcaggc

SEQ ID NO: 2435635 - RNA, 23 nt, Human
cagccucccgaguagcugggacu

SEQ ID NO: 2435636 - RNA, 22 nt, Human
cagccucccgaguagcugggac

SEQ ID NO: 2435637 - RNA, 21 nt, Human
cagccucccgaguagcuggga

SEQ ID NO: 2435638 - RNA, 20 nt, Human
cagccucccgaguagcuggg

SEQ ID NO: 2435639 - RNA, 19 nt, Human
cagccucccgaguagcugg

SEQ ID NO: 2435640 - RNA, 23 nt, Human
cagccucccgaauagcugggacu

SEQ ID NO: 2435641 - RNA, 12 nt, Human
cagccucccuga

SEQ ID NO: 2435642 - RNA, 14 nt, Human
cagccucccugaag

SEQ ID NO: 2435643 - RNA, 16 nt, Human
cagccucccugaagcc

SEQ ID NO: 2435644 - RNA, 17 nt, Human
cagccucccugaagccu

SEQ ID NO: 2435645 - RNA, 17 nt, Human
cagccuccgagagggag

SEQ ID NO: 2435646 - RNA, 21 nt, Human
cagccucccugucggccuggu

SEQ ID NO: 2435647 - RNA, 18 nt, Human
cagccucccugaagccuu

SEQ ID NO: 2435648 - RNA, 20 nt, Human
cagccuccgagagggagaga

SEQ ID NO: 2435649 - RNA, 19 nt, Human
cagccuccgagagggagag

SEQ ID NO: 2435650 - RNA, 17 nt, Human
cagccuccucugucugc

SEQ ID NO: 2435651 - RNA, 23 nt, Human
cagccuccucuggacggcaggcu

SEQ ID NO: 2435652 - RNA, 22 nt, Human
cagccuccucuggacggcaggc

SEQ ID NO: 2435653 - RNA, 21 nt, Human
cagccuccucuggacggcagg

SEQ ID NO: 2435654 - RNA, 17 nt, Human
cagccuccucuggacgg

SEQ ID NO: 2435655 - RNA, 14 nt, Human
cagccuccucugga

SEQ ID NO: 2435656 - RNA, 12 nt, Human
cagccuccucug

SEQ ID NO: 2435657 - RNA, 15 nt, Human
cagccuccuccugac

SEQ ID NO: 2435658 - RNA, 13 nt, Human
cagccuccuccug

SEQ ID NO: 2435659 - RNA, 23 nt, Human
cagccuccucaucugggggagug

SEQ ID NO: 2435660 - RNA, 17 nt, Human
cagccuccucaucuggg

SEQ ID NO: 2435661 - RNA, 16 nt, Human
cagccuccucaucugg

SEQ ID NO: 2435662 - RNA, 18 nt, Human
cagccuccguauuucaga

SEQ ID NO: 2435663 - RNA, 19 nt, Human
cagccuccguauuucagac

SEQ ID NO: 2435664 - RNA, 20 nt, Human
cagccucuagggaccccucc

SEQ ID NO: 2435665 - RNA, 19 nt, Human
cagccucuagggaccccuc

SEQ ID NO: 2435666 - RNA, 15 nt, Human
cagccucuagggacc

SEQ ID NO: 2435667 - RNA, 14 nt, Human
cagccucuagggac

SEQ ID NO: 2435668 - RNA, 20 nt, Human
cagccugcuccagcuguuca

SEQ ID NO: 2435669 - RNA, 23 nt, Human
cagccuccucugucugcccuuca

SEQ ID NO: 2435670 - RNA, 15 nt, Human
cagccuccugaguag

SEQ ID NO: 2435671 - RNA, 20 nt, Human
cagccuccugaguagcugga

SEQ ID NO: 2435672 - RNA, 24 nt, Human
cagccuugaccauucuccaccugc

SEQ ID NO: 2435673 - RNA, 17 nt, Human
cagccuucuuugcuugc

SEQ ID NO: 2435674 - RNA, 14 nt, Human
cagccuucuuugcu

SEQ ID NO: 2435675 - RNA, 23 nt, Human
cagccuucuuccaucccaggaca

SEQ ID NO: 2435676 - RNA, 21 nt, Human
cagccuucuuccaucccagga

SEQ ID NO: 2435677 - RNA, 23 nt, Human
cagccuugaccauucuccaccug

SEQ ID NO: 2435678 - RNA, 22 nt, Human
cagccuugaccauucuccaccu

SEQ ID NO: 2435679 - RNA, 13 nt, Human
cagccuugccaga

SEQ ID NO: 2435680 - RNA, 14 nt, Human
cagccuugccagag

SEQ ID NO: 2435681 - RNA, 15 nt, Human
cagccuugccagaga

SEQ ID NO: 2435682 - RNA, 16 nt, Human
cagccuugccagagau

SEQ ID NO: 2435683 - RNA, 21 nt, Human
cagccuucuuugcuugccucu

SEQ ID NO: 2435684 - RNA, 21 nt, Human
cagccuuggauaaugcuguug

SEQ ID NO: 2435685 - RNA, 17 nt, Human
cagccuuggcaucuaga

SEQ ID NO: 2435686 - RNA, 17 nt, Human
cagccuuucucccaggc

SEQ ID NO: 2435687 - RNA, 18 nt, Human
cagccuuucucccaggcc

SEQ ID NO: 2435688 - RNA, 19 nt, Human
cagccuuucucccaggcca

SEQ ID NO: 2435689 - RNA, 20 nt, Human
cagccuuucucccaggccag

SEQ ID NO: 2435690 - RNA, 23 nt, Human
cagccuuucucccaggccaggcu

SEQ ID NO: 2435691 - RNA, 19 nt, Human
cagccuuugaucagguggg

SEQ ID NO: 2435692 - RNA, 22 nt, Human
cagccuuugaucagguggggag

SEQ ID NO: 2435693 - RNA, 23 nt, Human
cagccuuugaucagguggggagu

SEQ ID NO: 2435694 - RNA, 17 nt, Human
cagccuuugccuccccg

SEQ ID NO: 2435695 - RNA, 21 nt, Human
cagcgaaaggauguaaacagu

SEQ ID NO: 2435696 - RNA, 21 nt, Human
cagccuugaccauucuccacc

SEQ ID NO: 2435697 - RNA, 20 nt, Human
cagccuugaccauucuccac

SEQ ID NO: 2435698 - RNA, 18 nt, Human
cagccuucuuccauccca

SEQ ID NO: 2435699 - RNA, 23 nt, Human
cagccuuccucugcagcugaccu

SEQ ID NO: 2435700 - RNA, 22 nt, Human
cagccuuccucugcagcugacc

SEQ ID NO: 2435701 - RNA, 21 nt, Human
cagccuuccucugcagcugac

SEQ ID NO: 2435702 - RNA, 16 nt, Human
cagccuucuuccaucc

SEQ ID NO: 2435703 - RNA, 17 nt, Human
cagccuugaccauucuc

SEQ ID NO: 2435704 - RNA, 22 nt, Human
cagccuguggcggugccugggu

SEQ ID NO: 2435705 - RNA, 23 nt, Human
cagccuucagacagagaggacug

SEQ ID NO: 2435706 - RNA, 14 nt, Human
cagccuucccccuc

SEQ ID NO: 2435707 - RNA, 16 nt, Human
cagccuguuggacccg

SEQ ID NO: 2435708 - RNA, 18 nt, Human
cagccuguggcggugccu

SEQ ID NO: 2435709 - RNA, 19 nt, Human
cagccuguggcggugccug

SEQ ID NO: 2435710 - RNA, 20 nt, Human
cagccuguggcggugccugg

SEQ ID NO: 2435711 - RNA, 21 nt, Human
cagccuguggcggugccuggg

SEQ ID NO: 2435712 - RNA, 20 nt, Human
cagccuuccucugcagcuga

SEQ ID NO: 2435713 - RNA, 19 nt, Human
cagccuuccucugcagcug

SEQ ID NO: 2435714 - RNA, 18 nt, Human
cagccuuccucugcagcu

SEQ ID NO: 2435715 - RNA, 15 nt, Human
cagccuuccucugca

SEQ ID NO: 2435716 - RNA, 14 nt, Human
cagccuuccucugc

SEQ ID NO: 2435717 - RNA, 23 nt, Human
cagccuuccccuugcccagggcu

SEQ ID NO: 2435718 - RNA, 20 nt, Human
cagccuucccccucccaggg

SEQ ID NO: 2435719 - RNA, 21 nt, Human
cagccuucccccucccagggc

SEQ ID NO: 2435720 - RNA, 16 nt, Human
cagccuuccccuugcc

SEQ ID NO: 2435721 - RNA, 21 nt, Human
cagccuuccccuugcccaggg

SEQ ID NO: 2435722 - RNA, 20 nt, Human
cagccugggcaacacagcga

SEQ ID NO: 2435723 - RNA, 19 nt, Human
cagccugggcaacagagca

SEQ ID NO: 2435724 - RNA, 20 nt, Human
cagccugggcaacagagcaa

SEQ ID NO: 2435725 - RNA, 20 nt, Human
cagccuggcuucuggagccc

SEQ ID NO: 2435726 - RNA, 21 nt, Human
cagccuggcuucuggagcccu

SEQ ID NO: 2435727 - RNA, 16 nt, Human
cagccugggcaaugug

SEQ ID NO: 2435728 - RNA, 19 nt, Human
cagccugggcaaugugaua

SEQ ID NO: 2435729 - RNA, 11 nt, Human
cagccugggcg

SEQ ID NO: 2435730 - RNA, 15 nt, Human
cagccugggcgacag

SEQ ID NO: 2435731 - RNA, 20 nt, Human
cagccugggcagcauagcaa

SEQ ID NO: 2435732 - RNA, 17 nt, Human
cagccugggcagccagg

SEQ ID NO: 2435733 - RNA, 18 nt, Human
cagccugggcagccaggc

SEQ ID NO: 2435734 - RNA, 19 nt, Human
cagccugggcagccaggcu

SEQ ID NO: 2435735 - RNA, 20 nt, Human
cagccugggcagccaggcug

SEQ ID NO: 2435736 - RNA, 21 nt, Human
cagccugggcagccaggcugc

SEQ ID NO: 2435737 - RNA, 17 nt, Human
cagccuggggcuggccu

SEQ ID NO: 2435738 - RNA, 18 nt, Human
cagccuggggcuggccuc

SEQ ID NO: 2435739 - RNA, 21 nt, Human
cagccuggggcuggccuccca

SEQ ID NO: 2435740 - RNA, 15 nt, Human
cagccuggggucugg

SEQ ID NO: 2435741 - RNA, 20 nt, Human
cagccugggugacagaguga

SEQ ID NO: 2435742 - RNA, 19 nt, Human
cagccuggggucuggaguu

SEQ ID NO: 2435743 - RNA, 20 nt, Human
cagccuggucaacaugguga

SEQ ID NO: 2435744 - RNA, 15 nt, Human
cagccuggugggccu

SEQ ID NO: 2435745 - RNA, 16 nt, Human
cagccuggugggccuc

SEQ ID NO: 2435746 - RNA, 17 nt, Human
cagccuggugggccucc

SEQ ID NO: 2435747 - RNA, 18 nt, Human
cagccuggugggccuccu

SEQ ID NO: 2435748 - RNA, 17 nt, Human
cagccugucucuuccau

SEQ ID NO: 2435749 - RNA, 16 nt, Human
cagccugucucuucca

SEQ ID NO: 2435750 - RNA, 14 nt, Human
cagccugugcugcc

SEQ ID NO: 2435751 - RNA, 16 nt, Human
cagccugugcugcccg

SEQ ID NO: 2435752 - RNA, 12 nt, Human
cagccuguggca

SEQ ID NO: 2435753 - RNA, 15 nt, Human
cagccuguggcaucu

SEQ ID NO: 2435754 - RNA, 19 nt, Human
cagccuguggcaucuuugc

SEQ ID NO: 2435755 - RNA, 21 nt, Human
cagccuguggcaucuuugccu

SEQ ID NO: 2435756 - RNA, 19 nt, Human
cagccugucucuuccauau

SEQ ID NO: 2435757 - RNA, 12 nt, Human
cagccuguggcg

SEQ ID NO: 2435758 - RNA, 15 nt, Human
cagccugucucuucc

SEQ ID NO: 2435759 - RNA, 19 nt, Human
cagccuguccugggcuggu

SEQ ID NO: 2435760 - RNA, 15 nt, Human
cagccuguccugggc

SEQ ID NO: 2435761 - RNA, 12 nt, Human
cagccuguccug

SEQ ID NO: 2435762 - RNA, 22 nt, Human
cagccugucccauggacacucc

SEQ ID NO: 2435763 - RNA, 21 nt, Human
cagccugucccauggacacuc

SEQ ID NO: 2435764 - RNA, 19 nt, Human
cagccugucccauggacac

SEQ ID NO: 2435765 - RNA, 23 nt, Human
cagccuggugggccuccucuguc

SEQ ID NO: 2435766 - RNA, 17 nt, Human
cagccuguaucuugggg

SEQ ID NO: 2435767 - RNA, 17 nt, Human
cagcucaccucucccuu

SEQ ID NO: 2435768 - RNA, 16 nt, Human
cagcucaccucucccu

SEQ ID NO: 2435769 - RNA, 15 nt, Human
cagcucaccucuccc

SEQ ID NO: 2435770 - RNA, 13 nt, Human
cagcucaccucuc

SEQ ID NO: 2435771 - RNA, 21 nt, Human
cagcucaccagccccagugcc

SEQ ID NO: 2435772 - RNA, 20 nt, Human
cagcucaccagccccagugc

SEQ ID NO: 2435773 - RNA, 22 nt, Human
cagcucaccagccccagugccc

SEQ ID NO: 2435774 - RNA, 20 nt, Human
cagcucaauggacuggaagg

SEQ ID NO: 2435775 - RNA, 18 nt, Human
cagcucaccccccacacu

SEQ ID NO: 2435776 - RNA, 12 nt, Human
cagcucaccccc

SEQ ID NO: 2435777 - RNA, 20 nt, Human
cagcucacccagccccaggg

SEQ ID NO: 2435778 - RNA, 22 nt, Human
cagcucaagucuucccugauca

SEQ ID NO: 2435779 - RNA, 21 nt, Human
cagcucagaaguuucuucuuu

SEQ ID NO: 2435780 - RNA, 22 nt, Human
cagcucagaaguuucuucuuua

SEQ ID NO: 2435781 - RNA, 12 nt, Human
cagcucagagag

SEQ ID NO: 2435782 - RNA, 21 nt, Human
cagcucacugcaaccuucgcc

SEQ ID NO: 2435783 - RNA, 15 nt, Human
cagcucacugcaacc

SEQ ID NO: 2435784 - RNA, 20 nt, Human
cagcucaccucucccuugga

SEQ ID NO: 2435785 - RNA, 19 nt, Human
cagcucaccucucccuugg

SEQ ID NO: 2435786 - RNA, 14 nt, Human
cagcucaccccugg

SEQ ID NO: 2435787 - RNA, 22 nt, Human
cagcucaccccccacacucacu

SEQ ID NO: 2435788 - RNA, 20 nt, Human
cagcucaccccccacacuca

SEQ ID NO: 2435789 - RNA, 19 nt, Human
cagcucaccccccacacuc

SEQ ID NO: 2435790 - RNA, 12 nt, Human
cagcucacugca

SEQ ID NO: 2435791 - RNA, 14 nt, Human
cagcucacugcaac

SEQ ID NO: 2435792 - RNA, 17 nt, Human
cagcucacgucacacuu

SEQ ID NO: 2435793 - RNA, 17 nt, Human
cagcuauaccugugccu

SEQ ID NO: 2435794 - RNA, 19 nt, Human
cagcuauaccugugccucg

SEQ ID NO: 2435795 - RNA, 21 nt, Human
cagcuauaccugugccucggc

SEQ ID NO: 2435796 - RNA, 22 nt, Human
cagcuauaccugugccucggcu

SEQ ID NO: 2435797 - RNA, 23 nt, Human
cagcuaucuggucaaccuccugg

SEQ ID NO: 2435798 - RNA, 18 nt, Human
cagcuaucucucagugaa

SEQ ID NO: 2435799 - RNA, 23 nt, Human
cagcuauaccugugccucggcuu

SEQ ID NO: 2435800 - RNA, 20 nt, Human
cagcuauaacaguagggaug

SEQ ID NO: 2435801 - RNA, 17 nt, Human
cagcuaucucucaguga

SEQ ID NO: 2435802 - RNA, 13 nt, Human
cagcuaugggagc

SEQ ID NO: 2435803 - RNA, 15 nt, Human
cagcuaugggagccc

SEQ ID NO: 2435804 - RNA, 17 nt, Human
cagcuaugggagcccca

SEQ ID NO: 2435805 - RNA, 18 nt, Human
cagcuaugggagccccag

SEQ ID NO: 2435806 - RNA, 20 nt, Human
cagcuaugggagccccaggg

SEQ ID NO: 2435807 - RNA, 21 nt, Human
cagcuaugggagccccagggu

SEQ ID NO: 2435808 - RNA, 22 nt, Human
cagcuaugggagccccaggguc

SEQ ID NO: 2435809 - RNA, 23 nt, Human
cagcuaugggagccccagggucu

SEQ ID NO: 2435810 - RNA, 23 nt, Human
cagcuagaaauaagcccaacaga

SEQ ID NO: 2435811 - RNA, 17 nt, Human
cagcuacuuuaacacca

SEQ ID NO: 2435812 - RNA, 16 nt, Human
cagcuacuugggaggc

SEQ ID NO: 2435813 - RNA, 16 nt, Human
cagcuacuugggaagc

SEQ ID NO: 2435814 - RNA, 15 nt, Human
cagcuacuugggaag

SEQ ID NO: 2435815 - RNA, 15 nt, Human
cagcuacuugggagg

SEQ ID NO: 2435816 - RNA, 18 nt, Human
cagcuauaacaguaggga

SEQ ID NO: 2435817 - RNA, 15 nt, Human
cagcuauaccugugc

SEQ ID NO: 2435818 - RNA, 16 nt, Human
cagcuauaccugugcc

SEQ ID NO: 2435819 - RNA, 19 nt, Human
cagcuagguggggccuaga

SEQ ID NO: 2435820 - RNA, 19 nt, Human
cagcucaccagccccagug

SEQ ID NO: 2435821 - RNA, 17 nt, Human
cagcucaccagccccag

SEQ ID NO: 2435822 - RNA, 16 nt, Human
cagcucaccagcccca

SEQ ID NO: 2435823 - RNA, 15 nt, Human
cagcucaccagcccc

SEQ ID NO: 2435824 - RNA, 13 nt, Human
cagcucaccagcc

SEQ ID NO: 2435825 - RNA, 19 nt, Human
cagcucaaggaaaggccug

SEQ ID NO: 2435826 - RNA, 20 nt, Human
cagcucaaggaaaggccuga

SEQ ID NO: 2435827 - RNA, 16 nt, Human
cagcucaauggacugg

SEQ ID NO: 2435828 - RNA, 13 nt, Human
cagcucaagucuu

SEQ ID NO: 2435829 - RNA, 19 nt, Human
cagcucaagucuucccuga

SEQ ID NO: 2435830 - RNA, 20 nt, Human
cagcuauguuauauugaaaa

SEQ ID NO: 2435831 - RNA, 21 nt, Human
cagcuauguuauauugaaaaa

SEQ ID NO: 2435832 - RNA, 13 nt, Human
cagcuaugcuggu

SEQ ID NO: 2435833 - RNA, 18 nt, Human
cagcuauugauauaaaua

SEQ ID NO: 2435834 - RNA, 19 nt, Human
cagcucaaaggcacaguga

SEQ ID NO: 2435835 - RNA, 18 nt, Human
cagcuauuuuuacuagaa

SEQ ID NO: 2435836 - RNA, 15 nt, Human
cagcucaaaggcaca

SEQ ID NO: 2435837 - RNA, 16 nt, Human
cagcuauuuuuacuag

SEQ ID NO: 2435838 - RNA, 13 nt, Human
cagcuauuuuuau

SEQ ID NO: 2435839 - RNA, 18 nt, Human
cagcuaacauggaaguac

SEQ ID NO: 2435840 - RNA, 19 nt, Human
cagcuaacauggaaguacu

SEQ ID NO: 2435841 - RNA, 22 nt, Human
cagcgauguaugcagcuaucug

SEQ ID NO: 2435842 - RNA, 18 nt, Human
cagcgauguaugcagcua

SEQ ID NO: 2435843 - RNA, 23 nt, Human
cagcgauguaugcagcuaucugg

SEQ ID NO: 2435844 - RNA, 23 nt, Human
cagcgccaagcaaccugggucca

SEQ ID NO: 2435845 - RNA, 19 nt, Human
cagcgccaagcaaccuggg

SEQ ID NO: 2435846 - RNA, 17 nt, Human
cagcgccaagcaaccug

SEQ ID NO: 2435847 - RNA, 16 nt, Human
cagcgccaagcaaccu

SEQ ID NO: 2435848 - RNA, 14 nt, Human
cagcgccaagcaac

SEQ ID NO: 2435849 - RNA, 16 nt, Human
cagcgaggaggcucca

SEQ ID NO: 2435850 - RNA, 17 nt, Human
cagcgaggaggcuccag

SEQ ID NO: 2435851 - RNA, 18 nt, Human
cagcgaggaggcuccaga

SEQ ID NO: 2435852 - RNA, 22 nt, Human
cagcgaguuguggaaagccucu

SEQ ID NO: 2435853 - RNA, 20 nt, Human
cagcgagaggcagagaaaga

SEQ ID NO: 2435854 - RNA, 18 nt, Human
cagcgagaggcagagaaa

SEQ ID NO: 2435855 - RNA, 13 nt, Human
cagcgagaggcag

SEQ ID NO: 2435856 - RNA, 21 nt, Human
cagcgagcccugguggcagug

SEQ ID NO: 2435857 - RNA, 20 nt, Human
cagcgagcccugguggcagu

SEQ ID NO: 2435858 - RNA, 19 nt, Human
cagcgagcccugguggcag

SEQ ID NO: 2435859 - RNA, 17 nt, Human
cagcgagcccugguggc

SEQ ID NO: 2435860 - RNA, 16 nt, Human
cagcgagcccuggugg

SEQ ID NO: 2435861 - RNA, 22 nt, Human
cagcgacuccguuggccacucc

SEQ ID NO: 2435862 - RNA, 21 nt, Human
cagcgacuccguuggccacuc

SEQ ID NO: 2435863 - RNA, 17 nt, Human
cagcgacuccguuggcc

SEQ ID NO: 2435864 - RNA, 18 nt, Human
cagcgaccuuccucaucc

SEQ ID NO: 2435865 - RNA, 13 nt, Human
cagcgagcccugg

SEQ ID NO: 2435866 - RNA, 18 nt, Human
cagcgaccgcccccuccu

SEQ ID NO: 2435867 - RNA, 17 nt, Human
cagcgaccgcccccucc

SEQ ID NO: 2435868 - RNA, 21 nt, Human
cagcgaccaccccugccucca

SEQ ID NO: 2435869 - RNA, 20 nt, Human
cagcgaccaccccugccucc

SEQ ID NO: 2435870 - RNA, 16 nt, Human
cagcgaccgcccccuc

SEQ ID NO: 2435871 - RNA, 16 nt, Human
cagcgaccaccccugc

SEQ ID NO: 2435872 - RNA, 14 nt, Human
cagcgaccaccccu

SEQ ID NO: 2435873 - RNA, 20 nt, Human
cagcgacauagcccaucccu

SEQ ID NO: 2435874 - RNA, 14 nt, Human
cagcgaagggagug

SEQ ID NO: 2435875 - RNA, 19 nt, Human
cagcgacauagcccauccc

SEQ ID NO: 2435876 - RNA, 18 nt, Human
cagcuaagcuaggaauga

SEQ ID NO: 2435877 - RNA, 15 nt, Human
cagcuaagcuaggaa

SEQ ID NO: 2435878 - RNA, 23 nt, Human
cagcuaagaaccuggaacuuggg

SEQ ID NO: 2435879 - RNA, 14 nt, Human
cagcuaagaaccug

SEQ ID NO: 2435880 - RNA, 16 nt, Human
cagcuaagaaccugga

SEQ ID NO: 2435881 - RNA, 18 nt, Human
cagcuaagaaccuggaac

SEQ ID NO: 2435882 - RNA, 19 nt, Human
cagcuaagaaccuggaacu

SEQ ID NO: 2435883 - RNA, 22 nt, Human
cagcgccaagcaaccugggucc

SEQ ID NO: 2435884 - RNA, 14 nt, Human
cagcgccagccugu

SEQ ID NO: 2435885 - RNA, 13 nt, Human
cagcuaagaaccu

SEQ ID NO: 2435886 - RNA, 12 nt, Human
cagcuaagaaaa

SEQ ID NO: 2435887 - RNA, 23 nt, Human
cagcuaagaaaagauuuuaauca

SEQ ID NO: 2435888 - RNA, 20 nt, Human
cagcuaacauggaaguacua

SEQ ID NO: 2435889 - RNA, 19 nt, Human
cagcuaaucuguagggcug

SEQ ID NO: 2435890 - RNA, 17 nt, Human
cagcuaaucuguagggc

SEQ ID NO: 2435891 - RNA, 16 nt, Human
cagcuaaucuguaggg

SEQ ID NO: 2435892 - RNA, 14 nt, Human
cagcuaaucuguag

SEQ ID NO: 2435893 - RNA, 12 nt, Human
cagcuaaucugu

SEQ ID NO: 2435894 - RNA, 19 nt, Human
cagcuaaucagcauucuca

SEQ ID NO: 2435895 - RNA, 19 nt, Human
cagcuaaggacauuuccca

SEQ ID NO: 2435896 - RNA, 16 nt, Human
cagcuaaugggacacu

SEQ ID NO: 2435897 - RNA, 15 nt, Human
cagcuaaugggacac

SEQ ID NO: 2435898 - RNA, 21 nt, Human
cagcuacuuccuccuccccac

SEQ ID NO: 2435899 - RNA, 17 nt, Human
cagcuacuuccuccucc

SEQ ID NO: 2435900 - RNA, 19 nt, Human
cagcuacugauuuuuguga

SEQ ID NO: 2435901 - RNA, 15 nt, Human
cagcuacuuccuccu

SEQ ID NO: 2435902 - RNA, 19 nt, Human
cagcuacuugggaggcuga

SEQ ID NO: 2435903 - RNA, 16 nt, Human
cagcuacugauuuuug

SEQ ID NO: 2435904 - RNA, 22 nt, Human
cagcuacucagaagccugaggc

SEQ ID NO: 2435905 - RNA, 23 nt, Human
cagcuacucagaagccugaggcu

SEQ ID NO: 2435906 - RNA, 12 nt, Human
cagcuacucagg

SEQ ID NO: 2435907 - RNA, 13 nt, Human
cagcuacucagga

SEQ ID NO: 2435908 - RNA, 16 nt, Human
cagcuacucaggaggc

SEQ ID NO: 2435909 - RNA, 18 nt, Human
cagcuacucaggaggcug

SEQ ID NO: 2435910 - RNA, 19 nt, Human
cagcuacuaaugauguuuu

SEQ ID NO: 2435911 - RNA, 19 nt, Human
cagcuacucaagaggcuga

SEQ ID NO: 2435912 - RNA, 20 nt, Human
cagcuacucaagaggcugag

SEQ ID NO: 2435913 - RNA, 23 nt, Human
cagcuacucaagaggcugaggca

SEQ ID NO: 2435914 - RNA, 14 nt, Human
cagcuacucagaag

SEQ ID NO: 2435915 - RNA, 15 nt, Human
cagcuacucagaagc

SEQ ID NO: 2435916 - RNA, 16 nt, Human
cagcuacucagaagcc

SEQ ID NO: 2435917 - RNA, 19 nt, Human
cagcuacucagaagccuga

SEQ ID NO: 2435918 - RNA, 20 nt, Human
cagcuacucagaagccugag

SEQ ID NO: 2435919 - RNA, 21 nt, Human
cagcuacucagaagccugagg

SEQ ID NO: 2435920 - RNA, 21 nt, Human
cagcuaaucuguagggcugga

SEQ ID NO: 2435921 - RNA, 18 nt, Human
cagcuaccagguguucua

SEQ ID NO: 2435922 - RNA, 18 nt, Human
cagcuacaccuuucuccu

SEQ ID NO: 2435923 - RNA, 24 nt, Human
cagcuacccuuuuucuccagcugg

SEQ ID NO: 2435924 - RNA, 21 nt, Human
cagcuacccuuuuucuccagc

SEQ ID NO: 2435925 - RNA, 17 nt, Human
cagcuacuaaugauguu

SEQ ID NO: 2435926 - RNA, 21 nt, Human
cagcuaccucaaccaaugcca

SEQ ID NO: 2435927 - RNA, 14 nt, Human
cagccccauccucu

SEQ ID NO: 2435928 - RNA, 13 nt, Human
cagccccauccuc

SEQ ID NO: 2435929 - RNA, 12 nt, Human
cagccccauccu

SEQ ID NO: 2435930 - RNA, 22 nt, Human
cagccccaucccaaacccuuca

SEQ ID NO: 2435931 - RNA, 22 nt, Human
cagccccauccucuguacagag

SEQ ID NO: 2435932 - RNA, 16 nt, Human
cagccccauccucugu

SEQ ID NO: 2435933 - RNA, 14 nt, Human
cagccccauucugc

SEQ ID NO: 2435934 - RNA, 13 nt, Human
cagccccauucug

SEQ ID NO: 2435935 - RNA, 16 nt, Human
cagccccuucucagaa

SEQ ID NO: 2435936 - RNA, 15 nt, Human
cagccccuucucaga

SEQ ID NO: 2435937 - RNA, 20 nt, Human
cagccccuguauggcacugg

SEQ ID NO: 2435938 - RNA, 21 nt, Human
cagccccuguucuggcagagu

SEQ ID NO: 2435939 - RNA, 13 nt, Human
cagccccuggccc

SEQ ID NO: 2435940 - RNA, 21 nt, Human
cagccccuggccccaggaccu

SEQ ID NO: 2435941 - RNA, 22 nt, Human
cagccccuggaugcagccucac

SEQ ID NO: 2435942 - RNA, 20 nt, Human
cagccccuguucuggcagag

SEQ ID NO: 2435943 - RNA, 23 nt, Human
cagccccuggaugcagccucaca

SEQ ID NO: 2435944 - RNA, 18 nt, Human
cagccccauucugccugc

SEQ ID NO: 2435945 - RNA, 17 nt, Human
cagccccauucugccug

SEQ ID NO: 2435946 - RNA, 16 nt, Human
cagccccauucugccu

SEQ ID NO: 2435947 - RNA, 15 nt, Human
cagccccagagcagg

SEQ ID NO: 2435948 - RNA, 18 nt, Human
cagccccacagcccacgu

SEQ ID NO: 2435949 - RNA, 16 nt, Human
cagccccacagcccac

SEQ ID NO: 2435950 - RNA, 15 nt, Human
cagccccacagccca

SEQ ID NO: 2435951 - RNA, 14 nt, Human
cagccccacagccc

SEQ ID NO: 2435952 - RNA, 13 nt, Human
cagccccacagcc

SEQ ID NO: 2435953 - RNA, 12 nt, Human
cagccccacagc

SEQ ID NO: 2435954 - RNA, 11 nt, Human
cagccccaccc

SEQ ID NO: 2435955 - RNA, 12 nt, Human
cagccccaccca

SEQ ID NO: 2435956 - RNA, 13 nt, Human
cagccccacccag

SEQ ID NO: 2435957 - RNA, 14 nt, Human
cagccccacccagg

SEQ ID NO: 2435958 - RNA, 20 nt, Human
cagccccacagcccacgucc

SEQ ID NO: 2435959 - RNA, 15 nt, Human
cagccccacccagga

SEQ ID NO: 2435960 - RNA, 16 nt, Human
cagccccacccaggag

SEQ ID NO: 2435961 - RNA, 21 nt, Human
cagccccacccaggagggagg

SEQ ID NO: 2435962 - RNA, 22 nt, Human
cagccccacccaggagggaggg

SEQ ID NO: 2435963 - RNA, 21 nt, Human
cagccccaucccaaacccuuc

SEQ ID NO: 2435964 - RNA, 11 nt, Human
cagccccaucc

SEQ ID NO: 2435965 - RNA, 18 nt, Human
cagccccagugcccacag

SEQ ID NO: 2435966 - RNA, 17 nt, Human
cagccccagugcccaca

SEQ ID NO: 2435967 - RNA, 16 nt, Human
cagccccagugcccac

SEQ ID NO: 2435968 - RNA, 15 nt, Human
cagccccagugccca

SEQ ID NO: 2435969 - RNA, 14 nt, Human
cagccccagugccc

SEQ ID NO: 2435970 - RNA, 13 nt, Human
cagccccagugcc

SEQ ID NO: 2435971 - RNA, 16 nt, Human
cagcccuagagccugc

SEQ ID NO: 2435972 - RNA, 15 nt, Human
cagcccuagagccug

SEQ ID NO: 2435973 - RNA, 12 nt, Human
cagcccuagagc

SEQ ID NO: 2435974 - RNA, 22 nt, Human
cagcccuaaggaucucucagga

SEQ ID NO: 2435975 - RNA, 21 nt, Human
cagcccuaaggaucucucagg

SEQ ID NO: 2435976 - RNA, 20 nt, Human
cagcccuaaggaucucucag

SEQ ID NO: 2435977 - RNA, 19 nt, Human
cagcccuaaggaucucuca

SEQ ID NO: 2435978 - RNA, 18 nt, Human
cagcccuaaggaucucuc

SEQ ID NO: 2435979 - RNA, 22 nt, Human
cagcccuagagccugccuggag

SEQ ID NO: 2435980 - RNA, 21 nt, Human
cagcccuagagccugccugga

SEQ ID NO: 2435981 - RNA, 20 nt, Human
cagcccuagagccugccugg

SEQ ID NO: 2435982 - RNA, 18 nt, Human
cagcccuagagccugccu

SEQ ID NO: 2435983 - RNA, 23 nt, Human
cagcccuagagccugccuggagc

SEQ ID NO: 2435984 - RNA, 18 nt, Human
cagcccuaggguggagag

SEQ ID NO: 2435985 - RNA, 20 nt, Human
cagcccuauggauguggggu

SEQ ID NO: 2435986 - RNA, 15 nt, Human
cagcccuauggaugu

SEQ ID NO: 2435987 - RNA, 14 nt, Human
cagcccuauggaug

SEQ ID NO: 2435988 - RNA, 18 nt, Human
cagcccucaccccugguu

SEQ ID NO: 2435989 - RNA, 15 nt, Human
cagcccucaccccug

SEQ ID NO: 2435990 - RNA, 14 nt, Human
cagcccucaccccu

SEQ ID NO: 2435991 - RNA, 13 nt, Human
cagcccucacccc

SEQ ID NO: 2435992 - RNA, 18 nt, Human
cagcccucauuggcucuu

SEQ ID NO: 2435993 - RNA, 22 nt, Human
cagcccuccaucuaaacugccc

SEQ ID NO: 2435994 - RNA, 13 nt, Human
cagcccucauccc

SEQ ID NO: 2435995 - RNA, 14 nt, Human
cagcccucaucccg

SEQ ID NO: 2435996 - RNA, 17 nt, Human
cagcccucaucccgagc

SEQ ID NO: 2435997 - RNA, 20 nt, Human
cagcccuccccauggagcca

SEQ ID NO: 2435998 - RNA, 23 nt, Human
cagcccuccaucuaaacugcccc

SEQ ID NO: 2435999 - RNA, 15 nt, Human
cagcccucccugccc

SEQ ID NO: 2436000 - RNA, 13 nt, Human
cagcccucccugc

SEQ ID NO: 2436001 - RNA, 20 nt, Human
cagcccgggcucugccuccc

SEQ ID NO: 2436002 - RNA, 19 nt, Human
cagcccgggcucugccucc

SEQ ID NO: 2436003 - RNA, 18 nt, Human
cagcccgggcucugccuc

SEQ ID NO: 2436004 - RNA, 17 nt, Human
cagcccgggcucugccu

SEQ ID NO: 2436005 - RNA, 22 nt, Human
cagcccgggcucugccucccau

SEQ ID NO: 2436006 - RNA, 21 nt, Human
cagcccgggcucugccuccca

SEQ ID NO: 2436007 - RNA, 21 nt, Human
cagcccuaaaucuagacucaa

SEQ ID NO: 2436008 - RNA, 17 nt, Human
cagcccuaaggaucucu

SEQ ID NO: 2436009 - RNA, 17 nt, Human
cagcccguguggccccu

SEQ ID NO: 2436010 - RNA, 18 nt, Human
cagcccguguggccccuu

SEQ ID NO: 2436011 - RNA, 20 nt, Human
cagcccguguggccccuuca

SEQ ID NO: 2436012 - RNA, 21 nt, Human
cagcccguguggccccuucac

SEQ ID NO: 2436013 - RNA, 22 nt, Human
cagcccggcugguuuuguaaga

SEQ ID NO: 2436014 - RNA, 14 nt, Human
cagcccggcugguu

SEQ ID NO: 2436015 - RNA, 13 nt, Human
cagcccggcuggu

SEQ ID NO: 2436016 - RNA, 19 nt, Human
cagcccggcugguuuugua

SEQ ID NO: 2436017 - RNA, 15 nt, Human
cagcccguguggccc

SEQ ID NO: 2436018 - RNA, 21 nt, Human
cagccccuucugacccaugcu

SEQ ID NO: 2436019 - RNA, 19 nt, Human
cagccccuucugacccaug

SEQ ID NO: 2436020 - RNA, 17 nt, Human
cagccccuucugaccca

SEQ ID NO: 2436021 - RNA, 16 nt, Human
cagccccuucugaccc

SEQ ID NO: 2436022 - RNA, 23 nt, Human
cagccccuucugacccaugcugc

SEQ ID NO: 2436023 - RNA, 22 nt, Human
cagccccuucugacccaugcug

SEQ ID NO: 2436024 - RNA, 24 nt, Human
cagccccuucugacccaugcugcc

SEQ ID NO: 2436025 - RNA, 22 nt, Human
cagccccuucucagaaucuacc

SEQ ID NO: 2436026 - RNA, 20 nt, Human
cagccccuucucagaaucua

SEQ ID NO: 2436027 - RNA, 17 nt, Human
cagccccuugagaaacc

SEQ ID NO: 2436028 - RNA, 18 nt, Human
cagccccuugagaaaccu

SEQ ID NO: 2436029 - RNA, 16 nt, Human
cagcccgggcucugcc

SEQ ID NO: 2436030 - RNA, 15 nt, Human
cagcccgggcucugc

SEQ ID NO: 2436031 - RNA, 14 nt, Human
cagcccgggcucug

SEQ ID NO: 2436032 - RNA, 13 nt, Human
cagcccgggcucu

SEQ ID NO: 2436033 - RNA, 15 nt, Human
cagcccggcucccac

SEQ ID NO: 2436034 - RNA, 21 nt, Human
cagcccggcgccaccauccug

SEQ ID NO: 2436035 - RNA, 15 nt, Human
cagcccggcgccacc

SEQ ID NO: 2436036 - RNA, 23 nt, Human
cagcccggccugcucccagcagc

SEQ ID NO: 2436037 - RNA, 21 nt, Human
cagcccggccugcucccagca

SEQ ID NO: 2436038 - RNA, 20 nt, Human
cagcccggccugcucccagc

SEQ ID NO: 2436039 - RNA, 14 nt, Human
cagcccggccugcu

SEQ ID NO: 2436040 - RNA, 12 nt, Human
cagcccggccug

SEQ ID NO: 2436041 - RNA, 18 nt, Human
cagcccggaccuuggcag

SEQ ID NO: 2436042 - RNA, 15 nt, Human
cagcccggaccuugg

SEQ ID NO: 2436043 - RNA, 17 nt, Human
cagcccgcugaguggac

SEQ ID NO: 2436044 - RNA, 16 nt, Human
cagcccgcugagugga

SEQ ID NO: 2436045 - RNA, 16 nt, Human
cagccuaguugaucag

SEQ ID NO: 2436046 - RNA, 19 nt, Human
cagccuaggggucagggac

SEQ ID NO: 2436047 - RNA, 21 nt, Human
cagccuagggcugagcugggg

SEQ ID NO: 2436048 - RNA, 15 nt, Human
cagccuaccaugaga

SEQ ID NO: 2436049 - RNA, 18 nt, Human
cagccuaggggucaggga

SEQ ID NO: 2436050 - RNA, 18 nt, Human
cagccucaaccuccuggg

SEQ ID NO: 2436051 - RNA, 17 nt, Human
cagccucaaccuccugg

SEQ ID NO: 2436052 - RNA, 19 nt, Human
cagccucaauaagccuugu

SEQ ID NO: 2436053 - RNA, 18 nt, Human
cagccucaauaagccuug

SEQ ID NO: 2436054 - RNA, 21 nt, Human
cagccucaagucacucccaag

SEQ ID NO: 2436055 - RNA, 19 nt, Human
cagccucaagucacuccca

SEQ ID NO: 2436056 - RNA, 21 nt, Human
cagccucaaccuccugggcua

SEQ ID NO: 2436057 - RNA, 20 nt, Human
cagccucaaccuccugggcu

SEQ ID NO: 2436058 - RNA, 19 nt, Human
cagccucaaccuccugggc

SEQ ID NO: 2436059 - RNA, 16 nt, Human
cagccucaguccuccc

SEQ ID NO: 2436060 - RNA, 15 nt, Human
cagccucaguccucc

SEQ ID NO: 2436061 - RNA, 22 nt, Human
cagccucagggacgacucugac

SEQ ID NO: 2436062 - RNA, 20 nt, Human
cagccuccaagcuccaucuc

SEQ ID NO: 2436063 - RNA, 12 nt, Human
cagccuccagcc

SEQ ID NO: 2436064 - RNA, 23 nt, Human
cagccucaguccuccccucacag

SEQ ID NO: 2436065 - RNA, 22 nt, Human
cagccucaguccuccccucaca

SEQ ID NO: 2436066 - RNA, 21 nt, Human
cagccucaguccuccccucac

SEQ ID NO: 2436067 - RNA, 19 nt, Human
cagccucaguccuccccuc

SEQ ID NO: 2436068 - RNA, 14 nt, Human
cagccuccaagcuc

SEQ ID NO: 2436069 - RNA, 15 nt, Human
cagccucacaguccu

SEQ ID NO: 2436070 - RNA, 14 nt, Human
cagccucacagucc

SEQ ID NO: 2436071 - RNA, 20 nt, Human
cagccucacaguccuuacca

SEQ ID NO: 2436072 - RNA, 21 nt, Human
cagccucaauaagccuugucg

SEQ ID NO: 2436073 - RNA, 20 nt, Human
cagccucaauaagccuuguc

SEQ ID NO: 2436074 - RNA, 12 nt, Human
cagccucacaga

SEQ ID NO: 2436075 - RNA, 13 nt, Human
cagccucacagaa

SEQ ID NO: 2436076 - RNA, 14 nt, Human
cagccucacagaag

SEQ ID NO: 2436077 - RNA, 22 nt, Human
cagccucccgaauagcugggac

SEQ ID NO: 2436078 - RNA, 21 nt, Human
cagccucccgaauagcuggga

SEQ ID NO: 2436079 - RNA, 18 nt, Human
cagccuccccugccaggg

SEQ ID NO: 2436080 - RNA, 19 nt, Human
cagccuccccugccagggc

SEQ ID NO: 2436081 - RNA, 20 nt, Human
cagccuccccugccagggca

SEQ ID NO: 2436082 - RNA, 22 nt, Human
cagccuccccugccagggcagg

SEQ ID NO: 2436083 - RNA, 20 nt, Human
cagccucccgaauagcuggg

SEQ ID NO: 2436084 - RNA, 19 nt, Human
cagccucccaaguagcugg

SEQ ID NO: 2436085 - RNA, 14 nt, Human
cagccucccacccc

SEQ ID NO: 2436086 - RNA, 14 nt, Human
cagccucccaucca

SEQ ID NO: 2436087 - RNA, 19 nt, Human
cagccucccacccccaucu

SEQ ID NO: 2436088 - RNA, 16 nt, Human
cagccucccaccccca

SEQ ID NO: 2436089 - RNA, 18 nt, Human
cagccucccacccccauc

SEQ ID NO: 2436090 - RNA, 16 nt, Human
cagccucccauccagg

SEQ ID NO: 2436091 - RNA, 18 nt, Human
cagccucccauccagggc

SEQ ID NO: 2436092 - RNA, 19 nt, Human
cagccucccauccagggcc

SEQ ID NO: 2436093 - RNA, 20 nt, Human
cagccucccauccagggccc

SEQ ID NO: 2436094 - RNA, 16 nt, Human
cagccuccccugccag

SEQ ID NO: 2436095 - RNA, 17 nt, Human
cagccuccccugccagg

SEQ ID NO: 2436096 - RNA, 23 nt, Human
cagccucccauccagggccccca

SEQ ID NO: 2436097 - RNA, 16 nt, Human
cagccuccagccucug

SEQ ID NO: 2436098 - RNA, 15 nt, Human
cagccuccagccucu

SEQ ID NO: 2436099 - RNA, 14 nt, Human
cagccuccagccuc

SEQ ID NO: 2436100 - RNA, 13 nt, Human
cagccuccagccu

SEQ ID NO: 2436101 - RNA, 14 nt, Human
cagccuccaugcug

SEQ ID NO: 2436102 - RNA, 17 nt, Human
cagccuccagccucugu

SEQ ID NO: 2436103 - RNA, 20 nt, Human
cagccuccaugcugccucca

SEQ ID NO: 2436104 - RNA, 17 nt, Human
cagccuccaugcugccu

SEQ ID NO: 2436105 - RNA, 15 nt, Human
cagccuccaugcugc

SEQ ID NO: 2436106 - RNA, 23 nt, Human
cagccucccaaagugcugggauu

SEQ ID NO: 2436107 - RNA, 21 nt, Human
cagccucccaaagugcuggga

SEQ ID NO: 2436108 - RNA, 20 nt, Human
cagccucccaaagugcuggg

SEQ ID NO: 2436109 - RNA, 19 nt, Human
cagccucccaaagugcugg

SEQ ID NO: 2436110 - RNA, 12 nt, Human
cagcccuggagg

SEQ ID NO: 2436111 - RNA, 21 nt, Human
cagcccugcuggccgccucac

SEQ ID NO: 2436112 - RNA, 23 nt, Human
cagcccugcuggccgccucaccc

SEQ ID NO: 2436113 - RNA, 23 nt, Human
cagcccugcuuugggcugcccug

SEQ ID NO: 2436114 - RNA, 22 nt, Human
cagcccugcuuugggcugcccu

SEQ ID NO: 2436115 - RNA, 21 nt, Human
cagcccugcuuugggcugccc

SEQ ID NO: 2436116 - RNA, 20 nt, Human
cagcccugcuuugggcugcc

SEQ ID NO: 2436117 - RNA, 19 nt, Human
cagcccugcuuugggcugc

SEQ ID NO: 2436118 - RNA, 13 nt, Human
cagcccugcuuug

SEQ ID NO: 2436119 - RNA, 11 nt, Human
cagcccugcuu

SEQ ID NO: 2436120 - RNA, 15 nt, Human
cagccgguaccuggg

SEQ ID NO: 2436121 - RNA, 23 nt, Human
cagcccugggccccaccaccuag

SEQ ID NO: 2436122 - RNA, 12 nt, Human
cagcccugggcc

SEQ ID NO: 2436123 - RNA, 13 nt, Human
cagcccugggccc

SEQ ID NO: 2436124 - RNA, 17 nt, Human
cagcccugggccccacc

SEQ ID NO: 2436125 - RNA, 18 nt, Human
cagcccugggccccacca

SEQ ID NO: 2436126 - RNA, 19 nt, Human
cagcccugggccccaccac

SEQ ID NO: 2436127 - RNA, 20 nt, Human
cagcccugggccccaccacc

SEQ ID NO: 2436128 - RNA, 21 nt, Human
cagcccugggccccaccaccu

SEQ ID NO: 2436129 - RNA, 22 nt, Human
cagcccugggccccaccaccua

SEQ ID NO: 2436130 - RNA, 12 nt, Human
cagcccuggcuc

SEQ ID NO: 2436131 - RNA, 14 nt, Human
cagcccuggaguca

SEQ ID NO: 2436132 - RNA, 20 nt, Human
cagcccuggagucaugccaa

SEQ ID NO: 2436133 - RNA, 22 nt, Human
cagcccuggaggugccagcaaa

SEQ ID NO: 2436134 - RNA, 19 nt, Human
cagcccuggaggugccagc

SEQ ID NO: 2436135 - RNA, 18 nt, Human
cagcccuggaggugccag

SEQ ID NO: 2436136 - RNA, 17 nt, Human
cagcccuggaggugcca

SEQ ID NO: 2436137 - RNA, 15 nt, Human
cagcccuggcugaag

SEQ ID NO: 2436138 - RNA, 13 nt, Human
cagcccuggcuga

SEQ ID NO: 2436139 - RNA, 16 nt, Human
cagcccuggcucugca

SEQ ID NO: 2436140 - RNA, 15 nt, Human
cagcccuggcucugc

SEQ ID NO: 2436141 - RNA, 17 nt, Human
cagcccuggcugaagga

SEQ ID NO: 2436142 - RNA, 16 nt, Human
cagcccuggcugaagg

SEQ ID NO: 2436143 - RNA, 20 nt, Human
cagcccuggcugaaggacug

SEQ ID NO: 2436144 - RNA, 11 nt, Human
cagcccugggc

SEQ ID NO: 2436145 - RNA, 19 nt, Human
cagccgugaugcucaggcu

SEQ ID NO: 2436146 - RNA, 17 nt, Human
cagccgugaugcucagg

SEQ ID NO: 2436147 - RNA, 20 nt, Human
cagccgugccuucagcucua

SEQ ID NO: 2436148 - RNA, 18 nt, Human
cagccgugccuucagcuc

SEQ ID NO: 2436149 - RNA, 16 nt, Human
cagccgugccuucagc

SEQ ID NO: 2436150 - RNA, 14 nt, Human
cagccgugccuuca

SEQ ID NO: 2436151 - RNA, 9 nt, Human
cagccgugc

SEQ ID NO: 2436152 - RNA, 19 nt, Human
cagccgguaccugggaagg

SEQ ID NO: 2436153 - RNA, 17 nt, Human
cagccgguaccugggaa

SEQ ID NO: 2436154 - RNA, 18 nt, Human
cagccgucagccaaaugu

SEQ ID NO: 2436155 - RNA, 16 nt, Human
cagccgugaugcucag

SEQ ID NO: 2436156 - RNA, 21 nt, Human
cagccgguaccugggaagggg

SEQ ID NO: 2436157 - RNA, 19 nt, Human
cagccgucagccaaaugua

SEQ ID NO: 2436158 - RNA, 16 nt, Human
cagccuaagaugaaga

SEQ ID NO: 2436159 - RNA, 21 nt, Human
cagccguguaaccauggaccc

SEQ ID NO: 2436160 - RNA, 15 nt, Human
cagccuagccgaccu

SEQ ID NO: 2436161 - RNA, 17 nt, Human
cagccuagccgaccuca

SEQ ID NO: 2436162 - RNA, 18 nt, Human
cagccuagccgaccucag

SEQ ID NO: 2436163 - RNA, 19 nt, Human
cagccuagccgaccucagc

SEQ ID NO: 2436164 - RNA, 20 nt, Human
cagccuagccgaccucagcc

SEQ ID NO: 2436165 - RNA, 21 nt, Human
cagccuagccgaccucagccu

SEQ ID NO: 2436166 - RNA, 22 nt, Human
cagccuagccgaccucagccuu

SEQ ID NO: 2436167 - RNA, 16 nt, Human
cagcccugcagagggc

SEQ ID NO: 2436168 - RNA, 15 nt, Human
cagcccugcagaggg

SEQ ID NO: 2436169 - RNA, 14 nt, Human
cagcccugcagagg

SEQ ID NO: 2436170 - RNA, 13 nt, Human
cagcccugcagag

SEQ ID NO: 2436171 - RNA, 20 nt, Human
cagcccugcuggccgccuca

SEQ ID NO: 2436172 - RNA, 18 nt, Human
cagcccugcuggccgccu

SEQ ID NO: 2436173 - RNA, 16 nt, Human
cagcccugcuggccgc

SEQ ID NO: 2436174 - RNA, 14 nt, Human
cagcccugcuggcc

SEQ ID NO: 2436175 - RNA, 13 nt, Human
cagcccugcuggc

SEQ ID NO: 2436176 - RNA, 20 nt, Human
cagcccugcagagggcacag

SEQ ID NO: 2436177 - RNA, 18 nt, Human
cagcccugcagagggcac

SEQ ID NO: 2436178 - RNA, 22 nt, Human
cagcccucccugccccucccuu

SEQ ID NO: 2436179 - RNA, 18 nt, Human
cagcccucccugccccuc

SEQ ID NO: 2436180 - RNA, 17 nt, Human
cagcccucccugccccu

SEQ ID NO: 2436181 - RNA, 16 nt, Human
cagcccucccugcccc

SEQ ID NO: 2436182 - RNA, 21 nt, Human
cagcccuccccauggagccag

SEQ ID NO: 2436183 - RNA, 20 nt, Human
cagcccucccgccccuuccc

SEQ ID NO: 2436184 - RNA, 13 nt, Human
cagcccucccugu

SEQ ID NO: 2436185 - RNA, 14 nt, Human
cagcccucccuguc

SEQ ID NO: 2436186 - RNA, 15 nt, Human
cagcccucccugucc

SEQ ID NO: 2436187 - RNA, 16 nt, Human
cagcccucccuguccu

SEQ ID NO: 2436188 - RNA, 18 nt, Human
cagcccucccuguccucc

SEQ ID NO: 2436189 - RNA, 19 nt, Human
cagcccucccuguccuccu

SEQ ID NO: 2436190 - RNA, 20 nt, Human
cagcccucccuguccuccuc

SEQ ID NO: 2436191 - RNA, 21 nt, Human
cagcccucccuguccuccucg

SEQ ID NO: 2436192 - RNA, 22 nt, Human
cagcccucccuguccuccucgg

SEQ ID NO: 2436193 - RNA, 12 nt, Human
cagcccuccuca

SEQ ID NO: 2436194 - RNA, 13 nt, Human
cagcccuccucac

SEQ ID NO: 2436195 - RNA, 14 nt, Human
cagcccuccucacc

SEQ ID NO: 2436196 - RNA, 16 nt, Human
cagcccuccucacccc

SEQ ID NO: 2436197 - RNA, 18 nt, Human
cagcccugaguuccuagc

SEQ ID NO: 2436198 - RNA, 19 nt, Human
cagcccugaguuccuagcc

SEQ ID NO: 2436199 - RNA, 21 nt, Human
cagcccugaguuccuagccac

SEQ ID NO: 2436200 - RNA, 22 nt, Human
cagcccuccucaccccgucugg

SEQ ID NO: 2436201 - RNA, 12 nt, Human
cagcccugaggu

SEQ ID NO: 2436202 - RNA, 22 nt, Human
cagcccugaggugaaagggagc

SEQ ID NO: 2436203 - RNA, 16 nt, Human
cagcccugacccugug

SEQ ID NO: 2436204 - RNA, 13 nt, Human
cagcccugacccu

SEQ ID NO: 2436205 - RNA, 22 nt, Human
caggaagcucagggccuggcuc

SEQ ID NO: 2436206 - RNA, 20 nt, Human
cagcuggggccaggcugggu

SEQ ID NO: 2436207 - RNA, 19 nt, Human
cagcuggggccaggcuggg

SEQ ID NO: 2436208 - RNA, 14 nt, Human
cagcugggcugugg

SEQ ID NO: 2436209 - RNA, 12 nt, Human
cagcugggcugu

SEQ ID NO: 2436210 - RNA, 18 nt, Human
cagcugggcucugccacc

SEQ ID NO: 2436211 - RNA, 16 nt, Human
cagcugggcucugcca

SEQ ID NO: 2436212 - RNA, 15 nt, Human
cagcugggcucugcc

SEQ ID NO: 2436213 - RNA, 14 nt, Human
cagcugggcucugc

SEQ ID NO: 2436214 - RNA, 17 nt, Human
cagcugggcucugcaau

SEQ ID NO: 2436215 - RNA, 18 nt, Human
cagcuggggccaggcugg

SEQ ID NO: 2436216 - RNA, 11 nt, Human
cagcugggcuc

SEQ ID NO: 2436217 - RNA, 17 nt, Human
cagcugggcccaacccu

SEQ ID NO: 2436218 - RNA, 21 nt, Human
cagcugggcccaacccugucu

SEQ ID NO: 2436219 - RNA, 16 nt, Human
cagcugggcucugcaa

SEQ ID NO: 2436220 - RNA, 15 nt, Human
cagcugggcucugca

SEQ ID NO: 2436221 - RNA, 23 nt, Human
cagcugggaucacauguggacuu

SEQ ID NO: 2436222 - RNA, 15 nt, Human
cagcugggcccaacc

SEQ ID NO: 2436223 - RNA, 23 nt, Human
cagcugggaggcaagaggggugg

SEQ ID NO: 2436224 - RNA, 14 nt, Human
cagcugggcccaac

SEQ ID NO: 2436225 - RNA, 19 nt, Human
cagcuggcccgugacagac

SEQ ID NO: 2436226 - RNA, 17 nt, Human
cagcuggccgucacuug

SEQ ID NO: 2436227 - RNA, 22 nt, Human
cagcugggaggcaagaggggug

SEQ ID NO: 2436228 - RNA, 14 nt, Human
cagcugggaggcaa

SEQ ID NO: 2436229 - RNA, 13 nt, Human
cagcugggaggca

SEQ ID NO: 2436230 - RNA, 12 nt, Human
cagcugggaggc

SEQ ID NO: 2436231 - RNA, 22 nt, Human
cagcugcuuuugucuaugggac

SEQ ID NO: 2436232 - RNA, 23 nt, Human
cagcugcuggagacuccuaggca

SEQ ID NO: 2436233 - RNA, 19 nt, Human
cagcugcuggagacuccua

SEQ ID NO: 2436234 - RNA, 18 nt, Human
cagcugcuggagacuccu

SEQ ID NO: 2436235 - RNA, 15 nt, Human
cagcugcuugugucc

SEQ ID NO: 2436236 - RNA, 14 nt, Human
cagcugcuuguguc

SEQ ID NO: 2436237 - RNA, 15 nt, Human
cagcugcuucuccca

SEQ ID NO: 2436238 - RNA, 12 nt, Human
cagcugcuucuc

SEQ ID NO: 2436239 - RNA, 22 nt, Human
cagcuggaaaagggucuuggga

SEQ ID NO: 2436240 - RNA, 23 nt, Human
cagcugcuugugucccuccuggg

SEQ ID NO: 2436241 - RNA, 22 nt, Human
cagcugcuugugucccuccugg

SEQ ID NO: 2436242 - RNA, 16 nt, Human
cagcugcuuguguccc

SEQ ID NO: 2436243 - RNA, 23 nt, Human
cagcugcuuuugucuaugggacu

SEQ ID NO: 2436244 - RNA, 19 nt, Human
cagcuggccgggagccuga

SEQ ID NO: 2436245 - RNA, 18 nt, Human
cagcuggcccgugacaga

SEQ ID NO: 2436246 - RNA, 17 nt, Human
cagcuggcccgugacag

SEQ ID NO: 2436247 - RNA, 15 nt, Human
cagcuggcagcagag

SEQ ID NO: 2436248 - RNA, 18 nt, Human
cagcuggcagcagagugu

SEQ ID NO: 2436249 - RNA, 23 nt, Human
cagcuggaugagaauuugagugc

SEQ ID NO: 2436250 - RNA, 18 nt, Human
cagcuggaugauggucuu

SEQ ID NO: 2436251 - RNA, 15 nt, Human
cagcuggauuggguu

SEQ ID NO: 2436252 - RNA, 21 nt, Human
cagcuggaugagacuuccaaa

SEQ ID NO: 2436253 - RNA, 19 nt, Human
cagcuggauuggguuauga

SEQ ID NO: 2436254 - RNA, 14 nt, Human
cagcuggcagcaga

SEQ ID NO: 2436255 - RNA, 16 nt, Human
cagcuggagaagaccc

SEQ ID NO: 2436256 - RNA, 18 nt, Human
cagcuggagaaauauggu

SEQ ID NO: 2436257 - RNA, 14 nt, Human
cagcugggucaggc

SEQ ID NO: 2436258 - RNA, 15 nt, Human
cagcugggucaggca

SEQ ID NO: 2436259 - RNA, 16 nt, Human
cagcugggucaggcag

SEQ ID NO: 2436260 - RNA, 18 nt, Human
cagcuggguggcacugcc

SEQ ID NO: 2436261 - RNA, 17 nt, Human
cagcuggguggcacugc

SEQ ID NO: 2436262 - RNA, 16 nt, Human
cagcuggguggcacug

SEQ ID NO: 2436263 - RNA, 18 nt, Human
cagcugggucaggcaggg

SEQ ID NO: 2436264 - RNA, 20 nt, Human
cagcugggucaggcagggug

SEQ ID NO: 2436265 - RNA, 23 nt, Human
cagcugggguggggaccucaggc

SEQ ID NO: 2436266 - RNA, 22 nt, Human
cagcugggguggggaccucagg

SEQ ID NO: 2436267 - RNA, 21 nt, Human
cagcuggggcguggggagggc

SEQ ID NO: 2436268 - RNA, 20 nt, Human
cagcuggggcguggggaggg

SEQ ID NO: 2436269 - RNA, 19 nt, Human
cagcuggggcguggggagg

SEQ ID NO: 2436270 - RNA, 18 nt, Human
cagcuggggcguggggag

SEQ ID NO: 2436271 - RNA, 21 nt, Human
cagcugggguggggaccucag

SEQ ID NO: 2436272 - RNA, 22 nt, Human
cagcuggggccaggcugggucg

SEQ ID NO: 2436273 - RNA, 21 nt, Human
cagcuggggccaggcuggguc

SEQ ID NO: 2436274 - RNA, 17 nt, Human
cagcuggguuggaaaac

SEQ ID NO: 2436275 - RNA, 22 nt, Human
cagcuggguggcacugccaugc

SEQ ID NO: 2436276 - RNA, 21 nt, Human
cagcuggguggcacugccaug

SEQ ID NO: 2436277 - RNA, 20 nt, Human
cagcuggguggcacugccau

SEQ ID NO: 2436278 - RNA, 19 nt, Human
cagcuggguggcacugcca

SEQ ID NO: 2436279 - RNA, 16 nt, Human
cagcuggguuggaaaa

SEQ ID NO: 2436280 - RNA, 18 nt, Human
cagcuguaugauucccag

SEQ ID NO: 2436281 - RNA, 20 nt, Human
cagcuguaacacagcugaga

SEQ ID NO: 2436282 - RNA, 18 nt, Human
cagcuguaacacagcuga

SEQ ID NO: 2436283 - RNA, 19 nt, Human
cagcuguaagaagagacug

SEQ ID NO: 2436284 - RNA, 20 nt, Human
cagcuguaagaagagacugg

SEQ ID NO: 2436285 - RNA, 18 nt, Human
cagcugguugagguuuca

SEQ ID NO: 2436286 - RNA, 20 nt, Human
cagcuggugggaagcgucug

SEQ ID NO: 2436287 - RNA, 22 nt, Human
cagcuggugggaagcgucuguc

SEQ ID NO: 2436288 - RNA, 19 nt, Human
cagcuggugguaucugagu

SEQ ID NO: 2436289 - RNA, 22 nt, Human
cagcugcuugggcuucauccuc

SEQ ID NO: 2436290 - RNA, 21 nt, Human
cagcugcuugggcuucauccu

SEQ ID NO: 2436291 - RNA, 19 nt, Human
cagcugcuugggcuucauc

SEQ ID NO: 2436292 - RNA, 18 nt, Human
cagcugcuugggcuucau

SEQ ID NO: 2436293 - RNA, 16 nt, Human
cagcugcuugggcuuc

SEQ ID NO: 2436294 - RNA, 15 nt, Human
cagcugcuugggcuu

SEQ ID NO: 2436295 - RNA, 14 nt, Human
cagcugcuugggcu

SEQ ID NO: 2436296 - RNA, 13 nt, Human
cagcugcuugggc

SEQ ID NO: 2436297 - RNA, 20 nt, Human
cagcugcugaaacaacaaau

SEQ ID NO: 2436298 - RNA, 21 nt, Human
cagcugcugaaacaacaaaua

SEQ ID NO: 2436299 - RNA, 15 nt, Human
cagcugcuggagacu

SEQ ID NO: 2436300 - RNA, 14 nt, Human
cagcugcuggagac

SEQ ID NO: 2436301 - RNA, 21 nt, Human
cagcugcucaauaaaguacaa

SEQ ID NO: 2436302 - RNA, 17 nt, Human
cagcugcgcuugcuuuu

SEQ ID NO: 2436303 - RNA, 17 nt, Human
cagcugcuacuacuccu

SEQ ID NO: 2436304 - RNA, 19 nt, Human
cagcugcgcuugcuuuucu

SEQ ID NO: 2436305 - RNA, 13 nt, Human
cagcugcuccccu

SEQ ID NO: 2436306 - RNA, 15 nt, Human
cagcugcuccccucc

SEQ ID NO: 2436307 - RNA, 16 nt, Human
cagcugcuccccuccc

SEQ ID NO: 2436308 - RNA, 17 nt, Human
cagcugcuccccucccu

SEQ ID NO: 2436309 - RNA, 18 nt, Human
cagcugcuccccucccuc

SEQ ID NO: 2436310 - RNA, 12 nt, Human
cagcugcuccua

SEQ ID NO: 2436311 - RNA, 18 nt, Human
cagcugcuccuagaggga

SEQ ID NO: 2436312 - RNA, 19 nt, Human
cagcugcuccuagagggag

SEQ ID NO: 2436313 - RNA, 23 nt, Human
cagcugcuccuagagggaggggc

SEQ ID NO: 2436314 - RNA, 20 nt, Human
cagcugcuccccucccuccu

SEQ ID NO: 2436315 - RNA, 21 nt, Human
cagcugcuccccucccuccuc

SEQ ID NO: 2436316 - RNA, 24 nt, Human
cagcugcgguccacccaggagccc

SEQ ID NO: 2436317 - RNA, 23 nt, Human
cagcugcgguccacccaggagcc

SEQ ID NO: 2436318 - RNA, 22 nt, Human
cagcugcgguccacccaggagc

SEQ ID NO: 2436319 - RNA, 21 nt, Human
cagcugcgguccacccaggag

SEQ ID NO: 2436320 - RNA, 20 nt, Human
cagcugcgguccacccagga

SEQ ID NO: 2436321 - RNA, 19 nt, Human
cagcugcgguccacccagg

SEQ ID NO: 2436322 - RNA, 15 nt, Human
cagcugccugggauc

SEQ ID NO: 2436323 - RNA, 18 nt, Human
cagcugcgguccacccag

SEQ ID NO: 2436324 - RNA, 23 nt, Human
cagcugccugggaucccucaucc

SEQ ID NO: 2436325 - RNA, 18 nt, Human
cagcugccugggaucccu

SEQ ID NO: 2436326 - RNA, 13 nt, Human
cagcugaccucug

SEQ ID NO: 2436327 - RNA, 17 nt, Human
cagcugaccauggaaga

SEQ ID NO: 2436328 - RNA, 21 nt, Human
cagcugacaguccucuccacc

SEQ ID NO: 2436329 - RNA, 18 nt, Human
cagcugacaguccucucc

SEQ ID NO: 2436330 - RNA, 16 nt, Human
cagcugacaguccucu

SEQ ID NO: 2436331 - RNA, 15 nt, Human
cagcugacaguccuc

SEQ ID NO: 2436332 - RNA, 14 nt, Human
cagcugacaguccu

SEQ ID NO: 2436333 - RNA, 18 nt, Human
cagcugaccucuguuguc

SEQ ID NO: 2436334 - RNA, 17 nt, Human
cagcugaccucuguugu

SEQ ID NO: 2436335 - RNA, 16 nt, Human
cagcugaccuuuguca

SEQ ID NO: 2436336 - RNA, 15 nt, Human
cagcugaacagccaa

SEQ ID NO: 2436337 - RNA, 16 nt, Human
cagcugaauuaucuau

SEQ ID NO: 2436338 - RNA, 22 nt, Human
cagcucuuuccuccuuccaugg

SEQ ID NO: 2436339 - RNA, 15 nt, Human
cagcugaaauacuga

SEQ ID NO: 2436340 - RNA, 19 nt, Human
cagcugaaauaugcuggcu

SEQ ID NO: 2436341 - RNA, 22 nt, Human
cagcugaaauaugcuggcugga

SEQ ID NO: 2436342 - RNA, 21 nt, Human
cagcugaaauaugcuggcugg

SEQ ID NO: 2436343 - RNA, 14 nt, Human
cagcucuuuccucc

SEQ ID NO: 2436344 - RNA, 16 nt, Human
cagcucuuuccuccuu

SEQ ID NO: 2436345 - RNA, 17 nt, Human
cagcucuuuccuccuuc

SEQ ID NO: 2436346 - RNA, 18 nt, Human
cagcucuuuccuccuucc

SEQ ID NO: 2436347 - RNA, 19 nt, Human
cagcucuuuccuccuucca

SEQ ID NO: 2436348 - RNA, 21 nt, Human
cagcucuuuccuccuuccaug

SEQ ID NO: 2436349 - RNA, 22 nt, Human
cagcucuuugaaauagucugug

SEQ ID NO: 2436350 - RNA, 16 nt, Human
cagcucuuggcuccac

SEQ ID NO: 2436351 - RNA, 17 nt, Human
cagcucuuggcuccacu

SEQ ID NO: 2436352 - RNA, 24 nt, Human
cagcucuugcuaaucagugucuca

SEQ ID NO: 2436353 - RNA, 13 nt, Human
cagcucuuuccuc

SEQ ID NO: 2436354 - RNA, 18 nt, Human
cagcucuuggcuccacug

SEQ ID NO: 2436355 - RNA, 18 nt, Human
cagcucuucuccccaggu

SEQ ID NO: 2436356 - RNA, 23 nt, Human
cagcucuucuccaggcuguaucc

SEQ ID NO: 2436357 - RNA, 23 nt, Human
cagcucuugcuaaucagugucuc

SEQ ID NO: 2436358 - RNA, 22 nt, Human
cagcucuugcuaaucagugucu

SEQ ID NO: 2436359 - RNA, 21 nt, Human
cagcucuugcuaaucaguguc

SEQ ID NO: 2436360 - RNA, 20 nt, Human
cagcucuugcuaaucagugu

SEQ ID NO: 2436361 - RNA, 14 nt, Human
cagcucuugcuaau

SEQ ID NO: 2436362 - RNA, 23 nt, Human
cagcucuugcccuucccuguccc

SEQ ID NO: 2436363 - RNA, 21 nt, Human
cagcucuugcccuucccuguc

SEQ ID NO: 2436364 - RNA, 20 nt, Human
cagcucuugcccuucccugu

SEQ ID NO: 2436365 - RNA, 19 nt, Human
cagcucuugcccuucccug

SEQ ID NO: 2436366 - RNA, 18 nt, Human
cagcucuugcccuucccu

SEQ ID NO: 2436367 - RNA, 17 nt, Human
cagcucuugcccuuccc

SEQ ID NO: 2436368 - RNA, 16 nt, Human
cagcucuugcccuucc

SEQ ID NO: 2436369 - RNA, 13 nt, Human
cagcucuucugcc

SEQ ID NO: 2436370 - RNA, 22 nt, Human
cagcucuucugccggcccuggg

SEQ ID NO: 2436371 - RNA, 15 nt, Human
cagcucuugcccuuc

SEQ ID NO: 2436372 - RNA, 23 nt, Human
cagcucuucugccggcccugggg

SEQ ID NO: 2436373 - RNA, 19 nt, Human
cagcucuucuccaggcugu

SEQ ID NO: 2436374 - RNA, 18 nt, Human
cagcucuucuccaggcug

SEQ ID NO: 2436375 - RNA, 17 nt, Human
cagcucuucuccaggcu

SEQ ID NO: 2436376 - RNA, 16 nt, Human
cagcucuucuccaggc

SEQ ID NO: 2436377 - RNA, 15 nt, Human
cagcucuucuccagg

SEQ ID NO: 2436378 - RNA, 14 nt, Human
cagcucuucuccag

SEQ ID NO: 2436379 - RNA, 15 nt, Human
cagcucugggagagg

SEQ ID NO: 2436380 - RNA, 13 nt, Human
cagcucuucucca

SEQ ID NO: 2436381 - RNA, 21 nt, Human
cagcucuuauauugccauuuc

SEQ ID NO: 2436382 - RNA, 10 nt, Human
cagcucuuau

SEQ ID NO: 2436383 - RNA, 23 nt, Human
cagcucuguccugggagugagcu

SEQ ID NO: 2436384 - RNA, 22 nt, Human
cagcucugggccauucuccaca

SEQ ID NO: 2436385 - RNA, 23 nt, Human
cagcucugggccauucuccacag

SEQ ID NO: 2436386 - RNA, 17 nt, Human
cagcucuguguugccau

SEQ ID NO: 2436387 - RNA, 21 nt, Human
cagcucuguguugccaugugu

SEQ ID NO: 2436388 - RNA, 18 nt, Human
cagcucuguccugggagu

SEQ ID NO: 2436389 - RNA, 17 nt, Human
cagcucuguccugggag

SEQ ID NO: 2436390 - RNA, 16 nt, Human
cagcucuguccuggga

SEQ ID NO: 2436391 - RNA, 14 nt, Human
cagcucuguccugg

SEQ ID NO: 2436392 - RNA, 23 nt, Human
cagcucugguccauagagagcaa

SEQ ID NO: 2436393 - RNA, 22 nt, Human
cagcucugguccauagagagca

SEQ ID NO: 2436394 - RNA, 13 nt, Human
cagcucuguccug

SEQ ID NO: 2436395 - RNA, 12 nt, Human
cagcucuguccu

SEQ ID NO: 2436396 - RNA, 21 nt, Human
cagcucugguccauagagagc

SEQ ID NO: 2436397 - RNA, 18 nt, Human
cagcucugguccauagag

SEQ ID NO: 2436398 - RNA, 17 nt, Human
cagcucugguccauaga

SEQ ID NO: 2436399 - RNA, 16 nt, Human
cagcucugguccauag

SEQ ID NO: 2436400 - RNA, 13 nt, Human
cagcucuggucca

SEQ ID NO: 2436401 - RNA, 10 nt, Human
cagcucuggu

SEQ ID NO: 2436402 - RNA, 14 nt, Human
cagcucuggagggg

SEQ ID NO: 2436403 - RNA, 18 nt, Human
cagcucuggaggggaggg

SEQ ID NO: 2436404 - RNA, 16 nt, Human
cagcucuggagggggu

SEQ ID NO: 2436405 - RNA, 12 nt, Human
cagcucuggcuu

SEQ ID NO: 2436406 - RNA, 12 nt, Human
cagcucugggcc

SEQ ID NO: 2436407 - RNA, 19 nt, Human
cagcucugggccauucucc

SEQ ID NO: 2436408 - RNA, 14 nt, Human
cagcucugggagag

SEQ ID NO: 2436409 - RNA, 14 nt, Human
cagcucuggcuucc

SEQ ID NO: 2436410 - RNA, 15 nt, Human
cagcucugcaagaau

SEQ ID NO: 2436411 - RNA, 16 nt, Human
cagcucugcaagaauu

SEQ ID NO: 2436412 - RNA, 18 nt, Human
cagcucugaaaccagugu

SEQ ID NO: 2436413 - RNA, 19 nt, Human
cagcucugaaaccaguguu

SEQ ID NO: 2436414 - RNA, 19 nt, Human
cagcucucccucuggcccu

SEQ ID NO: 2436415 - RNA, 20 nt, Human
cagcucucccucuggcccug

SEQ ID NO: 2436416 - RNA, 21 nt, Human
cagcucucccucuggcccugc

SEQ ID NO: 2436417 - RNA, 23 nt, Human
cagcucucccucuggcccugccu

SEQ ID NO: 2436418 - RNA, 20 nt, Human
cagcucugcauacucauuag

SEQ ID NO: 2436419 - RNA, 21 nt, Human
cagcucugcaagaauugaagc

SEQ ID NO: 2436420 - RNA, 18 nt, Human
cagcucuggacagcccca

SEQ ID NO: 2436421 - RNA, 21 nt, Human
cagcucuggacagccccaccc

SEQ ID NO: 2436422 - RNA, 11 nt, Human
cagcucuggag

SEQ ID NO: 2436423 - RNA, 23 nt, Human
cagcucuggacagccccacccug

SEQ ID NO: 2436424 - RNA, 17 nt, Human
cagcucuggacagcccc

SEQ ID NO: 2436425 - RNA, 13 nt, Human
cagcuccuuccug

SEQ ID NO: 2436426 - RNA, 14 nt, Human
cagcuccuuccugg

SEQ ID NO: 2436427 - RNA, 16 nt, Human
cagcuccuugggagga

SEQ ID NO: 2436428 - RNA, 12 nt, Human
cagcuccuuggg

SEQ ID NO: 2436429 - RNA, 16 nt, Human
cagcuccuuccuggag

SEQ ID NO: 2436430 - RNA, 21 nt, Human
cagcuccuugggaggaagcag

SEQ ID NO: 2436431 - RNA, 20 nt, Human
cagcuccuugggaggaagca

SEQ ID NO: 2436432 - RNA, 18 nt, Human
cagcuccuugggaggaag

SEQ ID NO: 2436433 - RNA, 17 nt, Human
cagcuccuugggaggaa

SEQ ID NO: 2436434 - RNA, 23 nt, Human
cagcuccuugggaggaagcagaa

SEQ ID NO: 2436435 - RNA, 22 nt, Human
cagcuccuugggaggaagcaga

SEQ ID NO: 2436436 - RNA, 21 nt, Human
cagcucuagacaacccugcaa

SEQ ID NO: 2436437 - RNA, 13 nt, Human
cagcucucagcca

SEQ ID NO: 2436438 - RNA, 20 nt, Human
cagcucuagacacugccaca

SEQ ID NO: 2436439 - RNA, 12 nt, Human
cagcucucagcc

SEQ ID NO: 2436440 - RNA, 15 nt, Human
cagcucuacuggucu

SEQ ID NO: 2436441 - RNA, 17 nt, Human
cagcucuagacaacccu

SEQ ID NO: 2436442 - RNA, 20 nt, Human
cagcucuagacaacccugca

SEQ ID NO: 2436443 - RNA, 14 nt, Human
cagcucuccaguca

SEQ ID NO: 2436444 - RNA, 13 nt, Human
cagcucuccaguc

SEQ ID NO: 2436445 - RNA, 12 nt, Human
cagcucuccagu

SEQ ID NO: 2436446 - RNA, 11 nt, Human
cagcucuccag

SEQ ID NO: 2436447 - RNA, 15 nt, Human
cagcucucccucugg

SEQ ID NO: 2436448 - RNA, 16 nt, Human
cagcucucccucuggc

SEQ ID NO: 2436449 - RNA, 17 nt, Human
cagcucucccucuggcc

SEQ ID NO: 2436450 - RNA, 18 nt, Human
cagcucucccucuggccc

SEQ ID NO: 2436451 - RNA, 12 nt, Human
cagcucucccuc

SEQ ID NO: 2436452 - RNA, 14 nt, Human
cagcucucccucug

SEQ ID NO: 2436453 - RNA, 12 nt, Human
cagcucuccccu

SEQ ID NO: 2436454 - RNA, 23 nt, Human
cagcuccuucuguccuacucugu

SEQ ID NO: 2436455 - RNA, 21 nt, Human
cagcuccuucuguccuacucu

SEQ ID NO: 2436456 - RNA, 17 nt, Human
cagcuccuucuguccua

SEQ ID NO: 2436457 - RNA, 16 nt, Human
cagcuccuucuguccu

SEQ ID NO: 2436458 - RNA, 15 nt, Human
cagcuccuguaacau

SEQ ID NO: 2436459 - RNA, 23 nt, Human
cagcucaggcacacuucuucuug

SEQ ID NO: 2436460 - RNA, 12 nt, Human
cagcucaguccc

SEQ ID NO: 2436461 - RNA, 18 nt, Human
cagcucagucccaucaga

SEQ ID NO: 2436462 - RNA, 17 nt, Human
cagcucaugcccccuuu

SEQ ID NO: 2436463 - RNA, 15 nt, Human
cagcucaucucuguc

SEQ ID NO: 2436464 - RNA, 23 nt, Human
cagcucaguucuagucucucugg

SEQ ID NO: 2436465 - RNA, 20 nt, Human
cagcucagagagggugggag

SEQ ID NO: 2436466 - RNA, 19 nt, Human
cagcucagagaggguggga

SEQ ID NO: 2436467 - RNA, 17 nt, Human
cagcucagagagggugg

SEQ ID NO: 2436468 - RNA, 13 nt, Human
cagcucagagagg

SEQ ID NO: 2436469 - RNA, 13 nt, Human
cagcucaggacag

SEQ ID NO: 2436470 - RNA, 16 nt, Human
cagcucaggacagaug

SEQ ID NO: 2436471 - RNA, 18 nt, Human
cagcucaggacagaugcc

SEQ ID NO: 2436472 - RNA, 19 nt, Human
cagcucaggacagaugcca

SEQ ID NO: 2436473 - RNA, 22 nt, Human
cagcucaggacagaugccacac

SEQ ID NO: 2436474 - RNA, 11 nt, Human
cagcucaggau

SEQ ID NO: 2436475 - RNA, 13 nt, Human
cagcucaggaucu

SEQ ID NO: 2436476 - RNA, 12 nt, Human
cagcucaggcac

SEQ ID NO: 2436477 - RNA, 21 nt, Human
cagcucaggcacacuucuucu

SEQ ID NO: 2436478 - RNA, 17 nt, Human
cagcucagcgccagccu

SEQ ID NO: 2436479 - RNA, 13 nt, Human
cagcucagcgcca

SEQ ID NO: 2436480 - RNA, 11 nt, Human
cagcucagcgc

SEQ ID NO: 2436481 - RNA, 12 nt, Human
cagcucaggaca

SEQ ID NO: 2436482 - RNA, 18 nt, Human
cagcucagcgccagccug

SEQ ID NO: 2436483 - RNA, 10 nt, Human
cagcucagga

SEQ ID NO: 2436484 - RNA, 15 nt, Human
caggaaguagaggag

SEQ ID NO: 2436485 - RNA, 20 nt, Human
caggaaguacuggagaaaau

SEQ ID NO: 2436486 - RNA, 18 nt, Human
caggaaguacuggagaaa

SEQ ID NO: 2436487 - RNA, 17 nt, Human
caggaaguacuggagaa

SEQ ID NO: 2436488 - RNA, 16 nt, Human
caggaagucuucaggg

SEQ ID NO: 2436489 - RNA, 10 nt, Human
caggaaguga

SEQ ID NO: 2436490 - RNA, 12 nt, Human
caggaauaaggc

SEQ ID NO: 2436491 - RNA, 23 nt, Human
caggaaucaagagcugcccuccu

SEQ ID NO: 2436492 - RNA, 18 nt, Human
caggaaucaagagcugcc

SEQ ID NO: 2436493 - RNA, 17 nt, Human
caggaaucaagagcugc

SEQ ID NO: 2436494 - RNA, 16 nt, Human
caggaaucaagagcug

SEQ ID NO: 2436495 - RNA, 17 nt, Human
caggaauauuuuccaaa

SEQ ID NO: 2436496 - RNA, 23 nt, Human
caggaauaaggccuuaauauguu

SEQ ID NO: 2436497 - RNA, 16 nt, Human
caggaaguagaggagg

SEQ ID NO: 2436498 - RNA, 23 nt, Human
caggaaggggguccacccagcaa

SEQ ID NO: 2436499 - RNA, 21 nt, Human
caggaaggggguccacccagc

SEQ ID NO: 2436500 - RNA, 16 nt, Human
caggaaguacuggaga

SEQ ID NO: 2436501 - RNA, 14 nt, Human
caggaaguacugga

SEQ ID NO: 2436502 - RNA, 12 nt, Human
caggaaguacug

SEQ ID NO: 2436503 - RNA, 21 nt, Human
caggaagggcaggaaggagag

SEQ ID NO: 2436504 - RNA, 22 nt, Human
caggaagggccuacagcccauu

SEQ ID NO: 2436505 - RNA, 18 nt, Human
caggaaggggguccaccc

SEQ ID NO: 2436506 - RNA, 15 nt, Human
caggaaggcuaaagg

SEQ ID NO: 2436507 - RNA, 19 nt, Human
caggaaggcugagaggaga

SEQ ID NO: 2436508 - RNA, 17 nt, Human
caggaaggagagccugc

SEQ ID NO: 2436509 - RNA, 18 nt, Human
caggaaggagagccugcu

SEQ ID NO: 2436510 - RNA, 18 nt, Human
caggaaggaugagcauuu

SEQ ID NO: 2436511 - RNA, 16 nt, Human
caggaauuucccagga

SEQ ID NO: 2436512 - RNA, 17 nt, Human
caggaauuucccaggac

SEQ ID NO: 2436513 - RNA, 18 nt, Human
caggaauuucccaggacc

SEQ ID NO: 2436514 - RNA, 19 nt, Human
caggaauuucccaggaccc

SEQ ID NO: 2436515 - RNA, 20 nt, Human
caggaauuucccaggacccu

SEQ ID NO: 2436516 - RNA, 21 nt, Human
caggaauuucccaggacccug

SEQ ID NO: 2436517 - RNA, 15 nt, Human
caggacaacgaggaa

SEQ ID NO: 2436518 - RNA, 16 nt, Human
caggacaacgaggaag

SEQ ID NO: 2436519 - RNA, 18 nt, Human
caggacaacgaggaagcc

SEQ ID NO: 2436520 - RNA, 17 nt, Human
caggacaaugucugaac

SEQ ID NO: 2436521 - RNA, 19 nt, Human
caggacaacgaggaagccc

SEQ ID NO: 2436522 - RNA, 20 nt, Human
caggaaugaagccuuagcca

SEQ ID NO: 2436523 - RNA, 19 nt, Human
caggaauguguggccugca

SEQ ID NO: 2436524 - RNA, 21 nt, Human
caggaauguguggccugcaca

SEQ ID NO: 2436525 - RNA, 23 nt, Human
caggaauguguggccugcacagu

SEQ ID NO: 2436526 - RNA, 18 nt, Human
caggaauguuaaagucag

SEQ ID NO: 2436527 - RNA, 19 nt, Human
caggaauguuaaagucagu

SEQ ID NO: 2436528 - RNA, 16 nt, Human
caggaauguguggccu

SEQ ID NO: 2436529 - RNA, 17 nt, Human
caggaauguguggccug

SEQ ID NO: 2436530 - RNA, 21 nt, Human
caggaaugccaaggagacauc

SEQ ID NO: 2436531 - RNA, 14 nt, Human
caggaaugaucucu

SEQ ID NO: 2436532 - RNA, 13 nt, Human
caggaaugggcug

SEQ ID NO: 2436533 - RNA, 17 nt, Human
caggaauguguggcaga

SEQ ID NO: 2436534 - RNA, 14 nt, Human
caggaccugccugu

SEQ ID NO: 2436535 - RNA, 15 nt, Human
caggaccugccugua

SEQ ID NO: 2436536 - RNA, 19 nt, Human
caggaccugccuguagccc

SEQ ID NO: 2436537 - RNA, 14 nt, Human
caggaccuggcugc

SEQ ID NO: 2436538 - RNA, 16 nt, Human
caggaccuggcugcca

SEQ ID NO: 2436539 - RNA, 17 nt, Human
caggaccuggcugccau

SEQ ID NO: 2436540 - RNA, 20 nt, Human
caggaccugggaccuccccu

SEQ ID NO: 2436541 - RNA, 18 nt, Human
caggaccuggcugccaua

SEQ ID NO: 2436542 - RNA, 21 nt, Human
caggacaccacacccagccuc

SEQ ID NO: 2436543 - RNA, 20 nt, Human
caggacaccacacccagccu

SEQ ID NO: 2436544 - RNA, 19 nt, Human
caggacaccacacccagcc

SEQ ID NO: 2436545 - RNA, 17 nt, Human
caggacaccacacccag

SEQ ID NO: 2436546 - RNA, 13 nt, Human
caggacacaguca

SEQ ID NO: 2436547 - RNA, 14 nt, Human
caggacaccacacc

SEQ ID NO: 2436548 - RNA, 15 nt, Human
caggacacagucaga

SEQ ID NO: 2436549 - RNA, 21 nt, Human
caggaccucugaaacccugga

SEQ ID NO: 2436550 - RNA, 13 nt, Human
caggaccugccug

SEQ ID NO: 2436551 - RNA, 13 nt, Human
caggaccugacua

SEQ ID NO: 2436552 - RNA, 20 nt, Human
caggacggggccggccaggu

SEQ ID NO: 2436553 - RNA, 19 nt, Human
caggacggggccggccagg

SEQ ID NO: 2436554 - RNA, 16 nt, Human
caggacggggccggcc

SEQ ID NO: 2436555 - RNA, 22 nt, Human
caggacgcuucugaaugcugcu

SEQ ID NO: 2436556 - RNA, 21 nt, Human
caggacgcuucugaaugcugc

SEQ ID NO: 2436557 - RNA, 16 nt, Human
caggacgcuucugaau

SEQ ID NO: 2436558 - RNA, 15 nt, Human
caggacgcuucugaa

SEQ ID NO: 2436559 - RNA, 14 nt, Human
caggacgcuucuga

SEQ ID NO: 2436560 - RNA, 20 nt, Human
caggaccuuuugaaguaguu

SEQ ID NO: 2436561 - RNA, 13 nt, Human
caggaccuuuuga

SEQ ID NO: 2436562 - RNA, 21 nt, Human
caggaccuucgggcugugccc

SEQ ID NO: 2436563 - RNA, 22 nt, Human
caggaccuucgggcugugcccg

SEQ ID NO: 2436564 - RNA, 20 nt, Human
caggaccuucgggcugugcc

SEQ ID NO: 2436565 - RNA, 17 nt, Human
caggaccuguggccaag

SEQ ID NO: 2436566 - RNA, 19 nt, Human
caggaagcucagggccugg

SEQ ID NO: 2436567 - RNA, 18 nt, Human
caggaagcucagggccug

SEQ ID NO: 2436568 - RNA, 17 nt, Human
caggaagcucagggccu

SEQ ID NO: 2436569 - RNA, 16 nt, Human
caggaagcucagggcc

SEQ ID NO: 2436570 - RNA, 15 nt, Human
caggaagcucagggc

SEQ ID NO: 2436571 - RNA, 14 nt, Human
caggaagcucaggg

SEQ ID NO: 2436572 - RNA, 19 nt, Human
caggaagccugcaguccug

SEQ ID NO: 2436573 - RNA, 13 nt, Human
caggaagccugca

SEQ ID NO: 2436574 - RNA, 19 nt, Human
caggaagcccccaaguuga

SEQ ID NO: 2436575 - RNA, 13 nt, Human
caggaagccccca

SEQ ID NO: 2436576 - RNA, 13 nt, Human
caggaagcucagg

SEQ ID NO: 2436577 - RNA, 21 nt, Human
caggaagcucagggccuggcu

SEQ ID NO: 2436578 - RNA, 20 nt, Human
caggaagcucagggccuggc

SEQ ID NO: 2436579 - RNA, 23 nt, Human
caggaagcucagggccuggcuca

SEQ ID NO: 2436580 - RNA, 21 nt, Human
caggaagccugcaguccugga

SEQ ID NO: 2436581 - RNA, 12 nt, Human
caggaagcucag

SEQ ID NO: 2436582 - RNA, 21 nt, Human
caggaagccgugcccugcccc

SEQ ID NO: 2436583 - RNA, 17 nt, Human
caggaagcucagacugg

SEQ ID NO: 2436584 - RNA, 12 nt, Human
caggaaggagag

SEQ ID NO: 2436585 - RNA, 14 nt, Human
caggaaggaaguca

SEQ ID NO: 2436586 - RNA, 13 nt, Human
caggaaggagagc

SEQ ID NO: 2436587 - RNA, 14 nt, Human
caggaaggagagcc

SEQ ID NO: 2436588 - RNA, 15 nt, Human
caggaaggagagccu

SEQ ID NO: 2436589 - RNA, 16 nt, Human
caggaaggagagccug

SEQ ID NO: 2436590 - RNA, 18 nt, Human
caggaagcugcuccgugc

SEQ ID NO: 2436591 - RNA, 15 nt, Human
caggaagcugcuccg

SEQ ID NO: 2436592 - RNA, 17 nt, Human
caggaagcugcuccgug

SEQ ID NO: 2436593 - RNA, 18 nt, Human
caggaagccagcaggcuc

SEQ ID NO: 2436594 - RNA, 17 nt, Human
caggaagccagcaggcu

SEQ ID NO: 2436595 - RNA, 16 nt, Human
caggaagccagcaggc

SEQ ID NO: 2436596 - RNA, 14 nt, Human
caggaagccagcag

SEQ ID NO: 2436597 - RNA, 21 nt, Human
caggaagccagcaggcucuca

SEQ ID NO: 2436598 - RNA, 19 nt, Human
caggaagccagcaggcucu

SEQ ID NO: 2436599 - RNA, 20 nt, Human
caggaagcauucagagagca

SEQ ID NO: 2436600 - RNA, 19 nt, Human
caggaagcauucagagagc

SEQ ID NO: 2436601 - RNA, 18 nt, Human
caggaagcauucagagag

SEQ ID NO: 2436602 - RNA, 23 nt, Human
caggaagcaaacuaagcccccgc

SEQ ID NO: 2436603 - RNA, 22 nt, Human
caggaagcauucagagagcagc

SEQ ID NO: 2436604 - RNA, 22 nt, Human
caggaagccagcaggcucucag

SEQ ID NO: 2436605 - RNA, 17 nt, Human
caggaacucccagcaac

SEQ ID NO: 2436606 - RNA, 16 nt, Human
caggaacucccagcaa

SEQ ID NO: 2436607 - RNA, 15 nt, Human
caggaacucccagca

SEQ ID NO: 2436608 - RNA, 14 nt, Human
caggaacucccagc

SEQ ID NO: 2436609 - RNA, 12 nt, Human
caggaacugggc

SEQ ID NO: 2436610 - RNA, 13 nt, Human
caggaacugggcc

SEQ ID NO: 2436611 - RNA, 16 nt, Human
caggaaccacaccaca

SEQ ID NO: 2436612 - RNA, 19 nt, Human
caggaaccacaccacaucu

SEQ ID NO: 2436613 - RNA, 17 nt, Human
caggaacuauaaaaaca

SEQ ID NO: 2436614 - RNA, 15 nt, Human
caggaacuauaaaaa

SEQ ID NO: 2436615 - RNA, 14 nt, Human
caggaagcagcuuu

SEQ ID NO: 2436616 - RNA, 16 nt, Human
caggaagcaccccaug

SEQ ID NO: 2436617 - RNA, 17 nt, Human
caggaagcaccccaugc

SEQ ID NO: 2436618 - RNA, 14 nt, Human
caggaagcacccca

SEQ ID NO: 2436619 - RNA, 15 nt, Human
caggaagcaccccau

SEQ ID NO: 2436620 - RNA, 18 nt, Human
caggaagaucuuaaauuu

SEQ ID NO: 2436621 - RNA, 21 nt, Human
caggaagaugaaagaggaggu

SEQ ID NO: 2436622 - RNA, 14 nt, Human
caggaagagagcau

SEQ ID NO: 2436623 - RNA, 21 nt, Human
caggaagaaaucacagaauca

SEQ ID NO: 2436624 - RNA, 14 nt, Human
caggaagaaaucac

SEQ ID NO: 2436625 - RNA, 22 nt, Human
caggaagaaaggagucugcaca

SEQ ID NO: 2436626 - RNA, 22 nt, Human
caggaagaaaucacagaaucau

SEQ ID NO: 2436627 - RNA, 15 nt, Human
cagcuucauuugugu

SEQ ID NO: 2436628 - RNA, 13 nt, Human
cagcuucauuugu

SEQ ID NO: 2436629 - RNA, 17 nt, Human
cagcuguacuucgucuu

SEQ ID NO: 2436630 - RNA, 17 nt, Human
cagcuucauuuguguca

SEQ ID NO: 2436631 - RNA, 18 nt, Human
cagcuuccccucucuccu

SEQ ID NO: 2436632 - RNA, 22 nt, Human
cagcuuccccucucuccuccug

SEQ ID NO: 2436633 - RNA, 20 nt, Human
cagcuucguuuauuuucaag

SEQ ID NO: 2436634 - RNA, 22 nt, Human
cagcuuccuacccacaccucug

SEQ ID NO: 2436635 - RNA, 20 nt, Human
cagcuuccuacccacaccuc

SEQ ID NO: 2436636 - RNA, 19 nt, Human
cagcuuccuacccacaccu

SEQ ID NO: 2436637 - RNA, 14 nt, Human
cagcuuccuaccca

SEQ ID NO: 2436638 - RNA, 23 nt, Human
cagcuuccccucucuccuccugc

SEQ ID NO: 2436639 - RNA, 21 nt, Human
cagcuucauuuccugugucuu

SEQ ID NO: 2436640 - RNA, 20 nt, Human
cagcuucauuuccugugucu

SEQ ID NO: 2436641 - RNA, 19 nt, Human
cagcuguaugauucccagc

SEQ ID NO: 2436642 - RNA, 16 nt, Human
cagcuguaaucuauga

SEQ ID NO: 2436643 - RNA, 21 nt, Human
cagcuguaagaagagacuggg

SEQ ID NO: 2436644 - RNA, 22 nt, Human
cagcuguaagaagagacuggga

SEQ ID NO: 2436645 - RNA, 19 nt, Human
cagcuucauuuccuguguc

SEQ ID NO: 2436646 - RNA, 14 nt, Human
cagcuucugguacu

SEQ ID NO: 2436647 - RNA, 18 nt, Human
cagcuucugcugggcugg

SEQ ID NO: 2436648 - RNA, 17 nt, Human
cagcuucugcugggcug

SEQ ID NO: 2436649 - RNA, 16 nt, Human
cagcuucugcugggcu

SEQ ID NO: 2436650 - RNA, 15 nt, Human
cagcuucugcugggc

SEQ ID NO: 2436651 - RNA, 14 nt, Human
cagcuucugcuggg

SEQ ID NO: 2436652 - RNA, 19 nt, Human
cagcuucugccacuuccca

SEQ ID NO: 2436653 - RNA, 18 nt, Human
cagcuucugccacuuccc

SEQ ID NO: 2436654 - RNA, 17 nt, Human
cagcuucugccacuucc

SEQ ID NO: 2436655 - RNA, 15 nt, Human
cagcuucugccacuu

SEQ ID NO: 2436656 - RNA, 23 nt, Human
cagcuucugccacuucccaggua

SEQ ID NO: 2436657 - RNA, 20 nt, Human
cagcuucugccacuucccag

SEQ ID NO: 2436658 - RNA, 18 nt, Human
cagcuugaaacugagaug

SEQ ID NO: 2436659 - RNA, 22 nt, Human
cagcuucugguacucuccuaga

SEQ ID NO: 2436660 - RNA, 21 nt, Human
cagcuucugguacucuccuag

SEQ ID NO: 2436661 - RNA, 20 nt, Human
cagcuucugguacucuccua

SEQ ID NO: 2436662 - RNA, 19 nt, Human
cagcuucugguacucuccu

SEQ ID NO: 2436663 - RNA, 14 nt, Human
cagcuucuucaucu

SEQ ID NO: 2436664 - RNA, 23 nt, Human
cagcuucugguacucuccuagag

SEQ ID NO: 2436665 - RNA, 22 nt, Human
cagcuucuuaauauaacugccu

SEQ ID NO: 2436666 - RNA, 22 nt, Human
cagcuucguuuauuuucaagaa

SEQ ID NO: 2436667 - RNA, 18 nt, Human
cagcuucuauccuugacu

SEQ ID NO: 2436668 - RNA, 18 nt, Human
cagcuucucauccugcag

SEQ ID NO: 2436669 - RNA, 20 nt, Human
cagcuucucauccugcaggc

SEQ ID NO: 2436670 - RNA, 19 nt, Human
cagcuucucauccugcagg

SEQ ID NO: 2436671 - RNA, 15 nt, Human
cagcuucuccaggcu

SEQ ID NO: 2436672 - RNA, 14 nt, Human
cagcuucuccaggc

SEQ ID NO: 2436673 - RNA, 15 nt, Human
cagcuucuccugugu

SEQ ID NO: 2436674 - RNA, 16 nt, Human
cagcuucuccugugug

SEQ ID NO: 2436675 - RNA, 12 nt, Human
cagcuucugcca

SEQ ID NO: 2436676 - RNA, 11 nt, Human
cagcuucugcc

SEQ ID NO: 2436677 - RNA, 13 nt, Human
cagcuucugccac

SEQ ID NO: 2436678 - RNA, 14 nt, Human
cagcuucugccacu

SEQ ID NO: 2436679 - RNA, 13 nt, Human
cagcuucuccagg

SEQ ID NO: 2436680 - RNA, 12 nt, Human
cagcuucuccag

SEQ ID NO: 2436681 - RNA, 19 nt, Human
cagcuucuauuagccaguc

SEQ ID NO: 2436682 - RNA, 21 nt, Human
cagcuucucauccugcaggca

SEQ ID NO: 2436683 - RNA, 21 nt, Human
cagcuugaccgugaggccaga

SEQ ID NO: 2436684 - RNA, 20 nt, Human
cagcuugaccgugaggccag

SEQ ID NO: 2436685 - RNA, 19 nt, Human
cagcuugaccgugaggcca

SEQ ID NO: 2436686 - RNA, 18 nt, Human
cagcuugaccgugaggcc

SEQ ID NO: 2436687 - RNA, 23 nt, Human
cagcuugaccugaggcugugguc

SEQ ID NO: 2436688 - RNA, 22 nt, Human
cagcuugaccugaggcuguggu

SEQ ID NO: 2436689 - RNA, 21 nt, Human
cagcuugaccugaggcugugg

SEQ ID NO: 2436690 - RNA, 20 nt, Human
cagcuugaccugaggcugug

SEQ ID NO: 2436691 - RNA, 19 nt, Human
cagcuugaccugaggcugu

SEQ ID NO: 2436692 - RNA, 17 nt, Human
cagcuugaccugaggcu

SEQ ID NO: 2436693 - RNA, 16 nt, Human
cagcuugaccugaggc

SEQ ID NO: 2436694 - RNA, 15 nt, Human
cagcuugaccugagg

SEQ ID NO: 2436695 - RNA, 15 nt, Human
cagcuugaggguugg

SEQ ID NO: 2436696 - RNA, 14 nt, Human
cagcuugaggguug

SEQ ID NO: 2436697 - RNA, 21 nt, Human
cagcuugaggguugggcuggu

SEQ ID NO: 2436698 - RNA, 20 nt, Human
cagcuugaggguugggcugg

SEQ ID NO: 2436699 - RNA, 19 nt, Human
cagcuugaggguugggcug

SEQ ID NO: 2436700 - RNA, 18 nt, Human
cagcuugaggguugggcu

SEQ ID NO: 2436701 - RNA, 17 nt, Human
cagcuugggcccagcug

SEQ ID NO: 2436702 - RNA, 16 nt, Human
cagcuugggcccagcu

SEQ ID NO: 2436703 - RNA, 14 nt, Human
cagcuugggcccag

SEQ ID NO: 2436704 - RNA, 13 nt, Human
cagcuugggccca

SEQ ID NO: 2436705 - RNA, 17 nt, Human
cagcuugcugcccuagg

SEQ ID NO: 2436706 - RNA, 19 nt, Human
cagcuugcugcccuaggcu

SEQ ID NO: 2436707 - RNA, 15 nt, Human
cagcuugcucuucag

SEQ ID NO: 2436708 - RNA, 23 nt, Human
cagcuugcucuucagugggagaa

SEQ ID NO: 2436709 - RNA, 14 nt, Human
cagcuugcugcccu

SEQ ID NO: 2436710 - RNA, 12 nt, Human
cagcuugccccg

SEQ ID NO: 2436711 - RNA, 16 nt, Human
cagcuugccccggccc

SEQ ID NO: 2436712 - RNA, 13 nt, Human
cagcuugccccgg

SEQ ID NO: 2436713 - RNA, 22 nt, Human
cagcuugcguuagaaugaggag

SEQ ID NO: 2436714 - RNA, 22 nt, Human
cagcuugagccgggccccuggg

SEQ ID NO: 2436715 - RNA, 21 nt, Human
cagcuugagccgggccccugg

SEQ ID NO: 2436716 - RNA, 14 nt, Human
cagcuugagccggg

SEQ ID NO: 2436717 - RNA, 15 nt, Human
cagcuucuucaucuu

SEQ ID NO: 2436718 - RNA, 23 nt, Human
cagcuugaucaaaggcacacagc

SEQ ID NO: 2436719 - RNA, 19 nt, Human
cagcuugaucaaaggcaca

SEQ ID NO: 2436720 - RNA, 20 nt, Human
cagcuuguaaauagcucagg

SEQ ID NO: 2436721 - RNA, 19 nt, Human
cagcuuguaaauagcucag

SEQ ID NO: 2436722 - RNA, 22 nt, Human
cagcuugggcccagcugggcuc

SEQ ID NO: 2436723 - RNA, 23 nt, Human
cagcuugggcccagcugggcucu

SEQ ID NO: 2436724 - RNA, 21 nt, Human
cagcuugggcccagcugggcu

SEQ ID NO: 2436725 - RNA, 20 nt, Human
cagcuugggcccagcugggc

SEQ ID NO: 2436726 - RNA, 19 nt, Human
cagcuugggcccagcuggg

SEQ ID NO: 2436727 - RNA, 18 nt, Human
cagcuugggcccagcugg

SEQ ID NO: 2436728 - RNA, 18 nt, Human
cagcuuguaaauagcuca

SEQ ID NO: 2436729 - RNA, 21 nt, Human
cagcuuguggagccccacacu

SEQ ID NO: 2436730 - RNA, 18 nt, Human
cagcuuguggagccccac

SEQ ID NO: 2436731 - RNA, 17 nt, Human
cagcuuguggagcccca

SEQ ID NO: 2436732 - RNA, 15 nt, Human
cagcuuguggagccc

SEQ ID NO: 2436733 - RNA, 15 nt, Human
cagcuugugcacaau

SEQ ID NO: 2436734 - RNA, 14 nt, Human
cagcuugugcacaa

SEQ ID NO: 2436735 - RNA, 13 nt, Human
cagcuuguauuuu

SEQ ID NO: 2436736 - RNA, 22 nt, Human
cagcuuguaaauagcucaggug

SEQ ID NO: 2436737 - RNA, 21 nt, Human
cagcuuguaaauagcucaggu

SEQ ID NO: 2436738 - RNA, 21 nt, Human
cagcuuuaaacucagggacag

SEQ ID NO: 2436739 - RNA, 20 nt, Human
cagcuuuaaacucagggaca

SEQ ID NO: 2436740 - RNA, 19 nt, Human
cagcuuuaaacucagggac

SEQ ID NO: 2436741 - RNA, 18 nt, Human
cagcuuuaaacucaggga

SEQ ID NO: 2436742 - RNA, 17 nt, Human
cagcuuuaaacucaggg

SEQ ID NO: 2436743 - RNA, 15 nt, Human
cagcuuuaaacaaau

SEQ ID NO: 2436744 - RNA, 13 nt, Human
cagcuuuaaacaa

SEQ ID NO: 2436745 - RNA, 15 nt, Human
cagcuuuacaugcaa

SEQ ID NO: 2436746 - RNA, 20 nt, Human
cagcuuuaaccauuaaaacu

SEQ ID NO: 2436747 - RNA, 15 nt, Human
cagcuuuaaccauua

SEQ ID NO: 2436748 - RNA, 22 nt, Human
cagcuuuaaacucagggacaga

SEQ ID NO: 2436749 - RNA, 21 nt, Human
cagcuuuacaugcaauuuauu

SEQ ID NO: 2436750 - RNA, 19 nt, Human
cagcuuuacaugcaauuua

SEQ ID NO: 2436751 - RNA, 22 nt, Human
cagcuuuaaaaaauuaaucugg

SEQ ID NO: 2436752 - RNA, 15 nt, Human
cagcuuguguuguca

SEQ ID NO: 2436753 - RNA, 17 nt, Human
cagcuuguuauuuauaa

SEQ ID NO: 2436754 - RNA, 17 nt, Human
cagcuuucccugccucu

SEQ ID NO: 2436755 - RNA, 19 nt, Human
cagcuuucccugccucuca

SEQ ID NO: 2436756 - RNA, 23 nt, Human
cagcuuuccucaaaacuucagac

SEQ ID NO: 2436757 - RNA, 23 nt, Human
cagcuuuccccaugucucgacuc

SEQ ID NO: 2436758 - RNA, 17 nt, Human
cagcuuucaugauuagc

SEQ ID NO: 2436759 - RNA, 20 nt, Human
cagcuuucaugauuagcaag

SEQ ID NO: 2436760 - RNA, 16 nt, Human
cagcuuucaugauuag

SEQ ID NO: 2436761 - RNA, 12 nt, Human
cagcuuuguuug

SEQ ID NO: 2436762 - RNA, 21 nt, Human
cagcuuuguuuguugucagcu

SEQ ID NO: 2436763 - RNA, 22 nt, Human
cagcuuuguuuguugucagcug

SEQ ID NO: 2436764 - RNA, 23 nt, Human
cagcuuuguuuguugucagcuga

SEQ ID NO: 2436765 - RNA, 16 nt, Human
cagcuuugaucccuga

SEQ ID NO: 2436766 - RNA, 17 nt, Human
cagcuuugaucccugac

SEQ ID NO: 2436767 - RNA, 20 nt, Human
cagcuuugaucccugacauc

SEQ ID NO: 2436768 - RNA, 14 nt, Human
cagcuuugauauuu

SEQ ID NO: 2436769 - RNA, 13 nt, Human
cagcuuugcugcu

SEQ ID NO: 2436770 - RNA, 12 nt, Human
cagcuuugcugc

SEQ ID NO: 2436771 - RNA, 22 nt, Human
cagcuuugcuaccaaagcaccu

SEQ ID NO: 2436772 - RNA, 18 nt, Human
cagcuuugccuuccacgc

SEQ ID NO: 2436773 - RNA, 11 nt, Human
cagcuuugcua

SEQ ID NO: 2436774 - RNA, 15 nt, Human
cagcuuugccuucca

SEQ ID NO: 2436775 - RNA, 16 nt, Human
cagcuuugccuuccac

SEQ ID NO: 2436776 - RNA, 22 nt, Human
cagcuuugcccaacaccagccc

SEQ ID NO: 2436777 - RNA, 23 nt, Human
cagcuuugcccaacaccagcccc

SEQ ID NO: 2436778 - RNA, 14 nt, Human
cagcuuugccuucc

SEQ ID NO: 2436779 - RNA, 17 nt, Human
cagcuuuuuaccaaguu

SEQ ID NO: 2436780 - RNA, 19 nt, Human
cagcuuuuuaaaguggguu

SEQ ID NO: 2436781 - RNA, 15 nt, Human
cagcuuuugcuucau

SEQ ID NO: 2436782 - RNA, 16 nt, Human
cagcuuuuccucccuu

SEQ ID NO: 2436783 - RNA, 13 nt, Human
cagcuuuuugucu

SEQ ID NO: 2436784 - RNA, 16 nt, Human
cagcuuuuugucuuuu

SEQ ID NO: 2436785 - RNA, 19 nt, Human
cagcuuuuuuuuccccccu

SEQ ID NO: 2436786 - RNA, 19 nt, Human
cagcuuuuugucuuuucug

SEQ ID NO: 2436787 - RNA, 18 nt, Human
cagcuuuucccaaaagcc

SEQ ID NO: 2436788 - RNA, 20 nt, Human
cagcuuuucccaaaagccca

SEQ ID NO: 2436789 - RNA, 18 nt, Human
cagcuuugugacuguaua

SEQ ID NO: 2436790 - RNA, 14 nt, Human
cagcuuugcugcug

SEQ ID NO: 2436791 - RNA, 19 nt, Human
cagcuuugugacuguauau

SEQ ID NO: 2436792 - RNA, 18 nt, Human
caggaaccacaagacugc

SEQ ID NO: 2436793 - RNA, 14 nt, Human
caggaacagcuaug

SEQ ID NO: 2436794 - RNA, 20 nt, Human
caggaacagcuaugggagcc

SEQ ID NO: 2436795 - RNA, 22 nt, Human
caggaacagcuaugggagcccc

SEQ ID NO: 2436796 - RNA, 23 nt, Human
caggaacagcuaugggagcccca

SEQ ID NO: 2436797 - RNA, 23 nt, Human
caggaaaacgggaccggccaggc

SEQ ID NO: 2436798 - RNA, 19 nt, Human
caggaaaacugacagagga

SEQ ID NO: 2436799 - RNA, 14 nt, Human
caggaacagaagga

SEQ ID NO: 2436800 - RNA, 20 nt, Human
caggaaaacugacagaggag

SEQ ID NO: 2436801 - RNA, 15 nt, Human
caggaacagaaggau

SEQ ID NO: 2436802 - RNA, 18 nt, Human
caggaacagaaggaugaa

SEQ ID NO: 2436803 - RNA, 21 nt, Human
caggaaaaaaaaaaaaaagac

SEQ ID NO: 2436804 - RNA, 18 nt, Human
cagccuccaugcugccuc

SEQ ID NO: 2436805 - RNA, 14 nt, Human
cagcucaccagccc

SEQ ID NO: 2436806 - RNA, 15 nt, Human
cagcaggcucucagg

SEQ ID NO: 2436807 - RNA, 14 nt, Human
cagcaggcucucag

SEQ ID NO: 2436808 - RNA, 12 nt, Human
cagcaggcucuc

SEQ ID NO: 2436809 - RNA, 14 nt, Human
cagcaggaggccag

SEQ ID NO: 2436810 - RNA, 15 nt, Human
cagcaggaggccagg

SEQ ID NO: 2436811 - RNA, 18 nt, Human
cagcaggaggccaggccg

SEQ ID NO: 2436812 - RNA, 13 nt, Human
cagcagcccuccu

SEQ ID NO: 2436813 - RNA, 16 nt, Human
cagcagcuucaccaga

SEQ ID NO: 2436814 - RNA, 12 nt, Human
cagcagcuucac

SEQ ID NO: 2436815 - RNA, 20 nt, Human
cagcagcugaacagccaaau

SEQ ID NO: 2436816 - RNA, 18 nt, Human
cagcagcuucaccagagc

SEQ ID NO: 2436817 - RNA, 17 nt, Human
cagcagcuucaccagag

SEQ ID NO: 2436818 - RNA, 17 nt, Human
cagcagcuuuuaauaca

SEQ ID NO: 2436819 - RNA, 14 nt, Human
cagcagcucaggca

SEQ ID NO: 2436820 - RNA, 15 nt, Human
cagcagcucaggcac

SEQ ID NO: 2436821 - RNA, 18 nt, Human
cagcagcugaacagccaa

SEQ ID NO: 2436822 - RNA, 16 nt, Human
cagcagcgguggccuc

SEQ ID NO: 2436823 - RNA, 16 nt, Human
cagcagcucaggcaca

SEQ ID NO: 2436824 - RNA, 19 nt, Human
cagcagccuggacccugug

SEQ ID NO: 2436825 - RNA, 22 nt, Human
cagcagccuggacccuguggau

SEQ ID NO: 2436826 - RNA, 20 nt, Human
cagcagccuggggcuggccu

SEQ ID NO: 2436827 - RNA, 21 nt, Human
cagcagccuggggcuggccuc

SEQ ID NO: 2436828 - RNA, 20 nt, Human
cagcagcgaccaccccugcc

SEQ ID NO: 2436829 - RNA, 17 nt, Human
cagcagccuuuaaugca

SEQ ID NO: 2436830 - RNA, 15 nt, Human
cagcagcgguggccu

SEQ ID NO: 2436831 - RNA, 17 nt, Human
cagcagcggaaccgccc

SEQ ID NO: 2436832 - RNA, 21 nt, Human
cagcagcgaccaccccugccu

SEQ ID NO: 2436833 - RNA, 17 nt, Human
cagcagcgccuuuccca

SEQ ID NO: 2436834 - RNA, 12 nt, Human
cagcagcucagg

SEQ ID NO: 2436835 - RNA, 13 nt, Human
cagcagcucaggc

SEQ ID NO: 2436836 - RNA, 12 nt, Human
cagcagccugga

SEQ ID NO: 2436837 - RNA, 14 nt, Human
cagcagccuggacc

SEQ ID NO: 2436838 - RNA, 15 nt, Human
cagcagccuggaccc

SEQ ID NO: 2436839 - RNA, 18 nt, Human
cagcagccuggacccugu

SEQ ID NO: 2436840 - RNA, 17 nt, Human
cagcauccuggcacccg

SEQ ID NO: 2436841 - RNA, 16 nt, Human
cagcauccuggcaccc

SEQ ID NO: 2436842 - RNA, 15 nt, Human
cagcauccuggcacc

SEQ ID NO: 2436843 - RNA, 14 nt, Human
cagcauccuggcac

SEQ ID NO: 2436844 - RNA, 22 nt, Human
cagcagggaaaaugcagcaggg

SEQ ID NO: 2436845 - RNA, 23 nt, Human
cagcagggaaaaugcagcaggga

SEQ ID NO: 2436846 - RNA, 15 nt, Human
cagcagggaugcccu

SEQ ID NO: 2436847 - RNA, 24 nt, Human
cagcagggaaaaugcagcagggau

SEQ ID NO: 2436848 - RNA, 20 nt, Human
cagcagggagggcuucugcc

SEQ ID NO: 2436849 - RNA, 16 nt, Human
cagcagggaugcccug

SEQ ID NO: 2436850 - RNA, 18 nt, Human
cagcagggaugcccugga

SEQ ID NO: 2436851 - RNA, 21 nt, Human
cagcagggaugcccuggaggu

SEQ ID NO: 2436852 - RNA, 22 nt, Human
cagcagggaugcccuggaggug

SEQ ID NO: 2436853 - RNA, 17 nt, Human
cagcagggccacucccg

SEQ ID NO: 2436854 - RNA, 16 nt, Human
cagcagggccacuccc

SEQ ID NO: 2436855 - RNA, 19 nt, Human
cagcagggcuacccugagc

SEQ ID NO: 2436856 - RNA, 21 nt, Human
cagcagggcuacccugagcug

SEQ ID NO: 2436857 - RNA, 11 nt, Human
cagcagggcua

SEQ ID NO: 2436858 - RNA, 14 nt, Human
cagcagggccucaa

SEQ ID NO: 2436859 - RNA, 15 nt, Human
cagcagggccucaaa

SEQ ID NO: 2436860 - RNA, 19 nt, Human
cagcaggcucucaggccag

SEQ ID NO: 2436861 - RNA, 18 nt, Human
cagcaggcucucaggcca

SEQ ID NO: 2436862 - RNA, 17 nt, Human
cagcaggcucucaggcc

SEQ ID NO: 2436863 - RNA, 16 nt, Human
cagcaggcucucaggc

SEQ ID NO: 2436864 - RNA, 22 nt, Human
cagcaggcucucaggccagcug

SEQ ID NO: 2436865 - RNA, 20 nt, Human
cagcaggcucucaggccagc

SEQ ID NO: 2436866 - RNA, 18 nt, Human
cagcagggagggcuucug

SEQ ID NO: 2436867 - RNA, 18 nt, Human
cagccaaagccuccucca

SEQ ID NO: 2436868 - RNA, 21 nt, Human
cagccaaagccuccuccagcc

SEQ ID NO: 2436869 - RNA, 20 nt, Human
cagccaacacgcaccugccu

SEQ ID NO: 2436870 - RNA, 22 nt, Human
cagccaacacgcaccugccuca

SEQ ID NO: 2436871 - RNA, 23 nt, Human
cagccaacacgcaccugccucag

SEQ ID NO: 2436872 - RNA, 17 nt, Human
cagccaaagauaaucuc

SEQ ID NO: 2436873 - RNA, 20 nt, Human
cagccaaagauaaucucuca

SEQ ID NO: 2436874 - RNA, 19 nt, Human
cagccaacacgcaccugcc

SEQ ID NO: 2436875 - RNA, 22 nt, Human
cagccaaauguaauugaauaaa

SEQ ID NO: 2436876 - RNA, 11 nt, Human
cagccaagcac

SEQ ID NO: 2436877 - RNA, 13 nt, Human
cagccaacucauu

SEQ ID NO: 2436878 - RNA, 18 nt, Human
cagccaacuauggccugu

SEQ ID NO: 2436879 - RNA, 22 nt, Human
cagccaacagguggcaggacca

SEQ ID NO: 2436880 - RNA, 19 nt, Human
cagccaacagguggcagga

SEQ ID NO: 2436881 - RNA, 18 nt, Human
cagccaacagguggcagg

SEQ ID NO: 2436882 - RNA, 23 nt, Human
cagccaacagguggcaggaccag

SEQ ID NO: 2436883 - RNA, 12 nt, Human
cagccaaccccu

SEQ ID NO: 2436884 - RNA, 14 nt, Human
cagccaaccccugu

SEQ ID NO: 2436885 - RNA, 15 nt, Human
cagccaaccccugug

SEQ ID NO: 2436886 - RNA, 21 nt, Human
cagccaaccccuguggagccc

SEQ ID NO: 2436887 - RNA, 16 nt, Human
cagccaaccccugugg

SEQ ID NO: 2436888 - RNA, 18 nt, Human
cagccaaccccuguggag

SEQ ID NO: 2436889 - RNA, 21 nt, Human
cagccaacgaguaauuuauug

SEQ ID NO: 2436890 - RNA, 20 nt, Human
cagcauuuccacaccaagca

SEQ ID NO: 2436891 - RNA, 21 nt, Human
cagcauuuccacaccaagcag

SEQ ID NO: 2436892 - RNA, 14 nt, Human
cagcauugcuuucu

SEQ ID NO: 2436893 - RNA, 16 nt, Human
cagcauugcuuucuga

SEQ ID NO: 2436894 - RNA, 17 nt, Human
cagcauugcugguucua

SEQ ID NO: 2436895 - RNA, 16 nt, Human
cagcauugcugguucu

SEQ ID NO: 2436896 - RNA, 12 nt, Human
cagcauugcuuu

SEQ ID NO: 2436897 - RNA, 13 nt, Human
cagcauugcuuuc

SEQ ID NO: 2436898 - RNA, 15 nt, Human
cagcauugcugguuc

SEQ ID NO: 2436899 - RNA, 14 nt, Human
cagcauugcugguu

SEQ ID NO: 2436900 - RNA, 16 nt, Human
cagcauuucugaagug

SEQ ID NO: 2436901 - RNA, 15 nt, Human
cagcauuucugaagu

SEQ ID NO: 2436902 - RNA, 23 nt, Human
cagcauuuccacaccaagcagca

SEQ ID NO: 2436903 - RNA, 18 nt, Human
cagcauuuuacugauuca

SEQ ID NO: 2436904 - RNA, 15 nt, Human
cagccaaagccuccu

SEQ ID NO: 2436905 - RNA, 16 nt, Human
cagccaaagccuccuc

SEQ ID NO: 2436906 - RNA, 19 nt, Human
cagccaaacccaugaggca

SEQ ID NO: 2436907 - RNA, 15 nt, Human
cagccaaacccuguc

SEQ ID NO: 2436908 - RNA, 16 nt, Human
cagccaaacccugucu

SEQ ID NO: 2436909 - RNA, 17 nt, Human
cagccaaacccugucug

SEQ ID NO: 2436910 - RNA, 16 nt, Human
cagccaaacccaugag

SEQ ID NO: 2436911 - RNA, 17 nt, Human
cagccaaacccaugagg

SEQ ID NO: 2436912 - RNA, 18 nt, Human
cagcaugucuauucagcu

SEQ ID NO: 2436913 - RNA, 18 nt, Human
cagcauuacaaauugcuu

SEQ ID NO: 2436914 - RNA, 18 nt, Human
cagcauguugcugaggag

SEQ ID NO: 2436915 - RNA, 17 nt, Human
cagcauguugcugagga

SEQ ID NO: 2436916 - RNA, 22 nt, Human
cagcauguguauuuccagugca

SEQ ID NO: 2436917 - RNA, 21 nt, Human
cagcaugaccugugaccagca

SEQ ID NO: 2436918 - RNA, 20 nt, Human
cagcaugggcccaggaaugc

SEQ ID NO: 2436919 - RNA, 17 nt, Human
cagcaugaggaacuagc

SEQ ID NO: 2436920 - RNA, 23 nt, Human
cagcaugaccugugaccagcacu

SEQ ID NO: 2436921 - RNA, 21 nt, Human
cagcauuccagccccucuggu

SEQ ID NO: 2436922 - RNA, 20 nt, Human
cagcauuccagccccucugg

SEQ ID NO: 2436923 - RNA, 16 nt, Human
cagcauuccagccccu

SEQ ID NO: 2436924 - RNA, 14 nt, Human
cagcauuccagccc

SEQ ID NO: 2436925 - RNA, 14 nt, Human
cagcauucucacuc

SEQ ID NO: 2436926 - RNA, 15 nt, Human
cagcauucucacucc

SEQ ID NO: 2436927 - RNA, 20 nt, Human
cagcauccuggcacccggcc

SEQ ID NO: 2436928 - RNA, 19 nt, Human
cagcauccuggcacccggc

SEQ ID NO: 2436929 - RNA, 21 nt, Human
cagcauccuggcacccggccc

SEQ ID NO: 2436930 - RNA, 18 nt, Human
cagcagggcugcugugaa

SEQ ID NO: 2436931 - RNA, 23 nt, Human
cagcauccuuuucugcagagggg

SEQ ID NO: 2436932 - RNA, 20 nt, Human
cagcaggguagucugguuuc

SEQ ID NO: 2436933 - RNA, 17 nt, Human
cagcagggcugcuguga

SEQ ID NO: 2436934 - RNA, 17 nt, Human
cagcagggccucaaagu

SEQ ID NO: 2436935 - RNA, 23 nt, Human
cagcaucucccucacugaaacca

SEQ ID NO: 2436936 - RNA, 21 nt, Human
cagccaccgaagccgccugug

SEQ ID NO: 2436937 - RNA, 18 nt, Human
cagccacgaggugcaaca

SEQ ID NO: 2436938 - RNA, 15 nt, Human
cagccaccucucuuu

SEQ ID NO: 2436939 - RNA, 16 nt, Human
cagccaccucucuuuu

SEQ ID NO: 2436940 - RNA, 22 nt, Human
cagccaccccgggcucucugcu

SEQ ID NO: 2436941 - RNA, 12 nt, Human
cagccaccagcg

SEQ ID NO: 2436942 - RNA, 23 nt, Human
cagccacaguuuccucaucuguc

SEQ ID NO: 2436943 - RNA, 17 nt, Human
cagccaccccgggcucu

SEQ ID NO: 2436944 - RNA, 20 nt, Human
cagccaccccgggcucucug

SEQ ID NO: 2436945 - RNA, 21 nt, Human
cagccaccccgggcucucugc

SEQ ID NO: 2436946 - RNA, 17 nt, Human
cagccacauuccugaug

SEQ ID NO: 2436947 - RNA, 15 nt, Human
cagccacauuccuga

SEQ ID NO: 2436948 - RNA, 19 nt, Human
cagccacauuccugaugcu

SEQ ID NO: 2436949 - RNA, 11 nt, Human
cagccaccccg

SEQ ID NO: 2436950 - RNA, 11 nt, Human
cagccacacac

SEQ ID NO: 2436951 - RNA, 12 nt, Human
cagccacacaca

SEQ ID NO: 2436952 - RNA, 13 nt, Human
cagccacacacac

SEQ ID NO: 2436953 - RNA, 14 nt, Human
cagccacacacaca

SEQ ID NO: 2436954 - RNA, 9 nt, Human
cagccacac

SEQ ID NO: 2436955 - RNA, 18 nt, Human
cagccaauuauguuaaac

SEQ ID NO: 2436956 - RNA, 17 nt, Human
cagccaauuauguuaaa

SEQ ID NO: 2436957 - RNA, 17 nt, Human
cagccaagcacaguggu

SEQ ID NO: 2436958 - RNA, 16 nt, Human
cagccaagcacagugg

SEQ ID NO: 2436959 - RNA, 14 nt, Human
cagccaagcacagu

SEQ ID NO: 2436960 - RNA, 13 nt, Human
cagccaagcacag

SEQ ID NO: 2436961 - RNA, 23 nt, Human
cagccaagcacagugguggcagg

SEQ ID NO: 2436962 - RNA, 19 nt, Human
cagccaagcacaguggugg

SEQ ID NO: 2436963 - RNA, 20 nt, Human
cagccaagggaugaaagaga

SEQ ID NO: 2436964 - RNA, 23 nt, Human
cagccaaggccgaagcucuggcu

SEQ ID NO: 2436965 - RNA, 22 nt, Human
cagccaaggccgaagcucuggc

SEQ ID NO: 2436966 - RNA, 21 nt, Human
cagccaaggccgaagcucugg

SEQ ID NO: 2436967 - RNA, 23 nt, Human
cagccaagguuuuauaaggcuga

SEQ ID NO: 2436968 - RNA, 15 nt, Human
cagccacacacacag

SEQ ID NO: 2436969 - RNA, 16 nt, Human
cagccacacacacaga

SEQ ID NO: 2436970 - RNA, 17 nt, Human
cagccacacacacagaa

SEQ ID NO: 2436971 - RNA, 18 nt, Human
cagccacacacacagaaa

SEQ ID NO: 2436972 - RNA, 19 nt, Human
cagccacacacacagaaaa

SEQ ID NO: 2436973 - RNA, 20 nt, Human
cagccacacacacagaaaau

SEQ ID NO: 2436974 - RNA, 21 nt, Human
cagccacacacacagaaaaua

SEQ ID NO: 2436975 - RNA, 22 nt, Human
cagccacacacacagaaaauau

SEQ ID NO: 2436976 - RNA, 14 nt, Human
cagccacauuccug

SEQ ID NO: 2436977 - RNA, 23 nt, Human
cagccacacacacagaaaauaua

SEQ ID NO: 2436978 - RNA, 12 nt, Human
cagccacacugu

SEQ ID NO: 2436979 - RNA, 22 nt, Human
cagccacggccaggccagaggg

SEQ ID NO: 2436980 - RNA, 21 nt, Human
cagccacggccaggccagagg

SEQ ID NO: 2436981 - RNA, 19 nt, Human
cagccacggccaggccaga

SEQ ID NO: 2436982 - RNA, 18 nt, Human
cagccacggccaggccag

SEQ ID NO: 2436983 - RNA, 17 nt, Human
cagccacggccaggcca

SEQ ID NO: 2436984 - RNA, 16 nt, Human
cagccacggccaggcc

SEQ ID NO: 2436985 - RNA, 15 nt, Human
cagccacggccaggc

SEQ ID NO: 2436986 - RNA, 14 nt, Human
cagccacggccagg

SEQ ID NO: 2436987 - RNA, 22 nt, Human
cagccagaacguggcucugcug

SEQ ID NO: 2436988 - RNA, 21 nt, Human
cagccagaacguggcucugcu

SEQ ID NO: 2436989 - RNA, 20 nt, Human
cagccagaacguggcucugc

SEQ ID NO: 2436990 - RNA, 23 nt, Human
cagccagaacguggcucugcugg

SEQ ID NO: 2436991 - RNA, 23 nt, Human
cagccacucgggaggcugagaca

SEQ ID NO: 2436992 - RNA, 17 nt, Human
cagccagaacguggcuc

SEQ ID NO: 2436993 - RNA, 21 nt, Human
cagccacucgggaggcugaga

SEQ ID NO: 2436994 - RNA, 14 nt, Human
cagccacucgggag

SEQ ID NO: 2436995 - RNA, 23 nt, Human
cagccacggccaggccagaggga

SEQ ID NO: 2436996 - RNA, 22 nt, Human
cagccaguaaaugggggugcau

SEQ ID NO: 2436997 - RNA, 13 nt, Human
cagccaguaaaug

SEQ ID NO: 2436998 - RNA, 22 nt, Human
cagccagucccguuucauuuag

SEQ ID NO: 2436999 - RNA, 16 nt, Human
cagccagugaccugag

SEQ ID NO: 2437000 - RNA, 19 nt, Human
cagccagugaccugaggaa

SEQ ID NO: 2437001 - RNA, 13 nt, Human
cagccaucaaaau

SEQ ID NO: 2437002 - RNA, 21 nt, Human
cagccauacuuaucucucugu

SEQ ID NO: 2437003 - RNA, 20 nt, Human
cagccauacuuaucucucug

SEQ ID NO: 2437004 - RNA, 23 nt, Human
cagccauacuuaucucucugugc

SEQ ID NO: 2437005 - RNA, 20 nt, Human
cagccagugaccugaggaag

SEQ ID NO: 2437006 - RNA, 21 nt, Human
cagccagugaccugaggaagc

SEQ ID NO: 2437007 - RNA, 22 nt, Human
cagccagugaccugaggaagcg

SEQ ID NO: 2437008 - RNA, 13 nt, Human
cagcccagcccag

SEQ ID NO: 2437009 - RNA, 15 nt, Human
cagcccagcccagcu

SEQ ID NO: 2437010 - RNA, 17 nt, Human
cagcccagcccagcugg

SEQ ID NO: 2437011 - RNA, 21 nt, Human
cagcccagggcuccugcacuu

SEQ ID NO: 2437012 - RNA, 19 nt, Human
cagcccagggcuccugcac

SEQ ID NO: 2437013 - RNA, 18 nt, Human
cagcccagggcuccugca

SEQ ID NO: 2437014 - RNA, 17 nt, Human
cagcccagggcuccugc

SEQ ID NO: 2437015 - RNA, 23 nt, Human
cagcccaggccgggguggagcau

SEQ ID NO: 2437016 - RNA, 16 nt, Human
cagcccagggcuccug

SEQ ID NO: 2437017 - RNA, 12 nt, Human
cagcccagggac

SEQ ID NO: 2437018 - RNA, 13 nt, Human
cagcccagagaca

SEQ ID NO: 2437019 - RNA, 21 nt, Human
cagcccagagacauacuugaa

SEQ ID NO: 2437020 - RNA, 22 nt, Human
cagcccagagacauacuugaag

SEQ ID NO: 2437021 - RNA, 18 nt, Human
cagcccacuucugccaua

SEQ ID NO: 2437022 - RNA, 11 nt, Human
cagcccagaga

SEQ ID NO: 2437023 - RNA, 12 nt, Human
cagcccagagac

SEQ ID NO: 2437024 - RNA, 20 nt, Human
cagcccacguccugucagug

SEQ ID NO: 2437025 - RNA, 21 nt, Human
cagccccaaaacucuccucug

SEQ ID NO: 2437026 - RNA, 20 nt, Human
cagccccaaaacucuccucu

SEQ ID NO: 2437027 - RNA, 22 nt, Human
cagccccaaaacucuccucugc

SEQ ID NO: 2437028 - RNA, 11 nt, Human
cagcccagggu

SEQ ID NO: 2437029 - RNA, 17 nt, Human
cagcccaggguuccccc

SEQ ID NO: 2437030 - RNA, 18 nt, Human
cagcccaggguuccccca

SEQ ID NO: 2437031 - RNA, 19 nt, Human
cagcccaggguucccccag

SEQ ID NO: 2437032 - RNA, 15 nt, Human
cagcccaugcccacc

SEQ ID NO: 2437033 - RNA, 16 nt, Human
cagcccaugcccaccu

SEQ ID NO: 2437034 - RNA, 17 nt, Human
cagcccaugcccaccug

SEQ ID NO: 2437035 - RNA, 24 nt, Human
cagcccaugcccaccugcccauca

SEQ ID NO: 2437036 - RNA, 19 nt, Human
cagcccaugcccaccugcc

SEQ ID NO: 2437037 - RNA, 21 nt, Human
cagcccaugcccaccugccca

SEQ ID NO: 2437038 - RNA, 18 nt, Human
cagcccauucucucuccu

SEQ ID NO: 2437039 - RNA, 20 nt, Human
cagcccauucucucuccugu

SEQ ID NO: 2437040 - RNA, 21 nt, Human
cagcccauucucucuccuguc

SEQ ID NO: 2437041 - RNA, 22 nt, Human
cagcccauucucucuccugucc

SEQ ID NO: 2437042 - RNA, 23 nt, Human
cagcccauucucucuccugucca

SEQ ID NO: 2437043 - RNA, 18 nt, Human
cagcccacccuccugucu

SEQ ID NO: 2437044 - RNA, 17 nt, Human
cagcccacccuccuguc

SEQ ID NO: 2437045 - RNA, 16 nt, Human
cagcccacccuccugu

SEQ ID NO: 2437046 - RNA, 15 nt, Human
cagcccacccuccug

SEQ ID NO: 2437047 - RNA, 13 nt, Human
cagcccacccucc

SEQ ID NO: 2437048 - RNA, 12 nt, Human
cagcccacccuc

SEQ ID NO: 2437049 - RNA, 24 nt, Human
cagcccacccuccugucuucccag

SEQ ID NO: 2437050 - RNA, 22 nt, Human
cagcccacccuccugucuuccc

SEQ ID NO: 2437051 - RNA, 21 nt, Human
cagcccacccuccugucuucc

SEQ ID NO: 2437052 - RNA, 16 nt, Human
cagcccaccuggcuuu

SEQ ID NO: 2437053 - RNA, 19 nt, Human
cagcccacguccugucagu

SEQ ID NO: 2437054 - RNA, 18 nt, Human
cagcccacguccugucag

SEQ ID NO: 2437055 - RNA, 16 nt, Human
cagcccacguccuguc

SEQ ID NO: 2437056 - RNA, 15 nt, Human
cagcccacguccugu

SEQ ID NO: 2437057 - RNA, 15 nt, Human
cagcccacuucugcc

SEQ ID NO: 2437058 - RNA, 10 nt, Human
cagcccaagu

SEQ ID NO: 2437059 - RNA, 22 nt, Human
cagccauuggcuauuuaaaacu

SEQ ID NO: 2437060 - RNA, 21 nt, Human
cagccaugugcugcgugccug

SEQ ID NO: 2437061 - RNA, 11 nt, Human
cagcccacccc

SEQ ID NO: 2437062 - RNA, 12 nt, Human
cagcccaccccc

SEQ ID NO: 2437063 - RNA, 19 nt, Human
cagcccacauagugauggu

SEQ ID NO: 2437064 - RNA, 14 nt, Human
cagcccaccccccu

SEQ ID NO: 2437065 - RNA, 16 nt, Human
cagcccaccccccuca

SEQ ID NO: 2437066 - RNA, 17 nt, Human
cagcccaccccccucau

SEQ ID NO: 2437067 - RNA, 19 nt, Human
cagcccaccccccucauuu

SEQ ID NO: 2437068 - RNA, 15 nt, Human
cagcccaccccucaa

SEQ ID NO: 2437069 - RNA, 18 nt, Human
cagccaucauaggaaggg

SEQ ID NO: 2437070 - RNA, 17 nt, Human
cagccaucccagccuug

SEQ ID NO: 2437071 - RNA, 19 nt, Human
cagccaucauaggaaggga

SEQ ID NO: 2437072 - RNA, 13 nt, Human
cagccaucugccc

SEQ ID NO: 2437073 - RNA, 16 nt, Human
cagccaucaaaaugcu

SEQ ID NO: 2437074 - RNA, 17 nt, Human
cagccaucaaaaugcuu

SEQ ID NO: 2437075 - RNA, 21 nt, Human
cagccaucugcccaggggugc

SEQ ID NO: 2437076 - RNA, 19 nt, Human
cagccaucugcccaggggu

SEQ ID NO: 2437077 - RNA, 17 nt, Human
cagccaugucugcauuu

SEQ ID NO: 2437078 - RNA, 18 nt, Human
cagccaugaggaguugcu

SEQ ID NO: 2437079 - RNA, 17 nt, Human
cagccaugugcugcgug

SEQ ID NO: 2437080 - RNA, 13 nt, Human
cagccaugugcug

SEQ ID NO: 2437081 - RNA, 16 nt, Human
cagccauuaccaugga

SEQ ID NO: 2437082 - RNA, 18 nt, Human
cagccaucugcccagggg

SEQ ID NO: 2437083 - RNA, 17 nt, Human
cagccaucugcccaggg

SEQ ID NO: 2437084 - RNA, 16 nt, Human
cagccaucugcccagg

SEQ ID NO: 2437085 - RNA, 15 nt, Human
cagccaucugcccag

SEQ ID NO: 2437086 - RNA, 22 nt, Human
cagccaugaggaguugcuguuu

SEQ ID NO: 2437087 - RNA, 16 nt, Human
cagcccaaaccaccag

SEQ ID NO: 2437088 - RNA, 19 nt, Human
cagcccaaaccaccagaag

SEQ ID NO: 2437089 - RNA, 20 nt, Human
cagccauuggcuauuuaaaa

SEQ ID NO: 2437090 - RNA, 19 nt, Human
cagccauuggcuauuuaaa

SEQ ID NO: 2437091 - RNA, 19 nt, Human
cagccauucacugccccca

SEQ ID NO: 2437092 - RNA, 20 nt, Human
cagccauuaccauggagaca

SEQ ID NO: 2437093 - RNA, 20 nt, Human
cagcccaaaccaccagaagc

SEQ ID NO: 2437094 - RNA, 21 nt, Human
cagcccaaaccaccagaagcc

SEQ ID NO: 2437095 - RNA, 23 nt, Human
cagcccaaaccaccagaagccca

SEQ ID NO: 2437096 - RNA, 17 nt, Human
cagcccaaagaaggaaa

SEQ ID NO: 2437097 - RNA, 14 nt, Human
cagaugcugauguu

SEQ ID NO: 2437098 - RNA, 13 nt, Human
cagaugcugaugu

SEQ ID NO: 2437099 - RNA, 18 nt, Human
cagaugcuggucaugugu

SEQ ID NO: 2437100 - RNA, 22 nt, Human
cagaugcugauguucaguguaa

SEQ ID NO: 2437101 - RNA, 21 nt, Human
cagaugcugauguucagugua

SEQ ID NO: 2437102 - RNA, 20 nt, Human
cagaugcugauguucagugu

SEQ ID NO: 2437103 - RNA, 18 nt, Human
cagaugcugauguucagu

SEQ ID NO: 2437104 - RNA, 17 nt, Human
cagaugcugauguucag

SEQ ID NO: 2437105 - RNA, 16 nt, Human
cagaugcugauguuca

SEQ ID NO: 2437106 - RNA, 15 nt, Human
cagaugcugauguuc

SEQ ID NO: 2437107 - RNA, 15 nt, Human
cagaugcugugcaaa

SEQ ID NO: 2437108 - RNA, 12 nt, Human
cagaugcuucug

SEQ ID NO: 2437109 - RNA, 13 nt, Human
cagaugcuucugg

SEQ ID NO: 2437110 - RNA, 17 nt, Human
cagaugcuucugggaga

SEQ ID NO: 2437111 - RNA, 22 nt, Human
cagaugccuccaccccccagaa

SEQ ID NO: 2437112 - RNA, 14 nt, Human
cagaugccuccacc

SEQ ID NO: 2437113 - RNA, 18 nt, Human
cagaugccccagagcugu

SEQ ID NO: 2437114 - RNA, 15 nt, Human
cagaugccccagagc

SEQ ID NO: 2437115 - RNA, 17 nt, Human
cagaugcagggcaguca

SEQ ID NO: 2437116 - RNA, 15 nt, Human
cagaugcccagaggg

SEQ ID NO: 2437117 - RNA, 19 nt, Human
cagaugcccagagggccca

SEQ ID NO: 2437118 - RNA, 20 nt, Human
cagaugcccagagggcccag

SEQ ID NO: 2437119 - RNA, 22 nt, Human
cagaugcccagagggcccaggc

SEQ ID NO: 2437120 - RNA, 13 nt, Human
cagaugccccaga

SEQ ID NO: 2437121 - RNA, 16 nt, Human
cagaugccccagagcu

SEQ ID NO: 2437122 - RNA, 14 nt, Human
cagauggggccucu

SEQ ID NO: 2437123 - RNA, 22 nt, Human
cagauggcauguguuuacuuua

SEQ ID NO: 2437124 - RNA, 18 nt, Human
cagaugggugcuuggagg

SEQ ID NO: 2437125 - RNA, 16 nt, Human
cagauggcauguguuu

SEQ ID NO: 2437126 - RNA, 12 nt, Human
cagauggcacuu

SEQ ID NO: 2437127 - RNA, 22 nt, Human
cagauggauuugccugugccac

SEQ ID NO: 2437128 - RNA, 19 nt, Human
cagauggacuccagccugc

SEQ ID NO: 2437129 - RNA, 18 nt, Human
cagauggacuccagccug

SEQ ID NO: 2437130 - RNA, 21 nt, Human
cagauggaaccgcaggaagcu

SEQ ID NO: 2437131 - RNA, 22 nt, Human
cagauggaaccgcaggaagcug

SEQ ID NO: 2437132 - RNA, 23 nt, Human
cagauggauugauaauugcauuc

SEQ ID NO: 2437133 - RNA, 22 nt, Human
cagauggauugauaauugcauu

SEQ ID NO: 2437134 - RNA, 15 nt, Human
cagauggauuugccu

SEQ ID NO: 2437135 - RNA, 21 nt, Human
cagauggauuugccugugcca

SEQ ID NO: 2437136 - RNA, 21 nt, Human
cagauggaaugcuguguuaaa

SEQ ID NO: 2437137 - RNA, 19 nt, Human
cagauggaaugcuguguua

SEQ ID NO: 2437138 - RNA, 17 nt, Human
cagauggaaugcugugu

SEQ ID NO: 2437139 - RNA, 16 nt, Human
cagauggaaugcugug

SEQ ID NO: 2437140 - RNA, 21 nt, Human
cagaugcuuuccugcacauua

SEQ ID NO: 2437141 - RNA, 14 nt, Human
cagaugcuuuccug

SEQ ID NO: 2437142 - RNA, 14 nt, Human
cagauggaaccgca

SEQ ID NO: 2437143 - RNA, 18 nt, Human
cagauggaaccgcaggaa

SEQ ID NO: 2437144 - RNA, 19 nt, Human
cagauggaaccgcaggaag

SEQ ID NO: 2437145 - RNA, 20 nt, Human
cagauggaaccgcaggaagc

SEQ ID NO: 2437146 - RNA, 14 nt, Human
cagaugcuuuucug

SEQ ID NO: 2437147 - RNA, 22 nt, Human
cagaugguuuuauaaucugauu

SEQ ID NO: 2437148 - RNA, 19 nt, Human
cagaugggggaaagcacag

SEQ ID NO: 2437149 - RNA, 14 nt, Human
cagaugggggaaag

SEQ ID NO: 2437150 - RNA, 21 nt, Human
cagauggggcucccgcccgug

SEQ ID NO: 2437151 - RNA, 15 nt, Human
cagauggggccucug

SEQ ID NO: 2437152 - RNA, 23 nt, Human
cagaugggugcuuggaggaagga

SEQ ID NO: 2437153 - RNA, 16 nt, Human
cagaugucuucugccu

SEQ ID NO: 2437154 - RNA, 15 nt, Human
cagaugucuucugcc

SEQ ID NO: 2437155 - RNA, 13 nt, Human
cagaugucuucug

SEQ ID NO: 2437156 - RNA, 20 nt, Human
cagaugugguaacuguuaaa

SEQ ID NO: 2437157 - RNA, 18 nt, Human
cagaugucuucugccugu

SEQ ID NO: 2437158 - RNA, 17 nt, Human
cagaugucuucugccug

SEQ ID NO: 2437159 - RNA, 22 nt, Human
cagaugucuucugccuguuaua

SEQ ID NO: 2437160 - RNA, 15 nt, Human
cagauguuuccagac

SEQ ID NO: 2437161 - RNA, 16 nt, Human
cagauguuuccagacu

SEQ ID NO: 2437162 - RNA, 14 nt, Human
cagauguuuccaga

SEQ ID NO: 2437163 - RNA, 19 nt, Human
cagauguucucucccaggg

SEQ ID NO: 2437164 - RNA, 23 nt, Human
cagauguugaaugcccacaggca

SEQ ID NO: 2437165 - RNA, 14 nt, Human
cagauucccagagc

SEQ ID NO: 2437166 - RNA, 17 nt, Human
cagauucccagagcaaa

SEQ ID NO: 2437167 - RNA, 15 nt, Human
cagauucauuuuucu

SEQ ID NO: 2437168 - RNA, 21 nt, Human
cagauuccaggcgaugugcaa

SEQ ID NO: 2437169 - RNA, 23 nt, Human
cagauuccaggcgaugugcaagu

SEQ ID NO: 2437170 - RNA, 18 nt, Human
cagauucccagagcaaaa

SEQ ID NO: 2437171 - RNA, 19 nt, Human
cagauucccagagcaaaau

SEQ ID NO: 2437172 - RNA, 21 nt, Human
cagauucccagagcaaaauaa

SEQ ID NO: 2437173 - RNA, 19 nt, Human
cagauucacacugucuggu

SEQ ID NO: 2437174 - RNA, 14 nt, Human
cagauucacacugu

SEQ ID NO: 2437175 - RNA, 18 nt, Human
cagauguuuccagacuuc

SEQ ID NO: 2437176 - RNA, 23 nt, Human
cagauguuuccagacuuccuuga

SEQ ID NO: 2437177 - RNA, 22 nt, Human
cagauguuucuuuuguauguaa

SEQ ID NO: 2437178 - RNA, 19 nt, Human
cagauguuucuuuuguaug

SEQ ID NO: 2437179 - RNA, 14 nt, Human
cagauguuucuuuu

SEQ ID NO: 2437180 - RNA, 22 nt, Human
cagauguuuuacgucugggaga

SEQ ID NO: 2437181 - RNA, 18 nt, Human
cagauguuuuacgucugg

SEQ ID NO: 2437182 - RNA, 17 nt, Human
cagauguuuuacgucug

SEQ ID NO: 2437183 - RNA, 14 nt, Human
cagauuacugccca

SEQ ID NO: 2437184 - RNA, 21 nt, Human
cagcaaagccccaugcuggag

SEQ ID NO: 2437185 - RNA, 14 nt, Human
cagcaaagccccau

SEQ ID NO: 2437186 - RNA, 13 nt, Human
cagcaaagcccca

SEQ ID NO: 2437187 - RNA, 12 nt, Human
cagcaaagcccc

SEQ ID NO: 2437188 - RNA, 19 nt, Human
cagcaaagagugggcugca

SEQ ID NO: 2437189 - RNA, 20 nt, Human
cagcaaacucuuuucccacu

SEQ ID NO: 2437190 - RNA, 22 nt, Human
cagcaaaaugugaaugggaaaa

SEQ ID NO: 2437191 - RNA, 14 nt, Human
cagcaaaccggggc

SEQ ID NO: 2437192 - RNA, 16 nt, Human
cagcaaaccggggccu

SEQ ID NO: 2437193 - RNA, 15 nt, Human
cagcaaaaagcaaaa

SEQ ID NO: 2437194 - RNA, 18 nt, Human
cagcaaaagaugcuucuc

SEQ ID NO: 2437195 - RNA, 15 nt, Human
cagcaaaacuccauc

SEQ ID NO: 2437196 - RNA, 23 nt, Human
cagcaaagccccaugcuggagcc

SEQ ID NO: 2437197 - RNA, 22 nt, Human
cagcaaagccccaugcuggagc

SEQ ID NO: 2437198 - RNA, 17 nt, Human
cagcaaauuaauuggca

SEQ ID NO: 2437199 - RNA, 16 nt, Human
cagcaacacaagcugg

SEQ ID NO: 2437200 - RNA, 23 nt, Human
cagcaaauuaauuggcagcagau

SEQ ID NO: 2437201 - RNA, 22 nt, Human
cagcaaauuaauuggcagcaga

SEQ ID NO: 2437202 - RNA, 19 nt, Human
cagcaaauuaauuggcagc

SEQ ID NO: 2437203 - RNA, 20 nt, Human
cagcaacggggaggccaagu

SEQ ID NO: 2437204 - RNA, 13 nt, Human
cagcaacugaaua

SEQ ID NO: 2437205 - RNA, 12 nt, Human
cagcaacugaau

SEQ ID NO: 2437206 - RNA, 14 nt, Human
cagcaacuccaacu

SEQ ID NO: 2437207 - RNA, 21 nt, Human
cagcaacugaauaaauaccuc

SEQ ID NO: 2437208 - RNA, 15 nt, Human
cagcaacugaauaaa

SEQ ID NO: 2437209 - RNA, 14 nt, Human
cagcaacugaauaa

SEQ ID NO: 2437210 - RNA, 20 nt, Human
cagcaacugaauaaauaccu

SEQ ID NO: 2437211 - RNA, 15 nt, Human
cagcaacuugucuuu

SEQ ID NO: 2437212 - RNA, 18 nt, Human
cagcaacuugucuuuuuc

SEQ ID NO: 2437213 - RNA, 19 nt, Human
cagcaacuugucuuuuucu

SEQ ID NO: 2437214 - RNA, 22 nt, Human
cagcaacuugucuuuuucugga

SEQ ID NO: 2437215 - RNA, 23 nt, Human
cagcaacgcaggcccccaggugc

SEQ ID NO: 2437216 - RNA, 13 nt, Human
cagcaaccccagg

SEQ ID NO: 2437217 - RNA, 16 nt, Human
cagcaaccccaggcug

SEQ ID NO: 2437218 - RNA, 17 nt, Human
cagcaaccccaggcuga

SEQ ID NO: 2437219 - RNA, 14 nt, Human
cagcaacccuccua

SEQ ID NO: 2437220 - RNA, 12 nt, Human
cagcaaccccag

SEQ ID NO: 2437221 - RNA, 21 nt, Human
cagcaacacaagcuggaagca

SEQ ID NO: 2437222 - RNA, 17 nt, Human
cagcaacacaagcugga

SEQ ID NO: 2437223 - RNA, 13 nt, Human
cagauuuucagca

SEQ ID NO: 2437224 - RNA, 15 nt, Human
cagauuuucagcaaa

SEQ ID NO: 2437225 - RNA, 23 nt, Human
cagauuugugaacucagccaagc

SEQ ID NO: 2437226 - RNA, 17 nt, Human
cagauuugugaacucag

SEQ ID NO: 2437227 - RNA, 16 nt, Human
cagauuugugaacuca

SEQ ID NO: 2437228 - RNA, 15 nt, Human
cagauuugugaacuc

SEQ ID NO: 2437229 - RNA, 14 nt, Human
cagauuugugaacu

SEQ ID NO: 2437230 - RNA, 12 nt, Human
cagauuugugaa

SEQ ID NO: 2437231 - RNA, 14 nt, Human
cagauucuuuccug

SEQ ID NO: 2437232 - RNA, 18 nt, Human
cagauuuuaggaaaugaa

SEQ ID NO: 2437233 - RNA, 22 nt, Human
cagauuuuaaaaagucuucacu

SEQ ID NO: 2437234 - RNA, 14 nt, Human
cagauuuguguuau

SEQ ID NO: 2437235 - RNA, 24 nt, Human
cagauuugugaacucagccaagca

SEQ ID NO: 2437236 - RNA, 23 nt, Human
cagauuuuaauuuugaauaaaua

SEQ ID NO: 2437237 - RNA, 15 nt, Human
cagauuuuaauuuug

SEQ ID NO: 2437238 - RNA, 15 nt, Human
cagauuuuccugaaa

SEQ ID NO: 2437239 - RNA, 14 nt, Human
cagauuuuccugaa

SEQ ID NO: 2437240 - RNA, 19 nt, Human
cagauuuugauagcaaagc

SEQ ID NO: 2437241 - RNA, 18 nt, Human
cagauuuugauagcaaag

SEQ ID NO: 2437242 - RNA, 20 nt, Human
cagauuuugauagcaaagcg

SEQ ID NO: 2437243 - RNA, 16 nt, Human
cagauuuugcuguaua

SEQ ID NO: 2437244 - RNA, 17 nt, Human
cagauuuugcuguauau

SEQ ID NO: 2437245 - RNA, 19 nt, Human
cagauuuucagcaaacucu

SEQ ID NO: 2437246 - RNA, 22 nt, Human
cagauuuucagcaaacucuuuu

SEQ ID NO: 2437247 - RNA, 16 nt, Human
cagauuuugauagcaa

SEQ ID NO: 2437248 - RNA, 23 nt, Human
cagauuuugggguuguguuguca

SEQ ID NO: 2437249 - RNA, 21 nt, Human
cagauuuugggguuguguugu

SEQ ID NO: 2437250 - RNA, 19 nt, Human
cagauuuugcuguauauuu

SEQ ID NO: 2437251 - RNA, 23 nt, Human
cagauuuugcuguauauuuguga

SEQ ID NO: 2437252 - RNA, 20 nt, Human
cagauuuugggguuguguug

SEQ ID NO: 2437253 - RNA, 16 nt, Human
cagauuuuuacacaug

SEQ ID NO: 2437254 - RNA, 19 nt, Human
cagauuuuuuacagcugcc

SEQ ID NO: 2437255 - RNA, 20 nt, Human
cagcaaaaagcaaaaucauu

SEQ ID NO: 2437256 - RNA, 14 nt, Human
cagcaaaaagcaaa

SEQ ID NO: 2437257 - RNA, 13 nt, Human
cagcaaaaagcaa

SEQ ID NO: 2437258 - RNA, 22 nt, Human
cagauuuuuuacagcugccugc

SEQ ID NO: 2437259 - RNA, 15 nt, Human
cagauuuuuacaaau

SEQ ID NO: 2437260 - RNA, 14 nt, Human
cagauuuuuacaaa

SEQ ID NO: 2437261 - RNA, 13 nt, Human
cagcagauuuuag

SEQ ID NO: 2437262 - RNA, 17 nt, Human
cagcagaucccagcuca

SEQ ID NO: 2437263 - RNA, 18 nt, Human
cagcagaucccagcucac

SEQ ID NO: 2437264 - RNA, 21 nt, Human
cagcagaucccagcucacguc

SEQ ID NO: 2437265 - RNA, 16 nt, Human
cagcagaggcacuggg

SEQ ID NO: 2437266 - RNA, 15 nt, Human
cagcagaggcacugg

SEQ ID NO: 2437267 - RNA, 13 nt, Human
cagcagagugugg

SEQ ID NO: 2437268 - RNA, 15 nt, Human
cagcagaucccagcu

SEQ ID NO: 2437269 - RNA, 16 nt, Human
cagcagaucccagcuc

SEQ ID NO: 2437270 - RNA, 23 nt, Human
cagcagcccuaaggaucucucag

SEQ ID NO: 2437271 - RNA, 20 nt, Human
cagcagcccuaaggaucucu

SEQ ID NO: 2437272 - RNA, 16 nt, Human
cagcagcccuaaggau

SEQ ID NO: 2437273 - RNA, 11 nt, Human
cagcagcccua

SEQ ID NO: 2437274 - RNA, 23 nt, Human
cagcagccccugcacaaagcccu

SEQ ID NO: 2437275 - RNA, 16 nt, Human
cagcagccccugcaca

SEQ ID NO: 2437276 - RNA, 13 nt, Human
cagcagccccugc

SEQ ID NO: 2437277 - RNA, 18 nt, Human
cagcagcccuccucaccc

SEQ ID NO: 2437278 - RNA, 24 nt, Human
cagcagcccuaaggaucucucagg

SEQ ID NO: 2437279 - RNA, 11 nt, Human
cagcagcccuc

SEQ ID NO: 2437280 - RNA, 12 nt, Human
cagcagcccucc

SEQ ID NO: 2437281 - RNA, 14 nt, Human
cagcagcccuccuc

SEQ ID NO: 2437282 - RNA, 15 nt, Human
cagcagcccuccuca

SEQ ID NO: 2437283 - RNA, 17 nt, Human
cagcagcccuccucacc

SEQ ID NO: 2437284 - RNA, 19 nt, Human
cagcagcccuccucacccc

SEQ ID NO: 2437285 - RNA, 22 nt, Human
cagcagccaucauaggaaggga

SEQ ID NO: 2437286 - RNA, 21 nt, Human
cagcagccaucauaggaaggg

SEQ ID NO: 2437287 - RNA, 18 nt, Human
cagcagccaucauaggaa

SEQ ID NO: 2437288 - RNA, 20 nt, Human
cagcagccagcucucagcca

SEQ ID NO: 2437289 - RNA, 21 nt, Human
cagcagccagcucucagccaa

SEQ ID NO: 2437290 - RNA, 13 nt, Human
cagcagccagcuc

SEQ ID NO: 2437291 - RNA, 14 nt, Human
cagcagccagcucu

SEQ ID NO: 2437292 - RNA, 15 nt, Human
cagcagccagcucuc

SEQ ID NO: 2437293 - RNA, 17 nt, Human
cagcagccagcucucag

SEQ ID NO: 2437294 - RNA, 18 nt, Human
cagcagccagcucucagc

SEQ ID NO: 2437295 - RNA, 19 nt, Human
cagcagccagcucucagcc

SEQ ID NO: 2437296 - RNA, 15 nt, Human
cagcagaaaugccuu

SEQ ID NO: 2437297 - RNA, 17 nt, Human
cagcagaaaugccuuac

SEQ ID NO: 2437298 - RNA, 20 nt, Human
cagcacuuugggaggccaag

SEQ ID NO: 2437299 - RNA, 22 nt, Human
cagcacuuugggaggccaagga

SEQ ID NO: 2437300 - RNA, 23 nt, Human
cagcacuuugggaggccaaggag

SEQ ID NO: 2437301 - RNA, 22 nt, Human
cagcacuuugggaggccuaggc

SEQ ID NO: 2437302 - RNA, 18 nt, Human
cagcacuuugggaggcug

SEQ ID NO: 2437303 - RNA, 19 nt, Human
cagcacuuugggaggcuga

SEQ ID NO: 2437304 - RNA, 20 nt, Human
cagcacuuugggaggcugag

SEQ ID NO: 2437305 - RNA, 22 nt, Human
cagcacuuugggaggcugaggc

SEQ ID NO: 2437306 - RNA, 23 nt, Human
cagcacuuugggaggcugaggcg

SEQ ID NO: 2437307 - RNA, 18 nt, Human
cagcacuuguccagcuga

SEQ ID NO: 2437308 - RNA, 19 nt, Human
cagcacuuguccagcugag

SEQ ID NO: 2437309 - RNA, 15 nt, Human
cagcacuuugggagg

SEQ ID NO: 2437310 - RNA, 16 nt, Human
cagcacuuugggaggc

SEQ ID NO: 2437311 - RNA, 18 nt, Human
cagcacuuugggaggcca

SEQ ID NO: 2437312 - RNA, 13 nt, Human
cagcacuuguaua

SEQ ID NO: 2437313 - RNA, 15 nt, Human
cagcacuuguccagc

SEQ ID NO: 2437314 - RNA, 17 nt, Human
cagcacuuguccagcug

SEQ ID NO: 2437315 - RNA, 19 nt, Human
cagcacuuggagaggcuga

SEQ ID NO: 2437316 - RNA, 13 nt, Human
cagcacuuauuua

SEQ ID NO: 2437317 - RNA, 15 nt, Human
cagcacugucucagu

SEQ ID NO: 2437318 - RNA, 23 nt, Human
cagcacugucucaguuucacuuu

SEQ ID NO: 2437319 - RNA, 19 nt, Human
cagcagaaaugccuuaccc

SEQ ID NO: 2437320 - RNA, 22 nt, Human
cagcagaaaugccuuacccuca

SEQ ID NO: 2437321 - RNA, 17 nt, Human
cagcagaaggggguggu

SEQ ID NO: 2437322 - RNA, 13 nt, Human
cagcagaaggggg

SEQ ID NO: 2437323 - RNA, 18 nt, Human
cagcacuuugggaggccu

SEQ ID NO: 2437324 - RNA, 13 nt, Human
cagcagagcaccu

SEQ ID NO: 2437325 - RNA, 11 nt, Human
cagcagagcac

SEQ ID NO: 2437326 - RNA, 16 nt, Human
cagcagacauugucag

SEQ ID NO: 2437327 - RNA, 14 nt, Human
cagcagacauuguc

SEQ ID NO: 2437328 - RNA, 13 nt, Human
cagcagacauugu

SEQ ID NO: 2437329 - RNA, 17 nt, Human
cagcagacauugucagc

SEQ ID NO: 2437330 - RNA, 14 nt, Human
cagcagacuaugaa

SEQ ID NO: 2437331 - RNA, 21 nt, Human
cagcagagacuugggacauug

SEQ ID NO: 2437332 - RNA, 19 nt, Human
cagcagagacuugggacau

SEQ ID NO: 2437333 - RNA, 18 nt, Human
cagcagagacuugggaca

SEQ ID NO: 2437334 - RNA, 13 nt, Human
cagcaauaaagca

SEQ ID NO: 2437335 - RNA, 21 nt, Human
cagcaauaaagcagcguuucu

SEQ ID NO: 2437336 - RNA, 21 nt, Human
cagcaagugagagcugggugu

SEQ ID NO: 2437337 - RNA, 19 nt, Human
cagcaagugagagcugggu

SEQ ID NO: 2437338 - RNA, 22 nt, Human
cagcaauaaagcagcguuucua

SEQ ID NO: 2437339 - RNA, 20 nt, Human
cagcaaugauguccagaaga

SEQ ID NO: 2437340 - RNA, 18 nt, Human
cagcaaugauguccagaa

SEQ ID NO: 2437341 - RNA, 21 nt, Human
cagcaaugacaucucaggggc

SEQ ID NO: 2437342 - RNA, 20 nt, Human
cagcaaugacaucucagggg

SEQ ID NO: 2437343 - RNA, 22 nt, Human
cagcaaugauguccagaagaau

SEQ ID NO: 2437344 - RNA, 15 nt, Human
cagcaauauguaaau

SEQ ID NO: 2437345 - RNA, 19 nt, Human
cagcaaugacaucucaggg

SEQ ID NO: 2437346 - RNA, 16 nt, Human
cagcaauauguaaaua

SEQ ID NO: 2437347 - RNA, 18 nt, Human
cagcaaugacaucucagg

SEQ ID NO: 2437348 - RNA, 15 nt, Human
cagcaauucuccugc

SEQ ID NO: 2437349 - RNA, 16 nt, Human
cagcaauucuccugcc

SEQ ID NO: 2437350 - RNA, 17 nt, Human
cagcaauucuccugccu

SEQ ID NO: 2437351 - RNA, 18 nt, Human
cagcaauucuccugccuc

SEQ ID NO: 2437352 - RNA, 19 nt, Human
cagcaauucuccugccuca

SEQ ID NO: 2437353 - RNA, 20 nt, Human
cagcaauucuccugccucag

SEQ ID NO: 2437354 - RNA, 13 nt, Human
cagcacaaggcca

SEQ ID NO: 2437355 - RNA, 16 nt, Human
cagcacaaggccaucu

SEQ ID NO: 2437356 - RNA, 13 nt, Human
cagcacacagggc

SEQ ID NO: 2437357 - RNA, 14 nt, Human
cagcacacagggca

SEQ ID NO: 2437358 - RNA, 14 nt, Human
cagcacugucccuu

SEQ ID NO: 2437359 - RNA, 13 nt, Human
cagcacugucccu

SEQ ID NO: 2437360 - RNA, 12 nt, Human
cagcacuguccc

SEQ ID NO: 2437361 - RNA, 15 nt, Human
cagcacacagggcag

SEQ ID NO: 2437362 - RNA, 18 nt, Human
cagcacugucccuugccu

SEQ ID NO: 2437363 - RNA, 16 nt, Human
cagcacugucccuugc

SEQ ID NO: 2437364 - RNA, 20 nt, Human
cagcacugucccuugccuca

SEQ ID NO: 2437365 - RNA, 14 nt, Human
cagcacugucucag

SEQ ID NO: 2437366 - RNA, 23 nt, Human
cagcacuggcucucuccaggauc

SEQ ID NO: 2437367 - RNA, 23 nt, Human
cagcaaggcaccugcagguuggg

SEQ ID NO: 2437368 - RNA, 19 nt, Human
cagcaagggugaugggaaa

SEQ ID NO: 2437369 - RNA, 17 nt, Human
cagcaaggcaccugcag

SEQ ID NO: 2437370 - RNA, 16 nt, Human
cagcaaggcaccugca

SEQ ID NO: 2437371 - RNA, 15 nt, Human
cagcaaggcaccugc

SEQ ID NO: 2437372 - RNA, 22 nt, Human
cagcaaggaggcuggcuggggc

SEQ ID NO: 2437373 - RNA, 21 nt, Human
cagcaaggaggcuggcugggg

SEQ ID NO: 2437374 - RNA, 20 nt, Human
cagcaaggaggcuggcuggg

SEQ ID NO: 2437375 - RNA, 19 nt, Human
cagcaaggaggcuggcugg

SEQ ID NO: 2437376 - RNA, 18 nt, Human
cagcaaggaggcuggcug

SEQ ID NO: 2437377 - RNA, 18 nt, Human
cagcaaggagauuuacaa

SEQ ID NO: 2437378 - RNA, 17 nt, Human
cagcaaggagauuuaca

SEQ ID NO: 2437379 - RNA, 22 nt, Human
cagcaagaagauccuaaaacaa

SEQ ID NO: 2437380 - RNA, 20 nt, Human
cagcaacuugucuuuuucug

SEQ ID NO: 2437381 - RNA, 17 nt, Human
cagcaagugagagcugg

SEQ ID NO: 2437382 - RNA, 16 nt, Human
cagcaagugagagcug

SEQ ID NO: 2437383 - RNA, 15 nt, Human
cagcaagugagagcu

SEQ ID NO: 2437384 - RNA, 14 nt, Human
cagcaagugagagc

SEQ ID NO: 2437385 - RNA, 22 nt, Human
cagcaagggugaugggaaagca

SEQ ID NO: 2437386 - RNA, 23 nt, Human
cagcaagggugaugggaaagcau

SEQ ID NO: 2437387 - RNA, 12 nt, Human
cagcaagugaga

SEQ ID NO: 2437388 - RNA, 14 nt, Human
cagcaagucucuuu

SEQ ID NO: 2437389 - RNA, 15 nt, Human
cagcaagucaggguu

SEQ ID NO: 2437390 - RNA, 22 nt, Human
cagugcucgcuguugcugaaua

SEQ ID NO: 2437391 - RNA, 21 nt, Human
cagugcucgcuguugcugaau

SEQ ID NO: 2437392 - RNA, 20 nt, Human
cagugcucgcuguugcugaa

SEQ ID NO: 2437393 - RNA, 19 nt, Human
cagugcucgcuguugcuga

SEQ ID NO: 2437394 - RNA, 18 nt, Human
cagugcucgcuguugcug

SEQ ID NO: 2437395 - RNA, 17 nt, Human
cagugcucgcuguugcu

SEQ ID NO: 2437396 - RNA, 16 nt, Human
cagugcucgcuguugc

SEQ ID NO: 2437397 - RNA, 15 nt, Human
cagugcucgcuguug

SEQ ID NO: 2437398 - RNA, 14 nt, Human
cagugcucgcuguu

SEQ ID NO: 2437399 - RNA, 14 nt, Human
cagugcucccucac

SEQ ID NO: 2437400 - RNA, 23 nt, Human
cagugcuauuuugugcccacugu

SEQ ID NO: 2437401 - RNA, 22 nt, Human
cagugcuaaaaaugggacuucu

SEQ ID NO: 2437402 - RNA, 20 nt, Human
cagugcuaaaaaugggacuu

SEQ ID NO: 2437403 - RNA, 19 nt, Human
cagugcuaaaaaugggacu

SEQ ID NO: 2437404 - RNA, 17 nt, Human
cagugcuaaaaauggga

SEQ ID NO: 2437405 - RNA, 16 nt, Human
cagugcuaaaaauggg

SEQ ID NO: 2437406 - RNA, 15 nt, Human
cagugcuaaaaaugg

SEQ ID NO: 2437407 - RNA, 14 nt, Human
cagugcuaaaaaug

SEQ ID NO: 2437408 - RNA, 22 nt, Human
cagugccuuggggaauuuccuc

SEQ ID NO: 2437409 - RNA, 21 nt, Human
cagugccuuggggaauuuccu

SEQ ID NO: 2437410 - RNA, 14 nt, Human
cagugccuugggga

SEQ ID NO: 2437411 - RNA, 22 nt, Human
cagugccuuccuguuuuucaca

SEQ ID NO: 2437412 - RNA, 18 nt, Human
cagugcgauucuggauaa

SEQ ID NO: 2437413 - RNA, 24 nt, Human
cagugcgcgugcacguggagagcu

SEQ ID NO: 2437414 - RNA, 23 nt, Human
cagugccuuauggaacacucuga

SEQ ID NO: 2437415 - RNA, 16 nt, Human
cagugccuucaauaaa

SEQ ID NO: 2437416 - RNA, 15 nt, Human
cagugccuucaauaa

SEQ ID NO: 2437417 - RNA, 18 nt, Human
cagugccuucaauaaaug

SEQ ID NO: 2437418 - RNA, 14 nt, Human
cagugccuuccaua

SEQ ID NO: 2437419 - RNA, 15 nt, Human
cagugccuuccauaa

SEQ ID NO: 2437420 - RNA, 16 nt, Human
cagugccuuccauaau

SEQ ID NO: 2437421 - RNA, 17 nt, Human
cagugccuuccauaauu

SEQ ID NO: 2437422 - RNA, 23 nt, Human
cagugccuuccauaauuaugaca

SEQ ID NO: 2437423 - RNA, 12 nt, Human
cagugcccccac

SEQ ID NO: 2437424 - RNA, 15 nt, Human
cagugcccccacuga

SEQ ID NO: 2437425 - RNA, 17 nt, Human
cagugcccccacugacc

SEQ ID NO: 2437426 - RNA, 20 nt, Human
cagugcccccacugaccaga

SEQ ID NO: 2437427 - RNA, 21 nt, Human
cagugcccccacugaccagaa

SEQ ID NO: 2437428 - RNA, 22 nt, Human
cagugcccccacugaccagaac

SEQ ID NO: 2437429 - RNA, 23 nt, Human
cagugcccccacugaccagaacu

SEQ ID NO: 2437430 - RNA, 19 nt, Human
cagugcccauuccucaccu

SEQ ID NO: 2437431 - RNA, 14 nt, Human
cagugccccuagcu

SEQ ID NO: 2437432 - RNA, 17 nt, Human
cagugcccucauuuuau

SEQ ID NO: 2437433 - RNA, 19 nt, Human
cagugcccucauuuuaugu

SEQ ID NO: 2437434 - RNA, 15 nt, Human
cagugcccuccagga

SEQ ID NO: 2437435 - RNA, 18 nt, Human
cagugauuaccagggacu

SEQ ID NO: 2437436 - RNA, 17 nt, Human
cagugaugggagaguag

SEQ ID NO: 2437437 - RNA, 23 nt, Human
cagugauguaccaugaaacaaag

SEQ ID NO: 2437438 - RNA, 14 nt, Human
cagugcccauuccu

SEQ ID NO: 2437439 - RNA, 18 nt, Human
cagugcccauuccucacc

SEQ ID NO: 2437440 - RNA, 17 nt, Human
cagugauuaccagggac

SEQ ID NO: 2437441 - RNA, 17 nt, Human
cagugaucaaaguccga

SEQ ID NO: 2437442 - RNA, 13 nt, Human
cagugaucuccau

SEQ ID NO: 2437443 - RNA, 15 nt, Human
cagugaucuccauau

SEQ ID NO: 2437444 - RNA, 16 nt, Human
cagugaucuccauaug

SEQ ID NO: 2437445 - RNA, 21 nt, Human
cagugaucuccauauguuaca

SEQ ID NO: 2437446 - RNA, 18 nt, Human
cagugaugcuggaugcuc

SEQ ID NO: 2437447 - RNA, 20 nt, Human
cagugaugcuggaugcuccu

SEQ ID NO: 2437448 - RNA, 18 nt, Human
cagugauauggcagaaga

SEQ ID NO: 2437449 - RNA, 15 nt, Human
cagugauauggcaga

SEQ ID NO: 2437450 - RNA, 23 nt, Human
cagugaguuacagcgagaggcag

SEQ ID NO: 2437451 - RNA, 22 nt, Human
cagugaguuacagcgagaggca

SEQ ID NO: 2437452 - RNA, 18 nt, Human
cagugaguuacagcgaga

SEQ ID NO: 2437453 - RNA, 21 nt, Human
cagugagugagccuggcucuu

SEQ ID NO: 2437454 - RNA, 20 nt, Human
cagugagugagccuggcucu

SEQ ID NO: 2437455 - RNA, 19 nt, Human
cagugagugagccuggcuc

SEQ ID NO: 2437456 - RNA, 23 nt, Human
cagugauauggcagaagacacca

SEQ ID NO: 2437457 - RNA, 22 nt, Human
cagugauauggcagaagacacc

SEQ ID NO: 2437458 - RNA, 21 nt, Human
cagugauauggcagaagacac

SEQ ID NO: 2437459 - RNA, 20 nt, Human
cagugauauggcagaagaca

SEQ ID NO: 2437460 - RNA, 15 nt, Human
cagugaggugcccag

SEQ ID NO: 2437461 - RNA, 16 nt, Human
cagugagggucuucuu

SEQ ID NO: 2437462 - RNA, 23 nt, Human
cagugagggucuucuuacaugca

SEQ ID NO: 2437463 - RNA, 16 nt, Human
cagugaggugcccagc

SEQ ID NO: 2437464 - RNA, 18 nt, Human
cagugagugagccuggcu

SEQ ID NO: 2437465 - RNA, 17 nt, Human
cagugagugagccuggc

SEQ ID NO: 2437466 - RNA, 16 nt, Human
cagugagugagccugg

SEQ ID NO: 2437467 - RNA, 15 nt, Human
cagugagugagccug

SEQ ID NO: 2437468 - RNA, 15 nt, Human
cagugagucucuuca

SEQ ID NO: 2437469 - RNA, 17 nt, Human
cagugagucucuucaga

SEQ ID NO: 2437470 - RNA, 14 nt, Human
cagugagugagccu

SEQ ID NO: 2437471 - RNA, 18 nt, Human
cagugagucucuucagaa

SEQ ID NO: 2437472 - RNA, 23 nt, Human
cagugagucgaggacagggaggu

SEQ ID NO: 2437473 - RNA, 22 nt, Human
cagugagucgaggacagggagg

SEQ ID NO: 2437474 - RNA, 20 nt, Human
cagugagucgaggacaggga

SEQ ID NO: 2437475 - RNA, 19 nt, Human
cagugagucgaggacaggg

SEQ ID NO: 2437476 - RNA, 22 nt, Human
cagugccuuauggaacacucug

SEQ ID NO: 2437477 - RNA, 21 nt, Human
cagugccuuauggaacacucu

SEQ ID NO: 2437478 - RNA, 20 nt, Human
cagugccuuauggaacacuc

SEQ ID NO: 2437479 - RNA, 19 nt, Human
cagugccuuauggaacacu

SEQ ID NO: 2437480 - RNA, 18 nt, Human
cagugccuuauggaacac

SEQ ID NO: 2437481 - RNA, 17 nt, Human
cagugccuuauggaaca

SEQ ID NO: 2437482 - RNA, 16 nt, Human
cagugccuuauggaac

SEQ ID NO: 2437483 - RNA, 15 nt, Human
cagugccuuauggaa

SEQ ID NO: 2437484 - RNA, 23 nt, Human
cagugccgccgccucgcccaccg

SEQ ID NO: 2437485 - RNA, 22 nt, Human
cagugccgccgccucgcccacc

SEQ ID NO: 2437486 - RNA, 20 nt, Human
cagugccgccgccucgccca

SEQ ID NO: 2437487 - RNA, 19 nt, Human
cagugccgccgccucgccc

SEQ ID NO: 2437488 - RNA, 18 nt, Human
cagugccgccgccucgcc

SEQ ID NO: 2437489 - RNA, 17 nt, Human
cagugccgccgccucgc

SEQ ID NO: 2437490 - RNA, 15 nt, Human
cagugccgagaagga

SEQ ID NO: 2437491 - RNA, 18 nt, Human
cagugccgagaaggaagc

SEQ ID NO: 2437492 - RNA, 13 nt, Human
cagugccuuaugg

SEQ ID NO: 2437493 - RNA, 11 nt, Human
cagugccuuau

SEQ ID NO: 2437494 - RNA, 10 nt, Human
cagugccugc

SEQ ID NO: 2437495 - RNA, 11 nt, Human
cagugccugcu

SEQ ID NO: 2437496 - RNA, 13 nt, Human
cagugccugcuga

SEQ ID NO: 2437497 - RNA, 12 nt, Human
cagugccugcug

SEQ ID NO: 2437498 - RNA, 14 nt, Human
cagugccugggaau

SEQ ID NO: 2437499 - RNA, 20 nt, Human
cagugccugggaauguauua

SEQ ID NO: 2437500 - RNA, 18 nt, Human
cagugccugggaauguau

SEQ ID NO: 2437501 - RNA, 17 nt, Human
cagugccuuaccuccug

SEQ ID NO: 2437502 - RNA, 18 nt, Human
cagugccuuaccuccugc

SEQ ID NO: 2437503 - RNA, 19 nt, Human
cagugccuuaccuccugcc

SEQ ID NO: 2437504 - RNA, 20 nt, Human
cagugccuuaccuccugccc

SEQ ID NO: 2437505 - RNA, 21 nt, Human
cagugccuuaccuccugccca

SEQ ID NO: 2437506 - RNA, 22 nt, Human
cagugccuuaccuccugcccag

SEQ ID NO: 2437507 - RNA, 23 nt, Human
cagugccuuaccuccugcccagg

SEQ ID NO: 2437508 - RNA, 17 nt, Human
cagugcuguggccuggg

SEQ ID NO: 2437509 - RNA, 17 nt, Human
caguccucccaucucac

SEQ ID NO: 2437510 - RNA, 16 nt, Human
caguccucccaucuca

SEQ ID NO: 2437511 - RNA, 21 nt, Human
caguccuccccucacagccuc

SEQ ID NO: 2437512 - RNA, 20 nt, Human
caguccuccccucacagccu

SEQ ID NO: 2437513 - RNA, 19 nt, Human
caguccuccccucacagcc

SEQ ID NO: 2437514 - RNA, 18 nt, Human
caguccuccccucacagc

SEQ ID NO: 2437515 - RNA, 15 nt, Human
caguccuccccucac

SEQ ID NO: 2437516 - RNA, 14 nt, Human
caguccuccccuca

SEQ ID NO: 2437517 - RNA, 13 nt, Human
caguccuccccuc

SEQ ID NO: 2437518 - RNA, 12 nt, Human
caguccuccccu

SEQ ID NO: 2437519 - RNA, 13 nt, Human
caguccucuccac

SEQ ID NO: 2437520 - RNA, 22 nt, Human
caguccuccccucacagccucu

SEQ ID NO: 2437521 - RNA, 23 nt, Human
caguccuccccucacagccucug

SEQ ID NO: 2437522 - RNA, 22 nt, Human
caguccucuccaccuaguggcu

SEQ ID NO: 2437523 - RNA, 20 nt, Human
caguccucuccaccuagugg

SEQ ID NO: 2437524 - RNA, 13 nt, Human
caguccucuuuca

SEQ ID NO: 2437525 - RNA, 22 nt, Human
caguccugaucagagccguggu

SEQ ID NO: 2437526 - RNA, 17 nt, Human
caguccugccucagccu

SEQ ID NO: 2437527 - RNA, 19 nt, Human
caguccugccucagccucc

SEQ ID NO: 2437528 - RNA, 12 nt, Human
caguccugccug

SEQ ID NO: 2437529 - RNA, 13 nt, Human
caguccugccugg

SEQ ID NO: 2437530 - RNA, 14 nt, Human
caguccugccuggc

SEQ ID NO: 2437531 - RNA, 15 nt, Human
caguccugccuggcc

SEQ ID NO: 2437532 - RNA, 17 nt, Human
caguccuggaagccagc

SEQ ID NO: 2437533 - RNA, 22 nt, Human
caguccuggaagccagcuuucc

SEQ ID NO: 2437534 - RNA, 18 nt, Human
caguccugccuggccagg

SEQ ID NO: 2437535 - RNA, 16 nt, Human
caguccugccuggcca

SEQ ID NO: 2437536 - RNA, 17 nt, Human
caguccugccuggccag

SEQ ID NO: 2437537 - RNA, 21 nt, Human
caguccugccuggccaggcag

SEQ ID NO: 2437538 - RNA, 18 nt, Human
caguccuuaccagcagag

SEQ ID NO: 2437539 - RNA, 15 nt, Human
caguccuuaccagca

SEQ ID NO: 2437540 - RNA, 19 nt, Human
caguccuggccuggcuucu

SEQ ID NO: 2437541 - RNA, 13 nt, Human
caguccuggccug

SEQ ID NO: 2437542 - RNA, 11 nt, Human
caguccuggcc

SEQ ID NO: 2437543 - RNA, 12 nt, Human
caguccugggag

SEQ ID NO: 2437544 - RNA, 13 nt, Human
caguccugggaga

SEQ ID NO: 2437545 - RNA, 21 nt, Human
caguccugggagaaccucagg

SEQ ID NO: 2437546 - RNA, 22 nt, Human
caguccugggagaaccucaggc

SEQ ID NO: 2437547 - RNA, 23 nt, Human
caguccugggagaaccucaggcu

SEQ ID NO: 2437548 - RNA, 20 nt, Human
caguccuuaccagcagagca

SEQ ID NO: 2437549 - RNA, 19 nt, Human
caguccuuaccagcagagc

SEQ ID NO: 2437550 - RNA, 21 nt, Human
caguccuuaccagcagagcac

SEQ ID NO: 2437551 - RNA, 18 nt, Human
cagucuggaaugcagugg

SEQ ID NO: 2437552 - RNA, 16 nt, Human
cagugaaagaaaauaa

SEQ ID NO: 2437553 - RNA, 20 nt, Human
cagugaaagaaaauaacaau

SEQ ID NO: 2437554 - RNA, 22 nt, Human
cagucuuuuuggugaggguaac

SEQ ID NO: 2437555 - RNA, 14 nt, Human
cagugaaaaacuau

SEQ ID NO: 2437556 - RNA, 18 nt, Human
cagugaaaacaagugcug

SEQ ID NO: 2437557 - RNA, 16 nt, Human
cagugaaaacaagugc

SEQ ID NO: 2437558 - RNA, 17 nt, Human
cagugaaaaacuauuaa

SEQ ID NO: 2437559 - RNA, 22 nt, Human
cagucuuuaaucugagaggcca

SEQ ID NO: 2437560 - RNA, 14 nt, Human
cagucuugcagcag

SEQ ID NO: 2437561 - RNA, 13 nt, Human
cagucuugugcuu

SEQ ID NO: 2437562 - RNA, 17 nt, Human
cagucuuguauuaaguu

SEQ ID NO: 2437563 - RNA, 16 nt, Human
cagucuuggcucacug

SEQ ID NO: 2437564 - RNA, 15 nt, Human
cagucuugcagcagg

SEQ ID NO: 2437565 - RNA, 18 nt, Human
cagucuugacgaguguga

SEQ ID NO: 2437566 - RNA, 15 nt, Human
cagucuuccauuugc

SEQ ID NO: 2437567 - RNA, 17 nt, Human
cagucuuccauuugcaa

SEQ ID NO: 2437568 - RNA, 18 nt, Human
cagucuuccauuugcaag

SEQ ID NO: 2437569 - RNA, 21 nt, Human
cagucuuccauuugcaaggga

SEQ ID NO: 2437570 - RNA, 13 nt, Human
cagucuuccugac

SEQ ID NO: 2437571 - RNA, 16 nt, Human
cagucuuccugacacu

SEQ ID NO: 2437572 - RNA, 17 nt, Human
cagucuuccugacacuu

SEQ ID NO: 2437573 - RNA, 18 nt, Human
cagucuuccugacacuuu

SEQ ID NO: 2437574 - RNA, 21 nt, Human
cagucuuccugacacuuuaau

SEQ ID NO: 2437575 - RNA, 15 nt, Human
cagucuugaauuucu

SEQ ID NO: 2437576 - RNA, 22 nt, Human
cagucuugaauuucuaaaaaac

SEQ ID NO: 2437577 - RNA, 23 nt, Human
cagucuugaauuucuaaaaaaca

SEQ ID NO: 2437578 - RNA, 24 nt, Human
cagucugucaugaacauguuccug

SEQ ID NO: 2437579 - RNA, 12 nt, Human
cagucugucaug

SEQ ID NO: 2437580 - RNA, 20 nt, Human
cagucuggcugagcccugcu

SEQ ID NO: 2437581 - RNA, 18 nt, Human
cagucuggcugagcccug

SEQ ID NO: 2437582 - RNA, 21 nt, Human
cagucuggaggggcauggcca

SEQ ID NO: 2437583 - RNA, 15 nt, Human
cagucuguggaucag

SEQ ID NO: 2437584 - RNA, 23 nt, Human
cagucugucaugaacauguuccu

SEQ ID NO: 2437585 - RNA, 21 nt, Human
cagucuguuccccauggccac

SEQ ID NO: 2437586 - RNA, 19 nt, Human
cagucuggaaugcaguggu

SEQ ID NO: 2437587 - RNA, 12 nt, Human
cagucuggaggg

SEQ ID NO: 2437588 - RNA, 13 nt, Human
cagucuggagggg

SEQ ID NO: 2437589 - RNA, 16 nt, Human
cagucuggaggggcau

SEQ ID NO: 2437590 - RNA, 18 nt, Human
cagucuggaggggcaugg

SEQ ID NO: 2437591 - RNA, 12 nt, Human
caguccuuccac

SEQ ID NO: 2437592 - RNA, 16 nt, Human
cagugacgugcaccug

SEQ ID NO: 2437593 - RNA, 17 nt, Human
cagugaccugaggaagc

SEQ ID NO: 2437594 - RNA, 18 nt, Human
cagugaccugaggaagcg

SEQ ID NO: 2437595 - RNA, 19 nt, Human
cagugaccugcuggguaaa

SEQ ID NO: 2437596 - RNA, 19 nt, Human
cagugaccugaggaagcgu

SEQ ID NO: 2437597 - RNA, 14 nt, Human
cagugaccugagga

SEQ ID NO: 2437598 - RNA, 16 nt, Human
cagugaccugaggaag

SEQ ID NO: 2437599 - RNA, 19 nt, Human
cagugacucgggcuccugu

SEQ ID NO: 2437600 - RNA, 18 nt, Human
cagugacucgggcuccug

SEQ ID NO: 2437601 - RNA, 17 nt, Human
cagugacucgggcuccu

SEQ ID NO: 2437602 - RNA, 16 nt, Human
cagugacucgggcucc

SEQ ID NO: 2437603 - RNA, 21 nt, Human
cagugacuccaggagaggagc

SEQ ID NO: 2437604 - RNA, 17 nt, Human
cagugacuccaggagag

SEQ ID NO: 2437605 - RNA, 16 nt, Human
cagugacuccaggaga

SEQ ID NO: 2437606 - RNA, 15 nt, Human
cagugacuccaggag

SEQ ID NO: 2437607 - RNA, 17 nt, Human
cagugacgugcaccugu

SEQ ID NO: 2437608 - RNA, 18 nt, Human
cagugacgugcaccugua

SEQ ID NO: 2437609 - RNA, 14 nt, Human
cagugacuccagga

SEQ ID NO: 2437610 - RNA, 13 nt, Human
cagugacuccagg

SEQ ID NO: 2437611 - RNA, 22 nt, Human
cagugacgugcaccuguacuca

SEQ ID NO: 2437612 - RNA, 20 nt, Human
cagugagaaaaagcuccugu

SEQ ID NO: 2437613 - RNA, 19 nt, Human
cagugagaaaaagcuccug

SEQ ID NO: 2437614 - RNA, 14 nt, Human
cagugagaaaaagc

SEQ ID NO: 2437615 - RNA, 22 nt, Human
cagugagaaaaagcuccugucc

SEQ ID NO: 2437616 - RNA, 21 nt, Human
cagugagaaaaagcuccuguc

SEQ ID NO: 2437617 - RNA, 16 nt, Human
cagugagcacucccaa

SEQ ID NO: 2437618 - RNA, 20 nt, Human
cagugagauuacagaggaag

SEQ ID NO: 2437619 - RNA, 19 nt, Human
cagugagauuacagaggaa

SEQ ID NO: 2437620 - RNA, 18 nt, Human
cagugagauuacagagga

SEQ ID NO: 2437621 - RNA, 15 nt, Human
cagugagacagcucu

SEQ ID NO: 2437622 - RNA, 23 nt, Human
cagugacucgggcuccugugccc

SEQ ID NO: 2437623 - RNA, 22 nt, Human
cagugacucgggcuccugugcc

SEQ ID NO: 2437624 - RNA, 21 nt, Human
cagugacucgggcuccugugc

SEQ ID NO: 2437625 - RNA, 20 nt, Human
cagugacucgggcuccugug

SEQ ID NO: 2437626 - RNA, 12 nt, Human
cagugaauucuu

SEQ ID NO: 2437627 - RNA, 18 nt, Human
cagugaaugauucagugu

SEQ ID NO: 2437628 - RNA, 20 nt, Human
cagugaaugauucaguguua

SEQ ID NO: 2437629 - RNA, 16 nt, Human
cagugacacuucagag

SEQ ID NO: 2437630 - RNA, 16 nt, Human
cagugacagacaggcu

SEQ ID NO: 2437631 - RNA, 15 nt, Human
cagugacagacaggc

SEQ ID NO: 2437632 - RNA, 17 nt, Human
cagugacacuucagaga

SEQ ID NO: 2437633 - RNA, 18 nt, Human
cagugacacuucagagag

SEQ ID NO: 2437634 - RNA, 19 nt, Human
cagugacacuucagagagc

SEQ ID NO: 2437635 - RNA, 22 nt, Human
cagugacacuucagagagcugg

SEQ ID NO: 2437636 - RNA, 18 nt, Human
cagugacagacaggcucu

SEQ ID NO: 2437637 - RNA, 17 nt, Human
cagugacagacaggcuc

SEQ ID NO: 2437638 - RNA, 23 nt, Human
cagugacacuucagagagcuggu

SEQ ID NO: 2437639 - RNA, 16 nt, Human
cagugacagaguucac

SEQ ID NO: 2437640 - RNA, 18 nt, Human
cagugacagaguucacua

SEQ ID NO: 2437641 - RNA, 20 nt, Human
cagugacagaguucacuaua

SEQ ID NO: 2437642 - RNA, 23 nt, Human
cagugaaccaaagagacuggagc

SEQ ID NO: 2437643 - RNA, 17 nt, Human
cagugaaugauucagug

SEQ ID NO: 2437644 - RNA, 18 nt, Human
cagugaaaauguaagcug

SEQ ID NO: 2437645 - RNA, 15 nt, Human
cagugaaaauguaag

SEQ ID NO: 2437646 - RNA, 12 nt, Human
cagugaaaaugu

SEQ ID NO: 2437647 - RNA, 21 nt, Human
cagugaaaacaagugcuggca

SEQ ID NO: 2437648 - RNA, 20 nt, Human
cagugaaaacaagugcuggc

SEQ ID NO: 2437649 - RNA, 21 nt, Human
cagugaaccaaagagacugga

SEQ ID NO: 2437650 - RNA, 20 nt, Human
cagugaaccaaagagacugg

SEQ ID NO: 2437651 - RNA, 14 nt, Human
cagugaaccaaaga

SEQ ID NO: 2437652 - RNA, 21 nt, Human
cagugaaaauguaagcuguuu

SEQ ID NO: 2437653 - RNA, 14 nt, Human
cagugaaagcauca

SEQ ID NO: 2437654 - RNA, 13 nt, Human
cagugaaagcauc

SEQ ID NO: 2437655 - RNA, 20 nt, Human
cagugaggcucugcccuugg

SEQ ID NO: 2437656 - RNA, 19 nt, Human
cagugaggcucugcccuug

SEQ ID NO: 2437657 - RNA, 18 nt, Human
cagugaggcucugcccuu

SEQ ID NO: 2437658 - RNA, 17 nt, Human
cagugaggcucugcccu

SEQ ID NO: 2437659 - RNA, 18 nt, Human
cagugagucgaggacagg

SEQ ID NO: 2437660 - RNA, 17 nt, Human
cagugagucgaggacag

SEQ ID NO: 2437661 - RNA, 21 nt, Human
cagugaggcucugcccuuggu

SEQ ID NO: 2437662 - RNA, 21 nt, Human
cagugaggcccagggagaggc

SEQ ID NO: 2437663 - RNA, 21 nt, Human
cagugagggagggcugucauc

SEQ ID NO: 2437664 - RNA, 16 nt, Human
cagugaggcccaggga

SEQ ID NO: 2437665 - RNA, 17 nt, Human
cagugaggcccagggag

SEQ ID NO: 2437666 - RNA, 16 nt, Human
cagugaggcucugccc

SEQ ID NO: 2437667 - RNA, 15 nt, Human
cagugaggcucugcc

SEQ ID NO: 2437668 - RNA, 14 nt, Human
cagugaggcucugc

SEQ ID NO: 2437669 - RNA, 13 nt, Human
cagugaggcucug

SEQ ID NO: 2437670 - RNA, 12 nt, Human
cagugaggcucu

SEQ ID NO: 2437671 - RNA, 13 nt, Human
cagugagcugaga

SEQ ID NO: 2437672 - RNA, 17 nt, Human
cagugagcggagaucgc

SEQ ID NO: 2437673 - RNA, 19 nt, Human
cagugagccgcaucuucuc

SEQ ID NO: 2437674 - RNA, 13 nt, Human
cagugaggcccag

SEQ ID NO: 2437675 - RNA, 22 nt, Human
cagugagcuuggaaaggaccag

SEQ ID NO: 2437676 - RNA, 24 nt, Human
cagugagccgagauugcaccacug

SEQ ID NO: 2437677 - RNA, 13 nt, Human
cagugagccaaga

SEQ ID NO: 2437678 - RNA, 23 nt, Human
cagugagccaagaucgcgccacu

SEQ ID NO: 2437679 - RNA, 12 nt, Human
cagugagccuga

SEQ ID NO: 2437680 - RNA, 16 nt, Human
cagucccccaacccca

SEQ ID NO: 2437681 - RNA, 14 nt, Human
caguccccccaccc

SEQ ID NO: 2437682 - RNA, 20 nt, Human
caguccccccacccucauuc

SEQ ID NO: 2437683 - RNA, 20 nt, Human
caguccccaccccugccccc

SEQ ID NO: 2437684 - RNA, 19 nt, Human
caguccccaccccugcccc

SEQ ID NO: 2437685 - RNA, 21 nt, Human
caguccccaccccugccccca

SEQ ID NO: 2437686 - RNA, 17 nt, Human
cagucccccugccccag

SEQ ID NO: 2437687 - RNA, 16 nt, Human
cagucccccugcccca

SEQ ID NO: 2437688 - RNA, 13 nt, Human
caguccccuccca

SEQ ID NO: 2437689 - RNA, 12 nt, Human
caguccccuccc

SEQ ID NO: 2437690 - RNA, 18 nt, Human
caguccccgugccccgcc

SEQ ID NO: 2437691 - RNA, 18 nt, Human
cagucccccaaccccagc

SEQ ID NO: 2437692 - RNA, 23 nt, Human
caguccccgugaaggagagcccu

SEQ ID NO: 2437693 - RNA, 16 nt, Human
cagucccugccaaugg

SEQ ID NO: 2437694 - RNA, 15 nt, Human
cagucccugccaaug

SEQ ID NO: 2437695 - RNA, 14 nt, Human
cagucccugccaau

SEQ ID NO: 2437696 - RNA, 13 nt, Human
cagucccugccaa

SEQ ID NO: 2437697 - RNA, 14 nt, Human
cagucccugaggca

SEQ ID NO: 2437698 - RNA, 14 nt, Human
cagucccuaaagaa

SEQ ID NO: 2437699 - RNA, 17 nt, Human
caguccccucccaucug

SEQ ID NO: 2437700 - RNA, 16 nt, Human
caguccccucccaucu

SEQ ID NO: 2437701 - RNA, 15 nt, Human
caguccccucccauc

SEQ ID NO: 2437702 - RNA, 14 nt, Human
caguccccucccau

SEQ ID NO: 2437703 - RNA, 22 nt, Human
caguccccucccaucugggagu

SEQ ID NO: 2437704 - RNA, 19 nt, Human
caguccccucccaucuggg

SEQ ID NO: 2437705 - RNA, 20 nt, Human
cagucccugaggcagguccc

SEQ ID NO: 2437706 - RNA, 23 nt, Human
cagucccugaggcagguccccag

SEQ ID NO: 2437707 - RNA, 12 nt, Human
cagucccugcca

SEQ ID NO: 2437708 - RNA, 15 nt, Human
caguccucccaucuc

SEQ ID NO: 2437709 - RNA, 14 nt, Human
caguccucccaucu

SEQ ID NO: 2437710 - RNA, 13 nt, Human
caguccucccauc

SEQ ID NO: 2437711 - RNA, 12 nt, Human
caguccucccau

SEQ ID NO: 2437712 - RNA, 23 nt, Human
caguccuagcugcacagggcagc

SEQ ID NO: 2437713 - RNA, 18 nt, Human
caguccuagcugcacagg

SEQ ID NO: 2437714 - RNA, 17 nt, Human
caguccuagcugcacag

SEQ ID NO: 2437715 - RNA, 13 nt, Human
caguccuagcugc

SEQ ID NO: 2437716 - RNA, 19 nt, Human
caguccuaagaaagaggag

SEQ ID NO: 2437717 - RNA, 15 nt, Human
caguccuaagaaaga

SEQ ID NO: 2437718 - RNA, 17 nt, Human
cagucccugccaaugga

SEQ ID NO: 2437719 - RNA, 15 nt, Human
cagucccuauguauu

SEQ ID NO: 2437720 - RNA, 12 nt, Human
cagucccugggg

SEQ ID NO: 2437721 - RNA, 20 nt, Human
cagucccugggggaagcccu

SEQ ID NO: 2437722 - RNA, 21 nt, Human
cagucccugggggaagcccug

SEQ ID NO: 2437723 - RNA, 22 nt, Human
cagucccugggggaagcccugg

SEQ ID NO: 2437724 - RNA, 16 nt, Human
caguauccacuuugca

SEQ ID NO: 2437725 - RNA, 20 nt, Human
caguaucaugcccugugcaa

SEQ ID NO: 2437726 - RNA, 17 nt, Human
caguaucaugcccugug

SEQ ID NO: 2437727 - RNA, 19 nt, Human
caguaucaugcccugugca

SEQ ID NO: 2437728 - RNA, 22 nt, Human
caguaucuauauauguguaugu

SEQ ID NO: 2437729 - RNA, 21 nt, Human
caguaucuauauauguguaug

SEQ ID NO: 2437730 - RNA, 20 nt, Human
caguaucuauauauguguau

SEQ ID NO: 2437731 - RNA, 19 nt, Human
caguaucuauauaugugua

SEQ ID NO: 2437732 - RNA, 16 nt, Human
caguaucuauauaugu

SEQ ID NO: 2437733 - RNA, 18 nt, Human
caguaucuauauaugugu

SEQ ID NO: 2437734 - RNA, 13 nt, Human
caguaucucaggg

SEQ ID NO: 2437735 - RNA, 13 nt, Human
caguaucaugccc

SEQ ID NO: 2437736 - RNA, 16 nt, Human
caguaucaugcccugu

SEQ ID NO: 2437737 - RNA, 14 nt, Human
caguaucaugaagc

SEQ ID NO: 2437738 - RNA, 15 nt, Human
caguaucaugaagcc

SEQ ID NO: 2437739 - RNA, 14 nt, Human
caguaucacugucu

SEQ ID NO: 2437740 - RNA, 22 nt, Human
caguaucacugucuuuccuaga

SEQ ID NO: 2437741 - RNA, 14 nt, Human
caguauauuuauag

SEQ ID NO: 2437742 - RNA, 15 nt, Human
caguauauuuauagu

SEQ ID NO: 2437743 - RNA, 14 nt, Human
caguaucaggccug

SEQ ID NO: 2437744 - RNA, 17 nt, Human
caguaucaggccugcca

SEQ ID NO: 2437745 - RNA, 20 nt, Human
caguaucaggccugccagac

SEQ ID NO: 2437746 - RNA, 24 nt, Human
caguaucaggccugccagacggca

SEQ ID NO: 2437747 - RNA, 20 nt, Human
caguauaauucuguacugau

SEQ ID NO: 2437748 - RNA, 19 nt, Human
caguauaauucuguacuga

SEQ ID NO: 2437749 - RNA, 23 nt, Human
caguauaauugaguuuucagugg

SEQ ID NO: 2437750 - RNA, 22 nt, Human
caguauaauucuguacugauuu

SEQ ID NO: 2437751 - RNA, 14 nt, Human
caguauacaguccu

SEQ ID NO: 2437752 - RNA, 13 nt, Human
caguauauuuaua

SEQ ID NO: 2437753 - RNA, 22 nt, Human
caguauauuuauagucacaaga

SEQ ID NO: 2437754 - RNA, 23 nt, Human
caguaugagucaaugugcagugu

SEQ ID NO: 2437755 - RNA, 21 nt, Human
caguaugagucaaugugcagu

SEQ ID NO: 2437756 - RNA, 20 nt, Human
caguaugagucaaugugcag

SEQ ID NO: 2437757 - RNA, 14 nt, Human
caguaugaaaauaa

SEQ ID NO: 2437758 - RNA, 12 nt, Human
caguauggcagc

SEQ ID NO: 2437759 - RNA, 23 nt, Human
caguaucuauauauguguaugua

SEQ ID NO: 2437760 - RNA, 13 nt, Human
caguaugaaaaua

SEQ ID NO: 2437761 - RNA, 21 nt, Human
caguaucuugaagacuuuucu

SEQ ID NO: 2437762 - RNA, 18 nt, Human
caguaucuugaagacuuu

SEQ ID NO: 2437763 - RNA, 12 nt, Human
caguaucuugaa

SEQ ID NO: 2437764 - RNA, 15 nt, Human
caguaucucagggcc

SEQ ID NO: 2437765 - RNA, 19 nt, Human
caguauaaacaaaguuacu

SEQ ID NO: 2437766 - RNA, 14 nt, Human
caguauaaacaaag

SEQ ID NO: 2437767 - RNA, 14 nt, Human
caguauaauucugu

SEQ ID NO: 2437768 - RNA, 12 nt, Human
caguauaauucu

SEQ ID NO: 2437769 - RNA, 12 nt, Human
caguagugauag

SEQ ID NO: 2437770 - RNA, 23 nt, Human
caguagucucugugcuuugacuc

SEQ ID NO: 2437771 - RNA, 17 nt, Human
caguagucucugugcuu

SEQ ID NO: 2437772 - RNA, 23 nt, Human
caguagucuugaugaccaaaguc

SEQ ID NO: 2437773 - RNA, 22 nt, Human
caguaggugcccagaauaaguu

SEQ ID NO: 2437774 - RNA, 22 nt, Human
caguaggagcccagcucugaaa

SEQ ID NO: 2437775 - RNA, 18 nt, Human
caguaggcucaacuaggg

SEQ ID NO: 2437776 - RNA, 15 nt, Human
caguagguuggcagu

SEQ ID NO: 2437777 - RNA, 16 nt, Human
caguagucucugugcu

SEQ ID NO: 2437778 - RNA, 14 nt, Human
caguaguaccaaau

SEQ ID NO: 2437779 - RNA, 22 nt, Human
caguaguagccuccagguuucc

SEQ ID NO: 2437780 - RNA, 23 nt, Human
caguagaaggucggaggcuuggg

SEQ ID NO: 2437781 - RNA, 20 nt, Human
caguagaccuuguuacuucu

SEQ ID NO: 2437782 - RNA, 20 nt, Human
caguagaaggucggaggcuu

SEQ ID NO: 2437783 - RNA, 23 nt, Human
caguagaggcuauggacagggca

SEQ ID NO: 2437784 - RNA, 17 nt, Human
caguagagucaucucca

SEQ ID NO: 2437785 - RNA, 15 nt, Human
caguagagucaucuc

SEQ ID NO: 2437786 - RNA, 16 nt, Human
caguagagucaucucc

SEQ ID NO: 2437787 - RNA, 20 nt, Human
caguacuuuggaggccccua

SEQ ID NO: 2437788 - RNA, 16 nt, Human
caguacuuuggaggcc

SEQ ID NO: 2437789 - RNA, 19 nt, Human
caguacuuuggaggccccu

SEQ ID NO: 2437790 - RNA, 18 nt, Human
caguagaaauaauaugca

SEQ ID NO: 2437791 - RNA, 12 nt, Human
caguagacaagc

SEQ ID NO: 2437792 - RNA, 19 nt, Human
caguagaaauaauaugcau

SEQ ID NO: 2437793 - RNA, 12 nt, Human
caguaggagccc

SEQ ID NO: 2437794 - RNA, 14 nt, Human
caguaggagcccag

SEQ ID NO: 2437795 - RNA, 15 nt, Human
caguaggagcccagc

SEQ ID NO: 2437796 - RNA, 21 nt, Human
caguaggagcccagcucugaa

SEQ ID NO: 2437797 - RNA, 20 nt, Human
caguagcuguggugaggugg

SEQ ID NO: 2437798 - RNA, 14 nt, Human
caguagauuuucuu

SEQ ID NO: 2437799 - RNA, 13 nt, Human
caguagauuuucu

SEQ ID NO: 2437800 - RNA, 18 nt, Human
caguagauuuuccaaaug

SEQ ID NO: 2437801 - RNA, 16 nt, Human
caguagauuuuccaaa

SEQ ID NO: 2437802 - RNA, 23 nt, Human
caguagauuuucuuuaaaagaau

SEQ ID NO: 2437803 - RNA, 19 nt, Human
caguagauuuucuuuaaaa

SEQ ID NO: 2437804 - RNA, 18 nt, Human
caguagcaguagaugcau

SEQ ID NO: 2437805 - RNA, 18 nt, Human
cagucaggaaagagaacu

SEQ ID NO: 2437806 - RNA, 15 nt, Human
cagucaggaaagaga

SEQ ID NO: 2437807 - RNA, 22 nt, Human
cagucaggaaagagaacuucca

SEQ ID NO: 2437808 - RNA, 22 nt, Human
cagucagccucucucccagucu

SEQ ID NO: 2437809 - RNA, 21 nt, Human
cagucaggaaaggaaucauuu

SEQ ID NO: 2437810 - RNA, 12 nt, Human
cagucaggauga

SEQ ID NO: 2437811 - RNA, 18 nt, Human
cagucagugcaaauguca

SEQ ID NO: 2437812 - RNA, 18 nt, Human
cagucaucuugaccaagc

SEQ ID NO: 2437813 - RNA, 17 nt, Human
cagucagugcaaauguc

SEQ ID NO: 2437814 - RNA, 15 nt, Human
cagucaguauuguuu

SEQ ID NO: 2437815 - RNA, 16 nt, Human
cagucaguaauugcca

SEQ ID NO: 2437816 - RNA, 18 nt, Human
cagucaugcauaaauaug

SEQ ID NO: 2437817 - RNA, 17 nt, Human
cagucaugcauaaauau

SEQ ID NO: 2437818 - RNA, 16 nt, Human
cagucaugcauaaaua

SEQ ID NO: 2437819 - RNA, 14 nt, Human
cagucaugcauaaa

SEQ ID NO: 2437820 - RNA, 21 nt, Human
cagucaucuugaccaagcagg

SEQ ID NO: 2437821 - RNA, 22 nt, Human
cagucaucuugaccaagcagga

SEQ ID NO: 2437822 - RNA, 13 nt, Human
cagucaugcauaa

SEQ ID NO: 2437823 - RNA, 24 nt, Human
cagucaucuugaccaagcaggaag

SEQ ID NO: 2437824 - RNA, 15 nt, Human
cagucauaacuaaau

SEQ ID NO: 2437825 - RNA, 17 nt, Human
cagucaggggcagcuga

SEQ ID NO: 2437826 - RNA, 12 nt, Human
cagucaggggca

SEQ ID NO: 2437827 - RNA, 21 nt, Human
cagucagguaguugcaauuga

SEQ ID NO: 2437828 - RNA, 23 nt, Human
cagucacuggagguugaagccaa

SEQ ID NO: 2437829 - RNA, 15 nt, Human
caguauguugucaaa

SEQ ID NO: 2437830 - RNA, 14 nt, Human
cagucacuggaggu

SEQ ID NO: 2437831 - RNA, 22 nt, Human
cagucacugucccucaaaugac

SEQ ID NO: 2437832 - RNA, 21 nt, Human
cagucacugucccucaaauga

SEQ ID NO: 2437833 - RNA, 17 nt, Human
cagucagauuuccaguc

SEQ ID NO: 2437834 - RNA, 21 nt, Human
cagucagccucucucccaguc

SEQ ID NO: 2437835 - RNA, 18 nt, Human
cagucagccucucuccca

SEQ ID NO: 2437836 - RNA, 17 nt, Human
cagucagccucucuccc

SEQ ID NO: 2437837 - RNA, 14 nt, Human
cagucagccucucu

SEQ ID NO: 2437838 - RNA, 13 nt, Human
cagucagccucuc

SEQ ID NO: 2437839 - RNA, 12 nt, Human
cagucagccucu

SEQ ID NO: 2437840 - RNA, 20 nt, Human
cagucagauuuccagucucc

SEQ ID NO: 2437841 - RNA, 23 nt, Human
cagucagauuuccagucuccacc

SEQ ID NO: 2437842 - RNA, 19 nt, Human
caguauuacuucugcuaca

SEQ ID NO: 2437843 - RNA, 17 nt, Human
cagucacugaauuccau

SEQ ID NO: 2437844 - RNA, 18 nt, Human
caguauuacuucugcuac

SEQ ID NO: 2437845 - RNA, 16 nt, Human
caguauggguuaggga

SEQ ID NO: 2437846 - RNA, 21 nt, Human
caguauggguuagggaaaaca

SEQ ID NO: 2437847 - RNA, 12 nt, Human
caguauguggaa

SEQ ID NO: 2437848 - RNA, 16 nt, Human
caguauuacuucugcu

SEQ ID NO: 2437849 - RNA, 16 nt, Human
caguaugucccauagg

SEQ ID NO: 2437850 - RNA, 23 nt, Human
caguauggguuagggaaaacauu

SEQ ID NO: 2437851 - RNA, 18 nt, Human
caguauguugucaaagag

SEQ ID NO: 2437852 - RNA, 13 nt, Human
caguauguuguca

SEQ ID NO: 2437853 - RNA, 16 nt, Human
caguccagccuggaga

SEQ ID NO: 2437854 - RNA, 18 nt, Human
caguccccaccccugccc

SEQ ID NO: 2437855 - RNA, 17 nt, Human
caguccccaccccugcc

SEQ ID NO: 2437856 - RNA, 16 nt, Human
caguccccaccccugc

SEQ ID NO: 2437857 - RNA, 15 nt, Human
caguccccaccccug

SEQ ID NO: 2437858 - RNA, 14 nt, Human
caguccccaccccu

SEQ ID NO: 2437859 - RNA, 13 nt, Human
caguccccacccc

SEQ ID NO: 2437860 - RNA, 12 nt, Human
caguccccaccc

SEQ ID NO: 2437861 - RNA, 13 nt, Human
cagucccaggggc

SEQ ID NO: 2437862 - RNA, 19 nt, Human
cagucccaucagagagcga

SEQ ID NO: 2437863 - RNA, 13 nt, Human
caguccaugaaga

SEQ ID NO: 2437864 - RNA, 14 nt, Human
caguccauugaaag

SEQ ID NO: 2437865 - RNA, 18 nt, Human
caguccaggcugccgugg

SEQ ID NO: 2437866 - RNA, 15 nt, Human
caguccaggcugccg

SEQ ID NO: 2437867 - RNA, 17 nt, Human
caguccagccuggagau

SEQ ID NO: 2437868 - RNA, 23 nt, Human
caguccaggaugcuaacaucuaa

SEQ ID NO: 2437869 - RNA, 16 nt, Human
caguccauagcagaga

SEQ ID NO: 2437870 - RNA, 13 nt, Human
cagucauuaugag

SEQ ID NO: 2437871 - RNA, 23 nt, Human
cagucauuaugagaggcaaugau

SEQ ID NO: 2437872 - RNA, 23 nt, Human
cagucaugcauaaauaugcagug

SEQ ID NO: 2437873 - RNA, 20 nt, Human
cagucaugcauaaauaugca

SEQ ID NO: 2437874 - RNA, 19 nt, Human
cagucaugcauaaauaugc

SEQ ID NO: 2437875 - RNA, 18 nt, Human
cagucauuagacuccucc

SEQ ID NO: 2437876 - RNA, 24 nt, Human
cagucauggcaccaaagccaccag

SEQ ID NO: 2437877 - RNA, 13 nt, Human
cagucauuggcug

SEQ ID NO: 2437878 - RNA, 17 nt, Human
cagucauuggcugucuc

SEQ ID NO: 2437879 - RNA, 21 nt, Human
cagucauuggcugucuccuag

SEQ ID NO: 2437880 - RNA, 11 nt, Human
cagucauuuaa

SEQ ID NO: 2437881 - RNA, 22 nt, Human
cagucauuagacuccuccucca

SEQ ID NO: 2437882 - RNA, 12 nt, Human
cagucauuuaaa

SEQ ID NO: 2437883 - RNA, 15 nt, Human
caguccagccuggag

SEQ ID NO: 2437884 - RNA, 14 nt, Human
caguccagccugga

SEQ ID NO: 2437885 - RNA, 13 nt, Human
caguccagccugg

SEQ ID NO: 2437886 - RNA, 13 nt, Human
caguccacaaaau

SEQ ID NO: 2437887 - RNA, 24 nt, Human
caguccaaggaaaccacagcugcu

SEQ ID NO: 2437888 - RNA, 15 nt, Human
caguccaccugagcu

SEQ ID NO: 2437889 - RNA, 16 nt, Human
caguccaccugagcug

SEQ ID NO: 2437890 - RNA, 18 nt, Human
caguccaccugagcugcc

SEQ ID NO: 2437891 - RNA, 20 nt, Human
caguccaccugagcugccau

SEQ ID NO: 2437892 - RNA, 23 nt, Human
caguccaaggaaaccacagcugc

SEQ ID NO: 2437893 - RNA, 22 nt, Human
caguccaaggaaaccacagcug

SEQ ID NO: 2437894 - RNA, 19 nt, Human
caguccaaggaaaccacag

SEQ ID NO: 2437895 - RNA, 23 nt, Human
cagucauuuuuguuucuaccucc

SEQ ID NO: 2437896 - RNA, 22 nt, Human
caguccaaauguccuccagaag

SEQ ID NO: 2437897 - RNA, 23 nt, Human
caguccaaauguccuccagaagc

SEQ ID NO: 2437898 - RNA, 18 nt, Human
caguccaaauguccucca

SEQ ID NO: 2437899 - RNA, 21 nt, Human
caguccaaauguccuccagaa

SEQ ID NO: 2437900 - RNA, 17 nt, Human
caguccaaauguccucc

SEQ ID NO: 2437901 - RNA, 21 nt, Human
cagucauuuuuguuucuaccu

SEQ ID NO: 2437902 - RNA, 18 nt, Human
caggugugagccaccacg

SEQ ID NO: 2437903 - RNA, 21 nt, Human
caggugucauauauggggggc

SEQ ID NO: 2437904 - RNA, 16 nt, Human
caggugugagucacca

SEQ ID NO: 2437905 - RNA, 21 nt, Human
caggugugagucaccaagccc

SEQ ID NO: 2437906 - RNA, 20 nt, Human
caggugugagucaccaagcc

SEQ ID NO: 2437907 - RNA, 23 nt, Human
caggugugaaccaccacacccag

SEQ ID NO: 2437908 - RNA, 22 nt, Human
caggugugaaccaccacaccca

SEQ ID NO: 2437909 - RNA, 19 nt, Human
caggugugaaccaccacac

SEQ ID NO: 2437910 - RNA, 16 nt, Human
caggugugaaccacca

SEQ ID NO: 2437911 - RNA, 19 nt, Human
caggugugccgacagaagg

SEQ ID NO: 2437912 - RNA, 18 nt, Human
caggugugccgacagaag

SEQ ID NO: 2437913 - RNA, 23 nt, Human
caggugugcacguggcauguggc

SEQ ID NO: 2437914 - RNA, 21 nt, Human
cagguguguccaccugggcau

SEQ ID NO: 2437915 - RNA, 20 nt, Human
cagguguguccaccugggca

SEQ ID NO: 2437916 - RNA, 21 nt, Human
caggugugagccaccacgccc

SEQ ID NO: 2437917 - RNA, 15 nt, Human
caggugugcacgugg

SEQ ID NO: 2437918 - RNA, 13 nt, Human
caggugugcacgu

SEQ ID NO: 2437919 - RNA, 23 nt, Human
caggugugagucaccaagcccag

SEQ ID NO: 2437920 - RNA, 22 nt, Human
caggugugagucaccaagccca

SEQ ID NO: 2437921 - RNA, 21 nt, Human
cagguuacaacagauuuguga

SEQ ID NO: 2437922 - RNA, 19 nt, Human
cagguuacaacagauuugu

SEQ ID NO: 2437923 - RNA, 17 nt, Human
cagguuacaacagauuu

SEQ ID NO: 2437924 - RNA, 16 nt, Human
cagguuacaacagauu

SEQ ID NO: 2437925 - RNA, 15 nt, Human
cagguuacaacagau

SEQ ID NO: 2437926 - RNA, 14 nt, Human
cagguuacaacaga

SEQ ID NO: 2437927 - RNA, 13 nt, Human
cagguuacaacag

SEQ ID NO: 2437928 - RNA, 12 nt, Human
cagguuacaaca

SEQ ID NO: 2437929 - RNA, 11 nt, Human
cagguuacaac

SEQ ID NO: 2437930 - RNA, 22 nt, Human
cagguguuacuguaauuccuca

SEQ ID NO: 2437931 - RNA, 12 nt, Human
cagguguucuuc

SEQ ID NO: 2437932 - RNA, 14 nt, Human
cagguguugccaaa

SEQ ID NO: 2437933 - RNA, 13 nt, Human
cagguguugccaa

SEQ ID NO: 2437934 - RNA, 20 nt, Human
cagguguucuacacucaucu

SEQ ID NO: 2437935 - RNA, 16 nt, Human
cagguguuuaguugca

SEQ ID NO: 2437936 - RNA, 12 nt, Human
caggugugaacc

SEQ ID NO: 2437937 - RNA, 19 nt, Human
caggugucccugcacuugc

SEQ ID NO: 2437938 - RNA, 18 nt, Human
caggugucccugcacuug

SEQ ID NO: 2437939 - RNA, 16 nt, Human
caggugucccugcacu

SEQ ID NO: 2437940 - RNA, 15 nt, Human
caggugucccugcac

SEQ ID NO: 2437941 - RNA, 14 nt, Human
caguaacucaucug

SEQ ID NO: 2437942 - RNA, 16 nt, Human
caguaacucaucuguc

SEQ ID NO: 2437943 - RNA, 21 nt, Human
caguaacgcgucuuccugagu

SEQ ID NO: 2437944 - RNA, 18 nt, Human
caguaacgcaggggaaac

SEQ ID NO: 2437945 - RNA, 20 nt, Human
caguaacgcgucuuccugag

SEQ ID NO: 2437946 - RNA, 19 nt, Human
caguaacgcgucuuccuga

SEQ ID NO: 2437947 - RNA, 18 nt, Human
caguaacgcgucuuccug

SEQ ID NO: 2437948 - RNA, 20 nt, Human
caguaacuuuauguguaaau

SEQ ID NO: 2437949 - RNA, 19 nt, Human
caguaacuuuauguguaaa

SEQ ID NO: 2437950 - RNA, 18 nt, Human
caguaacuuuauguguaa

SEQ ID NO: 2437951 - RNA, 17 nt, Human
caguaacuuuaugugua

SEQ ID NO: 2437952 - RNA, 16 nt, Human
caguaacuuuaugugu

SEQ ID NO: 2437953 - RNA, 14 nt, Human
caguaacuuuaugu

SEQ ID NO: 2437954 - RNA, 21 nt, Human
caguaaaugggggugcauuug

SEQ ID NO: 2437955 - RNA, 21 nt, Human
cagguucuauuuggaauuuau

SEQ ID NO: 2437956 - RNA, 19 nt, Human
cagguucuauuuggaauuu

SEQ ID NO: 2437957 - RNA, 17 nt, Human
cagguucuauuuggaau

SEQ ID NO: 2437958 - RNA, 16 nt, Human
cagguucuauuuggaa

SEQ ID NO: 2437959 - RNA, 20 nt, Human
caguaaaugggggugcauuu

SEQ ID NO: 2437960 - RNA, 22 nt, Human
caguaaaugggggugcauuuga

SEQ ID NO: 2437961 - RNA, 20 nt, Human
cagguucuccguuagcuccu

SEQ ID NO: 2437962 - RNA, 15 nt, Human
cagguucuauuugga

SEQ ID NO: 2437963 - RNA, 17 nt, Human
cagguuccuauggcugg

SEQ ID NO: 2437964 - RNA, 14 nt, Human
cagguuccaucccg

SEQ ID NO: 2437965 - RNA, 15 nt, Human
cagguucccaagcuc

SEQ ID NO: 2437966 - RNA, 17 nt, Human
cagguucccaagcucag

SEQ ID NO: 2437967 - RNA, 14 nt, Human
cagguucccaagcu

SEQ ID NO: 2437968 - RNA, 13 nt, Human
cagguucagcuug

SEQ ID NO: 2437969 - RNA, 23 nt, Human
cagguuagaaccuagaagggcua

SEQ ID NO: 2437970 - RNA, 23 nt, Human
cagguuacaacagauuugugaac

SEQ ID NO: 2437971 - RNA, 22 nt, Human
cagguuacaacagauuugugaa

SEQ ID NO: 2437972 - RNA, 19 nt, Human
cagguuagaaccuagaagg

SEQ ID NO: 2437973 - RNA, 16 nt, Human
cagguuaucugggcau

SEQ ID NO: 2437974 - RNA, 23 nt, Human
cagguuaucgaaauaacaauguu

SEQ ID NO: 2437975 - RNA, 20 nt, Human
cagguuaucgaaauaacaau

SEQ ID NO: 2437976 - RNA, 19 nt, Human
cagguuaucgaaauaacaa

SEQ ID NO: 2437977 - RNA, 22 nt, Human
cagguucacaggcgaggccugg

SEQ ID NO: 2437978 - RNA, 20 nt, Human
cagguucacaggcgaggccu

SEQ ID NO: 2437979 - RNA, 21 nt, Human
cagguuauuuuaguuucuguu

SEQ ID NO: 2437980 - RNA, 16 nt, Human
cagguuauuuuaguuu

SEQ ID NO: 2437981 - RNA, 14 nt, Human
cagguuauuuuagu

SEQ ID NO: 2437982 - RNA, 24 nt, Human
cagguuaucgaaauaacaauguua

SEQ ID NO: 2437983 - RNA, 12 nt, Human
cagguucagcuu

SEQ ID NO: 2437984 - RNA, 15 nt, Human
caguaccuggaggag

SEQ ID NO: 2437985 - RNA, 14 nt, Human
caguaccuggagga

SEQ ID NO: 2437986 - RNA, 13 nt, Human
caguaccuggagg

SEQ ID NO: 2437987 - RNA, 12 nt, Human
caguaccuggag

SEQ ID NO: 2437988 - RNA, 12 nt, Human
caguaccuccug

SEQ ID NO: 2437989 - RNA, 22 nt, Human
caguaccuauaaaguaaagcua

SEQ ID NO: 2437990 - RNA, 20 nt, Human
caguaccuccugucucuggc

SEQ ID NO: 2437991 - RNA, 20 nt, Human
caguaccuauaaaguaaagc

SEQ ID NO: 2437992 - RNA, 23 nt, Human
caguaccuucaaacuagggccaa

SEQ ID NO: 2437993 - RNA, 21 nt, Human
caguaccuggaggaggagcag

SEQ ID NO: 2437994 - RNA, 17 nt, Human
caguaccuuugucacaa

SEQ ID NO: 2437995 - RNA, 15 nt, Human
caguaccuuugucac

SEQ ID NO: 2437996 - RNA, 16 nt, Human
caguaccuuugucaca

SEQ ID NO: 2437997 - RNA, 24 nt, Human
caguacccucucagcuccaggugg

SEQ ID NO: 2437998 - RNA, 22 nt, Human
caguacccucucagcuccaggu

SEQ ID NO: 2437999 - RNA, 20 nt, Human
caguacccucucagcuccag

SEQ ID NO: 2438000 - RNA, 19 nt, Human
caguacccucucagcucca

SEQ ID NO: 2438001 - RNA, 16 nt, Human
caguacccucucagcu

SEQ ID NO: 2438002 - RNA, 15 nt, Human
caguacccucucagc

SEQ ID NO: 2438003 - RNA, 14 nt, Human
caguacccucucag

SEQ ID NO: 2438004 - RNA, 13 nt, Human
caguaauauuuau

SEQ ID NO: 2438005 - RNA, 20 nt, Human
caguaauauuuauauauuua

SEQ ID NO: 2438006 - RNA, 14 nt, Human
caguaauugugaaa

SEQ ID NO: 2438007 - RNA, 21 nt, Human
caguaauugguccgaucuuug

SEQ ID NO: 2438008 - RNA, 16 nt, Human
caguaauugugaaaau

SEQ ID NO: 2438009 - RNA, 17 nt, Human
caguaauuugaggacaa

SEQ ID NO: 2438010 - RNA, 12 nt, Human
caguacaggcag

SEQ ID NO: 2438011 - RNA, 13 nt, Human
caguacaggcagc

SEQ ID NO: 2438012 - RNA, 14 nt, Human
caguacaggcagca

SEQ ID NO: 2438013 - RNA, 16 nt, Human
caguacaggcagcaca

SEQ ID NO: 2438014 - RNA, 19 nt, Human
caguacaggcagcacagag

SEQ ID NO: 2438015 - RNA, 20 nt, Human
caguacaggcagcacagaga

SEQ ID NO: 2438016 - RNA, 18 nt, Human
caguaagggaaauagaaa

SEQ ID NO: 2438017 - RNA, 15 nt, Human
caguaagggaaauag

SEQ ID NO: 2438018 - RNA, 13 nt, Human
caguaaggcaggg

SEQ ID NO: 2438019 - RNA, 19 nt, Human
caguaagcugcucuauugu

SEQ ID NO: 2438020 - RNA, 15 nt, Human
caguaagccacugcc

SEQ ID NO: 2438021 - RNA, 18 nt, Human
caguaaguaucuggagga

SEQ ID NO: 2438022 - RNA, 14 nt, Human
caguaagucuuuuu

SEQ ID NO: 2438023 - RNA, 13 nt, Human
caguaaguuccua

SEQ ID NO: 2438024 - RNA, 12 nt, Human
caguaauaacuc

SEQ ID NO: 2438025 - RNA, 13 nt, Human
caguaauaacucu

SEQ ID NO: 2438026 - RNA, 14 nt, Human
caggugucccugca

SEQ ID NO: 2438027 - RNA, 11 nt, Human
caggugucccu

SEQ ID NO: 2438028 - RNA, 20 nt, Human
caggugguuauggagagggu

SEQ ID NO: 2438029 - RNA, 21 nt, Human
caggugguggcugcaaggugg

SEQ ID NO: 2438030 - RNA, 22 nt, Human
caggugguggcacugagccccc

SEQ ID NO: 2438031 - RNA, 21 nt, Human
caggugguggcacugagcccc

SEQ ID NO: 2438032 - RNA, 22 nt, Human
cagguggggucacucuggcagc

SEQ ID NO: 2438033 - RNA, 21 nt, Human
cagguggggucacucuggcag

SEQ ID NO: 2438034 - RNA, 20 nt, Human
cagguggggucacucuggca

SEQ ID NO: 2438035 - RNA, 19 nt, Human
cagguggggucacucuggc

SEQ ID NO: 2438036 - RNA, 20 nt, Human
caggugguggcacugagccc

SEQ ID NO: 2438037 - RNA, 19 nt, Human
caggugguggcacugagcc

SEQ ID NO: 2438038 - RNA, 15 nt, Human
caggugguggcacug

SEQ ID NO: 2438039 - RNA, 20 nt, Human
caggugguccugagaccuga

SEQ ID NO: 2438040 - RNA, 16 nt, Human
caggugguccugagac

SEQ ID NO: 2438041 - RNA, 22 nt, Human
cagguggggugaggcagugggu

SEQ ID NO: 2438042 - RNA, 18 nt, Human
caggugguuauggagagg

SEQ ID NO: 2438043 - RNA, 23 nt, Human
cagguggggucacucuggcagcu

SEQ ID NO: 2438044 - RNA, 17 nt, Human
cagguggggugaggcag

SEQ ID NO: 2438045 - RNA, 15 nt, Human
cagguggggaggggg

SEQ ID NO: 2438046 - RNA, 23 nt, Human
cagguggggagucagggaccccu

SEQ ID NO: 2438047 - RNA, 23 nt, Human
cagguggggagacugggcugagg

SEQ ID NO: 2438048 - RNA, 23 nt, Human
caggugggcuucccaguggcugc

SEQ ID NO: 2438049 - RNA, 12 nt, Human
cagguggggagg

SEQ ID NO: 2438050 - RNA, 18 nt, Human
cagguggggucacucugg

SEQ ID NO: 2438051 - RNA, 17 nt, Human
cagguggggcagcuuga

SEQ ID NO: 2438052 - RNA, 16 nt, Human
cagguggggcagcuug

SEQ ID NO: 2438053 - RNA, 15 nt, Human
cagguggggcagcuu

SEQ ID NO: 2438054 - RNA, 14 nt, Human
cagguggggcagcu

SEQ ID NO: 2438055 - RNA, 13 nt, Human
cagguggggcagc

SEQ ID NO: 2438056 - RNA, 22 nt, Human
caggugggcuucccaguggcug

SEQ ID NO: 2438057 - RNA, 19 nt, Human
caggugggcuucccagugg

SEQ ID NO: 2438058 - RNA, 19 nt, Human
cagguggggagacugggcu

SEQ ID NO: 2438059 - RNA, 20 nt, Human
cagguggggagacugggcug

SEQ ID NO: 2438060 - RNA, 22 nt, Human
cagguggggagacugggcugag

SEQ ID NO: 2438061 - RNA, 16 nt, Human
caggugggcuucccag

SEQ ID NO: 2438062 - RNA, 21 nt, Human
caggugggcguggucacugcu

SEQ ID NO: 2438063 - RNA, 23 nt, Human
caggugggcguggucacugcugu

SEQ ID NO: 2438064 - RNA, 17 nt, Human
caggugggcguggucac

SEQ ID NO: 2438065 - RNA, 22 nt, Human
caggugggcgggcagcacagca

SEQ ID NO: 2438066 - RNA, 21 nt, Human
caggugggcgggcagcacagc

SEQ ID NO: 2438067 - RNA, 22 nt, Human
cagguggcugacccagucccug

SEQ ID NO: 2438068 - RNA, 21 nt, Human
caggggugggacacccuguga

SEQ ID NO: 2438069 - RNA, 20 nt, Human
caggggugggacacccugug

SEQ ID NO: 2438070 - RNA, 15 nt, Human
caggggugggacacc

SEQ ID NO: 2438071 - RNA, 14 nt, Human
caggggugggacac

SEQ ID NO: 2438072 - RNA, 16 nt, Human
cagggggugugucugc

SEQ ID NO: 2438073 - RNA, 18 nt, Human
caggggucccagccaccc

SEQ ID NO: 2438074 - RNA, 20 nt, Human
caggggucccagccaccccg

SEQ ID NO: 2438075 - RNA, 17 nt, Human
caggggucucccuggag

SEQ ID NO: 2438076 - RNA, 18 nt, Human
caggggucgucaccaccu

SEQ ID NO: 2438077 - RNA, 21 nt, Human
caggggucgucaccaccucuc

SEQ ID NO: 2438078 - RNA, 20 nt, Human
caggggugauuucagagagg

SEQ ID NO: 2438079 - RNA, 16 nt, Human
caggggucucccugga

SEQ ID NO: 2438080 - RNA, 17 nt, Human
caggggugcccccuccu

SEQ ID NO: 2438081 - RNA, 16 nt, Human
caggggugcccccucc

SEQ ID NO: 2438082 - RNA, 15 nt, Human
caggggugcccccuc

SEQ ID NO: 2438083 - RNA, 13 nt, Human
caggggugccccc

SEQ ID NO: 2438084 - RNA, 23 nt, Human
caggggugcccccuccucuccca

SEQ ID NO: 2438085 - RNA, 22 nt, Human
caggggugcccccuccucuccc

SEQ ID NO: 2438086 - RNA, 15 nt, Human
cagggucucacucug

SEQ ID NO: 2438087 - RNA, 23 nt, Human
cagggucucacuauguugcccag

SEQ ID NO: 2438088 - RNA, 22 nt, Human
cagggucucacuauguugccca

SEQ ID NO: 2438089 - RNA, 21 nt, Human
cagggucucacuauguugccc

SEQ ID NO: 2438090 - RNA, 23 nt, Human
cagggucccugguggcagcucac

SEQ ID NO: 2438091 - RNA, 16 nt, Human
cagggucccucugugu

SEQ ID NO: 2438092 - RNA, 15 nt, Human
cagggucccucugug

SEQ ID NO: 2438093 - RNA, 13 nt, Human
cagggucccugcu

SEQ ID NO: 2438094 - RNA, 21 nt, Human
cagggucccauuucucacuga

SEQ ID NO: 2438095 - RNA, 15 nt, Human
cagggucccugcugu

SEQ ID NO: 2438096 - RNA, 18 nt, Human
caggguccuguagcccua

SEQ ID NO: 2438097 - RNA, 17 nt, Human
cagguaacaggcagaua

SEQ ID NO: 2438098 - RNA, 16 nt, Human
cagguaacaggcagau

SEQ ID NO: 2438099 - RNA, 15 nt, Human
cagguaacaggcaga

SEQ ID NO: 2438100 - RNA, 14 nt, Human
cagguaacaggcag

SEQ ID NO: 2438101 - RNA, 16 nt, Human
cagggucucacucugu

SEQ ID NO: 2438102 - RNA, 16 nt, Human
caggguuuugccaugu

SEQ ID NO: 2438103 - RNA, 15 nt, Human
cagguaaacuccugu

SEQ ID NO: 2438104 - RNA, 22 nt, Human
cagggguggggguggaggcuuc

SEQ ID NO: 2438105 - RNA, 20 nt, Human
cagggguggggguggaggcu

SEQ ID NO: 2438106 - RNA, 12 nt, Human
cagggguggggg

SEQ ID NO: 2438107 - RNA, 22 nt, Human
cagggguggcugccucauuuag

SEQ ID NO: 2438108 - RNA, 15 nt, Human
cagggguugcaguga

SEQ ID NO: 2438109 - RNA, 13 nt, Human
cagggguugcagu

SEQ ID NO: 2438110 - RNA, 13 nt, Human
cagggguuucucg

SEQ ID NO: 2438111 - RNA, 21 nt, Human
cagggguucgagaccagucug

SEQ ID NO: 2438112 - RNA, 17 nt, Human
cagggguucgagaccag

SEQ ID NO: 2438113 - RNA, 13 nt, Human
cagggguucgaga

SEQ ID NO: 2438114 - RNA, 22 nt, Human
cagggguugcagugagcggaga

SEQ ID NO: 2438115 - RNA, 20 nt, Human
caggggugcccccuccucuc

SEQ ID NO: 2438116 - RNA, 20 nt, Human
caggguagcccgccugccag

SEQ ID NO: 2438117 - RNA, 16 nt, Human
caggguagcccgccug

SEQ ID NO: 2438118 - RNA, 15 nt, Human
caggguagcccgccu

SEQ ID NO: 2438119 - RNA, 13 nt, Human
caggguagcccgc

SEQ ID NO: 2438120 - RNA, 23 nt, Human
caggguagauaaccuguacuuca

SEQ ID NO: 2438121 - RNA, 13 nt, Human
caggguagcaggu

SEQ ID NO: 2438122 - RNA, 16 nt, Human
caggguagcagguacc

SEQ ID NO: 2438123 - RNA, 23 nt, Human
caggguauggacuaucugucugg

SEQ ID NO: 2438124 - RNA, 18 nt, Human
caggguauggacuaucug

SEQ ID NO: 2438125 - RNA, 21 nt, Human
caggguagcccgccugccagu

SEQ ID NO: 2438126 - RNA, 20 nt, Human
caggguauuccagagugggg

SEQ ID NO: 2438127 - RNA, 21 nt, Human
caggguauuccagagugggga

SEQ ID NO: 2438128 - RNA, 20 nt, Human
cagggucacugaaggccugg

SEQ ID NO: 2438129 - RNA, 22 nt, Human
cagggucccugguggcagcuca

SEQ ID NO: 2438130 - RNA, 19 nt, Human
cagggucccugguggcagc

SEQ ID NO: 2438131 - RNA, 18 nt, Human
cagggucccugguggcag

SEQ ID NO: 2438132 - RNA, 15 nt, Human
cagggucccuggugg

SEQ ID NO: 2438133 - RNA, 13 nt, Human
cagggucccucug

SEQ ID NO: 2438134 - RNA, 17 nt, Human
cagggucccauuucuca

SEQ ID NO: 2438135 - RNA, 21 nt, Human
cagggucacugaaggccuggc

SEQ ID NO: 2438136 - RNA, 22 nt, Human
caggguccacaggaagugaaga

SEQ ID NO: 2438137 - RNA, 14 nt, Human
cagggucaggagag

SEQ ID NO: 2438138 - RNA, 14 nt, Human
cagggucccuggug

SEQ ID NO: 2438139 - RNA, 12 nt, Human
cagggucccugg

SEQ ID NO: 2438140 - RNA, 19 nt, Human
cagguaccagcugcgcuug

SEQ ID NO: 2438141 - RNA, 18 nt, Human
cagguaccagcugcgcuu

SEQ ID NO: 2438142 - RNA, 17 nt, Human
cagguaccagcugcgcu

SEQ ID NO: 2438143 - RNA, 16 nt, Human
cagguaccagcugcgc

SEQ ID NO: 2438144 - RNA, 21 nt, Human
cagguaccagcugcgcuugcu

SEQ ID NO: 2438145 - RNA, 23 nt, Human
cagguaaugagggacuggaacca

SEQ ID NO: 2438146 - RNA, 22 nt, Human
cagguaaugagggacuggaacc

SEQ ID NO: 2438147 - RNA, 20 nt, Human
cagguaaugagggacuggaa

SEQ ID NO: 2438148 - RNA, 17 nt, Human
cagguaaugagggacug

SEQ ID NO: 2438149 - RNA, 15 nt, Human
cagguaaugagggac

SEQ ID NO: 2438150 - RNA, 17 nt, Human
cagguaaauuaagacau

SEQ ID NO: 2438151 - RNA, 13 nt, Human
cagguaaugugaa

SEQ ID NO: 2438152 - RNA, 19 nt, Human
cagguaaugugaauaaauu

SEQ ID NO: 2438153 - RNA, 15 nt, Human
cagguaccagcugcg

SEQ ID NO: 2438154 - RNA, 14 nt, Human
cagguaccagcugc

SEQ ID NO: 2438155 - RNA, 13 nt, Human
cagguaccagcug

SEQ ID NO: 2438156 - RNA, 17 nt, Human
cagguaaucgaccugcc

SEQ ID NO: 2438157 - RNA, 18 nt, Human
cagguaaucgaccugccu

SEQ ID NO: 2438158 - RNA, 19 nt, Human
cagguaaucgaccugccuc

SEQ ID NO: 2438159 - RNA, 20 nt, Human
cagguaaucgaccugccucg

SEQ ID NO: 2438160 - RNA, 21 nt, Human
cagguaacaggcagauacagg

SEQ ID NO: 2438161 - RNA, 20 nt, Human
cagguaacaggcagauacag

SEQ ID NO: 2438162 - RNA, 22 nt, Human
cagguagcugccccuggcucug

SEQ ID NO: 2438163 - RNA, 20 nt, Human
cagguagcugccccuggcuc

SEQ ID NO: 2438164 - RNA, 21 nt, Human
cagguagcugccccuggcucu

SEQ ID NO: 2438165 - RNA, 23 nt, Human
cagguagcugccccuggcucuga

SEQ ID NO: 2438166 - RNA, 12 nt, Human
cagguagccagg

SEQ ID NO: 2438167 - RNA, 14 nt, Human
cagguagcugcccc

SEQ ID NO: 2438168 - RNA, 15 nt, Human
cagguagcugccccu

SEQ ID NO: 2438169 - RNA, 16 nt, Human
cagguagcugccccug

SEQ ID NO: 2438170 - RNA, 18 nt, Human
cagguagcugccccuggc

SEQ ID NO: 2438171 - RNA, 19 nt, Human
cagguagcugccccuggcu

SEQ ID NO: 2438172 - RNA, 19 nt, Human
cagguagaacacaagguca

SEQ ID NO: 2438173 - RNA, 14 nt, Human
cagguaggaggcaa

SEQ ID NO: 2438174 - RNA, 23 nt, Human
cagguaggaggcaaauaucuuga

SEQ ID NO: 2438175 - RNA, 18 nt, Human
cagguaguugcaauugaa

SEQ ID NO: 2438176 - RNA, 23 nt, Human
cagguaguugcaauugaauuaaa

SEQ ID NO: 2438177 - RNA, 17 nt, Human
cagguauagacuccuga

SEQ ID NO: 2438178 - RNA, 16 nt, Human
cagguaucuccaggau

SEQ ID NO: 2438179 - RNA, 15 nt, Human
cagguaucuccagga

SEQ ID NO: 2438180 - RNA, 14 nt, Human
cagguaucuccagg

SEQ ID NO: 2438181 - RNA, 22 nt, Human
cagguaucuccaggauugaaga

SEQ ID NO: 2438182 - RNA, 18 nt, Human
cagguaucuccaggauug

SEQ ID NO: 2438183 - RNA, 20 nt, Human
cagguaugaccuucuaggaa

SEQ ID NO: 2438184 - RNA, 18 nt, Human
caggucccuaauaaagcu

SEQ ID NO: 2438185 - RNA, 17 nt, Human
caggucccuaauaaagc

SEQ ID NO: 2438186 - RNA, 16 nt, Human
caggucccuaauaaag

SEQ ID NO: 2438187 - RNA, 15 nt, Human
caggucccuaauaaa

SEQ ID NO: 2438188 - RNA, 14 nt, Human
caggucccuaauaa

SEQ ID NO: 2438189 - RNA, 13 nt, Human
caggucccuaaua

SEQ ID NO: 2438190 - RNA, 12 nt, Human
caggucccuaau

SEQ ID NO: 2438191 - RNA, 11 nt, Human
caggucccuaa

SEQ ID NO: 2438192 - RNA, 19 nt, Human
cagguccagcucuggaggg

SEQ ID NO: 2438193 - RNA, 17 nt, Human
cagguccagcucuggag

SEQ ID NO: 2438194 - RNA, 16 nt, Human
cagguccagcucugga

SEQ ID NO: 2438195 - RNA, 14 nt, Human
cagguccagcucug

SEQ ID NO: 2438196 - RNA, 13 nt, Human
cagguccagcucu

SEQ ID NO: 2438197 - RNA, 22 nt, Human
cagguccacggucuguucuuga

SEQ ID NO: 2438198 - RNA, 13 nt, Human
cagguccccagac

SEQ ID NO: 2438199 - RNA, 18 nt, Human
cagguccccagcuuuggc

SEQ ID NO: 2438200 - RNA, 23 nt, Human
cagguccagcucuggaggggagg

SEQ ID NO: 2438201 - RNA, 12 nt, Human
cagguccccaga

SEQ ID NO: 2438202 - RNA, 16 nt, Human
caggucagggugagga

SEQ ID NO: 2438203 - RNA, 20 nt, Human
caggucaggaguucgagacc

SEQ ID NO: 2438204 - RNA, 15 nt, Human
cagguauguugccuu

SEQ ID NO: 2438205 - RNA, 14 nt, Human
cagguauguugccu

SEQ ID NO: 2438206 - RNA, 23 nt, Human
cagguauggaaggguuuguggcu

SEQ ID NO: 2438207 - RNA, 20 nt, Human
cagguauguugccuuuaugg

SEQ ID NO: 2438208 - RNA, 16 nt, Human
cagguauguugccuuu

SEQ ID NO: 2438209 - RNA, 17 nt, Human
caggucacacgaggggc

SEQ ID NO: 2438210 - RNA, 23 nt, Human
caggucaauacaguacaggcagc

SEQ ID NO: 2438211 - RNA, 22 nt, Human
caggucaauacaguacaggcag

SEQ ID NO: 2438212 - RNA, 23 nt, Human
caggucuugaacuccuggccuca

SEQ ID NO: 2438213 - RNA, 22 nt, Human
caggucuugaacuccuggccuc

SEQ ID NO: 2438214 - RNA, 21 nt, Human
caggucuugaacuccuggccu

SEQ ID NO: 2438215 - RNA, 20 nt, Human
caggucuugaacuccuggcc

SEQ ID NO: 2438216 - RNA, 19 nt, Human
caggucuugaacuccuggc

SEQ ID NO: 2438217 - RNA, 18 nt, Human
caggucuugaacuccugg

SEQ ID NO: 2438218 - RNA, 15 nt, Human
caggucuccucuuaa

SEQ ID NO: 2438219 - RNA, 17 nt, Human
caggucuccucuuaaaa

SEQ ID NO: 2438220 - RNA, 19 nt, Human
caggucuccuccaccgcca

SEQ ID NO: 2438221 - RNA, 22 nt, Human
caggucucccacgugggagaca

SEQ ID NO: 2438222 - RNA, 13 nt, Human
caggucuccucuu

SEQ ID NO: 2438223 - RNA, 14 nt, Human
caggucuccucuua

SEQ ID NO: 2438224 - RNA, 13 nt, Human
caggucucccacg

SEQ ID NO: 2438225 - RNA, 14 nt, Human
caggucucacgggc

SEQ ID NO: 2438226 - RNA, 12 nt, Human
caggucucccac

SEQ ID NO: 2438227 - RNA, 20 nt, Human
caggucucccacgugggaga

SEQ ID NO: 2438228 - RNA, 19 nt, Human
caggucucccacgugggag

SEQ ID NO: 2438229 - RNA, 11 nt, Human
caggucuccuc

SEQ ID NO: 2438230 - RNA, 22 nt, Human
caggucccuaauaaagcugugu

SEQ ID NO: 2438231 - RNA, 21 nt, Human
caggucccuaauaaagcugug

SEQ ID NO: 2438232 - RNA, 20 nt, Human
caggucccuaauaaagcugu

SEQ ID NO: 2438233 - RNA, 19 nt, Human
caggucccuaauaaagcug

SEQ ID NO: 2438234 - RNA, 15 nt, Human
cagguccucagagaa

SEQ ID NO: 2438235 - RNA, 20 nt, Human
cagguccucagagaauuucu

SEQ ID NO: 2438236 - RNA, 22 nt, Human
cagguccucugauacccagagc

SEQ ID NO: 2438237 - RNA, 21 nt, Human
cagguccucugauacccagag

SEQ ID NO: 2438238 - RNA, 21 nt, Human
cagguccugcagucuggcuga

SEQ ID NO: 2438239 - RNA, 13 nt, Human
caggugcugcugc

SEQ ID NO: 2438240 - RNA, 23 nt, Human
caggugcugcuacccucccugcu

SEQ ID NO: 2438241 - RNA, 22 nt, Human
caggugcugcuacccucccugc

SEQ ID NO: 2438242 - RNA, 20 nt, Human
caggugagcccauggcccuc

SEQ ID NO: 2438243 - RNA, 17 nt, Human
cagguggcaggaccagg

SEQ ID NO: 2438244 - RNA, 16 nt, Human
cagguggcaggaccag

SEQ ID NO: 2438245 - RNA, 15 nt, Human
cagguggcaggacca

SEQ ID NO: 2438246 - RNA, 23 nt, Human
cagguggaggugucaggcugcug

SEQ ID NO: 2438247 - RNA, 21 nt, Human
cagguggaggugucaggcugc

SEQ ID NO: 2438248 - RNA, 20 nt, Human
cagguggcaggaccaggacu

SEQ ID NO: 2438249 - RNA, 18 nt, Human
cagguggcaggaccagga

SEQ ID NO: 2438250 - RNA, 21 nt, Human
cagguggcaggaccaggacua

SEQ ID NO: 2438251 - RNA, 15 nt, Human
cagguggccacucca

SEQ ID NO: 2438252 - RNA, 19 nt, Human
cagguggccagccuggauc

SEQ ID NO: 2438253 - RNA, 21 nt, Human
cagguggccacuccagacccc

SEQ ID NO: 2438254 - RNA, 19 nt, Human
cagguggccacuccagacc

SEQ ID NO: 2438255 - RNA, 16 nt, Human
cagguggccacuccag

SEQ ID NO: 2438256 - RNA, 14 nt, Human
cagguggcugaccc

SEQ ID NO: 2438257 - RNA, 15 nt, Human
cagguggcugaccca

SEQ ID NO: 2438258 - RNA, 16 nt, Human
cagguggcugacccag

SEQ ID NO: 2438259 - RNA, 19 nt, Human
cagguggcugacccagucc

SEQ ID NO: 2438260 - RNA, 20 nt, Human
cagguggcugacccaguccc

SEQ ID NO: 2438261 - RNA, 23 nt, Human
cagguggcugacccagucccugg

SEQ ID NO: 2438262 - RNA, 15 nt, Human
cagguggccaugccu

SEQ ID NO: 2438263 - RNA, 13 nt, Human
cagguggccaugc

SEQ ID NO: 2438264 - RNA, 22 nt, Human
cagguggcucugaggugccugu

SEQ ID NO: 2438265 - RNA, 19 nt, Human
cagguggccaugccucagc

SEQ ID NO: 2438266 - RNA, 21 nt, Human
caggugagaagcagaggaagg

SEQ ID NO: 2438267 - RNA, 17 nt, Human
caggugagcccauggcc

SEQ ID NO: 2438268 - RNA, 15 nt, Human
caggugagcccaugg

SEQ ID NO: 2438269 - RNA, 21 nt, Human
caggugcugcuacccucccug

SEQ ID NO: 2438270 - RNA, 21 nt, Human
caggugagcaaccaguuggcu

SEQ ID NO: 2438271 - RNA, 18 nt, Human
caggugaccuucugggaa

SEQ ID NO: 2438272 - RNA, 13 nt, Human
caggugagaagca

SEQ ID NO: 2438273 - RNA, 20 nt, Human
caggugagaagcagaggaag

SEQ ID NO: 2438274 - RNA, 21 nt, Human
caggucuuggagcugagccuc

SEQ ID NO: 2438275 - RNA, 20 nt, Human
caggucuuggagcugagccu

SEQ ID NO: 2438276 - RNA, 23 nt, Human
caggucuuggagcugagccucuc

SEQ ID NO: 2438277 - RNA, 13 nt, Human
caggucuuuccua

SEQ ID NO: 2438278 - RNA, 20 nt, Human
caggucuucaucgaaucuac

SEQ ID NO: 2438279 - RNA, 19 nt, Human
caggucuuggagcugagcc

SEQ ID NO: 2438280 - RNA, 22 nt, Human
caggucuccucuuaaaaaauaa

SEQ ID NO: 2438281 - RNA, 14 nt, Human
caggucuuuccuaa

SEQ ID NO: 2438282 - RNA, 19 nt, Human
caggucuuuccuaaggcug

SEQ ID NO: 2438283 - RNA, 21 nt, Human
caggucuuuccuaaggcugca

SEQ ID NO: 2438284 - RNA, 20 nt, Human
caggugaagcaccaagcuca

SEQ ID NO: 2438285 - RNA, 12 nt, Human
caggugacaugu

SEQ ID NO: 2438286 - RNA, 21 nt, Human
caggugacaugugaaaccuuu

SEQ ID NO: 2438287 - RNA, 18 nt, Human
caggugacaugugaaacc

SEQ ID NO: 2438288 - RNA, 23 nt, Human
caggugaccaaaauccccuucuc

SEQ ID NO: 2438289 - RNA, 17 nt, Human
caggugaccuucuggga

SEQ ID NO: 2438290 - RNA, 17 nt, Human
caggugacaugugaaac

SEQ ID NO: 2438291 - RNA, 16 nt, Human
caggugacaugugaaa

SEQ ID NO: 2438292 - RNA, 14 nt, Human
caggugacauguga

SEQ ID NO: 2438293 - RNA, 13 nt, Human
caggauagacuuu

SEQ ID NO: 2438294 - RNA, 15 nt, Human
caggauaguugcucc

SEQ ID NO: 2438295 - RNA, 23 nt, Human
caggauacucugucagaugggaa

SEQ ID NO: 2438296 - RNA, 18 nt, Human
caggauacucugucagau

SEQ ID NO: 2438297 - RNA, 20 nt, Human
caggauacucugucagaugg

SEQ ID NO: 2438298 - RNA, 18 nt, Human
caggauaauaaaguguuu

SEQ ID NO: 2438299 - RNA, 14 nt, Human
caggauacaugugc

SEQ ID NO: 2438300 - RNA, 17 nt, Human
caggauacucugucaga

SEQ ID NO: 2438301 - RNA, 22 nt, Human
caggaguuugagaccaaccugg

SEQ ID NO: 2438302 - RNA, 23 nt, Human
caggaguuugagaccaaccuggg

SEQ ID NO: 2438303 - RNA, 18 nt, Human
caggaguuugaggcugca

SEQ ID NO: 2438304 - RNA, 20 nt, Human
caggaguuugaggcugcagc

SEQ ID NO: 2438305 - RNA, 21 nt, Human
caggaguuugaggcugcagcg

SEQ ID NO: 2438306 - RNA, 22 nt, Human
caggaguuugaggcugcagcga

SEQ ID NO: 2438307 - RNA, 22 nt, Human
caggagugggaaaacacugcca

SEQ ID NO: 2438308 - RNA, 17 nt, Human
caggaguggguugauuu

SEQ ID NO: 2438309 - RNA, 19 nt, Human
caggaguuaaaaagggcag

SEQ ID NO: 2438310 - RNA, 16 nt, Human
caggaguuagaggcca

SEQ ID NO: 2438311 - RNA, 17 nt, Human
caggaguuagaggccag

SEQ ID NO: 2438312 - RNA, 18 nt, Human
caggaguuagaggccagc

SEQ ID NO: 2438313 - RNA, 19 nt, Human
caggaguuagaggccagcc

SEQ ID NO: 2438314 - RNA, 20 nt, Human
caggaguuagaggccagccu

SEQ ID NO: 2438315 - RNA, 21 nt, Human
caggaguuagaggccagccug

SEQ ID NO: 2438316 - RNA, 21 nt, Human
caggaguucaauaaaugucug

SEQ ID NO: 2438317 - RNA, 22 nt, Human
caggaguuagaggccagccugg

SEQ ID NO: 2438318 - RNA, 23 nt, Human
caggaguucaauaaaugucuguu

SEQ ID NO: 2438319 - RNA, 21 nt, Human
caggaguucgagaccagccug

SEQ ID NO: 2438320 - RNA, 19 nt, Human
caggaguuucguuuucaaa

SEQ ID NO: 2438321 - RNA, 21 nt, Human
caggaguuugagaccaaccug

SEQ ID NO: 2438322 - RNA, 18 nt, Human
caggaguucgaggcugca

SEQ ID NO: 2438323 - RNA, 23 nt, Human
caggaguucgagaccagccuggc

SEQ ID NO: 2438324 - RNA, 19 nt, Human
caggaguucgaggcugcag

SEQ ID NO: 2438325 - RNA, 16 nt, Human
caggaguuggaagugu

SEQ ID NO: 2438326 - RNA, 18 nt, Human
caggaguccacuuuguuu

SEQ ID NO: 2438327 - RNA, 14 nt, Human
caggaguccacuuu

SEQ ID NO: 2438328 - RNA, 15 nt, Human
caggagucccaagga

SEQ ID NO: 2438329 - RNA, 16 nt, Human
caggagucccaaggaa

SEQ ID NO: 2438330 - RNA, 17 nt, Human
caggagucccaaggaaa

SEQ ID NO: 2438331 - RNA, 18 nt, Human
caggagucccaaggaaag

SEQ ID NO: 2438332 - RNA, 12 nt, Human
caggagugagca

SEQ ID NO: 2438333 - RNA, 24 nt, Human
caggagucccaaggaaagccccag

SEQ ID NO: 2438334 - RNA, 13 nt, Human
caggagucccugg

SEQ ID NO: 2438335 - RNA, 14 nt, Human
caggagucccuggu

SEQ ID NO: 2438336 - RNA, 15 nt, Human
caggagucccuggua

SEQ ID NO: 2438337 - RNA, 15 nt, Human
caggagucccugcca

SEQ ID NO: 2438338 - RNA, 21 nt, Human
caggagucccugccaucaugu

SEQ ID NO: 2438339 - RNA, 14 nt, Human
caggagucccugcc

SEQ ID NO: 2438340 - RNA, 19 nt, Human
caggagucccaaggaaagc

SEQ ID NO: 2438341 - RNA, 21 nt, Human
caggagucccaaggaaagccc

SEQ ID NO: 2438342 - RNA, 21 nt, Human
caggagcccugggaggcucug

SEQ ID NO: 2438343 - RNA, 20 nt, Human
caggagcauccaccuccuuc

SEQ ID NO: 2438344 - RNA, 22 nt, Human
caggagcauccaccuccuucuc

SEQ ID NO: 2438345 - RNA, 17 nt, Human
caggagccuccugcccu

SEQ ID NO: 2438346 - RNA, 14 nt, Human
caggagccuccugc

SEQ ID NO: 2438347 - RNA, 11 nt, Human
caggagccugg

SEQ ID NO: 2438348 - RNA, 12 nt, Human
caggagccuggc

SEQ ID NO: 2438349 - RNA, 20 nt, Human
caggagccuccugcccuuac

SEQ ID NO: 2438350 - RNA, 16 nt, Human
caggagccugugccuc

SEQ ID NO: 2438351 - RNA, 15 nt, Human
caggagccugugccu

SEQ ID NO: 2438352 - RNA, 19 nt, Human
caggagcagccacauuccu

SEQ ID NO: 2438353 - RNA, 14 nt, Human
caggagcagccaca

SEQ ID NO: 2438354 - RNA, 13 nt, Human
caggagcagccac

SEQ ID NO: 2438355 - RNA, 12 nt, Human
caggagcagcca

SEQ ID NO: 2438356 - RNA, 18 nt, Human
caggagccccgaggccuu

SEQ ID NO: 2438357 - RNA, 16 nt, Human
caggagccccgaggcc

SEQ ID NO: 2438358 - RNA, 23 nt, Human
caggagcagccucagaacaaagu

SEQ ID NO: 2438359 - RNA, 20 nt, Human
caggagcagccucagaacaa

SEQ ID NO: 2438360 - RNA, 15 nt, Human
caggagcagccucag

SEQ ID NO: 2438361 - RNA, 16 nt, Human
caggagcaguaucaug

SEQ ID NO: 2438362 - RNA, 20 nt, Human
caggagcaguaucaugaagc

SEQ ID NO: 2438363 - RNA, 15 nt, Human
caggagccccgaggc

SEQ ID NO: 2438364 - RNA, 19 nt, Human
caggagcccugggaggcuc

SEQ ID NO: 2438365 - RNA, 18 nt, Human
caggagcccugggaggcu

SEQ ID NO: 2438366 - RNA, 16 nt, Human
caggagcccugggagg

SEQ ID NO: 2438367 - RNA, 14 nt, Human
caggagcccuggga

SEQ ID NO: 2438368 - RNA, 22 nt, Human
caggagccccgaggccuucucu

SEQ ID NO: 2438369 - RNA, 20 nt, Human
caggagccccgaggccuucu

SEQ ID NO: 2438370 - RNA, 11 nt, Human
caggagcccug

SEQ ID NO: 2438371 - RNA, 23 nt, Human
caggagccccgaggccuucucug

SEQ ID NO: 2438372 - RNA, 16 nt, Human
caggacucugccuccu

SEQ ID NO: 2438373 - RNA, 15 nt, Human
caggacucugccucc

SEQ ID NO: 2438374 - RNA, 13 nt, Human
caggacucugccu

SEQ ID NO: 2438375 - RNA, 12 nt, Human
caggacucugcc

SEQ ID NO: 2438376 - RNA, 22 nt, Human
caggacucccuccucaccucug

SEQ ID NO: 2438377 - RNA, 23 nt, Human
caggacucccuccucaccucugg

SEQ ID NO: 2438378 - RNA, 13 nt, Human
caggacugggcca

SEQ ID NO: 2438379 - RNA, 12 nt, Human
caggacugggcc

SEQ ID NO: 2438380 - RNA, 16 nt, Human
caggacugggccacuu

SEQ ID NO: 2438381 - RNA, 15 nt, Human
caggacugggccacu

SEQ ID NO: 2438382 - RNA, 14 nt, Human
caggacugugacuc

SEQ ID NO: 2438383 - RNA, 20 nt, Human
caggacugggccacuucugg

SEQ ID NO: 2438384 - RNA, 13 nt, Human
caggacugcacag

SEQ ID NO: 2438385 - RNA, 19 nt, Human
caggacugcaacaggcuug

SEQ ID NO: 2438386 - RNA, 20 nt, Human
caggacugagccccgcagac

SEQ ID NO: 2438387 - RNA, 18 nt, Human
caggacugagccccgcag

SEQ ID NO: 2438388 - RNA, 18 nt, Human
caggacucuugugaaaag

SEQ ID NO: 2438389 - RNA, 20 nt, Human
caggacucugcccagaccac

SEQ ID NO: 2438390 - RNA, 18 nt, Human
caggacugaauugucccc

SEQ ID NO: 2438391 - RNA, 19 nt, Human
caggacugaauugucccca

SEQ ID NO: 2438392 - RNA, 17 nt, Human
caggacugagccccgca

SEQ ID NO: 2438393 - RNA, 14 nt, Human
caggacugagcccc

SEQ ID NO: 2438394 - RNA, 20 nt, Human
caggacugaauuguccccag

SEQ ID NO: 2438395 - RNA, 21 nt, Human
caggacugaauuguccccagu

SEQ ID NO: 2438396 - RNA, 20 nt, Human
caggacuccccaggccaggc

SEQ ID NO: 2438397 - RNA, 19 nt, Human
caggacuccccaggccagg

SEQ ID NO: 2438398 - RNA, 18 nt, Human
caggacuccccaggccag

SEQ ID NO: 2438399 - RNA, 17 nt, Human
caggacuccccaggcca

SEQ ID NO: 2438400 - RNA, 16 nt, Human
caggacuccccaggcc

SEQ ID NO: 2438401 - RNA, 15 nt, Human
caggacuccccaggc

SEQ ID NO: 2438402 - RNA, 21 nt, Human
caggacucagcuccccagagu

SEQ ID NO: 2438403 - RNA, 20 nt, Human
caggacucagcuccccagag

SEQ ID NO: 2438404 - RNA, 19 nt, Human
caggacucagcuccccaga

SEQ ID NO: 2438405 - RNA, 13 nt, Human
caggacucccucc

SEQ ID NO: 2438406 - RNA, 14 nt, Human
caggacucccuccu

SEQ ID NO: 2438407 - RNA, 15 nt, Human
caggacucccuccuc

SEQ ID NO: 2438408 - RNA, 16 nt, Human
caggacucccuccuca

SEQ ID NO: 2438409 - RNA, 17 nt, Human
caggacucccuccucac

SEQ ID NO: 2438410 - RNA, 19 nt, Human
caggacucccuccucaccu

SEQ ID NO: 2438411 - RNA, 20 nt, Human
caggacucccuccucaccuc

SEQ ID NO: 2438412 - RNA, 21 nt, Human
caggacucccuccucaccucu

SEQ ID NO: 2438413 - RNA, 18 nt, Human
caggacucagcuccccag

SEQ ID NO: 2438414 - RNA, 17 nt, Human
caggacucagcucccca

SEQ ID NO: 2438415 - RNA, 14 nt, Human
caggacucagcucc

SEQ ID NO: 2438416 - RNA, 21 nt, Human
caggacuauagcccagguccu

SEQ ID NO: 2438417 - RNA, 20 nt, Human
caggacucagaagccucugg

SEQ ID NO: 2438418 - RNA, 21 nt, Human
caggacucagaagccucuggg

SEQ ID NO: 2438419 - RNA, 18 nt, Human
caggacucagaagccucu

SEQ ID NO: 2438420 - RNA, 19 nt, Human
caggacucagaagccucug

SEQ ID NO: 2438421 - RNA, 16 nt, Human
caggacucagaagccu

SEQ ID NO: 2438422 - RNA, 20 nt, Human
caggacuauauuugggccug

SEQ ID NO: 2438423 - RNA, 18 nt, Human
caggacuauagcccaggu

SEQ ID NO: 2438424 - RNA, 17 nt, Human
caggacuauagcccagg

SEQ ID NO: 2438425 - RNA, 16 nt, Human
caggacuauagcccag

SEQ ID NO: 2438426 - RNA, 23 nt, Human
caggacggggccggccagguggg

SEQ ID NO: 2438427 - RNA, 22 nt, Human
caggacggggccggccaggugg

SEQ ID NO: 2438428 - RNA, 24 nt, Human
caggacggggccggccaggugggc

SEQ ID NO: 2438429 - RNA, 23 nt, Human
caggacuuggucugauuucagga

SEQ ID NO: 2438430 - RNA, 20 nt, Human
caggacuuggucugauuuca

SEQ ID NO: 2438431 - RNA, 23 nt, Human
caggagaaaugcauccauuccuc

SEQ ID NO: 2438432 - RNA, 11 nt, Human
caggagaacca

SEQ ID NO: 2438433 - RNA, 23 nt, Human
caggacuuaacggcuccaggauu

SEQ ID NO: 2438434 - RNA, 21 nt, Human
caggacuuaacggcuccagga

SEQ ID NO: 2438435 - RNA, 20 nt, Human
caggacuuaacggcuccagg

SEQ ID NO: 2438436 - RNA, 19 nt, Human
caggacuuaacggcuccag

SEQ ID NO: 2438437 - RNA, 17 nt, Human
caggagaaccacuacau

SEQ ID NO: 2438438 - RNA, 19 nt, Human
caggagaaggccaauuccu

SEQ ID NO: 2438439 - RNA, 21 nt, Human
caggagaaggccaauuccuau

SEQ ID NO: 2438440 - RNA, 22 nt, Human
caggagaaggccaauuccuaua

SEQ ID NO: 2438441 - RNA, 14 nt, Human
caggagacaggaag

SEQ ID NO: 2438442 - RNA, 12 nt, Human
caggagacaucc

SEQ ID NO: 2438443 - RNA, 18 nt, Human
caggagagagaaagccag

SEQ ID NO: 2438444 - RNA, 14 nt, Human
caggagagagaaag

SEQ ID NO: 2438445 - RNA, 13 nt, Human
caggagagagaaa

SEQ ID NO: 2438446 - RNA, 12 nt, Human
caggagagagaa

SEQ ID NO: 2438447 - RNA, 20 nt, Human
caggagagagaaagccaggc

SEQ ID NO: 2438448 - RNA, 19 nt, Human
caggagagagaaagccagg

SEQ ID NO: 2438449 - RNA, 19 nt, Human
caggagagaguugaaccua

SEQ ID NO: 2438450 - RNA, 15 nt, Human
caggagacaggaagg

SEQ ID NO: 2438451 - RNA, 14 nt, Human
caggagagaaaggg

SEQ ID NO: 2438452 - RNA, 16 nt, Human
caggagacccacaggu

SEQ ID NO: 2438453 - RNA, 21 nt, Human
caggagaggagagccagagaa

SEQ ID NO: 2438454 - RNA, 20 nt, Human
caggagaggagagccagaga

SEQ ID NO: 2438455 - RNA, 19 nt, Human
caggagaggagagccagag

SEQ ID NO: 2438456 - RNA, 18 nt, Human
caggagaggagagccaga

SEQ ID NO: 2438457 - RNA, 12 nt, Human
caggagaggagc

SEQ ID NO: 2438458 - RNA, 22 nt, Human
caggagaggagagccagagaag

SEQ ID NO: 2438459 - RNA, 20 nt, Human
caggagaggagcgggaccug

SEQ ID NO: 2438460 - RNA, 12 nt, Human
caggagaguaga

SEQ ID NO: 2438461 - RNA, 15 nt, Human
caggagaggggcaga

SEQ ID NO: 2438462 - RNA, 17 nt, Human
caggagaggggcagaac

SEQ ID NO: 2438463 - RNA, 12 nt, Human
caggagagcagc

SEQ ID NO: 2438464 - RNA, 23 nt, Human
caggagagagaaagccaggcagg

SEQ ID NO: 2438465 - RNA, 22 nt, Human
caggagagcagcggggcgaagc

SEQ ID NO: 2438466 - RNA, 13 nt, Human
caggagagccagc

SEQ ID NO: 2438467 - RNA, 15 nt, Human
caggagagccagccc

SEQ ID NO: 2438468 - RNA, 16 nt, Human
caggagagccagcccu

SEQ ID NO: 2438469 - RNA, 17 nt, Human
caggagagccagcccuc

SEQ ID NO: 2438470 - RNA, 18 nt, Human
caggagagccagcccucc

SEQ ID NO: 2438471 - RNA, 17 nt, Human
caggagaggagagccag

SEQ ID NO: 2438472 - RNA, 16 nt, Human
caggagaggagagcca

SEQ ID NO: 2438473 - RNA, 15 nt, Human
caggagaggagagcc

SEQ ID NO: 2438474 - RNA, 14 nt, Human
caggagaggagagc

SEQ ID NO: 2438475 - RNA, 19 nt, Human
caggagagccagcccuccc

SEQ ID NO: 2438476 - RNA, 21 nt, Human
caggagagccagcccucccug

SEQ ID NO: 2438477 - RNA, 23 nt, Human
caggagagccagcccucccuguc

SEQ ID NO: 2438478 - RNA, 18 nt, Human
caggagcaaauguuucug

SEQ ID NO: 2438479 - RNA, 23 nt, Human
caggagauugagaaggagagaaa

SEQ ID NO: 2438480 - RNA, 22 nt, Human
caggagauugagaaggagagaa

SEQ ID NO: 2438481 - RNA, 21 nt, Human
caggagauugagaaggagaga

SEQ ID NO: 2438482 - RNA, 20 nt, Human
caggagauugagaaggagag

SEQ ID NO: 2438483 - RNA, 19 nt, Human
caggagauugagaaggaga

SEQ ID NO: 2438484 - RNA, 17 nt, Human
caggagauugagaagga

SEQ ID NO: 2438485 - RNA, 16 nt, Human
caggagauugagaagg

SEQ ID NO: 2438486 - RNA, 12 nt, Human
caggagagggaa

SEQ ID NO: 2438487 - RNA, 20 nt, Human
caggagauggaaguugcagu

SEQ ID NO: 2438488 - RNA, 22 nt, Human
caggagcaaauguuucugcagu

SEQ ID NO: 2438489 - RNA, 19 nt, Human
caggagcaaauguuucugc

SEQ ID NO: 2438490 - RNA, 23 nt, Human
caggagcacaggcagcuggauga

SEQ ID NO: 2438491 - RNA, 18 nt, Human
caggagcacaggcagcug

SEQ ID NO: 2438492 - RNA, 17 nt, Human
caggagcacaggcagcu

SEQ ID NO: 2438493 - RNA, 16 nt, Human
caggagcacaggcagc

SEQ ID NO: 2438494 - RNA, 15 nt, Human
caggagcacaggcag

SEQ ID NO: 2438495 - RNA, 22 nt, Human
caggauccuauucucaccagga

SEQ ID NO: 2438496 - RNA, 21 nt, Human
caggauccuauucucaccagg

SEQ ID NO: 2438497 - RNA, 23 nt, Human
caggaucgcaagagccauguaga

SEQ ID NO: 2438498 - RNA, 20 nt, Human
caggauccuauucucaccag

SEQ ID NO: 2438499 - RNA, 22 nt, Human
caggaucccaggggcccaaggc

SEQ ID NO: 2438500 - RNA, 19 nt, Human
caggauccuauucucacca

SEQ ID NO: 2438501 - RNA, 22 nt, Human
caggaucaugguguaauaagac

SEQ ID NO: 2438502 - RNA, 21 nt, Human
caggaucaugguguaauaaga

SEQ ID NO: 2438503 - RNA, 19 nt, Human
caggaucaugguguaauaa

SEQ ID NO: 2438504 - RNA, 18 nt, Human
caggaucaugguguaaua

SEQ ID NO: 2438505 - RNA, 16 nt, Human
caggaucaugguguaa

SEQ ID NO: 2438506 - RNA, 15 nt, Human
caggaucauggugua

SEQ ID NO: 2438507 - RNA, 21 nt, Human
caggaucccaggggcccaagg

SEQ ID NO: 2438508 - RNA, 23 nt, Human
caggaucaugguguaauaagaca

SEQ ID NO: 2438509 - RNA, 16 nt, Human
caggaucccaggggcc

SEQ ID NO: 2438510 - RNA, 24 nt, Human
caggaucagauugcaugugacucu

SEQ ID NO: 2438511 - RNA, 20 nt, Human
caggaucagauugcauguga

SEQ ID NO: 2438512 - RNA, 23 nt, Human
caggaucagauugcaugugacuc

SEQ ID NO: 2438513 - RNA, 14 nt, Human
caggaucagucuga

SEQ ID NO: 2438514 - RNA, 13 nt, Human
caggaucagucug

SEQ ID NO: 2438515 - RNA, 23 nt, Human
caggaugguucccuugaugaaga

SEQ ID NO: 2438516 - RNA, 21 nt, Human
caggaugguucccuugaugaa

SEQ ID NO: 2438517 - RNA, 24 nt, Human
caggauggccuggccagggccugg

SEQ ID NO: 2438518 - RNA, 17 nt, Human
caggauggccuggccag

SEQ ID NO: 2438519 - RNA, 18 nt, Human
caggaugggggcuggccu

SEQ ID NO: 2438520 - RNA, 16 nt, Human
caggauggccuggcca

SEQ ID NO: 2438521 - RNA, 15 nt, Human
caggauggccuggcc

SEQ ID NO: 2438522 - RNA, 23 nt, Human
caggauggcccuucccacuggag

SEQ ID NO: 2438523 - RNA, 19 nt, Human
caggaugggggcuggccuc

SEQ ID NO: 2438524 - RNA, 17 nt, Human
caggauucuuccucccu

SEQ ID NO: 2438525 - RNA, 18 nt, Human
caggauucuuccucccuc

SEQ ID NO: 2438526 - RNA, 19 nt, Human
caggauguacaaggacagc

SEQ ID NO: 2438527 - RNA, 21 nt, Human
caggaugggggcuggccucug

SEQ ID NO: 2438528 - RNA, 22 nt, Human
caggaugaugacuauggaaaga

SEQ ID NO: 2438529 - RNA, 23 nt, Human
caggaugcuaacaucuaaaaaua

SEQ ID NO: 2438530 - RNA, 13 nt, Human
caggaugcccagg

SEQ ID NO: 2438531 - RNA, 14 nt, Human
caggaugcccaggg

SEQ ID NO: 2438532 - RNA, 17 nt, Human
caggaugcccagggcca

SEQ ID NO: 2438533 - RNA, 23 nt, Human
caggauggccgggcgcgguggcu

SEQ ID NO: 2438534 - RNA, 15 nt, Human
caggauggaggggug

SEQ ID NO: 2438535 - RNA, 21 nt, Human
caggauggaggggugguccug

SEQ ID NO: 2438536 - RNA, 22 nt, Human
caggauggaggggugguccuga

SEQ ID NO: 2438537 - RNA, 23 nt, Human
caggauggaggggugguccugac

SEQ ID NO: 2438538 - RNA, 19 nt, Human
caggaugcccagggccacu

SEQ ID NO: 2438539 - RNA, 22 nt, Human
caggaugcccagggccacucug

SEQ ID NO: 2438540 - RNA, 24 nt, Human
caggaugcccagggccacucugcc

SEQ ID NO: 2438541 - RNA, 20 nt, Human
caggaugaugacuauggaaa

SEQ ID NO: 2438542 - RNA, 18 nt, Human
caggaugaugacuaugga

SEQ ID NO: 2438543 - RNA, 21 nt, Human
caggaugacgguauuaugcuu

SEQ ID NO: 2438544 - RNA, 20 nt, Human
caggaugacgguauuaugcu

SEQ ID NO: 2438545 - RNA, 17 nt, Human
caggaugaccuggauaa

SEQ ID NO: 2438546 - RNA, 16 nt, Human
caggaugaccuggaua

SEQ ID NO: 2438547 - RNA, 15 nt, Human
caggaugacccugcg

SEQ ID NO: 2438548 - RNA, 18 nt, Human
caggaucucuuagcauuu

SEQ ID NO: 2438549 - RNA, 15 nt, Human
caggaugaacccagg

SEQ ID NO: 2438550 - RNA, 23 nt, Human
caggaucucuuagcauuuuaauu

SEQ ID NO: 2438551 - RNA, 17 nt, Human
caggaugaacccaggac

SEQ ID NO: 2438552 - RNA, 16 nt, Human
caggaugaacccagga

SEQ ID NO: 2438553 - RNA, 15 nt, Human
caggcaugccugugu

SEQ ID NO: 2438554 - RNA, 16 nt, Human
caggcaugccugugug

SEQ ID NO: 2438555 - RNA, 17 nt, Human
caggcaugguggcccac

SEQ ID NO: 2438556 - RNA, 12 nt, Human
caggcauccucc

SEQ ID NO: 2438557 - RNA, 20 nt, Human
caggcaugaacauguacugu

SEQ ID NO: 2438558 - RNA, 12 nt, Human
caggcaugaagu

SEQ ID NO: 2438559 - RNA, 17 nt, Human
caggcaugcaugugcuu

SEQ ID NO: 2438560 - RNA, 14 nt, Human
caggcaugccugug

SEQ ID NO: 2438561 - RNA, 18 nt, Human
caggcagucgggggcugg

SEQ ID NO: 2438562 - RNA, 16 nt, Human
caggcagucgggggcu

SEQ ID NO: 2438563 - RNA, 16 nt, Human
caggcaggugccugga

SEQ ID NO: 2438564 - RNA, 14 nt, Human
caggcaggugccug

SEQ ID NO: 2438565 - RNA, 20 nt, Human
caggcagguagccaggggga

SEQ ID NO: 2438566 - RNA, 15 nt, Human
caggcagggugcagu

SEQ ID NO: 2438567 - RNA, 22 nt, Human
caggcagucgggggcuggccua

SEQ ID NO: 2438568 - RNA, 21 nt, Human
caggcagucgggggcuggccu

SEQ ID NO: 2438569 - RNA, 20 nt, Human
caggcagucgggggcuggcc

SEQ ID NO: 2438570 - RNA, 19 nt, Human
caggcagucgggggcuggc

SEQ ID NO: 2438571 - RNA, 24 nt, Human
caggcagucgggggcuggccuagg

SEQ ID NO: 2438572 - RNA, 23 nt, Human
caggcagucgggggcuggccuag

SEQ ID NO: 2438573 - RNA, 20 nt, Human
caggcagugaugcuggaugc

SEQ ID NO: 2438574 - RNA, 22 nt, Human
caggcagugaugcuggaugcuc

SEQ ID NO: 2438575 - RNA, 23 nt, Human
caggcauagaggcuucuccgcca

SEQ ID NO: 2438576 - RNA, 21 nt, Human
caggcauagaggcuucuccgc

SEQ ID NO: 2438577 - RNA, 19 nt, Human
caggcauagaggcuucucc

SEQ ID NO: 2438578 - RNA, 18 nt, Human
caggcauagaggcuucuc

SEQ ID NO: 2438579 - RNA, 17 nt, Human
caggcauagaggcuucu

SEQ ID NO: 2438580 - RNA, 14 nt, Human
caggcauagaggcu

SEQ ID NO: 2438581 - RNA, 17 nt, Human
caggcaguuggccagag

SEQ ID NO: 2438582 - RNA, 14 nt, Human
caggcauaggccug

SEQ ID NO: 2438583 - RNA, 15 nt, Human
caggcauaggccugg

SEQ ID NO: 2438584 - RNA, 16 nt, Human
caggcauaggccuggg

SEQ ID NO: 2438585 - RNA, 17 nt, Human
caggcauaggccugggu

SEQ ID NO: 2438586 - RNA, 15 nt, Human
caggcaucacagcua

SEQ ID NO: 2438587 - RNA, 14 nt, Human
caggcaucacagcu

SEQ ID NO: 2438588 - RNA, 18 nt, Human
caggcauaggccugggug

SEQ ID NO: 2438589 - RNA, 19 nt, Human
caggcauaggccugggugc

SEQ ID NO: 2438590 - RNA, 23 nt, Human
caggcaggucuugaacuccuggc

SEQ ID NO: 2438591 - RNA, 15 nt, Human
caggcaggugggaug

SEQ ID NO: 2438592 - RNA, 22 nt, Human
caggcaggucuugaacuccugg

SEQ ID NO: 2438593 - RNA, 13 nt, Human
caggcaggucuug

SEQ ID NO: 2438594 - RNA, 12 nt, Human
caggcaggucuu

SEQ ID NO: 2438595 - RNA, 19 nt, Human
caggcagguccaggguuug

SEQ ID NO: 2438596 - RNA, 15 nt, Human
caggcagguccaggg

SEQ ID NO: 2438597 - RNA, 14 nt, Human
caggcagguccagg

SEQ ID NO: 2438598 - RNA, 21 nt, Human
caggcauuccccaggaggcca

SEQ ID NO: 2438599 - RNA, 20 nt, Human
caggcauuccccaggaggcc

SEQ ID NO: 2438600 - RNA, 19 nt, Human
caggcauuccccaggaggc

SEQ ID NO: 2438601 - RNA, 18 nt, Human
caggcauuccccaggagg

SEQ ID NO: 2438602 - RNA, 23 nt, Human
caggcauuccccaggaggccagc

SEQ ID NO: 2438603 - RNA, 22 nt, Human
caggcauuccccaggaggccag

SEQ ID NO: 2438604 - RNA, 19 nt, Human
caggcauugccaagggcuu

SEQ ID NO: 2438605 - RNA, 24 nt, Human
caggcauuccccaggaggccagcc

SEQ ID NO: 2438606 - RNA, 17 nt, Human
caggcauuccccaggag

SEQ ID NO: 2438607 - RNA, 16 nt, Human
caggcauuccccagga

SEQ ID NO: 2438608 - RNA, 15 nt, Human
caggcauuccccagg

SEQ ID NO: 2438609 - RNA, 13 nt, Human
caggcauucccca

SEQ ID NO: 2438610 - RNA, 20 nt, Human
caggcauguucucugaggac

SEQ ID NO: 2438611 - RNA, 19 nt, Human
caggcauguucucugagga

SEQ ID NO: 2438612 - RNA, 18 nt, Human
caggcauguucucugagg

SEQ ID NO: 2438613 - RNA, 15 nt, Human
caggcauguucucug

SEQ ID NO: 2438614 - RNA, 16 nt, Human
caggauuuuaaucuuu

SEQ ID NO: 2438615 - RNA, 14 nt, Human
caggcaaaauccuu

SEQ ID NO: 2438616 - RNA, 18 nt, Human
caggcaaaauccuugcuu

SEQ ID NO: 2438617 - RNA, 22 nt, Human
caggauuuuaacaaaagcaaga

SEQ ID NO: 2438618 - RNA, 13 nt, Human
caggcaaaucagu

SEQ ID NO: 2438619 - RNA, 11 nt, Human
caggcaaauca

SEQ ID NO: 2438620 - RNA, 16 nt, Human
caggcaaagcaaguga

SEQ ID NO: 2438621 - RNA, 15 nt, Human
caggcaacugaggca

SEQ ID NO: 2438622 - RNA, 16 nt, Human
caggcaacugaggcag

SEQ ID NO: 2438623 - RNA, 17 nt, Human
caggcaacugaggcaga

SEQ ID NO: 2438624 - RNA, 18 nt, Human
caggcaacugaggcagac

SEQ ID NO: 2438625 - RNA, 19 nt, Human
caggcaacugaggcagaca

SEQ ID NO: 2438626 - RNA, 21 nt, Human
caggauuugaacucagaucug

SEQ ID NO: 2438627 - RNA, 21 nt, Human
caggauuucgugggucuguuu

SEQ ID NO: 2438628 - RNA, 22 nt, Human
caggauuugaacucagaucugu

SEQ ID NO: 2438629 - RNA, 15 nt, Human
caggauugaagagca

SEQ ID NO: 2438630 - RNA, 13 nt, Human
caggauugaagag

SEQ ID NO: 2438631 - RNA, 20 nt, Human
caggauucuuccucccuccc

SEQ ID NO: 2438632 - RNA, 21 nt, Human
caggcaagcaccuccugccuc

SEQ ID NO: 2438633 - RNA, 16 nt, Human
caggcaagcaccuccu

SEQ ID NO: 2438634 - RNA, 15 nt, Human
caggcaagcaccucc

SEQ ID NO: 2438635 - RNA, 14 nt, Human
caggcaagcaccuc

SEQ ID NO: 2438636 - RNA, 15 nt, Human
caggcagccaggcca

SEQ ID NO: 2438637 - RNA, 14 nt, Human
caggcagccaggcc

SEQ ID NO: 2438638 - RNA, 18 nt, Human
caggcaagugaagaaaag

SEQ ID NO: 2438639 - RNA, 22 nt, Human
caggcaaggucuggccucaggu

SEQ ID NO: 2438640 - RNA, 17 nt, Human
caggcaaggucuggccu

SEQ ID NO: 2438641 - RNA, 20 nt, Human
caggcaacugaggcagacag

SEQ ID NO: 2438642 - RNA, 22 nt, Human
caggcaacugaggcagacagca

SEQ ID NO: 2438643 - RNA, 12 nt, Human
caggcagcccua

SEQ ID NO: 2438644 - RNA, 17 nt, Human
caggcagccaggccaca

SEQ ID NO: 2438645 - RNA, 16 nt, Human
caggcagccaggccac

SEQ ID NO: 2438646 - RNA, 20 nt, Human
caggcaggaaggcugagagg

SEQ ID NO: 2438647 - RNA, 18 nt, Human
caggcaggaagggcagga

SEQ ID NO: 2438648 - RNA, 22 nt, Human
caggcagcuuuuucucucccac

SEQ ID NO: 2438649 - RNA, 19 nt, Human
caggcagcuuuuucucucc

SEQ ID NO: 2438650 - RNA, 15 nt, Human
caggcagcgccaagc

SEQ ID NO: 2438651 - RNA, 14 nt, Human
caggcagcgccaag

SEQ ID NO: 2438652 - RNA, 18 nt, Human
caggcagcgauggucuca

SEQ ID NO: 2438653 - RNA, 21 nt, Human
caggcagcgauggucucagaa

SEQ ID NO: 2438654 - RNA, 12 nt, Human
caggcagcgaug

SEQ ID NO: 2438655 - RNA, 13 nt, Human
caggcagccugga

SEQ ID NO: 2438656 - RNA, 20 nt, Human
caggcagcuuuaaccauuaa

SEQ ID NO: 2438657 - RNA, 18 nt, Human
caggcagcuggaugagac

SEQ ID NO: 2438658 - RNA, 15 nt, Human
caggcagcuggauga

SEQ ID NO: 2438659 - RNA, 23 nt, Human
caggcagggcugacucuaggugc

SEQ ID NO: 2438660 - RNA, 17 nt, Human
caggcagggcugacucu

SEQ ID NO: 2438661 - RNA, 23 nt, Human
caggcagggguggggguggaggc

SEQ ID NO: 2438662 - RNA, 22 nt, Human
caggcagggguggggguggagg

SEQ ID NO: 2438663 - RNA, 21 nt, Human
caggcagggguggggguggag

SEQ ID NO: 2438664 - RNA, 17 nt, Human
caggcaggggugggggu

SEQ ID NO: 2438665 - RNA, 13 nt, Human
caggcaggggugg

SEQ ID NO: 2438666 - RNA, 12 nt, Human
caggcaggggug

SEQ ID NO: 2438667 - RNA, 13 nt, Human
caggcagguccag

SEQ ID NO: 2438668 - RNA, 19 nt, Human
caggcaggcugugcgcuga

SEQ ID NO: 2438669 - RNA, 13 nt, Human
caggcaggcugug

SEQ ID NO: 2438670 - RNA, 12 nt, Human
caggcaggcugu

SEQ ID NO: 2438671 - RNA, 21 nt, Human
caggcaggccaaggccuucuc

SEQ ID NO: 2438672 - RNA, 23 nt, Human
caggcaggcuaaggcguggagcu

SEQ ID NO: 2438673 - RNA, 20 nt, Human
caggcaggcuaaggcgugga

SEQ ID NO: 2438674 - RNA, 19 nt, Human
caggcaggaagggcaggaa

SEQ ID NO: 2438675 - RNA, 22 nt, Human
caggcagggccaacccuucucc

SEQ ID NO: 2438676 - RNA, 20 nt, Human
caggcagggccaacccuucu

SEQ ID NO: 2438677 - RNA, 20 nt, Human
caggccccugccacccuggg

SEQ ID NO: 2438678 - RNA, 19 nt, Human
caggccccugccacccugg

SEQ ID NO: 2438679 - RNA, 17 nt, Human
caggccccugccacccu

SEQ ID NO: 2438680 - RNA, 15 nt, Human
caggccccugccacc

SEQ ID NO: 2438681 - RNA, 15 nt, Human
caggcccggcuccag

SEQ ID NO: 2438682 - RNA, 14 nt, Human
caggcccggcucca

SEQ ID NO: 2438683 - RNA, 22 nt, Human
caggccccuuuucacucccucc

SEQ ID NO: 2438684 - RNA, 21 nt, Human
caggccccgugaggcaauggg

SEQ ID NO: 2438685 - RNA, 13 nt, Human
caggcccggcucc

SEQ ID NO: 2438686 - RNA, 18 nt, Human
caggccaaacucaccugc

SEQ ID NO: 2438687 - RNA, 18 nt, Human
caggcauuugacugaaga

SEQ ID NO: 2438688 - RNA, 23 nt, Human
caggcauuugacugaagaugcag

SEQ ID NO: 2438689 - RNA, 21 nt, Human
caggcauuugacugaagaugc

SEQ ID NO: 2438690 - RNA, 23 nt, Human
caggccaaacucaccugccccuc

SEQ ID NO: 2438691 - RNA, 17 nt, Human
caggccaagaaacgucu

SEQ ID NO: 2438692 - RNA, 18 nt, Human
caggccaagagcagaggc

SEQ ID NO: 2438693 - RNA, 18 nt, Human
caggccacaagacccuug

SEQ ID NO: 2438694 - RNA, 17 nt, Human
caggccacaagacccuu

SEQ ID NO: 2438695 - RNA, 13 nt, Human
caggccacaagac

SEQ ID NO: 2438696 - RNA, 19 nt, Human
caggccaagagcagaggca

SEQ ID NO: 2438697 - RNA, 21 nt, Human
caggccaagagcagaggcagc

SEQ ID NO: 2438698 - RNA, 19 nt, Human
caggccaaggccuucuccu

SEQ ID NO: 2438699 - RNA, 23 nt, Human
caggccaagagcagaggcagcga

SEQ ID NO: 2438700 - RNA, 15 nt, Human
caggccauggaggca

SEQ ID NO: 2438701 - RNA, 19 nt, Human
caggccaucuuccaggugg

SEQ ID NO: 2438702 - RNA, 16 nt, Human
caggccaucuuccagg

SEQ ID NO: 2438703 - RNA, 15 nt, Human
caggccaucuuccag

SEQ ID NO: 2438704 - RNA, 18 nt, Human
caggccauuccccgucuc

SEQ ID NO: 2438705 - RNA, 14 nt, Human
caggccaucuucca

SEQ ID NO: 2438706 - RNA, 13 nt, Human
caggccaucuucc

SEQ ID NO: 2438707 - RNA, 18 nt, Human
caggccauccggccccca

SEQ ID NO: 2438708 - RNA, 23 nt, Human
caggccaguaagggaaauagaaa

SEQ ID NO: 2438709 - RNA, 22 nt, Human
caggccaguaagggaaauagaa

SEQ ID NO: 2438710 - RNA, 21 nt, Human
caggccaguaagggaaauaga

SEQ ID NO: 2438711 - RNA, 21 nt, Human
caggccaucaucaguggagcc

SEQ ID NO: 2438712 - RNA, 21 nt, Human
caggccagggggccagucccu

SEQ ID NO: 2438713 - RNA, 23 nt, Human
caggccaccauauucagugcugu

SEQ ID NO: 2438714 - RNA, 15 nt, Human
caggccaggugcagu

SEQ ID NO: 2438715 - RNA, 12 nt, Human
caggccaggcuc

SEQ ID NO: 2438716 - RNA, 18 nt, Human
caggccaggcuccuuccu

SEQ ID NO: 2438717 - RNA, 16 nt, Human
caggccaggugcagug

SEQ ID NO: 2438718 - RNA, 16 nt, Human
caggccaguaagggaa

SEQ ID NO: 2438719 - RNA, 21 nt, Human
caggccaggcuccuuccuguc

SEQ ID NO: 2438720 - RNA, 22 nt, Human
caggccaggcccucugcccacu

SEQ ID NO: 2438721 - RNA, 21 nt, Human
caggccaggcccucugcccac

SEQ ID NO: 2438722 - RNA, 20 nt, Human
caggccacaagacccuugug

SEQ ID NO: 2438723 - RNA, 16 nt, Human
caggccaccaggaugg

SEQ ID NO: 2438724 - RNA, 15 nt, Human
caggccaccaggaug

SEQ ID NO: 2438725 - RNA, 13 nt, Human
caggccaccagga

SEQ ID NO: 2438726 - RNA, 23 nt, Human
caggccacauggggcugggcagc

SEQ ID NO: 2438727 - RNA, 20 nt, Human
caggcccccaggugccaguu

SEQ ID NO: 2438728 - RNA, 20 nt, Human
caggccccgaggacccagac

SEQ ID NO: 2438729 - RNA, 18 nt, Human
caggccccgaggacccag

SEQ ID NO: 2438730 - RNA, 17 nt, Human
caggccccgaggaccca

SEQ ID NO: 2438731 - RNA, 13 nt, Human
caggccccugcca

SEQ ID NO: 2438732 - RNA, 22 nt, Human
caggccccgaggacccagaccc

SEQ ID NO: 2438733 - RNA, 21 nt, Human
caggccccgaggacccagacc

SEQ ID NO: 2438734 - RNA, 23 nt, Human
caggccccgaggacccagaccca

SEQ ID NO: 2438735 - RNA, 17 nt, Human
caggccccgcuugucca

SEQ ID NO: 2438736 - RNA, 18 nt, Human
caggccccgcuuguccag

SEQ ID NO: 2438737 - RNA, 19 nt, Human
caggccccgcuuguccagc

SEQ ID NO: 2438738 - RNA, 22 nt, Human
caggccccgcuuguccagcgcc

SEQ ID NO: 2438739 - RNA, 23 nt, Human
caggccccgcuuguccagcgccu

SEQ ID NO: 2438740 - RNA, 14 nt, Human
caggcccccaggug

SEQ ID NO: 2438741 - RNA, 19 nt, Human
caggcccccaggugccagu

SEQ ID NO: 2438742 - RNA, 21 nt, Human
caggcccccagaaccccuggc

SEQ ID NO: 2438743 - RNA, 18 nt, Human
caggcccccaagccugca

SEQ ID NO: 2438744 - RNA, 19 nt, Human
caggcccccaagccugcag

SEQ ID NO: 2438745 - RNA, 15 nt, Human
caggcccccaagccu

SEQ ID NO: 2438746 - RNA, 17 nt, Human
caggcccccaagccugc

SEQ ID NO: 2438747 - RNA, 15 nt, Human
caggcccccaccacu

SEQ ID NO: 2438748 - RNA, 21 nt, Human
caggcccagcauugcugguuc

SEQ ID NO: 2438749 - RNA, 20 nt, Human
caggcccagcauugcugguu

SEQ ID NO: 2438750 - RNA, 19 nt, Human
caggcccagcauugcuggu

SEQ ID NO: 2438751 - RNA, 12 nt, Human
caggcccagcau

SEQ ID NO: 2438752 - RNA, 11 nt, Human
caggcccagca

SEQ ID NO: 2438753 - RNA, 10 nt, Human
caggcccagc

SEQ ID NO: 2438754 - RNA, 13 nt, Human
caggcccacagua

SEQ ID NO: 2438755 - RNA, 18 nt, Human
caggcccaagagaugaag

SEQ ID NO: 2438756 - RNA, 19 nt, Human
caggcccaagagaugaaga

SEQ ID NO: 2438757 - RNA, 21 nt, Human
caggccauuccccgucucugg

SEQ ID NO: 2438758 - RNA, 18 nt, Human
caggccauggaggcagaa

SEQ ID NO: 2438759 - RNA, 22 nt, Human
caggcccagcauugcugguucu

SEQ ID NO: 2438760 - RNA, 15 nt, Human
caggccccaggaaag

SEQ ID NO: 2438761 - RNA, 17 nt, Human
caggccccaaaaccaca

SEQ ID NO: 2438762 - RNA, 19 nt, Human
caggccccaaaaccacagc

SEQ ID NO: 2438763 - RNA, 22 nt, Human
caggccccaaaaccacagcccu

SEQ ID NO: 2438764 - RNA, 23 nt, Human
caggccccaaaaccacagcccug

SEQ ID NO: 2438765 - RNA, 13 nt, Human
caggcccccaagc

SEQ ID NO: 2438766 - RNA, 13 nt, Human
caggccccagcaa

SEQ ID NO: 2438767 - RNA, 13 nt, Human
caggccccaggaa

SEQ ID NO: 2438768 - RNA, 14 nt, Human
caggccccaggaag

SEQ ID NO: 2438769 - RNA, 15 nt, Human
caggccccaggaagc

SEQ ID NO: 2438770 - RNA, 16 nt, Human
caggccccaggaagcc

SEQ ID NO: 2438771 - RNA, 17 nt, Human
caggccccaggaagccg

SEQ ID NO: 2438772 - RNA, 18 nt, Human
caggccccaggcagggcc

SEQ ID NO: 2438773 - RNA, 12 nt, Human
caggcugcucuu

SEQ ID NO: 2438774 - RNA, 20 nt, Human
caggcugcucuugaacuccu

SEQ ID NO: 2438775 - RNA, 18 nt, Human
caggcugcucagggcugg

SEQ ID NO: 2438776 - RNA, 17 nt, Human
caggcugcucagggcug

SEQ ID NO: 2438777 - RNA, 23 nt, Human
caggcugcucuugaacuccugac

SEQ ID NO: 2438778 - RNA, 11 nt, Human
caggcugcugg

SEQ ID NO: 2438779 - RNA, 12 nt, Human
caggcugcugga

SEQ ID NO: 2438780 - RNA, 14 nt, Human
caggcugcuggagg

SEQ ID NO: 2438781 - RNA, 15 nt, Human
caggcugcuggagga

SEQ ID NO: 2438782 - RNA, 22 nt, Human
caggcugcuggcgccucugcaa

SEQ ID NO: 2438783 - RNA, 20 nt, Human
caggcugcuggcgccucugc

SEQ ID NO: 2438784 - RNA, 18 nt, Human
caggcugcuggcgccucu

SEQ ID NO: 2438785 - RNA, 16 nt, Human
caggcugcuggcgccu

SEQ ID NO: 2438786 - RNA, 13 nt, Human
caggcugcuggcg

SEQ ID NO: 2438787 - RNA, 12 nt, Human
caggcugcuggc

SEQ ID NO: 2438788 - RNA, 16 nt, Human
caggcugcuggaggaa

SEQ ID NO: 2438789 - RNA, 20 nt, Human
caggcuggagguaaggccuu

SEQ ID NO: 2438790 - RNA, 21 nt, Human
caggcugcuggcgccucugca

SEQ ID NO: 2438791 - RNA, 14 nt, Human
caggcuggacgugg

SEQ ID NO: 2438792 - RNA, 12 nt, Human
caggcugcuugg

SEQ ID NO: 2438793 - RNA, 15 nt, Human
caggcugcuugggau

SEQ ID NO: 2438794 - RNA, 15 nt, Human
caggcuggccagccc

SEQ ID NO: 2438795 - RNA, 14 nt, Human
caggcuggccagcc

SEQ ID NO: 2438796 - RNA, 13 nt, Human
caggcuggccagc

SEQ ID NO: 2438797 - RNA, 11 nt, Human
caggcuggcca

SEQ ID NO: 2438798 - RNA, 20 nt, Human
caggcuggcagcucuccagu

SEQ ID NO: 2438799 - RNA, 19 nt, Human
caggcuggcagcucuccag

SEQ ID NO: 2438800 - RNA, 12 nt, Human
caggcuggccag

SEQ ID NO: 2438801 - RNA, 18 nt, Human
caggcuggcagcucucca

SEQ ID NO: 2438802 - RNA, 17 nt, Human
caggcuggcagcucucc

SEQ ID NO: 2438803 - RNA, 16 nt, Human
caggcuggcagcucuc

SEQ ID NO: 2438804 - RNA, 15 nt, Human
caggcuggcagcucu

SEQ ID NO: 2438805 - RNA, 21 nt, Human
caggcuggagguaaggccuuu

SEQ ID NO: 2438806 - RNA, 20 nt, Human
caggcuggcaccgccuucuc

SEQ ID NO: 2438807 - RNA, 13 nt, Human
caggcuggcagcu

SEQ ID NO: 2438808 - RNA, 21 nt, Human
caggcuggcaccgccuucucu

SEQ ID NO: 2438809 - RNA, 23 nt, Human
caggcuggccagccccacagccc

SEQ ID NO: 2438810 - RNA, 21 nt, Human
caggcuggccagccccacagc

SEQ ID NO: 2438811 - RNA, 20 nt, Human
caggcuggccagccccacag

SEQ ID NO: 2438812 - RNA, 19 nt, Human
caggcuggccagccccaca

SEQ ID NO: 2438813 - RNA, 18 nt, Human
caggcuggccagccccac

SEQ ID NO: 2438814 - RNA, 17 nt, Human
caggcuggccagcccca

SEQ ID NO: 2438815 - RNA, 16 nt, Human
caggcuggccagcccc

SEQ ID NO: 2438816 - RNA, 19 nt, Human
caggcuggccaguccaggc

SEQ ID NO: 2438817 - RNA, 18 nt, Human
caggcuggccaguccagg

SEQ ID NO: 2438818 - RNA, 16 nt, Human
caggcuggccagucca

SEQ ID NO: 2438819 - RNA, 14 nt, Human
caggcuggccaguc

SEQ ID NO: 2438820 - RNA, 12 nt, Human
caggcuggcccu

SEQ ID NO: 2438821 - RNA, 14 nt, Human
caggcuggcccugc

SEQ ID NO: 2438822 - RNA, 15 nt, Human
caggcuggcccugcc

SEQ ID NO: 2438823 - RNA, 16 nt, Human
caggcuggcccugccc

SEQ ID NO: 2438824 - RNA, 18 nt, Human
caggcuggggcugaccuu

SEQ ID NO: 2438825 - RNA, 13 nt, Human
caggcuggggcug

SEQ ID NO: 2438826 - RNA, 21 nt, Human
caggcuggccaguccaggcug

SEQ ID NO: 2438827 - RNA, 23 nt, Human
caggcugggucgcccuggacugu

SEQ ID NO: 2438828 - RNA, 21 nt, Human
caggcugggucgcccuggacu

SEQ ID NO: 2438829 - RNA, 23 nt, Human
caggcugggcuucaguggcagcu

SEQ ID NO: 2438830 - RNA, 13 nt, Human
caggcugagccuc

SEQ ID NO: 2438831 - RNA, 14 nt, Human
caggcugagccuca

SEQ ID NO: 2438832 - RNA, 15 nt, Human
caggcugagccucag

SEQ ID NO: 2438833 - RNA, 16 nt, Human
caggcugagccucagu

SEQ ID NO: 2438834 - RNA, 17 nt, Human
caggcugagccucaguc

SEQ ID NO: 2438835 - RNA, 21 nt, Human
caggcugagccucagucuccc

SEQ ID NO: 2438836 - RNA, 16 nt, Human
caggcugacaucugug

SEQ ID NO: 2438837 - RNA, 11 nt, Human
caggcugaggu

SEQ ID NO: 2438838 - RNA, 22 nt, Human
caggcugccaaggccagagugg

SEQ ID NO: 2438839 - RNA, 21 nt, Human
caggcugccaaggccagagug

SEQ ID NO: 2438840 - RNA, 16 nt, Human
caggcugccguggggc

SEQ ID NO: 2438841 - RNA, 22 nt, Human
caggcucugugcugacccuccu

SEQ ID NO: 2438842 - RNA, 21 nt, Human
caggcucugugcugacccucc

SEQ ID NO: 2438843 - RNA, 19 nt, Human
caggcucugugcugacccu

SEQ ID NO: 2438844 - RNA, 18 nt, Human
caggcucugugcugaccc

SEQ ID NO: 2438845 - RNA, 15 nt, Human
caggcucugugcuga

SEQ ID NO: 2438846 - RNA, 14 nt, Human
caggcucugugcug

SEQ ID NO: 2438847 - RNA, 13 nt, Human
caggcucugugcu

SEQ ID NO: 2438848 - RNA, 17 nt, Human
caggcucugccucaccu

SEQ ID NO: 2438849 - RNA, 18 nt, Human
caggcucuuagcagcuuc

SEQ ID NO: 2438850 - RNA, 15 nt, Human
caggcucuuagcagc

SEQ ID NO: 2438851 - RNA, 24 nt, Human
caggcucugugcugacccuccugu

SEQ ID NO: 2438852 - RNA, 23 nt, Human
caggcucugugcugacccuccug

SEQ ID NO: 2438853 - RNA, 12 nt, Human
caggcucuuagc

SEQ ID NO: 2438854 - RNA, 22 nt, Human
caggcucuuagcagcuuccaga

SEQ ID NO: 2438855 - RNA, 21 nt, Human
caggcucuuagcagcuuccag

SEQ ID NO: 2438856 - RNA, 12 nt, Human
caggcucuucuc

SEQ ID NO: 2438857 - RNA, 15 nt, Human
caggcucuucuccuu

SEQ ID NO: 2438858 - RNA, 14 nt, Human
caggcucuucuccu

SEQ ID NO: 2438859 - RNA, 15 nt, Human
caggcugaccacagc

SEQ ID NO: 2438860 - RNA, 17 nt, Human
caggcugaccacagcac

SEQ ID NO: 2438861 - RNA, 20 nt, Human
caggcugaccacagcacagc

SEQ ID NO: 2438862 - RNA, 21 nt, Human
caggcugaccacagcacagcc

SEQ ID NO: 2438863 - RNA, 22 nt, Human
caggcugaccacagcacagcca

SEQ ID NO: 2438864 - RNA, 12 nt, Human
caggcugagccu

SEQ ID NO: 2438865 - RNA, 23 nt, Human
caggcucuuuggggucagccagg

SEQ ID NO: 2438866 - RNA, 18 nt, Human
caggcugaagcagguucc

SEQ ID NO: 2438867 - RNA, 14 nt, Human
caggcugacaucug

SEQ ID NO: 2438868 - RNA, 22 nt, Human
caggcucuuuggggucagccag

SEQ ID NO: 2438869 - RNA, 14 nt, Human
caggcugaccacag

SEQ ID NO: 2438870 - RNA, 22 nt, Human
caggcucuucuccuuucacaac

SEQ ID NO: 2438871 - RNA, 18 nt, Human
caggcucuucuccuuuca

SEQ ID NO: 2438872 - RNA, 21 nt, Human
caggcuuagucacugagacag

SEQ ID NO: 2438873 - RNA, 20 nt, Human
caggcuuagucacugagaca

SEQ ID NO: 2438874 - RNA, 17 nt, Human
caggcuuagucacugag

SEQ ID NO: 2438875 - RNA, 16 nt, Human
caggcuuagucacuga

SEQ ID NO: 2438876 - RNA, 14 nt, Human
caggcugugaguuu

SEQ ID NO: 2438877 - RNA, 17 nt, Human
caggcugucuggccagg

SEQ ID NO: 2438878 - RNA, 16 nt, Human
caggcugucuggccag

SEQ ID NO: 2438879 - RNA, 19 nt, Human
caggcugugcgcugacaac

SEQ ID NO: 2438880 - RNA, 22 nt, Human
caggcugugcgcugacaaccac

SEQ ID NO: 2438881 - RNA, 16 nt, Human
caggcugugggccuca

SEQ ID NO: 2438882 - RNA, 17 nt, Human
caggcugugggccucaa

SEQ ID NO: 2438883 - RNA, 23 nt, Human
caggcuguaucccaugagccuca

SEQ ID NO: 2438884 - RNA, 22 nt, Human
caggcuguaucccaugagccuc

SEQ ID NO: 2438885 - RNA, 21 nt, Human
caggcuguaucccaugagccu

SEQ ID NO: 2438886 - RNA, 20 nt, Human
caggcuguaucccaugagcc

SEQ ID NO: 2438887 - RNA, 15 nt, Human
caggcuggugggagg

SEQ ID NO: 2438888 - RNA, 18 nt, Human
caggcuggugggaggggc

SEQ ID NO: 2438889 - RNA, 23 nt, Human
caggcuggucucgaacuccugac

SEQ ID NO: 2438890 - RNA, 14 nt, Human
caggcuguauccca

SEQ ID NO: 2438891 - RNA, 20 nt, Human
caggcuggucucgaacuccu

SEQ ID NO: 2438892 - RNA, 22 nt, Human
caggcuggucucgaacuccuga

SEQ ID NO: 2438893 - RNA, 19 nt, Human
caggcuggucucaaacucu

SEQ ID NO: 2438894 - RNA, 12 nt, Human
caggcuggucuc

SEQ ID NO: 2438895 - RNA, 13 nt, Human
caggcuggucuca

SEQ ID NO: 2438896 - RNA, 23 nt, Human
caggcuggucucaaacuccugac

SEQ ID NO: 2438897 - RNA, 23 nt, Human
caggcuuagucacugagacagcc

SEQ ID NO: 2438898 - RNA, 22 nt, Human
caggcuuagucacugagacagc

SEQ ID NO: 2438899 - RNA, 22 nt, Human
caggcuucacccugaaugguuc

SEQ ID NO: 2438900 - RNA, 15 nt, Human
caggcuucacccuga

SEQ ID NO: 2438901 - RNA, 14 nt, Human
caggcuuccuuggc

SEQ ID NO: 2438902 - RNA, 18 nt, Human
caggcuugccugcaggca

SEQ ID NO: 2438903 - RNA, 17 nt, Human
caggcuugccugcaggc

SEQ ID NO: 2438904 - RNA, 16 nt, Human
caggcuugccugcagg

SEQ ID NO: 2438905 - RNA, 15 nt, Human
caggcuugccugcag

SEQ ID NO: 2438906 - RNA, 23 nt, Human
caggcuuuuuuaucaugugaaau

SEQ ID NO: 2438907 - RNA, 23 nt, Human
caggcuuuguuuauagcuugcgc

SEQ ID NO: 2438908 - RNA, 15 nt, Human
cagggaaaagcagcu

SEQ ID NO: 2438909 - RNA, 19 nt, Human
caggcccggcuccaggcuc

SEQ ID NO: 2438910 - RNA, 18 nt, Human
caggcccggcuccaggcu

SEQ ID NO: 2438911 - RNA, 16 nt, Human
caggcccggcuccagg

SEQ ID NO: 2438912 - RNA, 17 nt, Human
caggcccggcuccaggc

SEQ ID NO: 2438913 - RNA, 21 nt, Human
caggcccggcuccaggcuccu

SEQ ID NO: 2438914 - RNA, 20 nt, Human
caggcccggcuccaggcucc

SEQ ID NO: 2438915 - RNA, 18 nt, Human
caggcccggcgcgguggc

SEQ ID NO: 2438916 - RNA, 16 nt, Human
caggcccggggcuggc

SEQ ID NO: 2438917 - RNA, 22 nt, Human
caggcccggcuccaggcuccuu

SEQ ID NO: 2438918 - RNA, 15 nt, Human
caggcccucugccca

SEQ ID NO: 2438919 - RNA, 14 nt, Human
caggcccucugccc

SEQ ID NO: 2438920 - RNA, 13 nt, Human
caggcccucugcc

SEQ ID NO: 2438921 - RNA, 23 nt, Human
caggcccucccuguuccccagag

SEQ ID NO: 2438922 - RNA, 15 nt, Human
caggcccggggcugg

SEQ ID NO: 2438923 - RNA, 22 nt, Human
caggcccucccuguuccccaga

SEQ ID NO: 2438924 - RNA, 19 nt, Human
caggcccggcgcgguggcu

SEQ ID NO: 2438925 - RNA, 14 nt, Human
caggcccggggcug

SEQ ID NO: 2438926 - RNA, 22 nt, Human
caggcccucugcccacucccug

SEQ ID NO: 2438927 - RNA, 21 nt, Human
caggcccucugcccacucccu

SEQ ID NO: 2438928 - RNA, 23 nt, Human
caggcccugcacuguccugcucc

SEQ ID NO: 2438929 - RNA, 14 nt, Human
caggcccugcacug

SEQ ID NO: 2438930 - RNA, 13 nt, Human
caggcccugcacu

SEQ ID NO: 2438931 - RNA, 12 nt, Human
caggcccugcac

SEQ ID NO: 2438932 - RNA, 11 nt, Human
caggcccugca

SEQ ID NO: 2438933 - RNA, 20 nt, Human
caggcccucugcccacuccc

SEQ ID NO: 2438934 - RNA, 19 nt, Human
caggcccucugcccacucc

SEQ ID NO: 2438935 - RNA, 17 nt, Human
caggcccucugcccacu

SEQ ID NO: 2438936 - RNA, 16 nt, Human
caggcccucugcccac

SEQ ID NO: 2438937 - RNA, 20 nt, Human
caggcccuggccuccccugc

SEQ ID NO: 2438938 - RNA, 18 nt, Human
caggcccuggccuccccu

SEQ ID NO: 2438939 - RNA, 17 nt, Human
caggcccuggccucccc

SEQ ID NO: 2438940 - RNA, 15 nt, Human
caggcccuggccucc

SEQ ID NO: 2438941 - RNA, 18 nt, Human
caggcccugcacuguccu

SEQ ID NO: 2438942 - RNA, 17 nt, Human
caggcccugcacugucc

SEQ ID NO: 2438943 - RNA, 16 nt, Human
caggcccugcacuguc

SEQ ID NO: 2438944 - RNA, 15 nt, Human
caggcccugcacugu

SEQ ID NO: 2438945 - RNA, 20 nt, Human
caggcccugcacuguccugc

SEQ ID NO: 2438946 - RNA, 19 nt, Human
caggcccugcacuguccug

SEQ ID NO: 2438947 - RNA, 14 nt, Human
caggcccuggccuc

SEQ ID NO: 2438948 - RNA, 22 nt, Human
caggcccuggccuccccugcca

SEQ ID NO: 2438949 - RNA, 21 nt, Human
caggcccuuauuuucaagaaa

SEQ ID NO: 2438950 - RNA, 15 nt, Human
caggcccuuccucuc

SEQ ID NO: 2438951 - RNA, 17 nt, Human
caggcccuuccucucca

SEQ ID NO: 2438952 - RNA, 16 nt, Human
caggcccuuccucucc

SEQ ID NO: 2438953 - RNA, 23 nt, Human
caggcccuuccucuccacugccu

SEQ ID NO: 2438954 - RNA, 21 nt, Human
caggcccuuccucuccacugc

SEQ ID NO: 2438955 - RNA, 20 nt, Human
caggcccuuccucuccacug

SEQ ID NO: 2438956 - RNA, 19 nt, Human
caggcccuuccucuccacu

SEQ ID NO: 2438957 - RNA, 14 nt, Human
caggccgcagcucu

SEQ ID NO: 2438958 - RNA, 13 nt, Human
caggccgcagcuc

SEQ ID NO: 2438959 - RNA, 18 nt, Human
caggccgagaagccagug

SEQ ID NO: 2438960 - RNA, 16 nt, Human
caggcccuuuccucag

SEQ ID NO: 2438961 - RNA, 17 nt, Human
caggcccuuuccucagg

SEQ ID NO: 2438962 - RNA, 22 nt, Human
caggcccugcacuguccugcuc

SEQ ID NO: 2438963 - RNA, 18 nt, Human
caggccgcagcucuugcc

SEQ ID NO: 2438964 - RNA, 15 nt, Human
caggccgcagcucuu

SEQ ID NO: 2438965 - RNA, 22 nt, Human
caggccgcagcucuugcccuuc

SEQ ID NO: 2438966 - RNA, 14 nt, Human
caggccgccccagc

SEQ ID NO: 2438967 - RNA, 16 nt, Human
caggccgccccagccu

SEQ ID NO: 2438968 - RNA, 18 nt, Human
caggccgccccagccucu

SEQ ID NO: 2438969 - RNA, 20 nt, Human
caggccgccccagccucuga

SEQ ID NO: 2438970 - RNA, 21 nt, Human
caggccgccccagccucugag

SEQ ID NO: 2438971 - RNA, 13 nt, Human
caggcuccugcca

SEQ ID NO: 2438972 - RNA, 14 nt, Human
caggcuccugccac

SEQ ID NO: 2438973 - RNA, 15 nt, Human
caggcuccugccacc

SEQ ID NO: 2438974 - RNA, 16 nt, Human
caggcuccugccacca

SEQ ID NO: 2438975 - RNA, 22 nt, Human
caggcucauagggaagaccugc

SEQ ID NO: 2438976 - RNA, 20 nt, Human
caggcuccuuuagcgcccag

SEQ ID NO: 2438977 - RNA, 19 nt, Human
caggcuccuuuagcgccca

SEQ ID NO: 2438978 - RNA, 18 nt, Human
caggcuccugccaccacg

SEQ ID NO: 2438979 - RNA, 12 nt, Human
caggcuccuucc

SEQ ID NO: 2438980 - RNA, 13 nt, Human
caggcuccuuccu

SEQ ID NO: 2438981 - RNA, 14 nt, Human
caggcuccuuccug

SEQ ID NO: 2438982 - RNA, 17 nt, Human
caggcuccuuccugucu

SEQ ID NO: 2438983 - RNA, 14 nt, Human
caggcuccuuuagc

SEQ ID NO: 2438984 - RNA, 22 nt, Human
caggcucacugccaggccagcc

SEQ ID NO: 2438985 - RNA, 21 nt, Human
caggcucacugccaggccagc

SEQ ID NO: 2438986 - RNA, 20 nt, Human
caggcucacugccaggccag

SEQ ID NO: 2438987 - RNA, 18 nt, Human
caggcucacugccaggcc

SEQ ID NO: 2438988 - RNA, 23 nt, Human
caggcucacugccaggccagccu

SEQ ID NO: 2438989 - RNA, 16 nt, Human
caggcucacugccagg

SEQ ID NO: 2438990 - RNA, 15 nt, Human
caggcucacugccag

SEQ ID NO: 2438991 - RNA, 14 nt, Human
caggcucacugcca

SEQ ID NO: 2438992 - RNA, 13 nt, Human
caggcucacugcc

SEQ ID NO: 2438993 - RNA, 16 nt, Human
caggcuagagugcagu

SEQ ID NO: 2438994 - RNA, 19 nt, Human
caggccggcgagcccugug

SEQ ID NO: 2438995 - RNA, 15 nt, Human
caggcuagaaccugg

SEQ ID NO: 2438996 - RNA, 19 nt, Human
caggcuagauguauguacu

SEQ ID NO: 2438997 - RNA, 13 nt, Human
caggcuagaugua

SEQ ID NO: 2438998 - RNA, 14 nt, Human
caggcuacugucag

SEQ ID NO: 2438999 - RNA, 14 nt, Human
caggccgcccugcg

SEQ ID NO: 2439000 - RNA, 23 nt, Human
caggccgccccagccucugagcc

SEQ ID NO: 2439001 - RNA, 16 nt, Human
caggcucucaggccag

SEQ ID NO: 2439002 - RNA, 15 nt, Human
caggcucucaggcca

SEQ ID NO: 2439003 - RNA, 14 nt, Human
caggcucucaggcc

SEQ ID NO: 2439004 - RNA, 13 nt, Human
caggcucucaggc

SEQ ID NO: 2439005 - RNA, 12 nt, Human
caggcucucagg

SEQ ID NO: 2439006 - RNA, 20 nt, Human
caggcucgggcuccccagcc

SEQ ID NO: 2439007 - RNA, 21 nt, Human
caggcuccuuuagcgcccagu

SEQ ID NO: 2439008 - RNA, 21 nt, Human
caggcuccuuccugucuuccu

SEQ ID NO: 2439009 - RNA, 18 nt, Human
caggcuccuuccugucuu

SEQ ID NO: 2439010 - RNA, 20 nt, Human
caggcuccuuccugucuucc

SEQ ID NO: 2439011 - RNA, 20 nt, Human
caggcucucaggccagcugc

SEQ ID NO: 2439012 - RNA, 19 nt, Human
caggcucucaggccagcug

SEQ ID NO: 2439013 - RNA, 18 nt, Human
caggcucucaggccagcu

SEQ ID NO: 2439014 - RNA, 17 nt, Human
caggcucucaggccagc

SEQ ID NO: 2439015 - RNA, 23 nt, Human
caggcucucaggccagcugcuug

SEQ ID NO: 2439016 - RNA, 21 nt, Human
caggcucucaggccagcugcu

SEQ ID NO: 2439017 - RNA, 14 nt, Human
caggcucugcccug

SEQ ID NO: 2439018 - RNA, 13 nt, Human
caggcucugcccu

SEQ ID NO: 2439019 - RNA, 15 nt, Human
caggcucugcccugc

SEQ ID NO: 2439020 - RNA, 21 nt, Human
caggcucugcccugcccuagc

SEQ ID NO: 2439021 - RNA, 22 nt, Human
caggcucugcccugcccuagcu

SEQ ID NO: 2439022 - RNA, 23 nt, Human
caggcucugcccugcccuagcuc

SEQ ID NO: 2439023 - RNA, 13 nt, Human
caggcucucaaca

SEQ ID NO: 2439024 - RNA, 14 nt, Human
caggcucucaacag

SEQ ID NO: 2439025 - RNA, 20 nt, Human
cagggggguugugaggccug

SEQ ID NO: 2439026 - RNA, 19 nt, Human
cagggggguugugaggccu

SEQ ID NO: 2439027 - RNA, 18 nt, Human
caggggggugaggagcug

SEQ ID NO: 2439028 - RNA, 19 nt, Human
caggggggugaggagcugg

SEQ ID NO: 2439029 - RNA, 15 nt, Human
caggggggugaggag

SEQ ID NO: 2439030 - RNA, 21 nt, Human
cagggggcccaccagagcugu

SEQ ID NO: 2439031 - RNA, 20 nt, Human
cagggggcccaccagagcug

SEQ ID NO: 2439032 - RNA, 19 nt, Human
cagggggccaggugcacag

SEQ ID NO: 2439033 - RNA, 15 nt, Human
caggggcuguuugag

SEQ ID NO: 2439034 - RNA, 12 nt, Human
caggggcuguuu

SEQ ID NO: 2439035 - RNA, 19 nt, Human
cagggggaagguggggucc

SEQ ID NO: 2439036 - RNA, 18 nt, Human
cagggggacuagccccug

SEQ ID NO: 2439037 - RNA, 11 nt, Human
cagggggccag

SEQ ID NO: 2439038 - RNA, 22 nt, Human
cagggggccagucccugaggca

SEQ ID NO: 2439039 - RNA, 16 nt, Human
cagggggccaggugca

SEQ ID NO: 2439040 - RNA, 13 nt, Human
cagggggccaggu

SEQ ID NO: 2439041 - RNA, 12 nt, Human
caggggagcccu

SEQ ID NO: 2439042 - RNA, 15 nt, Human
caggggagcccucca

SEQ ID NO: 2439043 - RNA, 13 nt, Human
caggggagcccuc

SEQ ID NO: 2439044 - RNA, 21 nt, Human
caggggagcccuccacgccgg

SEQ ID NO: 2439045 - RNA, 17 nt, Human
caggggagagggucugg

SEQ ID NO: 2439046 - RNA, 23 nt, Human
caggggacucagcccugagguga

SEQ ID NO: 2439047 - RNA, 20 nt, Human
caggggagagggucuggaga

SEQ ID NO: 2439048 - RNA, 21 nt, Human
caggggagagggucuggagaa

SEQ ID NO: 2439049 - RNA, 22 nt, Human
caggggacaggaguccacuuug

SEQ ID NO: 2439050 - RNA, 16 nt, Human
caggggacaggagucc

SEQ ID NO: 2439051 - RNA, 15 nt, Human
caggggaccacaccu

SEQ ID NO: 2439052 - RNA, 17 nt, Human
caggggaccacaccucc

SEQ ID NO: 2439053 - RNA, 15 nt, Human
caggggacucagccc

SEQ ID NO: 2439054 - RNA, 17 nt, Human
caggggacucagcccug

SEQ ID NO: 2439055 - RNA, 18 nt, Human
caggggacucagcccuga

SEQ ID NO: 2439056 - RNA, 20 nt, Human
caggggacucagcccugagg

SEQ ID NO: 2439057 - RNA, 21 nt, Human
caggggacucagcccugaggu

SEQ ID NO: 2439058 - RNA, 16 nt, Human
caggggacaggauggu

SEQ ID NO: 2439059 - RNA, 11 nt, Human
caggggacagg

SEQ ID NO: 2439060 - RNA, 13 nt, Human
cagggcgagacuc

SEQ ID NO: 2439061 - RNA, 15 nt, Human
cagggccuugcccag

SEQ ID NO: 2439062 - RNA, 16 nt, Human
cagggccuugcccaga

SEQ ID NO: 2439063 - RNA, 17 nt, Human
cagggccuugcccagag

SEQ ID NO: 2439064 - RNA, 18 nt, Human
cagggccuugcccagaga

SEQ ID NO: 2439065 - RNA, 19 nt, Human
cagggccuugcccagagau

SEQ ID NO: 2439066 - RNA, 20 nt, Human
cagggccuugcccagagaug

SEQ ID NO: 2439067 - RNA, 24 nt, Human
cagggccuugcccagagaugccuc

SEQ ID NO: 2439068 - RNA, 15 nt, Human
cagggccuggcucag

SEQ ID NO: 2439069 - RNA, 14 nt, Human
cagggccuggcuca

SEQ ID NO: 2439070 - RNA, 13 nt, Human
cagggccuggcuc

SEQ ID NO: 2439071 - RNA, 19 nt, Human
cagggccuggaagacagag

SEQ ID NO: 2439072 - RNA, 18 nt, Human
cagggccuggaagacaga

SEQ ID NO: 2439073 - RNA, 17 nt, Human
cagggccuggaagacag

SEQ ID NO: 2439074 - RNA, 19 nt, Human
cagggccuggcucaggugg

SEQ ID NO: 2439075 - RNA, 16 nt, Human
cagggccuggcucagg

SEQ ID NO: 2439076 - RNA, 22 nt, Human
cagggccuggggagauggagga

SEQ ID NO: 2439077 - RNA, 13 nt, Human
cagggccuugccc

SEQ ID NO: 2439078 - RNA, 14 nt, Human
cagggccuugccca

SEQ ID NO: 2439079 - RNA, 22 nt, Human
caggggccuggagauccuccug

SEQ ID NO: 2439080 - RNA, 15 nt, Human
caggggccuggagau

SEQ ID NO: 2439081 - RNA, 14 nt, Human
caggggccuggaga

SEQ ID NO: 2439082 - RNA, 13 nt, Human
caggggccuggag

SEQ ID NO: 2439083 - RNA, 12 nt, Human
caggggccugga

SEQ ID NO: 2439084 - RNA, 14 nt, Human
caggggcucuggag

SEQ ID NO: 2439085 - RNA, 13 nt, Human
caggggcucugga

SEQ ID NO: 2439086 - RNA, 19 nt, Human
caggggcuacaagagggaa

SEQ ID NO: 2439087 - RNA, 23 nt, Human
caggggccuggagauccuccugc

SEQ ID NO: 2439088 - RNA, 18 nt, Human
caggggcuacaagaggga

SEQ ID NO: 2439089 - RNA, 17 nt, Human
caggggcuacaagaggg

SEQ ID NO: 2439090 - RNA, 15 nt, Human
caggggcguggaggg

SEQ ID NO: 2439091 - RNA, 18 nt, Human
caggggcguguggcucac

SEQ ID NO: 2439092 - RNA, 12 nt, Human
caggggcugccc

SEQ ID NO: 2439093 - RNA, 19 nt, Human
caggggcucuggagagaaa

SEQ ID NO: 2439094 - RNA, 20 nt, Human
caggggcucuggagagaaac

SEQ ID NO: 2439095 - RNA, 18 nt, Human
caggggcucuggagagaa

SEQ ID NO: 2439096 - RNA, 17 nt, Human
caggggcucuggagaga

SEQ ID NO: 2439097 - RNA, 16 nt, Human
caggggcucuggagag

SEQ ID NO: 2439098 - RNA, 15 nt, Human
caggggcucuggaga

SEQ ID NO: 2439099 - RNA, 18 nt, Human
caggggcugcccgcuccc

SEQ ID NO: 2439100 - RNA, 16 nt, Human
caggggcugcccgcuc

SEQ ID NO: 2439101 - RNA, 14 nt, Human
caggggcugcccgc

SEQ ID NO: 2439102 - RNA, 13 nt, Human
caggggcugcccg

SEQ ID NO: 2439103 - RNA, 20 nt, Human
caggggcugcccgcucccag

SEQ ID NO: 2439104 - RNA, 19 nt, Human
caggggcugcccgcuccca

SEQ ID NO: 2439105 - RNA, 13 nt, Human
caggggcugcuuc

SEQ ID NO: 2439106 - RNA, 20 nt, Human
caggggcugcuuccuccugg

SEQ ID NO: 2439107 - RNA, 19 nt, Human
caggggcugcuuccuccug

SEQ ID NO: 2439108 - RNA, 18 nt, Human
caggggcugcuuccuccu

SEQ ID NO: 2439109 - RNA, 16 nt, Human
caggggcugcuuccuc

SEQ ID NO: 2439110 - RNA, 13 nt, Human
caggggcuggcuu

SEQ ID NO: 2439111 - RNA, 12 nt, Human
caggggcuggcu

SEQ ID NO: 2439112 - RNA, 22 nt, Human
caggggcugcuuccuccuggaa

SEQ ID NO: 2439113 - RNA, 17 nt, Human
caggggcuggcuucagg

SEQ ID NO: 2439114 - RNA, 15 nt, Human
caggggcuggcuuca

SEQ ID NO: 2439115 - RNA, 19 nt, Human
caggggcuggcuucaggag

SEQ ID NO: 2439116 - RNA, 17 nt, Human
caggggauugaagcccu

SEQ ID NO: 2439117 - RNA, 14 nt, Human
caggggauugaagc

SEQ ID NO: 2439118 - RNA, 22 nt, Human
caggggauggcguggucaagca

SEQ ID NO: 2439119 - RNA, 16 nt, Human
caggggauggcguggu

SEQ ID NO: 2439120 - RNA, 18 nt, Human
caggggagucccgucagg

SEQ ID NO: 2439121 - RNA, 14 nt, Human
caggggcaggagga

SEQ ID NO: 2439122 - RNA, 20 nt, Human
caggggauugaagcccucca

SEQ ID NO: 2439123 - RNA, 19 nt, Human
caggggaggguagagcgga

SEQ ID NO: 2439124 - RNA, 18 nt, Human
caggggccccuccagcuu

SEQ ID NO: 2439125 - RNA, 17 nt, Human
caggggccccuccagcu

SEQ ID NO: 2439126 - RNA, 16 nt, Human
caggggccccuccagc

SEQ ID NO: 2439127 - RNA, 15 nt, Human
caggggccccuccag

SEQ ID NO: 2439128 - RNA, 13 nt, Human
caggggccccucc

SEQ ID NO: 2439129 - RNA, 11 nt, Human
caggggccccg

SEQ ID NO: 2439130 - RNA, 16 nt, Human
caggggcccacaggga

SEQ ID NO: 2439131 - RNA, 22 nt, Human
caggggcccaaggcggccccuc

SEQ ID NO: 2439132 - RNA, 20 nt, Human
caggggccccuccagcuugu

SEQ ID NO: 2439133 - RNA, 19 nt, Human
caggggccccuccagcuug

SEQ ID NO: 2439134 - RNA, 20 nt, Human
caggggcauguauuggccug

SEQ ID NO: 2439135 - RNA, 22 nt, Human
caggggcaggcacagcacaggg

SEQ ID NO: 2439136 - RNA, 17 nt, Human
caggggcaggcacagca

SEQ ID NO: 2439137 - RNA, 16 nt, Human
caggggcaggcacagc

SEQ ID NO: 2439138 - RNA, 15 nt, Human
caggggcaggcacag

SEQ ID NO: 2439139 - RNA, 14 nt, Human
caggggcaggcaca

SEQ ID NO: 2439140 - RNA, 13 nt, Human
caggggcaggcac

SEQ ID NO: 2439141 - RNA, 21 nt, Human
caggggcccaaggcggccccu

SEQ ID NO: 2439142 - RNA, 20 nt, Human
caggggcccaaggcggcccc

SEQ ID NO: 2439143 - RNA, 15 nt, Human
caggggccagaggaa

SEQ ID NO: 2439144 - RNA, 23 nt, Human
caggggcauguauuggccuggag

SEQ ID NO: 2439145 - RNA, 22 nt, Human
caggggcauguauuggccugga

SEQ ID NO: 2439146 - RNA, 21 nt, Human
caggggcauguauuggccugg

SEQ ID NO: 2439147 - RNA, 14 nt, Human
caggggccagagga

SEQ ID NO: 2439148 - RNA, 21 nt, Human
cagggccaugcugaggccugg

SEQ ID NO: 2439149 - RNA, 18 nt, Human
cagggccaugcugaggcc

SEQ ID NO: 2439150 - RNA, 17 nt, Human
cagggccaugcugaggc

SEQ ID NO: 2439151 - RNA, 16 nt, Human
cagggccaugcugagg

SEQ ID NO: 2439152 - RNA, 17 nt, Human
cagggccaugccugccc

SEQ ID NO: 2439153 - RNA, 16 nt, Human
cagggccaugccugcc

SEQ ID NO: 2439154 - RNA, 14 nt, Human
cagggccaugcuga

SEQ ID NO: 2439155 - RNA, 20 nt, Human
cagggccaggacugagcccc

SEQ ID NO: 2439156 - RNA, 18 nt, Human
cagggccaggacugagcc

SEQ ID NO: 2439157 - RNA, 15 nt, Human
cagggccaggacuga

SEQ ID NO: 2439158 - RNA, 14 nt, Human
cagggccaggacug

SEQ ID NO: 2439159 - RNA, 12 nt, Human
cagggccagggc

SEQ ID NO: 2439160 - RNA, 13 nt, Human
cagggccagggcc

SEQ ID NO: 2439161 - RNA, 15 nt, Human
cagggccagggcccu

SEQ ID NO: 2439162 - RNA, 16 nt, Human
cagggccagggcccug

SEQ ID NO: 2439163 - RNA, 18 nt, Human
cagggccagggcccugca

SEQ ID NO: 2439164 - RNA, 19 nt, Human
cagggccagggcccugcag

SEQ ID NO: 2439165 - RNA, 13 nt, Human
cagggccaggacu

SEQ ID NO: 2439166 - RNA, 12 nt, Human
cagggccaggac

SEQ ID NO: 2439167 - RNA, 18 nt, Human
cagggccacucugccucu

SEQ ID NO: 2439168 - RNA, 20 nt, Human
cagggccacucugccucugc

SEQ ID NO: 2439169 - RNA, 18 nt, Human
cagggccacgugccaggc

SEQ ID NO: 2439170 - RNA, 20 nt, Human
cagggccacgugccaggccc

SEQ ID NO: 2439171 - RNA, 13 nt, Human
cagggccacuccc

SEQ ID NO: 2439172 - RNA, 21 nt, Human
cagggccacgugccaggcccg

SEQ ID NO: 2439173 - RNA, 19 nt, Human
cagggccacucccggcacu

SEQ ID NO: 2439174 - RNA, 12 nt, Human
cagggccacucu

SEQ ID NO: 2439175 - RNA, 16 nt, Human
cagggccacucugccu

SEQ ID NO: 2439176 - RNA, 17 nt, Human
cagggccacucugccuc

SEQ ID NO: 2439177 - RNA, 15 nt, Human
cagggccacgugcca

SEQ ID NO: 2439178 - RNA, 16 nt, Human
cagggccacgugccag

SEQ ID NO: 2439179 - RNA, 17 nt, Human
cagggccacgugccagg

SEQ ID NO: 2439180 - RNA, 22 nt, Human
cagggccaacuugagggcccag

SEQ ID NO: 2439181 - RNA, 19 nt, Human
cagggccaacuugagggcc

SEQ ID NO: 2439182 - RNA, 17 nt, Human
cagggccaacuugaggg

SEQ ID NO: 2439183 - RNA, 18 nt, Human
cagggccaacccuucucc

SEQ ID NO: 2439184 - RNA, 22 nt, Human
cagggcagcugggcccaacccu

SEQ ID NO: 2439185 - RNA, 21 nt, Human
cagggcagcugggcccaaccc

SEQ ID NO: 2439186 - RNA, 13 nt, Human
cagggcagggccc

SEQ ID NO: 2439187 - RNA, 13 nt, Human
cagggcagggcca

SEQ ID NO: 2439188 - RNA, 15 nt, Human
cagggcagggcucug

SEQ ID NO: 2439189 - RNA, 16 nt, Human
cagggcagggcucuga

SEQ ID NO: 2439190 - RNA, 19 nt, Human
cagggcagggcucugauau

SEQ ID NO: 2439191 - RNA, 15 nt, Human
cagggcaucuccagg

SEQ ID NO: 2439192 - RNA, 21 nt, Human
cagggcagucauuggcugucu

SEQ ID NO: 2439193 - RNA, 17 nt, Human
cagggcagggcucugau

SEQ ID NO: 2439194 - RNA, 21 nt, Human
cagggcaucuccaggaaggcg

SEQ ID NO: 2439195 - RNA, 18 nt, Human
cagggcaucuccaggaag

SEQ ID NO: 2439196 - RNA, 17 nt, Human
cagggcaucuccaggaa

SEQ ID NO: 2439197 - RNA, 16 nt, Human
cagggcaucuccagga

SEQ ID NO: 2439198 - RNA, 15 nt, Human
cagggcaucuccugu

SEQ ID NO: 2439199 - RNA, 13 nt, Human
cagggcaucuccu

SEQ ID NO: 2439200 - RNA, 14 nt, Human
cagggcaucuccug

SEQ ID NO: 2439201 - RNA, 21 nt, Human
cagggcaugccccggccaccu

SEQ ID NO: 2439202 - RNA, 18 nt, Human
cagggcaugccccggcca

SEQ ID NO: 2439203 - RNA, 15 nt, Human
cagggcaugccacgu

SEQ ID NO: 2439204 - RNA, 19 nt, Human
cagggcaugcauuuugcag

SEQ ID NO: 2439205 - RNA, 17 nt, Human
cagggcauggcugggaa

SEQ ID NO: 2439206 - RNA, 20 nt, Human
cagggcauggccagguggcc

SEQ ID NO: 2439207 - RNA, 23 nt, Human
cagggcaugccccggccaccucu

SEQ ID NO: 2439208 - RNA, 22 nt, Human
cagggcaugccccggccaccuc

SEQ ID NO: 2439209 - RNA, 13 nt, Human
cagggccaacccu

SEQ ID NO: 2439210 - RNA, 22 nt, Human
cagggccaugcugaggccuggg

SEQ ID NO: 2439211 - RNA, 23 nt, Human
cagggccaugcugaggccugggc

SEQ ID NO: 2439212 - RNA, 14 nt, Human
cagggcccacaccc

SEQ ID NO: 2439213 - RNA, 19 nt, Human
cagggcccaagucccuguu

SEQ ID NO: 2439214 - RNA, 18 nt, Human
cagggcccaagucccugu

SEQ ID NO: 2439215 - RNA, 17 nt, Human
cagggcccaagucccug

SEQ ID NO: 2439216 - RNA, 12 nt, Human
cagggcccagag

SEQ ID NO: 2439217 - RNA, 13 nt, Human
cagggcccagagc

SEQ ID NO: 2439218 - RNA, 14 nt, Human
cagggcccagagcc

SEQ ID NO: 2439219 - RNA, 15 nt, Human
cagggcccagagccc

SEQ ID NO: 2439220 - RNA, 16 nt, Human
cagggcccagagccca

SEQ ID NO: 2439221 - RNA, 18 nt, Human
cagggcccagagcccagc

SEQ ID NO: 2439222 - RNA, 19 nt, Human
cagggcccagagcccagcu

SEQ ID NO: 2439223 - RNA, 21 nt, Human
cagggcccagagcccagcucc

SEQ ID NO: 2439224 - RNA, 22 nt, Human
cagggcccagagcccagcucca

SEQ ID NO: 2439225 - RNA, 20 nt, Human
cagggccccaggcauugcca

SEQ ID NO: 2439226 - RNA, 21 nt, Human
cagggcccccagcgagagucc

SEQ ID NO: 2439227 - RNA, 16 nt, Human
cagggccccagcacua

SEQ ID NO: 2439228 - RNA, 22 nt, Human
cagggccccagcacuaaagcag

SEQ ID NO: 2439229 - RNA, 17 nt, Human
cagggcccacacccccu

SEQ ID NO: 2439230 - RNA, 13 nt, Human
cagggccccagaa

SEQ ID NO: 2439231 - RNA, 15 nt, Human
cagggccccagaagg

SEQ ID NO: 2439232 - RNA, 17 nt, Human
cagggccccagaaggca

SEQ ID NO: 2439233 - RNA, 14 nt, Human
cagggccccagcac

SEQ ID NO: 2439234 - RNA, 15 nt, Human
cagggccccagcacu

SEQ ID NO: 2439235 - RNA, 15 nt, Human
cagggcccccaucuc

SEQ ID NO: 2439236 - RNA, 16 nt, Human
cagggcccccaucuca

SEQ ID NO: 2439237 - RNA, 18 nt, Human
cagggccccucacccugc

SEQ ID NO: 2439238 - RNA, 21 nt, Human
cagggcccccaucucaugccc

SEQ ID NO: 2439239 - RNA, 22 nt, Human
cagggccccucacccugccuua

SEQ ID NO: 2439240 - RNA, 21 nt, Human
cagggccccucacccugccuu

SEQ ID NO: 2439241 - RNA, 21 nt, Human
cagggccccagaaggcaggga

SEQ ID NO: 2439242 - RNA, 16 nt, Human
cagggccucacacggu

SEQ ID NO: 2439243 - RNA, 23 nt, Human
cagggccuagcugcuacaaagaa

SEQ ID NO: 2439244 - RNA, 22 nt, Human
cagggccuagcugcuacaaaga

SEQ ID NO: 2439245 - RNA, 21 nt, Human
cagggccuagcugcuacaaag

SEQ ID NO: 2439246 - RNA, 20 nt, Human
cagggccuagcugcuacaaa

SEQ ID NO: 2439247 - RNA, 19 nt, Human
cagggccuagcugcuacaa

SEQ ID NO: 2439248 - RNA, 16 nt, Human
cagggccugagccugg

SEQ ID NO: 2439249 - RNA, 17 nt, Human
cagggccugagccuggc

SEQ ID NO: 2439250 - RNA, 18 nt, Human
cagggccugagccuggcc

SEQ ID NO: 2439251 - RNA, 19 nt, Human
cagggccugagccuggcca

SEQ ID NO: 2439252 - RNA, 20 nt, Human
cagggccugagccuggccag

SEQ ID NO: 2439253 - RNA, 21 nt, Human
cagggccugagccuggccagc

SEQ ID NO: 2439254 - RNA, 22 nt, Human
cagggccugagccuggccagcc

SEQ ID NO: 2439255 - RNA, 22 nt, Human
cagggccugcaggaccugccug

SEQ ID NO: 2439256 - RNA, 12 nt, Human
cagggccuggaa

SEQ ID NO: 2439257 - RNA, 15 nt, Human
cagggcccugcagag

SEQ ID NO: 2439258 - RNA, 18 nt, Human
cagggcccugcagagggg

SEQ ID NO: 2439259 - RNA, 15 nt, Human
cagggcccugagcuc

SEQ ID NO: 2439260 - RNA, 21 nt, Human
cagggcccugagcucggugga

SEQ ID NO: 2439261 - RNA, 13 nt, Human
cagggcccugcag

SEQ ID NO: 2439262 - RNA, 14 nt, Human
cagggcccugcaga

SEQ ID NO: 2439263 - RNA, 19 nt, Human
cagggacagaggccccagc

SEQ ID NO: 2439264 - RNA, 21 nt, Human
cagggacagaggccccagccu

SEQ ID NO: 2439265 - RNA, 12 nt, Human
cagggacaggau

SEQ ID NO: 2439266 - RNA, 23 nt, Human
cagggacagaggccccagccucc

SEQ ID NO: 2439267 - RNA, 23 nt, Human
cagggacagaggggguggccucc

SEQ ID NO: 2439268 - RNA, 18 nt, Human
cagggacaggauaagagg

SEQ ID NO: 2439269 - RNA, 22 nt, Human
cagggaccacacccuguacugu

SEQ ID NO: 2439270 - RNA, 16 nt, Human
cagggaccacacccug

SEQ ID NO: 2439271 - RNA, 17 nt, Human
cagggacagagccaugc

SEQ ID NO: 2439272 - RNA, 14 nt, Human
cagggaccaaggac

SEQ ID NO: 2439273 - RNA, 15 nt, Human
cagggaccaaggacc

SEQ ID NO: 2439274 - RNA, 18 nt, Human
cagggaccaaggaccccu

SEQ ID NO: 2439275 - RNA, 14 nt, Human
cagggaccccugcc

SEQ ID NO: 2439276 - RNA, 15 nt, Human
cagggaccccugccc

SEQ ID NO: 2439277 - RNA, 16 nt, Human
cagggaccccugcccu

SEQ ID NO: 2439278 - RNA, 20 nt, Human
cagggaccacagcaaggcac

SEQ ID NO: 2439279 - RNA, 17 nt, Human
cagggaccacagcaagg

SEQ ID NO: 2439280 - RNA, 22 nt, Human
cagggacccacuucacacacag

SEQ ID NO: 2439281 - RNA, 15 nt, Human
cagggaccacagcaa

SEQ ID NO: 2439282 - RNA, 14 nt, Human
cagggaccacagca

SEQ ID NO: 2439283 - RNA, 13 nt, Human
cagggaccacagc

SEQ ID NO: 2439284 - RNA, 19 nt, Human
cagggaccaaggaccccuc

SEQ ID NO: 2439285 - RNA, 20 nt, Human
cagggacugaaaaccucucc

SEQ ID NO: 2439286 - RNA, 21 nt, Human
cagggacugaaaaccucuccu

SEQ ID NO: 2439287 - RNA, 23 nt, Human
cagggacugaaaaccucuccuca

SEQ ID NO: 2439288 - RNA, 21 nt, Human
cagggacuaugaaugggcaaa

SEQ ID NO: 2439289 - RNA, 21 nt, Human
cagggaccuuuggagaccauu

SEQ ID NO: 2439290 - RNA, 14 nt, Human
cagggcacaccggg

SEQ ID NO: 2439291 - RNA, 18 nt, Human
cagggcaaugaugaauga

SEQ ID NO: 2439292 - RNA, 23 nt, Human
cagggacuguuccugucucagca

SEQ ID NO: 2439293 - RNA, 18 nt, Human
cagggacuguuccugucu

SEQ ID NO: 2439294 - RNA, 14 nt, Human
cagggacuugaagu

SEQ ID NO: 2439295 - RNA, 19 nt, Human
cagggacuugaaguuguua

SEQ ID NO: 2439296 - RNA, 15 nt, Human
cagggacuugaaguu

SEQ ID NO: 2439297 - RNA, 12 nt, Human
cagggagaagcu

SEQ ID NO: 2439298 - RNA, 17 nt, Human
cagggauuaaccucugc

SEQ ID NO: 2439299 - RNA, 18 nt, Human
cagggauguacaaggcga

SEQ ID NO: 2439300 - RNA, 19 nt, Human
cagggauuaaccucugcac

SEQ ID NO: 2439301 - RNA, 18 nt, Human
cagggauuaaccucugca

SEQ ID NO: 2439302 - RNA, 20 nt, Human
cagggauuaaccucugcacu

SEQ ID NO: 2439303 - RNA, 14 nt, Human
cagggauuugagga

SEQ ID NO: 2439304 - RNA, 16 nt, Human
cagggauugcugccac

SEQ ID NO: 2439305 - RNA, 13 nt, Human
cagggauuugagg

SEQ ID NO: 2439306 - RNA, 21 nt, Human
cagggcacaccgggcacucag

SEQ ID NO: 2439307 - RNA, 19 nt, Human
cagggcacaccgggcacuc

SEQ ID NO: 2439308 - RNA, 17 nt, Human
cagggcacaccgggcac

SEQ ID NO: 2439309 - RNA, 15 nt, Human
cagggcacaccgggc

SEQ ID NO: 2439310 - RNA, 23 nt, Human
cagggcacaccgggcacucagaa

SEQ ID NO: 2439311 - RNA, 22 nt, Human
cagggcacaccgggcacucaga

SEQ ID NO: 2439312 - RNA, 16 nt, Human
cagggcagcgccaggc

SEQ ID NO: 2439313 - RNA, 17 nt, Human
cagggcagcgccaggcu

SEQ ID NO: 2439314 - RNA, 18 nt, Human
cagggcagcgccaggcug

SEQ ID NO: 2439315 - RNA, 19 nt, Human
cagggcagcgccaggcuga

SEQ ID NO: 2439316 - RNA, 20 nt, Human
cagggcagcugggcccaacc

SEQ ID NO: 2439317 - RNA, 18 nt, Human
cagggcagcugggcccaa

SEQ ID NO: 2439318 - RNA, 17 nt, Human
cagggcagcugggccca

SEQ ID NO: 2439319 - RNA, 16 nt, Human
cagggcagcugggccc

SEQ ID NO: 2439320 - RNA, 15 nt, Human
cagggcagcugggcc

SEQ ID NO: 2439321 - RNA, 14 nt, Human
cagggcagcugggc

SEQ ID NO: 2439322 - RNA, 22 nt, Human
cagggcagcgccaggcugacca

SEQ ID NO: 2439323 - RNA, 14 nt, Human
cagggcagcgccag

SEQ ID NO: 2439324 - RNA, 15 nt, Human
cagggcagcgccagg

SEQ ID NO: 2439325 - RNA, 13 nt, Human
cagggcagcgcca

SEQ ID NO: 2439326 - RNA, 19 nt, Human
cagggcagagugagaccca

SEQ ID NO: 2439327 - RNA, 20 nt, Human
cagggcacuucacagagugu

SEQ ID NO: 2439328 - RNA, 13 nt, Human
cagggcagaguga

SEQ ID NO: 2439329 - RNA, 16 nt, Human
cagggcagagccggga

SEQ ID NO: 2439330 - RNA, 12 nt, Human
cagggcagagcc

SEQ ID NO: 2439331 - RNA, 15 nt, Human
cagggcagagccggg

SEQ ID NO: 2439332 - RNA, 18 nt, Human
cagggcacuucacagagu

SEQ ID NO: 2439333 - RNA, 17 nt, Human
cagggcacuucacagag

SEQ ID NO: 2439334 - RNA, 14 nt, Human
cagggcacuucaca

SEQ ID NO: 2439335 - RNA, 15 nt, Human
cagggcacugcugcu

SEQ ID NO: 2439336 - RNA, 11 nt, Human
cagggcacugc

SEQ ID NO: 2439337 - RNA, 17 nt, Human
cagggaagagcagaacg

SEQ ID NO: 2439338 - RNA, 15 nt, Human
cagggaagagcagaa

SEQ ID NO: 2439339 - RNA, 16 nt, Human
cagggaagagaaagug

SEQ ID NO: 2439340 - RNA, 22 nt, Human
cagggaagagcagaacggagcc

SEQ ID NO: 2439341 - RNA, 17 nt, Human
cagggaagcuacagguu

SEQ ID NO: 2439342 - RNA, 15 nt, Human
cagggaagcuacagg

SEQ ID NO: 2439343 - RNA, 14 nt, Human
cagggaagcuacag

SEQ ID NO: 2439344 - RNA, 22 nt, Human
cagggaacccugcuugcacuuu

SEQ ID NO: 2439345 - RNA, 19 nt, Human
cagggaacccugcuugcac

SEQ ID NO: 2439346 - RNA, 23 nt, Human
cagggaaccguuauuauaauugu

SEQ ID NO: 2439347 - RNA, 22 nt, Human
cagggaaccguuauuauaauug

SEQ ID NO: 2439348 - RNA, 20 nt, Human
cagggaaaauuauuugcaua

SEQ ID NO: 2439349 - RNA, 20 nt, Human
cagggaaaaugcagcaggga

SEQ ID NO: 2439350 - RNA, 15 nt, Human
cagggaaaggccagu

SEQ ID NO: 2439351 - RNA, 14 nt, Human
cagggaaaggcucu

SEQ ID NO: 2439352 - RNA, 23 nt, Human
cagggaaaggcucugaaagccag

SEQ ID NO: 2439353 - RNA, 22 nt, Human
cagggaaacagcuaaugggaca

SEQ ID NO: 2439354 - RNA, 15 nt, Human
cagggaaaauauaua

SEQ ID NO: 2439355 - RNA, 16 nt, Human
cagggaaacagcuaau

SEQ ID NO: 2439356 - RNA, 17 nt, Human
cagggaaaagcagcucu

SEQ ID NO: 2439357 - RNA, 19 nt, Human
cagggaaaagcagcucucc

SEQ ID NO: 2439358 - RNA, 20 nt, Human
cagggaaaagcagcucuccc

SEQ ID NO: 2439359 - RNA, 21 nt, Human
cagggaaaagcagcucucccc

SEQ ID NO: 2439360 - RNA, 15 nt, Human
cagggaaggggacaa

SEQ ID NO: 2439361 - RNA, 17 nt, Human
cagggaaggggacaagg

SEQ ID NO: 2439362 - RNA, 19 nt, Human
cagggaaggggaggcagcc

SEQ ID NO: 2439363 - RNA, 14 nt, Human
cagggaagucccca

SEQ ID NO: 2439364 - RNA, 16 nt, Human
cagggaaguccccagg

SEQ ID NO: 2439365 - RNA, 17 nt, Human
cagggaaguccccaggc

SEQ ID NO: 2439366 - RNA, 18 nt, Human
cagggaaguccccaggcc

SEQ ID NO: 2439367 - RNA, 17 nt, Human
cagggaagugcucugau

SEQ ID NO: 2439368 - RNA, 21 nt, Human
cagggaaguguaagaaacaca

SEQ ID NO: 2439369 - RNA, 23 nt, Human
cagggaaugccugagugccuggc

SEQ ID NO: 2439370 - RNA, 23 nt, Human
cagggaaguccccaggccccagg

SEQ ID NO: 2439371 - RNA, 14 nt, Human
cagggaagcuggcc

SEQ ID NO: 2439372 - RNA, 17 nt, Human
cagggaagcuggccgag

SEQ ID NO: 2439373 - RNA, 21 nt, Human
cagggaagcuacagguuacaa

SEQ ID NO: 2439374 - RNA, 20 nt, Human
cagggaagcuacagguuaca

SEQ ID NO: 2439375 - RNA, 19 nt, Human
cagggaagcuacagguuac

SEQ ID NO: 2439376 - RNA, 18 nt, Human
cagggaagcuacagguua

SEQ ID NO: 2439377 - RNA, 24 nt, Human
cagggaagcuacagguuacaacag

SEQ ID NO: 2439378 - RNA, 22 nt, Human
cagggaagcuacagguuacaac

SEQ ID NO: 2439379 - RNA, 13 nt, Human
cagggaagcuggc

SEQ ID NO: 2439380 - RNA, 20 nt, Human
cagggacagaggggguggcc

SEQ ID NO: 2439381 - RNA, 14 nt, Human
cagggacagagggg

SEQ ID NO: 2439382 - RNA, 16 nt, Human
cagggacagagccaug

SEQ ID NO: 2439383 - RNA, 15 nt, Human
cagggacagagccau

SEQ ID NO: 2439384 - RNA, 14 nt, Human
cagggacagaggcc

SEQ ID NO: 2439385 - RNA, 16 nt, Human
cagggacagaggcccc

SEQ ID NO: 2439386 - RNA, 18 nt, Human
cagggacagaggccccag

SEQ ID NO: 2439387 - RNA, 13 nt, Human
cagggacagaggg

SEQ ID NO: 2439388 - RNA, 14 nt, Human
cagggacagagaca

SEQ ID NO: 2439389 - RNA, 17 nt, Human
cagggacagagacaccu

SEQ ID NO: 2439390 - RNA, 18 nt, Human
cagggacagagacaccug

SEQ ID NO: 2439391 - RNA, 19 nt, Human
cagggacagagacaccugc

SEQ ID NO: 2439392 - RNA, 20 nt, Human
cagggacagagacaccugca

SEQ ID NO: 2439393 - RNA, 21 nt, Human
cagggacagagacaccugcac

SEQ ID NO: 2439394 - RNA, 14 nt, Human
cagggacagagcca

SEQ ID NO: 2439395 - RNA, 13 nt, Human
cagggacagagcc

SEQ ID NO: 2439396 - RNA, 22 nt, Human
cagggacagagacaccugcacc

SEQ ID NO: 2439397 - RNA, 23 nt, Human
cagggacagagacaccugcaccu

SEQ ID NO: 2439398 - RNA, 23 nt, Human
cagggacaccagccaggcucugu

SEQ ID NO: 2439399 - RNA, 22 nt, Human
cagggacaccagccaggcucug

SEQ ID NO: 2439400 - RNA, 21 nt, Human
cagggacaccagccaggcucu

SEQ ID NO: 2439401 - RNA, 20 nt, Human
cagggacaccagccaggcuc

SEQ ID NO: 2439402 - RNA, 19 nt, Human
cagggacaccagccaggcu

SEQ ID NO: 2439403 - RNA, 17 nt, Human
cagggacaccagccagg

SEQ ID NO: 2439404 - RNA, 16 nt, Human
cagggacaccagccag

SEQ ID NO: 2439405 - RNA, 15 nt, Human
cagggacaccagcca

SEQ ID NO: 2439406 - RNA, 23 nt, Human
cagggaauuucaggaacuagaga

SEQ ID NO: 2439407 - RNA, 21 nt, Human
cauuaaaacugaagucugaaa

SEQ ID NO: 2439408 - RNA, 20 nt, Human
cauuaaaagaaaauaaaaaa

SEQ ID NO: 2439409 - RNA, 12 nt, Human
cauuaaaagaaa

SEQ ID NO: 2439410 - RNA, 13 nt, Human
cauuaaaagaaaa

SEQ ID NO: 2439411 - RNA, 14 nt, Human
cauuaaaagaaaau

SEQ ID NO: 2439412 - RNA, 17 nt, Human
cauuaaaagaaaauaaa

SEQ ID NO: 2439413 - RNA, 22 nt, Human
cauuaaaaaugcauauacuuua

SEQ ID NO: 2439414 - RNA, 23 nt, Human
cauguuuuuguuuucuuugaaug

SEQ ID NO: 2439415 - RNA, 12 nt, Human
cauuaaaacaau

SEQ ID NO: 2439416 - RNA, 22 nt, Human
cauuaaaacugaagucugaaau

SEQ ID NO: 2439417 - RNA, 19 nt, Human
cauuaaaacugaagucuga

SEQ ID NO: 2439418 - RNA, 21 nt, Human
cauuaaaacaauauuguuucu

SEQ ID NO: 2439419 - RNA, 22 nt, Human
cauuaaaacaauauuguuucua

SEQ ID NO: 2439420 - RNA, 12 nt, Human
cauguuugugau

SEQ ID NO: 2439421 - RNA, 14 nt, Human
cauguuugugauug

SEQ ID NO: 2439422 - RNA, 14 nt, Human
cauguuugcuucau

SEQ ID NO: 2439423 - RNA, 16 nt, Human
cauguuugcugaacac

SEQ ID NO: 2439424 - RNA, 21 nt, Human
cauguuucucuggccccaagg

SEQ ID NO: 2439425 - RNA, 13 nt, Human
cauguuucuucau

SEQ ID NO: 2439426 - RNA, 19 nt, Human
cauguuuuucuucucccuc

SEQ ID NO: 2439427 - RNA, 20 nt, Human
cauguuuuucuucucccuca

SEQ ID NO: 2439428 - RNA, 17 nt, Human
cauguuuuuguuuucuu

SEQ ID NO: 2439429 - RNA, 13 nt, Human
cauguuuguaaaa

SEQ ID NO: 2439430 - RNA, 22 nt, Human
cauuaaaaaaaaaaaaaaaagu

SEQ ID NO: 2439431 - RNA, 21 nt, Human
caugugaugagaggaaaucac

SEQ ID NO: 2439432 - RNA, 19 nt, Human
caugugauccuuuuauguu

SEQ ID NO: 2439433 - RNA, 18 nt, Human
caugugauccuuuuaugu

SEQ ID NO: 2439434 - RNA, 16 nt, Human
caugugauccuuuuau

SEQ ID NO: 2439435 - RNA, 12 nt, Human
caugugauccuu

SEQ ID NO: 2439436 - RNA, 22 nt, Human
caugugauccuuuuauguuauu

SEQ ID NO: 2439437 - RNA, 20 nt, Human
caugugaugagaggaaauca

SEQ ID NO: 2439438 - RNA, 18 nt, Human
caugugaugagaggaaau

SEQ ID NO: 2439439 - RNA, 17 nt, Human
caugugaugagaggaaa

SEQ ID NO: 2439440 - RNA, 16 nt, Human
caugugaugagaggaa

SEQ ID NO: 2439441 - RNA, 15 nt, Human
caugugaugagagga

SEQ ID NO: 2439442 - RNA, 17 nt, Human
caugugacucugaagcu

SEQ ID NO: 2439443 - RNA, 13 nt, Human
caugugacucuga

SEQ ID NO: 2439444 - RNA, 16 nt, Human
caugugacucugaagc

SEQ ID NO: 2439445 - RNA, 12 nt, Human
caugugacucug

SEQ ID NO: 2439446 - RNA, 17 nt, Human
caugucuuguacaugug

SEQ ID NO: 2439447 - RNA, 15 nt, Human
caugucuuguacaug

SEQ ID NO: 2439448 - RNA, 14 nt, Human
caugucuuguacau

SEQ ID NO: 2439449 - RNA, 13 nt, Human
caugucuuguaca

SEQ ID NO: 2439450 - RNA, 22 nt, Human
caugucuuaaugaaguuugaau

SEQ ID NO: 2439451 - RNA, 21 nt, Human
caugucuuaaugaaguuugaa

SEQ ID NO: 2439452 - RNA, 23 nt, Human
caugucuuaaugaaguuugaaug

SEQ ID NO: 2439453 - RNA, 20 nt, Human
caugucuuaaugaaguuuga

SEQ ID NO: 2439454 - RNA, 18 nt, Human
caugucuuaaugaaguuu

SEQ ID NO: 2439455 - RNA, 17 nt, Human
caugucuuaaugaaguu

SEQ ID NO: 2439456 - RNA, 16 nt, Human
caugucuuaaugaagu

SEQ ID NO: 2439457 - RNA, 15 nt, Human
caugucuuaaugaag

SEQ ID NO: 2439458 - RNA, 14 nt, Human
caugucuuaaugaa

SEQ ID NO: 2439459 - RNA, 13 nt, Human
caugucuuaauga

SEQ ID NO: 2439460 - RNA, 15 nt, Human
caugucugcauuucg

SEQ ID NO: 2439461 - RNA, 23 nt, Human
caugucugcauuucgguggcuag

SEQ ID NO: 2439462 - RNA, 12 nt, Human
caugucuggcua

SEQ ID NO: 2439463 - RNA, 14 nt, Human
caugucucgacuca

SEQ ID NO: 2439464 - RNA, 14 nt, Human
caugucugcauuuc

SEQ ID NO: 2439465 - RNA, 17 nt, Human
caugucuccuauccugg

SEQ ID NO: 2439466 - RNA, 17 nt, Human
caugucucucagaauuc

SEQ ID NO: 2439467 - RNA, 13 nt, Human
cauguuucauguu

SEQ ID NO: 2439468 - RNA, 14 nt, Human
cauguguugaaaaa

SEQ ID NO: 2439469 - RNA, 17 nt, Human
cauguuucauguuuugu

SEQ ID NO: 2439470 - RNA, 16 nt, Human
cauguuucauguuuug

SEQ ID NO: 2439471 - RNA, 22 nt, Human
cauguuucauguuuugugacua

SEQ ID NO: 2439472 - RNA, 13 nt, Human
cauguuuccucua

SEQ ID NO: 2439473 - RNA, 21 nt, Human
cauguuuccucuaguucuuug

SEQ ID NO: 2439474 - RNA, 10 nt, Human
cauguuucuu

SEQ ID NO: 2439475 - RNA, 18 nt, Human
cauguguuuacuuuaugu

SEQ ID NO: 2439476 - RNA, 18 nt, Human
cauguguuggcagccucu

SEQ ID NO: 2439477 - RNA, 20 nt, Human
cauguguuuuaauuccaaua

SEQ ID NO: 2439478 - RNA, 19 nt, Human
cauguguuugguucugggg

SEQ ID NO: 2439479 - RNA, 15 nt, Human
cauguguccugguuc

SEQ ID NO: 2439480 - RNA, 21 nt, Human
cauguguccugguucccguuu

SEQ ID NO: 2439481 - RNA, 15 nt, Human
caugugugagugugu

SEQ ID NO: 2439482 - RNA, 16 nt, Human
cauguguuaaguauuu

SEQ ID NO: 2439483 - RNA, 17 nt, Human
caugugugagugugugc

SEQ ID NO: 2439484 - RNA, 16 nt, Human
caugugccgaaugugc

SEQ ID NO: 2439485 - RNA, 17 nt, Human
caugugcccccucuacc

SEQ ID NO: 2439486 - RNA, 20 nt, Human
caugugccugauccagccuc

SEQ ID NO: 2439487 - RNA, 19 nt, Human
caugugccugauccagccu

SEQ ID NO: 2439488 - RNA, 15 nt, Human
caugugccugaucca

SEQ ID NO: 2439489 - RNA, 14 nt, Human
caugugccugaucc

SEQ ID NO: 2439490 - RNA, 14 nt, Human
caugugcacaugca

SEQ ID NO: 2439491 - RNA, 22 nt, Human
caugugccagguuuuuggucug

SEQ ID NO: 2439492 - RNA, 18 nt, Human
cauguguagccugugcau

SEQ ID NO: 2439493 - RNA, 16 nt, Human
cauguguagccugugc

SEQ ID NO: 2439494 - RNA, 20 nt, Human
cauguguacuuaauuucuuu

SEQ ID NO: 2439495 - RNA, 14 nt, Human
cauguguagccugu

SEQ ID NO: 2439496 - RNA, 18 nt, Human
cauguguaugggcaaaaa

SEQ ID NO: 2439497 - RNA, 12 nt, Human
cauguguauguu

SEQ ID NO: 2439498 - RNA, 20 nt, Human
caugugcuaguaauuggaaa

SEQ ID NO: 2439499 - RNA, 23 nt, Human
cauguguaaucaauaaacgauuu

SEQ ID NO: 2439500 - RNA, 22 nt, Human
cauguguaaucaauaaacgauu

SEQ ID NO: 2439501 - RNA, 18 nt, Human
cauguguaaucaauaaac

SEQ ID NO: 2439502 - RNA, 17 nt, Human
cauguguaaucaauaaa

SEQ ID NO: 2439503 - RNA, 17 nt, Human
cauggucggaaaacaug

SEQ ID NO: 2439504 - RNA, 19 nt, Human
cauggucggaaaacaugcu

SEQ ID NO: 2439505 - RNA, 13 nt, Human
caugguguaauaa

SEQ ID NO: 2439506 - RNA, 14 nt, Human
caugguguaauaag

SEQ ID NO: 2439507 - RNA, 20 nt, Human
caugguggcgcaagccugua

SEQ ID NO: 2439508 - RNA, 12 nt, Human
caugguggcgca

SEQ ID NO: 2439509 - RNA, 17 nt, Human
caugguggcgcaagccu

SEQ ID NO: 2439510 - RNA, 18 nt, Human
caugguggcgcaagccug

SEQ ID NO: 2439511 - RNA, 21 nt, Human
caugguggguccaugggcaga

SEQ ID NO: 2439512 - RNA, 22 nt, Human
caugguggguccaugggcagag

SEQ ID NO: 2439513 - RNA, 19 nt, Human
caugguggguucaggggac

SEQ ID NO: 2439514 - RNA, 11 nt, Human
cauggugaaaa

SEQ ID NO: 2439515 - RNA, 21 nt, Human
caugguacccccuucugggca

SEQ ID NO: 2439516 - RNA, 14 nt, Human
cauggucacacacu

SEQ ID NO: 2439517 - RNA, 15 nt, Human
cauggucacacacug

SEQ ID NO: 2439518 - RNA, 23 nt, Human
cauggucggaaaacaugcuacac

SEQ ID NO: 2439519 - RNA, 21 nt, Human
cauggugccugagaggcaggc

SEQ ID NO: 2439520 - RNA, 19 nt, Human
cauggugccugagaggcag

SEQ ID NO: 2439521 - RNA, 18 nt, Human
cauggugccugagaggca

SEQ ID NO: 2439522 - RNA, 19 nt, Human
cauggugaaaauguacuga

SEQ ID NO: 2439523 - RNA, 18 nt, Human
cauggugaaaauguacug

SEQ ID NO: 2439524 - RNA, 22 nt, Human
cauggugccugagaggcaggca

SEQ ID NO: 2439525 - RNA, 23 nt, Human
caugguggcaccagcgaagggag

SEQ ID NO: 2439526 - RNA, 16 nt, Human
caugucuauucagcuu

SEQ ID NO: 2439527 - RNA, 17 nt, Human
caugucuauucagcuuc

SEQ ID NO: 2439528 - RNA, 16 nt, Human
caugucuccuauccug

SEQ ID NO: 2439529 - RNA, 14 nt, Human
caugucgugaccaa

SEQ ID NO: 2439530 - RNA, 14 nt, Human
caugucggccucua

SEQ ID NO: 2439531 - RNA, 22 nt, Human
caugucuauaaucccagcacuu

SEQ ID NO: 2439532 - RNA, 22 nt, Human
cauguacuguaguuuuucuuca

SEQ ID NO: 2439533 - RNA, 22 nt, Human
caugucgcgcucagcaugcauc

SEQ ID NO: 2439534 - RNA, 13 nt, Human
caugucggccucu

SEQ ID NO: 2439535 - RNA, 14 nt, Human
cauguacuguaguu

SEQ ID NO: 2439536 - RNA, 22 nt, Human
cauguacugagccuuguaauuc

SEQ ID NO: 2439537 - RNA, 19 nt, Human
cauguacugagccuuguaa

SEQ ID NO: 2439538 - RNA, 13 nt, Human
cauguaccccaau

SEQ ID NO: 2439539 - RNA, 23 nt, Human
cauguacugagccuuguaauucu

SEQ ID NO: 2439540 - RNA, 13 nt, Human
cauguacuguagu

SEQ ID NO: 2439541 - RNA, 15 nt, Human
cauguaaacugugca

SEQ ID NO: 2439542 - RNA, 22 nt, Human
cauguaaacacgccugcaaacg

SEQ ID NO: 2439543 - RNA, 16 nt, Human
cauguaaacugugcac

SEQ ID NO: 2439544 - RNA, 21 nt, Human
cauguaaacaaaauuuaguuu

SEQ ID NO: 2439545 - RNA, 18 nt, Human
cauguaaacaaaauuuag

SEQ ID NO: 2439546 - RNA, 14 nt, Human
cauguaaaagaguc

SEQ ID NO: 2439547 - RNA, 16 nt, Human
cauguaaaagagucau

SEQ ID NO: 2439548 - RNA, 19 nt, Human
cauguaccauuugcauggc

SEQ ID NO: 2439549 - RNA, 15 nt, Human
cauguacaugaagaa

SEQ ID NO: 2439550 - RNA, 19 nt, Human
cauguacccuaaggucauu

SEQ ID NO: 2439551 - RNA, 20 nt, Human
cauguacaugaagaagcuaa

SEQ ID NO: 2439552 - RNA, 14 nt, Human
caugcuucuuccuu

SEQ ID NO: 2439553 - RNA, 22 nt, Human
caugcugugugacucaaaccaa

SEQ ID NO: 2439554 - RNA, 17 nt, Human
cauggaaaccugaaaaa

SEQ ID NO: 2439555 - RNA, 17 nt, Human
caugcuuugugaacaag

SEQ ID NO: 2439556 - RNA, 13 nt, Human
caugcuuguguua

SEQ ID NO: 2439557 - RNA, 16 nt, Human
caugcuucuuccuuac

SEQ ID NO: 2439558 - RNA, 19 nt, Human
cauggaauuuguaaguuua

SEQ ID NO: 2439559 - RNA, 16 nt, Human
cauggaauuuguaagu

SEQ ID NO: 2439560 - RNA, 20 nt, Human
cauggaauuggagcucgugg

SEQ ID NO: 2439561 - RNA, 18 nt, Human
cauggaaaccugaaaaaa

SEQ ID NO: 2439562 - RNA, 21 nt, Human
cauggaaauucccuucaucug

SEQ ID NO: 2439563 - RNA, 22 nt, Human
cauggacaccccuuauccagga

SEQ ID NO: 2439564 - RNA, 21 nt, Human
cauggacaccccuuauccagg

SEQ ID NO: 2439565 - RNA, 14 nt, Human
cauggacaccccuu

SEQ ID NO: 2439566 - RNA, 23 nt, Human
cauggacaccccuuauccaggac

SEQ ID NO: 2439567 - RNA, 12 nt, Human
cauggacccgga

SEQ ID NO: 2439568 - RNA, 14 nt, Human
cauggacuucacau

SEQ ID NO: 2439569 - RNA, 19 nt, Human
cauggacguucggggcaug

SEQ ID NO: 2439570 - RNA, 15 nt, Human
cauggacccggagcu

SEQ ID NO: 2439571 - RNA, 21 nt, Human
cauggacucuacacugugaac

SEQ ID NO: 2439572 - RNA, 15 nt, Human
cauggacuucacaua

SEQ ID NO: 2439573 - RNA, 14 nt, Human
cauggagccagcuc

SEQ ID NO: 2439574 - RNA, 22 nt, Human
cauggacuucugccagcauaau

SEQ ID NO: 2439575 - RNA, 15 nt, Human
cauggacuuccacug

SEQ ID NO: 2439576 - RNA, 17 nt, Human
cauggagccccagcccc

SEQ ID NO: 2439577 - RNA, 16 nt, Human
cauggagccccagccc

SEQ ID NO: 2439578 - RNA, 12 nt, Human
cauggagcuggc

SEQ ID NO: 2439579 - RNA, 15 nt, Human
cauggagccccagcc

SEQ ID NO: 2439580 - RNA, 14 nt, Human
cauggagccccagc

SEQ ID NO: 2439581 - RNA, 17 nt, Human
cauggagccagcucccu

SEQ ID NO: 2439582 - RNA, 13 nt, Human
cauggagcuggcc

SEQ ID NO: 2439583 - RNA, 18 nt, Human
cauggagccccagccccc

SEQ ID NO: 2439584 - RNA, 14 nt, Human
cauggagcuggccg

SEQ ID NO: 2439585 - RNA, 14 nt, Human
cauggaggagcuug

SEQ ID NO: 2439586 - RNA, 13 nt, Human
cauggaggcacac

SEQ ID NO: 2439587 - RNA, 17 nt, Human
caugcagccacugugcu

SEQ ID NO: 2439588 - RNA, 16 nt, Human
caugcagcccaugccc

SEQ ID NO: 2439589 - RNA, 19 nt, Human
caugcagcccaugcccacc

SEQ ID NO: 2439590 - RNA, 20 nt, Human
caugcagcccaugcccaccu

SEQ ID NO: 2439591 - RNA, 19 nt, Human
caugcagauggggcucccg

SEQ ID NO: 2439592 - RNA, 14 nt, Human
caugcagcaucuaa

SEQ ID NO: 2439593 - RNA, 14 nt, Human
caugcggcccagcc

SEQ ID NO: 2439594 - RNA, 13 nt, Human
caugcggcccagc

SEQ ID NO: 2439595 - RNA, 23 nt, Human
caugcggagaacaaaugugaagg

SEQ ID NO: 2439596 - RNA, 16 nt, Human
caugcggagaacaaau

SEQ ID NO: 2439597 - RNA, 14 nt, Human
caugcggagaacaa

SEQ ID NO: 2439598 - RNA, 21 nt, Human
caugcagccgugaucaaggga

SEQ ID NO: 2439599 - RNA, 23 nt, Human
caugcgcucagggccaugcugag

SEQ ID NO: 2439600 - RNA, 17 nt, Human
caugcagccgugaucaa

SEQ ID NO: 2439601 - RNA, 15 nt, Human
caugcagccgugauc

SEQ ID NO: 2439602 - RNA, 22 nt, Human
caugcgcucagggccaugcuga

SEQ ID NO: 2439603 - RNA, 22 nt, Human
caugcagcccaugcccaccugc

SEQ ID NO: 2439604 - RNA, 23 nt, Human
caugcagcccaugcccaccugcc

SEQ ID NO: 2439605 - RNA, 10 nt, Human
caugcacugu

SEQ ID NO: 2439606 - RNA, 13 nt, Human
caugcacugugaa

SEQ ID NO: 2439607 - RNA, 14 nt, Human
caugcacugugaag

SEQ ID NO: 2439608 - RNA, 16 nt, Human
caugcacugugaagga

SEQ ID NO: 2439609 - RNA, 17 nt, Human
caugcacugugaaggac

SEQ ID NO: 2439610 - RNA, 18 nt, Human
caugcacugugaaggacc

SEQ ID NO: 2439611 - RNA, 20 nt, Human
caugcacugugaaggacccu

SEQ ID NO: 2439612 - RNA, 23 nt, Human
caugcacuguucccccugugcag

SEQ ID NO: 2439613 - RNA, 19 nt, Human
caugcacuguucccccugu

SEQ ID NO: 2439614 - RNA, 22 nt, Human
caugcacugugaaggacccuug

SEQ ID NO: 2439615 - RNA, 19 nt, Human
caugcagacaugagugcgu

SEQ ID NO: 2439616 - RNA, 13 nt, Human
caugcagagcgcc

SEQ ID NO: 2439617 - RNA, 17 nt, Human
caugcacuuggcugcau

SEQ ID NO: 2439618 - RNA, 15 nt, Human
caugcugucccuuac

SEQ ID NO: 2439619 - RNA, 13 nt, Human
caugcugucccuu

SEQ ID NO: 2439620 - RNA, 17 nt, Human
caugcugugugacucaa

SEQ ID NO: 2439621 - RNA, 21 nt, Human
caugcugugugacucaaacca

SEQ ID NO: 2439622 - RNA, 14 nt, Human
caugcugugugacu

SEQ ID NO: 2439623 - RNA, 19 nt, Human
caugcggcccagcccggcu

SEQ ID NO: 2439624 - RNA, 18 nt, Human
caugcggcccagcccggc

SEQ ID NO: 2439625 - RNA, 16 nt, Human
caugcggcccagcccg

SEQ ID NO: 2439626 - RNA, 15 nt, Human
caugcggcccagccc

SEQ ID NO: 2439627 - RNA, 22 nt, Human
caugcggcccagcccggcuccc

SEQ ID NO: 2439628 - RNA, 21 nt, Human
caugcggcccagcccggcucc

SEQ ID NO: 2439629 - RNA, 16 nt, Human
caugcggcccaggaug

SEQ ID NO: 2439630 - RNA, 20 nt, Human
caugcgggcugggcagcugu

SEQ ID NO: 2439631 - RNA, 19 nt, Human
caugcgggcugggcagcug

SEQ ID NO: 2439632 - RNA, 18 nt, Human
caugcgggcugggcagcu

SEQ ID NO: 2439633 - RNA, 15 nt, Human
caugcgggcugggca

SEQ ID NO: 2439634 - RNA, 19 nt, Human
caugcuggguucugcacag

SEQ ID NO: 2439635 - RNA, 21 nt, Human
caugcgggcugggcagcuguu

SEQ ID NO: 2439636 - RNA, 16 nt, Human
cauggucacacacuga

SEQ ID NO: 2439637 - RNA, 19 nt, Human
caugggugaagggagagcc

SEQ ID NO: 2439638 - RNA, 22 nt, Human
caugggugaagggagagccagc

SEQ ID NO: 2439639 - RNA, 23 nt, Human
caugggugaagggagagccagcu

SEQ ID NO: 2439640 - RNA, 19 nt, Human
caugguacccccuucuggg

SEQ ID NO: 2439641 - RNA, 18 nt, Human
caugguacccccuucugg

SEQ ID NO: 2439642 - RNA, 23 nt, Human
caugggcuucacuguauaaauag

SEQ ID NO: 2439643 - RNA, 20 nt, Human
caugggcuucacuguauaaa

SEQ ID NO: 2439644 - RNA, 17 nt, Human
caugggcuucacuguau

SEQ ID NO: 2439645 - RNA, 16 nt, Human
cauggggaagggauau

SEQ ID NO: 2439646 - RNA, 21 nt, Human
caugggcuucacuguauaaau

SEQ ID NO: 2439647 - RNA, 20 nt, Human
caugggguuggcugggccca

SEQ ID NO: 2439648 - RNA, 22 nt, Human
caugggguuggcugggcccaga

SEQ ID NO: 2439649 - RNA, 21 nt, Human
cauggggugggguagggcuga

SEQ ID NO: 2439650 - RNA, 19 nt, Human
caugggguuggcugggccc

SEQ ID NO: 2439651 - RNA, 18 nt, Human
cauggcagaguuugugug

SEQ ID NO: 2439652 - RNA, 17 nt, Human
cauggcagaguuugugu

SEQ ID NO: 2439653 - RNA, 22 nt, Human
cauggaggagcuugggggauga

SEQ ID NO: 2439654 - RNA, 20 nt, Human
cauggaggcacacagcugca

SEQ ID NO: 2439655 - RNA, 19 nt, Human
cauggaggcacacagcugc

SEQ ID NO: 2439656 - RNA, 16 nt, Human
cauggaggcacacagc

SEQ ID NO: 2439657 - RNA, 23 nt, Human
caugggacagggaggacgcucuc

SEQ ID NO: 2439658 - RNA, 21 nt, Human
caugggagcugguuagaaaug

SEQ ID NO: 2439659 - RNA, 18 nt, Human
cauggcaucaccuccacc

SEQ ID NO: 2439660 - RNA, 13 nt, Human
caugggagccggg

SEQ ID NO: 2439661 - RNA, 22 nt, Human
caugggagccgggucugccucu

SEQ ID NO: 2439662 - RNA, 16 nt, Human
caugggcuucacugua

SEQ ID NO: 2439663 - RNA, 15 nt, Human
caugggcuucacugu

SEQ ID NO: 2439664 - RNA, 14 nt, Human
caugggcuucacug

SEQ ID NO: 2439665 - RNA, 13 nt, Human
caugggcuucacu

SEQ ID NO: 2439666 - RNA, 12 nt, Human
caugggcuucac

SEQ ID NO: 2439667 - RNA, 24 nt, Human
caugggccuggccaccucucuccu

SEQ ID NO: 2439668 - RNA, 13 nt, Human
caugggcucugac

SEQ ID NO: 2439669 - RNA, 23 nt, Human
caugggccuggccaccucucucc

SEQ ID NO: 2439670 - RNA, 13 nt, Human
caugggccuggcc

SEQ ID NO: 2439671 - RNA, 23 nt, Human
caugggcacugcuggguggccca

SEQ ID NO: 2439672 - RNA, 19 nt, Human
caugggcacugcugggugg

SEQ ID NO: 2439673 - RNA, 18 nt, Human
caugggcacugcugggug

SEQ ID NO: 2439674 - RNA, 17 nt, Human
caugggcacugcugggu

SEQ ID NO: 2439675 - RNA, 16 nt, Human
caugggcacugcuggg

SEQ ID NO: 2439676 - RNA, 15 nt, Human
caugggcagagccca

SEQ ID NO: 2439677 - RNA, 17 nt, Human
caugggcagagcccaag

SEQ ID NO: 2439678 - RNA, 18 nt, Human
caugggccuccugugugu

SEQ ID NO: 2439679 - RNA, 22 nt, Human
caugggagggggcuugaagcca

SEQ ID NO: 2439680 - RNA, 14 nt, Human
caugggagggggcu

SEQ ID NO: 2439681 - RNA, 14 nt, Human
caugggaggcucac

SEQ ID NO: 2439682 - RNA, 15 nt, Human
caugggcacugcugg

SEQ ID NO: 2439683 - RNA, 14 nt, Human
caugggcacugcug

SEQ ID NO: 2439684 - RNA, 13 nt, Human
caugggcacugcu

SEQ ID NO: 2439685 - RNA, 17 nt, Human
cauuugaaaauuuugau

SEQ ID NO: 2439686 - RNA, 19 nt, Human
cauuugaaaauuuugaugu

SEQ ID NO: 2439687 - RNA, 15 nt, Human
cauuuacuguggcuu

SEQ ID NO: 2439688 - RNA, 14 nt, Human
cauuuacuguggcu

SEQ ID NO: 2439689 - RNA, 13 nt, Human
cauuuacuguggc

SEQ ID NO: 2439690 - RNA, 12 nt, Human
cauuuacugugg

SEQ ID NO: 2439691 - RNA, 18 nt, Human
cauuucuuugugcuuugg

SEQ ID NO: 2439692 - RNA, 12 nt, Human
cauuucuugggc

SEQ ID NO: 2439693 - RNA, 14 nt, Human
cauuucuugggccc

SEQ ID NO: 2439694 - RNA, 15 nt, Human
cauuucuugggcccu

SEQ ID NO: 2439695 - RNA, 16 nt, Human
cauuucuugggcccuc

SEQ ID NO: 2439696 - RNA, 22 nt, Human
cauuuacccuucuuuucugacu

SEQ ID NO: 2439697 - RNA, 20 nt, Human
cauuuacauguauuauuuca

SEQ ID NO: 2439698 - RNA, 12 nt, Human
cauuuacaugua

SEQ ID NO: 2439699 - RNA, 20 nt, Human
cauuuaauaauauacuugug

SEQ ID NO: 2439700 - RNA, 17 nt, Human
cauuuaauaauauacuu

SEQ ID NO: 2439701 - RNA, 20 nt, Human
cauuuaauguagccauggga

SEQ ID NO: 2439702 - RNA, 22 nt, Human
cauuuaauguagccaugggacc

SEQ ID NO: 2439703 - RNA, 21 nt, Human
cauuuaauguagccaugggac

SEQ ID NO: 2439704 - RNA, 24 nt, Human
cauuuaauguagccaugggaccaa

SEQ ID NO: 2439705 - RNA, 17 nt, Human
cauuuaagagacaguca

SEQ ID NO: 2439706 - RNA, 14 nt, Human
cauuuaauaauaua

SEQ ID NO: 2439707 - RNA, 13 nt, Human
cauuuaauaauau

SEQ ID NO: 2439708 - RNA, 23 nt, Human
cauuuaagagacagucaccccag

SEQ ID NO: 2439709 - RNA, 19 nt, Human
cauuuaagagacagucacc

SEQ ID NO: 2439710 - RNA, 12 nt, Human
cauuuaauaaua

SEQ ID NO: 2439711 - RNA, 23 nt, Human
cauuuaaauuuuacccuuuagac

SEQ ID NO: 2439712 - RNA, 18 nt, Human
cauuuaaauuuuuuuccu

SEQ ID NO: 2439713 - RNA, 20 nt, Human
cauuuaaauacagucuucca

SEQ ID NO: 2439714 - RNA, 18 nt, Human
cauuuaaauacagucuuc

SEQ ID NO: 2439715 - RNA, 17 nt, Human
cauuuaaauacagucuu

SEQ ID NO: 2439716 - RNA, 23 nt, Human
cauuguuuuaaaaagaaacaaga

SEQ ID NO: 2439717 - RNA, 16 nt, Human
cauuguucaauuagaa

SEQ ID NO: 2439718 - RNA, 17 nt, Human
cauuguuuuaaaaagaa

SEQ ID NO: 2439719 - RNA, 20 nt, Human
cauuguuuugccaacauugc

SEQ ID NO: 2439720 - RNA, 16 nt, Human
cauuguuuugccaaca

SEQ ID NO: 2439721 - RNA, 14 nt, Human
cauuguuuugccaa

SEQ ID NO: 2439722 - RNA, 12 nt, Human
cauuuaaaaaaa

SEQ ID NO: 2439723 - RNA, 21 nt, Human
cauuuaaaaaaaaaauuuguu

SEQ ID NO: 2439724 - RNA, 13 nt, Human
cauuuaaaacaga

SEQ ID NO: 2439725 - RNA, 17 nt, Human
cauuuaaaacagacacu

SEQ ID NO: 2439726 - RNA, 18 nt, Human
cauuuaaaacagacacug

SEQ ID NO: 2439727 - RNA, 23 nt, Human
cauuuaaaacagacacuggcaug

SEQ ID NO: 2439728 - RNA, 15 nt, Human
cauuuaaaaaaaauc

SEQ ID NO: 2439729 - RNA, 21 nt, Human
cauuguacaguuuguuuacac

SEQ ID NO: 2439730 - RNA, 20 nt, Human
cauuguacaguuuguuuaca

SEQ ID NO: 2439731 - RNA, 19 nt, Human
cauuguacaguuuguuuac

SEQ ID NO: 2439732 - RNA, 14 nt, Human
cauuguacaguuug

SEQ ID NO: 2439733 - RNA, 13 nt, Human
cauuguacaguuu

SEQ ID NO: 2439734 - RNA, 21 nt, Human
cauuguaauguuacugaucau

SEQ ID NO: 2439735 - RNA, 17 nt, Human
cauuguaauguuacuga

SEQ ID NO: 2439736 - RNA, 18 nt, Human
cauuguaauguuacugau

SEQ ID NO: 2439737 - RNA, 15 nt, Human
cauuguaacuuggau

SEQ ID NO: 2439738 - RNA, 15 nt, Human
cauuguaauguuacu

SEQ ID NO: 2439739 - RNA, 16 nt, Human
cauuguaauguuacug

SEQ ID NO: 2439740 - RNA, 21 nt, Human
cauuguaaaugugcuuuuaaa

SEQ ID NO: 2439741 - RNA, 19 nt, Human
cauugauggggaaggaggc

SEQ ID NO: 2439742 - RNA, 16 nt, Human
cauugauugucagcua

SEQ ID NO: 2439743 - RNA, 16 nt, Human
cauugauggggaagga

SEQ ID NO: 2439744 - RNA, 17 nt, Human
cauugauugucagcuac

SEQ ID NO: 2439745 - RNA, 18 nt, Human
cauugauugucagcuacu

SEQ ID NO: 2439746 - RNA, 13 nt, Human
cauugugggaagg

SEQ ID NO: 2439747 - RNA, 15 nt, Human
cauugugggaagggg

SEQ ID NO: 2439748 - RNA, 22 nt, Human
cauuguacaguuuguuuacaca

SEQ ID NO: 2439749 - RNA, 21 nt, Human
cauugugggauguucagcacu

SEQ ID NO: 2439750 - RNA, 22 nt, Human
cauugugggauguucagcacug

SEQ ID NO: 2439751 - RNA, 22 nt, Human
cauugaacacaaacuguaaaua

SEQ ID NO: 2439752 - RNA, 15 nt, Human
cauugaaucuguaug

SEQ ID NO: 2439753 - RNA, 16 nt, Human
cauugaagucagaugu

SEQ ID NO: 2439754 - RNA, 19 nt, Human
cauugaaguaaugaauuuu

SEQ ID NO: 2439755 - RNA, 14 nt, Human
cauugaauuagaaa

SEQ ID NO: 2439756 - RNA, 19 nt, Human
cauugaaucuguauggcua

SEQ ID NO: 2439757 - RNA, 18 nt, Human
cauugaaguaaugaauuu

SEQ ID NO: 2439758 - RNA, 18 nt, Human
cauucuuuuaaaagacaa

SEQ ID NO: 2439759 - RNA, 19 nt, Human
cauucuuuuguaauuuaaa

SEQ ID NO: 2439760 - RNA, 17 nt, Human
cauugaccugaggcccu

SEQ ID NO: 2439761 - RNA, 15 nt, Human
cauugaccugaggcc

SEQ ID NO: 2439762 - RNA, 21 nt, Human
cauugaauucuugguugagga

SEQ ID NO: 2439763 - RNA, 22 nt, Human
cauugaauucuugguugaggaa

SEQ ID NO: 2439764 - RNA, 23 nt, Human
cauugaauucuugguugaggaaa

SEQ ID NO: 2439765 - RNA, 14 nt, Human
cauugaccugaggc

SEQ ID NO: 2439766 - RNA, 16 nt, Human
cauugacaagaacuga

SEQ ID NO: 2439767 - RNA, 15 nt, Human
cauugaguaauauag

SEQ ID NO: 2439768 - RNA, 18 nt, Human
cauugaccugaggcccuu

SEQ ID NO: 2439769 - RNA, 17 nt, Human
cauugauaugaaaaaua

SEQ ID NO: 2439770 - RNA, 18 nt, Human
cauugauaugaaaaauau

SEQ ID NO: 2439771 - RNA, 19 nt, Human
cauugauaugaaaaauaug

SEQ ID NO: 2439772 - RNA, 22 nt, Human
cauugauaugaaaaauaugaua

SEQ ID NO: 2439773 - RNA, 14 nt, Human
cauugauggggaag

SEQ ID NO: 2439774 - RNA, 17 nt, Human
cauuucuugggcccucc

SEQ ID NO: 2439775 - RNA, 18 nt, Human
cauuucuugggcccuccu

SEQ ID NO: 2439776 - RNA, 22 nt, Human
cauuugaguuauuuuaauuauc

SEQ ID NO: 2439777 - RNA, 14 nt, Human
cauuugaugcuaaa

SEQ ID NO: 2439778 - RNA, 15 nt, Human
cauuugaugcuaaau

SEQ ID NO: 2439779 - RNA, 13 nt, Human
cauuugcugaaua

SEQ ID NO: 2439780 - RNA, 22 nt, Human
cauuugcaagggaaaagucucu

SEQ ID NO: 2439781 - RNA, 16 nt, Human
cauuugaugcuaaaua

SEQ ID NO: 2439782 - RNA, 15 nt, Human
cauuugauucugugu

SEQ ID NO: 2439783 - RNA, 19 nt, Human
cauuugcagaguccugcac

SEQ ID NO: 2439784 - RNA, 18 nt, Human
cauuugcagaguccugca

SEQ ID NO: 2439785 - RNA, 21 nt, Human
cauuugcacuggaguucuaug

SEQ ID NO: 2439786 - RNA, 20 nt, Human
cauuugcacuggaguucuau

SEQ ID NO: 2439787 - RNA, 15 nt, Human
cauuugcacccuccg

SEQ ID NO: 2439788 - RNA, 17 nt, Human
cauuugcacccuccgcc

SEQ ID NO: 2439789 - RNA, 13 nt, Human
cauuugcuuuuug

SEQ ID NO: 2439790 - RNA, 16 nt, Human
cauuugcuuuuucacc

SEQ ID NO: 2439791 - RNA, 23 nt, Human
cauuuuaccuuugacaaagguaa

SEQ ID NO: 2439792 - RNA, 19 nt, Human
cauuuuaauuuuaaccaaa

SEQ ID NO: 2439793 - RNA, 23 nt, Human
cauuuuauuuuauuaugcaugaa

SEQ ID NO: 2439794 - RNA, 22 nt, Human
cauuuuauuuuauuaugcauga

SEQ ID NO: 2439795 - RNA, 16 nt, Human
cauuuucaccccaccc

SEQ ID NO: 2439796 - RNA, 22 nt, Human
cauuuuacuuuuuccuggcuca

SEQ ID NO: 2439797 - RNA, 20 nt, Human
cauuuuacuuuuuccuggcu

SEQ ID NO: 2439798 - RNA, 17 nt, Human
cauuuuacuuuuuccug

SEQ ID NO: 2439799 - RNA, 20 nt, Human
cauuuuacccacacacagau

SEQ ID NO: 2439800 - RNA, 16 nt, Human
ccaaacccuucagugc

SEQ ID NO: 2439801 - RNA, 17 nt, Human
ccaaaccaccagaagcc

SEQ ID NO: 2439802 - RNA, 15 nt, Human
ccaaacaccuuccag

SEQ ID NO: 2439803 - RNA, 19 nt, Human
ccaaacaccuuccagcucc

SEQ ID NO: 2439804 - RNA, 20 nt, Human
ccaaaauguuggucauuuua

SEQ ID NO: 2439805 - RNA, 21 nt, Human
ccaaaauguuggucauuuuau

SEQ ID NO: 2439806 - RNA, 16 nt, Human
ccaaaauuauuucaga

SEQ ID NO: 2439807 - RNA, 20 nt, Human
ccaaaauuguuuugagcuuu

SEQ ID NO: 2439808 - RNA, 16 nt, Human
ccaaacaaauaugcaa

SEQ ID NO: 2439809 - RNA, 15 nt, Human
cauuuuuacaauaaa

SEQ ID NO: 2439810 - RNA, 15 nt, Human
cauuuuuaaucauga

SEQ ID NO: 2439811 - RNA, 17 nt, Human
cauuuuuacaauaaaua

SEQ ID NO: 2439812 - RNA, 17 nt, Human
cauuuuuaguagagaca

SEQ ID NO: 2439813 - RNA, 23 nt, Human
ccaaaauguaggcuuaguuugug

SEQ ID NO: 2439814 - RNA, 22 nt, Human
ccaaaaugcucuagugccuucu

SEQ ID NO: 2439815 - RNA, 17 nt, Human
cauuuucugcaagccug

SEQ ID NO: 2439816 - RNA, 15 nt, Human
cauuuucugcaagcc

SEQ ID NO: 2439817 - RNA, 18 nt, Human
cauuuucugcaagccugc

SEQ ID NO: 2439818 - RNA, 19 nt, Human
cauuuuuaaucaugaaauu

SEQ ID NO: 2439819 - RNA, 21 nt, Human
cauuuuuaagugcugcauuua

SEQ ID NO: 2439820 - RNA, 14 nt, Human
cauuuucugcaagc

SEQ ID NO: 2439821 - RNA, 12 nt, Human
cauuuucugcaa

SEQ ID NO: 2439822 - RNA, 11 nt, Human
cauuuucugca

SEQ ID NO: 2439823 - RNA, 17 nt, Human
cauuuuccccccacucu

SEQ ID NO: 2439824 - RNA, 20 nt, Human
cauuuuccccccacucuccc

SEQ ID NO: 2439825 - RNA, 21 nt, Human
cauuuuccccccacucucccc

SEQ ID NO: 2439826 - RNA, 22 nt, Human
cauuuuccccccacucucccca

SEQ ID NO: 2439827 - RNA, 12 nt, Human
cauuuucccaga

SEQ ID NO: 2439828 - RNA, 14 nt, Human
cauuuuccccccac

SEQ ID NO: 2439829 - RNA, 15 nt, Human
cauuuuccccccacu

SEQ ID NO: 2439830 - RNA, 17 nt, Human
cauuuucaccccacccu

SEQ ID NO: 2439831 - RNA, 20 nt, Human
cauuuuagaagacucuacca

SEQ ID NO: 2439832 - RNA, 13 nt, Human
cauucuuccuagu

SEQ ID NO: 2439833 - RNA, 18 nt, Human
cauucuuccuaguuuucu

SEQ ID NO: 2439834 - RNA, 19 nt, Human
cauucuucucuagcuggug

SEQ ID NO: 2439835 - RNA, 18 nt, Human
cauucuucucuagcuggu

SEQ ID NO: 2439836 - RNA, 21 nt, Human
cauucuuccuaguuuucuccu

SEQ ID NO: 2439837 - RNA, 20 nt, Human
cauucuucucuagcuggugg

SEQ ID NO: 2439838 - RNA, 23 nt, Human
cauucuucuguacgucugacagg

SEQ ID NO: 2439839 - RNA, 17 nt, Human
cauucuugaaagcugug

SEQ ID NO: 2439840 - RNA, 21 nt, Human
cauucuugguuggcuggccuu

SEQ ID NO: 2439841 - RNA, 17 nt, Human
cauucuugguuggcugg

SEQ ID NO: 2439842 - RNA, 16 nt, Human
cauucuugguuggcug

SEQ ID NO: 2439843 - RNA, 17 nt, Human
cauucuuucugauaacu

SEQ ID NO: 2439844 - RNA, 18 nt, Human
cauucuuuaucuugacau

SEQ ID NO: 2439845 - RNA, 16 nt, Human
cauucuuuuaaaagac

SEQ ID NO: 2439846 - RNA, 19 nt, Human
cauucuuuuaaaagacaag

SEQ ID NO: 2439847 - RNA, 12 nt, Human
cauucuuuugua

SEQ ID NO: 2439848 - RNA, 18 nt, Human
cauucuuuuguaauuuaa

SEQ ID NO: 2439849 - RNA, 16 nt, Human
cauucuuuuguaauuu

SEQ ID NO: 2439850 - RNA, 15 nt, Human
cauucuuuuguaauu

SEQ ID NO: 2439851 - RNA, 14 nt, Human
cauucuuuuguaau

SEQ ID NO: 2439852 - RNA, 21 nt, Human
cauucugacucgguuucucca

SEQ ID NO: 2439853 - RNA, 19 nt, Human
cauucugacucgguuucuc

SEQ ID NO: 2439854 - RNA, 16 nt, Human
cauucugacucgguuu

SEQ ID NO: 2439855 - RNA, 12 nt, Human
cauucugacucg

SEQ ID NO: 2439856 - RNA, 15 nt, Human
cauucugacucauau

SEQ ID NO: 2439857 - RNA, 16 nt, Human
cauucugaccauuuca

SEQ ID NO: 2439858 - RNA, 17 nt, Human
cauucugaccauuucag

SEQ ID NO: 2439859 - RNA, 23 nt, Human
cauucugacucgguuucuccaaa

SEQ ID NO: 2439860 - RNA, 20 nt, Human
cauucugauuuggaaaaaga

SEQ ID NO: 2439861 - RNA, 22 nt, Human
cauucugccaggcccccaagcc

SEQ ID NO: 2439862 - RNA, 23 nt, Human
cauuccugguacccagccaucug

SEQ ID NO: 2439863 - RNA, 21 nt, Human
cauuccugguacccagccauc

SEQ ID NO: 2439864 - RNA, 20 nt, Human
cauuccugguacccagccau

SEQ ID NO: 2439865 - RNA, 19 nt, Human
cauuccugguacccagcca

SEQ ID NO: 2439866 - RNA, 13 nt, Human
cauuccuguauuc

SEQ ID NO: 2439867 - RNA, 24 nt, Human
cauuccugguacccagccaucugc

SEQ ID NO: 2439868 - RNA, 18 nt, Human
cauuccuguauucacccg

SEQ ID NO: 2439869 - RNA, 18 nt, Human
cauuccugguacccagcc

SEQ ID NO: 2439870 - RNA, 17 nt, Human
cauuccugguacccagc

SEQ ID NO: 2439871 - RNA, 15 nt, Human
cauuccugguaccca

SEQ ID NO: 2439872 - RNA, 16 nt, Human
cauuccugggcacagu

SEQ ID NO: 2439873 - RNA, 14 nt, Human
cauuccugggcaca

SEQ ID NO: 2439874 - RNA, 21 nt, Human
cauuccuggaaaccacagucc

SEQ ID NO: 2439875 - RNA, 21 nt, Human
cauuccugggaaauauucccu

SEQ ID NO: 2439876 - RNA, 23 nt, Human
cauuccugaugcuucuucagaga

SEQ ID NO: 2439877 - RNA, 13 nt, Human
cauuccugccugu

SEQ ID NO: 2439878 - RNA, 14 nt, Human
cauuccugccuguc

SEQ ID NO: 2439879 - RNA, 15 nt, Human
cauuccugccugucu

SEQ ID NO: 2439880 - RNA, 16 nt, Human
cauuccugccugucuc

SEQ ID NO: 2439881 - RNA, 19 nt, Human
cauuccuggaaaccacagu

SEQ ID NO: 2439882 - RNA, 17 nt, Human
cauuccuggaaaccaca

SEQ ID NO: 2439883 - RNA, 22 nt, Human
cauuccugaugcuucuucagag

SEQ ID NO: 2439884 - RNA, 19 nt, Human
cauuccugaugcuucuuca

SEQ ID NO: 2439885 - RNA, 16 nt, Human
cauuccugaugcuucu

SEQ ID NO: 2439886 - RNA, 14 nt, Human
cauuccugaugcuu

SEQ ID NO: 2439887 - RNA, 13 nt, Human
cauuccugaagaa

SEQ ID NO: 2439888 - RNA, 16 nt, Human
cauuccugaagaacca

SEQ ID NO: 2439889 - RNA, 17 nt, Human
cauuccugaagaaccag

SEQ ID NO: 2439890 - RNA, 20 nt, Human
cauuccugaagaaccagucc

SEQ ID NO: 2439891 - RNA, 21 nt, Human
cauuccugaagaaccaguccc

SEQ ID NO: 2439892 - RNA, 21 nt, Human
cauuccugauaugauuuaaaa

SEQ ID NO: 2439893 - RNA, 19 nt, Human
cauuccugaaagaaacagu

SEQ ID NO: 2439894 - RNA, 13 nt, Human
cauuccugaaaga

SEQ ID NO: 2439895 - RNA, 23 nt, Human
cauuccucaccuuuucccgggga

SEQ ID NO: 2439896 - RNA, 13 nt, Human
cauuccucaggga

SEQ ID NO: 2439897 - RNA, 16 nt, Human
cauuccucagggacag

SEQ ID NO: 2439898 - RNA, 23 nt, Human
cauuccucagggacagagacacc

SEQ ID NO: 2439899 - RNA, 20 nt, Human
cauucugccugcccaggccc

SEQ ID NO: 2439900 - RNA, 19 nt, Human
cauucugccugcccaggcc

SEQ ID NO: 2439901 - RNA, 18 nt, Human
cauucugccugcccaggc

SEQ ID NO: 2439902 - RNA, 17 nt, Human
cauucugccugcccagg

SEQ ID NO: 2439903 - RNA, 16 nt, Human
cauucugccugcccag

SEQ ID NO: 2439904 - RNA, 15 nt, Human
cauucugccugccca

SEQ ID NO: 2439905 - RNA, 13 nt, Human
cauucugccugcc

SEQ ID NO: 2439906 - RNA, 12 nt, Human
cauucugccugc

SEQ ID NO: 2439907 - RNA, 13 nt, Human
cauucuggaauaa

SEQ ID NO: 2439908 - RNA, 21 nt, Human
cauucugucgccuuagcaugu

SEQ ID NO: 2439909 - RNA, 16 nt, Human
cauucuggaagugacu

SEQ ID NO: 2439910 - RNA, 12 nt, Human
cauucuggaagu

SEQ ID NO: 2439911 - RNA, 20 nt, Human
cauucugcuuucaucuuggu

SEQ ID NO: 2439912 - RNA, 22 nt, Human
cauucuuauaaauaugaagcuc

SEQ ID NO: 2439913 - RNA, 17 nt, Human
cauucuuauaaauauga

SEQ ID NO: 2439914 - RNA, 21 nt, Human
cauucuuauuucaugaaaauu

SEQ ID NO: 2439915 - RNA, 16 nt, Human
cauucuuauaaauaug

SEQ ID NO: 2439916 - RNA, 15 nt, Human
cauucuuauaaauau

SEQ ID NO: 2439917 - RNA, 14 nt, Human
cauucuuauaaaua

SEQ ID NO: 2439918 - RNA, 17 nt, Human
cauucuuagcucuuaau

SEQ ID NO: 2439919 - RNA, 14 nt, Human
cauucuuagcucuu

SEQ ID NO: 2439920 - RNA, 17 nt, Human
cauucuguuaaucauua

SEQ ID NO: 2439921 - RNA, 22 nt, Human
cauucugucgccuuagcauguu

SEQ ID NO: 2439922 - RNA, 15 nt, Human
cauucugucuugaag

SEQ ID NO: 2439923 - RNA, 13 nt, Human
cauuacugcaugc

SEQ ID NO: 2439924 - RNA, 16 nt, Human
cauuacugcaugcacu

SEQ ID NO: 2439925 - RNA, 23 nt, Human
cauuacugcaugcacuucuuaca

SEQ ID NO: 2439926 - RNA, 23 nt, Human
cauuacucaauugauaaacauuu

SEQ ID NO: 2439927 - RNA, 16 nt, Human
cauuaccacucaggca

SEQ ID NO: 2439928 - RNA, 21 nt, Human
cauuacuuuaccacccccaca

SEQ ID NO: 2439929 - RNA, 23 nt, Human
cauuacuuuaccacccccacacc

SEQ ID NO: 2439930 - RNA, 17 nt, Human
cauuagaaauagacagu

SEQ ID NO: 2439931 - RNA, 19 nt, Human
cauuagaauuauuuaaaca

SEQ ID NO: 2439932 - RNA, 14 nt, Human
cauuagaauuauuu

SEQ ID NO: 2439933 - RNA, 22 nt, Human
cauuagaagauauuagucuugg

SEQ ID NO: 2439934 - RNA, 18 nt, Human
cauuagaaauuagcugug

SEQ ID NO: 2439935 - RNA, 17 nt, Human
cauuauuggaauuaacc

SEQ ID NO: 2439936 - RNA, 18 nt, Human
cauuauuggaauuaaccu

SEQ ID NO: 2439937 - RNA, 20 nt, Human
cauuauuggaauuaaccugg

SEQ ID NO: 2439938 - RNA, 22 nt, Human
cauuauuggaauuaaccuggug

SEQ ID NO: 2439939 - RNA, 14 nt, Human
cauuauuggaauua

SEQ ID NO: 2439940 - RNA, 12 nt, Human
cauuauuggaau

SEQ ID NO: 2439941 - RNA, 16 nt, Human
cauucaaaaguugaaa

SEQ ID NO: 2439942 - RNA, 17 nt, Human
cauucaaaaguugaaau

SEQ ID NO: 2439943 - RNA, 22 nt, Human
cauuauuuuuccacuuuguucu

SEQ ID NO: 2439944 - RNA, 20 nt, Human
cauuauuuuuccacuuuguu

SEQ ID NO: 2439945 - RNA, 23 nt, Human
cauuauuggaauuaaccuggugc

SEQ ID NO: 2439946 - RNA, 23 nt, Human
cauucaaauuaaggguuaagaaa

SEQ ID NO: 2439947 - RNA, 12 nt, Human
cauucaacaaga

SEQ ID NO: 2439948 - RNA, 12 nt, Human
cauucaaauuaa

SEQ ID NO: 2439949 - RNA, 18 nt, Human
cauucaaaaguugaaauu

SEQ ID NO: 2439950 - RNA, 17 nt, Human
cauucaaguguaaaaua

SEQ ID NO: 2439951 - RNA, 17 nt, Human
cauucaacccuggagag

SEQ ID NO: 2439952 - RNA, 22 nt, Human
cauucacaguucuuugggccag

SEQ ID NO: 2439953 - RNA, 21 nt, Human
cauucaauuuauucaagaaaa

SEQ ID NO: 2439954 - RNA, 13 nt, Human
cauucaauguuua

SEQ ID NO: 2439955 - RNA, 22 nt, Human
cauucaauaagcaucaaacucu

SEQ ID NO: 2439956 - RNA, 20 nt, Human
cauucaauuuauucaagaaa

SEQ ID NO: 2439957 - RNA, 23 nt, Human
cauucacaguucuuugggccaga

SEQ ID NO: 2439958 - RNA, 13 nt, Human
cauucaccugccc

SEQ ID NO: 2439959 - RNA, 13 nt, Human
cauucacccagac

SEQ ID NO: 2439960 - RNA, 14 nt, Human
cauucacccagaca

SEQ ID NO: 2439961 - RNA, 21 nt, Human
cauucaaguguaaaauauuuu

SEQ ID NO: 2439962 - RNA, 20 nt, Human
cauucaaguguaaaauauuu

SEQ ID NO: 2439963 - RNA, 19 nt, Human
cauucaaguguaaaauauu

SEQ ID NO: 2439964 - RNA, 18 nt, Human
cauucaaguguaaaauau

SEQ ID NO: 2439965 - RNA, 23 nt, Human
cauucaaguguaaaauauuuuga

SEQ ID NO: 2439966 - RNA, 22 nt, Human
cauucaaguguaaaauauuuug

SEQ ID NO: 2439967 - RNA, 21 nt, Human
cauucaauaagcaucaaacuc

SEQ ID NO: 2439968 - RNA, 16 nt, Human
cauucaauacaagugu

SEQ ID NO: 2439969 - RNA, 13 nt, Human
cauuacagagagg

SEQ ID NO: 2439970 - RNA, 15 nt, Human
cauuacagagaggag

SEQ ID NO: 2439971 - RNA, 18 nt, Human
cauuacagagaggagaaa

SEQ ID NO: 2439972 - RNA, 20 nt, Human
cauuacagagaggagaaaca

SEQ ID NO: 2439973 - RNA, 12 nt, Human
cauuaauucuau

SEQ ID NO: 2439974 - RNA, 16 nt, Human
cauuacaaauugcuua

SEQ ID NO: 2439975 - RNA, 15 nt, Human
cauuaccacucaggc

SEQ ID NO: 2439976 - RNA, 14 nt, Human
cauuaccacucagg

SEQ ID NO: 2439977 - RNA, 13 nt, Human
cauuaccacucag

SEQ ID NO: 2439978 - RNA, 12 nt, Human
cauuaccacuca

SEQ ID NO: 2439979 - RNA, 21 nt, Human
cauuacagugggugccccccu

SEQ ID NO: 2439980 - RNA, 22 nt, Human
cauuacagagaggagaaacaca

SEQ ID NO: 2439981 - RNA, 14 nt, Human
cauuacagcuuaau

SEQ ID NO: 2439982 - RNA, 21 nt, Human
cauuacagagaggagaaacac

SEQ ID NO: 2439983 - RNA, 24 nt, Human
cauuacagggaaugccugagugcc

SEQ ID NO: 2439984 - RNA, 16 nt, Human
cauuacagcuuaauca

SEQ ID NO: 2439985 - RNA, 21 nt, Human
cauuaacaguuuuccaugaaa

SEQ ID NO: 2439986 - RNA, 22 nt, Human
cauuaacaguuuuccaugaaaa

SEQ ID NO: 2439987 - RNA, 16 nt, Human
cauuaacuaaucuauu

SEQ ID NO: 2439988 - RNA, 18 nt, Human
cauuaacuaaucuauugg

SEQ ID NO: 2439989 - RNA, 23 nt, Human
cauuaacaguuuuccaugaaaac

SEQ ID NO: 2439990 - RNA, 17 nt, Human
cauuaagaaaaucauau

SEQ ID NO: 2439991 - RNA, 14 nt, Human
cauuaagaaaauca

SEQ ID NO: 2439992 - RNA, 13 nt, Human
cauuaagaaaauc

SEQ ID NO: 2439993 - RNA, 12 nt, Human
cauuaagaaaau

SEQ ID NO: 2439994 - RNA, 11 nt, Human
cauuaagaaaa

SEQ ID NO: 2439995 - RNA, 16 nt, Human
cauuaacuucucugga

SEQ ID NO: 2439996 - RNA, 17 nt, Human
cauuaacuuagcaugug

SEQ ID NO: 2439997 - RNA, 17 nt, Human
cauuaagcccucuucca

SEQ ID NO: 2439998 - RNA, 15 nt, Human
cauuaagaaaaucau

SEQ ID NO: 2439999 - RNA, 16 nt, Human
cauuaagcccucuucc

SEQ ID NO: 2440000 - RNA, 20 nt, Human
cauuaagcccucuuccauca

SEQ ID NO: 2440001 - RNA, 16 nt, Human
cauuaagccuuccaca

SEQ ID NO: 2440002 - RNA, 17 nt, Human
cauuccccaggaggcca

SEQ ID NO: 2440003 - RNA, 15 nt, Human
cauuccccaggaggc

SEQ ID NO: 2440004 - RNA, 13 nt, Human
cauuccccaggag

SEQ ID NO: 2440005 - RNA, 15 nt, Human
cauuccauucuggaa

SEQ ID NO: 2440006 - RNA, 14 nt, Human
cauuccauucugga

SEQ ID NO: 2440007 - RNA, 22 nt, Human
cauuccagccccucuggucgcu

SEQ ID NO: 2440008 - RNA, 12 nt, Human
cauuccauccuu

SEQ ID NO: 2440009 - RNA, 14 nt, Human
cauuccauccuuga

SEQ ID NO: 2440010 - RNA, 19 nt, Human
cauuccagccccucugguc

SEQ ID NO: 2440011 - RNA, 18 nt, Human
cauuccagccccucuggu

SEQ ID NO: 2440012 - RNA, 15 nt, Human
cauuccagccccucu

SEQ ID NO: 2440013 - RNA, 13 nt, Human
cauuccagccccu

SEQ ID NO: 2440014 - RNA, 14 nt, Human
cauuccagaggaag

SEQ ID NO: 2440015 - RNA, 14 nt, Human
cauuccaagccuga

SEQ ID NO: 2440016 - RNA, 19 nt, Human
cauuccccaggaggccagc

SEQ ID NO: 2440017 - RNA, 18 nt, Human
cauuccccaggaggccag

SEQ ID NO: 2440018 - RNA, 20 nt, Human
cauuccccaggaggccagcc

SEQ ID NO: 2440019 - RNA, 13 nt, Human
cauuccccauggg

SEQ ID NO: 2440020 - RNA, 13 nt, Human
cauuccccaggug

SEQ ID NO: 2440021 - RNA, 17 nt, Human
cauuccccagguggcug

SEQ ID NO: 2440022 - RNA, 23 nt, Human
cauuccccagguggcugacccag

SEQ ID NO: 2440023 - RNA, 17 nt, Human
cauuccccgucucuggu

SEQ ID NO: 2440024 - RNA, 11 nt, Human
cauucccugag

SEQ ID NO: 2440025 - RNA, 17 nt, Human
cauucccugagucacca

SEQ ID NO: 2440026 - RNA, 18 nt, Human
cauuccuaaacuaucuuu

SEQ ID NO: 2440027 - RNA, 20 nt, Human
cauuccuaacacagcaugug

SEQ ID NO: 2440028 - RNA, 21 nt, Human
cauuccuaacacagcaugugu

SEQ ID NO: 2440029 - RNA, 13 nt, Human
cauuccuauuucu

SEQ ID NO: 2440030 - RNA, 13 nt, Human
cauuccucaccuu

SEQ ID NO: 2440031 - RNA, 23 nt, Human
cauuccuaacacagcauguguau

SEQ ID NO: 2440032 - RNA, 18 nt, Human
cauucccugagucaccag

SEQ ID NO: 2440033 - RNA, 20 nt, Human
cauucccugagucaccagga

SEQ ID NO: 2440034 - RNA, 21 nt, Human
cauucccugagucaccaggaa

SEQ ID NO: 2440035 - RNA, 22 nt, Human
cauuccgacaaccgaugcucca

SEQ ID NO: 2440036 - RNA, 16 nt, Human
cauucauuccauucug

SEQ ID NO: 2440037 - RNA, 17 nt, Human
cauucauuccauucugg

SEQ ID NO: 2440038 - RNA, 20 nt, Human
cauucauuuagcuaaacgga

SEQ ID NO: 2440039 - RNA, 14 nt, Human
cauucaugccuggc

SEQ ID NO: 2440040 - RNA, 15 nt, Human
cauucauuccauucu

SEQ ID NO: 2440041 - RNA, 16 nt, Human
cauucaugccuggcuu

SEQ ID NO: 2440042 - RNA, 18 nt, Human
cauucaucuuguguuuua

SEQ ID NO: 2440043 - RNA, 19 nt, Human
cauucauuuucuggguguu

SEQ ID NO: 2440044 - RNA, 12 nt, Human
cauuccaacaaa

SEQ ID NO: 2440045 - RNA, 15 nt, Human
cauucauucuuagcu

SEQ ID NO: 2440046 - RNA, 23 nt, Human
cauuccaagacaguauacagucc

SEQ ID NO: 2440047 - RNA, 15 nt, Human
cauuccaagacagua

SEQ ID NO: 2440048 - RNA, 17 nt, Human
cauuccaccuucccaug

SEQ ID NO: 2440049 - RNA, 13 nt, Human
cauuccagaggaa

SEQ ID NO: 2440050 - RNA, 22 nt, Human
cauuccaccuucccaugcccug

SEQ ID NO: 2440051 - RNA, 22 nt, Human
cauuccaacuaucucauuucca

SEQ ID NO: 2440052 - RNA, 14 nt, Human
cauuccaagacagu

SEQ ID NO: 2440053 - RNA, 13 nt, Human
cauuccaagacag

SEQ ID NO: 2440054 - RNA, 18 nt, Human
cauuccaacaaaggguuu

SEQ ID NO: 2440055 - RNA, 14 nt, Human
cauuccaacaaagg

SEQ ID NO: 2440056 - RNA, 16 nt, Human
cauuccaacagugagu

SEQ ID NO: 2440057 - RNA, 23 nt, Human
cauuccaacagcucaagucuucc

SEQ ID NO: 2440058 - RNA, 16 nt, Human
cauucacucuuccaga

SEQ ID NO: 2440059 - RNA, 14 nt, Human
cauucacucuucca

SEQ ID NO: 2440060 - RNA, 11 nt, Human
cauucacuuca

SEQ ID NO: 2440061 - RNA, 20 nt, Human
cauucacucuuccagaaucc

SEQ ID NO: 2440062 - RNA, 15 nt, Human
cauucaccugcccca

SEQ ID NO: 2440063 - RNA, 16 nt, Human
cauucaccugccccaa

SEQ ID NO: 2440064 - RNA, 19 nt, Human
cauucaccugccccaacuc

SEQ ID NO: 2440065 - RNA, 13 nt, Human
cauucacucuucc

SEQ ID NO: 2440066 - RNA, 20 nt, Human
cauucacccagacagcuccc

SEQ ID NO: 2440067 - RNA, 13 nt, Human
cauucagaaaaaa

SEQ ID NO: 2440068 - RNA, 18 nt, Human
cauucacuugcauuucuu

SEQ ID NO: 2440069 - RNA, 12 nt, Human
cauucagagagc

SEQ ID NO: 2440070 - RNA, 14 nt, Human
cauucacuucauaa

SEQ ID NO: 2440071 - RNA, 15 nt, Human
cauucacuucauaau

SEQ ID NO: 2440072 - RNA, 15 nt, Human
cauucacuugcauuu

SEQ ID NO: 2440073 - RNA, 15 nt, Human
cauucagagagcagc

SEQ ID NO: 2440074 - RNA, 15 nt, Human
cauucagcaagacaa

SEQ ID NO: 2440075 - RNA, 13 nt, Human
cauucaggaaaac

SEQ ID NO: 2440076 - RNA, 20 nt, Human
cauucaggaaaacugacaga

SEQ ID NO: 2440077 - RNA, 23 nt, Human
cauucaggaaaacugacagagga

SEQ ID NO: 2440078 - RNA, 17 nt, Human
cauucaggaagaugaaa

SEQ ID NO: 2440079 - RNA, 13 nt, Human
cauucaucucauu

SEQ ID NO: 2440080 - RNA, 15 nt, Human
cauucauaacuuuca

SEQ ID NO: 2440081 - RNA, 20 nt, Human
cauucagugauuacugucaa

SEQ ID NO: 2440082 - RNA, 21 nt, Human
cauucagugauuacugucaag

SEQ ID NO: 2440083 - RNA, 19 nt, Human
cauucagugauuacuguca

SEQ ID NO: 2440084 - RNA, 14 nt, Human
caucacuccccucc

SEQ ID NO: 2440085 - RNA, 13 nt, Human
caucacuccccuc

SEQ ID NO: 2440086 - RNA, 16 nt, Human
caucacucugcugcuu

SEQ ID NO: 2440087 - RNA, 15 nt, Human
caucacuccccucca

SEQ ID NO: 2440088 - RNA, 12 nt, Human
caucagggacag

SEQ ID NO: 2440089 - RNA, 14 nt, Human
caucagggacagga

SEQ ID NO: 2440090 - RNA, 18 nt, Human
caucagggacaggaugac

SEQ ID NO: 2440091 - RNA, 16 nt, Human
caucaguauugaagca

SEQ ID NO: 2440092 - RNA, 17 nt, Human
caucagguuccaucccg

SEQ ID NO: 2440093 - RNA, 16 nt, Human
caucagguuccauccc

SEQ ID NO: 2440094 - RNA, 20 nt, Human
caucaguauugaagcauuuu

SEQ ID NO: 2440095 - RNA, 22 nt, Human
caucaguauugaagcauuuuau

SEQ ID NO: 2440096 - RNA, 17 nt, Human
caucagucccuauguau

SEQ ID NO: 2440097 - RNA, 15 nt, Human
caucagucccuaugu

SEQ ID NO: 2440098 - RNA, 15 nt, Human
caucagugcucccuc

SEQ ID NO: 2440099 - RNA, 16 nt, Human
caucagugcucccuca

SEQ ID NO: 2440100 - RNA, 24 nt, Human
caucagugcucccucacaugucag

SEQ ID NO: 2440101 - RNA, 14 nt, Human
caucaguggagcca

SEQ ID NO: 2440102 - RNA, 16 nt, Human
caucaguggcauggcu

SEQ ID NO: 2440103 - RNA, 18 nt, Human
caucaguggcauggcucc

SEQ ID NO: 2440104 - RNA, 23 nt, Human
caucaguguacccccgcccaggc

SEQ ID NO: 2440105 - RNA, 22 nt, Human
caucaguguacccccgcccagg

SEQ ID NO: 2440106 - RNA, 21 nt, Human
caucaguguacccccgcccag

SEQ ID NO: 2440107 - RNA, 22 nt, Human
caucaguggcauggcuccaguc

SEQ ID NO: 2440108 - RNA, 22 nt, Human
caucaguuacucugaagggcau

SEQ ID NO: 2440109 - RNA, 18 nt, Human
caucaguuagagcugaca

SEQ ID NO: 2440110 - RNA, 16 nt, Human
caucaguuagagcuga

SEQ ID NO: 2440111 - RNA, 15 nt, Human
caucaguuagagcug

SEQ ID NO: 2440112 - RNA, 24 nt, Human
caucaguguacccccgcccaggcu

SEQ ID NO: 2440113 - RNA, 20 nt, Human
caucaguuagagcugacaca

SEQ ID NO: 2440114 - RNA, 12 nt, Human
caucauaaaaua

SEQ ID NO: 2440115 - RNA, 19 nt, Human
caucaccgacgcgucuccu

SEQ ID NO: 2440116 - RNA, 20 nt, Human
caucacccuuaccaugugcc

SEQ ID NO: 2440117 - RNA, 22 nt, Human
caucaccgacgcgucuccuguu

SEQ ID NO: 2440118 - RNA, 13 nt, Human
caucaccacaguu

SEQ ID NO: 2440119 - RNA, 12 nt, Human
caucacccgcua

SEQ ID NO: 2440120 - RNA, 13 nt, Human
caucaagacugga

SEQ ID NO: 2440121 - RNA, 22 nt, Human
caucaagaauggggaucacaga

SEQ ID NO: 2440122 - RNA, 14 nt, Human
caucaacugaauga

SEQ ID NO: 2440123 - RNA, 19 nt, Human
caucaagaagguagcuuga

SEQ ID NO: 2440124 - RNA, 20 nt, Human
caucaccaacgucugugcca

SEQ ID NO: 2440125 - RNA, 16 nt, Human
caucaccuuaggcagg

SEQ ID NO: 2440126 - RNA, 17 nt, Human
caucaccuuaggcaggg

SEQ ID NO: 2440127 - RNA, 18 nt, Human
caucaccuuaggcaggga

SEQ ID NO: 2440128 - RNA, 19 nt, Human
caucaccuuaggcagggaa

SEQ ID NO: 2440129 - RNA, 20 nt, Human
caucaccuuaggcagggaag

SEQ ID NO: 2440130 - RNA, 22 nt, Human
caucaccuuaggcagggaagug

SEQ ID NO: 2440131 - RNA, 23 nt, Human
caucaccuuaggcagggaagugu

SEQ ID NO: 2440132 - RNA, 14 nt, Human
caucacgccugugc

SEQ ID NO: 2440133 - RNA, 15 nt, Human
caucacgccugugca

SEQ ID NO: 2440134 - RNA, 12 nt, Human
caucaccucagg

SEQ ID NO: 2440135 - RNA, 13 nt, Human
caucaccucaggc

SEQ ID NO: 2440136 - RNA, 14 nt, Human
caucaccuccacca

SEQ ID NO: 2440137 - RNA, 13 nt, Human
caucaccuccacc

SEQ ID NO: 2440138 - RNA, 15 nt, Human
caucaccucaggcca

SEQ ID NO: 2440139 - RNA, 18 nt, Human
caucaccucaggccaggu

SEQ ID NO: 2440140 - RNA, 15 nt, Human
caucaugucuggcua

SEQ ID NO: 2440141 - RNA, 14 nt, Human
caucaugucuggcu

SEQ ID NO: 2440142 - RNA, 19 nt, Human
caucauguuuacagaggac

SEQ ID NO: 2440143 - RNA, 21 nt, Human
caucauguuuacagaggacag

SEQ ID NO: 2440144 - RNA, 13 nt, Human
caucauguuuaca

SEQ ID NO: 2440145 - RNA, 22 nt, Human
caucauguccccaaaccugcaa

SEQ ID NO: 2440146 - RNA, 21 nt, Human
caucauguccccaaaccugca

SEQ ID NO: 2440147 - RNA, 21 nt, Human
caucauggauucauuacagcu

SEQ ID NO: 2440148 - RNA, 21 nt, Human
caucaugcuuacaaaaaagaa

SEQ ID NO: 2440149 - RNA, 15 nt, Human
caucauggcuaucug

SEQ ID NO: 2440150 - RNA, 13 nt, Human
caucaugucuggc

SEQ ID NO: 2440151 - RNA, 16 nt, Human
caucaugcaucuuacu

SEQ ID NO: 2440152 - RNA, 17 nt, Human
caucaucaguggagcca

SEQ ID NO: 2440153 - RNA, 21 nt, Human
caucaucaaggcacugccuga

SEQ ID NO: 2440154 - RNA, 20 nt, Human
caucaucaaggcacugccug

SEQ ID NO: 2440155 - RNA, 19 nt, Human
caucaucaaggcacugccu

SEQ ID NO: 2440156 - RNA, 13 nt, Human
caucaucaaggca

SEQ ID NO: 2440157 - RNA, 23 nt, Human
caucauaggaagggaccaaggca

SEQ ID NO: 2440158 - RNA, 14 nt, Human
caucauauuauaca

SEQ ID NO: 2440159 - RNA, 16 nt, Human
caucauauuauacaga

SEQ ID NO: 2440160 - RNA, 22 nt, Human
caucauaggaagggaccaaggc

SEQ ID NO: 2440161 - RNA, 17 nt, Human
caucauaggaagggacc

SEQ ID NO: 2440162 - RNA, 15 nt, Human
caucauacacuuccu

SEQ ID NO: 2440163 - RNA, 22 nt, Human
caucauaaaauaaaguauauau

SEQ ID NO: 2440164 - RNA, 23 nt, Human
caucauaaaauaaaguauauaua

SEQ ID NO: 2440165 - RNA, 13 nt, Human
caucauaaaauaa

SEQ ID NO: 2440166 - RNA, 14 nt, Human
caucauaaaauaaa

SEQ ID NO: 2440167 - RNA, 18 nt, Human
caucauaaaauaaaguau

SEQ ID NO: 2440168 - RNA, 20 nt, Human
caucauaaaauaaaguauau

SEQ ID NO: 2440169 - RNA, 15 nt, Human
caucaucccagcugc

SEQ ID NO: 2440170 - RNA, 13 nt, Human
caucaucccagcu

SEQ ID NO: 2440171 - RNA, 16 nt, Human
caucauccuaagcuau

SEQ ID NO: 2440172 - RNA, 13 nt, Human
caucaucuccugc

SEQ ID NO: 2440173 - RNA, 20 nt, Human
caucaucuccugccuuccuc

SEQ ID NO: 2440174 - RNA, 21 nt, Human
caucaucuccugccuuccucc

SEQ ID NO: 2440175 - RNA, 19 nt, Human
caucccuuugaaacaagau

SEQ ID NO: 2440176 - RNA, 20 nt, Human
caucccuugaccaggccugg

SEQ ID NO: 2440177 - RNA, 23 nt, Human
caucccuugaccaggccugggcc

SEQ ID NO: 2440178 - RNA, 20 nt, Human
caucccuuuuugaaguguag

SEQ ID NO: 2440179 - RNA, 18 nt, Human
caucccuuuuugaagugu

SEQ ID NO: 2440180 - RNA, 17 nt, Human
caucccuuuuugaagug

SEQ ID NO: 2440181 - RNA, 16 nt, Human
caucccuuuuugaagu

SEQ ID NO: 2440182 - RNA, 13 nt, Human
caucccuuuuuga

SEQ ID NO: 2440183 - RNA, 16 nt, Human
caucccuuugcccaga

SEQ ID NO: 2440184 - RNA, 18 nt, Human
caucccuuaccugggaaa

SEQ ID NO: 2440185 - RNA, 19 nt, Human
caucccuugaccaggccug

SEQ ID NO: 2440186 - RNA, 16 nt, Human
cauccggcccccagag

SEQ ID NO: 2440187 - RNA, 13 nt, Human
cauccgaggcagg

SEQ ID NO: 2440188 - RNA, 14 nt, Human
cauccgaggcaggg

SEQ ID NO: 2440189 - RNA, 15 nt, Human
cauccgaggcagggu

SEQ ID NO: 2440190 - RNA, 23 nt, Human
cauccgaggcagggucaggagag

SEQ ID NO: 2440191 - RNA, 16 nt, Human
cauccgaggcaggguc

SEQ ID NO: 2440192 - RNA, 22 nt, Human
cauccgaggcagggucaggaga

SEQ ID NO: 2440193 - RNA, 13 nt, Human
caucccuccuggg

SEQ ID NO: 2440194 - RNA, 17 nt, Human
caucccugaggagccag

SEQ ID NO: 2440195 - RNA, 22 nt, Human
caucccugaaggccccgcccag

SEQ ID NO: 2440196 - RNA, 15 nt, Human
caucccucuggggcu

SEQ ID NO: 2440197 - RNA, 14 nt, Human
caucccuggaaggu

SEQ ID NO: 2440198 - RNA, 16 nt, Human
caucccugccugguca

SEQ ID NO: 2440199 - RNA, 15 nt, Human
caucccuggaaggug

SEQ ID NO: 2440200 - RNA, 19 nt, Human
caucccugauuccuguugu

SEQ ID NO: 2440201 - RNA, 18 nt, Human
caucccugaggagccagg

SEQ ID NO: 2440202 - RNA, 15 nt, Human
caucccugccagcuc

SEQ ID NO: 2440203 - RNA, 15 nt, Human
caucccugccugguc

SEQ ID NO: 2440204 - RNA, 14 nt, Human
caucccugccuggu

SEQ ID NO: 2440205 - RNA, 13 nt, Human
caucccugccugg

SEQ ID NO: 2440206 - RNA, 21 nt, Human
caucccugccagcucuucugc

SEQ ID NO: 2440207 - RNA, 18 nt, Human
cauccauaguaguaugau

SEQ ID NO: 2440208 - RNA, 14 nt, Human
cauccaucaucaug

SEQ ID NO: 2440209 - RNA, 16 nt, Human
cauccauaguaguaug

SEQ ID NO: 2440210 - RNA, 16 nt, Human
cauccauaaagaagca

SEQ ID NO: 2440211 - RNA, 13 nt, Human
cauccaucaucau

SEQ ID NO: 2440212 - RNA, 12 nt, Human
cauccauccagg

SEQ ID NO: 2440213 - RNA, 17 nt, Human
cauccauaaagaagcaa

SEQ ID NO: 2440214 - RNA, 14 nt, Human
cauccauaaagaag

SEQ ID NO: 2440215 - RNA, 22 nt, Human
cauccagugucucacagcccug

SEQ ID NO: 2440216 - RNA, 13 nt, Human
cauccaguucaug

SEQ ID NO: 2440217 - RNA, 23 nt, Human
cauccagucucccaacuuguauu

SEQ ID NO: 2440218 - RNA, 22 nt, Human
cauccacucuacccucccaccc

SEQ ID NO: 2440219 - RNA, 18 nt, Human
cauccacucuacccuccc

SEQ ID NO: 2440220 - RNA, 19 nt, Human
cauccacucuacccuccca

SEQ ID NO: 2440221 - RNA, 17 nt, Human
cauccagguucagcuug

SEQ ID NO: 2440222 - RNA, 23 nt, Human
cauccacugugccaugugccagg

SEQ ID NO: 2440223 - RNA, 17 nt, Human
cauccacugugccaugu

SEQ ID NO: 2440224 - RNA, 14 nt, Human
cauccacugugcca

SEQ ID NO: 2440225 - RNA, 15 nt, Human
caucauucucugucu

SEQ ID NO: 2440226 - RNA, 16 nt, Human
caucauucucugucuc

SEQ ID NO: 2440227 - RNA, 17 nt, Human
cauccacucuacccucc

SEQ ID NO: 2440228 - RNA, 18 nt, Human
caucauucaugcuacugc

SEQ ID NO: 2440229 - RNA, 21 nt, Human
caucauuauuugcagagacag

SEQ ID NO: 2440230 - RNA, 14 nt, Human
caucauuagaacaa

SEQ ID NO: 2440231 - RNA, 17 nt, Human
caucauuauaaacguga

SEQ ID NO: 2440232 - RNA, 13 nt, Human
caucauuagaaca

SEQ ID NO: 2440233 - RNA, 10 nt, Human
caucauuaga

SEQ ID NO: 2440234 - RNA, 17 nt, Human
caucauuccuugagaaa

SEQ ID NO: 2440235 - RNA, 22 nt, Human
caucauuccuugagaaaaacaa

SEQ ID NO: 2440236 - RNA, 12 nt, Human
caucauucucug

SEQ ID NO: 2440237 - RNA, 14 nt, Human
caucauucucuguc

SEQ ID NO: 2440238 - RNA, 19 nt, Human
caucaaauggaagacacau

SEQ ID NO: 2440239 - RNA, 17 nt, Human
caucaaauggaagacac

SEQ ID NO: 2440240 - RNA, 16 nt, Human
caucaaauggaagaca

SEQ ID NO: 2440241 - RNA, 15 nt, Human
caucaaauggaagac

SEQ ID NO: 2440242 - RNA, 13 nt, Human
caucaacaaaaau

SEQ ID NO: 2440243 - RNA, 15 nt, Human
caucaacaaaaauug

SEQ ID NO: 2440244 - RNA, 21 nt, Human
cauauuuguuaaauauuuaca

SEQ ID NO: 2440245 - RNA, 10 nt, Human
caucaacuga

SEQ ID NO: 2440246 - RNA, 12 nt, Human
caucaacugaau

SEQ ID NO: 2440247 - RNA, 14 nt, Human
caucaacaucuugg

SEQ ID NO: 2440248 - RNA, 14 nt, Human
cauauuuaaagaca

SEQ ID NO: 2440249 - RNA, 19 nt, Human
cauauuguuacugguacca

SEQ ID NO: 2440250 - RNA, 22 nt, Human
cauauugugccaauauguauug

SEQ ID NO: 2440251 - RNA, 21 nt, Human
cauauugugccaauauguauu

SEQ ID NO: 2440252 - RNA, 18 nt, Human
cauauuguggcacaagca

SEQ ID NO: 2440253 - RNA, 17 nt, Human
cauauuguggcacaagc

SEQ ID NO: 2440254 - RNA, 14 nt, Human
cauauuguguguaa

SEQ ID NO: 2440255 - RNA, 13 nt, Human
cauauuguuacug

SEQ ID NO: 2440256 - RNA, 22 nt, Human
cauauuuguauaguugcuugcc

SEQ ID NO: 2440257 - RNA, 18 nt, Human
cauauuuguauaguugcu

SEQ ID NO: 2440258 - RNA, 14 nt, Human
cauauuuguggaau

SEQ ID NO: 2440259 - RNA, 14 nt, Human
cauauuuguuaaau

SEQ ID NO: 2440260 - RNA, 19 nt, Human
cauauuuguuaaauauuua

SEQ ID NO: 2440261 - RNA, 20 nt, Human
cauauuuguuaaauauuuac

SEQ ID NO: 2440262 - RNA, 19 nt, Human
cauauuugcauauguauga

SEQ ID NO: 2440263 - RNA, 15 nt, Human
cauauuugcauaugu

SEQ ID NO: 2440264 - RNA, 17 nt, Human
cauauuugcauauguau

SEQ ID NO: 2440265 - RNA, 13 nt, Human
cauauuguugaaa

SEQ ID NO: 2440266 - RNA, 16 nt, Human
cauauuguugaaaggu

SEQ ID NO: 2440267 - RNA, 14 nt, Human
cauauuguuauuau

SEQ ID NO: 2440268 - RNA, 21 nt, Human
cauauugagcacuugcuguau

SEQ ID NO: 2440269 - RNA, 16 nt, Human
cauauugaauguuucc

SEQ ID NO: 2440270 - RNA, 16 nt, Human
cauaugaccucaugca

SEQ ID NO: 2440271 - RNA, 22 nt, Human
cauaugacauucaugccuggcu

SEQ ID NO: 2440272 - RNA, 17 nt, Human
cauauugauuuccguua

SEQ ID NO: 2440273 - RNA, 21 nt, Human
cauaugacauucaugccuggc

SEQ ID NO: 2440274 - RNA, 19 nt, Human
cauaugacauucaugccug

SEQ ID NO: 2440275 - RNA, 17 nt, Human
cauaugaaauuuaauau

SEQ ID NO: 2440276 - RNA, 22 nt, Human
cauauucuguuggccaguguga

SEQ ID NO: 2440277 - RNA, 20 nt, Human
cauaucugccuuuauugugu

SEQ ID NO: 2440278 - RNA, 14 nt, Human
cauaucuuuauuaa

SEQ ID NO: 2440279 - RNA, 15 nt, Human
cauaucuuuauuaau

SEQ ID NO: 2440280 - RNA, 16 nt, Human
cauaucuuuauuaauc

SEQ ID NO: 2440281 - RNA, 22 nt, Human
cauaugaaaaaaaugcauuuua

SEQ ID NO: 2440282 - RNA, 11 nt, Human
cauaugaaaaa

SEQ ID NO: 2440283 - RNA, 17 nt, Human
cauaucuuuauuaauca

SEQ ID NO: 2440284 - RNA, 18 nt, Human
cauaugaaaauacaacuu

SEQ ID NO: 2440285 - RNA, 18 nt, Human
cauaucugccuuuauugu

SEQ ID NO: 2440286 - RNA, 15 nt, Human
cauaucugccuuuau

SEQ ID NO: 2440287 - RNA, 13 nt, Human
cauaucugccuuu

SEQ ID NO: 2440288 - RNA, 12 nt, Human
cauaucugccuu

SEQ ID NO: 2440289 - RNA, 11 nt, Human
cauaucugccu

SEQ ID NO: 2440290 - RNA, 22 nt, Human
cauauugcacaugucuuaauga

SEQ ID NO: 2440291 - RNA, 23 nt, Human
cauauugcacaugucuuaaugaa

SEQ ID NO: 2440292 - RNA, 21 nt, Human
cauauugcacaugucuuaaug

SEQ ID NO: 2440293 - RNA, 20 nt, Human
cauauugcacaugucuuaau

SEQ ID NO: 2440294 - RNA, 19 nt, Human
cauauugcacaugucuuaa

SEQ ID NO: 2440295 - RNA, 18 nt, Human
cauauugcacaugucuua

SEQ ID NO: 2440296 - RNA, 17 nt, Human
cauauugcacaugucuu

SEQ ID NO: 2440297 - RNA, 16 nt, Human
cauauugcacaugucu

SEQ ID NO: 2440298 - RNA, 15 nt, Human
cauauugcacauguc

SEQ ID NO: 2440299 - RNA, 14 nt, Human
cauauugcacaugu

SEQ ID NO: 2440300 - RNA, 21 nt, Human
cauauugauuuccguuaaaau

SEQ ID NO: 2440301 - RNA, 16 nt, Human
cauauugcugagagaa

SEQ ID NO: 2440302 - RNA, 19 nt, Human
cauauugcuuuuucuaaug

SEQ ID NO: 2440303 - RNA, 17 nt, Human
cauauugcugagagaaa

SEQ ID NO: 2440304 - RNA, 21 nt, Human
cauauugcugagagaaauaug

SEQ ID NO: 2440305 - RNA, 16 nt, Human
cauauugguauucacu

SEQ ID NO: 2440306 - RNA, 14 nt, Human
cauauugguauuca

SEQ ID NO: 2440307 - RNA, 23 nt, Human
cauauugcugagagaaauaugga

SEQ ID NO: 2440308 - RNA, 23 nt, Human
cauauuguacacuuuuuugggga

SEQ ID NO: 2440309 - RNA, 20 nt, Human
cauauuguacacuuuuuugg

SEQ ID NO: 2440310 - RNA, 18 nt, Human
cauauugugauucugccu

SEQ ID NO: 2440311 - RNA, 20 nt, Human
cauauugugccaauauguau

SEQ ID NO: 2440312 - RNA, 13 nt, Human
cauauugugccaa

SEQ ID NO: 2440313 - RNA, 20 nt, Human
cauauugugauucugccuuu

SEQ ID NO: 2440314 - RNA, 15 nt, Human
cauauuguacacuuu

SEQ ID NO: 2440315 - RNA, 14 nt, Human
cauauuguacacuu

SEQ ID NO: 2440316 - RNA, 13 nt, Human
cauauuguacacu

SEQ ID NO: 2440317 - RNA, 12 nt, Human
cauauuguacac

SEQ ID NO: 2440318 - RNA, 11 nt, Human
cauauuguaca

SEQ ID NO: 2440319 - RNA, 20 nt, Human
cauauaacuuauauuguaag

SEQ ID NO: 2440320 - RNA, 22 nt, Human
cauauaacuuauauuguaagaa

SEQ ID NO: 2440321 - RNA, 23 nt, Human
cauauaacuuauauuguaagaaa

SEQ ID NO: 2440322 - RNA, 22 nt, Human
cauagugaccggcugcuuuucc

SEQ ID NO: 2440323 - RNA, 18 nt, Human
cauagugaccggcugcuu

SEQ ID NO: 2440324 - RNA, 19 nt, Human
cauagugaugguuccccug

SEQ ID NO: 2440325 - RNA, 18 nt, Human
cauagugaugguuccccu

SEQ ID NO: 2440326 - RNA, 13 nt, Human
cauauauaacaau

SEQ ID NO: 2440327 - RNA, 14 nt, Human
cauauaaguuugaa

SEQ ID NO: 2440328 - RNA, 16 nt, Human
cauauaagugauugcu

SEQ ID NO: 2440329 - RNA, 23 nt, Human
cauauaagauucauauuuacuuc

SEQ ID NO: 2440330 - RNA, 17 nt, Human
cauauaugaggacuugu

SEQ ID NO: 2440331 - RNA, 22 nt, Human
cauauauggggggccaacacca

SEQ ID NO: 2440332 - RNA, 21 nt, Human
cauauauggggggccaacacc

SEQ ID NO: 2440333 - RNA, 15 nt, Human
cauauauaacaaugc

SEQ ID NO: 2440334 - RNA, 23 nt, Human
cauauauauguuuuaagaggcag

SEQ ID NO: 2440335 - RNA, 15 nt, Human
cauauccugccucag

SEQ ID NO: 2440336 - RNA, 14 nt, Human
cauauccugccuca

SEQ ID NO: 2440337 - RNA, 13 nt, Human
cauauccugccuc

SEQ ID NO: 2440338 - RNA, 12 nt, Human
cauauccugccu

SEQ ID NO: 2440339 - RNA, 11 nt, Human
cauauccugcc

SEQ ID NO: 2440340 - RNA, 20 nt, Human
cauaguaguaugaugauaca

SEQ ID NO: 2440341 - RNA, 18 nt, Human
cauaguauuccauugugu

SEQ ID NO: 2440342 - RNA, 13 nt, Human
cauagucacaugg

SEQ ID NO: 2440343 - RNA, 22 nt, Human
cauaguaccauuuauacaaauu

SEQ ID NO: 2440344 - RNA, 21 nt, Human
cauaguauuccauugugugag

SEQ ID NO: 2440345 - RNA, 23 nt, Human
cauagucauguaagcugaaaaua

SEQ ID NO: 2440346 - RNA, 17 nt, Human
cauaguaugguggcugg

SEQ ID NO: 2440347 - RNA, 16 nt, Human
cauaguaugguggcug

SEQ ID NO: 2440348 - RNA, 18 nt, Human
cauaguaccaaucauuuu

SEQ ID NO: 2440349 - RNA, 16 nt, Human
cauaguaccaaucauu

SEQ ID NO: 2440350 - RNA, 23 nt, Human
cauaguaacuucuuauggaauug

SEQ ID NO: 2440351 - RNA, 24 nt, Human
cauaguaacuucuuauggaauuga

SEQ ID NO: 2440352 - RNA, 21 nt, Human
cauaguaacuucuuauggaau

SEQ ID NO: 2440353 - RNA, 22 nt, Human
cauaguaacuucuuauggaauu

SEQ ID NO: 2440354 - RNA, 15 nt, Human
cauaguaugguggcu

SEQ ID NO: 2440355 - RNA, 22 nt, Human
cauaguaccaaucauuuuaauu

SEQ ID NO: 2440356 - RNA, 16 nt, Human
cauaguaccauuuaua

SEQ ID NO: 2440357 - RNA, 19 nt, Human
cauaguaccauuuauacaa

SEQ ID NO: 2440358 - RNA, 20 nt, Human
cauaguaccauuuauacaaa

SEQ ID NO: 2440359 - RNA, 21 nt, Human
cauaguacucuuuguagcaaa

SEQ ID NO: 2440360 - RNA, 19 nt, Human
cagugcugucugaucugug

SEQ ID NO: 2440361 - RNA, 15 nt, Human
cagugcuguacuuga

SEQ ID NO: 2440362 - RNA, 22 nt, Human
cagugcugucugaucugugcuu

SEQ ID NO: 2440363 - RNA, 12 nt, Human
cagugcuguggc

SEQ ID NO: 2440364 - RNA, 13 nt, Human
cagugcuguggcc

SEQ ID NO: 2440365 - RNA, 15 nt, Human
cagugcuguggccug

SEQ ID NO: 2440366 - RNA, 18 nt, Human
cagugcuguggccugggc

SEQ ID NO: 2440367 - RNA, 20 nt, Human
cagugcuguggccugggcaa

SEQ ID NO: 2440368 - RNA, 19 nt, Human
cagugcuguggccugggca

SEQ ID NO: 2440369 - RNA, 14 nt, Human
cagugcuucagccu

SEQ ID NO: 2440370 - RNA, 15 nt, Human
cagugcuucagccug

SEQ ID NO: 2440371 - RNA, 16 nt, Human
cagugcuucagccuga

SEQ ID NO: 2440372 - RNA, 17 nt, Human
cagugcuucagccugag

SEQ ID NO: 2440373 - RNA, 18 nt, Human
cagugcuucagccugagg

SEQ ID NO: 2440374 - RNA, 19 nt, Human
cagugcuucagccugaggc

SEQ ID NO: 2440375 - RNA, 20 nt, Human
cagugcuucagccugaggcu

SEQ ID NO: 2440376 - RNA, 18 nt, Human
cagugcuugccacagagc

SEQ ID NO: 2440377 - RNA, 17 nt, Human
cagugcuugccacagag

SEQ ID NO: 2440378 - RNA, 15 nt, Human
cagugcuugccacag

SEQ ID NO: 2440379 - RNA, 12 nt, Human
cagugcuucuca

SEQ ID NO: 2440380 - RNA, 17 nt, Human
cagugcuucucuacaga

SEQ ID NO: 2440381 - RNA, 14 nt, Human
cagugcuugccaca

SEQ ID NO: 2440382 - RNA, 20 nt, Human
cagugcuugaguuuggggaa

SEQ ID NO: 2440383 - RNA, 19 nt, Human
cagugcuugauugcgugga

SEQ ID NO: 2440384 - RNA, 13 nt, Human
caucuuuccuguc

SEQ ID NO: 2440385 - RNA, 19 nt, Human
caucuuuccugauggcagg

SEQ ID NO: 2440386 - RNA, 16 nt, Human
caucuuuaucuguucu

SEQ ID NO: 2440387 - RNA, 22 nt, Human
caucuucuuugcagccugggug

SEQ ID NO: 2440388 - RNA, 22 nt, Human
caucuuuacaaaacuacaugag

SEQ ID NO: 2440389 - RNA, 17 nt, Human
caucuuuaucuguucuu

SEQ ID NO: 2440390 - RNA, 12 nt, Human
caucuuucacau

SEQ ID NO: 2440391 - RNA, 22 nt, Human
caucuuucaucaaucauuguac

SEQ ID NO: 2440392 - RNA, 21 nt, Human
caucuuucaucaaucauugua

SEQ ID NO: 2440393 - RNA, 13 nt, Human
caucuuucacauu

SEQ ID NO: 2440394 - RNA, 17 nt, Human
caucuuucaucaaucau

SEQ ID NO: 2440395 - RNA, 14 nt, Human
caucuuucacacuu

SEQ ID NO: 2440396 - RNA, 17 nt, Human
caucuuugcagguugcu

SEQ ID NO: 2440397 - RNA, 15 nt, Human
caucuuugccuuggg

SEQ ID NO: 2440398 - RNA, 17 nt, Human
caucuuugccuugggcu

SEQ ID NO: 2440399 - RNA, 23 nt, Human
caucuuugccuugggcugcuccu

SEQ ID NO: 2440400 - RNA, 22 nt, Human
caucuuugccuugggcugcucc

SEQ ID NO: 2440401 - RNA, 16 nt, Human
caucuuucuucuauuu

SEQ ID NO: 2440402 - RNA, 21 nt, Human
caucuuucuucuauuuuauuc

SEQ ID NO: 2440403 - RNA, 21 nt, Human
caucuuuccugauggcaggau

SEQ ID NO: 2440404 - RNA, 14 nt, Human
caugaaaacacauu

SEQ ID NO: 2440405 - RNA, 15 nt, Human
caugaaaacacauuu

SEQ ID NO: 2440406 - RNA, 16 nt, Human
caugaaaacacauuuu

SEQ ID NO: 2440407 - RNA, 17 nt, Human
caugaaaacacauuuuu

SEQ ID NO: 2440408 - RNA, 13 nt, Human
caugaaaacacau

SEQ ID NO: 2440409 - RNA, 16 nt, Human
caucuuuugugagaug

SEQ ID NO: 2440410 - RNA, 21 nt, Human
caucuuuugugagauguaauu

SEQ ID NO: 2440411 - RNA, 14 nt, Human
caucuuuugugaga

SEQ ID NO: 2440412 - RNA, 21 nt, Human
caucuuuucuugccucugucc

SEQ ID NO: 2440413 - RNA, 16 nt, Human
caucuuuucuugccuc

SEQ ID NO: 2440414 - RNA, 14 nt, Human
caucuuuucuugcc

SEQ ID NO: 2440415 - RNA, 13 nt, Human
caucuuuuacauu

SEQ ID NO: 2440416 - RNA, 15 nt, Human
caugaaauaugcauc

SEQ ID NO: 2440417 - RNA, 14 nt, Human
caugaaauaugcau

SEQ ID NO: 2440418 - RNA, 13 nt, Human
caugaaauaugca

SEQ ID NO: 2440419 - RNA, 15 nt, Human
caugaacauguacug

SEQ ID NO: 2440420 - RNA, 13 nt, Human
caugaacauguac

SEQ ID NO: 2440421 - RNA, 19 nt, Human
caugaaccucaagcugcau

SEQ ID NO: 2440422 - RNA, 23 nt, Human
caugaacagaaaacauucugauu

SEQ ID NO: 2440423 - RNA, 22 nt, Human
caugaacagaaaacauucugau

SEQ ID NO: 2440424 - RNA, 20 nt, Human
caugaacacacuguguccug

SEQ ID NO: 2440425 - RNA, 18 nt, Human
caugaacacacugugucc

SEQ ID NO: 2440426 - RNA, 17 nt, Human
caugaacacacuguguc

SEQ ID NO: 2440427 - RNA, 16 nt, Human
caugaacacacugugu

SEQ ID NO: 2440428 - RNA, 14 nt, Human
caugaaauuacuua

SEQ ID NO: 2440429 - RNA, 24 nt, Human
caugaaauugucuagcagagcagg

SEQ ID NO: 2440430 - RNA, 23 nt, Human
caugaacuucgcaucaaaagaca

SEQ ID NO: 2440431 - RNA, 21 nt, Human
caugaacuucgcaucaaaaga

SEQ ID NO: 2440432 - RNA, 16 nt, Human
caugaacauguuccug

SEQ ID NO: 2440433 - RNA, 20 nt, Human
caugaaccucaagcugcauc

SEQ ID NO: 2440434 - RNA, 12 nt, Human
caugaagacaga

SEQ ID NO: 2440435 - RNA, 13 nt, Human
caugaagaccaca

SEQ ID NO: 2440436 - RNA, 14 nt, Human
caugaagacaggau

SEQ ID NO: 2440437 - RNA, 17 nt, Human
caugaagaccacaucca

SEQ ID NO: 2440438 - RNA, 14 nt, Human
caugaagacaggac

SEQ ID NO: 2440439 - RNA, 15 nt, Human
caugaagacaggaca

SEQ ID NO: 2440440 - RNA, 16 nt, Human
caugaagacaggacag

SEQ ID NO: 2440441 - RNA, 17 nt, Human
caugaagacaggacagu

SEQ ID NO: 2440442 - RNA, 19 nt, Human
caugaaaacacauuuuucu

SEQ ID NO: 2440443 - RNA, 21 nt, Human
caugaaaacacauuuuucuua

SEQ ID NO: 2440444 - RNA, 21 nt, Human
caugaaaacguuuuauugugu

SEQ ID NO: 2440445 - RNA, 22 nt, Human
caugaaaacguuuuauuguguu

SEQ ID NO: 2440446 - RNA, 23 nt, Human
caugaaaaagcagcuaccaggug

SEQ ID NO: 2440447 - RNA, 16 nt, Human
caugaaaacguuuuau

SEQ ID NO: 2440448 - RNA, 17 nt, Human
caugaaaacguuuuauu

SEQ ID NO: 2440449 - RNA, 19 nt, Human
caugaaaacguuuuauugu

SEQ ID NO: 2440450 - RNA, 18 nt, Human
caugaaaaaaggacaauu

SEQ ID NO: 2440451 - RNA, 12 nt, Human
caugaaaaagca

SEQ ID NO: 2440452 - RNA, 13 nt, Human
caugaaaaagcag

SEQ ID NO: 2440453 - RNA, 15 nt, Human
caugaaaaagcagcu

SEQ ID NO: 2440454 - RNA, 18 nt, Human
caugaaaaagcagcuacc

SEQ ID NO: 2440455 - RNA, 19 nt, Human
caugaaaaagcagcuacca

SEQ ID NO: 2440456 - RNA, 13 nt, Human
caugaaaacguuu

SEQ ID NO: 2440457 - RNA, 22 nt, Human
caugaaauauagaucaguuaua

SEQ ID NO: 2440458 - RNA, 15 nt, Human
caugaaacuccaccu

SEQ ID NO: 2440459 - RNA, 14 nt, Human
caugaaacuccacc

SEQ ID NO: 2440460 - RNA, 19 nt, Human
caugaaacagaaacaaaaa

SEQ ID NO: 2440461 - RNA, 22 nt, Human
caugaaaccuuauuuuuuccca

SEQ ID NO: 2440462 - RNA, 13 nt, Human
caugaaacagaaa

SEQ ID NO: 2440463 - RNA, 15 nt, Human
caugaaacagaaaca

SEQ ID NO: 2440464 - RNA, 13 nt, Human
caugaaacaaagc

SEQ ID NO: 2440465 - RNA, 22 nt, Human
caugaaaaugcaacaacaugua

SEQ ID NO: 2440466 - RNA, 15 nt, Human
caugaaaaugcaaca

SEQ ID NO: 2440467 - RNA, 13 nt, Human
caugaaaaugcaa

SEQ ID NO: 2440468 - RNA, 23 nt, Human
caugagcaucaggccaggcccuc

SEQ ID NO: 2440469 - RNA, 22 nt, Human
caugagcaucaggccaggcccu

SEQ ID NO: 2440470 - RNA, 21 nt, Human
caugagcaucaggccaggccc

SEQ ID NO: 2440471 - RNA, 20 nt, Human
caugagcaucaggccaggcc

SEQ ID NO: 2440472 - RNA, 18 nt, Human
caugagcaucaggccagg

SEQ ID NO: 2440473 - RNA, 17 nt, Human
caugagcaucaggccag

SEQ ID NO: 2440474 - RNA, 16 nt, Human
caugagcaucaggcca

SEQ ID NO: 2440475 - RNA, 15 nt, Human
caugagcaucaggcc

SEQ ID NO: 2440476 - RNA, 21 nt, Human
caugagccucagcauccuggc

SEQ ID NO: 2440477 - RNA, 20 nt, Human
caugagccucagcauccugg

SEQ ID NO: 2440478 - RNA, 19 nt, Human
caugagccucagcauccug

SEQ ID NO: 2440479 - RNA, 18 nt, Human
caugagccucagcauccu

SEQ ID NO: 2440480 - RNA, 17 nt, Human
caugagccucagcaucc

SEQ ID NO: 2440481 - RNA, 15 nt, Human
caugagccucagcau

SEQ ID NO: 2440482 - RNA, 21 nt, Human
caugagcaccccaaggcugcg

SEQ ID NO: 2440483 - RNA, 16 nt, Human
caugagcaccccaagg

SEQ ID NO: 2440484 - RNA, 12 nt, Human
caugagccucag

SEQ ID NO: 2440485 - RNA, 19 nt, Human
caugagaccacuguuauca

SEQ ID NO: 2440486 - RNA, 17 nt, Human
caugagaccacuguuau

SEQ ID NO: 2440487 - RNA, 18 nt, Human
caugagauaauaugcaga

SEQ ID NO: 2440488 - RNA, 17 nt, Human
caugagaggcucugugc

SEQ ID NO: 2440489 - RNA, 23 nt, Human
caugagagaauuguaucauuuga

SEQ ID NO: 2440490 - RNA, 13 nt, Human
caugagcaucagg

SEQ ID NO: 2440491 - RNA, 16 nt, Human
caugagcaauucuccu

SEQ ID NO: 2440492 - RNA, 22 nt, Human
caugagaugauacauccaaagc

SEQ ID NO: 2440493 - RNA, 20 nt, Human
caugagaucuaggugaggau

SEQ ID NO: 2440494 - RNA, 18 nt, Human
caugagaagagggccugu

SEQ ID NO: 2440495 - RNA, 17 nt, Human
caugagaagagggccug

SEQ ID NO: 2440496 - RNA, 16 nt, Human
caugagaagagggccu

SEQ ID NO: 2440497 - RNA, 15 nt, Human
caugagaagagggcc

SEQ ID NO: 2440498 - RNA, 22 nt, Human
caugagaaguugauauagaaca

SEQ ID NO: 2440499 - RNA, 22 nt, Human
caugagaagagggccuguggga

SEQ ID NO: 2440500 - RNA, 12 nt, Human
caugagaaucua

SEQ ID NO: 2440501 - RNA, 19 nt, Human
caugagaaucuauauuuaa

SEQ ID NO: 2440502 - RNA, 20 nt, Human
caugagaauaagagaaagaa

SEQ ID NO: 2440503 - RNA, 14 nt, Human
caugagacacaucu

SEQ ID NO: 2440504 - RNA, 19 nt, Human
caugagacacaucuccucc

SEQ ID NO: 2440505 - RNA, 21 nt, Human
caugacuuuuccauguaucua

SEQ ID NO: 2440506 - RNA, 16 nt, Human
caugagaacaaacaga

SEQ ID NO: 2440507 - RNA, 14 nt, Human
caugagaagagggc

SEQ ID NO: 2440508 - RNA, 15 nt, Human
caugacuuuuccaug

SEQ ID NO: 2440509 - RNA, 22 nt, Human
caugacuugagaaacaaauaau

SEQ ID NO: 2440510 - RNA, 17 nt, Human
caugacucggggguggg

SEQ ID NO: 2440511 - RNA, 20 nt, Human
caugacucguauaugucuca

SEQ ID NO: 2440512 - RNA, 23 nt, Human
caugacucguauaugucucaggu

SEQ ID NO: 2440513 - RNA, 19 nt, Human
caugaccuaguuuuccaug

SEQ ID NO: 2440514 - RNA, 14 nt, Human
caugaccugugacc

SEQ ID NO: 2440515 - RNA, 16 nt, Human
caugaccugugaccag

SEQ ID NO: 2440516 - RNA, 21 nt, Human
caugaccuuacauuuccuggg

SEQ ID NO: 2440517 - RNA, 17 nt, Human
caugaccugugaccagc

SEQ ID NO: 2440518 - RNA, 18 nt, Human
caugaccugugaccagca

SEQ ID NO: 2440519 - RNA, 19 nt, Human
caugaagauguagaggaga

SEQ ID NO: 2440520 - RNA, 17 nt, Human
caugaagauauuuuucc

SEQ ID NO: 2440521 - RNA, 18 nt, Human
caugaagauucuuuccca

SEQ ID NO: 2440522 - RNA, 18 nt, Human
caugaagauguagaggag

SEQ ID NO: 2440523 - RNA, 18 nt, Human
caugaagagauuuuucau

SEQ ID NO: 2440524 - RNA, 22 nt, Human
caugaggccacugcugcuucuc

SEQ ID NO: 2440525 - RNA, 21 nt, Human
caugaggccucaguggacuuu

SEQ ID NO: 2440526 - RNA, 24 nt, Human
caugaggcaaugucaggaacagaa

SEQ ID NO: 2440527 - RNA, 16 nt, Human
caugaggccacugcug

SEQ ID NO: 2440528 - RNA, 16 nt, Human
caugaggaguugcugu

SEQ ID NO: 2440529 - RNA, 15 nt, Human
caugaggaguugcug

SEQ ID NO: 2440530 - RNA, 22 nt, Human
caugaggcaaugucaggaacag

SEQ ID NO: 2440531 - RNA, 23 nt, Human
caugaggcaaugucaggaacaga

SEQ ID NO: 2440532 - RNA, 16 nt, Human
caugagguacugagag

SEQ ID NO: 2440533 - RNA, 17 nt, Human
caugagggaucacaggg

SEQ ID NO: 2440534 - RNA, 18 nt, Human
caugagggaucacagggc

SEQ ID NO: 2440535 - RNA, 16 nt, Human
caugaggggcccgagc

SEQ ID NO: 2440536 - RNA, 19 nt, Human
caugagggaucacagggcc

SEQ ID NO: 2440537 - RNA, 20 nt, Human
caugagggaucacagggccc

SEQ ID NO: 2440538 - RNA, 12 nt, Human
caugaggaacua

SEQ ID NO: 2440539 - RNA, 14 nt, Human
caugagcuuuuaua

SEQ ID NO: 2440540 - RNA, 23 nt, Human
caugaggaacaaggcaaggcugu

SEQ ID NO: 2440541 - RNA, 20 nt, Human
caugaggacaugauggagcg

SEQ ID NO: 2440542 - RNA, 21 nt, Human
caugaggacaugauggagcgc

SEQ ID NO: 2440543 - RNA, 22 nt, Human
caugaggacaugauggagcgca

SEQ ID NO: 2440544 - RNA, 21 nt, Human
caugaggaacaaggcaaggcu

SEQ ID NO: 2440545 - RNA, 20 nt, Human
caugaggaacaaggcaaggc

SEQ ID NO: 2440546 - RNA, 17 nt, Human
caugaggaacaaggcaa

SEQ ID NO: 2440547 - RNA, 16 nt, Human
caugaggaacaaggca

SEQ ID NO: 2440548 - RNA, 23 nt, Human
caugagccucagcauccuggcac

SEQ ID NO: 2440549 - RNA, 22 nt, Human
caugagccucagcauccuggca

SEQ ID NO: 2440550 - RNA, 23 nt, Human
caugagcuauuuccauuccagaa

SEQ ID NO: 2440551 - RNA, 22 nt, Human
caugagcuauuuccauuccaga

SEQ ID NO: 2440552 - RNA, 16 nt, Human
caugagcuauuuccau

SEQ ID NO: 2440553 - RNA, 20 nt, Human
caugagcuacgccugccucc

SEQ ID NO: 2440554 - RNA, 19 nt, Human
caugagcuacgccugccuc

SEQ ID NO: 2440555 - RNA, 13 nt, Human
caugagcuccaga

SEQ ID NO: 2440556 - RNA, 14 nt, Human
caugagcuccagac

SEQ ID NO: 2440557 - RNA, 15 nt, Human
caugagcuccagacc

SEQ ID NO: 2440558 - RNA, 16 nt, Human
caugagcuccagaccc

SEQ ID NO: 2440559 - RNA, 17 nt, Human
caugagcuccagacccc

SEQ ID NO: 2440560 - RNA, 19 nt, Human
caugagcuccagaccccca

SEQ ID NO: 2440561 - RNA, 21 nt, Human
caugagcuccagacccccagc

SEQ ID NO: 2440562 - RNA, 23 nt, Human
caugagcuccagacccccagcaa

SEQ ID NO: 2440563 - RNA, 15 nt, Human
caugaguccccuguu

SEQ ID NO: 2440564 - RNA, 14 nt, Human
caugaguccccugu

SEQ ID NO: 2440565 - RNA, 20 nt, Human
caugaguccuugaaaauauu

SEQ ID NO: 2440566 - RNA, 19 nt, Human
caugaguccuugaaaauau

SEQ ID NO: 2440567 - RNA, 18 nt, Human
caugaguccuugaaaaua

SEQ ID NO: 2440568 - RNA, 17 nt, Human
caugaguccuugaaaau

SEQ ID NO: 2440569 - RNA, 14 nt, Human
caugagugcgugcu

SEQ ID NO: 2440570 - RNA, 21 nt, Human
caugaguccuugaaaauauuu

SEQ ID NO: 2440571 - RNA, 14 nt, Human
caugagugaauaaa

SEQ ID NO: 2440572 - RNA, 23 nt, Human
caugaguccccuguuuguuucug

SEQ ID NO: 2440573 - RNA, 19 nt, Human
caugagucccagugggagg

SEQ ID NO: 2440574 - RNA, 18 nt, Human
caugagucccagugggag

SEQ ID NO: 2440575 - RNA, 17 nt, Human
caugagucccaguggga

SEQ ID NO: 2440576 - RNA, 16 nt, Human
caugagucccaguggg

SEQ ID NO: 2440577 - RNA, 15 nt, Human
caugagucccagugg

SEQ ID NO: 2440578 - RNA, 14 nt, Human
caugagucccagug

SEQ ID NO: 2440579 - RNA, 12 nt, Human
caugagucccag

SEQ ID NO: 2440580 - RNA, 13 nt, Human
caugaguccccug

SEQ ID NO: 2440581 - RNA, 19 nt, Human
caugagguacugagaguga

SEQ ID NO: 2440582 - RNA, 20 nt, Human
caugaggggcccgagcagaa

SEQ ID NO: 2440583 - RNA, 22 nt, Human
caugaucccuguguugucucua

SEQ ID NO: 2440584 - RNA, 21 nt, Human
caugaucccuguguugucucu

SEQ ID NO: 2440585 - RNA, 15 nt, Human
caugaucucccugcc

SEQ ID NO: 2440586 - RNA, 13 nt, Human
caugaucucccug

SEQ ID NO: 2440587 - RNA, 16 nt, Human
caugaucucccugccg

SEQ ID NO: 2440588 - RNA, 17 nt, Human
caugaucucccugccgc

SEQ ID NO: 2440589 - RNA, 18 nt, Human
caugaucucccugccgcc

SEQ ID NO: 2440590 - RNA, 19 nt, Human
caugaucucccugccgccu

SEQ ID NO: 2440591 - RNA, 15 nt, Human
caugaucuugagcaa

SEQ ID NO: 2440592 - RNA, 15 nt, Human
caugaucucggcuua

SEQ ID NO: 2440593 - RNA, 20 nt, Human
caugaucucccugccgccuc

SEQ ID NO: 2440594 - RNA, 21 nt, Human
caugaucucccugccgccuca

SEQ ID NO: 2440595 - RNA, 18 nt, Human
caugaugagcuccucuuc

SEQ ID NO: 2440596 - RNA, 19 nt, Human
caugaugagcuccucuucc

SEQ ID NO: 2440597 - RNA, 15 nt, Human
caugaugagcuccuc

SEQ ID NO: 2440598 - RNA, 21 nt, Human
caugaucuugugacauauuau

SEQ ID NO: 2440599 - RNA, 15 nt, Human
caugcacucagcucu

SEQ ID NO: 2440600 - RNA, 16 nt, Human
caugcacucagcucuu

SEQ ID NO: 2440601 - RNA, 18 nt, Human
caugagugcgugcucagu

SEQ ID NO: 2440602 - RNA, 21 nt, Human
caugaguuggggucuggcagc

SEQ ID NO: 2440603 - RNA, 23 nt, Human
caugaguuggggucuggcagccu

SEQ ID NO: 2440604 - RNA, 19 nt, Human
caugaguuggcugggaaua

SEQ ID NO: 2440605 - RNA, 15 nt, Human
caugaguuugcccug

SEQ ID NO: 2440606 - RNA, 16 nt, Human
caugaguuugcccugg

SEQ ID NO: 2440607 - RNA, 22 nt, Human
caugaguuugcccugguuucac

SEQ ID NO: 2440608 - RNA, 19 nt, Human
caugaguuuuuucucuugg

SEQ ID NO: 2440609 - RNA, 22 nt, Human
caugaguuuuuucucuugggcu

SEQ ID NO: 2440610 - RNA, 14 nt, Human
caugauaugucagg

SEQ ID NO: 2440611 - RNA, 21 nt, Human
caucuugaauuguaaggaaug

SEQ ID NO: 2440612 - RNA, 16 nt, Human
caucuugaauuguaag

SEQ ID NO: 2440613 - RNA, 21 nt, Human
caucuucuuugcagccugggu

SEQ ID NO: 2440614 - RNA, 22 nt, Human
caucuucuggagucuccagugg

SEQ ID NO: 2440615 - RNA, 19 nt, Human
caucuucuucaccauuugg

SEQ ID NO: 2440616 - RNA, 22 nt, Human
caucuucuuuuugaaaucagca

SEQ ID NO: 2440617 - RNA, 19 nt, Human
caucuucuggagucuccag

SEQ ID NO: 2440618 - RNA, 13 nt, Human
caucuucuggagu

SEQ ID NO: 2440619 - RNA, 14 nt, Human
caucuucuucacca

SEQ ID NO: 2440620 - RNA, 17 nt, Human
caucuucugccuuaguc

SEQ ID NO: 2440621 - RNA, 23 nt, Human
caucugcccaggggugcccccuc

SEQ ID NO: 2440622 - RNA, 17 nt, Human
caucuugcucugcugac

SEQ ID NO: 2440623 - RNA, 16 nt, Human
caucuugcucugcuga

SEQ ID NO: 2440624 - RNA, 15 nt, Human
caucuugcucugcug

SEQ ID NO: 2440625 - RNA, 15 nt, Human
caucuuguguuuuau

SEQ ID NO: 2440626 - RNA, 19 nt, Human
caucuugcucugcugacag

SEQ ID NO: 2440627 - RNA, 23 nt, Human
caucuuucuucuauuuuauuccc

SEQ ID NO: 2440628 - RNA, 15 nt, Human
cauccuaccaaugca

SEQ ID NO: 2440629 - RNA, 14 nt, Human
cauccuaccaaugc

SEQ ID NO: 2440630 - RNA, 17 nt, Human
cauccuacaagacacag

SEQ ID NO: 2440631 - RNA, 19 nt, Human
cauccuacaagacacagug

SEQ ID NO: 2440632 - RNA, 19 nt, Human
cauccuaccaaugcaugca

SEQ ID NO: 2440633 - RNA, 18 nt, Human
cauccuaccaaugcaugc

SEQ ID NO: 2440634 - RNA, 18 nt, Human
cauccuacaagacacagu

SEQ ID NO: 2440635 - RNA, 15 nt, Human
cauccgccagggccc

SEQ ID NO: 2440636 - RNA, 14 nt, Human
cauccgccagggcc

SEQ ID NO: 2440637 - RNA, 15 nt, Human
cauccggcagccugg

SEQ ID NO: 2440638 - RNA, 16 nt, Human
cauccggcagccugga

SEQ ID NO: 2440639 - RNA, 16 nt, Human
caucuccugccuuccu

SEQ ID NO: 2440640 - RNA, 20 nt, Human
caucuccuccauacucagga

SEQ ID NO: 2440641 - RNA, 15 nt, Human
caucucccucccaca

SEQ ID NO: 2440642 - RNA, 20 nt, Human
caucuccugugcauggguga

SEQ ID NO: 2440643 - RNA, 21 nt, Human
caucucgccaccccuccuucc

SEQ ID NO: 2440644 - RNA, 22 nt, Human
caucucgccaccccuccuuccu

SEQ ID NO: 2440645 - RNA, 19 nt, Human
caucuccugccuuccuccu

SEQ ID NO: 2440646 - RNA, 22 nt, Human
caucuccugccuuccuccuggg

SEQ ID NO: 2440647 - RNA, 13 nt, Human
caucuccugugca

SEQ ID NO: 2440648 - RNA, 15 nt, Human
caucuccugugcaug

SEQ ID NO: 2440649 - RNA, 19 nt, Human
caucuccugugcaugggug

SEQ ID NO: 2440650 - RNA, 16 nt, Human
caucucuaacagcuca

SEQ ID NO: 2440651 - RNA, 18 nt, Human
caucucuaacagcucagg

SEQ ID NO: 2440652 - RNA, 19 nt, Human
caucucuaacagcucagga

SEQ ID NO: 2440653 - RNA, 20 nt, Human
caucucuaacagcucaggau

SEQ ID NO: 2440654 - RNA, 21 nt, Human
caucucuaacagcucaggauc

SEQ ID NO: 2440655 - RNA, 16 nt, Human
caucucuacaaaaagc

SEQ ID NO: 2440656 - RNA, 17 nt, Human
caucugaccagcagcgc

SEQ ID NO: 2440657 - RNA, 19 nt, Human
caucugaccagcagcgccu

SEQ ID NO: 2440658 - RNA, 21 nt, Human
caucugaccagcagcgccuuu

SEQ ID NO: 2440659 - RNA, 14 nt, Human
caucugaccagcag

SEQ ID NO: 2440660 - RNA, 15 nt, Human
caucugaccagcagc

SEQ ID NO: 2440661 - RNA, 15 nt, Human
caucugaccacgugc

SEQ ID NO: 2440662 - RNA, 15 nt, Human
caucugaagagcaga

SEQ ID NO: 2440663 - RNA, 15 nt, Human
caucucuuugaauuu

SEQ ID NO: 2440664 - RNA, 13 nt, Human
caucucuuugaau

SEQ ID NO: 2440665 - RNA, 16 nt, Human
caucucuuguuuaaau

SEQ ID NO: 2440666 - RNA, 22 nt, Human
caucucuuugaauuuucugugu

SEQ ID NO: 2440667 - RNA, 19 nt, Human
caucucuuugaauuuucug

SEQ ID NO: 2440668 - RNA, 12 nt, Human
caucugaaagcc

SEQ ID NO: 2440669 - RNA, 13 nt, Human
caucugaaagcca

SEQ ID NO: 2440670 - RNA, 16 nt, Human
caucugaaagccacgu

SEQ ID NO: 2440671 - RNA, 14 nt, Human
caucugaaagccac

SEQ ID NO: 2440672 - RNA, 23 nt, Human
caucugcacccucgaugaagccc

SEQ ID NO: 2440673 - RNA, 18 nt, Human
caucugacucacaagaag

SEQ ID NO: 2440674 - RNA, 12 nt, Human
caucugacucac

SEQ ID NO: 2440675 - RNA, 19 nt, Human
caucugcauuuucacccca

SEQ ID NO: 2440676 - RNA, 22 nt, Human
caucugcccaggacggggccgg

SEQ ID NO: 2440677 - RNA, 14 nt, Human
caucugcccaggac

SEQ ID NO: 2440678 - RNA, 13 nt, Human
caucugcccagga

SEQ ID NO: 2440679 - RNA, 12 nt, Human
caucugcccagg

SEQ ID NO: 2440680 - RNA, 11 nt, Human
caucugcccag

SEQ ID NO: 2440681 - RNA, 16 nt, Human
caucugcacccucgau

SEQ ID NO: 2440682 - RNA, 20 nt, Human
caucugcauuuucaccccac

SEQ ID NO: 2440683 - RNA, 21 nt, Human
caucugcccaggggugccccc

SEQ ID NO: 2440684 - RNA, 16 nt, Human
caucugcccaggggug

SEQ ID NO: 2440685 - RNA, 15 nt, Human
caucugcccaggggu

SEQ ID NO: 2440686 - RNA, 13 nt, Human
caucugcccaggg

SEQ ID NO: 2440687 - RNA, 11 nt, Human
caucugccccu

SEQ ID NO: 2440688 - RNA, 13 nt, Human
caucugccccucc

SEQ ID NO: 2440689 - RNA, 14 nt, Human
caucugccccuccc

SEQ ID NO: 2440690 - RNA, 15 nt, Human
caucugccccucccc

SEQ ID NO: 2440691 - RNA, 16 nt, Human
caucugccccuccccc

SEQ ID NO: 2440692 - RNA, 17 nt, Human
caucugccccuccccca

SEQ ID NO: 2440693 - RNA, 15 nt, Human
caucucuccuccuuu

SEQ ID NO: 2440694 - RNA, 20 nt, Human
caucucucccuccccugcca

SEQ ID NO: 2440695 - RNA, 23 nt, Human
caucucucccuccccugccauuu

SEQ ID NO: 2440696 - RNA, 21 nt, Human
caucucucuacuccuaccuca

SEQ ID NO: 2440697 - RNA, 22 nt, Human
caucucucuacuccuaccucag

SEQ ID NO: 2440698 - RNA, 19 nt, Human
caucucuaauuggaagaaa

SEQ ID NO: 2440699 - RNA, 22 nt, Human
caucucuaacagcucaggaucu

SEQ ID NO: 2440700 - RNA, 23 nt, Human
caucucuaacagcucaggaucuc

SEQ ID NO: 2440701 - RNA, 15 nt, Human
caucucucagaaggg

SEQ ID NO: 2440702 - RNA, 18 nt, Human
caucucucagaagggagg

SEQ ID NO: 2440703 - RNA, 12 nt, Human
caucucucccuc

SEQ ID NO: 2440704 - RNA, 15 nt, Human
caucucucccucccc

SEQ ID NO: 2440705 - RNA, 16 nt, Human
caucucucccuccccu

SEQ ID NO: 2440706 - RNA, 16 nt, Human
caucucuggaugccug

SEQ ID NO: 2440707 - RNA, 14 nt, Human
caucucuggaugcc

SEQ ID NO: 2440708 - RNA, 13 nt, Human
caucucugcuugg

SEQ ID NO: 2440709 - RNA, 21 nt, Human
caucucugcuugagucagguu

SEQ ID NO: 2440710 - RNA, 13 nt, Human
caucucugcuuga

SEQ ID NO: 2440711 - RNA, 20 nt, Human
caucucugcuugagucaggu

SEQ ID NO: 2440712 - RNA, 12 nt, Human
caucucugcuug

SEQ ID NO: 2440713 - RNA, 22 nt, Human
caucucugcaaucuucucagaa

SEQ ID NO: 2440714 - RNA, 11 nt, Human
caucucugcac

SEQ ID NO: 2440715 - RNA, 15 nt, Human
caucucugcaaucuu

SEQ ID NO: 2440716 - RNA, 21 nt, Human
caucucucuggcccucuaccc

SEQ ID NO: 2440717 - RNA, 13 nt, Human
caucucucugccc

SEQ ID NO: 2440718 - RNA, 15 nt, Human
caucucucugcccaa

SEQ ID NO: 2440719 - RNA, 11 nt, Human
caucucucucc

SEQ ID NO: 2440720 - RNA, 23 nt, Human
caucucucuacuccuaccucagc

SEQ ID NO: 2440721 - RNA, 16 nt, Human
caucucucugcccaac

SEQ ID NO: 2440722 - RNA, 18 nt, Human
caucucucugcccaaccc

SEQ ID NO: 2440723 - RNA, 15 nt, Human
caucucucuggcccu

SEQ ID NO: 2440724 - RNA, 14 nt, Human
caucucucuggccc

SEQ ID NO: 2440725 - RNA, 14 nt, Human
caucucucuuuaau

SEQ ID NO: 2440726 - RNA, 22 nt, Human
cccaaauggaaaugggcagagc

SEQ ID NO: 2440727 - RNA, 18 nt, Human
cccaaauggaaaugggca

SEQ ID NO: 2440728 - RNA, 14 nt, Human
cccaaaugagccau

SEQ ID NO: 2440729 - RNA, 13 nt, Human
cccaacccugccc

SEQ ID NO: 2440730 - RNA, 14 nt, Human
cccaacccugcccc

SEQ ID NO: 2440731 - RNA, 15 nt, Human
cccaacccugccccu

SEQ ID NO: 2440732 - RNA, 15 nt, Human
cccaaauccgaaccu

SEQ ID NO: 2440733 - RNA, 18 nt, Human
cccaaauccgaaccuccu

SEQ ID NO: 2440734 - RNA, 23 nt, Human
cccaaauccgaaccuccucugug

SEQ ID NO: 2440735 - RNA, 16 nt, Human
cccaaaucaauacacu

SEQ ID NO: 2440736 - RNA, 14 nt, Human
cccaaaucaauaca

SEQ ID NO: 2440737 - RNA, 17 nt, Human
cccaaauaagaagggau

SEQ ID NO: 2440738 - RNA, 21 nt, Human
cccaaagugcuuccaaggcag

SEQ ID NO: 2440739 - RNA, 21 nt, Human
cccaaagugguauagaaaugc

SEQ ID NO: 2440740 - RNA, 16 nt, Human
cccaaagugcugggau

SEQ ID NO: 2440741 - RNA, 23 nt, Human
cccaaaggauacuguaacacuuu

SEQ ID NO: 2440742 - RNA, 16 nt, Human
cccaaagucuguguga

SEQ ID NO: 2440743 - RNA, 20 nt, Human
cccaaagugguauagaaaug

SEQ ID NO: 2440744 - RNA, 22 nt, Human
cccaaggaaagccccagcacua

SEQ ID NO: 2440745 - RNA, 16 nt, Human
cccaaccuccugaccu

SEQ ID NO: 2440746 - RNA, 21 nt, Human
cccaaggacugagggacucug

SEQ ID NO: 2440747 - RNA, 16 nt, Human
cccaaggacugaggga

SEQ ID NO: 2440748 - RNA, 15 nt, Human
cccaaggacugaggg

SEQ ID NO: 2440749 - RNA, 14 nt, Human
cccaaggaggaaaa

SEQ ID NO: 2440750 - RNA, 15 nt, Human
cccaaggaggaaaaa

SEQ ID NO: 2440751 - RNA, 15 nt, Human
cccaacccuggcacc

SEQ ID NO: 2440752 - RNA, 15 nt, Human
cccaacccuucccca

SEQ ID NO: 2440753 - RNA, 14 nt, Human
cccaacccugucug

SEQ ID NO: 2440754 - RNA, 16 nt, Human
cccaacccugccccug

SEQ ID NO: 2440755 - RNA, 17 nt, Human
cccaacccuucccucac

SEQ ID NO: 2440756 - RNA, 12 nt, Human
cccaaccucaga

SEQ ID NO: 2440757 - RNA, 22 nt, Human
cccaaccggggagcccccgccc

SEQ ID NO: 2440758 - RNA, 15 nt, Human
cccaaggcggccccu

SEQ ID NO: 2440759 - RNA, 22 nt, Human
cccaaggcguccgcgcgccagc

SEQ ID NO: 2440760 - RNA, 22 nt, Human
cccaaggaggaaaaacagacaa

SEQ ID NO: 2440761 - RNA, 21 nt, Human
cccaaggcugcgucuggaggg

SEQ ID NO: 2440762 - RNA, 20 nt, Human
cccaaggcugcgucuggagg

SEQ ID NO: 2440763 - RNA, 19 nt, Human
cccaaggcugcgucuggag

SEQ ID NO: 2440764 - RNA, 15 nt, Human
cccaaggcugcgucu

SEQ ID NO: 2440765 - RNA, 17 nt, Human
cccaaggcucugagcaa

SEQ ID NO: 2440766 - RNA, 17 nt, Human
cccaaucccuuuauuac

SEQ ID NO: 2440767 - RNA, 21 nt, Human
cccaaucccuuuauuaccccc

SEQ ID NO: 2440768 - RNA, 17 nt, Human
cccaagggaaagaaaag

SEQ ID NO: 2440769 - RNA, 22 nt, Human
cccaaggcugcgucuggagggg

SEQ ID NO: 2440770 - RNA, 23 nt, Human
cccaaucccagcuaccucaacca

SEQ ID NO: 2440771 - RNA, 15 nt, Human
cccaaagugcuggga

SEQ ID NO: 2440772 - RNA, 13 nt, Human
cccaaagugcugg

SEQ ID NO: 2440773 - RNA, 18 nt, Human
cccaaaggacuccaccca

SEQ ID NO: 2440774 - RNA, 14 nt, Human
cccaaaggacucca

SEQ ID NO: 2440775 - RNA, 17 nt, Human
cccaaagcuuuccugcc

SEQ ID NO: 2440776 - RNA, 16 nt, Human
cccaaagcuuuccugc

SEQ ID NO: 2440777 - RNA, 20 nt, Human
cccaaagcuuuccugcccca

SEQ ID NO: 2440778 - RNA, 17 nt, Human
cccaaaggaaaaagcac

SEQ ID NO: 2440779 - RNA, 21 nt, Human
cccaaaaccacagcccuguca

SEQ ID NO: 2440780 - RNA, 18 nt, Human
cccaaaacucuccucugc

SEQ ID NO: 2440781 - RNA, 16 nt, Human
cccaaaacucuccucu

SEQ ID NO: 2440782 - RNA, 21 nt, Human
cccaaaacaccggguuccagc

SEQ ID NO: 2440783 - RNA, 20 nt, Human
cccaaaacucuccucugcug

SEQ ID NO: 2440784 - RNA, 15 nt, Human
cccaaagcuuuccug

SEQ ID NO: 2440785 - RNA, 14 nt, Human
cccaaagcuuuccu

SEQ ID NO: 2440786 - RNA, 14 nt, Human
cccaaaaccacagc

SEQ ID NO: 2440787 - RNA, 15 nt, Human
cccaaaaccacagcc

SEQ ID NO: 2440788 - RNA, 14 nt, Human
cccaaagccagaca

SEQ ID NO: 2440789 - RNA, 14 nt, Human
ccauuuguguuuau

SEQ ID NO: 2440790 - RNA, 19 nt, Human
cccaaaacaccggguucca

SEQ ID NO: 2440791 - RNA, 14 nt, Human
ccauuugugugugu

SEQ ID NO: 2440792 - RNA, 20 nt, Human
ccauucuccaccugccaggg

SEQ ID NO: 2440793 - RNA, 19 nt, Human
ccauucuccaccugccagg

SEQ ID NO: 2440794 - RNA, 15 nt, Human
ccauucucccaggua

SEQ ID NO: 2440795 - RNA, 14 nt, Human
ccauucucccaggu

SEQ ID NO: 2440796 - RNA, 13 nt, Human
ccauucucccagg

SEQ ID NO: 2440797 - RNA, 12 nt, Human
ccauucucccag

SEQ ID NO: 2440798 - RNA, 22 nt, Human
ccauucucccagguaccagcug

SEQ ID NO: 2440799 - RNA, 19 nt, Human
ccauuuggcagagcuucuu

SEQ ID NO: 2440800 - RNA, 13 nt, Human
ccauucauuccau

SEQ ID NO: 2440801 - RNA, 14 nt, Human
ccauucauuccauu

SEQ ID NO: 2440802 - RNA, 11 nt, Human
ccauucuccca

SEQ ID NO: 2440803 - RNA, 15 nt, Human
ccaucuaaacugccc

SEQ ID NO: 2440804 - RNA, 16 nt, Human
ccaucuaaacugcccc

SEQ ID NO: 2440805 - RNA, 20 nt, Human
ccaucuaaauaccugcccug

SEQ ID NO: 2440806 - RNA, 23 nt, Human
ccaucgcuguguguuaguuccca

SEQ ID NO: 2440807 - RNA, 21 nt, Human
ccaucugcccaggggugcccc

SEQ ID NO: 2440808 - RNA, 20 nt, Human
ccaucugcccaggggugccc

SEQ ID NO: 2440809 - RNA, 17 nt, Human
ccaucugcccaggggug

SEQ ID NO: 2440810 - RNA, 16 nt, Human
ccaucugcccaggacg

SEQ ID NO: 2440811 - RNA, 15 nt, Human
ccaucugcccaggac

SEQ ID NO: 2440812 - RNA, 13 nt, Human
ccaucugcccagg

SEQ ID NO: 2440813 - RNA, 12 nt, Human
ccaucugcccag

SEQ ID NO: 2440814 - RNA, 23 nt, Human
ccaucugcaccccuucucuccuc

SEQ ID NO: 2440815 - RNA, 22 nt, Human
ccaucugcaccccuucucuccu

SEQ ID NO: 2440816 - RNA, 20 nt, Human
ccaucugcaccccuucucuc

SEQ ID NO: 2440817 - RNA, 17 nt, Human
ccaucugcaccccuucu

SEQ ID NO: 2440818 - RNA, 12 nt, Human
ccaucugcaccc

SEQ ID NO: 2440819 - RNA, 19 nt, Human
ccaucugcaccccccuggg

SEQ ID NO: 2440820 - RNA, 14 nt, Human
ccaucugcaccccu

SEQ ID NO: 2440821 - RNA, 20 nt, Human
ccaucugcaccccccugggc

SEQ ID NO: 2440822 - RNA, 23 nt, Human
ccaucugcccaggggugcccccu

SEQ ID NO: 2440823 - RNA, 22 nt, Human
ccaucugcccaggggugccccc

SEQ ID NO: 2440824 - RNA, 20 nt, Human
ccaucugcgugacaauaaaa

SEQ ID NO: 2440825 - RNA, 15 nt, Human
ccauggcccucccag

SEQ ID NO: 2440826 - RNA, 15 nt, Human
ccauggcccucauua

SEQ ID NO: 2440827 - RNA, 19 nt, Human
ccauggcgugucccucucg

SEQ ID NO: 2440828 - RNA, 21 nt, Human
ccauggcgugucccucucgga

SEQ ID NO: 2440829 - RNA, 21 nt, Human
ccaugggaaaugucaacaagu

SEQ ID NO: 2440830 - RNA, 18 nt, Human
ccauggcuuaaugcuucu

SEQ ID NO: 2440831 - RNA, 22 nt, Human
ccauccuacccucgggcccacc

SEQ ID NO: 2440832 - RNA, 18 nt, Human
ccauccuacccucgggcc

SEQ ID NO: 2440833 - RNA, 17 nt, Human
ccauccuacccucgggc

SEQ ID NO: 2440834 - RNA, 16 nt, Human
ccauccuacccucggg

SEQ ID NO: 2440835 - RNA, 13 nt, Human
ccauccucaaaca

SEQ ID NO: 2440836 - RNA, 23 nt, Human
ccauccuacccucgggcccaccu

SEQ ID NO: 2440837 - RNA, 18 nt, Human
ccauccucaaacacugca

SEQ ID NO: 2440838 - RNA, 13 nt, Human
ccauccuccagca

SEQ ID NO: 2440839 - RNA, 14 nt, Human
ccauccuccagcag

SEQ ID NO: 2440840 - RNA, 15 nt, Human
ccauccuccagcagg

SEQ ID NO: 2440841 - RNA, 16 nt, Human
ccauccuccagcaggg

SEQ ID NO: 2440842 - RNA, 13 nt, Human
ccauccuccagcu

SEQ ID NO: 2440843 - RNA, 17 nt, Human
ccauccuccagcaggga

SEQ ID NO: 2440844 - RNA, 14 nt, Human
ccaucuaaacugcc

SEQ ID NO: 2440845 - RNA, 17 nt, Human
ccauccuccagcuucug

SEQ ID NO: 2440846 - RNA, 16 nt, Human
ccauccuccagcuucu

SEQ ID NO: 2440847 - RNA, 15 nt, Human
ccauccuccagcuuc

SEQ ID NO: 2440848 - RNA, 14 nt, Human
ccauccuccagcuu

SEQ ID NO: 2440849 - RNA, 14 nt, Human
ccauccuccccuuc

SEQ ID NO: 2440850 - RNA, 16 nt, Human
ccaucgcuguguguua

SEQ ID NO: 2440851 - RNA, 20 nt, Human
ccaucgcuguguguuaguuc

SEQ ID NO: 2440852 - RNA, 13 nt, Human
ccauccuccccuu

SEQ ID NO: 2440853 - RNA, 23 nt, Human
ccauauugcacaugucuuaauga

SEQ ID NO: 2440854 - RNA, 21 nt, Human
ccauauugcacaugucuuaau

SEQ ID NO: 2440855 - RNA, 18 nt, Human
ccauauugcacaugucuu

SEQ ID NO: 2440856 - RNA, 13 nt, Human
ccauauugcacau

SEQ ID NO: 2440857 - RNA, 14 nt, Human
ccauaguaguauga

SEQ ID NO: 2440858 - RNA, 19 nt, Human
ccauauucuguuggccagu

SEQ ID NO: 2440859 - RNA, 12 nt, Human
ccauccuacccu

SEQ ID NO: 2440860 - RNA, 16 nt, Human
ccaugggacagggagg

SEQ ID NO: 2440861 - RNA, 19 nt, Human
ccaugggacagggaggacg

SEQ ID NO: 2440862 - RNA, 14 nt, Human
ccauggcuuccucc

SEQ ID NO: 2440863 - RNA, 20 nt, Human
ccauggcuuccaaggugguc

SEQ ID NO: 2440864 - RNA, 15 nt, Human
ccaugggaccaaacc

SEQ ID NO: 2440865 - RNA, 21 nt, Human
ccaugggaccaaaccuagccc

SEQ ID NO: 2440866 - RNA, 21 nt, Human
ccaugggaagacgaggcccuc

SEQ ID NO: 2440867 - RNA, 22 nt, Human
ccaugggagcugguuagaaaug

SEQ ID NO: 2440868 - RNA, 18 nt, Human
ccauguuggccaggcugc

SEQ ID NO: 2440869 - RNA, 21 nt, Human
ccauguuggccaggcugcucu

SEQ ID NO: 2440870 - RNA, 16 nt, Human
ccauguuggccaggcu

SEQ ID NO: 2440871 - RNA, 17 nt, Human
ccauguuggccaggcug

SEQ ID NO: 2440872 - RNA, 16 nt, Human
ccauguuucucuggcc

SEQ ID NO: 2440873 - RNA, 15 nt, Human
ccauguuucucuggc

SEQ ID NO: 2440874 - RNA, 21 nt, Human
ccauguuucucuggccccaag

SEQ ID NO: 2440875 - RNA, 14 nt, Human
ccauguuucucugg

SEQ ID NO: 2440876 - RNA, 16 nt, Human
ccauguuugagcucag

SEQ ID NO: 2440877 - RNA, 17 nt, Human
ccauguuugagcucaga

SEQ ID NO: 2440878 - RNA, 13 nt, Human
ccauguuuguaaa

SEQ ID NO: 2440879 - RNA, 21 nt, Human
ccauguuugagcucagacccc

SEQ ID NO: 2440880 - RNA, 15 nt, Human
ccauguuuguaaaac

SEQ ID NO: 2440881 - RNA, 14 nt, Human
ccauguuuguaaaa

SEQ ID NO: 2440882 - RNA, 18 nt, Human
ccauucuccaccugccag

SEQ ID NO: 2440883 - RNA, 19 nt, Human
ccauucacucuuccagaau

SEQ ID NO: 2440884 - RNA, 20 nt, Human
ccauucagugauuacuguca

SEQ ID NO: 2440885 - RNA, 20 nt, Human
ccauucacuucauaauccag

SEQ ID NO: 2440886 - RNA, 17 nt, Human
ccauucacucuuccaga

SEQ ID NO: 2440887 - RNA, 14 nt, Human
ccaguuauggcuau

SEQ ID NO: 2440888 - RNA, 21 nt, Human
ccaguuauggcuauaggugcu

SEQ ID NO: 2440889 - RNA, 19 nt, Human
ccauagcuccugcuccaca

SEQ ID NO: 2440890 - RNA, 21 nt, Human
ccauaguaugggacuggccuc

SEQ ID NO: 2440891 - RNA, 15 nt, Human
ccauagucacauggc

SEQ ID NO: 2440892 - RNA, 23 nt, Human
ccauauucuguuggccaguguga

SEQ ID NO: 2440893 - RNA, 15 nt, Human
ccauaguaccauuua

SEQ ID NO: 2440894 - RNA, 19 nt, Human
ccauaguaccauuuauaca

SEQ ID NO: 2440895 - RNA, 12 nt, Human
ccauaggucacc

SEQ ID NO: 2440896 - RNA, 13 nt, Human
ccauaggcccagu

SEQ ID NO: 2440897 - RNA, 15 nt, Human
ccauagcuuccauga

SEQ ID NO: 2440898 - RNA, 22 nt, Human
ccaguguuguggauuuaacaga

SEQ ID NO: 2440899 - RNA, 17 nt, Human
ccaguguuagggaaggg

SEQ ID NO: 2440900 - RNA, 17 nt, Human
ccaguuaaaaaaaauuu

SEQ ID NO: 2440901 - RNA, 20 nt, Human
ccaguguuagggaagggccu

SEQ ID NO: 2440902 - RNA, 18 nt, Human
ccagugucugucccgggg

SEQ ID NO: 2440903 - RNA, 22 nt, Human
ccaguguccccuccacugucac

SEQ ID NO: 2440904 - RNA, 16 nt, Human
ccaguguccccuccac

SEQ ID NO: 2440905 - RNA, 14 nt, Human
ccaguguccccucc

SEQ ID NO: 2440906 - RNA, 22 nt, Human
ccagugucaaguugugcuuguu

SEQ ID NO: 2440907 - RNA, 19 nt, Human
ccagugucaaguugugcuu

SEQ ID NO: 2440908 - RNA, 14 nt, Human
ccagugguugcugu

SEQ ID NO: 2440909 - RNA, 14 nt, Human
ccaguguagccuug

SEQ ID NO: 2440910 - RNA, 15 nt, Human
ccaguguagccuugc

SEQ ID NO: 2440911 - RNA, 16 nt, Human
ccaguguccuuagaac

SEQ ID NO: 2440912 - RNA, 21 nt, Human
ccagugucugucccggggucc

SEQ ID NO: 2440913 - RNA, 22 nt, Human
ccagugugggaaugcggcaaga

SEQ ID NO: 2440914 - RNA, 15 nt, Human
ccagugucugucccg

SEQ ID NO: 2440915 - RNA, 15 nt, Human
ccagugaggcucugc

SEQ ID NO: 2440916 - RNA, 14 nt, Human
ccagugaggcucug

SEQ ID NO: 2440917 - RNA, 23 nt, Human
ccagugcccacaggaucagucug

SEQ ID NO: 2440918 - RNA, 18 nt, Human
ccagugcccauuccucac

SEQ ID NO: 2440919 - RNA, 13 nt, Human
ccagugcccauuc

SEQ ID NO: 2440920 - RNA, 16 nt, Human
ccagucuguggaucag

SEQ ID NO: 2440921 - RNA, 16 nt, Human
ccagugaggcucugcc

SEQ ID NO: 2440922 - RNA, 14 nt, Human
ccagugcccccacu

SEQ ID NO: 2440923 - RNA, 16 nt, Human
ccagugcccccacuga

SEQ ID NO: 2440924 - RNA, 18 nt, Human
ccagugcccccacugacc

SEQ ID NO: 2440925 - RNA, 22 nt, Human
ccagugguuccuaauccucuag

SEQ ID NO: 2440926 - RNA, 20 nt, Human
ccagugccgagaaggaagcc

SEQ ID NO: 2440927 - RNA, 13 nt, Human
ccaucuacccucc

SEQ ID NO: 2440928 - RNA, 13 nt, Human
ccagccucccuga

SEQ ID NO: 2440929 - RNA, 15 nt, Human
ccagccucccugaag

SEQ ID NO: 2440930 - RNA, 17 nt, Human
ccagccucccugaagcc

SEQ ID NO: 2440931 - RNA, 21 nt, Human
ccagccucccugaagccuuug

SEQ ID NO: 2440932 - RNA, 16 nt, Human
ccagccuccaugcugc

SEQ ID NO: 2440933 - RNA, 15 nt, Human
ccagccuccaugcug

SEQ ID NO: 2440934 - RNA, 15 nt, Human
ccagccuccucugga

SEQ ID NO: 2440935 - RNA, 14 nt, Human
ccagccuccucugg

SEQ ID NO: 2440936 - RNA, 20 nt, Human
ccaggagaaggccaauuccu

SEQ ID NO: 2440937 - RNA, 21 nt, Human
ccagccuccgagagggagaga

SEQ ID NO: 2440938 - RNA, 19 nt, Human
ccagccuccgagagggaga

SEQ ID NO: 2440939 - RNA, 18 nt, Human
ccagccuccgagagggag

SEQ ID NO: 2440940 - RNA, 22 nt, Human
ccagccucaguccuccccucac

SEQ ID NO: 2440941 - RNA, 13 nt, Human
ccagccuccucug

SEQ ID NO: 2440942 - RNA, 12 nt, Human
ccagccuccucu

SEQ ID NO: 2440943 - RNA, 11 nt, Human
ccagccuccuc

SEQ ID NO: 2440944 - RNA, 19 nt, Human
ccagccuccguauuucaga

SEQ ID NO: 2440945 - RNA, 23 nt, Human
ccaggcccucugcccacucccug

SEQ ID NO: 2440946 - RNA, 22 nt, Human
ccaggcccucugcccacucccu

SEQ ID NO: 2440947 - RNA, 20 nt, Human
ccaggccccaaaaccacagc

SEQ ID NO: 2440948 - RNA, 14 nt, Human
ccaggccgcagcuc

SEQ ID NO: 2440949 - RNA, 18 nt, Human
ccaggccgagaagccagu

SEQ ID NO: 2440950 - RNA, 21 nt, Human
ccaggccccaaaaccacagcc

SEQ ID NO: 2440951 - RNA, 21 nt, Human
ccaggccgcagcucuugcccu

SEQ ID NO: 2440952 - RNA, 19 nt, Human
ccaggccgcagcucuugcc

SEQ ID NO: 2440953 - RNA, 17 nt, Human
ccaggccgcagcucuug

SEQ ID NO: 2440954 - RNA, 16 nt, Human
ccaggccgcagcucuu

SEQ ID NO: 2440955 - RNA, 21 nt, Human
ccaggccgccccagccucuga

SEQ ID NO: 2440956 - RNA, 21 nt, Human
ccaggcccucugcccacuccc

SEQ ID NO: 2440957 - RNA, 20 nt, Human
ccaggcccucugcccacucc

SEQ ID NO: 2440958 - RNA, 16 nt, Human
ccaggccauggaggca

SEQ ID NO: 2440959 - RNA, 19 nt, Human
ccaggccagggggccaguc

SEQ ID NO: 2440960 - RNA, 18 nt, Human
ccaggccaucuuccaggu

SEQ ID NO: 2440961 - RNA, 16 nt, Human
ccaggccaucuuccag

SEQ ID NO: 2440962 - RNA, 22 nt, Human
ccaggccauccggcccccagag

SEQ ID NO: 2440963 - RNA, 21 nt, Human
ccaggccauccggcccccaga

SEQ ID NO: 2440964 - RNA, 17 nt, Human
ccaggcgggcucaagga

SEQ ID NO: 2440965 - RNA, 16 nt, Human
ccaggcgggcucaagg

SEQ ID NO: 2440966 - RNA, 14 nt, Human
ccaggcgggcucaa

SEQ ID NO: 2440967 - RNA, 22 nt, Human
ccaggcgggagcgguggcccug

SEQ ID NO: 2440968 - RNA, 18 nt, Human
ccaggcgaugugcaagug

SEQ ID NO: 2440969 - RNA, 21 nt, Human
ccaggcgggagcgguggcccu

SEQ ID NO: 2440970 - RNA, 17 nt, Human
ccaggcuuagucacuga

SEQ ID NO: 2440971 - RNA, 24 nt, Human
ccaggcuguaucccaugagccuca

SEQ ID NO: 2440972 - RNA, 18 nt, Human
ccaggccggcgagcccug

SEQ ID NO: 2440973 - RNA, 15 nt, Human
ccaggccgccccagc

SEQ ID NO: 2440974 - RNA, 16 nt, Human
ccaggccgccccagcc

SEQ ID NO: 2440975 - RNA, 21 nt, Human
ccaggccgggguggagcaugg

SEQ ID NO: 2440976 - RNA, 18 nt, Human
ccaggccgccccagccuc

SEQ ID NO: 2440977 - RNA, 19 nt, Human
ccaggccguccucccgggc

SEQ ID NO: 2440978 - RNA, 15 nt, Human
ccaggccguccuccc

SEQ ID NO: 2440979 - RNA, 22 nt, Human
ccaggccggugugggcuguguc

SEQ ID NO: 2440980 - RNA, 16 nt, Human
ccaggccguggcugcc

SEQ ID NO: 2440981 - RNA, 14 nt, Human
ccaggccguggcug

SEQ ID NO: 2440982 - RNA, 18 nt, Human
ccaggcgccccuuccccc

SEQ ID NO: 2440983 - RNA, 22 nt, Human
ccaggccguccucccgggcccu

SEQ ID NO: 2440984 - RNA, 18 nt, Human
ccaggccguggcugccca

SEQ ID NO: 2440985 - RNA, 19 nt, Human
ccaggcgccccuucccccu

SEQ ID NO: 2440986 - RNA, 18 nt, Human
ccaggcgcaggggcucac

SEQ ID NO: 2440987 - RNA, 16 nt, Human
ccaggagccugugccu

SEQ ID NO: 2440988 - RNA, 17 nt, Human
ccaggagccugugccuc

SEQ ID NO: 2440989 - RNA, 12 nt, Human
ccaggagcaaau

SEQ ID NO: 2440990 - RNA, 20 nt, Human
ccaggagccccgaggccuuc

SEQ ID NO: 2440991 - RNA, 12 nt, Human
ccaggagccucc

SEQ ID NO: 2440992 - RNA, 23 nt, Human
ccaggagagccagcccucccugu

SEQ ID NO: 2440993 - RNA, 21 nt, Human
ccaggagaggagcgggaccug

SEQ ID NO: 2440994 - RNA, 20 nt, Human
ccaggagagccagcccuccc

SEQ ID NO: 2440995 - RNA, 19 nt, Human
ccaggagccccgaggccuu

SEQ ID NO: 2440996 - RNA, 16 nt, Human
ccaggagccccgaggc

SEQ ID NO: 2440997 - RNA, 15 nt, Human
ccaggagagagaaag

SEQ ID NO: 2440998 - RNA, 14 nt, Human
ccaggagagagaaa

SEQ ID NO: 2440999 - RNA, 12 nt, Human
ccaggagagaga

SEQ ID NO: 2441000 - RNA, 17 nt, Human
ccaggagagagaaagcc

SEQ ID NO: 2441001 - RNA, 16 nt, Human
ccaggagagagaaagc

SEQ ID NO: 2441002 - RNA, 21 nt, Human
ccaggagagagaaagccaggc

SEQ ID NO: 2441003 - RNA, 13 nt, Human
ccaggagagccag

SEQ ID NO: 2441004 - RNA, 16 nt, Human
ccaggagagccagccc

SEQ ID NO: 2441005 - RNA, 17 nt, Human
ccaggagagccagcccu

SEQ ID NO: 2441006 - RNA, 18 nt, Human
ccaggagagccagcccuc

SEQ ID NO: 2441007 - RNA, 19 nt, Human
ccaggagagccagcccucc

SEQ ID NO: 2441008 - RNA, 18 nt, Human
ccaggcauuccccaggag

SEQ ID NO: 2441009 - RNA, 17 nt, Human
ccaggcauuccccagga

SEQ ID NO: 2441010 - RNA, 21 nt, Human
ccaggagcugggcagaaggcc

SEQ ID NO: 2441011 - RNA, 16 nt, Human
ccaggagcugggcaga

SEQ ID NO: 2441012 - RNA, 13 nt, Human
ccaggagcucuuc

SEQ ID NO: 2441013 - RNA, 18 nt, Human
ccaggagcucuucaggcc

SEQ ID NO: 2441014 - RNA, 21 nt, Human
ccaggagcucuucaggccucc

SEQ ID NO: 2441015 - RNA, 17 nt, Human
ccaggagcugcucacua

SEQ ID NO: 2441016 - RNA, 16 nt, Human
ccaggagcugcccaga

SEQ ID NO: 2441017 - RNA, 23 nt, Human
ccaggagcucuucaggccucccu

SEQ ID NO: 2441018 - RNA, 21 nt, Human
ccaggcauuccccaggaggcc

SEQ ID NO: 2441019 - RNA, 19 nt, Human
ccaggcauuccccaggagg

SEQ ID NO: 2441020 - RNA, 18 nt, Human
ccaggccaggccaccagg

SEQ ID NO: 2441021 - RNA, 12 nt, Human
ccaggccaggcc

SEQ ID NO: 2441022 - RNA, 15 nt, Human
ccaggccagcugccu

SEQ ID NO: 2441023 - RNA, 23 nt, Human
ccaggccagccuccgagagggag

SEQ ID NO: 2441024 - RNA, 23 nt, Human
ccagguaccagcugcgcuugcuu

SEQ ID NO: 2441025 - RNA, 18 nt, Human
ccagguaccagcugcgcu

SEQ ID NO: 2441026 - RNA, 17 nt, Human
ccagguaccagcugcgc

SEQ ID NO: 2441027 - RNA, 15 nt, Human
ccagguaccagcugc

SEQ ID NO: 2441028 - RNA, 23 nt, Human
ccagguaaugagggacuggaacc

SEQ ID NO: 2441029 - RNA, 18 nt, Human
ccaggugcacaagcucca

SEQ ID NO: 2441030 - RNA, 20 nt, Human
ccaggugcacaagcuccaag

SEQ ID NO: 2441031 - RNA, 19 nt, Human
ccaggugcacaagcuccaa

SEQ ID NO: 2441032 - RNA, 16 nt, Human
ccaggguugaccccag

SEQ ID NO: 2441033 - RNA, 18 nt, Human
ccaggguugaccccagag

SEQ ID NO: 2441034 - RNA, 22 nt, Human
ccaggguugaucacacucuggg

SEQ ID NO: 2441035 - RNA, 16 nt, Human
ccaggguugaucacac

SEQ ID NO: 2441036 - RNA, 21 nt, Human
ccaggguugaccccagaggau

SEQ ID NO: 2441037 - RNA, 18 nt, Human
ccagguaaugagggacug

SEQ ID NO: 2441038 - RNA, 16 nt, Human
ccagguaaugagggac

SEQ ID NO: 2441039 - RNA, 23 nt, Human
ccagguaagcaggaggaggugcc

SEQ ID NO: 2441040 - RNA, 17 nt, Human
ccaggguuucgagaagc

SEQ ID NO: 2441041 - RNA, 18 nt, Human
ccagggcuggacugaggc

SEQ ID NO: 2441042 - RNA, 17 nt, Human
ccagggcuggacugagg

SEQ ID NO: 2441043 - RNA, 16 nt, Human
ccagggcuggacugag

SEQ ID NO: 2441044 - RNA, 13 nt, Human
ccagggcuggacu

SEQ ID NO: 2441045 - RNA, 19 nt, Human
ccagggcuggacugaggcc

SEQ ID NO: 2441046 - RNA, 14 nt, Human
ccaggguuccccca

SEQ ID NO: 2441047 - RNA, 14 nt, Human
ccagggugugugcu

SEQ ID NO: 2441048 - RNA, 15 nt, Human
ccaggguucccccag

SEQ ID NO: 2441049 - RNA, 20 nt, Human
ccaggguucccccagcccug

SEQ ID NO: 2441050 - RNA, 21 nt, Human
ccaggguucccccagcccugu

SEQ ID NO: 2441051 - RNA, 22 nt, Human
ccaggguucccccagcccugug

SEQ ID NO: 2441052 - RNA, 16 nt, Human
ccagggcucugaccag

SEQ ID NO: 2441053 - RNA, 20 nt, Human
ccagggcugcuagacggagg

SEQ ID NO: 2441054 - RNA, 20 nt, Human
ccagggcuccugcacuuacu

SEQ ID NO: 2441055 - RNA, 21 nt, Human
ccagggcuggaaugauuucag

SEQ ID NO: 2441056 - RNA, 19 nt, Human
ccagggcccagagcccagc

SEQ ID NO: 2441057 - RNA, 21 nt, Human
ccagggcccagagcccagcuc

SEQ ID NO: 2441058 - RNA, 22 nt, Human
ccagggcccagagcccagcucc

SEQ ID NO: 2441059 - RNA, 14 nt, Human
ccagggcuccugca

SEQ ID NO: 2441060 - RNA, 13 nt, Human
ccagggcuccugc

SEQ ID NO: 2441061 - RNA, 12 nt, Human
ccagggcuccug

SEQ ID NO: 2441062 - RNA, 18 nt, Human
ccagggagccuuugguuc

SEQ ID NO: 2441063 - RNA, 14 nt, Human
ccagggagccuuug

SEQ ID NO: 2441064 - RNA, 12 nt, Human
ccagggagccuu

SEQ ID NO: 2441065 - RNA, 13 nt, Human
ccagggagccuuu

SEQ ID NO: 2441066 - RNA, 12 nt, Human
ccagggccaggg

SEQ ID NO: 2441067 - RNA, 21 nt, Human
ccagggccacucugccucugc

SEQ ID NO: 2441068 - RNA, 14 nt, Human
ccagggccagggcc

SEQ ID NO: 2441069 - RNA, 16 nt, Human
ccagggccagggcccu

SEQ ID NO: 2441070 - RNA, 15 nt, Human
ccagggcccagagcc

SEQ ID NO: 2441071 - RNA, 16 nt, Human
ccagggcccagagccc

SEQ ID NO: 2441072 - RNA, 17 nt, Human
ccagggcccagagccca

SEQ ID NO: 2441073 - RNA, 18 nt, Human
ccagggcccagagcccag

SEQ ID NO: 2441074 - RNA, 13 nt, Human
ccagggcccagag

SEQ ID NO: 2441075 - RNA, 14 nt, Human
ccagggcccagagc

SEQ ID NO: 2441076 - RNA, 15 nt, Human
ccagggccagggguc

SEQ ID NO: 2441077 - RNA, 17 nt, Human
ccagggccagggcccug

SEQ ID NO: 2441078 - RNA, 20 nt, Human
ccagucuggaaugcaguggu

SEQ ID NO: 2441079 - RNA, 19 nt, Human
ccagucuggaaugcagugg

SEQ ID NO: 2441080 - RNA, 13 nt, Human
ccagugaggcucu

SEQ ID NO: 2441081 - RNA, 13 nt, Human
ccagucuguggau

SEQ ID NO: 2441082 - RNA, 12 nt, Human
ccagucugugga

SEQ ID NO: 2441083 - RNA, 16 nt, Human
ccagucugcugcccuc

SEQ ID NO: 2441084 - RNA, 17 nt, Human
ccagucugcugcccucc

SEQ ID NO: 2441085 - RNA, 18 nt, Human
ccagucugcugcccucca

SEQ ID NO: 2441086 - RNA, 22 nt, Human
ccagucugcugcccuccauccc

SEQ ID NO: 2441087 - RNA, 19 nt, Human
ccagucugggcugccgggu

SEQ ID NO: 2441088 - RNA, 18 nt, Human
ccagucugggcugccggg

SEQ ID NO: 2441089 - RNA, 16 nt, Human
ccagucugggcugccg

SEQ ID NO: 2441090 - RNA, 23 nt, Human
ccagucugcugcccuccaucccg

SEQ ID NO: 2441091 - RNA, 17 nt, Human
ccaguaaacagaggagu

SEQ ID NO: 2441092 - RNA, 12 nt, Human
ccaguaaacaga

SEQ ID NO: 2441093 - RNA, 23 nt, Human
ccaguaaaauugccauauugcac

SEQ ID NO: 2441094 - RNA, 19 nt, Human
ccaguaaaauugccauauu

SEQ ID NO: 2441095 - RNA, 17 nt, Human
ccaguaaaauugccaua

SEQ ID NO: 2441096 - RNA, 14 nt, Human
ccagucuaaaaaua

SEQ ID NO: 2441097 - RNA, 19 nt, Human
ccagucgcgcugccugugu

SEQ ID NO: 2441098 - RNA, 21 nt, Human
ccagucgcgcugccugugugg

SEQ ID NO: 2441099 - RNA, 20 nt, Human
ccagucgcgcugccugugug

SEQ ID NO: 2441100 - RNA, 16 nt, Human
ccagucuacccagaga

SEQ ID NO: 2441101 - RNA, 16 nt, Human
ccagucuccaccagga

SEQ ID NO: 2441102 - RNA, 18 nt, Human
ccagucuccaccaggaac

SEQ ID NO: 2441103 - RNA, 19 nt, Human
ccagucuccaccaggaacc

SEQ ID NO: 2441104 - RNA, 18 nt, Human
ccagucuggaaugcagug

SEQ ID NO: 2441105 - RNA, 20 nt, Human
ccagucuccaccaggaaccu

SEQ ID NO: 2441106 - RNA, 21 nt, Human
ccagucuccaccaggaaccuc

SEQ ID NO: 2441107 - RNA, 23 nt, Human
ccagucuccaccaggaaccucuu

SEQ ID NO: 2441108 - RNA, 12 nt, Human
ccagucugaccc

SEQ ID NO: 2441109 - RNA, 13 nt, Human
ccagucugacccu

SEQ ID NO: 2441110 - RNA, 12 nt, Human
ccagucucuucu

SEQ ID NO: 2441111 - RNA, 24 nt, Human
ccaggugcacaagcuccaagcucc

SEQ ID NO: 2441112 - RNA, 15 nt, Human
ccagguucagcuugu

SEQ ID NO: 2441113 - RNA, 22 nt, Human
ccagguucuauuuggaauuuau

SEQ ID NO: 2441114 - RNA, 16 nt, Human
ccagguucuauuugga

SEQ ID NO: 2441115 - RNA, 21 nt, Human
ccagguucuccguuagcuccu

SEQ ID NO: 2441116 - RNA, 15 nt, Human
ccagguucuauuugg

SEQ ID NO: 2441117 - RNA, 19 nt, Human
ccagguaccagcugcgcuu

SEQ ID NO: 2441118 - RNA, 23 nt, Human
ccagguucuccguuagcuccugu

SEQ ID NO: 2441119 - RNA, 22 nt, Human
ccagguucuccguuagcuccug

SEQ ID NO: 2441120 - RNA, 24 nt, Human
ccagguucuccguuagcuccugug

SEQ ID NO: 2441121 - RNA, 13 nt, Human
ccagguugaaaga

SEQ ID NO: 2441122 - RNA, 22 nt, Human
ccagguuuuucaauuaaacgga

SEQ ID NO: 2441123 - RNA, 21 nt, Human
ccagguuuuucaauuaaacgg

SEQ ID NO: 2441124 - RNA, 20 nt, Human
ccagguuuuucaauuaaacg

SEQ ID NO: 2441125 - RNA, 19 nt, Human
ccagguuuuucaauuaaac

SEQ ID NO: 2441126 - RNA, 18 nt, Human
ccagguuuuucaauuaaa

SEQ ID NO: 2441127 - RNA, 17 nt, Human
ccagguuuuucaauuaa

SEQ ID NO: 2441128 - RNA, 16 nt, Human
ccagguuuuucaauua

SEQ ID NO: 2441129 - RNA, 15 nt, Human
ccagguuuuucaauu

SEQ ID NO: 2441130 - RNA, 14 nt, Human
ccagguuuuucaau

SEQ ID NO: 2441131 - RNA, 16 nt, Human
ccagguugaaagaccu

SEQ ID NO: 2441132 - RNA, 17 nt, Human
ccagguuuuuggucuga

SEQ ID NO: 2441133 - RNA, 15 nt, Human
ccaguaaaauugcca

SEQ ID NO: 2441134 - RNA, 13 nt, Human
ccaguaaaauugc

SEQ ID NO: 2441135 - RNA, 11 nt, Human
ccaguaaaauu

SEQ ID NO: 2441136 - RNA, 23 nt, Human
ccagguuuuucaauuaaacggau

SEQ ID NO: 2441137 - RNA, 22 nt, Human
ccagggacagaggggguggccu

SEQ ID NO: 2441138 - RNA, 21 nt, Human
ccagggacagaggggguggcc

SEQ ID NO: 2441139 - RNA, 15 nt, Human
ccagggacagagggg

SEQ ID NO: 2441140 - RNA, 14 nt, Human
ccagggacagaggg

SEQ ID NO: 2441141 - RNA, 20 nt, Human
ccaggcuuagucacugagac

SEQ ID NO: 2441142 - RNA, 22 nt, Human
ccaggcgggcucaaggaaaggg

SEQ ID NO: 2441143 - RNA, 18 nt, Human
ccaggcgggcucaaggaa

SEQ ID NO: 2441144 - RNA, 17 nt, Human
ccaggcugugggccuca

SEQ ID NO: 2441145 - RNA, 21 nt, Human
ccaggcugugggccucaagga

SEQ ID NO: 2441146 - RNA, 22 nt, Human
ccaggcugugggccucaaggac

SEQ ID NO: 2441147 - RNA, 14 nt, Human
ccagggagaggcca

SEQ ID NO: 2441148 - RNA, 17 nt, Human
ccagggagaggccauga

SEQ ID NO: 2441149 - RNA, 21 nt, Human
ccagggagcauuuuccuccau

SEQ ID NO: 2441150 - RNA, 20 nt, Human
ccagggagcauuuuccucca

SEQ ID NO: 2441151 - RNA, 19 nt, Human
ccagggagcauuuuccucc

SEQ ID NO: 2441152 - RNA, 15 nt, Human
ccagcaagugagagc

SEQ ID NO: 2441153 - RNA, 18 nt, Human
ccagcaacuugucuuuuu

SEQ ID NO: 2441154 - RNA, 16 nt, Human
ccagcaacugaauaaa

SEQ ID NO: 2441155 - RNA, 21 nt, Human
ccagcaacuugucuuuuucug

SEQ ID NO: 2441156 - RNA, 14 nt, Human
ccagauuucacucu

SEQ ID NO: 2441157 - RNA, 17 nt, Human
ccagcaacugaauaaau

SEQ ID NO: 2441158 - RNA, 15 nt, Human
ccagcaacugaauaa

SEQ ID NO: 2441159 - RNA, 13 nt, Human
ccagcaacugaau

SEQ ID NO: 2441160 - RNA, 18 nt, Human
ccagcaacccuccuauca

SEQ ID NO: 2441161 - RNA, 11 nt, Human
ccagcaacuga

SEQ ID NO: 2441162 - RNA, 15 nt, Human
ccagcaacuccaacu

SEQ ID NO: 2441163 - RNA, 22 nt, Human
ccagcaaugacaucucaggggc

SEQ ID NO: 2441164 - RNA, 21 nt, Human
ccagcaaugacaucucagggg

SEQ ID NO: 2441165 - RNA, 12 nt, Human
ccagcaaugaca

SEQ ID NO: 2441166 - RNA, 17 nt, Human
ccagcaauauguaaaua

SEQ ID NO: 2441167 - RNA, 17 nt, Human
ccagcaaugauguccag

SEQ ID NO: 2441168 - RNA, 23 nt, Human
ccagcaaugacaucucaggggcc

SEQ ID NO: 2441169 - RNA, 16 nt, Human
ccagcaauucuccugc

SEQ ID NO: 2441170 - RNA, 18 nt, Human
ccagcaauucuccugccu

SEQ ID NO: 2441171 - RNA, 19 nt, Human
ccagcaauucuccugccuc

SEQ ID NO: 2441172 - RNA, 20 nt, Human
ccagcaauucuccugccuca

SEQ ID NO: 2441173 - RNA, 17 nt, Human
ccagcacuaaagcagug

SEQ ID NO: 2441174 - RNA, 18 nt, Human
ccagcaaugauguccaga

SEQ ID NO: 2441175 - RNA, 19 nt, Human
ccagauuuacacugggaga

SEQ ID NO: 2441176 - RNA, 18 nt, Human
ccagcacuaaagcagugg

SEQ ID NO: 2441177 - RNA, 22 nt, Human
ccagcaagugagagcugggugu

SEQ ID NO: 2441178 - RNA, 21 nt, Human
ccagcaagugagagcugggug

SEQ ID NO: 2441179 - RNA, 20 nt, Human
ccagcaagugagagcugggu

SEQ ID NO: 2441180 - RNA, 16 nt, Human
ccagcaagugagagcu

SEQ ID NO: 2441181 - RNA, 22 nt, Human
ccagccccacagcccacguccu

SEQ ID NO: 2441182 - RNA, 17 nt, Human
ccagccccacccaggag

SEQ ID NO: 2441183 - RNA, 18 nt, Human
ccagccccacccaggagg

SEQ ID NO: 2441184 - RNA, 15 nt, Human
ccagccccagugccc

SEQ ID NO: 2441185 - RNA, 13 nt, Human
ccagccccagugc

SEQ ID NO: 2441186 - RNA, 23 nt, Human
ccagccccaaaacucuccucugc

SEQ ID NO: 2441187 - RNA, 14 nt, Human
ccagccagggcugc

SEQ ID NO: 2441188 - RNA, 13 nt, Human
ccagccagggcug

SEQ ID NO: 2441189 - RNA, 15 nt, Human
ccagccagggcugcu

SEQ ID NO: 2441190 - RNA, 19 nt, Human
ccagccagugaccugagga

SEQ ID NO: 2441191 - RNA, 20 nt, Human
ccagccagugaccugaggaa

SEQ ID NO: 2441192 - RNA, 22 nt, Human
ccagccagugaccugaggaagc

SEQ ID NO: 2441193 - RNA, 21 nt, Human
ccagccauacuuaucucucug

SEQ ID NO: 2441194 - RNA, 15 nt, Human
ccagccccacagccc

SEQ ID NO: 2441195 - RNA, 14 nt, Human
ccagccccacagcc

SEQ ID NO: 2441196 - RNA, 13 nt, Human
ccagccccacagc

SEQ ID NO: 2441197 - RNA, 23 nt, Human
ccagccagugaccugaggaagcg

SEQ ID NO: 2441198 - RNA, 21 nt, Human
ccagccccacagcccacgucc

SEQ ID NO: 2441199 - RNA, 19 nt, Human
ccagccccacagcccacgu

SEQ ID NO: 2441200 - RNA, 14 nt, Human
ccagccccacccag

SEQ ID NO: 2441201 - RNA, 15 nt, Human
ccagccccacccagg

SEQ ID NO: 2441202 - RNA, 16 nt, Human
ccagccccacccagga

SEQ ID NO: 2441203 - RNA, 20 nt, Human
ccagcccuugagcuccccaa

SEQ ID NO: 2441204 - RNA, 15 nt, Human
ccagcccuguggaag

SEQ ID NO: 2441205 - RNA, 18 nt, Human
ccagcccuguggaaggga

SEQ ID NO: 2441206 - RNA, 17 nt, Human
ccagcccuuagcaggga

SEQ ID NO: 2441207 - RNA, 21 nt, Human
ccagcccuccuuaucaaagga

SEQ ID NO: 2441208 - RNA, 21 nt, Human
ccagcccucccuguccuccuc

SEQ ID NO: 2441209 - RNA, 22 nt, Human
ccagcccucccuguccuccucg

SEQ ID NO: 2441210 - RNA, 14 nt, Human
ccagcccuguggaa

SEQ ID NO: 2441211 - RNA, 16 nt, Human
ccagcccuuagcaggg

SEQ ID NO: 2441212 - RNA, 16 nt, Human
ccagcccuauggaugu

SEQ ID NO: 2441213 - RNA, 15 nt, Human
ccagcccuauggaug

SEQ ID NO: 2441214 - RNA, 13 nt, Human
ccagcccucaucc

SEQ ID NO: 2441215 - RNA, 16 nt, Human
ccagccccagugccca

SEQ ID NO: 2441216 - RNA, 14 nt, Human
ccagcccucauccc

SEQ ID NO: 2441217 - RNA, 14 nt, Human
ccagcccuccccau

SEQ ID NO: 2441218 - RNA, 20 nt, Human
ccagcccuccccauggagcc

SEQ ID NO: 2441219 - RNA, 21 nt, Human
ccagcccuccccauggagcca

SEQ ID NO: 2441220 - RNA, 13 nt, Human
ccagcccucccug

SEQ ID NO: 2441221 - RNA, 14 nt, Human
ccagcccucccugu

SEQ ID NO: 2441222 - RNA, 15 nt, Human
ccagcccucccuguc

SEQ ID NO: 2441223 - RNA, 16 nt, Human
ccagcccucccugucc

SEQ ID NO: 2441224 - RNA, 17 nt, Human
ccagcccucccuguccu

SEQ ID NO: 2441225 - RNA, 18 nt, Human
ccagcccucccuguccuc

SEQ ID NO: 2441226 - RNA, 19 nt, Human
ccagcccucccuguccucc

SEQ ID NO: 2441227 - RNA, 20 nt, Human
ccagcccucccuguccuccu

SEQ ID NO: 2441228 - RNA, 16 nt, Human
ccagccuccucuggac

SEQ ID NO: 2441229 - RNA, 14 nt, Human
ccagccgccaugcu

SEQ ID NO: 2441230 - RNA, 23 nt, Human
ccagccgagauagccaaggccaa

SEQ ID NO: 2441231 - RNA, 20 nt, Human
ccagcccuuugggaggcuga

SEQ ID NO: 2441232 - RNA, 18 nt, Human
ccagccgccaugcuccug

SEQ ID NO: 2441233 - RNA, 19 nt, Human
ccagccgccaugcuccugg

SEQ ID NO: 2441234 - RNA, 11 nt, Human
ccagccucagu

SEQ ID NO: 2441235 - RNA, 10 nt, Human
ccagccucag

SEQ ID NO: 2441236 - RNA, 21 nt, Human
ccagccucaguccuccccuca

SEQ ID NO: 2441237 - RNA, 20 nt, Human
ccagccucaguccuccccuc

SEQ ID NO: 2441238 - RNA, 19 nt, Human
ccagccucaguccuccccu

SEQ ID NO: 2441239 - RNA, 15 nt, Human
ccagccucaguccuc

SEQ ID NO: 2441240 - RNA, 12 nt, Human
ccagccucaguc

SEQ ID NO: 2441241 - RNA, 21 nt, Human
ccagccuccaagcuccaucuc

SEQ ID NO: 2441242 - RNA, 19 nt, Human
ccagccucaucucuuuguu

SEQ ID NO: 2441243 - RNA, 22 nt, Human
ccagcauuccagccccucuggu

SEQ ID NO: 2441244 - RNA, 21 nt, Human
ccagcauuccagccccucugg

SEQ ID NO: 2441245 - RNA, 20 nt, Human
ccagcauuccagccccucug

SEQ ID NO: 2441246 - RNA, 19 nt, Human
ccagcauuccagccccucu

SEQ ID NO: 2441247 - RNA, 18 nt, Human
ccagcauuccagccccuc

SEQ ID NO: 2441248 - RNA, 17 nt, Human
ccagcauuccagccccu

SEQ ID NO: 2441249 - RNA, 16 nt, Human
ccagcauuccagcccc

SEQ ID NO: 2441250 - RNA, 15 nt, Human
ccagcauuccagccc

SEQ ID NO: 2441251 - RNA, 14 nt, Human
ccagcauuccagcc

SEQ ID NO: 2441252 - RNA, 23 nt, Human
ccagcauaauacuugcuuuggaa

SEQ ID NO: 2441253 - RNA, 22 nt, Human
ccagcaguugaaugacaacaga

SEQ ID NO: 2441254 - RNA, 15 nt, Human
ccagcaguuugggag

SEQ ID NO: 2441255 - RNA, 15 nt, Human
ccagcaguuuucaag

SEQ ID NO: 2441256 - RNA, 22 nt, Human
ccagcaguuuucaagucaaauu

SEQ ID NO: 2441257 - RNA, 21 nt, Human
ccagcaucccuugaccaggcc

SEQ ID NO: 2441258 - RNA, 21 nt, Human
ccagcauccuuuucugcagag

SEQ ID NO: 2441259 - RNA, 18 nt, Human
ccagcaucccuugaccag

SEQ ID NO: 2441260 - RNA, 15 nt, Human
ccagcaucccuugac

SEQ ID NO: 2441261 - RNA, 19 nt, Human
ccagcauccuuuucugcag

SEQ ID NO: 2441262 - RNA, 22 nt, Human
ccagcacugaggaagaacgggg

SEQ ID NO: 2441263 - RNA, 17 nt, Human
ccagcacugaggaagaa

SEQ ID NO: 2441264 - RNA, 15 nt, Human
ccagcacugaggaag

SEQ ID NO: 2441265 - RNA, 14 nt, Human
ccagcacugaggaa

SEQ ID NO: 2441266 - RNA, 13 nt, Human
ccagcacugagga

SEQ ID NO: 2441267 - RNA, 12 nt, Human
ccagcacugagg

SEQ ID NO: 2441268 - RNA, 24 nt, Human
ccagcacuaaagcaguggacacca

SEQ ID NO: 2441269 - RNA, 12 nt, Human
ccagcacuaacg

SEQ ID NO: 2441270 - RNA, 12 nt, Human
ccagcacugcuu

SEQ ID NO: 2441271 - RNA, 13 nt, Human
ccagcacugccca

SEQ ID NO: 2441272 - RNA, 15 nt, Human
ccagcacugcuugag

SEQ ID NO: 2441273 - RNA, 18 nt, Human
ccagcacugcuugaggaa

SEQ ID NO: 2441274 - RNA, 19 nt, Human
ccagcacugcuugaggaaa

SEQ ID NO: 2441275 - RNA, 22 nt, Human
ccagcacugcuugaggaaaaca

SEQ ID NO: 2441276 - RNA, 15 nt, Human
ccagcaggugcugac

SEQ ID NO: 2441277 - RNA, 14 nt, Human
ccagcacugcccaa

SEQ ID NO: 2441278 - RNA, 18 nt, Human
ccagcaggugcugacuuc

SEQ ID NO: 2441279 - RNA, 15 nt, Human
ccagcagguggggag

SEQ ID NO: 2441280 - RNA, 14 nt, Human
ccagcauuccuuuu

SEQ ID NO: 2441281 - RNA, 13 nt, Human
ccagcauuccuuu

SEQ ID NO: 2441282 - RNA, 18 nt, Human
ccagcauuuuacugauuc

SEQ ID NO: 2441283 - RNA, 13 nt, Human
ccagcauugcugg

SEQ ID NO: 2441284 - RNA, 17 nt, Human
ccagcauugcugguucu

SEQ ID NO: 2441285 - RNA, 15 nt, Human
ccagccaaagccucc

SEQ ID NO: 2441286 - RNA, 18 nt, Human
ccagccaaagccuccucc

SEQ ID NO: 2441287 - RNA, 19 nt, Human
ccagccaaagccuccucca

SEQ ID NO: 2441288 - RNA, 13 nt, Human
ccagccaccccgg

SEQ ID NO: 2441289 - RNA, 19 nt, Human
ccagccaaccccuguggag

SEQ ID NO: 2441290 - RNA, 22 nt, Human
ccagccaacuuuugcauguuuu

SEQ ID NO: 2441291 - RNA, 17 nt, Human
ccagccaaacccugucu

SEQ ID NO: 2441292 - RNA, 18 nt, Human
ccagccaaacccugucug

SEQ ID NO: 2441293 - RNA, 19 nt, Human
ccagccaaacccugucuga

SEQ ID NO: 2441294 - RNA, 13 nt, Human
ccagccaaccccu

SEQ ID NO: 2441295 - RNA, 18 nt, Human
ccagccaaccccugugga

SEQ ID NO: 2441296 - RNA, 13 nt, Human
ccagccagauccu

SEQ ID NO: 2441297 - RNA, 19 nt, Human
ccagccagaguuccugcgg

SEQ ID NO: 2441298 - RNA, 23 nt, Human
ccagccagaacguggcucugcug

SEQ ID NO: 2441299 - RNA, 22 nt, Human
ccagccagaacguggcucugcu

SEQ ID NO: 2441300 - RNA, 22 nt, Human
ccagccacucgggaggcugaga

SEQ ID NO: 2441301 - RNA, 21 nt, Human
ccagccacucgggaggcugag

SEQ ID NO: 2441302 - RNA, 20 nt, Human
ccagccacucgggaggcuga

SEQ ID NO: 2441303 - RNA, 14 nt, Human
ccagccacguggag

SEQ ID NO: 2441304 - RNA, 21 nt, Human
ccagccaccccgggcucucug

SEQ ID NO: 2441305 - RNA, 22 nt, Human
ccagccaccccgggcucucugc

SEQ ID NO: 2441306 - RNA, 22 nt, Human
ccagccagcaaugauguccaga

SEQ ID NO: 2441307 - RNA, 21 nt, Human
ccagccagauggacuccagcc

SEQ ID NO: 2441308 - RNA, 19 nt, Human
ccagccagauccucuuggu

SEQ ID NO: 2441309 - RNA, 18 nt, Human
ccagccagauccucuugg

SEQ ID NO: 2441310 - RNA, 13 nt, Human
ccagccagcagcc

SEQ ID NO: 2441311 - RNA, 15 nt, Human
ccagccagcagccag

SEQ ID NO: 2441312 - RNA, 16 nt, Human
ccagccagcagccagc

SEQ ID NO: 2441313 - RNA, 19 nt, Human
ccagccagcagccagcucu

SEQ ID NO: 2441314 - RNA, 23 nt, Human
ccagccagcagccagcucucagc

SEQ ID NO: 2441315 - RNA, 10 nt, Human
ccagccaggc

SEQ ID NO: 2441316 - RNA, 20 nt, Human
ccagccaggcucugugcuga

SEQ ID NO: 2441317 - RNA, 19 nt, Human
ccagccaggcucugugcug

SEQ ID NO: 2441318 - RNA, 18 nt, Human
ccagccaggcucugugcu

SEQ ID NO: 2441319 - RNA, 17 nt, Human
ccagccaggcucugugc

SEQ ID NO: 2441320 - RNA, 15 nt, Human
ccagccaggcucugu

SEQ ID NO: 2441321 - RNA, 14 nt, Human
ccagccaggcucug

SEQ ID NO: 2441322 - RNA, 21 nt, Human
ccagccaggcgggcucaagga

SEQ ID NO: 2441323 - RNA, 17 nt, Human
ccagccaggcgggcuca

SEQ ID NO: 2441324 - RNA, 12 nt, Human
ccagccaggcgg

SEQ ID NO: 2441325 - RNA, 17 nt, Human
ccagccaggccccaggc

SEQ ID NO: 2441326 - RNA, 22 nt, Human
ccagauucuuuccugaggcugg

SEQ ID NO: 2441327 - RNA, 21 nt, Human
ccagauucuuuccugaggcug

SEQ ID NO: 2441328 - RNA, 20 nt, Human
ccagauucuuuccugaggcu

SEQ ID NO: 2441329 - RNA, 19 nt, Human
ccagauucuuuccugaggc

SEQ ID NO: 2441330 - RNA, 17 nt, Human
ccagauguuuccagacu

SEQ ID NO: 2441331 - RNA, 23 nt, Human
ccagauguuuccagacuuccuug

SEQ ID NO: 2441332 - RNA, 18 nt, Human
ccagauucuuuccugagg

SEQ ID NO: 2441333 - RNA, 23 nt, Human
ccagaugcugauguucaguguaa

SEQ ID NO: 2441334 - RNA, 21 nt, Human
ccagaugcugauguucagugu

SEQ ID NO: 2441335 - RNA, 19 nt, Human
ccagaugcugauguucagu

SEQ ID NO: 2441336 - RNA, 15 nt, Human
ccagaugcugauguu

SEQ ID NO: 2441337 - RNA, 17 nt, Human
ccagauggacuccagcc

SEQ ID NO: 2441338 - RNA, 22 nt, Human
ccagaugcugauguucagugua

SEQ ID NO: 2441339 - RNA, 16 nt, Human
ccagauggacuccagc

SEQ ID NO: 2441340 - RNA, 20 nt, Human
ccagaugggggaaagcacag

SEQ ID NO: 2441341 - RNA, 16 nt, Human
ccagaugggggaaagc

SEQ ID NO: 2441342 - RNA, 14 nt, Human
ccagauggggccuc

SEQ ID NO: 2441343 - RNA, 23 nt, Human
ccagagggagugacagaggcagc

SEQ ID NO: 2441344 - RNA, 22 nt, Human
ccagagggagugacagaggcag

SEQ ID NO: 2441345 - RNA, 13 nt, Human
ccagagggccugc

SEQ ID NO: 2441346 - RNA, 16 nt, Human
ccagaggcuggguuca

SEQ ID NO: 2441347 - RNA, 13 nt, Human
ccagagggcccag

SEQ ID NO: 2441348 - RNA, 15 nt, Human
ccagagggcccaggc

SEQ ID NO: 2441349 - RNA, 17 nt, Human
ccagagggcccaggcag

SEQ ID NO: 2441350 - RNA, 16 nt, Human
ccagagggccugcaag

SEQ ID NO: 2441351 - RNA, 15 nt, Human
ccagagggccugcaa

SEQ ID NO: 2441352 - RNA, 23 nt, Human
ccagaugcaccagcccuuagcag

SEQ ID NO: 2441353 - RNA, 15 nt, Human
ccagaggcugcccca

SEQ ID NO: 2441354 - RNA, 18 nt, Human
ccagagggcccaggcagg

SEQ ID NO: 2441355 - RNA, 14 nt, Human
ccagaugcagggca

SEQ ID NO: 2441356 - RNA, 15 nt, Human
ccagaugcagggcag

SEQ ID NO: 2441357 - RNA, 18 nt, Human
ccagaugcagggcaguca

SEQ ID NO: 2441358 - RNA, 18 nt, Human
ccagaugccuucuccaga

SEQ ID NO: 2441359 - RNA, 21 nt, Human
ccagauguuuuacgucuggga

SEQ ID NO: 2441360 - RNA, 19 nt, Human
ccagauguuuuacgucugg

SEQ ID NO: 2441361 - RNA, 23 nt, Human
ccagauucuuuccugaggcuggg

SEQ ID NO: 2441362 - RNA, 20 nt, Human
ccagauugcaacaggcuggg

SEQ ID NO: 2441363 - RNA, 19 nt, Human
ccagauugcaacaggcugg

SEQ ID NO: 2441364 - RNA, 12 nt, Human
ccagauuucacu

SEQ ID NO: 2441365 - RNA, 22 nt, Human
ccagauuuaugcauauuauuuu

SEQ ID NO: 2441366 - RNA, 13 nt, Human
ccagauuuaugca

SEQ ID NO: 2441367 - RNA, 21 nt, Human
ccagauugcaacaggcugggc

SEQ ID NO: 2441368 - RNA, 14 nt, Human
ccacugucacccuc

SEQ ID NO: 2441369 - RNA, 19 nt, Human
ccacuguacuugcucuuga

SEQ ID NO: 2441370 - RNA, 18 nt, Human
ccacuguacuugcucuug

SEQ ID NO: 2441371 - RNA, 17 nt, Human
ccacuguacuugcucuu

SEQ ID NO: 2441372 - RNA, 11 nt, Human
ccacuggggaa

SEQ ID NO: 2441373 - RNA, 22 nt, Human
ccacuggggaaauaacagcugu

SEQ ID NO: 2441374 - RNA, 14 nt, Human
ccacuguaaaauga

SEQ ID NO: 2441375 - RNA, 19 nt, Human
ccagacaccuugacagggc

SEQ ID NO: 2441376 - RNA, 17 nt, Human
ccagacaccuugacagg

SEQ ID NO: 2441377 - RNA, 20 nt, Human
ccacuguacuugcucuugau

SEQ ID NO: 2441378 - RNA, 15 nt, Human
ccagacacccaggac

SEQ ID NO: 2441379 - RNA, 16 nt, Human
ccagacacccaggacu

SEQ ID NO: 2441380 - RNA, 14 nt, Human
ccagacacccagga

SEQ ID NO: 2441381 - RNA, 12 nt, Human
ccacuggggaaa

SEQ ID NO: 2441382 - RNA, 18 nt, Human
ccacuguaaaaugaaauu

SEQ ID NO: 2441383 - RNA, 14 nt, Human
ccagagaggguggu

SEQ ID NO: 2441384 - RNA, 18 nt, Human
ccagacccccuggagacu

SEQ ID NO: 2441385 - RNA, 23 nt, Human
ccagagaggguggugaccucugc

SEQ ID NO: 2441386 - RNA, 21 nt, Human
ccagagaggguggugaccucu

SEQ ID NO: 2441387 - RNA, 20 nt, Human
ccagacaccuugacagggca

SEQ ID NO: 2441388 - RNA, 12 nt, Human
ccagacccccac

SEQ ID NO: 2441389 - RNA, 14 nt, Human
ccagacccaguggg

SEQ ID NO: 2441390 - RNA, 12 nt, Human
ccagacccccug

SEQ ID NO: 2441391 - RNA, 16 nt, Human
ccagacccccuggaga

SEQ ID NO: 2441392 - RNA, 14 nt, Human
ccagacccccaccc

SEQ ID NO: 2441393 - RNA, 15 nt, Human
ccagacccccacccc

SEQ ID NO: 2441394 - RNA, 16 nt, Human
ccagacccccaccccu

SEQ ID NO: 2441395 - RNA, 19 nt, Human
ccagacccccaccccuucc

SEQ ID NO: 2441396 - RNA, 21 nt, Human
ccagacccccaccccuucccc

SEQ ID NO: 2441397 - RNA, 22 nt, Human
ccagacccccaccccuucccca

SEQ ID NO: 2441398 - RNA, 14 nt, Human
ccagacccccagca

SEQ ID NO: 2441399 - RNA, 19 nt, Human
ccagacccccagcaacccu

SEQ ID NO: 2441400 - RNA, 19 nt, Human
ccagagcugccaccugccu

SEQ ID NO: 2441401 - RNA, 16 nt, Human
ccagagcugccaccug

SEQ ID NO: 2441402 - RNA, 15 nt, Human
ccagagcugccaccu

SEQ ID NO: 2441403 - RNA, 14 nt, Human
ccagagcugccacc

SEQ ID NO: 2441404 - RNA, 14 nt, Human
ccagagcugggagg

SEQ ID NO: 2441405 - RNA, 21 nt, Human
ccagagcugggaggcauggcc

SEQ ID NO: 2441406 - RNA, 19 nt, Human
ccagagcuguuuauggccu

SEQ ID NO: 2441407 - RNA, 20 nt, Human
ccagagcuguuuauggccuc

SEQ ID NO: 2441408 - RNA, 21 nt, Human
ccagagcuguuuauggccuca

SEQ ID NO: 2441409 - RNA, 23 nt, Human
ccagaggaacuguccagagagca

SEQ ID NO: 2441410 - RNA, 22 nt, Human
ccagaggaacuguccagagagc

SEQ ID NO: 2441411 - RNA, 21 nt, Human
ccagaggaacuguccagagag

SEQ ID NO: 2441412 - RNA, 20 nt, Human
ccagaggaacuguccagaga

SEQ ID NO: 2441413 - RNA, 17 nt, Human
ccagaggaaggggccag

SEQ ID NO: 2441414 - RNA, 19 nt, Human
ccagaggaaggggccagag

SEQ ID NO: 2441415 - RNA, 22 nt, Human
ccagagcuguuuauggccucag

SEQ ID NO: 2441416 - RNA, 23 nt, Human
ccagagcuguuuauggccucagc

SEQ ID NO: 2441417 - RNA, 19 nt, Human
ccagaggaacuguccagag

SEQ ID NO: 2441418 - RNA, 14 nt, Human
ccagaggaacuguc

SEQ ID NO: 2441419 - RNA, 24 nt, Human
ccagagcuguuuauggccucagcu

SEQ ID NO: 2441420 - RNA, 20 nt, Human
ccagagauccaaaagaagcc

SEQ ID NO: 2441421 - RNA, 22 nt, Human
ccagacccccagcaacccuccu

SEQ ID NO: 2441422 - RNA, 17 nt, Human
ccagaccccucuggcca

SEQ ID NO: 2441423 - RNA, 13 nt, Human
ccagagauccaaa

SEQ ID NO: 2441424 - RNA, 14 nt, Human
ccagagaugccucc

SEQ ID NO: 2441425 - RNA, 15 nt, Human
ccagagaugccucca

SEQ ID NO: 2441426 - RNA, 16 nt, Human
ccagagaugccuccac

SEQ ID NO: 2441427 - RNA, 17 nt, Human
ccagagaugccuccacc

SEQ ID NO: 2441428 - RNA, 18 nt, Human
ccagagaugccuccaccg

SEQ ID NO: 2441429 - RNA, 20 nt, Human
ccagagaugccuccaccgcu

SEQ ID NO: 2441430 - RNA, 23 nt, Human
ccagagaugccuccaccgcugcc

SEQ ID NO: 2441431 - RNA, 22 nt, Human
ccagagauggagguucucucgg

SEQ ID NO: 2441432 - RNA, 16 nt, Human
ccagagaugggacugg

SEQ ID NO: 2441433 - RNA, 21 nt, Human
ccagagaugggacugggaggg

SEQ ID NO: 2441434 - RNA, 22 nt, Human
ccagagaugggacugggagggc

SEQ ID NO: 2441435 - RNA, 12 nt, Human
ccagagcacugg

SEQ ID NO: 2441436 - RNA, 13 nt, Human
ccagagcaaaaua

SEQ ID NO: 2441437 - RNA, 23 nt, Human
ccagagaugggacugggagggcc

SEQ ID NO: 2441438 - RNA, 19 nt, Human
ccagagcacagaucuguuu

SEQ ID NO: 2441439 - RNA, 13 nt, Human
ccagagcugccac

SEQ ID NO: 2441440 - RNA, 12 nt, Human
ccagagcugcca

SEQ ID NO: 2441441 - RNA, 11 nt, Human
ccagagcugcc

SEQ ID NO: 2441442 - RNA, 21 nt, Human
ccagagcuacccgcagaguuc

SEQ ID NO: 2441443 - RNA, 20 nt, Human
ccagagcuacccgcagaguu

SEQ ID NO: 2441444 - RNA, 21 nt, Human
ccagagggagugacagaggca

SEQ ID NO: 2441445 - RNA, 20 nt, Human
ccagagggagugacagaggc

SEQ ID NO: 2441446 - RNA, 19 nt, Human
ccagagggagugacagagg

SEQ ID NO: 2441447 - RNA, 18 nt, Human
ccagagggagugacagag

SEQ ID NO: 2441448 - RNA, 21 nt, Human
ccagaggcccccagcccaggg

SEQ ID NO: 2441449 - RNA, 19 nt, Human
ccagaggcccccagcccag

SEQ ID NO: 2441450 - RNA, 22 nt, Human
ccagaggcccccagcccagggc

SEQ ID NO: 2441451 - RNA, 19 nt, Human
ccagaggcuauuauuuuca

SEQ ID NO: 2441452 - RNA, 15 nt, Human
ccagaggcuggguuc

SEQ ID NO: 2441453 - RNA, 12 nt, Human
ccagaggcuggg

SEQ ID NO: 2441454 - RNA, 14 nt, Human
ccagaggcugcaga

SEQ ID NO: 2441455 - RNA, 11 nt, Human
ccagaggcucg

SEQ ID NO: 2441456 - RNA, 17 nt, Human
ccagagggagugacaga

SEQ ID NO: 2441457 - RNA, 16 nt, Human
ccagagggagugacag

SEQ ID NO: 2441458 - RNA, 22 nt, Human
ccagaggagggcagcagaaggg

SEQ ID NO: 2441459 - RNA, 12 nt, Human
ccagaggagggc

SEQ ID NO: 2441460 - RNA, 21 nt, Human
ccagaggauugcugccccauc

SEQ ID NO: 2441461 - RNA, 18 nt, Human
ccagaggcccccagccca

SEQ ID NO: 2441462 - RNA, 15 nt, Human
ccagaggcccccagc

SEQ ID NO: 2441463 - RNA, 14 nt, Human
ccagaggcccccag

SEQ ID NO: 2441464 - RNA, 22 nt, Human
ccagaggaaggggccagaggcu

SEQ ID NO: 2441465 - RNA, 21 nt, Human
ccagaggagagaggacccccu

SEQ ID NO: 2441466 - RNA, 22 nt, Human
ccagaggagagaggacccccug

SEQ ID NO: 2441467 - RNA, 13 nt, Human
ccagaggagacau

SEQ ID NO: 2441468 - RNA, 16 nt, Human
ccacaccucugccaga

SEQ ID NO: 2441469 - RNA, 15 nt, Human
ccacaccucugccag

SEQ ID NO: 2441470 - RNA, 12 nt, Human
ccacaccugagc

SEQ ID NO: 2441471 - RNA, 13 nt, Human
ccacacuccagcu

SEQ ID NO: 2441472 - RNA, 14 nt, Human
ccacacuccagcug

SEQ ID NO: 2441473 - RNA, 17 nt, Human
ccacacuccagcuggga

SEQ ID NO: 2441474 - RNA, 14 nt, Human
ccacaccucugcca

SEQ ID NO: 2441475 - RNA, 16 nt, Human
ccacaccucccugaac

SEQ ID NO: 2441476 - RNA, 17 nt, Human
ccacaccucccugaacc

SEQ ID NO: 2441477 - RNA, 14 nt, Human
ccacaccuccacag

SEQ ID NO: 2441478 - RNA, 13 nt, Human
ccacaccuccaca

SEQ ID NO: 2441479 - RNA, 22 nt, Human
ccacaccucaguucccuuggcc

SEQ ID NO: 2441480 - RNA, 17 nt, Human
ccacaccuccacaguuc

SEQ ID NO: 2441481 - RNA, 15 nt, Human
ccacaccuccacagu

SEQ ID NO: 2441482 - RNA, 23 nt, Human
ccacaccuccacaguucaguggc

SEQ ID NO: 2441483 - RNA, 14 nt, Human
ccacaccucccuga

SEQ ID NO: 2441484 - RNA, 14 nt, Human
ccacacccagccca

SEQ ID NO: 2441485 - RNA, 13 nt, Human
ccacacccagccc

SEQ ID NO: 2441486 - RNA, 14 nt, Human
ccacacacucgccc

SEQ ID NO: 2441487 - RNA, 23 nt, Human
ccacacccuguacuguucugugu

SEQ ID NO: 2441488 - RNA, 14 nt, Human
ccacaccgcagaag

SEQ ID NO: 2441489 - RNA, 20 nt, Human
ccacaccguguaaaccaaag

SEQ ID NO: 2441490 - RNA, 18 nt, Human
ccacaccguguaaaccaa

SEQ ID NO: 2441491 - RNA, 16 nt, Human
ccacaccguguaaacc

SEQ ID NO: 2441492 - RNA, 15 nt, Human
ccacaccgcagaagc

SEQ ID NO: 2441493 - RNA, 18 nt, Human
ccacaccucaguucccuu

SEQ ID NO: 2441494 - RNA, 19 nt, Human
ccacaccucaguucccuug

SEQ ID NO: 2441495 - RNA, 18 nt, Human
ccacacacacagaaaaua

SEQ ID NO: 2441496 - RNA, 19 nt, Human
ccacacacacagaaaauau

SEQ ID NO: 2441497 - RNA, 20 nt, Human
ccacacacacagaaaauaua

SEQ ID NO: 2441498 - RNA, 21 nt, Human
ccacacacacagaaaauauac

SEQ ID NO: 2441499 - RNA, 17 nt, Human
ccacacacacagaaaau

SEQ ID NO: 2441500 - RNA, 14 nt, Human
ccaaacccugucug

SEQ ID NO: 2441501 - RNA, 16 nt, Human
ccaaaccaccuucccu

SEQ ID NO: 2441502 - RNA, 14 nt, Human
ccaaaccaccuucc

SEQ ID NO: 2441503 - RNA, 20 nt, Human
ccaaaccaccagaagcccag

SEQ ID NO: 2441504 - RNA, 16 nt, Human
ccaaacccaugaggca

SEQ ID NO: 2441505 - RNA, 22 nt, Human
ccacacacacagaaaauauacu

SEQ ID NO: 2441506 - RNA, 23 nt, Human
ccacacacacagaaaauauacug

SEQ ID NO: 2441507 - RNA, 23 nt, Human
ccacacacacccacacacucgcc

SEQ ID NO: 2441508 - RNA, 16 nt, Human
ccacacacacccacac

SEQ ID NO: 2441509 - RNA, 12 nt, Human
ccacacacagag

SEQ ID NO: 2441510 - RNA, 16 nt, Human
ccacacacagaggaag

SEQ ID NO: 2441511 - RNA, 17 nt, Human
ccacacacagaggaaga

SEQ ID NO: 2441512 - RNA, 18 nt, Human
ccacacacagaggaagag

SEQ ID NO: 2441513 - RNA, 19 nt, Human
ccacacacagcugggcugu

SEQ ID NO: 2441514 - RNA, 22 nt, Human
ccacacacagaggaagagcagg

SEQ ID NO: 2441515 - RNA, 20 nt, Human
ccacacacagcugggcugug

SEQ ID NO: 2441516 - RNA, 12 nt, Human
ccacacacccca

SEQ ID NO: 2441517 - RNA, 12 nt, Human
ccacacccagcc

SEQ ID NO: 2441518 - RNA, 15 nt, Human
ccacacacucgcccg

SEQ ID NO: 2441519 - RNA, 23 nt, Human
ccacacacgcaggaacucccagc

SEQ ID NO: 2441520 - RNA, 22 nt, Human
ccacacacgcaggaacucccag

SEQ ID NO: 2441521 - RNA, 18 nt, Human
ccacacacgcaggaacuc

SEQ ID NO: 2441522 - RNA, 15 nt, Human
ccacacacgcaggaa

SEQ ID NO: 2441523 - RNA, 13 nt, Human
ccacacaccccaa

SEQ ID NO: 2441524 - RNA, 21 nt, Human
ccacccaagggccuggccuga

SEQ ID NO: 2441525 - RNA, 20 nt, Human
ccacccaagggccuggccug

SEQ ID NO: 2441526 - RNA, 22 nt, Human
ccacccaagggccuggccugag

SEQ ID NO: 2441527 - RNA, 13 nt, Human
ccacccaccucag

SEQ ID NO: 2441528 - RNA, 15 nt, Human
ccacccaccucagcc

SEQ ID NO: 2441529 - RNA, 14 nt, Human
ccacccaccucagc

SEQ ID NO: 2441530 - RNA, 16 nt, Human
ccacccaccucagccu

SEQ ID NO: 2441531 - RNA, 15 nt, Human
ccacccacuucccug

SEQ ID NO: 2441532 - RNA, 19 nt, Human
ccacccaccucccugccuc

SEQ ID NO: 2441533 - RNA, 15 nt, Human
ccacccaaugcugau

SEQ ID NO: 2441534 - RNA, 17 nt, Human
ccacccaccucccugcc

SEQ ID NO: 2441535 - RNA, 15 nt, Human
ccacccaccagggcg

SEQ ID NO: 2441536 - RNA, 19 nt, Human
ccacccaagggccuggccu

SEQ ID NO: 2441537 - RNA, 17 nt, Human
ccacccaagggccuggc

SEQ ID NO: 2441538 - RNA, 17 nt, Human
ccaccaaggucuucagc

SEQ ID NO: 2441539 - RNA, 11 nt, Human
ccaccaagggc

SEQ ID NO: 2441540 - RNA, 21 nt, Human
ccacccaagcuuggcagccga

SEQ ID NO: 2441541 - RNA, 11 nt, Human
ccaccaagguc

SEQ ID NO: 2441542 - RNA, 16 nt, Human
ccacccaagcuuggca

SEQ ID NO: 2441543 - RNA, 16 nt, Human
ccacccaagggccugg

SEQ ID NO: 2441544 - RNA, 22 nt, Human
ccaccaagccuggucagcccaa

SEQ ID NO: 2441545 - RNA, 21 nt, Human
ccaccaagccuggucagccca

SEQ ID NO: 2441546 - RNA, 20 nt, Human
ccaccaacauacucccaucu

SEQ ID NO: 2441547 - RNA, 16 nt, Human
ccaccacacccagccc

SEQ ID NO: 2441548 - RNA, 14 nt, Human
ccaccacacccagc

SEQ ID NO: 2441549 - RNA, 18 nt, Human
ccaccaacauacucccau

SEQ ID NO: 2441550 - RNA, 14 nt, Human
ccaccaacauacuc

SEQ ID NO: 2441551 - RNA, 19 nt, Human
ccacaugagucccaguggg

SEQ ID NO: 2441552 - RNA, 17 nt, Human
ccacaugagucccagug

SEQ ID NO: 2441553 - RNA, 13 nt, Human
ccacaugaguccc

SEQ ID NO: 2441554 - RNA, 23 nt, Human
ccacaugagucccagugggaggc

SEQ ID NO: 2441555 - RNA, 22 nt, Human
ccacaugagucccagugggagg

SEQ ID NO: 2441556 - RNA, 19 nt, Human
ccacaugccaagcacugug

SEQ ID NO: 2441557 - RNA, 20 nt, Human
ccaccaaaggccagggucac

SEQ ID NO: 2441558 - RNA, 23 nt, Human
ccacaucuugcucugcugacaga

SEQ ID NO: 2441559 - RNA, 22 nt, Human
ccacaucuugcucugcugacag

SEQ ID NO: 2441560 - RNA, 20 nt, Human
ccacaucuugcucugcugac

SEQ ID NO: 2441561 - RNA, 16 nt, Human
ccacaucuugcucugc

SEQ ID NO: 2441562 - RNA, 19 nt, Human
ccacacugauccagcccug

SEQ ID NO: 2441563 - RNA, 22 nt, Human
ccacacugauccagcccugagu

SEQ ID NO: 2441564 - RNA, 23 nt, Human
ccacacugcuaggugggccagcc

SEQ ID NO: 2441565 - RNA, 22 nt, Human
ccacauagugaugguuccccug

SEQ ID NO: 2441566 - RNA, 21 nt, Human
ccacauagugaugguuccccu

SEQ ID NO: 2441567 - RNA, 19 nt, Human
ccacauagugaugguuccc

SEQ ID NO: 2441568 - RNA, 14 nt, Human
ccacacuggacucc

SEQ ID NO: 2441569 - RNA, 13 nt, Human
ccacacuggacuc

SEQ ID NO: 2441570 - RNA, 23 nt, Human
ccacaucugccuuaaaaccaaag

SEQ ID NO: 2441571 - RNA, 22 nt, Human
ccacaucugccuuaaaaccaaa

SEQ ID NO: 2441572 - RNA, 14 nt, Human
ccacaucugccuua

SEQ ID NO: 2441573 - RNA, 13 nt, Human
ccacaucugccuu

SEQ ID NO: 2441574 - RNA, 23 nt, Human
ccacaucuugaucugcucagccc

SEQ ID NO: 2441575 - RNA, 22 nt, Human
ccacaucuugaucugcucagcc

SEQ ID NO: 2441576 - RNA, 20 nt, Human
ccacaucuugaucugcucag

SEQ ID NO: 2441577 - RNA, 14 nt, Human
ccacaucuugcucu

SEQ ID NO: 2441578 - RNA, 12 nt, Human
ccacaucugccu

SEQ ID NO: 2441579 - RNA, 19 nt, Human
ccacaucuacguuuuuggu

SEQ ID NO: 2441580 - RNA, 20 nt, Human
ccacauccacacacgcagga

SEQ ID NO: 2441581 - RNA, 14 nt, Human
ccacaucuacguuu

SEQ ID NO: 2441582 - RNA, 15 nt, Human
ccacauccacacacg

SEQ ID NO: 2441583 - RNA, 22 nt, Human
ccacaucaauauugucauuccu

SEQ ID NO: 2441584 - RNA, 23 nt, Human
ccacauagugaugguuccccugu

SEQ ID NO: 2441585 - RNA, 14 nt, Human
ccacaucaaagagg

SEQ ID NO: 2441586 - RNA, 14 nt, Human
ccacccaggagccc

SEQ ID NO: 2441587 - RNA, 16 nt, Human
ccaccccgccugcccu

SEQ ID NO: 2441588 - RNA, 20 nt, Human
ccacccccuucucugcucca

SEQ ID NO: 2441589 - RNA, 23 nt, Human
ccacccccuucucugcuccacca

SEQ ID NO: 2441590 - RNA, 12 nt, Human
ccacccaggagc

SEQ ID NO: 2441591 - RNA, 11 nt, Human
ccacccagccc

SEQ ID NO: 2441592 - RNA, 12 nt, Human
ccacccagccca

SEQ ID NO: 2441593 - RNA, 13 nt, Human
ccacccagcccau

SEQ ID NO: 2441594 - RNA, 22 nt, Human
ccacccagcccauucucucucc

SEQ ID NO: 2441595 - RNA, 15 nt, Human
ccaccucagccuccc

SEQ ID NO: 2441596 - RNA, 14 nt, Human
ccaccuccagaaac

SEQ ID NO: 2441597 - RNA, 16 nt, Human
ccaccucagccuccug

SEQ ID NO: 2441598 - RNA, 10 nt, Human
ccaccucagc

SEQ ID NO: 2441599 - RNA, 14 nt, Human
ccaccucagccuug

SEQ ID NO: 2441600 - RNA, 15 nt, Human
ccaccucagccuugg

SEQ ID NO: 2441601 - RNA, 14 nt, Human
ccaccucagccucc

SEQ ID NO: 2441602 - RNA, 13 nt, Human
ccaccucagccuc

SEQ ID NO: 2441603 - RNA, 12 nt, Human
ccaccucagccu

SEQ ID NO: 2441604 - RNA, 18 nt, Human
ccacccugaaagcccuga

SEQ ID NO: 2441605 - RNA, 16 nt, Human
ccacccugaaagcccu

SEQ ID NO: 2441606 - RNA, 17 nt, Human
ccacccugaaagcccug

SEQ ID NO: 2441607 - RNA, 17 nt, Human
ccacccgaugcugcuuu

SEQ ID NO: 2441608 - RNA, 16 nt, Human
ccacccgaugcugcuu

SEQ ID NO: 2441609 - RNA, 14 nt, Human
ccacccgaugcugc

SEQ ID NO: 2441610 - RNA, 20 nt, Human
ccaccccuugcucucaaccc

SEQ ID NO: 2441611 - RNA, 15 nt, Human
ccacccguggagaug

SEQ ID NO: 2441612 - RNA, 20 nt, Human
ccaccccguagauucccauc

SEQ ID NO: 2441613 - RNA, 13 nt, Human
ccacccgaugcug

SEQ ID NO: 2441614 - RNA, 19 nt, Human
ccaccccucaacaccucug

SEQ ID NO: 2441615 - RNA, 15 nt, Human
ccaccccgcucugca

SEQ ID NO: 2441616 - RNA, 16 nt, Human
ccaccccgcucugcau

SEQ ID NO: 2441617 - RNA, 14 nt, Human
ccaccccgggcucu

SEQ ID NO: 2441618 - RNA, 17 nt, Human
ccaccccgggcucucug

SEQ ID NO: 2441619 - RNA, 21 nt, Human
ccaccccggggacccugugac

SEQ ID NO: 2441620 - RNA, 20 nt, Human
ccaccccggggacccuguga

SEQ ID NO: 2441621 - RNA, 19 nt, Human
ccaccccggggacccugug

SEQ ID NO: 2441622 - RNA, 18 nt, Human
ccaccccggggacccugu

SEQ ID NO: 2441623 - RNA, 18 nt, Human
ccaccccgggcucucugc

SEQ ID NO: 2441624 - RNA, 20 nt, Human
ccaccccgggcucucugcug

SEQ ID NO: 2441625 - RNA, 19 nt, Human
ccacccucagcaccccuuc

SEQ ID NO: 2441626 - RNA, 13 nt, Human
ccacccucagcac

SEQ ID NO: 2441627 - RNA, 12 nt, Human
ccacccuaccug

SEQ ID NO: 2441628 - RNA, 22 nt, Human
ccacccuaccuguucagugucc

SEQ ID NO: 2441629 - RNA, 22 nt, Human
ccacccguucugcuggccugga

SEQ ID NO: 2441630 - RNA, 21 nt, Human
ccacccguucugcuggccugg

SEQ ID NO: 2441631 - RNA, 19 nt, Human
ccacccguucugcuggccu

SEQ ID NO: 2441632 - RNA, 15 nt, Human
ccacccucccuggag

SEQ ID NO: 2441633 - RNA, 13 nt, Human
ccacccucccugg

SEQ ID NO: 2441634 - RNA, 20 nt, Human
ccacccucugagcuuugcau

SEQ ID NO: 2441635 - RNA, 23 nt, Human
ccacccucugagcuuugcauguu

SEQ ID NO: 2441636 - RNA, 15 nt, Human
ccacccuccacucuc

SEQ ID NO: 2441637 - RNA, 22 nt, Human
ccacccucccagaccugccucu

SEQ ID NO: 2441638 - RNA, 17 nt, Human
ccacccucagcaccccu

SEQ ID NO: 2441639 - RNA, 21 nt, Human
ccacccuccccucucuugcac

SEQ ID NO: 2441640 - RNA, 15 nt, Human
ccacccuccccucuc

SEQ ID NO: 2441641 - RNA, 20 nt, Human
ccaccugccuguugggccag

SEQ ID NO: 2441642 - RNA, 17 nt, Human
ccaccugccuguugggc

SEQ ID NO: 2441643 - RNA, 20 nt, Human
ccaccugcccaucacagggu

SEQ ID NO: 2441644 - RNA, 23 nt, Human
ccaccugcccaucacaggguugg

SEQ ID NO: 2441645 - RNA, 12 nt, Human
ccaccugccccc

SEQ ID NO: 2441646 - RNA, 18 nt, Human
ccaccugcccccuucucc

SEQ ID NO: 2441647 - RNA, 20 nt, Human
ccaccugcccccuucuccca

SEQ ID NO: 2441648 - RNA, 16 nt, Human
ccaccugccagggaca

SEQ ID NO: 2441649 - RNA, 20 nt, Human
ccaccugaggugggcccagg

SEQ ID NO: 2441650 - RNA, 16 nt, Human
ccaccugaggugggcc

SEQ ID NO: 2441651 - RNA, 15 nt, Human
ccaccugaggugggc

SEQ ID NO: 2441652 - RNA, 15 nt, Human
ccaccucccucacca

SEQ ID NO: 2441653 - RNA, 22 nt, Human
ccaccugaggugggcccaggac

SEQ ID NO: 2441654 - RNA, 21 nt, Human
ccaccugaggugggcccagga

SEQ ID NO: 2441655 - RNA, 14 nt, Human
ccaccugcccaacc

SEQ ID NO: 2441656 - RNA, 14 nt, Human
ccaccugcccauca

SEQ ID NO: 2441657 - RNA, 15 nt, Human
ccaccugcccaucac

SEQ ID NO: 2441658 - RNA, 16 nt, Human
ccaccugcccaucaca

SEQ ID NO: 2441659 - RNA, 13 nt, Human
ccaccucccucac

SEQ ID NO: 2441660 - RNA, 14 nt, Human
ccaccugagguggg

SEQ ID NO: 2441661 - RNA, 17 nt, Human
ccaccucccacaaagga

SEQ ID NO: 2441662 - RNA, 18 nt, Human
ccaccuccccacgcccuc

SEQ ID NO: 2441663 - RNA, 17 nt, Human
ccaccuccccacgcccu

SEQ ID NO: 2441664 - RNA, 13 nt, Human
ccaccuccccacg

SEQ ID NO: 2441665 - RNA, 12 nt, Human
ccaccuccccac

SEQ ID NO: 2441666 - RNA, 20 nt, Human
ccaccuccaucuucuuugca

SEQ ID NO: 2441667 - RNA, 13 nt, Human
ccaccuccagaaa

SEQ ID NO: 2441668 - RNA, 16 nt, Human
ccaccucagccuugga

SEQ ID NO: 2441669 - RNA, 19 nt, Human
ccaccuccccuauccaccc

SEQ ID NO: 2441670 - RNA, 22 nt, Human
ccaccuccccuauccacccagc

SEQ ID NO: 2441671 - RNA, 20 nt, Human
ccaccucccccucccccuuc

SEQ ID NO: 2441672 - RNA, 17 nt, Human
ccaccuccccuauccac

SEQ ID NO: 2441673 - RNA, 23 nt, Human
ccaccuccccaggccguggcugc

SEQ ID NO: 2441674 - RNA, 16 nt, Human
ccaccuccccaggccg

SEQ ID NO: 2441675 - RNA, 23 nt, Human
ccaccuccccacgcccuccccuc

SEQ ID NO: 2441676 - RNA, 15 nt, Human
ccaccuccccagccu

SEQ ID NO: 2441677 - RNA, 13 nt, Human
ccaccuccccagg

SEQ ID NO: 2441678 - RNA, 14 nt, Human
ccaccuggccucug

SEQ ID NO: 2441679 - RNA, 17 nt, Human
ccaccuggccucugcac

SEQ ID NO: 2441680 - RNA, 20 nt, Human
ccacggacguuuccaucagg

SEQ ID NO: 2441681 - RNA, 19 nt, Human
ccacggacguuuccaucag

SEQ ID NO: 2441682 - RNA, 12 nt, Human
ccacggagccac

SEQ ID NO: 2441683 - RNA, 18 nt, Human
ccacggacguuuccauca

SEQ ID NO: 2441684 - RNA, 15 nt, Human
ccacgcuucucuuug

SEQ ID NO: 2441685 - RNA, 23 nt, Human
ccaccucuucucuuccuguaaca

SEQ ID NO: 2441686 - RNA, 14 nt, Human
ccacgcugucucca

SEQ ID NO: 2441687 - RNA, 15 nt, Human
ccacgcugucuccag

SEQ ID NO: 2441688 - RNA, 18 nt, Human
ccacgcugucuccagacc

SEQ ID NO: 2441689 - RNA, 19 nt, Human
ccacgcugucuccagaccc

SEQ ID NO: 2441690 - RNA, 21 nt, Human
ccacgcugucuccagaccccc

SEQ ID NO: 2441691 - RNA, 13 nt, Human
ccacgcuucucuu

SEQ ID NO: 2441692 - RNA, 20 nt, Human
ccacgcugucuccagacccc

SEQ ID NO: 2441693 - RNA, 16 nt, Human
ccaccuggccucugca

SEQ ID NO: 2441694 - RNA, 15 nt, Human
ccaccuggccucugc

SEQ ID NO: 2441695 - RNA, 22 nt, Human
ccaccugcggugcuaucucccc

SEQ ID NO: 2441696 - RNA, 14 nt, Human
ccaccugcucccag

SEQ ID NO: 2441697 - RNA, 15 nt, Human
ccaccugcucccagg

SEQ ID NO: 2441698 - RNA, 23 nt, Human
ccaccugcccccuucucccacac

SEQ ID NO: 2441699 - RNA, 21 nt, Human
ccaccugcccccuucucccac

SEQ ID NO: 2441700 - RNA, 22 nt, Human
ccaccugcccccuucucccaca

SEQ ID NO: 2441701 - RNA, 14 nt, Human
ccacggccaggcca

SEQ ID NO: 2441702 - RNA, 13 nt, Human
ccacggccaggcc

SEQ ID NO: 2441703 - RNA, 13 nt, Human
ccacggccacugg

SEQ ID NO: 2441704 - RNA, 17 nt, Human
ccacggacuccagucug

SEQ ID NO: 2441705 - RNA, 20 nt, Human
ccacggagccacuccucuga

SEQ ID NO: 2441706 - RNA, 21 nt, Human
ccacggagccacuccucugac

SEQ ID NO: 2441707 - RNA, 12 nt, Human
ccacggccaggc

SEQ ID NO: 2441708 - RNA, 19 nt, Human
ccacguccugucagugccg

SEQ ID NO: 2441709 - RNA, 18 nt, Human
ccacguccugucagugcc

SEQ ID NO: 2441710 - RNA, 16 nt, Human
ccacggccacuggcca

SEQ ID NO: 2441711 - RNA, 22 nt, Human
ccacgucugcgccgccgccgga

SEQ ID NO: 2441712 - RNA, 17 nt, Human
ccacgucugucuucaca

SEQ ID NO: 2441713 - RNA, 15 nt, Human
ccacggccaggccag

SEQ ID NO: 2441714 - RNA, 20 nt, Human
ccacgucugcuaacuuggag

SEQ ID NO: 2441715 - RNA, 17 nt, Human
ccacgugacagugccug

SEQ ID NO: 2441716 - RNA, 14 nt, Human
ccacgugccaggcc

SEQ ID NO: 2441717 - RNA, 15 nt, Human
ccacgugccaggccc

SEQ ID NO: 2441718 - RNA, 15 nt, Human
ccacgugcuaccccc

SEQ ID NO: 2441719 - RNA, 16 nt, Human
ccacgugccaggcccg

SEQ ID NO: 2441720 - RNA, 23 nt, Human
ccacgugccaggcccggggcugg

SEQ ID NO: 2441721 - RNA, 17 nt, Human
ccacguucaccccucca

SEQ ID NO: 2441722 - RNA, 15 nt, Human
ccacguucaccccuc

SEQ ID NO: 2441723 - RNA, 22 nt, Human
ccacguguaacugucagccggg

SEQ ID NO: 2441724 - RNA, 14 nt, Human
ccacguucaccccu

SEQ ID NO: 2441725 - RNA, 20 nt, Human
ccacguuggagaagcccgug

SEQ ID NO: 2441726 - RNA, 23 nt, Human
ccacguucugcucaucauucucu

SEQ ID NO: 2441727 - RNA, 21 nt, Human
ccacguuggagaagcccgugu

SEQ ID NO: 2441728 - RNA, 20 nt, Human
ccacuaacuagagcagcccu

SEQ ID NO: 2441729 - RNA, 11 nt, Human
ccacuaacuag

SEQ ID NO: 2441730 - RNA, 22 nt, Human
ccacuaaaagaucgcaguuugc

SEQ ID NO: 2441731 - RNA, 13 nt, Human
ccacguuucuaaa

SEQ ID NO: 2441732 - RNA, 15 nt, Human
ccacguuccuuacug

SEQ ID NO: 2441733 - RNA, 20 nt, Human
ccacguuccuuacugcagaa

SEQ ID NO: 2441734 - RNA, 19 nt, Human
ccacguucucacacccacc

SEQ ID NO: 2441735 - RNA, 17 nt, Human
ccacguucucacaccca

SEQ ID NO: 2441736 - RNA, 16 nt, Human
ccacguucucacaccc

SEQ ID NO: 2441737 - RNA, 21 nt, Human
ccacguuccuuacugcagaau

SEQ ID NO: 2441738 - RNA, 18 nt, Human
ccacucaguccauagcag

SEQ ID NO: 2441739 - RNA, 22 nt, Human
ccacucacuaggcccccacuug

SEQ ID NO: 2441740 - RNA, 12 nt, Human
ccacucaccccg

SEQ ID NO: 2441741 - RNA, 11 nt, Human
ccacucacccc

SEQ ID NO: 2441742 - RNA, 16 nt, Human
ccacucaccagugucc

SEQ ID NO: 2441743 - RNA, 23 nt, Human
ccacucacacagccaggugccuu

SEQ ID NO: 2441744 - RNA, 22 nt, Human
ccacucacgaauauuaugccca

SEQ ID NO: 2441745 - RNA, 13 nt, Human
ccacucaccccgg

SEQ ID NO: 2441746 - RNA, 18 nt, Human
ccacucacuaggccccca

SEQ ID NO: 2441747 - RNA, 22 nt, Human
ccacucacacagccaggugccu

SEQ ID NO: 2441748 - RNA, 21 nt, Human
ccacucacacagccaggugcc

SEQ ID NO: 2441749 - RNA, 18 nt, Human
ccacucacacagccaggu

SEQ ID NO: 2441750 - RNA, 17 nt, Human
ccacucacacagccagg

SEQ ID NO: 2441751 - RNA, 16 nt, Human
ccacucacacagccag

SEQ ID NO: 2441752 - RNA, 15 nt, Human
ccacucacacagcca

SEQ ID NO: 2441753 - RNA, 14 nt, Human
ccacucacacagcc

SEQ ID NO: 2441754 - RNA, 18 nt, Human
ccacucaagccaagcagc

SEQ ID NO: 2441755 - RNA, 13 nt, Human
ccacucccugcaa

SEQ ID NO: 2441756 - RNA, 12 nt, Human
ccacucccugca

SEQ ID NO: 2441757 - RNA, 16 nt, Human
ccacuccccaccuuca

SEQ ID NO: 2441758 - RNA, 19 nt, Human
ccacuccagaccccuggcu

SEQ ID NO: 2441759 - RNA, 17 nt, Human
ccacuccagaccccugg

SEQ ID NO: 2441760 - RNA, 18 nt, Human
ccacuacauucuguuaau

SEQ ID NO: 2441761 - RNA, 22 nt, Human
ccacuacggaauaguuggcuag

SEQ ID NO: 2441762 - RNA, 21 nt, Human
ccacuaagaauucaaacuggg

SEQ ID NO: 2441763 - RNA, 22 nt, Human
ccacuaacuagagcagcccugg

SEQ ID NO: 2441764 - RNA, 13 nt, Human
ccacuaagcagag

SEQ ID NO: 2441765 - RNA, 16 nt, Human
ccacuacucaaaaauu

SEQ ID NO: 2441766 - RNA, 14 nt, Human
ccacuaagcagagg

SEQ ID NO: 2441767 - RNA, 16 nt, Human
ccacuaagcagaggag

SEQ ID NO: 2441768 - RNA, 23 nt, Human
ccacuacggaauaguuggcuagg

SEQ ID NO: 2441769 - RNA, 12 nt, Human
ccacucaagcca

SEQ ID NO: 2441770 - RNA, 16 nt, Human
ccacucaagccaagca

SEQ ID NO: 2441771 - RNA, 17 nt, Human
ccacucaagccaagcag

SEQ ID NO: 2441772 - RNA, 13 nt, Human
ccacucacacagc

SEQ ID NO: 2441773 - RNA, 20 nt, Human
ccacucaaauuaaucuuucu

SEQ ID NO: 2441774 - RNA, 16 nt, Human
ccacugccauaaaaca

SEQ ID NO: 2441775 - RNA, 19 nt, Human
ccacugcccacccccucaa

SEQ ID NO: 2441776 - RNA, 16 nt, Human
ccacugcccacccccu

SEQ ID NO: 2441777 - RNA, 15 nt, Human
ccacugcccaccccc

SEQ ID NO: 2441778 - RNA, 21 nt, Human
ccacugcacuccagccugggc

SEQ ID NO: 2441779 - RNA, 15 nt, Human
ccacugcccgagcug

SEQ ID NO: 2441780 - RNA, 16 nt, Human
ccacugcccgagcugg

SEQ ID NO: 2441781 - RNA, 17 nt, Human
ccacugcccgagcuggu

SEQ ID NO: 2441782 - RNA, 18 nt, Human
ccacugcccgagcuggug

SEQ ID NO: 2441783 - RNA, 20 nt, Human
ccacugcccgagcuggugca

SEQ ID NO: 2441784 - RNA, 15 nt, Human
ccacugccucagguu

SEQ ID NO: 2441785 - RNA, 14 nt, Human
ccacugccucaggu

SEQ ID NO: 2441786 - RNA, 13 nt, Human
ccacugccucagg

SEQ ID NO: 2441787 - RNA, 16 nt, Human
ccacugccuacugcau

SEQ ID NO: 2441788 - RNA, 22 nt, Human
ccacugcccgagcuggugcauu

SEQ ID NO: 2441789 - RNA, 23 nt, Human
ccacugcccgagcuggugcauua

SEQ ID NO: 2441790 - RNA, 14 nt, Human
ccacugccuacugc

SEQ ID NO: 2441791 - RNA, 15 nt, Human
ccacucccugcaacc

SEQ ID NO: 2441792 - RNA, 18 nt, Human
ccacugcacuccagccug

SEQ ID NO: 2441793 - RNA, 19 nt, Human
ccacugcacuccagccugg

SEQ ID NO: 2441794 - RNA, 20 nt, Human
ccacugcacuccagccuggg

SEQ ID NO: 2441795 - RNA, 23 nt, Human
ccacugccuucgcuucuugccuc

SEQ ID NO: 2441796 - RNA, 22 nt, Human
ccacugccuucgcuucuugccu

SEQ ID NO: 2441797 - RNA, 14 nt, Human
ccacugccuuugac

SEQ ID NO: 2441798 - RNA, 22 nt, Human
ccacugccuuugaccugccucc

SEQ ID NO: 2441799 - RNA, 16 nt, Human
ccacugcgaccacaag

SEQ ID NO: 2441800 - RNA, 18 nt, Human
ccacugccuucgcuucuu

SEQ ID NO: 2441801 - RNA, 16 nt, Human
ccacugccuucgcuuc

SEQ ID NO: 2441802 - RNA, 15 nt, Human
ccacugccuucgcuu

SEQ ID NO: 2441803 - RNA, 14 nt, Human
ccacugccuucgcu

SEQ ID NO: 2441804 - RNA, 19 nt, Human
ccacugccucagguuccua

SEQ ID NO: 2441805 - RNA, 16 nt, Human
ccacugccucagguuc

SEQ ID NO: 2441806 - RNA, 11 nt, Human
ccacugccucu

SEQ ID NO: 2441807 - RNA, 11 nt, Human
ccacuggccau

SEQ ID NO: 2441808 - RNA, 20 nt, Human
ccacuggccaccaggcuggc

SEQ ID NO: 2441809 - RNA, 19 nt, Human
ccacuggccaccaggcugg

SEQ ID NO: 2441810 - RNA, 18 nt, Human
ccacuggccaccaggcug

SEQ ID NO: 2441811 - RNA, 17 nt, Human
ccacuggccaccaggcu

SEQ ID NO: 2441812 - RNA, 16 nt, Human
ccacuggccaccaggc

SEQ ID NO: 2441813 - RNA, 14 nt, Human
ccacuggccaccag

SEQ ID NO: 2441814 - RNA, 13 nt, Human
ccacuggccacca

SEQ ID NO: 2441815 - RNA, 11 nt, Human
ccacuggaggu

SEQ ID NO: 2441816 - RNA, 12 nt, Human
ccacuggccacc

SEQ ID NO: 2441817 - RNA, 11 nt, Human
ccacuggccac

SEQ ID NO: 2441818 - RNA, 22 nt, Human
ccacuggacuugagcuuggcag

SEQ ID NO: 2441819 - RNA, 20 nt, Human
ccacuggacuugagcuuggc

SEQ ID NO: 2441820 - RNA, 21 nt, Human
ccacuggacuugagcuuggca

SEQ ID NO: 2441821 - RNA, 13 nt, Human
ccacugcguuguc

SEQ ID NO: 2441822 - RNA, 16 nt, Human
ccacuggacuugagcu

SEQ ID NO: 2441823 - RNA, 12 nt, Human
ccuucagugccu

SEQ ID NO: 2441824 - RNA, 20 nt, Human
ccuguuaaaagaugaaaaua

SEQ ID NO: 2441825 - RNA, 21 nt, Human
ccuguuaaaagaugaaaauau

SEQ ID NO: 2441826 - RNA, 22 nt, Human
ccuguguugucucuagagcagg

SEQ ID NO: 2441827 - RNA, 20 nt, Human
ccuguguugucucuagagca

SEQ ID NO: 2441828 - RNA, 16 nt, Human
ccuguguugucucuag

SEQ ID NO: 2441829 - RNA, 21 nt, Human
ccugugugugaaaggaagcuc

SEQ ID NO: 2441830 - RNA, 15 nt, Human
ccuguuuaagagaca

SEQ ID NO: 2441831 - RNA, 12 nt, Human
ccuguuuaagag

SEQ ID NO: 2441832 - RNA, 23 nt, Human
ccuguugggccaggagccuccug

SEQ ID NO: 2441833 - RNA, 17 nt, Human
ccuguugguuccaagcc

SEQ ID NO: 2441834 - RNA, 13 nt, Human
ccuguugguucca

SEQ ID NO: 2441835 - RNA, 15 nt, Human
ccuguuacccagaga

SEQ ID NO: 2441836 - RNA, 13 nt, Human
ccuguguuucuag

SEQ ID NO: 2441837 - RNA, 14 nt, Human
ccuguuuguuucug

SEQ ID NO: 2441838 - RNA, 23 nt, Human
ccuguuugaagccugcccuuguc

SEQ ID NO: 2441839 - RNA, 18 nt, Human
ccuguuugaagccugccc

SEQ ID NO: 2441840 - RNA, 18 nt, Human
ccuguuuguuucugaaag

SEQ ID NO: 2441841 - RNA, 20 nt, Human
ccuguuuuagaagguucucu

SEQ ID NO: 2441842 - RNA, 21 nt, Human
ccuguuugggccccucuccca

SEQ ID NO: 2441843 - RNA, 13 nt, Human
ccuguuuucugag

SEQ ID NO: 2441844 - RNA, 19 nt, Human
ccuguuuuauacuguacuu

SEQ ID NO: 2441845 - RNA, 15 nt, Human
ccuguuuaauauuua

SEQ ID NO: 2441846 - RNA, 14 nt, Human
ccuguuuaauauuu

SEQ ID NO: 2441847 - RNA, 14 nt, Human
ccuguuuaaauauu

SEQ ID NO: 2441848 - RNA, 22 nt, Human
ccuguugguuccaagcccugga

SEQ ID NO: 2441849 - RNA, 21 nt, Human
ccuguugguuccaagcccugg

SEQ ID NO: 2441850 - RNA, 21 nt, Human
ccuguuuaauauuuaaacagc

SEQ ID NO: 2441851 - RNA, 16 nt, Human
ccuguuuaauauuuaa

SEQ ID NO: 2441852 - RNA, 16 nt, Human
ccuguuucugcagcca

SEQ ID NO: 2441853 - RNA, 12 nt, Human
ccuguuuccuga

SEQ ID NO: 2441854 - RNA, 13 nt, Human
ccuguguccaugc

SEQ ID NO: 2441855 - RNA, 12 nt, Human
ccuggugcucuc

SEQ ID NO: 2441856 - RNA, 9 nt, Human
ccuggugcu

SEQ ID NO: 2441857 - RNA, 17 nt, Human
ccuggugcucucugcca

SEQ ID NO: 2441858 - RNA, 16 nt, Human
ccuggugcucucugcc

SEQ ID NO: 2441859 - RNA, 15 nt, Human
ccuggugcucucugc

SEQ ID NO: 2441860 - RNA, 13 nt, Human
ccuggugcucucu

SEQ ID NO: 2441861 - RNA, 12 nt, Human
ccuguguacagg

SEQ ID NO: 2441862 - RNA, 19 nt, Human
ccuggugcucucugccacu

SEQ ID NO: 2441863 - RNA, 13 nt, Human
ccuguguagcugg

SEQ ID NO: 2441864 - RNA, 21 nt, Human
ccugugucuugcaauggcagc

SEQ ID NO: 2441865 - RNA, 19 nt, Human
ccugugucuugcaauggca

SEQ ID NO: 2441866 - RNA, 19 nt, Human
ccugugucccaugacccac

SEQ ID NO: 2441867 - RNA, 18 nt, Human
ccugugucccaugaccca

SEQ ID NO: 2441868 - RNA, 14 nt, Human
ccugugucccauga

SEQ ID NO: 2441869 - RNA, 13 nt, Human
ccugugucccaug

SEQ ID NO: 2441870 - RNA, 19 nt, Human
ccuguguccaugcgcucag

SEQ ID NO: 2441871 - RNA, 11 nt, Human
ccuguguccca

SEQ ID NO: 2441872 - RNA, 17 nt, Human
ccugugucuugcaaugg

SEQ ID NO: 2441873 - RNA, 23 nt, Human
ccugugucuucuccaccacgcug

SEQ ID NO: 2441874 - RNA, 18 nt, Human
ccugugugauugacagcu

SEQ ID NO: 2441875 - RNA, 19 nt, Human
ccugugugauugacagcuu

SEQ ID NO: 2441876 - RNA, 22 nt, Human
ccugugugauugacagcuuugc

SEQ ID NO: 2441877 - RNA, 23 nt, Human
ccugugucccaugacccaccccu

SEQ ID NO: 2441878 - RNA, 22 nt, Human
ccugugucccaugacccacccc

SEQ ID NO: 2441879 - RNA, 21 nt, Human
ccugugucccaugacccaccc

SEQ ID NO: 2441880 - RNA, 20 nt, Human
ccugugucccaugacccacc

SEQ ID NO: 2441881 - RNA, 14 nt, Human
ccugugugauugac

SEQ ID NO: 2441882 - RNA, 22 nt, Human
ccugugucuugcaauggcagcc

SEQ ID NO: 2441883 - RNA, 21 nt, Human
ccugugugugcgccuacagga

SEQ ID NO: 2441884 - RNA, 20 nt, Human
ccugugugugcgccuacagg

SEQ ID NO: 2441885 - RNA, 20 nt, Human
ccuguguguccaaaacugcc

SEQ ID NO: 2441886 - RNA, 21 nt, Human
ccuguguguccaaaacugccu

SEQ ID NO: 2441887 - RNA, 13 nt, Human
ccuuaccagcaga

SEQ ID NO: 2441888 - RNA, 17 nt, Human
ccuuaccaacuuucugu

SEQ ID NO: 2441889 - RNA, 15 nt, Human
ccuuaccaacuuucu

SEQ ID NO: 2441890 - RNA, 15 nt, Human
ccuuacauuuccugg

SEQ ID NO: 2441891 - RNA, 17 nt, Human
ccuuaccacugcucuga

SEQ ID NO: 2441892 - RNA, 18 nt, Human
ccuuacagccucugacuu

SEQ ID NO: 2441893 - RNA, 14 nt, Human
ccuuacagccucug

SEQ ID NO: 2441894 - RNA, 16 nt, Human
ccuuacacuuacuguu

SEQ ID NO: 2441895 - RNA, 15 nt, Human
ccuuacacuuacugu

SEQ ID NO: 2441896 - RNA, 17 nt, Human
ccuuacaguaggagccc

SEQ ID NO: 2441897 - RNA, 21 nt, Human
ccuuacaguaggagcccagcu

SEQ ID NO: 2441898 - RNA, 22 nt, Human
ccuuacaaguuagaaaacauaa

SEQ ID NO: 2441899 - RNA, 13 nt, Human
ccuuacacuuacu

SEQ ID NO: 2441900 - RNA, 22 nt, Human
ccuuacacguaccucucaucag

SEQ ID NO: 2441901 - RNA, 20 nt, Human
ccuuaccagcagagcaccuu

SEQ ID NO: 2441902 - RNA, 19 nt, Human
ccuuaccaacuuucuguaa

SEQ ID NO: 2441903 - RNA, 18 nt, Human
ccuuaccaacuuucugua

SEQ ID NO: 2441904 - RNA, 20 nt, Human
ccuuaccacugcucugauga

SEQ ID NO: 2441905 - RNA, 15 nt, Human
ccuuacccucauguu

SEQ ID NO: 2441906 - RNA, 21 nt, Human
ccuuaccaugugccugaucca

SEQ ID NO: 2441907 - RNA, 15 nt, Human
ccuuaccaugugccu

SEQ ID NO: 2441908 - RNA, 14 nt, Human
ccuuacccaucugc

SEQ ID NO: 2441909 - RNA, 15 nt, Human
ccuuaccccuuagcc

SEQ ID NO: 2441910 - RNA, 16 nt, Human
ccuuaccccuuagccu

SEQ ID NO: 2441911 - RNA, 14 nt, Human
ccuuaccuuuuuau

SEQ ID NO: 2441912 - RNA, 16 nt, Human
ccuuacucuucuugaa

SEQ ID NO: 2441913 - RNA, 17 nt, Human
ccuuacucuucuugaaa

SEQ ID NO: 2441914 - RNA, 19 nt, Human
ccuuaccugccaggaagcc

SEQ ID NO: 2441915 - RNA, 19 nt, Human
ccuuacccucauguucuua

SEQ ID NO: 2441916 - RNA, 22 nt, Human
ccuuacucuucuugaaauuuua

SEQ ID NO: 2441917 - RNA, 12 nt, Human
ccuuacugcaga

SEQ ID NO: 2441918 - RNA, 17 nt, Human
ccuuagaagucacacag

SEQ ID NO: 2441919 - RNA, 18 nt, Human
ccuuagaagucacacagu

SEQ ID NO: 2441920 - RNA, 20 nt, Human
ccuuaaggacaaaaaugaac

SEQ ID NO: 2441921 - RNA, 14 nt, Human
ccuuaacuggagcc

SEQ ID NO: 2441922 - RNA, 23 nt, Human
ccuuaacuggagccccaucagcu

SEQ ID NO: 2441923 - RNA, 17 nt, Human
ccuuaacuggagcccca

SEQ ID NO: 2441924 - RNA, 20 nt, Human
ccuuacacaaugguuuucuu

SEQ ID NO: 2441925 - RNA, 14 nt, Human
ccuuacacaauggu

SEQ ID NO: 2441926 - RNA, 17 nt, Human
ccuuaauucacucccac

SEQ ID NO: 2441927 - RNA, 23 nt, Human
ccuuaaucagguccucagagaau

SEQ ID NO: 2441928 - RNA, 14 nt, Human
ccuuaaguaagcaa

SEQ ID NO: 2441929 - RNA, 22 nt, Human
ccuuaaaggcaccaucuaauag

SEQ ID NO: 2441930 - RNA, 23 nt, Human
ccuuaaagaaagucgaauuaaua

SEQ ID NO: 2441931 - RNA, 22 nt, Human
ccuuaaagucaguaacuuaccc

SEQ ID NO: 2441932 - RNA, 12 nt, Human
ccuuaaaggaag

SEQ ID NO: 2441933 - RNA, 12 nt, Human
ccuuaacacuga

SEQ ID NO: 2441934 - RNA, 20 nt, Human
ccuuaaacaaaaauuaaaau

SEQ ID NO: 2441935 - RNA, 23 nt, Human
ccuuaaacagggcaucuccagga

SEQ ID NO: 2441936 - RNA, 15 nt, Human
ccuuaaacugugugg

SEQ ID NO: 2441937 - RNA, 17 nt, Human
ccuuaaaaccaaagagg

SEQ ID NO: 2441938 - RNA, 23 nt, Human
ccuuaaaacuuuaaucccacuug

SEQ ID NO: 2441939 - RNA, 16 nt, Human
ccuguuuucugagccc

SEQ ID NO: 2441940 - RNA, 15 nt, Human
ccuguuuucugagcc

SEQ ID NO: 2441941 - RNA, 17 nt, Human
ccuguuuucugagcccg

SEQ ID NO: 2441942 - RNA, 18 nt, Human
ccuguuuuguuggaaggu

SEQ ID NO: 2441943 - RNA, 17 nt, Human
ccuguuuuguuggaagg

SEQ ID NO: 2441944 - RNA, 17 nt, Human
ccuguuuuuaagcuguu

SEQ ID NO: 2441945 - RNA, 18 nt, Human
ccuguuuuuaagcuguuu

SEQ ID NO: 2441946 - RNA, 19 nt, Human
ccuguuuuuaagcuguuuc

SEQ ID NO: 2441947 - RNA, 13 nt, Human
ccuguuuuucaca

SEQ ID NO: 2441948 - RNA, 16 nt, Human
ccuguuuuucacauuu

SEQ ID NO: 2441949 - RNA, 16 nt, Human
ccuguuuuucugggug

SEQ ID NO: 2441950 - RNA, 15 nt, Human
ccuguuuuucugggu

SEQ ID NO: 2441951 - RNA, 20 nt, Human
ccuguuuuucacauuuuccu

SEQ ID NO: 2441952 - RNA, 17 nt, Human
ccuguuuuucugggugg

SEQ ID NO: 2441953 - RNA, 16 nt, Human
ccuuaaaaccaaagag

SEQ ID NO: 2441954 - RNA, 15 nt, Human
ccuuaaaaccaaaga

SEQ ID NO: 2441955 - RNA, 13 nt, Human
ccuugaacuagga

SEQ ID NO: 2441956 - RNA, 17 nt, Human
ccuucuuuccucuuccc

SEQ ID NO: 2441957 - RNA, 16 nt, Human
ccuucuuuccucuucc

SEQ ID NO: 2441958 - RNA, 21 nt, Human
ccuugaaaauaagaauagaaa

SEQ ID NO: 2441959 - RNA, 15 nt, Human
ccuugaaaauauuuu

SEQ ID NO: 2441960 - RNA, 13 nt, Human
ccuugaacacugg

SEQ ID NO: 2441961 - RNA, 20 nt, Human
ccuugaaaacuuuaugcuaa

SEQ ID NO: 2441962 - RNA, 16 nt, Human
ccuucuugccuucaga

SEQ ID NO: 2441963 - RNA, 21 nt, Human
ccuucuucuuuuugcuguugu

SEQ ID NO: 2441964 - RNA, 20 nt, Human
ccuucuucuuuuugcuguug

SEQ ID NO: 2441965 - RNA, 13 nt, Human
ccuucuuggugcu

SEQ ID NO: 2441966 - RNA, 22 nt, Human
ccuucuucuuuuugcuguuguu

SEQ ID NO: 2441967 - RNA, 12 nt, Human
ccuucuuguagu

SEQ ID NO: 2441968 - RNA, 13 nt, Human
ccuucuuuccucu

SEQ ID NO: 2441969 - RNA, 17 nt, Human
ccuugaagaaccucuca

SEQ ID NO: 2441970 - RNA, 18 nt, Human
ccuugaagaaccucucac

SEQ ID NO: 2441971 - RNA, 19 nt, Human
ccuugaacuuugaccucug

SEQ ID NO: 2441972 - RNA, 16 nt, Human
ccuugaaccacuuccc

SEQ ID NO: 2441973 - RNA, 15 nt, Human
ccuugaaccacuucc

SEQ ID NO: 2441974 - RNA, 20 nt, Human
ccuugaacacugggggaggg

SEQ ID NO: 2441975 - RNA, 19 nt, Human
ccuugaaccacuucccuca

SEQ ID NO: 2441976 - RNA, 14 nt, Human
ccuugaacuccugg

SEQ ID NO: 2441977 - RNA, 23 nt, Human
ccuugaagaacugcaggcccugg

SEQ ID NO: 2441978 - RNA, 22 nt, Human
ccuugaagaacugcaggcccug

SEQ ID NO: 2441979 - RNA, 21 nt, Human
ccuugaagaacugcaggcccu

SEQ ID NO: 2441980 - RNA, 18 nt, Human
ccuugaagaacugcaggc

SEQ ID NO: 2441981 - RNA, 18 nt, Human
ccuugaaccacuucccuc

SEQ ID NO: 2441982 - RNA, 13 nt, Human
ccuugaagauauc

SEQ ID NO: 2441983 - RNA, 14 nt, Human
ccuugaagccacug

SEQ ID NO: 2441984 - RNA, 19 nt, Human
ccuugaagccacugaagcu

SEQ ID NO: 2441985 - RNA, 22 nt, Human
ccuugaagccacugaagcuggg

SEQ ID NO: 2441986 - RNA, 22 nt, Human
ccuugaccauucuccaccugcc

SEQ ID NO: 2441987 - RNA, 13 nt, Human
ccuugacucuuuc

SEQ ID NO: 2441988 - RNA, 23 nt, Human
ccuugaccauucuccaccugcca

SEQ ID NO: 2441989 - RNA, 21 nt, Human
ccuugaauauccccucccagu

SEQ ID NO: 2441990 - RNA, 21 nt, Human
ccuugaaggguaaagaaguuu

SEQ ID NO: 2441991 - RNA, 11 nt, Human
ccuugaagccg

SEQ ID NO: 2441992 - RNA, 23 nt, Human
ccuugaagauaucuugaaaugaa

SEQ ID NO: 2441993 - RNA, 18 nt, Human
ccuugaggagucuugugu

SEQ ID NO: 2441994 - RNA, 16 nt, Human
ccuugaggagucuugu

SEQ ID NO: 2441995 - RNA, 22 nt, Human
ccuugaggaggggcagguaaac

SEQ ID NO: 2441996 - RNA, 21 nt, Human
ccuugaggaaacaacagcuuu

SEQ ID NO: 2441997 - RNA, 16 nt, Human
ccuugacuuagauucu

SEQ ID NO: 2441998 - RNA, 20 nt, Human
ccuugacgucaagucuccuu

SEQ ID NO: 2441999 - RNA, 20 nt, Human
ccuugaguugauucagcucu

SEQ ID NO: 2442000 - RNA, 23 nt, Human
ccuugaggucuuuugacaugugg

SEQ ID NO: 2442001 - RNA, 13 nt, Human
ccuugaggucuuu

SEQ ID NO: 2442002 - RNA, 12 nt, Human
ccuugaggucuu

SEQ ID NO: 2442003 - RNA, 21 nt, Human
ccuugagggugcuuguucccu

SEQ ID NO: 2442004 - RNA, 17 nt, Human
ccuucuuauucucacuc

SEQ ID NO: 2442005 - RNA, 18 nt, Human
ccuucuuauucucacucc

SEQ ID NO: 2442006 - RNA, 21 nt, Human
ccuucuguggcucacagaacc

SEQ ID NO: 2442007 - RNA, 23 nt, Human
ccuucuucacccagcuaaucugu

SEQ ID NO: 2442008 - RNA, 19 nt, Human
ccuucuuauucucacucca

SEQ ID NO: 2442009 - RNA, 20 nt, Human
ccuucuuauucucacuccac

SEQ ID NO: 2442010 - RNA, 14 nt, Human
ccuucuucacccag

SEQ ID NO: 2442011 - RNA, 22 nt, Human
ccuucuuauucucacuccacca

SEQ ID NO: 2442012 - RNA, 22 nt, Human
ccuucuuccaucccaggacacc

SEQ ID NO: 2442013 - RNA, 14 nt, Human
ccuucuuccauccc

SEQ ID NO: 2442014 - RNA, 19 nt, Human
ccuucuucacccagcuaau

SEQ ID NO: 2442015 - RNA, 17 nt, Human
ccuucuucacccagcua

SEQ ID NO: 2442016 - RNA, 15 nt, Human
ccuucuucacccagc

SEQ ID NO: 2442017 - RNA, 19 nt, Human
ccuucuuccaucccaggac

SEQ ID NO: 2442018 - RNA, 18 nt, Human
ccuucuuccaucccagga

SEQ ID NO: 2442019 - RNA, 16 nt, Human
ccuucuuccaucccag

SEQ ID NO: 2442020 - RNA, 19 nt, Human
ccuucuucuuuuugcuguu

SEQ ID NO: 2442021 - RNA, 18 nt, Human
ccuucuucuuuuugcugu

SEQ ID NO: 2442022 - RNA, 21 nt, Human
ccuucuucggggaacuccugg

SEQ ID NO: 2442023 - RNA, 22 nt, Human
ccuucuucggggaacuccugga

SEQ ID NO: 2442024 - RNA, 22 nt, Human
ccuucuguccuggugucacuua

SEQ ID NO: 2442025 - RNA, 21 nt, Human
ccuucuguccuggugucacuu

SEQ ID NO: 2442026 - RNA, 19 nt, Human
ccuucuguccuggugucac

SEQ ID NO: 2442027 - RNA, 18 nt, Human
ccuucuguccugguguca

SEQ ID NO: 2442028 - RNA, 15 nt, Human
ccuucugugaaagua

SEQ ID NO: 2442029 - RNA, 14 nt, Human
ccuucuguggcuca

SEQ ID NO: 2442030 - RNA, 17 nt, Human
ccuucuccucuuguaaa

SEQ ID NO: 2442031 - RNA, 16 nt, Human
ccuucucucaccuccu

SEQ ID NO: 2442032 - RNA, 18 nt, Human
ccuucucucaccuccuaa

SEQ ID NO: 2442033 - RNA, 17 nt, Human
ccuucucucaccuccua

SEQ ID NO: 2442034 - RNA, 14 nt, Human
ccuucucucaucuc

SEQ ID NO: 2442035 - RNA, 19 nt, Human
ccuucucucaccuccuaaa

SEQ ID NO: 2442036 - RNA, 19 nt, Human
ccuucuccuucaccuuugu

SEQ ID NO: 2442037 - RNA, 15 nt, Human
ccuucuccuucaccu

SEQ ID NO: 2442038 - RNA, 18 nt, Human
ccuucuaguuucccacaa

SEQ ID NO: 2442039 - RNA, 17 nt, Human
ccuucuaguuucccaca

SEQ ID NO: 2442040 - RNA, 16 nt, Human
ccuucuaguuucccac

SEQ ID NO: 2442041 - RNA, 20 nt, Human
ccuucuaggguuauugcauu

SEQ ID NO: 2442042 - RNA, 15 nt, Human
ccuucuaguuuccca

SEQ ID NO: 2442043 - RNA, 15 nt, Human
ccuucggcgccuuaa

SEQ ID NO: 2442044 - RNA, 12 nt, Human
ccuucuaccugc

SEQ ID NO: 2442045 - RNA, 20 nt, Human
ccuucuaccugccacucaca

SEQ ID NO: 2442046 - RNA, 18 nt, Human
ccuucuaccugccacuca

SEQ ID NO: 2442047 - RNA, 14 nt, Human
ccuucuacugagcc

SEQ ID NO: 2442048 - RNA, 15 nt, Human
ccuucuacugagccu

SEQ ID NO: 2442049 - RNA, 14 nt, Human
ccuucuaggaagcu

SEQ ID NO: 2442050 - RNA, 17 nt, Human
ccuucuaccugccacuc

SEQ ID NO: 2442051 - RNA, 16 nt, Human
ccuucuaccugccacu

SEQ ID NO: 2442052 - RNA, 15 nt, Human
ccuucuaccugccac

SEQ ID NO: 2442053 - RNA, 14 nt, Human
ccuucuaccugcca

SEQ ID NO: 2442054 - RNA, 13 nt, Human
ccuucuaccugcc

SEQ ID NO: 2442055 - RNA, 20 nt, Human
ccuucggacaacucaguccc

SEQ ID NO: 2442056 - RNA, 18 nt, Human
ccuuugacgccaucccag

SEQ ID NO: 2442057 - RNA, 17 nt, Human
ccuuugacgccauccca

SEQ ID NO: 2442058 - RNA, 16 nt, Human
ccuuugacgccauccc

SEQ ID NO: 2442059 - RNA, 15 nt, Human
ccuuugaccugccuc

SEQ ID NO: 2442060 - RNA, 16 nt, Human
ccuuugaccugccucc

SEQ ID NO: 2442061 - RNA, 19 nt, Human
ccuuucuccccugccccca

SEQ ID NO: 2442062 - RNA, 17 nt, Human
ccuuucucccaggccag

SEQ ID NO: 2442063 - RNA, 22 nt, Human
ccuuucuaguccuauucuauug

SEQ ID NO: 2442064 - RNA, 15 nt, Human
ccuuucuaaacaaga

SEQ ID NO: 2442065 - RNA, 23 nt, Human
ccuuucuaaacaagauuuuaaag

SEQ ID NO: 2442066 - RNA, 17 nt, Human
ccuuucuccagccagca

SEQ ID NO: 2442067 - RNA, 16 nt, Human
ccuuucuccagccagc

SEQ ID NO: 2442068 - RNA, 15 nt, Human
ccuuucuccagccag

SEQ ID NO: 2442069 - RNA, 14 nt, Human
ccuuucuccagcca

SEQ ID NO: 2442070 - RNA, 13 nt, Human
ccuuucuccagcc

SEQ ID NO: 2442071 - RNA, 18 nt, Human
ccuuucuaucauuuuugu

SEQ ID NO: 2442072 - RNA, 10 nt, Human
ccuuucucac

SEQ ID NO: 2442073 - RNA, 18 nt, Human
ccuuucuccccugccccc

SEQ ID NO: 2442074 - RNA, 15 nt, Human
ccuuucuccccugcc

SEQ ID NO: 2442075 - RNA, 20 nt, Human
ccuuucuccagccagcaaug

SEQ ID NO: 2442076 - RNA, 18 nt, Human
ccuuucuccagccagcaa

SEQ ID NO: 2442077 - RNA, 22 nt, Human
ccuuucuccagccagcaaugau

SEQ ID NO: 2442078 - RNA, 14 nt, Human
ccuuucucccaggc

SEQ ID NO: 2442079 - RNA, 19 nt, Human
ccuuguccccacacuccua

SEQ ID NO: 2442080 - RNA, 18 nt, Human
ccuuguccccacacuccu

SEQ ID NO: 2442081 - RNA, 17 nt, Human
ccuuguccccacacucc

SEQ ID NO: 2442082 - RNA, 16 nt, Human
ccuuguccccacacuc

SEQ ID NO: 2442083 - RNA, 15 nt, Human
ccuuguccccacacu

SEQ ID NO: 2442084 - RNA, 14 nt, Human
ccuuguccccacac

SEQ ID NO: 2442085 - RNA, 13 nt, Human
ccuuguccccaca

SEQ ID NO: 2442086 - RNA, 16 nt, Human
ccuuguccacccaccu

SEQ ID NO: 2442087 - RNA, 14 nt, Human
ccuuguccuuuccc

SEQ ID NO: 2442088 - RNA, 15 nt, Human
ccuuguccccugccu

SEQ ID NO: 2442089 - RNA, 21 nt, Human
ccuuguccccacacuccuaca

SEQ ID NO: 2442090 - RNA, 14 nt, Human
ccuuguccccugcc

SEQ ID NO: 2442091 - RNA, 16 nt, Human
ccuugucacugguaga

SEQ ID NO: 2442092 - RNA, 14 nt, Human
ccuuguccacccac

SEQ ID NO: 2442093 - RNA, 17 nt, Human
ccuugguggcaagagcc

SEQ ID NO: 2442094 - RNA, 15 nt, Human
ccuugguggcaagag

SEQ ID NO: 2442095 - RNA, 19 nt, Human
ccuuggugugacccucuga

SEQ ID NO: 2442096 - RNA, 18 nt, Human
ccuuguuacuucugaggu

SEQ ID NO: 2442097 - RNA, 16 nt, Human
ccuuguuacuucugag

SEQ ID NO: 2442098 - RNA, 19 nt, Human
ccuuguuacuucugaggua

SEQ ID NO: 2442099 - RNA, 21 nt, Human
ccuuguuauuucucagacuuu

SEQ ID NO: 2442100 - RNA, 13 nt, Human
ccuuguugcauga

SEQ ID NO: 2442101 - RNA, 16 nt, Human
ccuuguuggagccugc

SEQ ID NO: 2442102 - RNA, 21 nt, Human
ccuuguuccuagaguagagug

SEQ ID NO: 2442103 - RNA, 21 nt, Human
ccuuguucugauaaugaaaau

SEQ ID NO: 2442104 - RNA, 15 nt, Human
ccuuguucacacucu

SEQ ID NO: 2442105 - RNA, 18 nt, Human
ccuuguuggagccugcag

SEQ ID NO: 2442106 - RNA, 17 nt, Human
ccuuguuggagccugca

SEQ ID NO: 2442107 - RNA, 19 nt, Human
ccuuguuuacacauacccu

SEQ ID NO: 2442108 - RNA, 22 nt, Human
ccuuguuucaaacacaaaugca

SEQ ID NO: 2442109 - RNA, 20 nt, Human
ccuuguuucaaacacaaaug

SEQ ID NO: 2442110 - RNA, 14 nt, Human
ccuuguuucaaaca

SEQ ID NO: 2442111 - RNA, 19 nt, Human
ccuuguuggagccugcagg

SEQ ID NO: 2442112 - RNA, 22 nt, Human
ccuuguuugauuuuagcugcag

SEQ ID NO: 2442113 - RNA, 22 nt, Human
ccuugguuaggcauugugggaa

SEQ ID NO: 2442114 - RNA, 21 nt, Human
ccuugguuaggcauuguggga

SEQ ID NO: 2442115 - RNA, 22 nt, Human
ccuuggugucgggcaugacacg

SEQ ID NO: 2442116 - RNA, 21 nt, Human
ccuuggugucgggcaugacac

SEQ ID NO: 2442117 - RNA, 19 nt, Human
ccuuggggcugaugcaguu

SEQ ID NO: 2442118 - RNA, 18 nt, Human
ccuuggggauucuuccau

SEQ ID NO: 2442119 - RNA, 22 nt, Human
ccuuggggauucuuccaucuga

SEQ ID NO: 2442120 - RNA, 14 nt, Human
ccuuggggcaggca

SEQ ID NO: 2442121 - RNA, 15 nt, Human
ccuuggggcaggcag

SEQ ID NO: 2442122 - RNA, 16 nt, Human
ccuuggggcaggcagu

SEQ ID NO: 2442123 - RNA, 14 nt, Human
ccuugggcccuuug

SEQ ID NO: 2442124 - RNA, 12 nt, Human
ccuugggcccuu

SEQ ID NO: 2442125 - RNA, 23 nt, Human
ccuugagugggguuaucucugug

SEQ ID NO: 2442126 - RNA, 22 nt, Human
ccuugagugggguuaucucugu

SEQ ID NO: 2442127 - RNA, 14 nt, Human
ccuugagugggguu

SEQ ID NO: 2442128 - RNA, 14 nt, Human
ccuugaugaagaag

SEQ ID NO: 2442129 - RNA, 23 nt, Human
ccuugauuguucgggugugcaau

SEQ ID NO: 2442130 - RNA, 19 nt, Human
ccuugauggagauauuuac

SEQ ID NO: 2442131 - RNA, 14 nt, Human
ccuugaugugccug

SEQ ID NO: 2442132 - RNA, 21 nt, Human
ccuugauuuuagccuucucug

SEQ ID NO: 2442133 - RNA, 22 nt, Human
ccuugauuuuagccuucucugu

SEQ ID NO: 2442134 - RNA, 20 nt, Human
ccuugauuuuagccuucucu

SEQ ID NO: 2442135 - RNA, 20 nt, Human
ccuugggaggaagcagaaua

SEQ ID NO: 2442136 - RNA, 19 nt, Human
ccuugggaggaagcagaau

SEQ ID NO: 2442137 - RNA, 18 nt, Human
ccuugggaggaagcagaa

SEQ ID NO: 2442138 - RNA, 17 nt, Human
ccuugggaggaagcaga

SEQ ID NO: 2442139 - RNA, 16 nt, Human
ccuugggaggaagcag

SEQ ID NO: 2442140 - RNA, 15 nt, Human
ccuugggaggaagca

SEQ ID NO: 2442141 - RNA, 14 nt, Human
ccuugggaggaagc

SEQ ID NO: 2442142 - RNA, 19 nt, Human
ccuugggaggccccacugg

SEQ ID NO: 2442143 - RNA, 20 nt, Human
ccuugggaggccccacuggg

SEQ ID NO: 2442144 - RNA, 22 nt, Human
ccuugggaggaagcagaauaaa

SEQ ID NO: 2442145 - RNA, 21 nt, Human
ccuugggaggaagcagaauaa

SEQ ID NO: 2442146 - RNA, 23 nt, Human
ccuugggaggaagcagaauaaag

SEQ ID NO: 2442147 - RNA, 15 nt, Human
ccuugggaggcccca

SEQ ID NO: 2442148 - RNA, 17 nt, Human
ccuugcaacuucauguc

SEQ ID NO: 2442149 - RNA, 18 nt, Human
ccuugcaacacacagaca

SEQ ID NO: 2442150 - RNA, 22 nt, Human
ccuugcaacacacagacacacg

SEQ ID NO: 2442151 - RNA, 23 nt, Human
ccuugcaaagaccauaaagucca

SEQ ID NO: 2442152 - RNA, 14 nt, Human
ccuugauugggacu

SEQ ID NO: 2442153 - RNA, 16 nt, Human
ccuugcaacacacaga

SEQ ID NO: 2442154 - RNA, 17 nt, Human
ccuugcaacacacagac

SEQ ID NO: 2442155 - RNA, 12 nt, Human
ccuugggacccc

SEQ ID NO: 2442156 - RNA, 21 nt, Human
ccuuggcuuuuacugaagccu

SEQ ID NO: 2442157 - RNA, 14 nt, Human
ccuucacuuaggaa

SEQ ID NO: 2442158 - RNA, 18 nt, Human
ccuucacugccuuugcuc

SEQ ID NO: 2442159 - RNA, 14 nt, Human
ccuucacugccuuu

SEQ ID NO: 2442160 - RNA, 23 nt, Human
ccuucacuccggugugccugcag

SEQ ID NO: 2442161 - RNA, 10 nt, Human
ccuucagaca

SEQ ID NO: 2442162 - RNA, 11 nt, Human
ccuucagacac

SEQ ID NO: 2442163 - RNA, 20 nt, Human
ccuucacuucugaccacacu

SEQ ID NO: 2442164 - RNA, 18 nt, Human
ccuucagaaccauccaua

SEQ ID NO: 2442165 - RNA, 22 nt, Human
ccuucacuucugaccacacuuc

SEQ ID NO: 2442166 - RNA, 21 nt, Human
ccuucaccuuuguccccaccg

SEQ ID NO: 2442167 - RNA, 14 nt, Human
ccuucaccucugaa

SEQ ID NO: 2442168 - RNA, 17 nt, Human
ccuucaccccaguggcc

SEQ ID NO: 2442169 - RNA, 17 nt, Human
ccuucacauacccuccc

SEQ ID NO: 2442170 - RNA, 14 nt, Human
ccuucacuccggug

SEQ ID NO: 2442171 - RNA, 20 nt, Human
ccuucacuccggugugccug

SEQ ID NO: 2442172 - RNA, 20 nt, Human
ccuucaccuuuguccccacc

SEQ ID NO: 2442173 - RNA, 19 nt, Human
ccuucaccuuuguccccac

SEQ ID NO: 2442174 - RNA, 17 nt, Human
ccuucacagaugggugc

SEQ ID NO: 2442175 - RNA, 14 nt, Human
ccuuagacaguccc

SEQ ID NO: 2442176 - RNA, 12 nt, Human
ccuucacagugu

SEQ ID NO: 2442177 - RNA, 20 nt, Human
ccuucacauccuguguuucu

SEQ ID NO: 2442178 - RNA, 15 nt, Human
ccuucagcccucacc

SEQ ID NO: 2442179 - RNA, 14 nt, Human
ccuucagcccucac

SEQ ID NO: 2442180 - RNA, 10 nt, Human
ccuucagugc

SEQ ID NO: 2442181 - RNA, 11 nt, Human
ccuucagugcc

SEQ ID NO: 2442182 - RNA, 14 nt, Human
ccuucagugccaaa

SEQ ID NO: 2442183 - RNA, 19 nt, Human
ccuucauuuggcauucccc

SEQ ID NO: 2442184 - RNA, 12 nt, Human
ccuucagccuga

SEQ ID NO: 2442185 - RNA, 23 nt, Human
ccuucagauguucucucccaggg

SEQ ID NO: 2442186 - RNA, 22 nt, Human
ccuucagauguucucucccagg

SEQ ID NO: 2442187 - RNA, 13 nt, Human
ccuucagcccuca

SEQ ID NO: 2442188 - RNA, 21 nt, Human
ccuucagacuuugcuucccau

SEQ ID NO: 2442189 - RNA, 18 nt, Human
ccuucagacuuugcuucc

SEQ ID NO: 2442190 - RNA, 17 nt, Human
ccuucagacacccucaa

SEQ ID NO: 2442191 - RNA, 20 nt, Human
ccuucagacacccucaaccu

SEQ ID NO: 2442192 - RNA, 16 nt, Human
ccuucagauggaaacu

SEQ ID NO: 2442193 - RNA, 20 nt, Human
ccuuccucugagccuuggga

SEQ ID NO: 2442194 - RNA, 13 nt, Human
ccuuccucugagg

SEQ ID NO: 2442195 - RNA, 15 nt, Human
ccuuccuucccuggc

SEQ ID NO: 2442196 - RNA, 16 nt, Human
ccuuccuucccuggcu

SEQ ID NO: 2442197 - RNA, 16 nt, Human
ccuuccuugaccagca

SEQ ID NO: 2442198 - RNA, 15 nt, Human
ccuuccucugagccu

SEQ ID NO: 2442199 - RNA, 16 nt, Human
ccuuccucugagccuu

SEQ ID NO: 2442200 - RNA, 15 nt, Human
ccuuccucucuccag

SEQ ID NO: 2442201 - RNA, 17 nt, Human
ccuuccucucuccagau

SEQ ID NO: 2442202 - RNA, 21 nt, Human
ccuuccucuccacugccuucg

SEQ ID NO: 2442203 - RNA, 22 nt, Human
ccuucauuuggcauuccccacu

SEQ ID NO: 2442204 - RNA, 18 nt, Human
ccuucagcccucaccccu

SEQ ID NO: 2442205 - RNA, 12 nt, Human
ccuucagugccc

SEQ ID NO: 2442206 - RNA, 14 nt, Human
ccuucagugcccac

SEQ ID NO: 2442207 - RNA, 15 nt, Human
ccuucagugcccacc

SEQ ID NO: 2442208 - RNA, 16 nt, Human
ccuucagugcccacca

SEQ ID NO: 2442209 - RNA, 16 nt, Human
ccuuccaagagccuga

SEQ ID NO: 2442210 - RNA, 17 nt, Human
ccuuccaagagccugag

SEQ ID NO: 2442211 - RNA, 15 nt, Human
ccuuccaagagccug

SEQ ID NO: 2442212 - RNA, 18 nt, Human
ccuucagugcccaccaac

SEQ ID NO: 2442213 - RNA, 16 nt, Human
ccuuccaacaggagcu

SEQ ID NO: 2442214 - RNA, 19 nt, Human
ccuuccaacaggagcuggg

SEQ ID NO: 2442215 - RNA, 23 nt, Human
ccuucgcuucuugccucugugcu

SEQ ID NO: 2442216 - RNA, 21 nt, Human
ccuucgcuucuugccucugug

SEQ ID NO: 2442217 - RNA, 20 nt, Human
ccuucgcuucuugccucugu

SEQ ID NO: 2442218 - RNA, 19 nt, Human
ccuucgcuucuugccucug

SEQ ID NO: 2442219 - RNA, 14 nt, Human
ccuucggccuccau

SEQ ID NO: 2442220 - RNA, 19 nt, Human
ccuucggccuccauccuga

SEQ ID NO: 2442221 - RNA, 20 nt, Human
ccuucggccuccauccugag

SEQ ID NO: 2442222 - RNA, 14 nt, Human
ccuuccuugcuaau

SEQ ID NO: 2442223 - RNA, 15 nt, Human
ccuuccuucccuggg

SEQ ID NO: 2442224 - RNA, 23 nt, Human
ccuuccuugaccagcagauccca

SEQ ID NO: 2442225 - RNA, 19 nt, Human
ccuuccuugcucugcaccc

SEQ ID NO: 2442226 - RNA, 18 nt, Human
ccuuccuugcucugcacc

SEQ ID NO: 2442227 - RNA, 20 nt, Human
ccuuccuugcuguccuaggc

SEQ ID NO: 2442228 - RNA, 13 nt, Human
ccuuccuuuuccc

SEQ ID NO: 2442229 - RNA, 15 nt, Human
ccuuccuuuucccug

SEQ ID NO: 2442230 - RNA, 18 nt, Human
ccuucgcuucuugccucu

SEQ ID NO: 2442231 - RNA, 17 nt, Human
ccuucgcuucuugccuc

SEQ ID NO: 2442232 - RNA, 16 nt, Human
ccuucgcuucuugccu

SEQ ID NO: 2442233 - RNA, 19 nt, Human
ccuuccuuuucccugcuuc

SEQ ID NO: 2442234 - RNA, 18 nt, Human
ccuuccuuuucccugcuu

SEQ ID NO: 2442235 - RNA, 17 nt, Human
ccuuccuuuucccugcu

SEQ ID NO: 2442236 - RNA, 16 nt, Human
ccuuccuuuucccugc

SEQ ID NO: 2442237 - RNA, 21 nt, Human
ccuuccuuuucccugcuucca

SEQ ID NO: 2442238 - RNA, 20 nt, Human
ccuuccuuuucccugcuucc

SEQ ID NO: 2442239 - RNA, 23 nt, Human
ccuuccuuuucccugcuuccagg

SEQ ID NO: 2442240 - RNA, 19 nt, Human
cgagcaaagucuaaaguuu

SEQ ID NO: 2442241 - RNA, 23 nt, Human
cgagcaaagaucaaaauaaaaag

SEQ ID NO: 2442242 - RNA, 20 nt, Human
cgagcaaagucuaaaguuua

SEQ ID NO: 2442243 - RNA, 20 nt, Human
cgagcaaagaucaaaauaaa

SEQ ID NO: 2442244 - RNA, 15 nt, Human
cgagcaaagaucaaa

SEQ ID NO: 2442245 - RNA, 14 nt, Human
cgagcaaagaucaa

SEQ ID NO: 2442246 - RNA, 13 nt, Human
cgagcaccuccac

SEQ ID NO: 2442247 - RNA, 20 nt, Human
cgagauugcaccacugcacu

SEQ ID NO: 2442248 - RNA, 20 nt, Human
cgagaucacgccacugcacu

SEQ ID NO: 2442249 - RNA, 18 nt, Human
cgagaucacgccacugca

SEQ ID NO: 2442250 - RNA, 16 nt, Human
cgagaucacgccacug

SEQ ID NO: 2442251 - RNA, 17 nt, Human
cgagcaugccuggaugg

SEQ ID NO: 2442252 - RNA, 16 nt, Human
cgagcaugccuggaug

SEQ ID NO: 2442253 - RNA, 13 nt, Human
cgagcaugccugg

SEQ ID NO: 2442254 - RNA, 14 nt, Human
cgagcaugccugga

SEQ ID NO: 2442255 - RNA, 18 nt, Human
cgagcaggcuacugucag

SEQ ID NO: 2442256 - RNA, 20 nt, Human
cgagcaggcuucuucccccc

SEQ ID NO: 2442257 - RNA, 18 nt, Human
cgagcagggugcuguggg

SEQ ID NO: 2442258 - RNA, 15 nt, Human
cgagcaguccugccu

SEQ ID NO: 2442259 - RNA, 17 nt, Human
cgagcaguccugccuca

SEQ ID NO: 2442260 - RNA, 21 nt, Human
cgagcaguccugccucagccu

SEQ ID NO: 2442261 - RNA, 23 nt, Human
cgagcaguccugccucagccucc

SEQ ID NO: 2442262 - RNA, 15 nt, Human
cgacuuucugccugg

SEQ ID NO: 2442263 - RNA, 14 nt, Human
cgacuuucugccug

SEQ ID NO: 2442264 - RNA, 13 nt, Human
cgacuuucugccu

SEQ ID NO: 2442265 - RNA, 19 nt, Human
cgacuuguuuuugcacaug

SEQ ID NO: 2442266 - RNA, 21 nt, Human
cgacuugcuguuuuguucugu

SEQ ID NO: 2442267 - RNA, 22 nt, Human
cgacuugaauuuucccacugca

SEQ ID NO: 2442268 - RNA, 16 nt, Human
cgacuugcauuuuugc

SEQ ID NO: 2442269 - RNA, 17 nt, Human
cgagaacuuucauuuuu

SEQ ID NO: 2442270 - RNA, 16 nt, Human
cgagaacuuucauuuu

SEQ ID NO: 2442271 - RNA, 20 nt, Human
cgagaaauaaaguuugcuua

SEQ ID NO: 2442272 - RNA, 23 nt, Human
cgacuuuguaccccccaaccccu

SEQ ID NO: 2442273 - RNA, 16 nt, Human
cgacuuucugccugga

SEQ ID NO: 2442274 - RNA, 17 nt, Human
cgacuuuguacccccca

SEQ ID NO: 2442275 - RNA, 13 nt, Human
cgacuuuauuuuc

SEQ ID NO: 2442276 - RNA, 14 nt, Human
cgaauagcugggac

SEQ ID NO: 2442277 - RNA, 13 nt, Human
cgaauagcuggga

SEQ ID NO: 2442278 - RNA, 11 nt, Human
cgacugucucc

SEQ ID NO: 2442279 - RNA, 19 nt, Human
cgaauacuuuugcccuuug

SEQ ID NO: 2442280 - RNA, 21 nt, Human
cgacuugaauuuucccacugc

SEQ ID NO: 2442281 - RNA, 20 nt, Human
cgacuugaauuuucccacug

SEQ ID NO: 2442282 - RNA, 19 nt, Human
cgacuugaauuuucccacu

SEQ ID NO: 2442283 - RNA, 18 nt, Human
cgacuugaauuuucccac

SEQ ID NO: 2442284 - RNA, 17 nt, Human
cgacugugaccuguggg

SEQ ID NO: 2442285 - RNA, 19 nt, Human
cgacugugaccugugggga

SEQ ID NO: 2442286 - RNA, 18 nt, Human
cgagauagccaaggccaa

SEQ ID NO: 2442287 - RNA, 17 nt, Human
cgagaucacgccacugc

SEQ ID NO: 2442288 - RNA, 23 nt, Human
cgagaggugggccagucugugga

SEQ ID NO: 2442289 - RNA, 22 nt, Human
cgagaggugggccagucugugg

SEQ ID NO: 2442290 - RNA, 19 nt, Human
cgagaguagccgagagccu

SEQ ID NO: 2442291 - RNA, 20 nt, Human
cgagaguagccgagagccug

SEQ ID NO: 2442292 - RNA, 14 nt, Human
cgagagucugucuc

SEQ ID NO: 2442293 - RNA, 15 nt, Human
cgagagucugucuca

SEQ ID NO: 2442294 - RNA, 20 nt, Human
cgagaggugggccagucugu

SEQ ID NO: 2442295 - RNA, 19 nt, Human
cgagaggugggccagucug

SEQ ID NO: 2442296 - RNA, 15 nt, Human
cgagaggugggccag

SEQ ID NO: 2442297 - RNA, 14 nt, Human
cgagaggugggcca

SEQ ID NO: 2442298 - RNA, 18 nt, Human
cgagagguaugccuguac

SEQ ID NO: 2442299 - RNA, 22 nt, Human
cgagaggggaagaguguacugg

SEQ ID NO: 2442300 - RNA, 13 nt, Human
cgagaccagucug

SEQ ID NO: 2442301 - RNA, 17 nt, Human
cgagaccagccuggcca

SEQ ID NO: 2442302 - RNA, 14 nt, Human
cgagacacuugccu

SEQ ID NO: 2442303 - RNA, 20 nt, Human
cgagaagcugcucuggaauu

SEQ ID NO: 2442304 - RNA, 17 nt, Human
cgagaccaaccugacca

SEQ ID NO: 2442305 - RNA, 18 nt, Human
cgagaagcugcucuggaa

SEQ ID NO: 2442306 - RNA, 16 nt, Human
cgagaagcugcucugg

SEQ ID NO: 2442307 - RNA, 13 nt, Human
cgagaagcaagaa

SEQ ID NO: 2442308 - RNA, 15 nt, Human
cgagaagcaagaaag

SEQ ID NO: 2442309 - RNA, 13 nt, Human
cgagaccagccug

SEQ ID NO: 2442310 - RNA, 14 nt, Human
cgagaccagccugg

SEQ ID NO: 2442311 - RNA, 15 nt, Human
cgagaccagccuggc

SEQ ID NO: 2442312 - RNA, 16 nt, Human
cgagaccagccuggcc

SEQ ID NO: 2442313 - RNA, 20 nt, Human
cgaaaacguggcugcuucaa

SEQ ID NO: 2442314 - RNA, 22 nt, Human
cgaaaaguuggugucaaugaau

SEQ ID NO: 2442315 - RNA, 21 nt, Human
cgaaaaauccucuuccucuga

SEQ ID NO: 2442316 - RNA, 16 nt, Human
cgaaaccaaagaagaa

SEQ ID NO: 2442317 - RNA, 22 nt, Human
cgaaacaggcuacucuccucgg

SEQ ID NO: 2442318 - RNA, 14 nt, Human
cgaaaccccaucuc

SEQ ID NO: 2442319 - RNA, 17 nt, Human
cgaaacacagaaaccuu

SEQ ID NO: 2442320 - RNA, 13 nt, Human
cgaaacagcgcug

SEQ ID NO: 2442321 - RNA, 18 nt, Human
cgaaaccugggauucagg

SEQ ID NO: 2442322 - RNA, 18 nt, Human
cgaaaccuugccuuucuc

SEQ ID NO: 2442323 - RNA, 19 nt, Human
cgaaaacguggcugcuuca

SEQ ID NO: 2442324 - RNA, 18 nt, Human
cgaaaacguggcugcuuc

SEQ ID NO: 2442325 - RNA, 15 nt, Human
cgaaaacguggcugc

SEQ ID NO: 2442326 - RNA, 19 nt, Human
cgaaaaauccucuuccucu

SEQ ID NO: 2442327 - RNA, 13 nt, Human
cgaaaaccaggcc

SEQ ID NO: 2442328 - RNA, 22 nt, Human
cgaaaaccaggccuuaucucca

SEQ ID NO: 2442329 - RNA, 21 nt, Human
ccuuugacgccaucccagccc

SEQ ID NO: 2442330 - RNA, 20 nt, Human
ccuuugacgccaucccagcc

SEQ ID NO: 2442331 - RNA, 22 nt, Human
ccuuugacgccaucccagcccc

SEQ ID NO: 2442332 - RNA, 21 nt, Human
ccuuugaccugccucccuuca

SEQ ID NO: 2442333 - RNA, 22 nt, Human
ccuuugaccugccucccuucau

SEQ ID NO: 2442334 - RNA, 17 nt, Human
ccuuuuacauacugcug

SEQ ID NO: 2442335 - RNA, 16 nt, Human
ccuuuuauagcuauua

SEQ ID NO: 2442336 - RNA, 11 nt, Human
ccuuuuauagc

SEQ ID NO: 2442337 - RNA, 22 nt, Human
ccuuuuauguaguaauugacau

SEQ ID NO: 2442338 - RNA, 21 nt, Human
ccuuuuauaaaccucuaauuu

SEQ ID NO: 2442339 - RNA, 21 nt, Human
ccuuuuagccuaguucaucca

SEQ ID NO: 2442340 - RNA, 18 nt, Human
ccuuuuacauacugcugu

SEQ ID NO: 2442341 - RNA, 21 nt, Human
ccuuuucagcuucugcugggc

SEQ ID NO: 2442342 - RNA, 20 nt, Human
ccuuuucagcuucugcuggg

SEQ ID NO: 2442343 - RNA, 17 nt, Human
ccuuuucagcuucugcu

SEQ ID NO: 2442344 - RNA, 23 nt, Human
ccuuuucagcgauguaugcagcu

SEQ ID NO: 2442345 - RNA, 18 nt, Human
ccuuuuuuuccaucuuua

SEQ ID NO: 2442346 - RNA, 15 nt, Human
ccuuuucacuacacc

SEQ ID NO: 2442347 - RNA, 15 nt, Human
ccuuuuauugacaca

SEQ ID NO: 2442348 - RNA, 15 nt, Human
ccuuuuauguuauuu

SEQ ID NO: 2442349 - RNA, 12 nt, Human
cgaaagaacagu

SEQ ID NO: 2442350 - RNA, 21 nt, Human
cgaaagaacaguccauugaaa

SEQ ID NO: 2442351 - RNA, 19 nt, Human
cgaaagggacuuggaagcu

SEQ ID NO: 2442352 - RNA, 20 nt, Human
cgaaaggaugaaagugacca

SEQ ID NO: 2442353 - RNA, 22 nt, Human
cgaaagggacuuggaagcuccg

SEQ ID NO: 2442354 - RNA, 22 nt, Human
cgaaaggauguaaacagugccu

SEQ ID NO: 2442355 - RNA, 23 nt, Human
cgaaaggauguaaacagugccug

SEQ ID NO: 2442356 - RNA, 12 nt, Human
cgaaccaggagc

SEQ ID NO: 2442357 - RNA, 14 nt, Human
cgaaccaauauuug

SEQ ID NO: 2442358 - RNA, 14 nt, Human
cgaacccaccugcu

SEQ ID NO: 2442359 - RNA, 14 nt, Human
cgaacuccugaccu

SEQ ID NO: 2442360 - RNA, 16 nt, Human
cgaacgacaauagcuu

SEQ ID NO: 2442361 - RNA, 16 nt, Human
cgaaccuccucuguga

SEQ ID NO: 2442362 - RNA, 15 nt, Human
cgaaccuccucugug

SEQ ID NO: 2442363 - RNA, 23 nt, Human
cgaacccaccugcugagagaccc

SEQ ID NO: 2442364 - RNA, 15 nt, Human
cgaaccaggagcugc

SEQ ID NO: 2442365 - RNA, 16 nt, Human
cgaacccaccugcuga

SEQ ID NO: 2442366 - RNA, 13 nt, Human
cgaaccccaagga

SEQ ID NO: 2442367 - RNA, 14 nt, Human
cgaacuggcugcaa

SEQ ID NO: 2442368 - RNA, 12 nt, Human
cgaacuggcugc

SEQ ID NO: 2442369 - RNA, 16 nt, Human
cgaacuguuguauaaa

SEQ ID NO: 2442370 - RNA, 15 nt, Human
cgaacuccuugauuu

SEQ ID NO: 2442371 - RNA, 18 nt, Human
cgaagaaggguccuuccc

SEQ ID NO: 2442372 - RNA, 13 nt, Human
cgaagacacagac

SEQ ID NO: 2442373 - RNA, 22 nt, Human
cgaaguggacuggccccugggu

SEQ ID NO: 2442374 - RNA, 13 nt, Human
cgaaguguugcau

SEQ ID NO: 2442375 - RNA, 14 nt, Human
cgaaguugaugcaa

SEQ ID NO: 2442376 - RNA, 14 nt, Human
cgaauacaaaauug

SEQ ID NO: 2442377 - RNA, 17 nt, Human
cgccaugcuccuggccc

SEQ ID NO: 2442378 - RNA, 18 nt, Human
cgagccaugauguggagu

SEQ ID NO: 2442379 - RNA, 19 nt, Human
cgagccaugauguggagug

SEQ ID NO: 2442380 - RNA, 15 nt, Human
cgagcauccuggcca

SEQ ID NO: 2442381 - RNA, 18 nt, Human
cgagcaugccuggauggg

SEQ ID NO: 2442382 - RNA, 16 nt, Human
cgagcccugguggcag

SEQ ID NO: 2442383 - RNA, 15 nt, Human
cgagcccugguggca

SEQ ID NO: 2442384 - RNA, 23 nt, Human
cgauguggaaaaaugagagaagg

SEQ ID NO: 2442385 - RNA, 20 nt, Human
cgauguaugcagcuaucugg

SEQ ID NO: 2442386 - RNA, 19 nt, Human
cgauguaugcagcuaucug

SEQ ID NO: 2442387 - RNA, 18 nt, Human
cgauguaggcauucugga

SEQ ID NO: 2442388 - RNA, 20 nt, Human
cgagaggggaagaguguacu

SEQ ID NO: 2442389 - RNA, 17 nt, Human
cgauuauuaucuaaagu

SEQ ID NO: 2442390 - RNA, 21 nt, Human
cgauucacccuguccaaacug

SEQ ID NO: 2442391 - RNA, 16 nt, Human
cgauucacccugucca

SEQ ID NO: 2442392 - RNA, 22 nt, Human
cgauguggcccuggccugcugg

SEQ ID NO: 2442393 - RNA, 17 nt, Human
cgauguggcccuggccu

SEQ ID NO: 2442394 - RNA, 18 nt, Human
cgauguggcccuggccug

SEQ ID NO: 2442395 - RNA, 11 nt, Human
cgauguggccc

SEQ ID NO: 2442396 - RNA, 13 nt, Human
cgauguggcccug

SEQ ID NO: 2442397 - RNA, 15 nt, Human
cgauguggcccuggc

SEQ ID NO: 2442398 - RNA, 16 nt, Human
cgauguggcccuggcc

SEQ ID NO: 2442399 - RNA, 19 nt, Human
cgcacagcaugagaggcuc

SEQ ID NO: 2442400 - RNA, 13 nt, Human
cgcacagcaguuc

SEQ ID NO: 2442401 - RNA, 17 nt, Human
cgcacagagcuggggcu

SEQ ID NO: 2442402 - RNA, 15 nt, Human
cgcacagucucucuc

SEQ ID NO: 2442403 - RNA, 13 nt, Human
cgcacagucucuc

SEQ ID NO: 2442404 - RNA, 15 nt, Human
cgcaccauucugacu

SEQ ID NO: 2442405 - RNA, 14 nt, Human
cgcaccauucugac

SEQ ID NO: 2442406 - RNA, 14 nt, Human
cgcaccccagagug

SEQ ID NO: 2442407 - RNA, 13 nt, Human
cgcacccccaccc

SEQ ID NO: 2442408 - RNA, 14 nt, Human
cgcacccccacccu

SEQ ID NO: 2442409 - RNA, 20 nt, Human
cgcaaacccccuuugugcug

SEQ ID NO: 2442410 - RNA, 22 nt, Human
cgcaagagccauguagaagcug

SEQ ID NO: 2442411 - RNA, 15 nt, Human
cgcacacacacacac

SEQ ID NO: 2442412 - RNA, 20 nt, Human
cgcacacacacacacaggag

SEQ ID NO: 2442413 - RNA, 13 nt, Human
cgcacagagcugg

SEQ ID NO: 2442414 - RNA, 12 nt, Human
cgcacagagcug

SEQ ID NO: 2442415 - RNA, 20 nt, Human
cgauuucuguuuagauaaua

SEQ ID NO: 2442416 - RNA, 14 nt, Human
cgauuugucccagg

SEQ ID NO: 2442417 - RNA, 22 nt, Human
cgauucaccugagcaggaccuc

SEQ ID NO: 2442418 - RNA, 15 nt, Human
cgauucauauugaau

SEQ ID NO: 2442419 - RNA, 23 nt, Human
cgauuuuguaucugcaggcagac

SEQ ID NO: 2442420 - RNA, 18 nt, Human
cgauuuuguaucugcagg

SEQ ID NO: 2442421 - RNA, 17 nt, Human
cgauuuuguaucugcag

SEQ ID NO: 2442422 - RNA, 13 nt, Human
cgauuuuguaucu

SEQ ID NO: 2442423 - RNA, 13 nt, Human
cgauuuugccugu

SEQ ID NO: 2442424 - RNA, 23 nt, Human
cgauucaucucucagaagggagg

SEQ ID NO: 2442425 - RNA, 16 nt, Human
cgcaaaccacacugga

SEQ ID NO: 2442426 - RNA, 15 nt, Human
cgcaaaccacacugg

SEQ ID NO: 2442427 - RNA, 19 nt, Human
cgcaaagggcugaaagcca

SEQ ID NO: 2442428 - RNA, 18 nt, Human
cgcaaaccacacuggacu

SEQ ID NO: 2442429 - RNA, 14 nt, Human
cgcagagaggccag

SEQ ID NO: 2442430 - RNA, 12 nt, Human
cgcagagaggcc

SEQ ID NO: 2442431 - RNA, 21 nt, Human
cgcagccaaggccgaagcucu

SEQ ID NO: 2442432 - RNA, 14 nt, Human
cgcagcccugcaga

SEQ ID NO: 2442433 - RNA, 18 nt, Human
cgcagcccuagagccugc

SEQ ID NO: 2442434 - RNA, 17 nt, Human
cgcagcccuagagccug

SEQ ID NO: 2442435 - RNA, 10 nt, Human
cgcagcccug

SEQ ID NO: 2442436 - RNA, 16 nt, Human
cgcagacaggaccagg

SEQ ID NO: 2442437 - RNA, 15 nt, Human
cgcagacaggaccag

SEQ ID NO: 2442438 - RNA, 18 nt, Human
cgcagaccuccccagccc

SEQ ID NO: 2442439 - RNA, 17 nt, Human
cgcagaccuccccagcc

SEQ ID NO: 2442440 - RNA, 16 nt, Human
cgcagaccuccccagc

SEQ ID NO: 2442441 - RNA, 15 nt, Human
cgcagaccuccccag

SEQ ID NO: 2442442 - RNA, 20 nt, Human
cgcagaccuccccagccccu

SEQ ID NO: 2442443 - RNA, 19 nt, Human
cgcagaccuccccagcccc

SEQ ID NO: 2442444 - RNA, 17 nt, Human
cgcaccccccaagcugu

SEQ ID NO: 2442445 - RNA, 12 nt, Human
cgcagaccuccc

SEQ ID NO: 2442446 - RNA, 16 nt, Human
cgcacccuccccuccc

SEQ ID NO: 2442447 - RNA, 15 nt, Human
cgcacccccacccuu

SEQ ID NO: 2442448 - RNA, 19 nt, Human
cgcacccccacccuuuggg

SEQ ID NO: 2442449 - RNA, 21 nt, Human
cgccagauucuuuccugaggc

SEQ ID NO: 2442450 - RNA, 20 nt, Human
cgccagauucuuuccugagg

SEQ ID NO: 2442451 - RNA, 19 nt, Human
cgccagauucuuuccugag

SEQ ID NO: 2442452 - RNA, 17 nt, Human
cgccagauucuuuccug

SEQ ID NO: 2442453 - RNA, 20 nt, Human
cgcagcccuagagccugccu

SEQ ID NO: 2442454 - RNA, 19 nt, Human
cgcagcccuagagccugcc

SEQ ID NO: 2442455 - RNA, 21 nt, Human
cgccaggauggaacacggcca

SEQ ID NO: 2442456 - RNA, 22 nt, Human
cgcagcccuagagccugccugg

SEQ ID NO: 2442457 - RNA, 23 nt, Human
cgccaggauggaacacggccaca

SEQ ID NO: 2442458 - RNA, 16 nt, Human
cgccaggcugaccaca

SEQ ID NO: 2442459 - RNA, 17 nt, Human
cgccaggcugaccacag

SEQ ID NO: 2442460 - RNA, 20 nt, Human
cgccaggcugaccacagcac

SEQ ID NO: 2442461 - RNA, 22 nt, Human
cgccaggggaaaaucagccugc

SEQ ID NO: 2442462 - RNA, 21 nt, Human
cgccaggcugaccacagcaca

SEQ ID NO: 2442463 - RNA, 23 nt, Human
cgccaggcugaccacagcacagc

SEQ ID NO: 2442464 - RNA, 16 nt, Human
ccugcauucuuucugu

SEQ ID NO: 2442465 - RNA, 15 nt, Human
ccugaggcagguccc

SEQ ID NO: 2442466 - RNA, 21 nt, Human
ccucuccaagggcuucugcac

SEQ ID NO: 2442467 - RNA, 19 nt, Human
ccucuccaagggcuucugc

SEQ ID NO: 2442468 - RNA, 18 nt, Human
ccucuccaagggcuucug

SEQ ID NO: 2442469 - RNA, 13 nt, Human
ccucuccaagggc

SEQ ID NO: 2442470 - RNA, 23 nt, Human
ccucuccaagggcuucugcaccc

SEQ ID NO: 2442471 - RNA, 22 nt, Human
ccucuccaagggcuucugcacc

SEQ ID NO: 2442472 - RNA, 23 nt, Human
ccucuccaccuaguggcugucca

SEQ ID NO: 2442473 - RNA, 17 nt, Human
ccucuccaccuaguggc

SEQ ID NO: 2442474 - RNA, 22 nt, Human
ccucuccacccucccagaccug

SEQ ID NO: 2442475 - RNA, 17 nt, Human
ccucuccacccucccag

SEQ ID NO: 2442476 - RNA, 15 nt, Human
ccucuccacccuccc

SEQ ID NO: 2442477 - RNA, 19 nt, Human
ccugacaagcacugcuagg

SEQ ID NO: 2442478 - RNA, 14 nt, Human
ccugacaagcacug

SEQ ID NO: 2442479 - RNA, 19 nt, Human
ccugacaaccacuggucug

SEQ ID NO: 2442480 - RNA, 18 nt, Human
ccugacaaccacuggucu

SEQ ID NO: 2442481 - RNA, 23 nt, Human
ccugacaacacucauugaccuga

SEQ ID NO: 2442482 - RNA, 22 nt, Human
ccugacacugcggggcuuggcu

SEQ ID NO: 2442483 - RNA, 13 nt, Human
ccugacacucccu

SEQ ID NO: 2442484 - RNA, 20 nt, Human
ccugacaagcacugcuaggc

SEQ ID NO: 2442485 - RNA, 13 nt, Human
ccugacacuuuaa

SEQ ID NO: 2442486 - RNA, 14 nt, Human
ccugacacuuuaau

SEQ ID NO: 2442487 - RNA, 15 nt, Human
ccugacacuuuaauu

SEQ ID NO: 2442488 - RNA, 16 nt, Human
ccugacagaaggacuc

SEQ ID NO: 2442489 - RNA, 18 nt, Human
ccugacagucuugugcuu

SEQ ID NO: 2442490 - RNA, 20 nt, Human
ccugacagaugucagccgag

SEQ ID NO: 2442491 - RNA, 21 nt, Human
ccugacagaugucagccgagc

SEQ ID NO: 2442492 - RNA, 16 nt, Human
ccugacauuggagccu

SEQ ID NO: 2442493 - RNA, 13 nt, Human
ccugagcaacucu

SEQ ID NO: 2442494 - RNA, 14 nt, Human
ccugagcaacucuu

SEQ ID NO: 2442495 - RNA, 15 nt, Human
ccugagcaacucuug

SEQ ID NO: 2442496 - RNA, 18 nt, Human
ccugagcaacucuugauu

SEQ ID NO: 2442497 - RNA, 23 nt, Human
ccugagcaacucuugauuaucca

SEQ ID NO: 2442498 - RNA, 19 nt, Human
ccugagcaaugucugugcu

SEQ ID NO: 2442499 - RNA, 16 nt, Human
ccugagcuuucugcua

SEQ ID NO: 2442500 - RNA, 17 nt, Human
ccugagcuuggccagaa

SEQ ID NO: 2442501 - RNA, 21 nt, Human
ccugagcuuggccagaagggg

SEQ ID NO: 2442502 - RNA, 19 nt, Human
ccugaggaagagggacugu

SEQ ID NO: 2442503 - RNA, 18 nt, Human
ccugaggaacccuuacag

SEQ ID NO: 2442504 - RNA, 18 nt, Human
ccugagcuuggccagaag

SEQ ID NO: 2442505 - RNA, 17 nt, Human
ccugaggacagcugucc

SEQ ID NO: 2442506 - RNA, 16 nt, Human
ccugaggacagcuguc

SEQ ID NO: 2442507 - RNA, 15 nt, Human
ccugaggacagcugu

SEQ ID NO: 2442508 - RNA, 18 nt, Human
ccugaggaagaugggggc

SEQ ID NO: 2442509 - RNA, 12 nt, Human
ccugaggaagcg

SEQ ID NO: 2442510 - RNA, 23 nt, Human
ccugaggaagcgugaaggccgag

SEQ ID NO: 2442511 - RNA, 17 nt, Human
ccugaggaugagcugga

SEQ ID NO: 2442512 - RNA, 16 nt, Human
ccugaggaugagcugg

SEQ ID NO: 2442513 - RNA, 15 nt, Human
ccugaggaugagcug

SEQ ID NO: 2442514 - RNA, 20 nt, Human
ccugaggaugagcuggaagg

SEQ ID NO: 2442515 - RNA, 21 nt, Human
ccugaggcccagagggccugc

SEQ ID NO: 2442516 - RNA, 20 nt, Human
ccugaggacagcuguccucu

SEQ ID NO: 2442517 - RNA, 13 nt, Human
ccugaggaugagc

SEQ ID NO: 2442518 - RNA, 12 nt, Human
ccugagccagau

SEQ ID NO: 2442519 - RNA, 20 nt, Human
ccugagccagauuucacucu

SEQ ID NO: 2442520 - RNA, 23 nt, Human
ccugagccaagcuagaauucccu

SEQ ID NO: 2442521 - RNA, 13 nt, Human
ccugagccaagcu

SEQ ID NO: 2442522 - RNA, 20 nt, Human
ccugagcaaugucugugcua

SEQ ID NO: 2442523 - RNA, 11 nt, Human
ccugagcccca

SEQ ID NO: 2442524 - RNA, 14 nt, Human
ccugagcuuucugc

SEQ ID NO: 2442525 - RNA, 16 nt, Human
ccugagcuuggccaga

SEQ ID NO: 2442526 - RNA, 17 nt, Human
ccugccaggaagccagc

SEQ ID NO: 2442527 - RNA, 15 nt, Human
ccugccaggaagcca

SEQ ID NO: 2442528 - RNA, 14 nt, Human
ccugccaggaagcc

SEQ ID NO: 2442529 - RNA, 13 nt, Human
ccugccaggaagc

SEQ ID NO: 2442530 - RNA, 16 nt, Human
ccugccagcugcacug

SEQ ID NO: 2442531 - RNA, 17 nt, Human
ccugccagcugcacuga

SEQ ID NO: 2442532 - RNA, 18 nt, Human
ccugccagcugcacugau

SEQ ID NO: 2442533 - RNA, 23 nt, Human
ccugccagcugcacugaugcugc

SEQ ID NO: 2442534 - RNA, 13 nt, Human
ccugccagcugca

SEQ ID NO: 2442535 - RNA, 14 nt, Human
ccugccagcugcac

SEQ ID NO: 2442536 - RNA, 12 nt, Human
ccugccagcugc

SEQ ID NO: 2442537 - RNA, 21 nt, Human
ccugccagccuggcuucugga

SEQ ID NO: 2442538 - RNA, 12 nt, Human
ccugcauucuuu

SEQ ID NO: 2442539 - RNA, 13 nt, Human
ccugccagccugg

SEQ ID NO: 2442540 - RNA, 19 nt, Human
ccugccagacggcacccac

SEQ ID NO: 2442541 - RNA, 14 nt, Human
ccugccagccuggc

SEQ ID NO: 2442542 - RNA, 15 nt, Human
ccugccagccuggcu

SEQ ID NO: 2442543 - RNA, 16 nt, Human
ccugccagccuggcuu

SEQ ID NO: 2442544 - RNA, 17 nt, Human
ccugccagccuggcuuc

SEQ ID NO: 2442545 - RNA, 20 nt, Human
ccugcauguaaacacgccug

SEQ ID NO: 2442546 - RNA, 21 nt, Human
ccugcauguaaacacgccugc

SEQ ID NO: 2442547 - RNA, 22 nt, Human
ccugcauguaaacacgccugca

SEQ ID NO: 2442548 - RNA, 23 nt, Human
ccugcauguaaacacgccugcaa

SEQ ID NO: 2442549 - RNA, 14 nt, Human
ccugccacucaggc

SEQ ID NO: 2442550 - RNA, 15 nt, Human
ccugcauucacccag

SEQ ID NO: 2442551 - RNA, 16 nt, Human
ccugcauucacccaga

SEQ ID NO: 2442552 - RNA, 17 nt, Human
ccugcauucacccagac

SEQ ID NO: 2442553 - RNA, 22 nt, Human
ccugccacucaggcccaaagcc

SEQ ID NO: 2442554 - RNA, 23 nt, Human
ccugccacucaggcccaaagccu

SEQ ID NO: 2442555 - RNA, 14 nt, Human
ccugccagaccccc

SEQ ID NO: 2442556 - RNA, 19 nt, Human
ccugcauucacccagacag

SEQ ID NO: 2442557 - RNA, 22 nt, Human
ccugcauucugccgugugcccu

SEQ ID NO: 2442558 - RNA, 23 nt, Human
ccugccacuuugguacauggcca

SEQ ID NO: 2442559 - RNA, 24 nt, Human
ccugcauccccuuggcugugaggc

SEQ ID NO: 2442560 - RNA, 23 nt, Human
ccugcauccccuuggcugugagg

SEQ ID NO: 2442561 - RNA, 21 nt, Human
ccugcauccccuuggcuguga

SEQ ID NO: 2442562 - RNA, 18 nt, Human
ccugcauccccuuggcug

SEQ ID NO: 2442563 - RNA, 22 nt, Human
ccugcagucuggcugagcccug

SEQ ID NO: 2442564 - RNA, 21 nt, Human
ccugcagucuggcugagcccu

SEQ ID NO: 2442565 - RNA, 18 nt, Human
ccugcaucugaccagcag

SEQ ID NO: 2442566 - RNA, 19 nt, Human
ccugcauccguaguucccu

SEQ ID NO: 2442567 - RNA, 22 nt, Human
ccugcauccguaguucccugaa

SEQ ID NO: 2442568 - RNA, 19 nt, Human
ccugcaucugaccagcagc

SEQ ID NO: 2442569 - RNA, 15 nt, Human
ccugccagggacaga

SEQ ID NO: 2442570 - RNA, 14 nt, Human
ccugccagggacag

SEQ ID NO: 2442571 - RNA, 13 nt, Human
ccugccagggaca

SEQ ID NO: 2442572 - RNA, 12 nt, Human
ccugccagggac

SEQ ID NO: 2442573 - RNA, 23 nt, Human
ccugcccccaccacggccacugg

SEQ ID NO: 2442574 - RNA, 16 nt, Human
ccugccagggacagag

SEQ ID NO: 2442575 - RNA, 15 nt, Human
ccugcccccaggacu

SEQ ID NO: 2442576 - RNA, 14 nt, Human
ccugcccccaggac

SEQ ID NO: 2442577 - RNA, 17 nt, Human
ccugcccccagccccgg

SEQ ID NO: 2442578 - RNA, 15 nt, Human
ccugcccccagcccc

SEQ ID NO: 2442579 - RNA, 12 nt, Human
ccugcccccagg

SEQ ID NO: 2442580 - RNA, 17 nt, Human
ccugcccccacuuccug

SEQ ID NO: 2442581 - RNA, 15 nt, Human
ccugcccccacuucc

SEQ ID NO: 2442582 - RNA, 14 nt, Human
ccugcccccacuuc

SEQ ID NO: 2442583 - RNA, 14 nt, Human
ccugcccccagccc

SEQ ID NO: 2442584 - RNA, 13 nt, Human
ccugcccccagcc

SEQ ID NO: 2442585 - RNA, 22 nt, Human
ccugcccccagaccuuuuaucc

SEQ ID NO: 2442586 - RNA, 22 nt, Human
ccugccaggaagccagcaggcu

SEQ ID NO: 2442587 - RNA, 21 nt, Human
ccugccaggaagccagcaggc

SEQ ID NO: 2442588 - RNA, 19 nt, Human
ccugccaggaagccagcag

SEQ ID NO: 2442589 - RNA, 18 nt, Human
ccugccaggaagccagca

SEQ ID NO: 2442590 - RNA, 21 nt, Human
ccugccaggagcuuuggaccu

SEQ ID NO: 2442591 - RNA, 23 nt, Human
ccugccaggaagccagcaggcuc

SEQ ID NO: 2442592 - RNA, 11 nt, Human
ccugccaggga

SEQ ID NO: 2442593 - RNA, 16 nt, Human
ccugccaggcauggug

SEQ ID NO: 2442594 - RNA, 15 nt, Human
ccugauugugucucu

SEQ ID NO: 2442595 - RNA, 17 nt, Human
ccugauugccaagcuca

SEQ ID NO: 2442596 - RNA, 16 nt, Human
ccugauucaacuaaaa

SEQ ID NO: 2442597 - RNA, 19 nt, Human
ccugauucggcugucucag

SEQ ID NO: 2442598 - RNA, 14 nt, Human
ccugaggcccuucu

SEQ ID NO: 2442599 - RNA, 22 nt, Human
ccugaugcuucuucagagacuc

SEQ ID NO: 2442600 - RNA, 21 nt, Human
ccugaugcuucuucagagacu

SEQ ID NO: 2442601 - RNA, 20 nt, Human
ccugaugcuucuucagagac

SEQ ID NO: 2442602 - RNA, 19 nt, Human
ccugaugcuucuucagaga

SEQ ID NO: 2442603 - RNA, 12 nt, Human
ccugaggcccuu

SEQ ID NO: 2442604 - RNA, 11 nt, Human
ccugaggcccu

SEQ ID NO: 2442605 - RNA, 15 nt, Human
ccugcaaacgcugcc

SEQ ID NO: 2442606 - RNA, 16 nt, Human
ccugcaaacgcugccu

SEQ ID NO: 2442607 - RNA, 17 nt, Human
ccugcaaacgcugccug

SEQ ID NO: 2442608 - RNA, 18 nt, Human
ccugcaaacgcugccugc

SEQ ID NO: 2442609 - RNA, 19 nt, Human
ccugcaaacgcugccugcc

SEQ ID NO: 2442610 - RNA, 22 nt, Human
ccugcaaacgcugccugcccac

SEQ ID NO: 2442611 - RNA, 21 nt, Human
ccugcaaacgcugccugcccg

SEQ ID NO: 2442612 - RNA, 22 nt, Human
ccugcaaacgcugccugcccgu

SEQ ID NO: 2442613 - RNA, 21 nt, Human
ccugcaaccugauugugucuc

SEQ ID NO: 2442614 - RNA, 22 nt, Human
ccugcaaccugauugugucucu

SEQ ID NO: 2442615 - RNA, 19 nt, Human
ccugauugugucucuuggu

SEQ ID NO: 2442616 - RNA, 17 nt, Human
ccugauugugucucuug

SEQ ID NO: 2442617 - RNA, 22 nt, Human
ccugauuuuuuuuccuuuuaau

SEQ ID NO: 2442618 - RNA, 17 nt, Human
ccugcaaaaggacucuc

SEQ ID NO: 2442619 - RNA, 20 nt, Human
ccugauuguguauauucaua

SEQ ID NO: 2442620 - RNA, 19 nt, Human
ccugcaaaaggacucucag

SEQ ID NO: 2442621 - RNA, 18 nt, Human
ccugcaaaaugagacccu

SEQ ID NO: 2442622 - RNA, 14 nt, Human
ccugcaaaauuuua

SEQ ID NO: 2442623 - RNA, 13 nt, Human
ccugcaaggacua

SEQ ID NO: 2442624 - RNA, 20 nt, Human
ccugcaacucaaggacuuug

SEQ ID NO: 2442625 - RNA, 18 nt, Human
ccugcaacucaaggacuu

SEQ ID NO: 2442626 - RNA, 17 nt, Human
ccugcaagggcucccca

SEQ ID NO: 2442627 - RNA, 12 nt, Human
ccugcaaggacu

SEQ ID NO: 2442628 - RNA, 12 nt, Human
ccugcaacucau

SEQ ID NO: 2442629 - RNA, 16 nt, Human
ccugauuuuuuuuccu

SEQ ID NO: 2442630 - RNA, 16 nt, Human
ccugcaaacucacugc

SEQ ID NO: 2442631 - RNA, 15 nt, Human
ccugcaaacucacug

SEQ ID NO: 2442632 - RNA, 14 nt, Human
ccugcaaacucacu

SEQ ID NO: 2442633 - RNA, 22 nt, Human
ccugcaaaauuugaugccagga

SEQ ID NO: 2442634 - RNA, 20 nt, Human
ccugcaaacucacugcucaa

SEQ ID NO: 2442635 - RNA, 17 nt, Human
ccugcaaacucacugcu

SEQ ID NO: 2442636 - RNA, 17 nt, Human
ccugcaacucaaggacu

SEQ ID NO: 2442637 - RNA, 14 nt, Human
ccugcaagaacaag

SEQ ID NO: 2442638 - RNA, 19 nt, Human
ccugcaauuucauaugcug

SEQ ID NO: 2442639 - RNA, 21 nt, Human
ccugcaaugaagucucugaag

SEQ ID NO: 2442640 - RNA, 20 nt, Human
ccugcaagggcuccccacug

SEQ ID NO: 2442641 - RNA, 17 nt, Human
ccugcaagucaguccag

SEQ ID NO: 2442642 - RNA, 19 nt, Human
ccugcaaugaagucucuga

SEQ ID NO: 2442643 - RNA, 16 nt, Human
ccugcacggugggccu

SEQ ID NO: 2442644 - RNA, 15 nt, Human
ccugcaccugugcag

SEQ ID NO: 2442645 - RNA, 14 nt, Human
ccugcaccugugca

SEQ ID NO: 2442646 - RNA, 22 nt, Human
ccugcaccuccccccacugcag

SEQ ID NO: 2442647 - RNA, 20 nt, Human
ccugcaaugaagucucugaa

SEQ ID NO: 2442648 - RNA, 21 nt, Human
ccugcaccuccccccacugca

SEQ ID NO: 2442649 - RNA, 18 nt, Human
ccugcacgucaugggagg

SEQ ID NO: 2442650 - RNA, 23 nt, Human
ccugcacggugggccuugcuggg

SEQ ID NO: 2442651 - RNA, 22 nt, Human
ccugcacggugggccuugcugg

SEQ ID NO: 2442652 - RNA, 21 nt, Human
ccugcacggugggccuugcug

SEQ ID NO: 2442653 - RNA, 20 nt, Human
ccugcacggugggccuugcu

SEQ ID NO: 2442654 - RNA, 19 nt, Human
ccugcacggugggccuugc

SEQ ID NO: 2442655 - RNA, 18 nt, Human
ccugcacggugggccuug

SEQ ID NO: 2442656 - RNA, 17 nt, Human
ccugcacggugggccuu

SEQ ID NO: 2442657 - RNA, 23 nt, Human
ccugcacgucaugggagggggcu

SEQ ID NO: 2442658 - RNA, 19 nt, Human
ccugcacgucaugggaggg

SEQ ID NO: 2442659 - RNA, 21 nt, Human
ccugcacuaauuugauguuua

SEQ ID NO: 2442660 - RNA, 16 nt, Human
ccugcaggccaagagc

SEQ ID NO: 2442661 - RNA, 21 nt, Human
ccugcaggccaagagcagagg

SEQ ID NO: 2442662 - RNA, 22 nt, Human
ccugcaggccaagagcagaggc

SEQ ID NO: 2442663 - RNA, 12 nt, Human
ccugcaggccag

SEQ ID NO: 2442664 - RNA, 18 nt, Human
ccugcaggccaggccagc

SEQ ID NO: 2442665 - RNA, 20 nt, Human
ccugcaguacuuuaccuccu

SEQ ID NO: 2442666 - RNA, 15 nt, Human
ccugcagucacagcu

SEQ ID NO: 2442667 - RNA, 16 nt, Human
ccugcagucuggcuga

SEQ ID NO: 2442668 - RNA, 15 nt, Human
ccugcagucaucuug

SEQ ID NO: 2442669 - RNA, 21 nt, Human
ccugcagguugggccauacug

SEQ ID NO: 2442670 - RNA, 17 nt, Human
ccugcagguugggccau

SEQ ID NO: 2442671 - RNA, 16 nt, Human
ccugcagguugggcca

SEQ ID NO: 2442672 - RNA, 20 nt, Human
ccugcaggugcugcugcgug

SEQ ID NO: 2442673 - RNA, 18 nt, Human
ccugcaguacuuuaccuc

SEQ ID NO: 2442674 - RNA, 18 nt, Human
ccugcaggugcugcugcg

SEQ ID NO: 2442675 - RNA, 17 nt, Human
ccugcaggugcugcugc

SEQ ID NO: 2442676 - RNA, 15 nt, Human
ccugcaggugcugcu

SEQ ID NO: 2442677 - RNA, 23 nt, Human
ccugcaggguggugcugggacug

SEQ ID NO: 2442678 - RNA, 22 nt, Human
ccugcaggguggugcugggacu

SEQ ID NO: 2442679 - RNA, 21 nt, Human
ccugcaggguggugcugggac

SEQ ID NO: 2442680 - RNA, 20 nt, Human
ccugcaggguggugcuggga

SEQ ID NO: 2442681 - RNA, 19 nt, Human
ccugcaggguggugcuggg

SEQ ID NO: 2442682 - RNA, 15 nt, Human
ccugcagggccaagc

SEQ ID NO: 2442683 - RNA, 16 nt, Human
ccugcaggccaggcca

SEQ ID NO: 2442684 - RNA, 14 nt, Human
ccugcuuccaggaa

SEQ ID NO: 2442685 - RNA, 21 nt, Human
ccugcuuccaccucaccccac

SEQ ID NO: 2442686 - RNA, 23 nt, Human
ccugcuuugggcugcccuggugc

SEQ ID NO: 2442687 - RNA, 22 nt, Human
ccugcuuugggcugcccuggug

SEQ ID NO: 2442688 - RNA, 21 nt, Human
ccugcuuugggcugcccuggu

SEQ ID NO: 2442689 - RNA, 20 nt, Human
ccugcuuccaccucacccca

SEQ ID NO: 2442690 - RNA, 19 nt, Human
ccugcuuccaccucacccc

SEQ ID NO: 2442691 - RNA, 18 nt, Human
ccugcuuccaccucaccc

SEQ ID NO: 2442692 - RNA, 17 nt, Human
ccugcuucaugcucagc

SEQ ID NO: 2442693 - RNA, 16 nt, Human
ccugcuucaugcucag

SEQ ID NO: 2442694 - RNA, 14 nt, Human
ccugcuucaugcuc

SEQ ID NO: 2442695 - RNA, 19 nt, Human
ccugcuuugggcugcccug

SEQ ID NO: 2442696 - RNA, 20 nt, Human
ccugcuuugggcugcccugg

SEQ ID NO: 2442697 - RNA, 12 nt, Human
ccugcugucccc

SEQ ID NO: 2442698 - RNA, 17 nt, Human
ccugcugagggaccagc

SEQ ID NO: 2442699 - RNA, 19 nt, Human
ccugcugagggaccagcca

SEQ ID NO: 2442700 - RNA, 20 nt, Human
ccugcugugauuccacuaca

SEQ ID NO: 2442701 - RNA, 22 nt, Human
ccugcuguccccucuugcccca

SEQ ID NO: 2442702 - RNA, 19 nt, Human
ccugcuguccccucuugcc

SEQ ID NO: 2442703 - RNA, 15 nt, Human
ccugcuguccccucu

SEQ ID NO: 2442704 - RNA, 21 nt, Human
ccugcugagggaccagccaag

SEQ ID NO: 2442705 - RNA, 14 nt, Human
ccugcuguguuccc

SEQ ID NO: 2442706 - RNA, 23 nt, Human
ccugcugugauuccacuacaccu

SEQ ID NO: 2442707 - RNA, 14 nt, Human
ccugcuucaaauau

SEQ ID NO: 2442708 - RNA, 15 nt, Human
ccuggaagccagcuu

SEQ ID NO: 2442709 - RNA, 17 nt, Human
ccuggaagccagcuuuc

SEQ ID NO: 2442710 - RNA, 13 nt, Human
ccuggaagcugug

SEQ ID NO: 2442711 - RNA, 23 nt, Human
ccuggaagcuguguccuugcacc

SEQ ID NO: 2442712 - RNA, 17 nt, Human
ccuggaagcuguguccu

SEQ ID NO: 2442713 - RNA, 18 nt, Human
ccuggaagcuguguccuu

SEQ ID NO: 2442714 - RNA, 20 nt, Human
ccuggaagcuguguccuugc

SEQ ID NO: 2442715 - RNA, 14 nt, Human
ccuggaagacagag

SEQ ID NO: 2442716 - RNA, 13 nt, Human
ccuggaagacaga

SEQ ID NO: 2442717 - RNA, 12 nt, Human
ccuggaagacag

SEQ ID NO: 2442718 - RNA, 22 nt, Human
ccuggaagacagagaccuccug

SEQ ID NO: 2442719 - RNA, 15 nt, Human
ccuggaagacagaga

SEQ ID NO: 2442720 - RNA, 22 nt, Human
ccuggaacaucaucaaggcacu

SEQ ID NO: 2442721 - RNA, 18 nt, Human
ccuggaacugucucucau

SEQ ID NO: 2442722 - RNA, 20 nt, Human
ccuggaacugucucucauga

SEQ ID NO: 2442723 - RNA, 13 nt, Human
ccuggaacuuggg

SEQ ID NO: 2442724 - RNA, 16 nt, Human
ccuggaacuuggggag

SEQ ID NO: 2442725 - RNA, 17 nt, Human
ccuggaacuuggggagu

SEQ ID NO: 2442726 - RNA, 23 nt, Human
ccuggaaaucaggguuaguauug

SEQ ID NO: 2442727 - RNA, 19 nt, Human
ccugcuuuucacugcugca

SEQ ID NO: 2442728 - RNA, 21 nt, Human
ccugcuuccaggaaacuccac

SEQ ID NO: 2442729 - RNA, 15 nt, Human
ccugcuuuucacugc

SEQ ID NO: 2442730 - RNA, 21 nt, Human
ccugcuuuucacugcugcaag

SEQ ID NO: 2442731 - RNA, 22 nt, Human
ccuggaaauaucaguuacucag

SEQ ID NO: 2442732 - RNA, 21 nt, Human
ccugcugaagguggggauugc

SEQ ID NO: 2442733 - RNA, 23 nt, Human
ccugcugaaugauuuccaaagag

SEQ ID NO: 2442734 - RNA, 22 nt, Human
ccugcucuccucuugccacugc

SEQ ID NO: 2442735 - RNA, 17 nt, Human
ccugcugagagacccaa

SEQ ID NO: 2442736 - RNA, 21 nt, Human
ccugcugagagacccaaggag

SEQ ID NO: 2442737 - RNA, 20 nt, Human
ccugcugagagacccaagga

SEQ ID NO: 2442738 - RNA, 21 nt, Human
ccugcucuccucuugccacug

SEQ ID NO: 2442739 - RNA, 19 nt, Human
ccugcucuccucuugccac

SEQ ID NO: 2442740 - RNA, 18 nt, Human
ccugcucuccucuugcca

SEQ ID NO: 2442741 - RNA, 16 nt, Human
ccugcucuccucuugc

SEQ ID NO: 2442742 - RNA, 23 nt, Human
ccugcucuccaagucucaguggc

SEQ ID NO: 2442743 - RNA, 22 nt, Human
ccugcucuccaagucucagugg

SEQ ID NO: 2442744 - RNA, 22 nt, Human
ccugcucuccgaccagacaccu

SEQ ID NO: 2442745 - RNA, 13 nt, Human
ccugcuccacagu

SEQ ID NO: 2442746 - RNA, 20 nt, Human
ccugcuccacagccauccca

SEQ ID NO: 2442747 - RNA, 19 nt, Human
ccugcuccacagccauccc

SEQ ID NO: 2442748 - RNA, 12 nt, Human
ccugcuccacag

SEQ ID NO: 2442749 - RNA, 15 nt, Human
ccugcuccacagugu

SEQ ID NO: 2442750 - RNA, 14 nt, Human
ccugcuccacagug

SEQ ID NO: 2442751 - RNA, 11 nt, Human
ccugcuccaga

SEQ ID NO: 2442752 - RNA, 12 nt, Human
ccugcuccagac

SEQ ID NO: 2442753 - RNA, 13 nt, Human
ccugcuccagacc

SEQ ID NO: 2442754 - RNA, 14 nt, Human
ccugcuccagaccu

SEQ ID NO: 2442755 - RNA, 15 nt, Human
ccugcuccagaccug

SEQ ID NO: 2442756 - RNA, 22 nt, Human
ccugcuccucccuggcugcccu

SEQ ID NO: 2442757 - RNA, 18 nt, Human
ccugcuccuucccaggag

SEQ ID NO: 2442758 - RNA, 21 nt, Human
ccugcucgaugcucacagggc

SEQ ID NO: 2442759 - RNA, 21 nt, Human
ccugcucuccgaccagacacc

SEQ ID NO: 2442760 - RNA, 17 nt, Human
ccugcguccuccucacc

SEQ ID NO: 2442761 - RNA, 16 nt, Human
ccugcguccuccucac

SEQ ID NO: 2442762 - RNA, 15 nt, Human
ccugcguccuccuca

SEQ ID NO: 2442763 - RNA, 13 nt, Human
ccugcguccuccu

SEQ ID NO: 2442764 - RNA, 19 nt, Human
ccugcguccuccucaccuc

SEQ ID NO: 2442765 - RNA, 18 nt, Human
ccugcguccuccucaccu

SEQ ID NO: 2442766 - RNA, 22 nt, Human
ccugcggugcuaucucccccag

SEQ ID NO: 2442767 - RNA, 22 nt, Human
ccugcuauuacuaaggaguaau

SEQ ID NO: 2442768 - RNA, 22 nt, Human
ccugccccucaacucuccucca

SEQ ID NO: 2442769 - RNA, 15 nt, Human
ccugccgguaaacac

SEQ ID NO: 2442770 - RNA, 14 nt, Human
ccugccccucccag

SEQ ID NO: 2442771 - RNA, 15 nt, Human
ccugccccucccaga

SEQ ID NO: 2442772 - RNA, 14 nt, Human
ccugccgccucaau

SEQ ID NO: 2442773 - RNA, 15 nt, Human
ccugccggccggggc

SEQ ID NO: 2442774 - RNA, 20 nt, Human
ccugccgguaaacacgccug

SEQ ID NO: 2442775 - RNA, 21 nt, Human
ccugccgguaaacacgccugc

SEQ ID NO: 2442776 - RNA, 22 nt, Human
ccugccgguaaacacgccugca

SEQ ID NO: 2442777 - RNA, 23 nt, Human
ccugccgguaaacacgccugcaa

SEQ ID NO: 2442778 - RNA, 20 nt, Human
ccugccuaagggagaguggu

SEQ ID NO: 2442779 - RNA, 23 nt, Human
ccugccguggacuuggggucaga

SEQ ID NO: 2442780 - RNA, 21 nt, Human
ccugccuaggaauucccagcc

SEQ ID NO: 2442781 - RNA, 19 nt, Human
ccugcccccaggacugggc

SEQ ID NO: 2442782 - RNA, 18 nt, Human
ccugcccccaggacuggg

SEQ ID NO: 2442783 - RNA, 17 nt, Human
ccugcccccaggacugg

SEQ ID NO: 2442784 - RNA, 16 nt, Human
ccugcccccaggacug

SEQ ID NO: 2442785 - RNA, 22 nt, Human
ccugcccccaggacugggccac

SEQ ID NO: 2442786 - RNA, 20 nt, Human
ccugcccccaggacugggcc

SEQ ID NO: 2442787 - RNA, 18 nt, Human
ccugcccccagccccggg

SEQ ID NO: 2442788 - RNA, 17 nt, Human
ccugcccccuucuccca

SEQ ID NO: 2442789 - RNA, 16 nt, Human
ccugcccccuucuccc

SEQ ID NO: 2442790 - RNA, 18 nt, Human
ccugcccccuucucccac

SEQ ID NO: 2442791 - RNA, 19 nt, Human
ccugcccccuucucccaca

SEQ ID NO: 2442792 - RNA, 20 nt, Human
ccugcccccuucucccacac

SEQ ID NO: 2442793 - RNA, 21 nt, Human
ccugcccccuucucccacacu

SEQ ID NO: 2442794 - RNA, 22 nt, Human
ccugcccccuucucccacacug

SEQ ID NO: 2442795 - RNA, 23 nt, Human
ccugcccccuucucccacacugc

SEQ ID NO: 2442796 - RNA, 16 nt, Human
ccugccccgcccagcu

SEQ ID NO: 2442797 - RNA, 18 nt, Human
ccugccccgcccccaguc

SEQ ID NO: 2442798 - RNA, 13 nt, Human
ccugccccgcccc

SEQ ID NO: 2442799 - RNA, 22 nt, Human
ccugccccgcccagcugcaccu

SEQ ID NO: 2442800 - RNA, 20 nt, Human
ccugccccgcccccaguccc

SEQ ID NO: 2442801 - RNA, 22 nt, Human
ccugccccgucaccaucucagg

SEQ ID NO: 2442802 - RNA, 23 nt, Human
ccugccccgucaccaucucaggc

SEQ ID NO: 2442803 - RNA, 21 nt, Human
ccugccucacagcuggccguc

SEQ ID NO: 2442804 - RNA, 11 nt, Human
ccugccucagc

SEQ ID NO: 2442805 - RNA, 14 nt, Human
ccugccuggcaggc

SEQ ID NO: 2442806 - RNA, 11 nt, Human
ccugccuggcc

SEQ ID NO: 2442807 - RNA, 12 nt, Human
ccugccuggcca

SEQ ID NO: 2442808 - RNA, 13 nt, Human
ccugccuggccag

SEQ ID NO: 2442809 - RNA, 14 nt, Human
ccugccuggccagg

SEQ ID NO: 2442810 - RNA, 23 nt, Human
ccugccuguugggccaggagccu

SEQ ID NO: 2442811 - RNA, 21 nt, Human
ccugccuuagagccaggcaca

SEQ ID NO: 2442812 - RNA, 20 nt, Human
ccugccuuagagccaggcac

SEQ ID NO: 2442813 - RNA, 16 nt, Human
ccugccuuaucuugca

SEQ ID NO: 2442814 - RNA, 19 nt, Human
ccugccuuagagccaggca

SEQ ID NO: 2442815 - RNA, 23 nt, Human
ccugccuggggcgggccccucau

SEQ ID NO: 2442816 - RNA, 17 nt, Human
ccugccuggcccccugu

SEQ ID NO: 2442817 - RNA, 18 nt, Human
ccugccugguccucacac

SEQ ID NO: 2442818 - RNA, 23 nt, Human
ccugccuggccaggcagaucugu

SEQ ID NO: 2442819 - RNA, 18 nt, Human
ccugccuggccaggcaga

SEQ ID NO: 2442820 - RNA, 22 nt, Human
ccugccuggccaggcagaucug

SEQ ID NO: 2442821 - RNA, 23 nt, Human
ccugccuucuucuuuuugcuguu

SEQ ID NO: 2442822 - RNA, 22 nt, Human
ccugccuugaagccacugaagc

SEQ ID NO: 2442823 - RNA, 23 nt, Human
ccugccuugaagccacugaagcu

SEQ ID NO: 2442824 - RNA, 16 nt, Human
ccugccuugaagccac

SEQ ID NO: 2442825 - RNA, 17 nt, Human
ccugccuugaagccacu

SEQ ID NO: 2442826 - RNA, 19 nt, Human
ccugccuugaagccacuga

SEQ ID NO: 2442827 - RNA, 21 nt, Human
ccugccuugaagccacugaag

SEQ ID NO: 2442828 - RNA, 14 nt, Human
ccugccuuccuccu

SEQ ID NO: 2442829 - RNA, 16 nt, Human
ccugccuuccuccugg

SEQ ID NO: 2442830 - RNA, 17 nt, Human
ccugccuuccuccuggg

SEQ ID NO: 2442831 - RNA, 22 nt, Human
ccugccuuccuccugggcccuc

SEQ ID NO: 2442832 - RNA, 13 nt, Human
ccugccuugaagc

SEQ ID NO: 2442833 - RNA, 22 nt, Human
ccugccuucuucuuuuugcugu

SEQ ID NO: 2442834 - RNA, 18 nt, Human
ccugccuucuucggggaa

SEQ ID NO: 2442835 - RNA, 21 nt, Human
ccugccuucuguccugguguc

SEQ ID NO: 2442836 - RNA, 19 nt, Human
ccugccuucuguccuggug

SEQ ID NO: 2442837 - RNA, 16 nt, Human
ccugccuucuguccug

SEQ ID NO: 2442838 - RNA, 15 nt, Human
ccugccuucuguccu

SEQ ID NO: 2442839 - RNA, 19 nt, Human
ccugcgaaggggcccuggu

SEQ ID NO: 2442840 - RNA, 20 nt, Human
ccugcgaaggggcccugguc

SEQ ID NO: 2442841 - RNA, 15 nt, Human
ccugcgaaggggccc

SEQ ID NO: 2442842 - RNA, 17 nt, Human
ccugcgaaggggcccug

SEQ ID NO: 2442843 - RNA, 20 nt, Human
ccugcgccaccgcccagaga

SEQ ID NO: 2442844 - RNA, 19 nt, Human
ccugcgcccaccccgcucu

SEQ ID NO: 2442845 - RNA, 18 nt, Human
ccugcgauuuugccugug

SEQ ID NO: 2442846 - RNA, 20 nt, Human
ccugcgcccaguccuuccac

SEQ ID NO: 2442847 - RNA, 18 nt, Human
ccugcgcccaguccuucc

SEQ ID NO: 2442848 - RNA, 22 nt, Human
ccugcgcccaccccgcucugca

SEQ ID NO: 2442849 - RNA, 21 nt, Human
ccugcgcccaccccgcucugc

SEQ ID NO: 2442850 - RNA, 20 nt, Human
ccugcgcccaccccgcucug

SEQ ID NO: 2442851 - RNA, 17 nt, Human
ccugcggugcuaucucc

SEQ ID NO: 2442852 - RNA, 16 nt, Human
ccugcggugcuaucuc

SEQ ID NO: 2442853 - RNA, 24 nt, Human
ccugcggguggggcuuggggcuca

SEQ ID NO: 2442854 - RNA, 21 nt, Human
ccugcggguggggcuuggggc

SEQ ID NO: 2442855 - RNA, 23 nt, Human
ccugcgguagaugggagggaggc

SEQ ID NO: 2442856 - RNA, 20 nt, Human
ccugcggguggggcuugggg

SEQ ID NO: 2442857 - RNA, 24 nt, Human
ccugcgggugaacaaagcagccac

SEQ ID NO: 2442858 - RNA, 23 nt, Human
ccugcgggugaacaaagcagcca

SEQ ID NO: 2442859 - RNA, 21 nt, Human
ccugcggcugcugugugccuu

SEQ ID NO: 2442860 - RNA, 21 nt, Human
ccugcgggcuuuuccccgguc

SEQ ID NO: 2442861 - RNA, 18 nt, Human
ccugcgggucacaggagg

SEQ ID NO: 2442862 - RNA, 22 nt, Human
ccugcgggucacaggagggagg

SEQ ID NO: 2442863 - RNA, 16 nt, Human
ccugcggccugcugga

SEQ ID NO: 2442864 - RNA, 23 nt, Human
ccugcggagugaagaggggcagc

SEQ ID NO: 2442865 - RNA, 17 nt, Human
ccugcggccugcuggag

SEQ ID NO: 2442866 - RNA, 20 nt, Human
ccugcggcugcugugugccu

SEQ ID NO: 2442867 - RNA, 16 nt, Human
ccugcggcugcugugu

SEQ ID NO: 2442868 - RNA, 19 nt, Human
ccugcgggcuuuuccccgg

SEQ ID NO: 2442869 - RNA, 22 nt, Human
ccugcggagugaagaggggcag

SEQ ID NO: 2442870 - RNA, 20 nt, Human
ccugcggagugaagaggggc

SEQ ID NO: 2442871 - RNA, 19 nt, Human
ccugcggagugaagagggg

SEQ ID NO: 2442872 - RNA, 18 nt, Human
ccugcggagugaagaggg

SEQ ID NO: 2442873 - RNA, 17 nt, Human
ccugcggagugaagagg

SEQ ID NO: 2442874 - RNA, 16 nt, Human
ccugcggagugaagag

SEQ ID NO: 2442875 - RNA, 20 nt, Human
ccugcgcgcaugugcgcaca

SEQ ID NO: 2442876 - RNA, 14 nt, Human
ccugcgcgcaugug

SEQ ID NO: 2442877 - RNA, 22 nt, Human
ccugcgcccaguccuuccaccu

SEQ ID NO: 2442878 - RNA, 22 nt, Human
ccugggguaccaagagacuccu

SEQ ID NO: 2442879 - RNA, 23 nt, Human
ccuggggguucuuucuuccucug

SEQ ID NO: 2442880 - RNA, 22 nt, Human
ccuggggguucuuucuuccucu

SEQ ID NO: 2442881 - RNA, 21 nt, Human
ccuggggguucuuucuuccuc

SEQ ID NO: 2442882 - RNA, 14 nt, Human
ccuggguccuuuuc

SEQ ID NO: 2442883 - RNA, 18 nt, Human
ccugggucuaagggguug

SEQ ID NO: 2442884 - RNA, 14 nt, Human
ccugggucuguguc

SEQ ID NO: 2442885 - RNA, 15 nt, Human
ccugggucugugucu

SEQ ID NO: 2442886 - RNA, 16 nt, Human
ccugggucugugucuc

SEQ ID NO: 2442887 - RNA, 17 nt, Human
ccugggucugugucucu

SEQ ID NO: 2442888 - RNA, 21 nt, Human
ccugggucugugucucuuuuc

SEQ ID NO: 2442889 - RNA, 14 nt, Human
ccugggugacauuu

SEQ ID NO: 2442890 - RNA, 13 nt, Human
ccugggugacauu

SEQ ID NO: 2442891 - RNA, 15 nt, Human
ccugggugacauuug

SEQ ID NO: 2442892 - RNA, 23 nt, Human
ccugggugcuggcugcccagacc

SEQ ID NO: 2442893 - RNA, 15 nt, Human
ccugggggugccagg

SEQ ID NO: 2442894 - RNA, 16 nt, Human
ccugggggugccagga

SEQ ID NO: 2442895 - RNA, 18 nt, Human
ccuggggguucuuucuuc

SEQ ID NO: 2442896 - RNA, 14 nt, Human
ccugggggugccag

SEQ ID NO: 2442897 - RNA, 15 nt, Human
ccugggccccaccac

SEQ ID NO: 2442898 - RNA, 12 nt, Human
ccuggggggcag

SEQ ID NO: 2442899 - RNA, 16 nt, Human
ccugggcauugcuuuc

SEQ ID NO: 2442900 - RNA, 17 nt, Human
ccugggcauugcuuucc

SEQ ID NO: 2442901 - RNA, 13 nt, Human
ccugggccccacc

SEQ ID NO: 2442902 - RNA, 14 nt, Human
ccugggccccacca

SEQ ID NO: 2442903 - RNA, 22 nt, Human
ccugggcauauccaccaccucc

SEQ ID NO: 2442904 - RNA, 17 nt, Human
ccugggcauacuaauaa

SEQ ID NO: 2442905 - RNA, 17 nt, Human
ccuggcuucuggagccc

SEQ ID NO: 2442906 - RNA, 23 nt, Human
ccugggccacagggcgagacucc

SEQ ID NO: 2442907 - RNA, 16 nt, Human
ccugggcauccuucuu

SEQ ID NO: 2442908 - RNA, 23 nt, Human
ccugggcauauccaccaccuccc

SEQ ID NO: 2442909 - RNA, 14 nt, Human
ccugggcauugcuu

SEQ ID NO: 2442910 - RNA, 15 nt, Human
ccugggcauugcuuu

SEQ ID NO: 2442911 - RNA, 24 nt, Human
ccuggcuuuucacugcuggcugcc

SEQ ID NO: 2442912 - RNA, 23 nt, Human
ccuggcuuuucacugcuggcugc

SEQ ID NO: 2442913 - RNA, 22 nt, Human
ccuggcuuuucacugcuggcug

SEQ ID NO: 2442914 - RNA, 21 nt, Human
ccuggcuuuucacugcuggcu

SEQ ID NO: 2442915 - RNA, 18 nt, Human
ccuggcuuuucacugcug

SEQ ID NO: 2442916 - RNA, 20 nt, Human
ccuggcuuuucacugcuggc

SEQ ID NO: 2442917 - RNA, 13 nt, Human
ccuggcuucuccu

SEQ ID NO: 2442918 - RNA, 13 nt, Human
ccuggcuucugga

SEQ ID NO: 2442919 - RNA, 14 nt, Human
ccuggcuucuggag

SEQ ID NO: 2442920 - RNA, 15 nt, Human
ccuggcuucuggagc

SEQ ID NO: 2442921 - RNA, 16 nt, Human
ccuggcuucuggagcc

SEQ ID NO: 2442922 - RNA, 20 nt, Human
ccuggcugggacguggcuca

SEQ ID NO: 2442923 - RNA, 21 nt, Human
ccuggcugggacguggcucag

SEQ ID NO: 2442924 - RNA, 22 nt, Human
ccuggcugggacguggcucagc

SEQ ID NO: 2442925 - RNA, 24 nt, Human
ccuggcugggacguggcucagcca

SEQ ID NO: 2442926 - RNA, 20 nt, Human
ccuggguuuuguauucucug

SEQ ID NO: 2442927 - RNA, 21 nt, Human
ccuggguuuuguauucucuga

SEQ ID NO: 2442928 - RNA, 22 nt, Human
ccuggguuuuguauucucugag

SEQ ID NO: 2442929 - RNA, 23 nt, Human
ccuggguuuuguauucucugagc

SEQ ID NO: 2442930 - RNA, 19 nt, Human
ccuggguuuuguauucucu

SEQ ID NO: 2442931 - RNA, 16 nt, Human
ccuggguuuaagggga

SEQ ID NO: 2442932 - RNA, 17 nt, Human
ccuggguucccuuuccu

SEQ ID NO: 2442933 - RNA, 16 nt, Human
ccugggugcuggcugc

SEQ ID NO: 2442934 - RNA, 17 nt, Human
ccugggugggcucugug

SEQ ID NO: 2442935 - RNA, 16 nt, Human
ccugggugggcucugu

SEQ ID NO: 2442936 - RNA, 15 nt, Human
ccugggugggcucug

SEQ ID NO: 2442937 - RNA, 15 nt, Human
ccuggguggggcugc

SEQ ID NO: 2442938 - RNA, 16 nt, Human
ccuggguggggcugcu

SEQ ID NO: 2442939 - RNA, 13 nt, Human
ccuggguucccuu

SEQ ID NO: 2442940 - RNA, 22 nt, Human
ccugguacccagccaucugccc

SEQ ID NO: 2442941 - RNA, 20 nt, Human
ccugguacccagccaucugc

SEQ ID NO: 2442942 - RNA, 19 nt, Human
ccugguacccagccaucug

SEQ ID NO: 2442943 - RNA, 18 nt, Human
ccugguacccagccaucu

SEQ ID NO: 2442944 - RNA, 15 nt, Human
ccugguacccuccug

SEQ ID NO: 2442945 - RNA, 14 nt, Human
ccugguacccuccu

SEQ ID NO: 2442946 - RNA, 13 nt, Human
ccugguacccagc

SEQ ID NO: 2442947 - RNA, 17 nt, Human
ccugguacccagccauc

SEQ ID NO: 2442948 - RNA, 15 nt, Human
ccugguacccagcca

SEQ ID NO: 2442949 - RNA, 14 nt, Human
ccugguacccagcc

SEQ ID NO: 2442950 - RNA, 17 nt, Human
ccugguagaauagauau

SEQ ID NO: 2442951 - RNA, 13 nt, Human
ccugguagggcag

SEQ ID NO: 2442952 - RNA, 19 nt, Human
ccugguaggagugugugau

SEQ ID NO: 2442953 - RNA, 19 nt, Human
ccugguacucaagcccgcg

SEQ ID NO: 2442954 - RNA, 16 nt, Human
ccugguacucaagccc

SEQ ID NO: 2442955 - RNA, 17 nt, Human
ccugguacccuccuggc

SEQ ID NO: 2442956 - RNA, 15 nt, Human
ccugguacucaagcc

SEQ ID NO: 2442957 - RNA, 10 nt, Human
ccuggugccc

SEQ ID NO: 2442958 - RNA, 22 nt, Human
ccugguccagggaagcuggccg

SEQ ID NO: 2442959 - RNA, 14 nt, Human
ccugguccagggaa

SEQ ID NO: 2442960 - RNA, 21 nt, Human
ccugguccagggaagcuggcc

SEQ ID NO: 2442961 - RNA, 14 nt, Human
ccuggugaccccuu

SEQ ID NO: 2442962 - RNA, 17 nt, Human
ccuggugaccccuuuuc

SEQ ID NO: 2442963 - RNA, 18 nt, Human
ccugguauauccaaaagc

SEQ ID NO: 2442964 - RNA, 20 nt, Human
ccugguauauccaaaagcuu

SEQ ID NO: 2442965 - RNA, 21 nt, Human
ccuggucacaggacucugccu

SEQ ID NO: 2442966 - RNA, 23 nt, Human
ccuggucacaggacucugccucc

SEQ ID NO: 2442967 - RNA, 22 nt, Human
ccuggucacaggacucugccuc

SEQ ID NO: 2442968 - RNA, 20 nt, Human
ccuggucacagggcaugccc

SEQ ID NO: 2442969 - RNA, 12 nt, Human
ccuggucagccc

SEQ ID NO: 2442970 - RNA, 14 nt, Human
ccuggucagcccaa

SEQ ID NO: 2442971 - RNA, 22 nt, Human
ccuggcugcugcccccaccccg

SEQ ID NO: 2442972 - RNA, 21 nt, Human
ccuggcugcugcccccacccc

SEQ ID NO: 2442973 - RNA, 20 nt, Human
ccuggcugcugcccccaccc

SEQ ID NO: 2442974 - RNA, 18 nt, Human
ccuggcugcugcccccac

SEQ ID NO: 2442975 - RNA, 17 nt, Human
ccuggcugcugccccca

SEQ ID NO: 2442976 - RNA, 16 nt, Human
ccuggcugcugccccc

SEQ ID NO: 2442977 - RNA, 15 nt, Human
ccuggcugcugcccc

SEQ ID NO: 2442978 - RNA, 14 nt, Human
ccuggcugcugccc

SEQ ID NO: 2442979 - RNA, 13 nt, Human
ccuggcugcugcc

SEQ ID NO: 2442980 - RNA, 16 nt, Human
ccuggcugcccuggcc

SEQ ID NO: 2442981 - RNA, 15 nt, Human
ccuggcugcccuggc

SEQ ID NO: 2442982 - RNA, 14 nt, Human
ccuggcugcccugg

SEQ ID NO: 2442983 - RNA, 13 nt, Human
ccuggcugcccug

SEQ ID NO: 2442984 - RNA, 12 nt, Human
ccuggcugcccu

SEQ ID NO: 2442985 - RNA, 24 nt, Human
ccuggcugagguuccucugccugc

SEQ ID NO: 2442986 - RNA, 21 nt, Human
ccuggcucccacaggcagcuu

SEQ ID NO: 2442987 - RNA, 20 nt, Human
ccuggcugcccuggcccuga

SEQ ID NO: 2442988 - RNA, 18 nt, Human
ccuggcugcccuggcccu

SEQ ID NO: 2442989 - RNA, 17 nt, Human
ccuggcugcccuggccc

SEQ ID NO: 2442990 - RNA, 19 nt, Human
ccuggcugcccuggcccug

SEQ ID NO: 2442991 - RNA, 16 nt, Human
ccuggcuccaggccag

SEQ ID NO: 2442992 - RNA, 17 nt, Human
ccuggcuccaggccagg

SEQ ID NO: 2442993 - RNA, 22 nt, Human
ccuggcuccaaacccucgaggc

SEQ ID NO: 2442994 - RNA, 15 nt, Human
ccuggcuccaggcca

SEQ ID NO: 2442995 - RNA, 20 nt, Human
ccuggcucccacaggcagcu

SEQ ID NO: 2442996 - RNA, 19 nt, Human
ccuggcucccacaggcagc

SEQ ID NO: 2442997 - RNA, 18 nt, Human
ccuggcucccacaggcag

SEQ ID NO: 2442998 - RNA, 16 nt, Human
ccuggcucccacaggc

SEQ ID NO: 2442999 - RNA, 17 nt, Human
ccuggcucccacaggcc

SEQ ID NO: 2443000 - RNA, 18 nt, Human
ccuggcugcagccugcgc

SEQ ID NO: 2443001 - RNA, 23 nt, Human
ccuggcucccacaggcccuuccu

SEQ ID NO: 2443002 - RNA, 12 nt, Human
ccuggccagaca

SEQ ID NO: 2443003 - RNA, 13 nt, Human
ccuggccagacac

SEQ ID NO: 2443004 - RNA, 14 nt, Human
ccuggccagacaca

SEQ ID NO: 2443005 - RNA, 15 nt, Human
ccuggccagacacag

SEQ ID NO: 2443006 - RNA, 16 nt, Human
ccuggccagacacagg

SEQ ID NO: 2443007 - RNA, 18 nt, Human
ccuggccagacacaggcc

SEQ ID NO: 2443008 - RNA, 19 nt, Human
ccuggccagacacaggccc

SEQ ID NO: 2443009 - RNA, 23 nt, Human
ccuggccagacacaggcccuccc

SEQ ID NO: 2443010 - RNA, 15 nt, Human
ccuggccagaugcac

SEQ ID NO: 2443011 - RNA, 20 nt, Human
ccuggcuccaaacccucgag

SEQ ID NO: 2443012 - RNA, 12 nt, Human
ccuggccagagg

SEQ ID NO: 2443013 - RNA, 13 nt, Human
ccuggccagaggc

SEQ ID NO: 2443014 - RNA, 14 nt, Human
ccuggccagaggcu

SEQ ID NO: 2443015 - RNA, 14 nt, Human
ccuggcagcucugg

SEQ ID NO: 2443016 - RNA, 15 nt, Human
ccuggcagcucugga

SEQ ID NO: 2443017 - RNA, 17 nt, Human
ccuggcagcucuggaca

SEQ ID NO: 2443018 - RNA, 19 nt, Human
ccuggcagcucuggacagc

SEQ ID NO: 2443019 - RNA, 20 nt, Human
ccuggcagcucuggacagcc

SEQ ID NO: 2443020 - RNA, 21 nt, Human
ccuggcagcucuggacagccc

SEQ ID NO: 2443021 - RNA, 23 nt, Human
ccuggcagcucuggacagcccca

SEQ ID NO: 2443022 - RNA, 17 nt, Human
ccuggcaggaugacccu

SEQ ID NO: 2443023 - RNA, 22 nt, Human
ccuggcagccgugccuucagcu

SEQ ID NO: 2443024 - RNA, 21 nt, Human
ccuggcagccgugccuucagc

SEQ ID NO: 2443025 - RNA, 12 nt, Human
ccuggcagcucu

SEQ ID NO: 2443026 - RNA, 13 nt, Human
ccuggcagcucug

SEQ ID NO: 2443027 - RNA, 23 nt, Human
ccuggcacccggccccugcuggu

SEQ ID NO: 2443028 - RNA, 14 nt, Human
ccuggcagaacuga

SEQ ID NO: 2443029 - RNA, 18 nt, Human
ccuggcacgguggcucag

SEQ ID NO: 2443030 - RNA, 22 nt, Human
ccuggcacgguggcucaggccu

SEQ ID NO: 2443031 - RNA, 18 nt, Human
ccuggagauccuccugca

SEQ ID NO: 2443032 - RNA, 17 nt, Human
ccuggagauccuccugc

SEQ ID NO: 2443033 - RNA, 16 nt, Human
ccuggagauccuccug

SEQ ID NO: 2443034 - RNA, 22 nt, Human
ccuggcacccggccccugcugg

SEQ ID NO: 2443035 - RNA, 13 nt, Human
ccuggcagccccu

SEQ ID NO: 2443036 - RNA, 12 nt, Human
ccuggcagcccc

SEQ ID NO: 2443037 - RNA, 23 nt, Human
ccuggcacuaacguugagccccu

SEQ ID NO: 2443038 - RNA, 17 nt, Human
ccuggcagaacugagcu

SEQ ID NO: 2443039 - RNA, 18 nt, Human
ccuggcagaacugagcuc

SEQ ID NO: 2443040 - RNA, 13 nt, Human
ccuggcagaaugc

SEQ ID NO: 2443041 - RNA, 20 nt, Human
ccuggcagaacugagcuccu

SEQ ID NO: 2443042 - RNA, 23 nt, Human
ccuggcagaacugagcuccucug

SEQ ID NO: 2443043 - RNA, 23 nt, Human
ccuggagacuuagggcaccaggg

SEQ ID NO: 2443044 - RNA, 19 nt, Human
ccuggagacuuagggcacc

SEQ ID NO: 2443045 - RNA, 18 nt, Human
ccuggagacugcccagcu

SEQ ID NO: 2443046 - RNA, 19 nt, Human
ccuggagacuaaccccacc

SEQ ID NO: 2443047 - RNA, 21 nt, Human
ccuggagagcuagaaccuaga

SEQ ID NO: 2443048 - RNA, 19 nt, Human
ccuggagagcuagaaccua

SEQ ID NO: 2443049 - RNA, 14 nt, Human
ccuggagagcuaga

SEQ ID NO: 2443050 - RNA, 13 nt, Human
ccuggagagcuag

SEQ ID NO: 2443051 - RNA, 23 nt, Human
ccuggagagccagaaccuggagg

SEQ ID NO: 2443052 - RNA, 22 nt, Human
ccuggagagccagaaccuggag

SEQ ID NO: 2443053 - RNA, 21 nt, Human
ccuggagagccagaaccugga

SEQ ID NO: 2443054 - RNA, 14 nt, Human
ccuggagagccaga

SEQ ID NO: 2443055 - RNA, 15 nt, Human
ccuggagauccuccu

SEQ ID NO: 2443056 - RNA, 13 nt, Human
ccuggagauccuc

SEQ ID NO: 2443057 - RNA, 22 nt, Human
ccuggagagcuagaaccuggag

SEQ ID NO: 2443058 - RNA, 21 nt, Human
ccuggagagcuagaaccugga

SEQ ID NO: 2443059 - RNA, 23 nt, Human
ccuggagaguucaauggcugcug

SEQ ID NO: 2443060 - RNA, 22 nt, Human
ccuggagaguucaauggcugcu

SEQ ID NO: 2443061 - RNA, 18 nt, Human
ccuggaauauauaaccag

SEQ ID NO: 2443062 - RNA, 11 nt, Human
ccuggaagggc

SEQ ID NO: 2443063 - RNA, 12 nt, Human
ccuggaagggcu

SEQ ID NO: 2443064 - RNA, 21 nt, Human
ccuggaagcuguguccuugca

SEQ ID NO: 2443065 - RNA, 17 nt, Human
ccuggacacucagaccu

SEQ ID NO: 2443066 - RNA, 16 nt, Human
ccuggacacucagacc

SEQ ID NO: 2443067 - RNA, 24 nt, Human
ccuggaagggcuagaaccuguaga

SEQ ID NO: 2443068 - RNA, 13 nt, Human
ccuggaagggcua

SEQ ID NO: 2443069 - RNA, 18 nt, Human
cccuaccgagucucuucu

SEQ ID NO: 2443070 - RNA, 14 nt, Human
cccuaccccaccac

SEQ ID NO: 2443071 - RNA, 21 nt, Human
cccuaccgagucucuucucca

SEQ ID NO: 2443072 - RNA, 13 nt, Human
cccuaccucaggc

SEQ ID NO: 2443073 - RNA, 14 nt, Human
cccuaccugugccu

SEQ ID NO: 2443074 - RNA, 19 nt, Human
cccuaccuguucagugucc

SEQ ID NO: 2443075 - RNA, 23 nt, Human
cccuacuauucaguggcgagaaa

SEQ ID NO: 2443076 - RNA, 16 nt, Human
cccuaccucaggcagg

SEQ ID NO: 2443077 - RNA, 22 nt, Human
cccuaccugauuggugcaaccc

SEQ ID NO: 2443078 - RNA, 23 nt, Human
cccuaccugauuggugcaacccu

SEQ ID NO: 2443079 - RNA, 18 nt, Human
cccuagcccaggagagag

SEQ ID NO: 2443080 - RNA, 20 nt, Human
cccuagcuccacacccucuc

SEQ ID NO: 2443081 - RNA, 19 nt, Human
cccuagcuuuagacccugg

SEQ ID NO: 2443082 - RNA, 18 nt, Human
cccuagcuuuagacccug

SEQ ID NO: 2443083 - RNA, 17 nt, Human
cccuagcuuuagacccu

SEQ ID NO: 2443084 - RNA, 22 nt, Human
cccuagcuuagagccucccuca

SEQ ID NO: 2443085 - RNA, 14 nt, Human
cccuaggagaccaa

SEQ ID NO: 2443086 - RNA, 21 nt, Human
cccuagcuuuagacccugggu

SEQ ID NO: 2443087 - RNA, 14 nt, Human
cccuaggggacacu

SEQ ID NO: 2443088 - RNA, 18 nt, Human
cccuaggggacacuuccc

SEQ ID NO: 2443089 - RNA, 17 nt, Human
cccuaggggacacuucc

SEQ ID NO: 2443090 - RNA, 19 nt, Human
cccuaggggacacuucccu

SEQ ID NO: 2443091 - RNA, 21 nt, Human
cccuaggucagcuugcugccc

SEQ ID NO: 2443092 - RNA, 23 nt, Human
cccuaaugcgcaggcuggcccug

SEQ ID NO: 2443093 - RNA, 18 nt, Human
cccuacaccccuccccug

SEQ ID NO: 2443094 - RNA, 20 nt, Human
cccuacaguugaaaaacagc

SEQ ID NO: 2443095 - RNA, 21 nt, Human
cccuaccccacaccaggccgu

SEQ ID NO: 2443096 - RNA, 19 nt, Human
cccuaccccacaccaggcc

SEQ ID NO: 2443097 - RNA, 23 nt, Human
cccuaccagcgcccgcugggcug

SEQ ID NO: 2443098 - RNA, 22 nt, Human
cccuaccagcgcccgcugggcu

SEQ ID NO: 2443099 - RNA, 21 nt, Human
cccuaccagcgcccgcugggc

SEQ ID NO: 2443100 - RNA, 20 nt, Human
cccuaccagcgcccgcuggg

SEQ ID NO: 2443101 - RNA, 20 nt, Human
cccuaccacugucuucuuca

SEQ ID NO: 2443102 - RNA, 17 nt, Human
cccuaccacugucuucu

SEQ ID NO: 2443103 - RNA, 13 nt, Human
cccuacaccuuga

SEQ ID NO: 2443104 - RNA, 14 nt, Human
cccuacauguauug

SEQ ID NO: 2443105 - RNA, 17 nt, Human
cccuaccaccuccccag

SEQ ID NO: 2443106 - RNA, 19 nt, Human
cccuaccaccuccccagcc

SEQ ID NO: 2443107 - RNA, 20 nt, Human
cccuaccaccuccccagccu

SEQ ID NO: 2443108 - RNA, 15 nt, Human
cccguguccugccug

SEQ ID NO: 2443109 - RNA, 19 nt, Human
cccguguccccggccucag

SEQ ID NO: 2443110 - RNA, 12 nt, Human
cccguggucucu

SEQ ID NO: 2443111 - RNA, 14 nt, Human
cccguguggccccu

SEQ ID NO: 2443112 - RNA, 17 nt, Human
cccguguggccccuuca

SEQ ID NO: 2443113 - RNA, 22 nt, Human
cccguguggccccuucacuucu

SEQ ID NO: 2443114 - RNA, 22 nt, Human
cccuaaucuauggucgggagac

SEQ ID NO: 2443115 - RNA, 19 nt, Human
cccguucugcuggccugga

SEQ ID NO: 2443116 - RNA, 17 nt, Human
cccguucugcuggccug

SEQ ID NO: 2443117 - RNA, 18 nt, Human
cccguguggccccuucac

SEQ ID NO: 2443118 - RNA, 21 nt, Human
cccuaaugcgcaggcuggccc

SEQ ID NO: 2443119 - RNA, 22 nt, Human
cccuaaugcgcaggcuggcccu

SEQ ID NO: 2443120 - RNA, 17 nt, Human
cccuaaugcgcaggcug

SEQ ID NO: 2443121 - RNA, 15 nt, Human
cccuaaucuaugguc

SEQ ID NO: 2443122 - RNA, 12 nt, Human
cccuaaugccug

SEQ ID NO: 2443123 - RNA, 18 nt, Human
cccggugcccaagaauag

SEQ ID NO: 2443124 - RNA, 21 nt, Human
cccggggugcccacaggccgc

SEQ ID NO: 2443125 - RNA, 22 nt, Human
cccggguuuggcgggccaagga

SEQ ID NO: 2443126 - RNA, 15 nt, Human
cccgguucuuccagu

SEQ ID NO: 2443127 - RNA, 22 nt, Human
cccggucccuugagaccucagc

SEQ ID NO: 2443128 - RNA, 15 nt, Human
cccgucacagccuca

SEQ ID NO: 2443129 - RNA, 14 nt, Human
cccguaaugcuuag

SEQ ID NO: 2443130 - RNA, 17 nt, Human
cccgucaccaucucagg

SEQ ID NO: 2443131 - RNA, 18 nt, Human
cccgucaccaucucaggc

SEQ ID NO: 2443132 - RNA, 17 nt, Human
cccgggguccuguggca

SEQ ID NO: 2443133 - RNA, 21 nt, Human
cccggggcagcugccagagaa

SEQ ID NO: 2443134 - RNA, 22 nt, Human
cccgggguccuguggcaggcag

SEQ ID NO: 2443135 - RNA, 18 nt, Human
cccgggguccuguggcag

SEQ ID NO: 2443136 - RNA, 20 nt, Human
cccggguuuggcgggccaag

SEQ ID NO: 2443137 - RNA, 16 nt, Human
cccgggcucugccucc

SEQ ID NO: 2443138 - RNA, 16 nt, Human
cccgggcugccugggc

SEQ ID NO: 2443139 - RNA, 15 nt, Human
cccgggcugccuggg

SEQ ID NO: 2443140 - RNA, 13 nt, Human
cccgggcugccug

SEQ ID NO: 2443141 - RNA, 12 nt, Human
cccgggcugccu

SEQ ID NO: 2443142 - RNA, 16 nt, Human
cccgggcucucugcug

SEQ ID NO: 2443143 - RNA, 17 nt, Human
cccgggcucucugcugu

SEQ ID NO: 2443144 - RNA, 16 nt, Human
cccggggacccuguga

SEQ ID NO: 2443145 - RNA, 15 nt, Human
cccggggacccugug

SEQ ID NO: 2443146 - RNA, 23 nt, Human
cccgggcugccugggcuguuggc

SEQ ID NO: 2443147 - RNA, 17 nt, Human
cccgggcugccugggcu

SEQ ID NO: 2443148 - RNA, 22 nt, Human
cccggggaaaggcaagguccgg

SEQ ID NO: 2443149 - RNA, 21 nt, Human
cccggggacccugugacaugg

SEQ ID NO: 2443150 - RNA, 18 nt, Human
cccggggacccugugaca

SEQ ID NO: 2443151 - RNA, 17 nt, Human
cccggggacccugugac

SEQ ID NO: 2443152 - RNA, 12 nt, Human
cccggggcagcu

SEQ ID NO: 2443153 - RNA, 14 nt, Human
cccggggcagcugc

SEQ ID NO: 2443154 - RNA, 19 nt, Human
cccggggcagcugccagag

SEQ ID NO: 2443155 - RNA, 20 nt, Human
cccggggcagcugccagaga

SEQ ID NO: 2443156 - RNA, 23 nt, Human
cccguggccccagccuggcccag

SEQ ID NO: 2443157 - RNA, 22 nt, Human
cccguggccccagccuggccca

SEQ ID NO: 2443158 - RNA, 21 nt, Human
cccguggccccagccuggccc

SEQ ID NO: 2443159 - RNA, 20 nt, Human
cccguggccccagccuggcc

SEQ ID NO: 2443160 - RNA, 18 nt, Human
cccguggccccagccugg

SEQ ID NO: 2443161 - RNA, 15 nt, Human
cccgugggguuccuc

SEQ ID NO: 2443162 - RNA, 19 nt, Human
cccgucucucucccaugga

SEQ ID NO: 2443163 - RNA, 16 nt, Human
cccgucucucucccau

SEQ ID NO: 2443164 - RNA, 22 nt, Human
cccgucucugguuccuccccuc

SEQ ID NO: 2443165 - RNA, 23 nt, Human
cccgucugggguucagccccucc

SEQ ID NO: 2443166 - RNA, 20 nt, Human
cccgucugggguucagcccc

SEQ ID NO: 2443167 - RNA, 21 nt, Human
cccgucugggguucagccccu

SEQ ID NO: 2443168 - RNA, 17 nt, Human
cccguggccccagccug

SEQ ID NO: 2443169 - RNA, 15 nt, Human
cccguggccccagcc

SEQ ID NO: 2443170 - RNA, 17 nt, Human
cccguccugccuguggc

SEQ ID NO: 2443171 - RNA, 16 nt, Human
cccguccugccugugg

SEQ ID NO: 2443172 - RNA, 15 nt, Human
cccguccugccugug

SEQ ID NO: 2443173 - RNA, 14 nt, Human
cccguccugccugu

SEQ ID NO: 2443174 - RNA, 16 nt, Human
cccgucccauauccug

SEQ ID NO: 2443175 - RNA, 18 nt, Human
cccguccacggcucuagg

SEQ ID NO: 2443176 - RNA, 13 nt, Human
cccguccugccug

SEQ ID NO: 2443177 - RNA, 17 nt, Human
cccgucagggcccaagu

SEQ ID NO: 2443178 - RNA, 19 nt, Human
cccgucaggacguugagga

SEQ ID NO: 2443179 - RNA, 22 nt, Human
cccgucagggcccaagucccug

SEQ ID NO: 2443180 - RNA, 18 nt, Human
cccgucauguuccucaaa

SEQ ID NO: 2443181 - RNA, 15 nt, Human
cccgucucucuccca

SEQ ID NO: 2443182 - RNA, 12 nt, Human
cccgucucucuc

SEQ ID NO: 2443183 - RNA, 13 nt, Human
cccgucucagugu

SEQ ID NO: 2443184 - RNA, 12 nt, Human
cccgucucagug

SEQ ID NO: 2443185 - RNA, 19 nt, Human
cccgucccauauccugccu

SEQ ID NO: 2443186 - RNA, 20 nt, Human
cccgucgaggggcucucagc

SEQ ID NO: 2443187 - RNA, 21 nt, Human
cccgaguagcugggacuacag

SEQ ID NO: 2443188 - RNA, 18 nt, Human
cccgaguagcugggacua

SEQ ID NO: 2443189 - RNA, 17 nt, Human
cccgaguagcugggacu

SEQ ID NO: 2443190 - RNA, 16 nt, Human
cccgaguagcugggac

SEQ ID NO: 2443191 - RNA, 15 nt, Human
cccgaguagcuggga

SEQ ID NO: 2443192 - RNA, 14 nt, Human
cccgaguagcuggg

SEQ ID NO: 2443193 - RNA, 13 nt, Human
cccgaguagcugg

SEQ ID NO: 2443194 - RNA, 22 nt, Human
cccgagggaugaugccacacca

SEQ ID NO: 2443195 - RNA, 20 nt, Human
cccgagggaugaugccacac

SEQ ID NO: 2443196 - RNA, 14 nt, Human
cccgaggcugccca

SEQ ID NO: 2443197 - RNA, 19 nt, Human
cccgaggcugcccacuaug

SEQ ID NO: 2443198 - RNA, 22 nt, Human
cccagagggcccaggcaggcca

SEQ ID NO: 2443199 - RNA, 23 nt, Human
cccagagggcccaggcaggccac

SEQ ID NO: 2443200 - RNA, 20 nt, Human
cccagaacuggacucaggau

SEQ ID NO: 2443201 - RNA, 19 nt, Human
cccagaaccuguccuugca

SEQ ID NO: 2443202 - RNA, 15 nt, Human
cccagaaccuguccu

SEQ ID NO: 2443203 - RNA, 17 nt, Human
cccagaaccuguccuug

SEQ ID NO: 2443204 - RNA, 19 nt, Human
cccagaacuggacucagga

SEQ ID NO: 2443205 - RNA, 19 nt, Human
cccagaaggaccuccugag

SEQ ID NO: 2443206 - RNA, 13 nt, Human
cccagaaggcagg

SEQ ID NO: 2443207 - RNA, 23 nt, Human
cccagaaggcagggaaaggcucu

SEQ ID NO: 2443208 - RNA, 16 nt, Human
cccagaggcuggguga

SEQ ID NO: 2443209 - RNA, 13 nt, Human
cccagagggccca

SEQ ID NO: 2443210 - RNA, 15 nt, Human
cccagaaaaggacag

SEQ ID NO: 2443211 - RNA, 17 nt, Human
cccagaaaaggacagaa

SEQ ID NO: 2443212 - RNA, 16 nt, Human
cccagaaaaggacaga

SEQ ID NO: 2443213 - RNA, 14 nt, Human
cccagaaaggagac

SEQ ID NO: 2443214 - RNA, 15 nt, Human
cccagaaaggagacu

SEQ ID NO: 2443215 - RNA, 17 nt, Human
cccagaaaggagacuag

SEQ ID NO: 2443216 - RNA, 14 nt, Human
cccagaacacacuc

SEQ ID NO: 2443217 - RNA, 18 nt, Human
cccagaacacacuccauc

SEQ ID NO: 2443218 - RNA, 22 nt, Human
cccagaacacacuccaucagcu

SEQ ID NO: 2443219 - RNA, 14 nt, Human
cccagaaccugucc

SEQ ID NO: 2443220 - RNA, 15 nt, Human
cccagagggccugca

SEQ ID NO: 2443221 - RNA, 21 nt, Human
cccgaggccuucucugaagga

SEQ ID NO: 2443222 - RNA, 14 nt, Human
cccagagggccugc

SEQ ID NO: 2443223 - RNA, 14 nt, Human
cccagagggcccag

SEQ ID NO: 2443224 - RNA, 15 nt, Human
cccagagggcccagg

SEQ ID NO: 2443225 - RNA, 16 nt, Human
cccagagggcccaggc

SEQ ID NO: 2443226 - RNA, 18 nt, Human
cccagagggcccaggcag

SEQ ID NO: 2443227 - RNA, 15 nt, Human
cccgggcucugccuc

SEQ ID NO: 2443228 - RNA, 14 nt, Human
cccgggcucugccu

SEQ ID NO: 2443229 - RNA, 21 nt, Human
cccgggcucagggaccacagc

SEQ ID NO: 2443230 - RNA, 20 nt, Human
cccgggcucagggaccacag

SEQ ID NO: 2443231 - RNA, 21 nt, Human
cccgggcgcggccagccccgg

SEQ ID NO: 2443232 - RNA, 19 nt, Human
cccgggcgcggccagcccc

SEQ ID NO: 2443233 - RNA, 18 nt, Human
cccgggcccucccuugga

SEQ ID NO: 2443234 - RNA, 17 nt, Human
cccgggcccucccuugg

SEQ ID NO: 2443235 - RNA, 22 nt, Human
cccgggcccguugaggaugagg

SEQ ID NO: 2443236 - RNA, 20 nt, Human
cccgggcccguugaggauga

SEQ ID NO: 2443237 - RNA, 12 nt, Human
cccgggcucugc

SEQ ID NO: 2443238 - RNA, 22 nt, Human
cccgggaggggcccgcuugccu

SEQ ID NO: 2443239 - RNA, 18 nt, Human
cccgggaggggcccgcuu

SEQ ID NO: 2443240 - RNA, 17 nt, Human
cccgggaggggcccgcu

SEQ ID NO: 2443241 - RNA, 15 nt, Human
cccgggaggggcccg

SEQ ID NO: 2443242 - RNA, 23 nt, Human
cccgggaggggcccgcuugccuc

SEQ ID NO: 2443243 - RNA, 13 nt, Human
cccgggaggggcc

SEQ ID NO: 2443244 - RNA, 23 nt, Human
cccgcuugccucggcuccugcug

SEQ ID NO: 2443245 - RNA, 22 nt, Human
cccgcuugccucggcuccugcu

SEQ ID NO: 2443246 - RNA, 21 nt, Human
cccgcuugccucggcuccugc

SEQ ID NO: 2443247 - RNA, 20 nt, Human
cccgcuugccucggcuccug

SEQ ID NO: 2443248 - RNA, 19 nt, Human
cccgcuugccucggcuccu

SEQ ID NO: 2443249 - RNA, 17 nt, Human
cccgcuugccucggcuc

SEQ ID NO: 2443250 - RNA, 15 nt, Human
cccgcuugccucggc

SEQ ID NO: 2443251 - RNA, 12 nt, Human
cccgcuugccuc

SEQ ID NO: 2443252 - RNA, 11 nt, Human
cccgcuugccu

SEQ ID NO: 2443253 - RNA, 21 nt, Human
cccgcugggcugagccccuac

SEQ ID NO: 2443254 - RNA, 15 nt, Human
cccgcugggcugagc

SEQ ID NO: 2443255 - RNA, 12 nt, Human
cccgcugggcug

SEQ ID NO: 2443256 - RNA, 20 nt, Human
cccgcugucagccauuccug

SEQ ID NO: 2443257 - RNA, 19 nt, Human
cccgcugucagccauuccu

SEQ ID NO: 2443258 - RNA, 16 nt, Human
cccgccugccaguccu

SEQ ID NO: 2443259 - RNA, 14 nt, Human
cccgccugccaguc

SEQ ID NO: 2443260 - RNA, 13 nt, Human
cccgccugccagu

SEQ ID NO: 2443261 - RNA, 12 nt, Human
cccgccugcccu

SEQ ID NO: 2443262 - RNA, 16 nt, Human
cccgcugcugcugcug

SEQ ID NO: 2443263 - RNA, 12 nt, Human
cccgccugccag

SEQ ID NO: 2443264 - RNA, 11 nt, Human
cccgccugcca

SEQ ID NO: 2443265 - RNA, 21 nt, Human
cccgccucucccgucagggcc

SEQ ID NO: 2443266 - RNA, 13 nt, Human
cccgccucucccg

SEQ ID NO: 2443267 - RNA, 12 nt, Human
cccgccucuccc

SEQ ID NO: 2443268 - RNA, 22 nt, Human
cccgaguagcugggacuacagg

SEQ ID NO: 2443269 - RNA, 21 nt, Human
cccgagucauucguucugugg

SEQ ID NO: 2443270 - RNA, 19 nt, Human
cccgccccacauuccgaca

SEQ ID NO: 2443271 - RNA, 16 nt, Human
cccgcccccugcccuc

SEQ ID NO: 2443272 - RNA, 17 nt, Human
cccgcccccugcccucc

SEQ ID NO: 2443273 - RNA, 20 nt, Human
cccgccccuuccccgaggga

SEQ ID NO: 2443274 - RNA, 15 nt, Human
cccgccccacauucc

SEQ ID NO: 2443275 - RNA, 20 nt, Human
cccgccgcuuuucuccucuu

SEQ ID NO: 2443276 - RNA, 19 nt, Human
cccgccgcuuuucuccucu

SEQ ID NO: 2443277 - RNA, 18 nt, Human
cccgccgccugguacuca

SEQ ID NO: 2443278 - RNA, 12 nt, Human
cccucuggggcu

SEQ ID NO: 2443279 - RNA, 18 nt, Human
cccucuggccaggaugga

SEQ ID NO: 2443280 - RNA, 22 nt, Human
cccucuggccaggauggagggg

SEQ ID NO: 2443281 - RNA, 13 nt, Human
cccucuggcccug

SEQ ID NO: 2443282 - RNA, 14 nt, Human
cccucuggcccugc

SEQ ID NO: 2443283 - RNA, 21 nt, Human
cccucuggaguggccacuaag

SEQ ID NO: 2443284 - RNA, 22 nt, Human
cccucuggaguggccacuaagc

SEQ ID NO: 2443285 - RNA, 18 nt, Human
cccucuggaguggccacu

SEQ ID NO: 2443286 - RNA, 12 nt, Human
cccucuggccag

SEQ ID NO: 2443287 - RNA, 13 nt, Human
cccucuggaucaa

SEQ ID NO: 2443288 - RNA, 13 nt, Human
cccucuggccagg

SEQ ID NO: 2443289 - RNA, 22 nt, Human
cccucuggagggguguggcucc

SEQ ID NO: 2443290 - RNA, 21 nt, Human
cccucuggagggguguggcuc

SEQ ID NO: 2443291 - RNA, 12 nt, Human
cccucuggaggg

SEQ ID NO: 2443292 - RNA, 15 nt, Human
cccucugcugcuguc

SEQ ID NO: 2443293 - RNA, 14 nt, Human
cccucugcugcugu

SEQ ID NO: 2443294 - RNA, 15 nt, Human
cccucugccuguccc

SEQ ID NO: 2443295 - RNA, 16 nt, Human
cccucugccugucccu

SEQ ID NO: 2443296 - RNA, 23 nt, Human
cccucugccugucccucucaggc

SEQ ID NO: 2443297 - RNA, 14 nt, Human
cccucugaccugca

SEQ ID NO: 2443298 - RNA, 19 nt, Human
cccucugaaugguccaggg

SEQ ID NO: 2443299 - RNA, 18 nt, Human
cccucucuugcacccgcc

SEQ ID NO: 2443300 - RNA, 13 nt, Human
cccucucuugcac

SEQ ID NO: 2443301 - RNA, 23 nt, Human
cccucucuugcacccgccucucc

SEQ ID NO: 2443302 - RNA, 15 nt, Human
cccucucugcucugc

SEQ ID NO: 2443303 - RNA, 16 nt, Human
cccucucugcucugcg

SEQ ID NO: 2443304 - RNA, 11 nt, Human
cccucucugga

SEQ ID NO: 2443305 - RNA, 19 nt, Human
cccucugaccugcacuggg

SEQ ID NO: 2443306 - RNA, 17 nt, Human
cccucugaccugcacug

SEQ ID NO: 2443307 - RNA, 16 nt, Human
cccucugaccugcacu

SEQ ID NO: 2443308 - RNA, 15 nt, Human
cccucugaccugcac

SEQ ID NO: 2443309 - RNA, 9 nt, Human
cccucugcc

SEQ ID NO: 2443310 - RNA, 21 nt, Human
cccucugagaauuccaaggag

SEQ ID NO: 2443311 - RNA, 20 nt, Human
cccucugagaauuccaagga

SEQ ID NO: 2443312 - RNA, 22 nt, Human
cccucugaaugguccaggguug

SEQ ID NO: 2443313 - RNA, 13 nt, Human
cccucugccacca

SEQ ID NO: 2443314 - RNA, 12 nt, Human
cccucugccacc

SEQ ID NO: 2443315 - RNA, 14 nt, Human
cccucugccaccag

SEQ ID NO: 2443316 - RNA, 14 nt, Human
cccucugccugucc

SEQ ID NO: 2443317 - RNA, 20 nt, Human
cccucucugcaucugaccac

SEQ ID NO: 2443318 - RNA, 18 nt, Human
cccucucugcaucugacc

SEQ ID NO: 2443319 - RNA, 14 nt, Human
cccucucugcucug

SEQ ID NO: 2443320 - RNA, 12 nt, Human
cccucucugcau

SEQ ID NO: 2443321 - RNA, 18 nt, Human
cccucucucuucugcucc

SEQ ID NO: 2443322 - RNA, 19 nt, Human
cccucucucuucugcucca

SEQ ID NO: 2443323 - RNA, 22 nt, Human
cccucucucuucugcuccaccc

SEQ ID NO: 2443324 - RNA, 23 nt, Human
cccucucucuucugcuccacccu

SEQ ID NO: 2443325 - RNA, 13 nt, Human
cccucucuccucc

SEQ ID NO: 2443326 - RNA, 18 nt, Human
cccucucucugacucuca

SEQ ID NO: 2443327 - RNA, 15 nt, Human
cccucucucugacuc

SEQ ID NO: 2443328 - RNA, 13 nt, Human
cccucucucugac

SEQ ID NO: 2443329 - RNA, 12 nt, Human
cccucucucuga

SEQ ID NO: 2443330 - RNA, 13 nt, Human
cccucucucuucu

SEQ ID NO: 2443331 - RNA, 14 nt, Human
cccucucucuucug

SEQ ID NO: 2443332 - RNA, 15 nt, Human
cccucucucuucugc

SEQ ID NO: 2443333 - RNA, 17 nt, Human
cccucucucuucugcuc

SEQ ID NO: 2443334 - RNA, 21 nt, Human
cccucccccgccacuccugaa

SEQ ID NO: 2443335 - RNA, 11 nt, Human
cccucuccugc

SEQ ID NO: 2443336 - RNA, 20 nt, Human
cccucccccccaugcacugu

SEQ ID NO: 2443337 - RNA, 17 nt, Human
cccucuccugccuacuc

SEQ ID NO: 2443338 - RNA, 12 nt, Human
cccucuccugcc

SEQ ID NO: 2443339 - RNA, 13 nt, Human
cccucuccugccu

SEQ ID NO: 2443340 - RNA, 17 nt, Human
cccucuccuuccugugu

SEQ ID NO: 2443341 - RNA, 13 nt, Human
cccucccauuagg

SEQ ID NO: 2443342 - RNA, 17 nt, Human
cccucccaucugggagu

SEQ ID NO: 2443343 - RNA, 16 nt, Human
cccucccaucugggag

SEQ ID NO: 2443344 - RNA, 14 nt, Human
cccucccaucuggg

SEQ ID NO: 2443345 - RNA, 16 nt, Human
cccuccccagagcacu

SEQ ID NO: 2443346 - RNA, 15 nt, Human
cccucccauuaggac

SEQ ID NO: 2443347 - RNA, 15 nt, Human
cccuccccagagcac

SEQ ID NO: 2443348 - RNA, 13 nt, Human
cccucccaucugg

SEQ ID NO: 2443349 - RNA, 22 nt, Human
cccucccagggccagggcccug

SEQ ID NO: 2443350 - RNA, 15 nt, Human
cccucccccccaugc

SEQ ID NO: 2443351 - RNA, 18 nt, Human
cccucccccccaugcacu

SEQ ID NO: 2443352 - RNA, 14 nt, Human
cccucccccacugc

SEQ ID NO: 2443353 - RNA, 14 nt, Human
cccuccccagggga

SEQ ID NO: 2443354 - RNA, 14 nt, Human
cccuccccauggag

SEQ ID NO: 2443355 - RNA, 16 nt, Human
cccucccccaaccccc

SEQ ID NO: 2443356 - RNA, 16 nt, Human
cccuccccaucccaug

SEQ ID NO: 2443357 - RNA, 12 nt, Human
cccuccccaggg

SEQ ID NO: 2443358 - RNA, 13 nt, Human
cccuccccagggg

SEQ ID NO: 2443359 - RNA, 13 nt, Human
cccuccaccugcu

SEQ ID NO: 2443360 - RNA, 23 nt, Human
cccuccacucuccucuuccaggc

SEQ ID NO: 2443361 - RNA, 12 nt, Human
cccuccacuguc

SEQ ID NO: 2443362 - RNA, 12 nt, Human
cccuccacuccu

SEQ ID NO: 2443363 - RNA, 17 nt, Human
cccuccacuccuuccug

SEQ ID NO: 2443364 - RNA, 18 nt, Human
cccuccacguucaccccu

SEQ ID NO: 2443365 - RNA, 22 nt, Human
cccuccacccugucccccagcu

SEQ ID NO: 2443366 - RNA, 16 nt, Human
cccuccacccuguccc

SEQ ID NO: 2443367 - RNA, 14 nt, Human
cccuccacaucccu

SEQ ID NO: 2443368 - RNA, 14 nt, Human
cccuauccacccag

SEQ ID NO: 2443369 - RNA, 16 nt, Human
cccuauccacccagcc

SEQ ID NO: 2443370 - RNA, 18 nt, Human
cccuauccacccagccca

SEQ ID NO: 2443371 - RNA, 14 nt, Human
cccuccacccuguc

SEQ ID NO: 2443372 - RNA, 12 nt, Human
cccuccacccug

SEQ ID NO: 2443373 - RNA, 19 nt, Human
cccuauccacccagcccau

SEQ ID NO: 2443374 - RNA, 15 nt, Human
cccuccacaucccug

SEQ ID NO: 2443375 - RNA, 23 nt, Human
cccuauauguaguauaaagaaaa

SEQ ID NO: 2443376 - RNA, 19 nt, Human
cccuagugacccggaggcc

SEQ ID NO: 2443377 - RNA, 21 nt, Human
cccuagugacccggaggccac

SEQ ID NO: 2443378 - RNA, 19 nt, Human
cccuaguucuaccucaggc

SEQ ID NO: 2443379 - RNA, 17 nt, Human
cccuagucccuuccccu

SEQ ID NO: 2443380 - RNA, 22 nt, Human
cccuagucccuuccccucccug

SEQ ID NO: 2443381 - RNA, 22 nt, Human
cccuaggucagcuugcugcccu

SEQ ID NO: 2443382 - RNA, 23 nt, Human
cccuaguaagugccuuccauguc

SEQ ID NO: 2443383 - RNA, 20 nt, Human
cccuaguaagugccuuccau

SEQ ID NO: 2443384 - RNA, 16 nt, Human
cccuagucccuucccc

SEQ ID NO: 2443385 - RNA, 18 nt, Human
cccuaguaagugccuucc

SEQ ID NO: 2443386 - RNA, 17 nt, Human
cccuaguaagugccuuc

SEQ ID NO: 2443387 - RNA, 15 nt, Human
cccuaguaaaaauac

SEQ ID NO: 2443388 - RNA, 23 nt, Human
cccugcaaaauuugaugccagga

SEQ ID NO: 2443389 - RNA, 20 nt, Human
cccugaguggaucuccaagg

SEQ ID NO: 2443390 - RNA, 19 nt, Human
cccugcaaaaugagacccu

SEQ ID NO: 2443391 - RNA, 19 nt, Human
cccugaguggaucuccaag

SEQ ID NO: 2443392 - RNA, 15 nt, Human
cccugcaaagcccag

SEQ ID NO: 2443393 - RNA, 23 nt, Human
cccugaggugugggggcugcagc

SEQ ID NO: 2443394 - RNA, 22 nt, Human
cccugaggugugggggcugcag

SEQ ID NO: 2443395 - RNA, 21 nt, Human
cccugaggugugggggcugca

SEQ ID NO: 2443396 - RNA, 20 nt, Human
cccugaggugugggggcugc

SEQ ID NO: 2443397 - RNA, 22 nt, Human
cccugaguaaucgcuuaaagau

SEQ ID NO: 2443398 - RNA, 16 nt, Human
cccugagucaccagga

SEQ ID NO: 2443399 - RNA, 17 nt, Human
cccugagucaccaggaa

SEQ ID NO: 2443400 - RNA, 23 nt, Human
cccugaaacuuauuuuuuucuga

SEQ ID NO: 2443401 - RNA, 22 nt, Human
cccugaaacuuauuuuuuucug

SEQ ID NO: 2443402 - RNA, 12 nt, Human
cccugaggcuca

SEQ ID NO: 2443403 - RNA, 18 nt, Human
cccugaggcucagggaaa

SEQ ID NO: 2443404 - RNA, 17 nt, Human
cccugaggggucccuga

SEQ ID NO: 2443405 - RNA, 18 nt, Human
cccugaggugaaagggag

SEQ ID NO: 2443406 - RNA, 19 nt, Human
cccugaggugugggggcug

SEQ ID NO: 2443407 - RNA, 15 nt, Human
cccugaggugugggg

SEQ ID NO: 2443408 - RNA, 20 nt, Human
cccugaggugaaagggagcu

SEQ ID NO: 2443409 - RNA, 16 nt, Human
cccugcaaagcccagc

SEQ ID NO: 2443410 - RNA, 17 nt, Human
cccugcaaagcccagcu

SEQ ID NO: 2443411 - RNA, 19 nt, Human
cccugcaaagcccagcuug

SEQ ID NO: 2443412 - RNA, 20 nt, Human
cccugcaaagcccagcuuga

SEQ ID NO: 2443413 - RNA, 23 nt, Human
cccugcacaaagcccuuccaugu

SEQ ID NO: 2443414 - RNA, 15 nt, Human
cccugcaaaggacug

SEQ ID NO: 2443415 - RNA, 16 nt, Human
cccugcaaaggacugu

SEQ ID NO: 2443416 - RNA, 10 nt, Human
cccugcacug

SEQ ID NO: 2443417 - RNA, 14 nt, Human
cccugcacgucaug

SEQ ID NO: 2443418 - RNA, 15 nt, Human
cccugcacgucaugg

SEQ ID NO: 2443419 - RNA, 13 nt, Human
cccugcacgucau

SEQ ID NO: 2443420 - RNA, 13 nt, Human
cccugcacugucc

SEQ ID NO: 2443421 - RNA, 15 nt, Human
cccugcacuguccug

SEQ ID NO: 2443422 - RNA, 23 nt, Human
cccugcacuggaguccagucucu

SEQ ID NO: 2443423 - RNA, 13 nt, Human
cccugcacuggag

SEQ ID NO: 2443424 - RNA, 22 nt, Human
cccugcacuggaguccagucuc

SEQ ID NO: 2443425 - RNA, 23 nt, Human
cccugcacuguccugcuccacag

SEQ ID NO: 2443426 - RNA, 22 nt, Human
cccugcacuguccugcuccaca

SEQ ID NO: 2443427 - RNA, 21 nt, Human
cccugcacuguccugcuccac

SEQ ID NO: 2443428 - RNA, 20 nt, Human
cccugcacuguccugcucca

SEQ ID NO: 2443429 - RNA, 19 nt, Human
cccugcacuguccugcucc

SEQ ID NO: 2443430 - RNA, 18 nt, Human
cccugcacuguccugcuc

SEQ ID NO: 2443431 - RNA, 17 nt, Human
cccugcacuguccugcu

SEQ ID NO: 2443432 - RNA, 16 nt, Human
cccugcacuguccugc

SEQ ID NO: 2443433 - RNA, 12 nt, Human
cccugcacuugc

SEQ ID NO: 2443434 - RNA, 19 nt, Human
cccugccacucacuaggcc

SEQ ID NO: 2443435 - RNA, 18 nt, Human
cccugccacucacuaggc

SEQ ID NO: 2443436 - RNA, 13 nt, Human
cccugccacucac

SEQ ID NO: 2443437 - RNA, 19 nt, Human
cccugcacuugcagacucu

SEQ ID NO: 2443438 - RNA, 23 nt, Human
cccugaggcccagagggccugca

SEQ ID NO: 2443439 - RNA, 20 nt, Human
cccugaggcccagagggccu

SEQ ID NO: 2443440 - RNA, 19 nt, Human
cccugaggcccagagggcc

SEQ ID NO: 2443441 - RNA, 18 nt, Human
cccugaggcccagagggc

SEQ ID NO: 2443442 - RNA, 17 nt, Human
cccugaggcccagaggg

SEQ ID NO: 2443443 - RNA, 16 nt, Human
cccugaggcccagagg

SEQ ID NO: 2443444 - RNA, 15 nt, Human
cccugaggcccagag

SEQ ID NO: 2443445 - RNA, 14 nt, Human
cccugaggcccaga

SEQ ID NO: 2443446 - RNA, 15 nt, Human
cccugaaagcccuga

SEQ ID NO: 2443447 - RNA, 22 nt, Human
cccugaaaauguuuuucugcca

SEQ ID NO: 2443448 - RNA, 23 nt, Human
cccugaaaauguuuuucugccag

SEQ ID NO: 2443449 - RNA, 24 nt, Human
cccugaaaauguuuuucugccagg

SEQ ID NO: 2443450 - RNA, 13 nt, Human
cccugaggcccag

SEQ ID NO: 2443451 - RNA, 17 nt, Human
cccugaaacuuauuuuu

SEQ ID NO: 2443452 - RNA, 15 nt, Human
cccugaaacuuauuu

SEQ ID NO: 2443453 - RNA, 14 nt, Human
cccugaaacuuauu

SEQ ID NO: 2443454 - RNA, 16 nt, Human
cccugaaagcccugag

SEQ ID NO: 2443455 - RNA, 22 nt, Human
cccucuggucgcuccugcccac

SEQ ID NO: 2443456 - RNA, 20 nt, Human
cccucuggucgcuccugccc

SEQ ID NO: 2443457 - RNA, 19 nt, Human
cccucuggucgcuccugcc

SEQ ID NO: 2443458 - RNA, 18 nt, Human
cccucuggucgcuccugc

SEQ ID NO: 2443459 - RNA, 16 nt, Human
cccucuggggcuguuc

SEQ ID NO: 2443460 - RNA, 15 nt, Human
cccucuguccugacu

SEQ ID NO: 2443461 - RNA, 14 nt, Human
cccucuguccugac

SEQ ID NO: 2443462 - RNA, 18 nt, Human
cccucuguguauuugcuu

SEQ ID NO: 2443463 - RNA, 15 nt, Human
cccugaaaacccaga

SEQ ID NO: 2443464 - RNA, 16 nt, Human
cccugaaaacccagag

SEQ ID NO: 2443465 - RNA, 17 nt, Human
cccugaaaacccagaga

SEQ ID NO: 2443466 - RNA, 18 nt, Human
cccugaaaacccagagag

SEQ ID NO: 2443467 - RNA, 24 nt, Human
cccucuguccaggcacugagauac

SEQ ID NO: 2443468 - RNA, 13 nt, Human
cccucuguccuga

SEQ ID NO: 2443469 - RNA, 20 nt, Human
cccucuguccaggcacugag

SEQ ID NO: 2443470 - RNA, 16 nt, Human
cccuggaccagugguc

SEQ ID NO: 2443471 - RNA, 17 nt, Human
cccuggaccaguggucu

SEQ ID NO: 2443472 - RNA, 21 nt, Human
cccuggaccaguggucucaca

SEQ ID NO: 2443473 - RNA, 23 nt, Human
cccuggaccaguggucucacaug

SEQ ID NO: 2443474 - RNA, 20 nt, Human
cccugcuuugggcugcccug

SEQ ID NO: 2443475 - RNA, 12 nt, Human
cccuggaagccg

SEQ ID NO: 2443476 - RNA, 22 nt, Human
cccuggaagccggcggcccaag

SEQ ID NO: 2443477 - RNA, 18 nt, Human
cccuggaagccggcggcc

SEQ ID NO: 2443478 - RNA, 21 nt, Human
cccugcuggcucuucugccca

SEQ ID NO: 2443479 - RNA, 20 nt, Human
cccugcuggcucuucugccc

SEQ ID NO: 2443480 - RNA, 17 nt, Human
cccuggacaagcagagg

SEQ ID NO: 2443481 - RNA, 22 nt, Human
cccugcuggguguggcgcagca

SEQ ID NO: 2443482 - RNA, 15 nt, Human
cccugcuggcucuuc

SEQ ID NO: 2443483 - RNA, 14 nt, Human
cccugcuggcucuu

SEQ ID NO: 2443484 - RNA, 13 nt, Human
cccugcuggcucu

SEQ ID NO: 2443485 - RNA, 17 nt, Human
cccugcuuugggcugcc

SEQ ID NO: 2443486 - RNA, 19 nt, Human
cccugcuuugggcugcccu

SEQ ID NO: 2443487 - RNA, 18 nt, Human
cccugcuuugggcugccc

SEQ ID NO: 2443488 - RNA, 17 nt, Human
cccugcccaccuggccu

SEQ ID NO: 2443489 - RNA, 14 nt, Human
cccugcccaccugg

SEQ ID NO: 2443490 - RNA, 13 nt, Human
cccugccagaccc

SEQ ID NO: 2443491 - RNA, 21 nt, Human
cccugccagacccccuggaga

SEQ ID NO: 2443492 - RNA, 13 nt, Human
cccugcccaccug

SEQ ID NO: 2443493 - RNA, 21 nt, Human
cccugcuggguguggcgcagc

SEQ ID NO: 2443494 - RNA, 16 nt, Human
cccugcuggguguggc

SEQ ID NO: 2443495 - RNA, 18 nt, Human
cccugcccaccuggccuc

SEQ ID NO: 2443496 - RNA, 18 nt, Human
cccugcuggccgccucac

SEQ ID NO: 2443497 - RNA, 14 nt, Human
cccugcacuguccu

SEQ ID NO: 2443498 - RNA, 20 nt, Human
cccugccacucacuaggccc

SEQ ID NO: 2443499 - RNA, 12 nt, Human
cccugccagcuc

SEQ ID NO: 2443500 - RNA, 17 nt, Human
cccugggcucugugggc

SEQ ID NO: 2443501 - RNA, 22 nt, Human
cccuggguucagaaaugcugcc

SEQ ID NO: 2443502 - RNA, 23 nt, Human
cccuggguucagaaaugcugccu

SEQ ID NO: 2443503 - RNA, 23 nt, Human
cccugguaauaaguacuguguac

SEQ ID NO: 2443504 - RNA, 14 nt, Human
cccugggcucugug

SEQ ID NO: 2443505 - RNA, 16 nt, Human
cccugggcucugcccc

SEQ ID NO: 2443506 - RNA, 13 nt, Human
cccugggcucugc

SEQ ID NO: 2443507 - RNA, 15 nt, Human
cccugggcucugccc

SEQ ID NO: 2443508 - RNA, 15 nt, Human
cccugguagggcagu

SEQ ID NO: 2443509 - RNA, 16 nt, Human
cccugguccagggaag

SEQ ID NO: 2443510 - RNA, 18 nt, Human
cccugguccagggaagcu

SEQ ID NO: 2443511 - RNA, 15 nt, Human
cccugguccugaggg

SEQ ID NO: 2443512 - RNA, 13 nt, Human
cccugguccuucc

SEQ ID NO: 2443513 - RNA, 17 nt, Human
cccugguggcagcucac

SEQ ID NO: 2443514 - RNA, 16 nt, Human
cccugguggcagcuca

SEQ ID NO: 2443515 - RNA, 15 nt, Human
cccugguggcagcuc

SEQ ID NO: 2443516 - RNA, 20 nt, Human
cccuggucucagcagcgacc

SEQ ID NO: 2443517 - RNA, 17 nt, Human
cccuggucucagcagcg

SEQ ID NO: 2443518 - RNA, 13 nt, Human
cccuggucucagc

SEQ ID NO: 2443519 - RNA, 16 nt, Human
cccugguccuuccagg

SEQ ID NO: 2443520 - RNA, 17 nt, Human
cccugguccuuccaggc

SEQ ID NO: 2443521 - RNA, 18 nt, Human
cccugggaggcagugaug

SEQ ID NO: 2443522 - RNA, 14 nt, Human
cccuggacugggag

SEQ ID NO: 2443523 - RNA, 13 nt, Human
cccuggacuggga

SEQ ID NO: 2443524 - RNA, 22 nt, Human
cccuggcuuuucacugcuggcu

SEQ ID NO: 2443525 - RNA, 19 nt, Human
cccuggcuuuucacugcug

SEQ ID NO: 2443526 - RNA, 15 nt, Human
cccuggacugugugc

SEQ ID NO: 2443527 - RNA, 17 nt, Human
cccuggcuuuucacugc

SEQ ID NO: 2443528 - RNA, 18 nt, Human
cccuggcuuuucacugcu

SEQ ID NO: 2443529 - RNA, 17 nt, Human
cccugggcucggaggcu

SEQ ID NO: 2443530 - RNA, 19 nt, Human
cccugggcccugggcugga

SEQ ID NO: 2443531 - RNA, 22 nt, Human
cccugggccccaccaccuaggc

SEQ ID NO: 2443532 - RNA, 18 nt, Human
cccugggcccugggcugg

SEQ ID NO: 2443533 - RNA, 16 nt, Human
cccugggcccugggcu

SEQ ID NO: 2443534 - RNA, 13 nt, Human
cccugggcccugg

SEQ ID NO: 2443535 - RNA, 18 nt, Human
cccugggccccaccaccu

SEQ ID NO: 2443536 - RNA, 20 nt, Human
cccugggccccaccaccuag

SEQ ID NO: 2443537 - RNA, 16 nt, Human
cccugggccccaccac

SEQ ID NO: 2443538 - RNA, 21 nt, Human
cccaccuggccucugcacucc

SEQ ID NO: 2443539 - RNA, 19 nt, Human
cccaccuggccucugcacu

SEQ ID NO: 2443540 - RNA, 17 nt, Human
cccaccuggccucugca

SEQ ID NO: 2443541 - RNA, 13 nt, Human
cccaccugcccau

SEQ ID NO: 2443542 - RNA, 20 nt, Human
cccaccugcccaucacaggg

SEQ ID NO: 2443543 - RNA, 23 nt, Human
cccaccugcccaucacaggguug

SEQ ID NO: 2443544 - RNA, 20 nt, Human
cccacgacugcccggcaggg

SEQ ID NO: 2443545 - RNA, 21 nt, Human
cccacgacugcccggcagggu

SEQ ID NO: 2443546 - RNA, 16 nt, Human
cccaccuggccucugc

SEQ ID NO: 2443547 - RNA, 19 nt, Human
cccaccuuguuggagccug

SEQ ID NO: 2443548 - RNA, 18 nt, Human
cccaccuuguuggagccu

SEQ ID NO: 2443549 - RNA, 17 nt, Human
cccaccuuguuggagcc

SEQ ID NO: 2443550 - RNA, 21 nt, Human
cccaccuuguuggagccugca

SEQ ID NO: 2443551 - RNA, 20 nt, Human
cccaccuuguuggagccugc

SEQ ID NO: 2443552 - RNA, 21 nt, Human
cccaccuuuauuaaaaucuua

SEQ ID NO: 2443553 - RNA, 21 nt, Human
cccacuugccucuuccuugaa

SEQ ID NO: 2443554 - RNA, 15 nt, Human
cccacuugccucuuc

SEQ ID NO: 2443555 - RNA, 14 nt, Human
cccacuugccucuu

SEQ ID NO: 2443556 - RNA, 13 nt, Human
cccacuugccucu

SEQ ID NO: 2443557 - RNA, 20 nt, Human
cccagaaaaaaaaaaacuua

SEQ ID NO: 2443558 - RNA, 15 nt, Human
cccacuuuggccucc

SEQ ID NO: 2443559 - RNA, 12 nt, Human
cccacuucugcc

SEQ ID NO: 2443560 - RNA, 23 nt, Human
cccacuugagaauuacccuuuug

SEQ ID NO: 2443561 - RNA, 21 nt, Human
cccacgcuggagugcagugag

SEQ ID NO: 2443562 - RNA, 20 nt, Human
cccacgcuggagugcaguga

SEQ ID NO: 2443563 - RNA, 14 nt, Human
cccacgcuggagug

SEQ ID NO: 2443564 - RNA, 19 nt, Human
cccacgcuggagugcagug

SEQ ID NO: 2443565 - RNA, 14 nt, Human
cccaccgcaugccc

SEQ ID NO: 2443566 - RNA, 20 nt, Human
cccaccgcaugcccccucgu

SEQ ID NO: 2443567 - RNA, 18 nt, Human
cccaccgcaugcccccuc

SEQ ID NO: 2443568 - RNA, 22 nt, Human
cccaccgcaugcccccucgugc

SEQ ID NO: 2443569 - RNA, 20 nt, Human
cccaccgcagacaggaccag

SEQ ID NO: 2443570 - RNA, 19 nt, Human
cccaccgcagacaggacca

SEQ ID NO: 2443571 - RNA, 17 nt, Human
cccaccacacccucccu

SEQ ID NO: 2443572 - RNA, 12 nt, Human
cccaccacagca

SEQ ID NO: 2443573 - RNA, 13 nt, Human
cccaccacagcag

SEQ ID NO: 2443574 - RNA, 15 nt, Human
cccaccaccccagcu

SEQ ID NO: 2443575 - RNA, 18 nt, Human
cccaccaccccagcugcu

SEQ ID NO: 2443576 - RNA, 13 nt, Human
cccaccaccuagg

SEQ ID NO: 2443577 - RNA, 16 nt, Human
cccaccaccuaggcca

SEQ ID NO: 2443578 - RNA, 19 nt, Human
cccaccaccuaggccacuc

SEQ ID NO: 2443579 - RNA, 20 nt, Human
cccaccaccuaggccacucc

SEQ ID NO: 2443580 - RNA, 21 nt, Human
cccaccaccuaggccacuccu

SEQ ID NO: 2443581 - RNA, 22 nt, Human
cccaccaccuaggccacuccuc

SEQ ID NO: 2443582 - RNA, 22 nt, Human
cccaccaggcugcucagggcug

SEQ ID NO: 2443583 - RNA, 17 nt, Human
cccaccaggcugcucag

SEQ ID NO: 2443584 - RNA, 16 nt, Human
cccaccaggcugcuca

SEQ ID NO: 2443585 - RNA, 13 nt, Human
cccaccaggcugc

SEQ ID NO: 2443586 - RNA, 19 nt, Human
cccaccacgauguggcccu

SEQ ID NO: 2443587 - RNA, 20 nt, Human
cccaccacgauguggcccug

SEQ ID NO: 2443588 - RNA, 14 nt, Human
cccaccacggccac

SEQ ID NO: 2443589 - RNA, 24 nt, Human
cccaccacgauguggcccuggccu

SEQ ID NO: 2443590 - RNA, 21 nt, Human
cccaccacggccacuggccau

SEQ ID NO: 2443591 - RNA, 20 nt, Human
cccaccacggccacuggcca

SEQ ID NO: 2443592 - RNA, 23 nt, Human
cccaccacuaggacucugaggcu

SEQ ID NO: 2443593 - RNA, 23 nt, Human
cccaccgggcugggagcucugca

SEQ ID NO: 2443594 - RNA, 17 nt, Human
cccaccucagccucccg

SEQ ID NO: 2443595 - RNA, 17 nt, Human
cccaccuccccacgccc

SEQ ID NO: 2443596 - RNA, 16 nt, Human
cccaccuccccacgcc

SEQ ID NO: 2443597 - RNA, 15 nt, Human
cccaccuccccacgc

SEQ ID NO: 2443598 - RNA, 14 nt, Human
cccaccuccccacg

SEQ ID NO: 2443599 - RNA, 12 nt, Human
cccaccucccug

SEQ ID NO: 2443600 - RNA, 13 nt, Human
cccaccuccccac

SEQ ID NO: 2443601 - RNA, 10 nt, Human
cccaccuccc

SEQ ID NO: 2443602 - RNA, 11 nt, Human
cccaccuccac

SEQ ID NO: 2443603 - RNA, 17 nt, Human
cccaccucagccuccug

SEQ ID NO: 2443604 - RNA, 14 nt, Human
cccaccucccugcc

SEQ ID NO: 2443605 - RNA, 15 nt, Human
cccaccucccugccu

SEQ ID NO: 2443606 - RNA, 16 nt, Human
cccaccucccugccuc

SEQ ID NO: 2443607 - RNA, 22 nt, Human
cccaccucucucacuccuugaa

SEQ ID NO: 2443608 - RNA, 21 nt, Human
cccaccucugugaccucaggc

SEQ ID NO: 2443609 - RNA, 20 nt, Human
cccaccucugugaccucagg

SEQ ID NO: 2443610 - RNA, 12 nt, Human
cccaccucuucu

SEQ ID NO: 2443611 - RNA, 18 nt, Human
cccaccucugugaccuca

SEQ ID NO: 2443612 - RNA, 17 nt, Human
cccaccucugugaccuc

SEQ ID NO: 2443613 - RNA, 15 nt, Human
cccaccucugugacc

SEQ ID NO: 2443614 - RNA, 17 nt, Human
cccaccucccugccucc

SEQ ID NO: 2443615 - RNA, 19 nt, Human
cccacaggacauuucucua

SEQ ID NO: 2443616 - RNA, 20 nt, Human
cccacaggacauuucucuaa

SEQ ID NO: 2443617 - RNA, 16 nt, Human
cccacaggaggugguc

SEQ ID NO: 2443618 - RNA, 16 nt, Human
cccacaugugacacau

SEQ ID NO: 2443619 - RNA, 19 nt, Human
cccacaugugacacauaug

SEQ ID NO: 2443620 - RNA, 21 nt, Human
cccacaggagguggucuggga

SEQ ID NO: 2443621 - RNA, 21 nt, Human
cccaccaacaucccauugccc

SEQ ID NO: 2443622 - RNA, 14 nt, Human
cccacauuccgaca

SEQ ID NO: 2443623 - RNA, 14 nt, Human
cccacauuggaccc

SEQ ID NO: 2443624 - RNA, 23 nt, Human
cccacaggaagccugcaguccug

SEQ ID NO: 2443625 - RNA, 22 nt, Human
cccacaggaagccugcaguccu

SEQ ID NO: 2443626 - RNA, 20 nt, Human
cccacaggaagccugcaguc

SEQ ID NO: 2443627 - RNA, 19 nt, Human
cccacagcucccaccccac

SEQ ID NO: 2443628 - RNA, 20 nt, Human
cccacagcucccaccccacc

SEQ ID NO: 2443629 - RNA, 12 nt, Human
cccacagcuccc

SEQ ID NO: 2443630 - RNA, 14 nt, Human
cccacagcucccac

SEQ ID NO: 2443631 - RNA, 15 nt, Human
cccacagcucccacc

SEQ ID NO: 2443632 - RNA, 17 nt, Human
cccacagcucccacccc

SEQ ID NO: 2443633 - RNA, 23 nt, Human
cccacaaucuuaaggggcagcuu

SEQ ID NO: 2443634 - RNA, 13 nt, Human
cccacacacccca

SEQ ID NO: 2443635 - RNA, 13 nt, Human
cccacagcgcugg

SEQ ID NO: 2443636 - RNA, 17 nt, Human
cccacacacacacacau

SEQ ID NO: 2443637 - RNA, 18 nt, Human
cccacacacacacacaug

SEQ ID NO: 2443638 - RNA, 19 nt, Human
cccacacacacacacaugc

SEQ ID NO: 2443639 - RNA, 20 nt, Human
cccacacacacacacaugca

SEQ ID NO: 2443640 - RNA, 19 nt, Human
cccacagcgcuggccggga

SEQ ID NO: 2443641 - RNA, 13 nt, Human
cccacacacagau

SEQ ID NO: 2443642 - RNA, 13 nt, Human
cccacaagaaaug

SEQ ID NO: 2443643 - RNA, 20 nt, Human
cccaaugcacuuuguucugg

SEQ ID NO: 2443644 - RNA, 16 nt, Human
cccaaugcacuuuguu

SEQ ID NO: 2443645 - RNA, 10 nt, Human
cccacacaca

SEQ ID NO: 2443646 - RNA, 11 nt, Human
cccacacacac

SEQ ID NO: 2443647 - RNA, 13 nt, Human
cccacacacacac

SEQ ID NO: 2443648 - RNA, 14 nt, Human
cccacacacacaca

SEQ ID NO: 2443649 - RNA, 14 nt, Human
cccacaaguggugg

SEQ ID NO: 2443650 - RNA, 16 nt, Human
cccacaagugguggua

SEQ ID NO: 2443651 - RNA, 20 nt, Human
cccacaaguggugguaaccc

SEQ ID NO: 2443652 - RNA, 22 nt, Human
cccacaaucuuaaggggcagcu

SEQ ID NO: 2443653 - RNA, 22 nt, Human
cccacaauauaaaacuguacuu

SEQ ID NO: 2443654 - RNA, 22 nt, Human
cccacaaguggugguaacccug

SEQ ID NO: 2443655 - RNA, 23 nt, Human
cccacaaguggugguaacccugg

SEQ ID NO: 2443656 - RNA, 20 nt, Human
cccacaagaaaugaaagcag

SEQ ID NO: 2443657 - RNA, 13 nt, Human
cccacaaguggug

SEQ ID NO: 2443658 - RNA, 17 nt, Human
cccacaacuccugucua

SEQ ID NO: 2443659 - RNA, 22 nt, Human
ccuaugcaauauaucuaaauug

SEQ ID NO: 2443660 - RNA, 21 nt, Human
ccuaugcaugguguagaugcc

SEQ ID NO: 2443661 - RNA, 21 nt, Human
ccuaugcacauauggacucug

SEQ ID NO: 2443662 - RNA, 20 nt, Human
ccuaugcacauauggacucu

SEQ ID NO: 2443663 - RNA, 14 nt, Human
ccuaugcacauaug

SEQ ID NO: 2443664 - RNA, 19 nt, Human
ccuaugcagagguccacaa

SEQ ID NO: 2443665 - RNA, 19 nt, Human
ccucagucuggcccuuccu

SEQ ID NO: 2443666 - RNA, 20 nt, Human
ccuaugcugccuaggcugac

SEQ ID NO: 2443667 - RNA, 12 nt, Human
ccucauacccac

SEQ ID NO: 2443668 - RNA, 11 nt, Human
ccucagugcca

SEQ ID NO: 2443669 - RNA, 20 nt, Human
ccucagucuggcccuuccuu

SEQ ID NO: 2443670 - RNA, 14 nt, Human
ccucaucaccaacg

SEQ ID NO: 2443671 - RNA, 13 nt, Human
ccucaucaccaac

SEQ ID NO: 2443672 - RNA, 22 nt, Human
ccucauaguaugguggcugggu

SEQ ID NO: 2443673 - RNA, 21 nt, Human
ccucauaguaugguggcuggg

SEQ ID NO: 2443674 - RNA, 13 nt, Human
ccucauacccacc

SEQ ID NO: 2443675 - RNA, 17 nt, Human
ccucauagcccucaccc

SEQ ID NO: 2443676 - RNA, 18 nt, Human
ccucauagcccucacccu

SEQ ID NO: 2443677 - RNA, 21 nt, Human
ccucauagcccucacccuggg

SEQ ID NO: 2443678 - RNA, 22 nt, Human
ccucauagcccucacccugggg

SEQ ID NO: 2443679 - RNA, 20 nt, Human
ccucauaguaugguggcugg

SEQ ID NO: 2443680 - RNA, 20 nt, Human
ccucauccucauacccaccc

SEQ ID NO: 2443681 - RNA, 13 nt, Human
ccucauccucaua

SEQ ID NO: 2443682 - RNA, 13 nt, Human
ccucaucucauuc

SEQ ID NO: 2443683 - RNA, 21 nt, Human
ccucaucgcguccuccuaccg

SEQ ID NO: 2443684 - RNA, 17 nt, Human
ccucaucucucugccca

SEQ ID NO: 2443685 - RNA, 19 nt, Human
ccucaucucucugcccaac

SEQ ID NO: 2443686 - RNA, 21 nt, Human
ccucaucuccccaucauuggu

SEQ ID NO: 2443687 - RNA, 23 nt, Human
ccucauccagggcucugaccagu

SEQ ID NO: 2443688 - RNA, 14 nt, Human
ccucaucccgagca

SEQ ID NO: 2443689 - RNA, 20 nt, Human
ccucaucccguguucuccuu

SEQ ID NO: 2443690 - RNA, 20 nt, Human
ccucaucccgagcaccucca

SEQ ID NO: 2443691 - RNA, 14 nt, Human
ccucauccgaggca

SEQ ID NO: 2443692 - RNA, 15 nt, Human
ccucauccgaggcag

SEQ ID NO: 2443693 - RNA, 17 nt, Human
ccucauccgaggcaggg

SEQ ID NO: 2443694 - RNA, 20 nt, Human
ccucauccgaggcaggguca

SEQ ID NO: 2443695 - RNA, 23 nt, Human
ccucaucaggaugaacccaggac

SEQ ID NO: 2443696 - RNA, 21 nt, Human
ccucaucaggaugaacccagg

SEQ ID NO: 2443697 - RNA, 19 nt, Human
ccucaucaggaugaaccca

SEQ ID NO: 2443698 - RNA, 15 nt, Human
ccucaucaggaugaa

SEQ ID NO: 2443699 - RNA, 15 nt, Human
ccucauccagggcuc

SEQ ID NO: 2443700 - RNA, 14 nt, Human
ccucauccagggcu

SEQ ID NO: 2443701 - RNA, 22 nt, Human
ccucauccaccccaucccuccc

SEQ ID NO: 2443702 - RNA, 14 nt, Human
ccucaucaggauga

SEQ ID NO: 2443703 - RNA, 13 nt, Human
ccucaucaggaug

SEQ ID NO: 2443704 - RNA, 13 nt, Human
ccucauauuuaaa

SEQ ID NO: 2443705 - RNA, 16 nt, Human
ccucaguggacuuucc

SEQ ID NO: 2443706 - RNA, 18 nt, Human
ccucaguggacuuuccac

SEQ ID NO: 2443707 - RNA, 12 nt, Human
ccucauauuuaa

SEQ ID NO: 2443708 - RNA, 16 nt, Human
ccuccaauccugcccc

SEQ ID NO: 2443709 - RNA, 15 nt, Human
ccuccaauccugccc

SEQ ID NO: 2443710 - RNA, 17 nt, Human
ccucaucuuucaucaau

SEQ ID NO: 2443711 - RNA, 17 nt, Human
ccucaucuucuucacca

SEQ ID NO: 2443712 - RNA, 23 nt, Human
ccuccaaucccaccaacccucag

SEQ ID NO: 2443713 - RNA, 15 nt, Human
ccucaucugucccuc

SEQ ID NO: 2443714 - RNA, 17 nt, Human
ccucaucugucccuccg

SEQ ID NO: 2443715 - RNA, 19 nt, Human
ccucaucugcucagcagcu

SEQ ID NO: 2443716 - RNA, 13 nt, Human
ccucaucugcuca

SEQ ID NO: 2443717 - RNA, 20 nt, Human
ccucaucucucugcccaacc

SEQ ID NO: 2443718 - RNA, 18 nt, Human
ccucaucuucuucaccau

SEQ ID NO: 2443719 - RNA, 15 nt, Human
ccucaucuucuucac

SEQ ID NO: 2443720 - RNA, 20 nt, Human
ccucaucugggggaguggaa

SEQ ID NO: 2443721 - RNA, 23 nt, Human
ccuccacaguucgaccugcggcu

SEQ ID NO: 2443722 - RNA, 17 nt, Human
ccuccacaguucagugg

SEQ ID NO: 2443723 - RNA, 14 nt, Human
ccuccacauccucc

SEQ ID NO: 2443724 - RNA, 15 nt, Human
ccuccacauccucca

SEQ ID NO: 2443725 - RNA, 16 nt, Human
ccuccacauccuccac

SEQ ID NO: 2443726 - RNA, 16 nt, Human
ccuccacauccuuucu

SEQ ID NO: 2443727 - RNA, 14 nt, Human
ccuccaccaccacu

SEQ ID NO: 2443728 - RNA, 12 nt, Human
ccuccacauccu

SEQ ID NO: 2443729 - RNA, 20 nt, Human
ccuccacauccuccacguuc

SEQ ID NO: 2443730 - RNA, 15 nt, Human
ccuccacagccgcag

SEQ ID NO: 2443731 - RNA, 16 nt, Human
ccuccacagccgcagc

SEQ ID NO: 2443732 - RNA, 17 nt, Human
ccuccacagccgcagcc

SEQ ID NO: 2443733 - RNA, 11 nt, Human
ccuccacagcu

SEQ ID NO: 2443734 - RNA, 12 nt, Human
ccuccacagcuu

SEQ ID NO: 2443735 - RNA, 16 nt, Human
ccucccaaagugcugg

SEQ ID NO: 2443736 - RNA, 16 nt, Human
ccuccccauggagcca

SEQ ID NO: 2443737 - RNA, 20 nt, Human
ccuccccauuagagucagcc

SEQ ID NO: 2443738 - RNA, 22 nt, Human
ccuccccaggggagagggucug

SEQ ID NO: 2443739 - RNA, 15 nt, Human
ccuccauucugacca

SEQ ID NO: 2443740 - RNA, 22 nt, Human
ccuccccauuucccaucugcac

SEQ ID NO: 2443741 - RNA, 21 nt, Human
ccuccccauuucccaucugca

SEQ ID NO: 2443742 - RNA, 20 nt, Human
ccuccccauuucccaucugc

SEQ ID NO: 2443743 - RNA, 15 nt, Human
ccuccccauuuccca

SEQ ID NO: 2443744 - RNA, 14 nt, Human
ccuccccauuuccc

SEQ ID NO: 2443745 - RNA, 21 nt, Human
ccuccccauuagagucagccu

SEQ ID NO: 2443746 - RNA, 13 nt, Human
ccucccccaaccc

SEQ ID NO: 2443747 - RNA, 18 nt, Human
ccucccccaacccccacc

SEQ ID NO: 2443748 - RNA, 19 nt, Human
ccucccccaacccccaccc

SEQ ID NO: 2443749 - RNA, 22 nt, Human
ccucccccaacccccaccccac

SEQ ID NO: 2443750 - RNA, 15 nt, Human
ccuccaugcugccuc

SEQ ID NO: 2443751 - RNA, 15 nt, Human
ccucccaaagugcug

SEQ ID NO: 2443752 - RNA, 18 nt, Human
ccuccaucuucuuugcag

SEQ ID NO: 2443753 - RNA, 23 nt, Human
ccuccaucuccaagaaugcugaa

SEQ ID NO: 2443754 - RNA, 19 nt, Human
ccuccaugacugcacagua

SEQ ID NO: 2443755 - RNA, 14 nt, Human
ccuccaugcugccu

SEQ ID NO: 2443756 - RNA, 23 nt, Human
ccuccaugugggcuaguugggcu

SEQ ID NO: 2443757 - RNA, 11 nt, Human
ccuccagguuu

SEQ ID NO: 2443758 - RNA, 19 nt, Human
ccuccaggugugcacgugg

SEQ ID NO: 2443759 - RNA, 14 nt, Human
ccuccaggugugca

SEQ ID NO: 2443760 - RNA, 22 nt, Human
ccuccaggugcacaagcuccaa

SEQ ID NO: 2443761 - RNA, 14 nt, Human
ccuccauccugagg

SEQ ID NO: 2443762 - RNA, 21 nt, Human
ccuccaucuccaagaaugcug

SEQ ID NO: 2443763 - RNA, 19 nt, Human
ccuccaucuccaagaaugc

SEQ ID NO: 2443764 - RNA, 24 nt, Human
ccuccaucucauguaucaucugga

SEQ ID NO: 2443765 - RNA, 12 nt, Human
ccuccagguuuu

SEQ ID NO: 2443766 - RNA, 18 nt, Human
ccuccaucuaaacugccc

SEQ ID NO: 2443767 - RNA, 21 nt, Human
ccuccaggugcacaagcucca

SEQ ID NO: 2443768 - RNA, 19 nt, Human
ccuccaggugcacaagcuc

SEQ ID NO: 2443769 - RNA, 21 nt, Human
ccuccagggcuggacugaggc

SEQ ID NO: 2443770 - RNA, 20 nt, Human
ccuccagggcuggacugagg

SEQ ID NO: 2443771 - RNA, 18 nt, Human
ccuccagggcuggacuga

SEQ ID NO: 2443772 - RNA, 17 nt, Human
ccuccagggcuggacug

SEQ ID NO: 2443773 - RNA, 16 nt, Human
ccuccagggcuggacu

SEQ ID NO: 2443774 - RNA, 13 nt, Human
ccuccagggcugg

SEQ ID NO: 2443775 - RNA, 12 nt, Human
ccuccagggcug

SEQ ID NO: 2443776 - RNA, 21 nt, Human
ccuccagggccacgugccagg

SEQ ID NO: 2443777 - RNA, 22 nt, Human
ccuccagggccacgugccaggc

SEQ ID NO: 2443778 - RNA, 13 nt, Human
ccuccagcaggga

SEQ ID NO: 2443779 - RNA, 13 nt, Human
ccuccagccucug

SEQ ID NO: 2443780 - RNA, 12 nt, Human
ccuccagccucu

SEQ ID NO: 2443781 - RNA, 11 nt, Human
ccuccagccuc

SEQ ID NO: 2443782 - RNA, 14 nt, Human
ccuccagccucugu

SEQ ID NO: 2443783 - RNA, 12 nt, Human
ccuccagggcca

SEQ ID NO: 2443784 - RNA, 14 nt, Human
ccuccagggccacg

SEQ ID NO: 2443785 - RNA, 16 nt, Human
ccuccagggccacgug

SEQ ID NO: 2443786 - RNA, 17 nt, Human
ccuccagggccacgugc

SEQ ID NO: 2443787 - RNA, 18 nt, Human
ccuccagggccacgugcc

SEQ ID NO: 2443788 - RNA, 19 nt, Human
ccuccagggccacgugcca

SEQ ID NO: 2443789 - RNA, 20 nt, Human
ccuccagggccacgugccag

SEQ ID NO: 2443790 - RNA, 17 nt, Human
ccuccacguucugcuca

SEQ ID NO: 2443791 - RNA, 18 nt, Human
ccuccacguucugcucau

SEQ ID NO: 2443792 - RNA, 12 nt, Human
ccuccacuccca

SEQ ID NO: 2443793 - RNA, 23 nt, Human
ccuccaccucuucaccccccacu

SEQ ID NO: 2443794 - RNA, 21 nt, Human
ccuccacguucugcucaucau

SEQ ID NO: 2443795 - RNA, 18 nt, Human
ccuccacucccacuuccc

SEQ ID NO: 2443796 - RNA, 15 nt, Human
ccuccacucccacuu

SEQ ID NO: 2443797 - RNA, 14 nt, Human
ccuccacucccacu

SEQ ID NO: 2443798 - RNA, 13 nt, Human
ccuccacucccac

SEQ ID NO: 2443799 - RNA, 20 nt, Human
ccuccacucccacuucccug

SEQ ID NO: 2443800 - RNA, 11 nt, Human
ccuccacuccu

SEQ ID NO: 2443801 - RNA, 18 nt, Human
ccuccagaagccucuggc

SEQ ID NO: 2443802 - RNA, 19 nt, Human
ccuccagaagccucuggcu

SEQ ID NO: 2443803 - RNA, 20 nt, Human
ccuccagaagccucuggcua

SEQ ID NO: 2443804 - RNA, 21 nt, Human
ccuccagaagccucuggcuag

SEQ ID NO: 2443805 - RNA, 22 nt, Human
ccuccagaagccucuggcuaga

SEQ ID NO: 2443806 - RNA, 17 nt, Human
ccuccagaagccucugg

SEQ ID NO: 2443807 - RNA, 24 nt, Human
ccuccacccugucccccagcucug

SEQ ID NO: 2443808 - RNA, 21 nt, Human
ccuccacccugucccccagcu

SEQ ID NO: 2443809 - RNA, 20 nt, Human
ccuccacccugucccccagc

SEQ ID NO: 2443810 - RNA, 19 nt, Human
ccuccacccugucccccag

SEQ ID NO: 2443811 - RNA, 16 nt, Human
ccuccacccugucccc

SEQ ID NO: 2443812 - RNA, 15 nt, Human
ccuccacccuguccc

SEQ ID NO: 2443813 - RNA, 14 nt, Human
ccuccacccugucc

SEQ ID NO: 2443814 - RNA, 11 nt, Human
ccuccacccug

SEQ ID NO: 2443815 - RNA, 21 nt, Human
ccuccaccgccauggcuucca

SEQ ID NO: 2443816 - RNA, 19 nt, Human
ccuccaccgccauggcuuc

SEQ ID NO: 2443817 - RNA, 17 nt, Human
ccuccaccgccauggcu

SEQ ID NO: 2443818 - RNA, 13 nt, Human
ccuccaccgcugc

SEQ ID NO: 2443819 - RNA, 14 nt, Human
ccuccaccgcugcc

SEQ ID NO: 2443820 - RNA, 15 nt, Human
ccuccaccgcugccu

SEQ ID NO: 2443821 - RNA, 23 nt, Human
ccuccaccaccacuggccaccag

SEQ ID NO: 2443822 - RNA, 21 nt, Human
ccuccaccaccacuggccacc

SEQ ID NO: 2443823 - RNA, 20 nt, Human
ccuccaccaccacuggccac

SEQ ID NO: 2443824 - RNA, 19 nt, Human
ccuccaccaccacuggcca

SEQ ID NO: 2443825 - RNA, 18 nt, Human
ccuccaccaccacuggcc

SEQ ID NO: 2443826 - RNA, 17 nt, Human
ccuccaccaccacuggc

SEQ ID NO: 2443827 - RNA, 15 nt, Human
ccuccaccaccacug

SEQ ID NO: 2443828 - RNA, 22 nt, Human
ccuccacccucugagcuuugca

SEQ ID NO: 2443829 - RNA, 20 nt, Human
ccuccacccucugagcuuug

SEQ ID NO: 2443830 - RNA, 16 nt, Human
ccuccacccucugagc

SEQ ID NO: 2443831 - RNA, 15 nt, Human
ccuccacccucugag

SEQ ID NO: 2443832 - RNA, 14 nt, Human
ccuccacccucuga

SEQ ID NO: 2443833 - RNA, 13 nt, Human
ccuccacccucug

SEQ ID NO: 2443834 - RNA, 17 nt, Human
ccuccaccccccagaac

SEQ ID NO: 2443835 - RNA, 15 nt, Human
ccuccaccugccgug

SEQ ID NO: 2443836 - RNA, 14 nt, Human
ccuccaccucuuca

SEQ ID NO: 2443837 - RNA, 18 nt, Human
ccuccacguucaccccuc

SEQ ID NO: 2443838 - RNA, 17 nt, Human
ccuccacguucaccccu

SEQ ID NO: 2443839 - RNA, 17 nt, Human
ccucccgaauagcuggg

SEQ ID NO: 2443840 - RNA, 16 nt, Human
ccucuaggaggucucu

SEQ ID NO: 2443841 - RNA, 22 nt, Human
ccucuagcugugggggugaggg

SEQ ID NO: 2443842 - RNA, 12 nt, Human
ccucuagggacc

SEQ ID NO: 2443843 - RNA, 19 nt, Human
ccucuagggaccccuccuc

SEQ ID NO: 2443844 - RNA, 18 nt, Human
ccucuagggaccccuccu

SEQ ID NO: 2443845 - RNA, 20 nt, Human
ccucuagggaccccuccucc

SEQ ID NO: 2443846 - RNA, 13 nt, Human
ccucuagugcccu

SEQ ID NO: 2443847 - RNA, 14 nt, Human
ccucuagugcccuc

SEQ ID NO: 2443848 - RNA, 15 nt, Human
ccucuagugcccucc

SEQ ID NO: 2443849 - RNA, 23 nt, Human
ccucucaucaguguccucuugcu

SEQ ID NO: 2443850 - RNA, 15 nt, Human
ccucucaguacuuug

SEQ ID NO: 2443851 - RNA, 12 nt, Human
ccucuccaaggg

SEQ ID NO: 2443852 - RNA, 18 nt, Human
ccucucauuccagaggaa

SEQ ID NO: 2443853 - RNA, 14 nt, Human
ccucuauugaugua

SEQ ID NO: 2443854 - RNA, 19 nt, Human
ccucuaugaacuauggacg

SEQ ID NO: 2443855 - RNA, 13 nt, Human
ccucuaucccaau

SEQ ID NO: 2443856 - RNA, 23 nt, Human
ccucuauugauguacagucuguc

SEQ ID NO: 2443857 - RNA, 20 nt, Human
ccucuauugauguacagucu

SEQ ID NO: 2443858 - RNA, 17 nt, Human
ccucuauuuauguuugc

SEQ ID NO: 2443859 - RNA, 21 nt, Human
ccucuauuuauguuugcacuu

SEQ ID NO: 2443860 - RNA, 16 nt, Human
ccucuauuuagcauga

SEQ ID NO: 2443861 - RNA, 16 nt, Human
ccucggugccuuccuc

SEQ ID NO: 2443862 - RNA, 14 nt, Human
ccucgguguggaga

SEQ ID NO: 2443863 - RNA, 14 nt, Human
ccuccuuccuugac

SEQ ID NO: 2443864 - RNA, 15 nt, Human
ccuccuuccuugacc

SEQ ID NO: 2443865 - RNA, 18 nt, Human
ccuccuuccuugaccagc

SEQ ID NO: 2443866 - RNA, 20 nt, Human
ccuccuuccuugaccagcag

SEQ ID NO: 2443867 - RNA, 20 nt, Human
ccuccuuccuugcuguccua

SEQ ID NO: 2443868 - RNA, 15 nt, Human
ccuccuucucccuuu

SEQ ID NO: 2443869 - RNA, 16 nt, Human
ccuccuucucccuuuu

SEQ ID NO: 2443870 - RNA, 17 nt, Human
ccuccuucucccuuuuu

SEQ ID NO: 2443871 - RNA, 19 nt, Human
ccucgggcgagucacugcc

SEQ ID NO: 2443872 - RNA, 22 nt, Human
ccucgggcgagucacugccucu

SEQ ID NO: 2443873 - RNA, 19 nt, Human
ccuccugucuucccagggu

SEQ ID NO: 2443874 - RNA, 18 nt, Human
ccuccugucuucccaggg

SEQ ID NO: 2443875 - RNA, 13 nt, Human
ccuccuucagaca

SEQ ID NO: 2443876 - RNA, 14 nt, Human
ccuccuucagacac

SEQ ID NO: 2443877 - RNA, 19 nt, Human
ccuccuuccaccucccucc

SEQ ID NO: 2443878 - RNA, 18 nt, Human
ccuccuuccaccucccuc

SEQ ID NO: 2443879 - RNA, 17 nt, Human
ccuccuuccaccucccu

SEQ ID NO: 2443880 - RNA, 16 nt, Human
ccuccuuccaccuccc

SEQ ID NO: 2443881 - RNA, 15 nt, Human
ccuccuucagacacc

SEQ ID NO: 2443882 - RNA, 22 nt, Human
ccuccuucagacacccucaacc

SEQ ID NO: 2443883 - RNA, 14 nt, Human
ccuccuucccaaag

SEQ ID NO: 2443884 - RNA, 18 nt, Human
ccucuagaagccaaggga

SEQ ID NO: 2443885 - RNA, 16 nt, Human
ccucuagaagccaagg

SEQ ID NO: 2443886 - RNA, 15 nt, Human
ccucuagaagccaag

SEQ ID NO: 2443887 - RNA, 19 nt, Human
ccucuagaaauuuuucaga

SEQ ID NO: 2443888 - RNA, 14 nt, Human
ccucuagaggcaag

SEQ ID NO: 2443889 - RNA, 21 nt, Human
ccucuaaccccaggccccgag

SEQ ID NO: 2443890 - RNA, 19 nt, Human
ccucuaaccccaggccccg

SEQ ID NO: 2443891 - RNA, 18 nt, Human
ccucuaaccccaggcccc

SEQ ID NO: 2443892 - RNA, 17 nt, Human
ccucuaaccccaggccc

SEQ ID NO: 2443893 - RNA, 16 nt, Human
ccucuaaccccaggcc

SEQ ID NO: 2443894 - RNA, 15 nt, Human
ccucuaaccccaggc

SEQ ID NO: 2443895 - RNA, 23 nt, Human
ccucuaaagcaauaaugguccca

SEQ ID NO: 2443896 - RNA, 13 nt, Human
ccucuaaccccag

SEQ ID NO: 2443897 - RNA, 22 nt, Human
ccucguggccagcccggcuggu

SEQ ID NO: 2443898 - RNA, 18 nt, Human
ccucguggccagcccggc

SEQ ID NO: 2443899 - RNA, 15 nt, Human
ccucgguacucccau

SEQ ID NO: 2443900 - RNA, 18 nt, Human
ccucgggucuccucacuc

SEQ ID NO: 2443901 - RNA, 17 nt, Human
ccucgggucuccucacu

SEQ ID NO: 2443902 - RNA, 15 nt, Human
ccucgggucuccuca

SEQ ID NO: 2443903 - RNA, 14 nt, Human
ccucgggucuccuc

SEQ ID NO: 2443904 - RNA, 18 nt, Human
ccucgguguggagaagcg

SEQ ID NO: 2443905 - RNA, 18 nt, Human
ccucguggccuuccccag

SEQ ID NO: 2443906 - RNA, 19 nt, Human
ccucguggccuuccccagc

SEQ ID NO: 2443907 - RNA, 22 nt, Human
ccucguggccuuccccagccuc

SEQ ID NO: 2443908 - RNA, 23 nt, Human
ccucguggccuuccccagccucu

SEQ ID NO: 2443909 - RNA, 18 nt, Human
ccucgugguccccaacag

SEQ ID NO: 2443910 - RNA, 15 nt, Human
ccucgugguccccaa

SEQ ID NO: 2443911 - RNA, 19 nt, Human
ccucgugguccccaacagc

SEQ ID NO: 2443912 - RNA, 22 nt, Human
ccuccucugugaccaaugucuu

SEQ ID NO: 2443913 - RNA, 12 nt, Human
ccuccucuguga

SEQ ID NO: 2443914 - RNA, 14 nt, Human
ccuccucuucugac

SEQ ID NO: 2443915 - RNA, 13 nt, Human
ccuccucugugaa

SEQ ID NO: 2443916 - RNA, 20 nt, Human
ccuccugaaacuuacacaca

SEQ ID NO: 2443917 - RNA, 17 nt, Human
ccuccucuucugacgug

SEQ ID NO: 2443918 - RNA, 21 nt, Human
ccuccugaaacuuacacacaa

SEQ ID NO: 2443919 - RNA, 16 nt, Human
ccuccucugucugccc

SEQ ID NO: 2443920 - RNA, 14 nt, Human
ccuccucugucugc

SEQ ID NO: 2443921 - RNA, 17 nt, Human
ccuccucugucugcccu

SEQ ID NO: 2443922 - RNA, 11 nt, Human
ccuccucugug

SEQ ID NO: 2443923 - RNA, 18 nt, Human
ccuccucuguccagggcc

SEQ ID NO: 2443924 - RNA, 13 nt, Human
ccuccucugucug

SEQ ID NO: 2443925 - RNA, 14 nt, Human
ccuccucugucccu

SEQ ID NO: 2443926 - RNA, 22 nt, Human
ccuccucuggacggcaggcuca

SEQ ID NO: 2443927 - RNA, 21 nt, Human
ccuccucuggacggcaggcuc

SEQ ID NO: 2443928 - RNA, 12 nt, Human
ccuccucugucc

SEQ ID NO: 2443929 - RNA, 15 nt, Human
ccuccucuguccagg

SEQ ID NO: 2443930 - RNA, 16 nt, Human
ccuccucuguccaggg

SEQ ID NO: 2443931 - RNA, 21 nt, Human
ccuccucauguacauacccug

SEQ ID NO: 2443932 - RNA, 20 nt, Human
ccuccucauguacauacccu

SEQ ID NO: 2443933 - RNA, 23 nt, Human
ccuccucaucugggggaguggaa

SEQ ID NO: 2443934 - RNA, 13 nt, Human
ccuccucagggau

SEQ ID NO: 2443935 - RNA, 12 nt, Human
ccuccucaugua

SEQ ID NO: 2443936 - RNA, 23 nt, Human
ccuccucaucccguguucuccuu

SEQ ID NO: 2443937 - RNA, 20 nt, Human
ccuccucaucccguguucuc

SEQ ID NO: 2443938 - RNA, 13 nt, Human
ccuccucaucccg

SEQ ID NO: 2443939 - RNA, 12 nt, Human
ccuccucaggga

SEQ ID NO: 2443940 - RNA, 20 nt, Human
ccuccucuggacggcaggcu

SEQ ID NO: 2443941 - RNA, 19 nt, Human
ccuccuccaaaggcccccu

SEQ ID NO: 2443942 - RNA, 15 nt, Human
ccuccuccacaccag

SEQ ID NO: 2443943 - RNA, 17 nt, Human
ccuccugucuucccagg

SEQ ID NO: 2443944 - RNA, 16 nt, Human
ccuccugucuucccag

SEQ ID NO: 2443945 - RNA, 15 nt, Human
ccuccugucucuggc

SEQ ID NO: 2443946 - RNA, 22 nt, Human
ccuccuguaaaugguguacaua

SEQ ID NO: 2443947 - RNA, 21 nt, Human
ccuccugguggguccaggggc

SEQ ID NO: 2443948 - RNA, 20 nt, Human
ccuccugguggguccagggg

SEQ ID NO: 2443949 - RNA, 19 nt, Human
ccuccugguggguccaggg

SEQ ID NO: 2443950 - RNA, 18 nt, Human
ccuccugcugcagagggg

SEQ ID NO: 2443951 - RNA, 17 nt, Human
ccuccugcugcagaggg

SEQ ID NO: 2443952 - RNA, 12 nt, Human
ccuccugcugca

SEQ ID NO: 2443953 - RNA, 11 nt, Human
ccuccugcugc

SEQ ID NO: 2443954 - RNA, 21 nt, Human
ccuccugcugcagaggggcag

SEQ ID NO: 2443955 - RNA, 20 nt, Human
ccuccugcugcagaggggca

SEQ ID NO: 2443956 - RNA, 14 nt, Human
ccuccugggcuaag

SEQ ID NO: 2443957 - RNA, 16 nt, Human
ccuccugaccugaggc

SEQ ID NO: 2443958 - RNA, 23 nt, Human
ccuccugccucgaacuggcugca

SEQ ID NO: 2443959 - RNA, 12 nt, Human
ccuccugagaaa

SEQ ID NO: 2443960 - RNA, 18 nt, Human
ccuccugaccugaggcuc

SEQ ID NO: 2443961 - RNA, 15 nt, Human
ccuccugaccuguca

SEQ ID NO: 2443962 - RNA, 23 nt, Human
ccuccugcgcgcaugugcgcaca

SEQ ID NO: 2443963 - RNA, 20 nt, Human
ccuccugcgcgcaugugcgc

SEQ ID NO: 2443964 - RNA, 18 nt, Human
ccuccugcgcgcaugugc

SEQ ID NO: 2443965 - RNA, 11 nt, Human
ccuccugcuca

SEQ ID NO: 2443966 - RNA, 15 nt, Human
ccuccugcuacucug

SEQ ID NO: 2443967 - RNA, 14 nt, Human
ccuccccuugggcg

SEQ ID NO: 2443968 - RNA, 13 nt, Human
ccuccccuugggc

SEQ ID NO: 2443969 - RNA, 12 nt, Human
ccuccccuuggg

SEQ ID NO: 2443970 - RNA, 20 nt, Human
ccuccccuggggacagcaag

SEQ ID NO: 2443971 - RNA, 14 nt, Human
ccuccccuggggac

SEQ ID NO: 2443972 - RNA, 23 nt, Human
ccuccccuggggacagcaagggc

SEQ ID NO: 2443973 - RNA, 17 nt, Human
ccuccccuucccugcaa

SEQ ID NO: 2443974 - RNA, 13 nt, Human
ccuccccccacug

SEQ ID NO: 2443975 - RNA, 14 nt, Human
ccuccccccacugc

SEQ ID NO: 2443976 - RNA, 15 nt, Human
ccucccccacugcca

SEQ ID NO: 2443977 - RNA, 23 nt, Human
ccuccccauuucccaucugcacc

SEQ ID NO: 2443978 - RNA, 15 nt, Human
ccucccccagagggg

SEQ ID NO: 2443979 - RNA, 13 nt, Human
ccuccccugggga

SEQ ID NO: 2443980 - RNA, 16 nt, Human
ccuccccugcugcagg

SEQ ID NO: 2443981 - RNA, 20 nt, Human
ccuccccugcugcaggggcu

SEQ ID NO: 2443982 - RNA, 15 nt, Human
ccuccccccacugca

SEQ ID NO: 2443983 - RNA, 21 nt, Human
ccucccgaguagcugggacua

SEQ ID NO: 2443984 - RNA, 20 nt, Human
ccucccgaguagcugggacu

SEQ ID NO: 2443985 - RNA, 19 nt, Human
ccucccggcaugggaaagc

SEQ ID NO: 2443986 - RNA, 15 nt, Human
ccucccggcauggga

SEQ ID NO: 2443987 - RNA, 18 nt, Human
ccucccgccccuucccac

SEQ ID NO: 2443988 - RNA, 16 nt, Human
ccucccgccccuuccc

SEQ ID NO: 2443989 - RNA, 11 nt, Human
ccucccucagc

SEQ ID NO: 2443990 - RNA, 12 nt, Human
ccucccucagcc

SEQ ID NO: 2443991 - RNA, 22 nt, Human
ccucccucacccugagccccuu

SEQ ID NO: 2443992 - RNA, 11 nt, Human
ccucccgcccc

SEQ ID NO: 2443993 - RNA, 23 nt, Human
ccuccccuugggcggcugagagc

SEQ ID NO: 2443994 - RNA, 16 nt, Human
ccuccccuugggcggc

SEQ ID NO: 2443995 - RNA, 19 nt, Human
ccucccgaguagcugggac

SEQ ID NO: 2443996 - RNA, 21 nt, Human
ccucccugccccucccuucaa

SEQ ID NO: 2443997 - RNA, 18 nt, Human
ccucccugccccucccuu

SEQ ID NO: 2443998 - RNA, 14 nt, Human
ccucccucagcccc

SEQ ID NO: 2443999 - RNA, 15 nt, Human
ccucccucagccccu

SEQ ID NO: 2444000 - RNA, 16 nt, Human
ccucccucagccccuc

SEQ ID NO: 2444001 - RNA, 10 nt, Human
ccucccuccc

SEQ ID NO: 2444002 - RNA, 20 nt, Human
ccucccucagccccucuugc

SEQ ID NO: 2444003 - RNA, 14 nt, Human
ccuccucagaucuu

SEQ ID NO: 2444004 - RNA, 24 nt, Human
ccucccugccccucccuucaacca

SEQ ID NO: 2444005 - RNA, 22 nt, Human
ccucccugccccucccuucaac

SEQ ID NO: 2444006 - RNA, 14 nt, Human
ccucccugccucca

SEQ ID NO: 2444007 - RNA, 15 nt, Human
ccucccugccuccag

SEQ ID NO: 2444008 - RNA, 12 nt, Human
ccucccugcugu

SEQ ID NO: 2444009 - RNA, 13 nt, Human
ccucccugccccu

SEQ ID NO: 2444010 - RNA, 12 nt, Human
ccucccugccuc

SEQ ID NO: 2444011 - RNA, 17 nt, Human
ccgggaccuggugcugc

SEQ ID NO: 2444012 - RNA, 18 nt, Human
ccgggaccccgagccugg

SEQ ID NO: 2444013 - RNA, 20 nt, Human
ccgggcgcgguggcucacgc

SEQ ID NO: 2444014 - RNA, 16 nt, Human
ccgggcguggugguga

SEQ ID NO: 2444015 - RNA, 20 nt, Human
ccgggcucagggaccacagc

SEQ ID NO: 2444016 - RNA, 22 nt, Human
ccgggcucagggaccacagcaa

SEQ ID NO: 2444017 - RNA, 21 nt, Human
ccgggcucagggaccacagca

SEQ ID NO: 2444018 - RNA, 13 nt, Human
ccgggcucucugc

SEQ ID NO: 2444019 - RNA, 19 nt, Human
ccgggcugggagcucugca

SEQ ID NO: 2444020 - RNA, 18 nt, Human
ccgggcugggagcucugc

SEQ ID NO: 2444021 - RNA, 16 nt, Human
ccgggcugccugggcu

SEQ ID NO: 2444022 - RNA, 15 nt, Human
ccgggcugccugggc

SEQ ID NO: 2444023 - RNA, 12 nt, Human
ccgggcugccug

SEQ ID NO: 2444024 - RNA, 13 nt, Human
ccgggcugggagc

SEQ ID NO: 2444025 - RNA, 22 nt, Human
ccgggcucugccucccaucacc

SEQ ID NO: 2444026 - RNA, 14 nt, Human
ccgggcucucugcu

SEQ ID NO: 2444027 - RNA, 16 nt, Human
ccgggcucucugcugu

SEQ ID NO: 2444028 - RNA, 16 nt, Human
ccgugcucgccccagc

SEQ ID NO: 2444029 - RNA, 17 nt, Human
ccgugcucgccccagca

SEQ ID NO: 2444030 - RNA, 14 nt, Human
ccgugcugacagcu

SEQ ID NO: 2444031 - RNA, 16 nt, Human
ccgugcugacagcugc

SEQ ID NO: 2444032 - RNA, 17 nt, Human
ccgugcugacagcugcu

SEQ ID NO: 2444033 - RNA, 18 nt, Human
ccgugcugacagcugcuc

SEQ ID NO: 2444034 - RNA, 19 nt, Human
ccgugcugacagcugcucc

SEQ ID NO: 2444035 - RNA, 21 nt, Human
ccgugcugacagcugcuccua

SEQ ID NO: 2444036 - RNA, 14 nt, Human
ccgugcuuccucag

SEQ ID NO: 2444037 - RNA, 20 nt, Human
ccgugcugacagcugcuccu

SEQ ID NO: 2444038 - RNA, 21 nt, Human
ccgggcugccugggcuguugg

SEQ ID NO: 2444039 - RNA, 18 nt, Human
ccgggcugccugggcugu

SEQ ID NO: 2444040 - RNA, 17 nt, Human
ccgggcugccugggcug

SEQ ID NO: 2444041 - RNA, 20 nt, Human
ccgggugggcggcacagccu

SEQ ID NO: 2444042 - RNA, 14 nt, Human
ccgggugggcggca

SEQ ID NO: 2444043 - RNA, 14 nt, Human
ccgggucugccucu

SEQ ID NO: 2444044 - RNA, 12 nt, Human
ccggguuccagc

SEQ ID NO: 2444045 - RNA, 15 nt, Human
ccggguuccagcacc

SEQ ID NO: 2444046 - RNA, 22 nt, Human
ccgguaaacacgccugcaaacg

SEQ ID NO: 2444047 - RNA, 21 nt, Human
ccggguuuggcgggccaagga

SEQ ID NO: 2444048 - RNA, 22 nt, Human
ccggguuuggcgggccaaggac

SEQ ID NO: 2444049 - RNA, 20 nt, Human
ccggguucuagucuccuuug

SEQ ID NO: 2444050 - RNA, 17 nt, Human
ccggguucuagucuccu

SEQ ID NO: 2444051 - RNA, 19 nt, Human
ccggguuuggcgggccaag

SEQ ID NO: 2444052 - RNA, 20 nt, Human
ccggguuuggcgggccaagg

SEQ ID NO: 2444053 - RNA, 22 nt, Human
ccgcucugcaugcggcccagcc

SEQ ID NO: 2444054 - RNA, 21 nt, Human
ccgcucugcaugcggcccagc

SEQ ID NO: 2444055 - RNA, 20 nt, Human
ccgcucugcaugcggcccag

SEQ ID NO: 2444056 - RNA, 13 nt, Human
ccgcugaguggac

SEQ ID NO: 2444057 - RNA, 14 nt, Human
ccgcucuggaccaa

SEQ ID NO: 2444058 - RNA, 23 nt, Human
ccgcugagcgaggagaugcuccu

SEQ ID NO: 2444059 - RNA, 22 nt, Human
ccgcucagcccucccugccccu

SEQ ID NO: 2444060 - RNA, 21 nt, Human
ccgcucagcccucccugcccc

SEQ ID NO: 2444061 - RNA, 19 nt, Human
ccgcucagcccucccugcc

SEQ ID NO: 2444062 - RNA, 15 nt, Human
ccgcucagcccuccc

SEQ ID NO: 2444063 - RNA, 20 nt, Human
ccgcugccacguuggagaag

SEQ ID NO: 2444064 - RNA, 23 nt, Human
ccgcugccacccaccucccugcc

SEQ ID NO: 2444065 - RNA, 24 nt, Human
ccgcugccacccaccucccugccu

SEQ ID NO: 2444066 - RNA, 15 nt, Human
ccgcugccacccacc

SEQ ID NO: 2444067 - RNA, 16 nt, Human
ccgcugccacccaccu

SEQ ID NO: 2444068 - RNA, 17 nt, Human
ccgcugccacccaccuc

SEQ ID NO: 2444069 - RNA, 20 nt, Human
ccgcugccacccaccucccu

SEQ ID NO: 2444070 - RNA, 15 nt, Human
ccgcugauucucagg

SEQ ID NO: 2444071 - RNA, 13 nt, Human
ccgcugauucuca

SEQ ID NO: 2444072 - RNA, 19 nt, Human
ccgcugaguggacuggagu

SEQ ID NO: 2444073 - RNA, 17 nt, Human
ccgcugaguggacugga

SEQ ID NO: 2444074 - RNA, 22 nt, Human
ccgcugauucucagggucucug

SEQ ID NO: 2444075 - RNA, 11 nt, Human
ccgcugccacc

SEQ ID NO: 2444076 - RNA, 12 nt, Human
ccgcugccaccc

SEQ ID NO: 2444077 - RNA, 14 nt, Human
ccgcugccacccac

SEQ ID NO: 2444078 - RNA, 12 nt, Human
ccgcuuucuacc

SEQ ID NO: 2444079 - RNA, 20 nt, Human
ccgcugcccggcgcccucug

SEQ ID NO: 2444080 - RNA, 19 nt, Human
ccgcugcccggcgcccucu

SEQ ID NO: 2444081 - RNA, 22 nt, Human
ccgcugcccggcgcccucuguc

SEQ ID NO: 2444082 - RNA, 16 nt, Human
ccgcuuguccagcgcc

SEQ ID NO: 2444083 - RNA, 17 nt, Human
ccgcuuguccagcgccu

SEQ ID NO: 2444084 - RNA, 18 nt, Human
ccggcuggccuggccccu

SEQ ID NO: 2444085 - RNA, 17 nt, Human
ccggcuggccuggcccc

SEQ ID NO: 2444086 - RNA, 15 nt, Human
ccggcuggccuggcc

SEQ ID NO: 2444087 - RNA, 19 nt, Human
ccgcuuucuacccagcgag

SEQ ID NO: 2444088 - RNA, 17 nt, Human
ccgggaccccgagccug

SEQ ID NO: 2444089 - RNA, 20 nt, Human
ccgggaagggggcugggaca

SEQ ID NO: 2444090 - RNA, 23 nt, Human
ccggcugguuuuguaagaugcug

SEQ ID NO: 2444091 - RNA, 18 nt, Human
ccgcuuguccagcgccua

SEQ ID NO: 2444092 - RNA, 19 nt, Human
ccgcuuguccagcgccuag

SEQ ID NO: 2444093 - RNA, 14 nt, Human
ccgcacugggcuug

SEQ ID NO: 2444094 - RNA, 19 nt, Human
ccgcacugggcuuggggac

SEQ ID NO: 2444095 - RNA, 16 nt, Human
ccgcacccccacccuu

SEQ ID NO: 2444096 - RNA, 13 nt, Human
ccgcaccccccaa

SEQ ID NO: 2444097 - RNA, 11 nt, Human
ccgcaccccag

SEQ ID NO: 2444098 - RNA, 13 nt, Human
ccgcaccccagag

SEQ ID NO: 2444099 - RNA, 17 nt, Human
ccgcaccccagagugug

SEQ ID NO: 2444100 - RNA, 15 nt, Human
ccgcacccccacccu

SEQ ID NO: 2444101 - RNA, 15 nt, Human
ccgcaauacaggaac

SEQ ID NO: 2444102 - RNA, 21 nt, Human
ccgcaaugugcccccagacgc

SEQ ID NO: 2444103 - RNA, 18 nt, Human
ccgcgcgcgucccccugc

SEQ ID NO: 2444104 - RNA, 16 nt, Human
ccgcgcccgcgcccuc

SEQ ID NO: 2444105 - RNA, 16 nt, Human
ccgcgccuccuuccuu

SEQ ID NO: 2444106 - RNA, 22 nt, Human
ccgcgccaaauaaugucucugu

SEQ ID NO: 2444107 - RNA, 23 nt, Human
ccgccuucacuccggugugccug

SEQ ID NO: 2444108 - RNA, 20 nt, Human
ccgccuguucccccgccgcu

SEQ ID NO: 2444109 - RNA, 17 nt, Human
ccgccuguucccccgcc

SEQ ID NO: 2444110 - RNA, 14 nt, Human
ccgccugguacuca

SEQ ID NO: 2444111 - RNA, 14 nt, Human
ccgcacucacccau

SEQ ID NO: 2444112 - RNA, 14 nt, Human
ccgcacuaggggau

SEQ ID NO: 2444113 - RNA, 22 nt, Human
ccgccugguacucaagcccgcg

SEQ ID NO: 2444114 - RNA, 16 nt, Human
ccgcuagaggccugag

SEQ ID NO: 2444115 - RNA, 15 nt, Human
ccgcuagaggccuga

SEQ ID NO: 2444116 - RNA, 23 nt, Human
ccgcuaagagggagggagggcuc

SEQ ID NO: 2444117 - RNA, 13 nt, Human
ccgcucagcccuc

SEQ ID NO: 2444118 - RNA, 12 nt, Human
ccgcucagcccu

SEQ ID NO: 2444119 - RNA, 19 nt, Human
ccgcuagaggccugaggau

SEQ ID NO: 2444120 - RNA, 18 nt, Human
ccgcuagaggccugagga

SEQ ID NO: 2444121 - RNA, 17 nt, Human
ccgcuagaggccugagg

SEQ ID NO: 2444122 - RNA, 11 nt, Human
ccgcucagccc

SEQ ID NO: 2444123 - RNA, 13 nt, Human
ccgcguuguaaaa

SEQ ID NO: 2444124 - RNA, 17 nt, Human
ccgcguuguaaaauaua

SEQ ID NO: 2444125 - RNA, 21 nt, Human
ccgcuaagagggagggagggc

SEQ ID NO: 2444126 - RNA, 17 nt, Human
ccgcgucuggugacaac

SEQ ID NO: 2444127 - RNA, 22 nt, Human
ccgcgugaucaaagccacacuc

SEQ ID NO: 2444128 - RNA, 19 nt, Human
ccgcgucgcccucccaggc

SEQ ID NO: 2444129 - RNA, 17 nt, Human
ccgcgucgcccucccag

SEQ ID NO: 2444130 - RNA, 20 nt, Human
ccgcggggacauugggaagg

SEQ ID NO: 2444131 - RNA, 22 nt, Human
cccugguucugaugaugugccu

SEQ ID NO: 2444132 - RNA, 18 nt, Human
cccugguuuccugcccug

SEQ ID NO: 2444133 - RNA, 19 nt, Human
cccugguuuccugcccugg

SEQ ID NO: 2444134 - RNA, 14 nt, Human
ccgaggccuucucu

SEQ ID NO: 2444135 - RNA, 14 nt, Human
ccgaggcaggguca

SEQ ID NO: 2444136 - RNA, 11 nt, Human
ccgaggccagu

SEQ ID NO: 2444137 - RNA, 20 nt, Human
ccgaggcagggucaggagag

SEQ ID NO: 2444138 - RNA, 14 nt, Human
cccuggucucuggu

SEQ ID NO: 2444139 - RNA, 13 nt, Human
cccuggucucugg

SEQ ID NO: 2444140 - RNA, 15 nt, Human
cccuggucucugguc

SEQ ID NO: 2444141 - RNA, 16 nt, Human
cccugguucucaucuu

SEQ ID NO: 2444142 - RNA, 15 nt, Human
cccugguucucaucu

SEQ ID NO: 2444143 - RNA, 20 nt, Human
cccugguggcagcucaccuc

SEQ ID NO: 2444144 - RNA, 16 nt, Human
cccugguuuccugccc

SEQ ID NO: 2444145 - RNA, 17 nt, Human
cccugguuuccugcccu

SEQ ID NO: 2444146 - RNA, 23 nt, Human
cccugguucugaugaugugccug

SEQ ID NO: 2444147 - RNA, 17 nt, Human
cccugguucucaucuuu

SEQ ID NO: 2444148 - RNA, 15 nt, Human
cccugguuucacugg

SEQ ID NO: 2444149 - RNA, 20 nt, Human
cccugguuucacuggcccaa

SEQ ID NO: 2444150 - RNA, 17 nt, Human
ccgaguagcugggacua

SEQ ID NO: 2444151 - RNA, 22 nt, Human
ccgaggccuaccccgcagacac

SEQ ID NO: 2444152 - RNA, 19 nt, Human
ccgagucauucguucugug

SEQ ID NO: 2444153 - RNA, 20 nt, Human
ccgagucauucguucugugg

SEQ ID NO: 2444154 - RNA, 12 nt, Human
ccgaguccaagc

SEQ ID NO: 2444155 - RNA, 20 nt, Human
ccgaguagcugggacuacag

SEQ ID NO: 2444156 - RNA, 23 nt, Human
ccgaugcugcuuuccccuguggg

SEQ ID NO: 2444157 - RNA, 21 nt, Human
ccgaugcugcuuuccccugug

SEQ ID NO: 2444158 - RNA, 20 nt, Human
ccgaugcugcuuuccccugu

SEQ ID NO: 2444159 - RNA, 13 nt, Human
ccgaguccaagcu

SEQ ID NO: 2444160 - RNA, 17 nt, Human
ccgaugcugcuuucccc

SEQ ID NO: 2444161 - RNA, 16 nt, Human
ccgauucaccugagca

SEQ ID NO: 2444162 - RNA, 21 nt, Human
ccgauucaucucucagaaggg

SEQ ID NO: 2444163 - RNA, 22 nt, Human
ccgaugcugcuuuccccugugg

SEQ ID NO: 2444164 - RNA, 13 nt, Human
ccgauucacccug

SEQ ID NO: 2444165 - RNA, 14 nt, Human
ccgauuucccaggc

SEQ ID NO: 2444166 - RNA, 16 nt, Human
ccgcaaaccacacugg

SEQ ID NO: 2444167 - RNA, 15 nt, Human
ccgcaaaccacacug

SEQ ID NO: 2444168 - RNA, 21 nt, Human
ccgcaaacccccuuugugcug

SEQ ID NO: 2444169 - RNA, 21 nt, Human
ccgcaaaccacacuggacucc

SEQ ID NO: 2444170 - RNA, 14 nt, Human
ccuauagucccagc

SEQ ID NO: 2444171 - RNA, 15 nt, Human
ccuaggcuccacccc

SEQ ID NO: 2444172 - RNA, 21 nt, Human
ccuacuuugacuuuuugcauu

SEQ ID NO: 2444173 - RNA, 23 nt, Human
ccuacuucuuugcuuugcccagc

SEQ ID NO: 2444174 - RNA, 17 nt, Human
ccuaggcuccaccccau

SEQ ID NO: 2444175 - RNA, 18 nt, Human
ccuaggcuccaccccauc

SEQ ID NO: 2444176 - RNA, 17 nt, Human
ccuaggcugaccuugaa

SEQ ID NO: 2444177 - RNA, 17 nt, Human
ccuagggccacugaaga

SEQ ID NO: 2444178 - RNA, 20 nt, Human
ccuagggauguucuggcccu

SEQ ID NO: 2444179 - RNA, 22 nt, Human
ccuagggaagggugguggagcc

SEQ ID NO: 2444180 - RNA, 23 nt, Human
ccuagggaagggugguggagcca

SEQ ID NO: 2444181 - RNA, 14 nt, Human
ccuagggaaaaguu

SEQ ID NO: 2444182 - RNA, 14 nt, Human
ccuagggccugguc

SEQ ID NO: 2444183 - RNA, 16 nt, Human
ccuagggccuggucca

SEQ ID NO: 2444184 - RNA, 18 nt, Human
ccuaggggacacuucccu

SEQ ID NO: 2444185 - RNA, 17 nt, Human
ccuaggggacacuuccc

SEQ ID NO: 2444186 - RNA, 16 nt, Human
ccuacuucuuuugcuc

SEQ ID NO: 2444187 - RNA, 22 nt, Human
ccuacuucuuuugcucuuagcu

SEQ ID NO: 2444188 - RNA, 14 nt, Human
ccuacuuugacuuu

SEQ ID NO: 2444189 - RNA, 15 nt, Human
ccuacuuugacuuuu

SEQ ID NO: 2444190 - RNA, 19 nt, Human
ccuacuucuccagccuaga

SEQ ID NO: 2444191 - RNA, 14 nt, Human
ccuacuucuccagc

SEQ ID NO: 2444192 - RNA, 12 nt, Human
ccuacuucucca

SEQ ID NO: 2444193 - RNA, 15 nt, Human
ccuacuuccugugac

SEQ ID NO: 2444194 - RNA, 12 nt, Human
ccuaccucaggu

SEQ ID NO: 2444195 - RNA, 15 nt, Human
ccuaccucaggcagg

SEQ ID NO: 2444196 - RNA, 18 nt, Human
ccuaccucagccuagacc

SEQ ID NO: 2444197 - RNA, 21 nt, Human
ccuaccucagccuagacccuc

SEQ ID NO: 2444198 - RNA, 21 nt, Human
ccuacuuccccuuccuaauuc

SEQ ID NO: 2444199 - RNA, 13 nt, Human
ccuacuuccugug

SEQ ID NO: 2444200 - RNA, 15 nt, Human
ccuaccaaugcaugc

SEQ ID NO: 2444201 - RNA, 13 nt, Human
ccuaccaaugcau

SEQ ID NO: 2444202 - RNA, 12 nt, Human
ccuaccaaugca

SEQ ID NO: 2444203 - RNA, 23 nt, Human
ccuaccaauagauuccccauugc

SEQ ID NO: 2444204 - RNA, 19 nt, Human
ccuaccaauagauucccca

SEQ ID NO: 2444205 - RNA, 17 nt, Human
ccuacacccuuggacuu

SEQ ID NO: 2444206 - RNA, 13 nt, Human
ccuacaccauucc

SEQ ID NO: 2444207 - RNA, 20 nt, Human
ccuacacccuuggacuugag

SEQ ID NO: 2444208 - RNA, 18 nt, Human
ccuaccaccccuuccugu

SEQ ID NO: 2444209 - RNA, 17 nt, Human
ccuaccaccccuuccug

SEQ ID NO: 2444210 - RNA, 13 nt, Human
ccuaccaccuccc

SEQ ID NO: 2444211 - RNA, 17 nt, Human
ccuaccagcgcccgcug

SEQ ID NO: 2444212 - RNA, 16 nt, Human
ccuaccagcgcccgcu

SEQ ID NO: 2444213 - RNA, 13 nt, Human
ccuaccacugucu

SEQ ID NO: 2444214 - RNA, 18 nt, Human
ccuaccaccuccccagcc

SEQ ID NO: 2444215 - RNA, 22 nt, Human
ccuaccaaugcaugcagccacu

SEQ ID NO: 2444216 - RNA, 16 nt, Human
ccuaccaaugcaugca

SEQ ID NO: 2444217 - RNA, 13 nt, Human
ccuaccacagugu

SEQ ID NO: 2444218 - RNA, 14 nt, Human
ccuaccacaguguc

SEQ ID NO: 2444219 - RNA, 13 nt, Human
ccuaccaccccuu

SEQ ID NO: 2444220 - RNA, 14 nt, Human
ccuaccacaugcca

SEQ ID NO: 2444221 - RNA, 15 nt, Human
ccuaccacagugucu

SEQ ID NO: 2444222 - RNA, 16 nt, Human
ccuaccacagugucug

SEQ ID NO: 2444223 - RNA, 15 nt, Human
ccuacccaaccacuc

SEQ ID NO: 2444224 - RNA, 22 nt, Human
ccuaccaucagggacaggauga

SEQ ID NO: 2444225 - RNA, 16 nt, Human
ccuaccaucagggaca

SEQ ID NO: 2444226 - RNA, 23 nt, Human
ccuaccagcgcccgcugggcuga

SEQ ID NO: 2444227 - RNA, 22 nt, Human
ccuaccagcgcccgcugggcug

SEQ ID NO: 2444228 - RNA, 21 nt, Human
ccuaccagcgcccgcugggcu

SEQ ID NO: 2444229 - RNA, 20 nt, Human
ccuaccagcgcccgcugggc

SEQ ID NO: 2444230 - RNA, 19 nt, Human
ccuaccagcgcccgcuggg

SEQ ID NO: 2444231 - RNA, 23 nt, Human
ccuaccgagucucuucuccacug

SEQ ID NO: 2444232 - RNA, 22 nt, Human
ccuaccgagucucuucuccacu

SEQ ID NO: 2444233 - RNA, 14 nt, Human
ccuaccucagccua

SEQ ID NO: 2444234 - RNA, 16 nt, Human
ccuaccucagccuaga

SEQ ID NO: 2444235 - RNA, 13 nt, Human
ccuaccucagccu

SEQ ID NO: 2444236 - RNA, 21 nt, Human
ccuaccggcaauuuccggcca

SEQ ID NO: 2444237 - RNA, 12 nt, Human
ccuaccucagcc

SEQ ID NO: 2444238 - RNA, 13 nt, Human
ccuacccacaccu

SEQ ID NO: 2444239 - RNA, 20 nt, Human
ccuaccggcaauuuccggcc

SEQ ID NO: 2444240 - RNA, 12 nt, Human
ccuaguuuucca

SEQ ID NO: 2444241 - RNA, 13 nt, Human
ccuaguuuuccau

SEQ ID NO: 2444242 - RNA, 15 nt, Human
ccuaguuuuccaugc

SEQ ID NO: 2444243 - RNA, 15 nt, Human
ccuaguuuucuccuc

SEQ ID NO: 2444244 - RNA, 16 nt, Human
ccuaguuuucuccucc

SEQ ID NO: 2444245 - RNA, 18 nt, Human
ccuaguuuucuccuccca

SEQ ID NO: 2444246 - RNA, 19 nt, Human
ccuaguuuucuccucccag

SEQ ID NO: 2444247 - RNA, 18 nt, Human
ccuaguucuguagaaaug

SEQ ID NO: 2444248 - RNA, 14 nt, Human
ccuaguuucccuga

SEQ ID NO: 2444249 - RNA, 19 nt, Human
ccuaguucuguagaaaugg

SEQ ID NO: 2444250 - RNA, 23 nt, Human
ccuaguuccaccaucaagccacc

SEQ ID NO: 2444251 - RNA, 21 nt, Human
ccuaguuccaccaucaagcca

SEQ ID NO: 2444252 - RNA, 13 nt, Human
ccuaguuccacca

SEQ ID NO: 2444253 - RNA, 21 nt, Human
ccuaguucauccaauccucac

SEQ ID NO: 2444254 - RNA, 24 nt, Human
ccuaguggggucucccucuccugc

SEQ ID NO: 2444255 - RNA, 18 nt, Human
ccuaggggucagggacca

SEQ ID NO: 2444256 - RNA, 21 nt, Human
ccuaguggggucucccucucc

SEQ ID NO: 2444257 - RNA, 15 nt, Human
ccuaggggucaggga

SEQ ID NO: 2444258 - RNA, 23 nt, Human
ccuaguggggucucccucuccug

SEQ ID NO: 2444259 - RNA, 18 nt, Human
ccuauauuguuuucagug

SEQ ID NO: 2444260 - RNA, 18 nt, Human
ccuauauaauaaagcuac

SEQ ID NO: 2444261 - RNA, 16 nt, Human
ccuauauaguuuauug

SEQ ID NO: 2444262 - RNA, 14 nt, Human
ccuauauguaguau

SEQ ID NO: 2444263 - RNA, 15 nt, Human
ccuauauuuacagug

SEQ ID NO: 2444264 - RNA, 13 nt, Human
ccuauauuuacag

SEQ ID NO: 2444265 - RNA, 15 nt, Human
ccuauauuggcuaaa

SEQ ID NO: 2444266 - RNA, 18 nt, Human
ccuauaugauuuauaguu

SEQ ID NO: 2444267 - RNA, 14 nt, Human
ccuaugcaauauau

SEQ ID NO: 2444268 - RNA, 22 nt, Human
ccuauauuguuuucaguguaca

SEQ ID NO: 2444269 - RNA, 22 nt, Human
ccuauacgcagcgugcuuuaaa

SEQ ID NO: 2444270 - RNA, 13 nt, Human
ccuauagucccag

SEQ ID NO: 2444271 - RNA, 18 nt, Human
ccuauagucccagcuacu

SEQ ID NO: 2444272 - RNA, 20 nt, Human
ccuauaaaacaggucaauac

SEQ ID NO: 2444273 - RNA, 17 nt, Human
ccuauaaaguaaagcua

SEQ ID NO: 2444274 - RNA, 23 nt, Human
ccuauaaaacaggucaauacagu

SEQ ID NO: 2444275 - RNA, 20 nt, Human
ccuaguuuucuccucccagg

SEQ ID NO: 2444276 - RNA, 12 nt, Human
ccuauaaaacag

SEQ ID NO: 2444277 - RNA, 12 nt, Human
ccuauaaugaag

SEQ ID NO: 2444278 - RNA, 20 nt, Human
ccuaauuucuccucccuucc

SEQ ID NO: 2444279 - RNA, 23 nt, Human
ccuaauuucuccucccuuccuuu

SEQ ID NO: 2444280 - RNA, 15 nt, Human
ccuacaagacacagu

SEQ ID NO: 2444281 - RNA, 21 nt, Human
ccuacaccauuaucuuggaaa

SEQ ID NO: 2444282 - RNA, 19 nt, Human
ccuacaagagcagccugug

SEQ ID NO: 2444283 - RNA, 17 nt, Human
ccuacaagagcagccug

SEQ ID NO: 2444284 - RNA, 18 nt, Human
ccuacaagagcagccugu

SEQ ID NO: 2444285 - RNA, 21 nt, Human
ccuacaagagcagccuguggc

SEQ ID NO: 2444286 - RNA, 18 nt, Human
ccuaaauauauuuuaaga

SEQ ID NO: 2444287 - RNA, 14 nt, Human
ccuaaaguguauuu

SEQ ID NO: 2444288 - RNA, 16 nt, Human
ccuaaauauauuuuaa

SEQ ID NO: 2444289 - RNA, 15 nt, Human
ccuaaaauucagugg

SEQ ID NO: 2444290 - RNA, 16 nt, Human
ccguguaaaccaaagc

SEQ ID NO: 2444291 - RNA, 14 nt, Human
ccgugguccuuugg

SEQ ID NO: 2444292 - RNA, 20 nt, Human
ccgugguguuauuuaaagaa

SEQ ID NO: 2444293 - RNA, 22 nt, Human
ccgugcuuguuugcucaccugg

SEQ ID NO: 2444294 - RNA, 15 nt, Human
ccgugcuuccucagu

SEQ ID NO: 2444295 - RNA, 20 nt, Human
ccgugcuuguuugcucaccu

SEQ ID NO: 2444296 - RNA, 23 nt, Human
ccgugcuuguuugcucaccuggg

SEQ ID NO: 2444297 - RNA, 23 nt, Human
ccgugugagaagugaaugcuggg

SEQ ID NO: 2444298 - RNA, 22 nt, Human
ccgugugagaagugaaugcugg

SEQ ID NO: 2444299 - RNA, 13 nt, Human
ccgugugcccucg

SEQ ID NO: 2444300 - RNA, 14 nt, Human
ccuaaaaguaaaca

SEQ ID NO: 2444301 - RNA, 23 nt, Human
ccuaaaaggaaaucucaccccau

SEQ ID NO: 2444302 - RNA, 18 nt, Human
ccuaaaauaauugguucu

SEQ ID NO: 2444303 - RNA, 15 nt, Human
ccuaaaaguaaacau

SEQ ID NO: 2444304 - RNA, 22 nt, Human
ccuaaaagugggcuugauucug

SEQ ID NO: 2444305 - RNA, 16 nt, Human
ccgugugcccucgggc

SEQ ID NO: 2444306 - RNA, 13 nt, Human
ccguguggccccu

SEQ ID NO: 2444307 - RNA, 14 nt, Human
ccguguggccccuu

SEQ ID NO: 2444308 - RNA, 15 nt, Human
ccguguggccccuuc

SEQ ID NO: 2444309 - RNA, 22 nt, Human
ccuaaaaggaaaucucacccca

SEQ ID NO: 2444310 - RNA, 18 nt, Human
ccuaaaagcacacucauc

SEQ ID NO: 2444311 - RNA, 16 nt, Human
ccguguggccccuuca

SEQ ID NO: 2444312 - RNA, 17 nt, Human
ccuaaaagcacacucau

SEQ ID NO: 2444313 - RNA, 16 nt, Human
cuuaauuaaaagaaua

SEQ ID NO: 2444314 - RNA, 17 nt, Human
cuuaauuaaaagaauau

SEQ ID NO: 2444315 - RNA, 14 nt, Human
cuuaauguuuauuc

SEQ ID NO: 2444316 - RNA, 12 nt, Human
cuuaauguuuau

SEQ ID NO: 2444317 - RNA, 22 nt, Human
cuuaauguucugaauaauuucu

SEQ ID NO: 2444318 - RNA, 20 nt, Human
cuuaauguucugaauaauuu

SEQ ID NO: 2444319 - RNA, 22 nt, Human
cuuaaugaaguuugaauguuaa

SEQ ID NO: 2444320 - RNA, 23 nt, Human
cuuaaugaaguuugaauguuaaa

SEQ ID NO: 2444321 - RNA, 21 nt, Human
cuuaaugaaguuugaauguua

SEQ ID NO: 2444322 - RNA, 20 nt, Human
cuuaaugaaguuugaauguu

SEQ ID NO: 2444323 - RNA, 19 nt, Human
cuuaaugaaguuugaaugu

SEQ ID NO: 2444324 - RNA, 18 nt, Human
cuuaaugaaguuugaaug

SEQ ID NO: 2444325 - RNA, 17 nt, Human
cuuaaugaaguuugaau

SEQ ID NO: 2444326 - RNA, 15 nt, Human
cuuaaugaaguuuga

SEQ ID NO: 2444327 - RNA, 14 nt, Human
cuuaaugaaguuug

SEQ ID NO: 2444328 - RNA, 12 nt, Human
cuuaaugaaguu

SEQ ID NO: 2444329 - RNA, 21 nt, Human
cuuaaucuuuucacaaauaaa

SEQ ID NO: 2444330 - RNA, 20 nt, Human
cuuaaucuuuucacaaauaa

SEQ ID NO: 2444331 - RNA, 19 nt, Human
cuuaaucuuuucacaaaua

SEQ ID NO: 2444332 - RNA, 18 nt, Human
cuuaaucuuuucacaaau

SEQ ID NO: 2444333 - RNA, 17 nt, Human
cuuaaucuuuucacaaa

SEQ ID NO: 2444334 - RNA, 19 nt, Human
cuuaauauauauauccaga

SEQ ID NO: 2444335 - RNA, 14 nt, Human
cuuaauauguuaac

SEQ ID NO: 2444336 - RNA, 23 nt, Human
cuuaauuguucauuuugagcuga

SEQ ID NO: 2444337 - RNA, 19 nt, Human
cuuaauuguucauuuugag

SEQ ID NO: 2444338 - RNA, 16 nt, Human
cuuaauuguucauuuu

SEQ ID NO: 2444339 - RNA, 19 nt, Human
cuuaauuccuuucucaucc

SEQ ID NO: 2444340 - RNA, 15 nt, Human
cuuaauugcacucua

SEQ ID NO: 2444341 - RNA, 20 nt, Human
cuuaauucuuagcucauucu

SEQ ID NO: 2444342 - RNA, 17 nt, Human
cuuaauuccuuucucau

SEQ ID NO: 2444343 - RNA, 23 nt, Human
cuuaauguuuauuccugauaaua

SEQ ID NO: 2444344 - RNA, 19 nt, Human
cuuaauuauuauuuguguu

SEQ ID NO: 2444345 - RNA, 19 nt, Human
cuuaauuaaaagaauauuu

SEQ ID NO: 2444346 - RNA, 20 nt, Human
cuuaauuaaaagaauauuuu

SEQ ID NO: 2444347 - RNA, 18 nt, Human
cuuaauuauuauuugugu

SEQ ID NO: 2444348 - RNA, 15 nt, Human
cuuaauuauuauuug

SEQ ID NO: 2444349 - RNA, 11 nt, Human
cuuaauuauua

SEQ ID NO: 2444350 - RNA, 16 nt, Human
cuuaauguuuauuccu

SEQ ID NO: 2444351 - RNA, 15 nt, Human
cuuaauguuuauucc

SEQ ID NO: 2444352 - RNA, 23 nt, Human
cuuaagaagacugcauuauauuu

SEQ ID NO: 2444353 - RNA, 18 nt, Human
cuuaagaauuuugagcag

SEQ ID NO: 2444354 - RNA, 17 nt, Human
cuuaaccagaucauugu

SEQ ID NO: 2444355 - RNA, 14 nt, Human
cuuaacauucugua

SEQ ID NO: 2444356 - RNA, 17 nt, Human
cuuaacauucuguaaaa

SEQ ID NO: 2444357 - RNA, 21 nt, Human
cuuaagaagacugcauuauau

SEQ ID NO: 2444358 - RNA, 17 nt, Human
cuuaacauauuuacuaa

SEQ ID NO: 2444359 - RNA, 15 nt, Human
cuuaacauauuuacu

SEQ ID NO: 2444360 - RNA, 13 nt, Human
cuuaacauauuua

SEQ ID NO: 2444361 - RNA, 23 nt, Human
cuuaacaauuucuguccuucaga

SEQ ID NO: 2444362 - RNA, 20 nt, Human
cuuaaaaaucauugauuguc

SEQ ID NO: 2444363 - RNA, 17 nt, Human
cuuaaauuuuaauuuau

SEQ ID NO: 2444364 - RNA, 18 nt, Human
cuuaaauuuuaauuuauu

SEQ ID NO: 2444365 - RNA, 12 nt, Human
cuuaagcuuccg

SEQ ID NO: 2444366 - RNA, 20 nt, Human
cuuaaggacaaaaaugaacu

SEQ ID NO: 2444367 - RNA, 21 nt, Human
cuuaaggauggagccagcucu

SEQ ID NO: 2444368 - RNA, 18 nt, Human
cuuaaggggcagcuucua

SEQ ID NO: 2444369 - RNA, 16 nt, Human
cuuaaggcacucuguu

SEQ ID NO: 2444370 - RNA, 20 nt, Human
cuuaaggauugugauauuuu

SEQ ID NO: 2444371 - RNA, 12 nt, Human
cuuaaggggcag

SEQ ID NO: 2444372 - RNA, 15 nt, Human
cuuaaggggcagcuu

SEQ ID NO: 2444373 - RNA, 14 nt, Human
cuuaaggggcagcu

SEQ ID NO: 2444374 - RNA, 22 nt, Human
cuuaaguaagcaacagcauaac

SEQ ID NO: 2444375 - RNA, 16 nt, Human
cuuaauacuaccuuga

SEQ ID NO: 2444376 - RNA, 18 nt, Human
cuuaauacuaccuugaaa

SEQ ID NO: 2444377 - RNA, 17 nt, Human
cuuaauacacacaguua

SEQ ID NO: 2444378 - RNA, 21 nt, Human
cuuaauaccugggugauuaca

SEQ ID NO: 2444379 - RNA, 20 nt, Human
cuuaauagaaacauugaaga

SEQ ID NO: 2444380 - RNA, 16 nt, Human
cuuaauaguauuuaug

SEQ ID NO: 2444381 - RNA, 17 nt, Human
cuuaauaguauuuauga

SEQ ID NO: 2444382 - RNA, 14 nt, Human
cuuaguacugaguu

SEQ ID NO: 2444383 - RNA, 23 nt, Human
cuuagagccucccucaauucccc

SEQ ID NO: 2444384 - RNA, 22 nt, Human
cuuaguaaugcuacgugugauu

SEQ ID NO: 2444385 - RNA, 21 nt, Human
cuuaguaaugcuacgugugau

SEQ ID NO: 2444386 - RNA, 20 nt, Human
cuuaguaaugcuacguguga

SEQ ID NO: 2444387 - RNA, 23 nt, Human
cuuagguuggcaaaaaggcagga

SEQ ID NO: 2444388 - RNA, 21 nt, Human
cuuagguuggcaaaaaggcag

SEQ ID NO: 2444389 - RNA, 17 nt, Human
cuuagagccucccucaa

SEQ ID NO: 2444390 - RNA, 16 nt, Human
cuuagagccucccuca

SEQ ID NO: 2444391 - RNA, 23 nt, Human
cuuagagccaggcacacacugug

SEQ ID NO: 2444392 - RNA, 17 nt, Human
cuuagagccaggcacac

SEQ ID NO: 2444393 - RNA, 16 nt, Human
cuuagagccaggcaca

SEQ ID NO: 2444394 - RNA, 15 nt, Human
cuuagagccaggcac

SEQ ID NO: 2444395 - RNA, 14 nt, Human
cuuagagccaggca

SEQ ID NO: 2444396 - RNA, 12 nt, Human
cuuagagccagg

SEQ ID NO: 2444397 - RNA, 22 nt, Human
cuuagagcaguuucuguccugc

SEQ ID NO: 2444398 - RNA, 19 nt, Human
cuuagagcaguuucugucc

SEQ ID NO: 2444399 - RNA, 11 nt, Human
cuuagagcagu

SEQ ID NO: 2444400 - RNA, 22 nt, Human
cuuagagacaguugggugagaa

SEQ ID NO: 2444401 - RNA, 20 nt, Human
cuuagagaauguucuccuaa

SEQ ID NO: 2444402 - RNA, 17 nt, Human
cuuagacuugaaauacu

SEQ ID NO: 2444403 - RNA, 16 nt, Human
cuuagaccuuccauaa

SEQ ID NO: 2444404 - RNA, 20 nt, Human
cuuagaccucagccugugcu

SEQ ID NO: 2444405 - RNA, 17 nt, Human
cuuagaccucagccugu

SEQ ID NO: 2444406 - RNA, 18 nt, Human
cuuagaccucagccugug

SEQ ID NO: 2444407 - RNA, 18 nt, Human
cuuagaccuuccauaaug

SEQ ID NO: 2444408 - RNA, 19 nt, Human
cuuagacuucgacucagga

SEQ ID NO: 2444409 - RNA, 14 nt, Human
cuuagacuucugcu

SEQ ID NO: 2444410 - RNA, 20 nt, Human
cuuagacuucgacucaggau

SEQ ID NO: 2444411 - RNA, 16 nt, Human
cuuagacuucugcuuu

SEQ ID NO: 2444412 - RNA, 16 nt, Human
cuuagacuugaaauac

SEQ ID NO: 2444413 - RNA, 19 nt, Human
cuuagaauuaguggcacuu

SEQ ID NO: 2444414 - RNA, 20 nt, Human
cuuagaauaaaauuguaaaa

SEQ ID NO: 2444415 - RNA, 12 nt, Human
cuuagaauccaa

SEQ ID NO: 2444416 - RNA, 16 nt, Human
cuuagaauccaaacuu

SEQ ID NO: 2444417 - RNA, 17 nt, Human
cuuagaauccaaacuug

SEQ ID NO: 2444418 - RNA, 17 nt, Human
cuuagaauaaaauugua

SEQ ID NO: 2444419 - RNA, 16 nt, Human
cuuagaauaaaauugu

SEQ ID NO: 2444420 - RNA, 15 nt, Human
cuuagaauaaaauug

SEQ ID NO: 2444421 - RNA, 11 nt, Human
cuuagaauaaa

SEQ ID NO: 2444422 - RNA, 18 nt, Human
cuuagaaguuuguuguga

SEQ ID NO: 2444423 - RNA, 12 nt, Human
cuuagaccucag

SEQ ID NO: 2444424 - RNA, 13 nt, Human
cuuagaccucagc

SEQ ID NO: 2444425 - RNA, 14 nt, Human
cuuagaccucagcc

SEQ ID NO: 2444426 - RNA, 15 nt, Human
cuuagaccucagccu

SEQ ID NO: 2444427 - RNA, 16 nt, Human
cuuagaccucagccug

SEQ ID NO: 2444428 - RNA, 19 nt, Human
cuuacucuucuugaaauuu

SEQ ID NO: 2444429 - RNA, 12 nt, Human
cuuacugauaua

SEQ ID NO: 2444430 - RNA, 15 nt, Human
cuuacugauauauuu

SEQ ID NO: 2444431 - RNA, 19 nt, Human
cuuacugauauauuuuaca

SEQ ID NO: 2444432 - RNA, 21 nt, Human
cuuacugauauauuuuacaau

SEQ ID NO: 2444433 - RNA, 21 nt, Human
cuuacugauuuuuaaguuauu

SEQ ID NO: 2444434 - RNA, 12 nt, Human
cuuacugcaaau

SEQ ID NO: 2444435 - RNA, 13 nt, Human
cuuacugcagaau

SEQ ID NO: 2444436 - RNA, 13 nt, Human
cuuaccuuuuuau

SEQ ID NO: 2444437 - RNA, 22 nt, Human
cuuaccuucaauaaaguaucua

SEQ ID NO: 2444438 - RNA, 15 nt, Human
cuuacucuucuugaa

SEQ ID NO: 2444439 - RNA, 12 nt, Human
cuuacugaaggu

SEQ ID NO: 2444440 - RNA, 20 nt, Human
cuuaccugccaggaagccag

SEQ ID NO: 2444441 - RNA, 19 nt, Human
cuuaauuuugguuguauuc

SEQ ID NO: 2444442 - RNA, 14 nt, Human
cuuaauuuucagua

SEQ ID NO: 2444443 - RNA, 11 nt, Human
cuuaauuuugg

SEQ ID NO: 2444444 - RNA, 18 nt, Human
cuuaauuuucaguauaau

SEQ ID NO: 2444445 - RNA, 16 nt, Human
cuuaauuuugguugua

SEQ ID NO: 2444446 - RNA, 19 nt, Human
cuuaccugggcauucuugu

SEQ ID NO: 2444447 - RNA, 20 nt, Human
cuuaccuguaugucuccagu

SEQ ID NO: 2444448 - RNA, 15 nt, Human
cuuaccuucaauaaa

SEQ ID NO: 2444449 - RNA, 16 nt, Human
cuuaccuucaauaaag

SEQ ID NO: 2444450 - RNA, 17 nt, Human
cuuaccuucaauaaagu

SEQ ID NO: 2444451 - RNA, 18 nt, Human
cuuaccuucaauaaagua

SEQ ID NO: 2444452 - RNA, 21 nt, Human
cuuaccuucaauaaaguaucu

SEQ ID NO: 2444453 - RNA, 17 nt, Human
cuuagaaagcaggggcu

SEQ ID NO: 2444454 - RNA, 18 nt, Human
cuuagaaagcaggggcua

SEQ ID NO: 2444455 - RNA, 16 nt, Human
cuuagaaagcaggggc

SEQ ID NO: 2444456 - RNA, 14 nt, Human
cuuagaaagcaggg

SEQ ID NO: 2444457 - RNA, 19 nt, Human
cuuagaaaauucacuauug

SEQ ID NO: 2444458 - RNA, 20 nt, Human
cuuagaaaaaccaccaccau

SEQ ID NO: 2444459 - RNA, 20 nt, Human
cuuagaagucacacaguauu

SEQ ID NO: 2444460 - RNA, 17 nt, Human
cuuagaagucacacagu

SEQ ID NO: 2444461 - RNA, 17 nt, Human
cuuagaaguggaccagg

SEQ ID NO: 2444462 - RNA, 18 nt, Human
cuuagaaguggaccagga

SEQ ID NO: 2444463 - RNA, 20 nt, Human
cuuagaaguggaccaggaca

SEQ ID NO: 2444464 - RNA, 21 nt, Human
cuuagaaguggaccaggacag

SEQ ID NO: 2444465 - RNA, 22 nt, Human
cuuagaaguggaccaggacagg

SEQ ID NO: 2444466 - RNA, 23 nt, Human
cuuagaaguggaccaggacagga

SEQ ID NO: 2444467 - RNA, 16 nt, Human
cuuagaaauugcauuu

SEQ ID NO: 2444468 - RNA, 16 nt, Human
cuguugcccaggcugg

SEQ ID NO: 2444469 - RNA, 15 nt, Human
cuguugcccaggcug

SEQ ID NO: 2444470 - RNA, 14 nt, Human
cuguugcccaggcu

SEQ ID NO: 2444471 - RNA, 13 nt, Human
cuguugcccaggc

SEQ ID NO: 2444472 - RNA, 19 nt, Human
cuguugcacccagcccugg

SEQ ID NO: 2444473 - RNA, 18 nt, Human
cuguugcacccagcccug

SEQ ID NO: 2444474 - RNA, 17 nt, Human
cuguugcacccagcccu

SEQ ID NO: 2444475 - RNA, 14 nt, Human
cuguugcacccagc

SEQ ID NO: 2444476 - RNA, 21 nt, Human
cuguugcacccagcccugguc

SEQ ID NO: 2444477 - RNA, 20 nt, Human
cuguugcacccagcccuggu

SEQ ID NO: 2444478 - RNA, 23 nt, Human
cuguugcacccagcccuggucuc

SEQ ID NO: 2444479 - RNA, 20 nt, Human
cuguugauuucuuuccagag

SEQ ID NO: 2444480 - RNA, 17 nt, Human
cuguugauuucuuucca

SEQ ID NO: 2444481 - RNA, 23 nt, Human
cuguugauugcuaaauguaacag

SEQ ID NO: 2444482 - RNA, 22 nt, Human
cuguugauugcuaaauguaaca

SEQ ID NO: 2444483 - RNA, 13 nt, Human
cuguugcacccag

SEQ ID NO: 2444484 - RNA, 19 nt, Human
cuguugcaaacucagccuc

SEQ ID NO: 2444485 - RNA, 12 nt, Human
cuguugcccagg

SEQ ID NO: 2444486 - RNA, 12 nt, Human
cuguugcaguga

SEQ ID NO: 2444487 - RNA, 12 nt, Human
cuguugcauggg

SEQ ID NO: 2444488 - RNA, 13 nt, Human
cuguugccacaac

SEQ ID NO: 2444489 - RNA, 21 nt, Human
cuguugaugaggccucuugga

SEQ ID NO: 2444490 - RNA, 20 nt, Human
cuguugaugaggccucuugg

SEQ ID NO: 2444491 - RNA, 17 nt, Human
cuguugaugaggccucu

SEQ ID NO: 2444492 - RNA, 20 nt, Human
cuguugauugcuaaauguaa

SEQ ID NO: 2444493 - RNA, 19 nt, Human
cuguugauugcuaaaugua

SEQ ID NO: 2444494 - RNA, 18 nt, Human
cuguugauugcuaaaugu

SEQ ID NO: 2444495 - RNA, 17 nt, Human
cuguugauugcuaaaug

SEQ ID NO: 2444496 - RNA, 15 nt, Human
cuguugauugcuaaa

SEQ ID NO: 2444497 - RNA, 14 nt, Human
cuguugauugcuaa

SEQ ID NO: 2444498 - RNA, 15 nt, Human
cuguugauugcagga

SEQ ID NO: 2444499 - RNA, 15 nt, Human
cuguugagcuguuuu

SEQ ID NO: 2444500 - RNA, 20 nt, Human
cuguugagcuguuuucccug

SEQ ID NO: 2444501 - RNA, 17 nt, Human
cuguugacgaagucucu

SEQ ID NO: 2444502 - RNA, 21 nt, Human
cuguugacacaggucuuuccu

SEQ ID NO: 2444503 - RNA, 23 nt, Human
cuguugacauccaagcuuccuuu

SEQ ID NO: 2444504 - RNA, 23 nt, Human
cuguucuuucuggcuaugcauuu

SEQ ID NO: 2444505 - RNA, 15 nt, Human
cuguucuuggggccc

SEQ ID NO: 2444506 - RNA, 13 nt, Human
cuguucuuggggc

SEQ ID NO: 2444507 - RNA, 16 nt, Human
cuguucuuuaauuuau

SEQ ID NO: 2444508 - RNA, 13 nt, Human
cuguucuuuaauu

SEQ ID NO: 2444509 - RNA, 12 nt, Human
cuguugaaaauu

SEQ ID NO: 2444510 - RNA, 22 nt, Human
cuguugaaaauuauuuuaaaca

SEQ ID NO: 2444511 - RNA, 21 nt, Human
cuguugaaaauuauuuuaaac

SEQ ID NO: 2444512 - RNA, 14 nt, Human
cuguugaaaauuau

SEQ ID NO: 2444513 - RNA, 22 nt, Human
cuguugacacaggucuuuccua

SEQ ID NO: 2444514 - RNA, 17 nt, Human
cuguugacacaggucuu

SEQ ID NO: 2444515 - RNA, 20 nt, Human
cuguugacauccaagcuucc

SEQ ID NO: 2444516 - RNA, 12 nt, Human
cuguucuugaag

SEQ ID NO: 2444517 - RNA, 15 nt, Human
cuguucuuuccaaag

SEQ ID NO: 2444518 - RNA, 16 nt, Human
cuguucuuuccaaagu

SEQ ID NO: 2444519 - RNA, 19 nt, Human
cuguucuuuccaaaguaca

SEQ ID NO: 2444520 - RNA, 21 nt, Human
cuguucuuuccaaaguacacu

SEQ ID NO: 2444521 - RNA, 13 nt, Human
cuguucuuucugg

SEQ ID NO: 2444522 - RNA, 14 nt, Human
cuguucuuucuggc

SEQ ID NO: 2444523 - RNA, 21 nt, Human
cuguucuuucuggcuaugcau

SEQ ID NO: 2444524 - RNA, 16 nt, Human
cuguuaauaguucagg

SEQ ID NO: 2444525 - RNA, 14 nt, Human
cuguucuguggaaa

SEQ ID NO: 2444526 - RNA, 22 nt, Human
cuguuaaauugcuguguaucug

SEQ ID NO: 2444527 - RNA, 20 nt, Human
cuguuaaauugcuguguauc

SEQ ID NO: 2444528 - RNA, 19 nt, Human
cuguuaaauugcuguguau

SEQ ID NO: 2444529 - RNA, 18 nt, Human
cuguuaaauugcugugua

SEQ ID NO: 2444530 - RNA, 16 nt, Human
cuguuaaauugcugug

SEQ ID NO: 2444531 - RNA, 22 nt, Human
cuguucuguggaaaguguaaag

SEQ ID NO: 2444532 - RNA, 21 nt, Human
cuguucuguggaaaguguaaa

SEQ ID NO: 2444533 - RNA, 20 nt, Human
cuguucuguggaaaguguaa

SEQ ID NO: 2444534 - RNA, 15 nt, Human
cuguucuguggaaag

SEQ ID NO: 2444535 - RNA, 23 nt, Human
cuguucuguggaaaguguaaagc

SEQ ID NO: 2444536 - RNA, 11 nt, Human
cuguucugugu

SEQ ID NO: 2444537 - RNA, 14 nt, Human
cuguucugugucuu

SEQ ID NO: 2444538 - RNA, 13 nt, Human
cuguucugugucu

SEQ ID NO: 2444539 - RNA, 17 nt, Human
cuguucuguuuugccug

SEQ ID NO: 2444540 - RNA, 18 nt, Human
cuguucuuaagacgugau

SEQ ID NO: 2444541 - RNA, 19 nt, Human
cuguuugcuaagugaggau

SEQ ID NO: 2444542 - RNA, 17 nt, Human
cuguuugcuaagugagg

SEQ ID NO: 2444543 - RNA, 23 nt, Human
cuguuuggaggagcaaaggcuga

SEQ ID NO: 2444544 - RNA, 23 nt, Human
cuguuugaggauauauuuucacu

SEQ ID NO: 2444545 - RNA, 15 nt, Human
cuguuugacaaaccu

SEQ ID NO: 2444546 - RNA, 22 nt, Human
cuguuugaggauauauuuucac

SEQ ID NO: 2444547 - RNA, 16 nt, Human
cuguuucugucaggag

SEQ ID NO: 2444548 - RNA, 12 nt, Human
cuguuugacaaa

SEQ ID NO: 2444549 - RNA, 16 nt, Human
cuguuuauuuuauauu

SEQ ID NO: 2444550 - RNA, 17 nt, Human
cuguuucaacacagacc

SEQ ID NO: 2444551 - RNA, 15 nt, Human
cuguuucaaacuuua

SEQ ID NO: 2444552 - RNA, 17 nt, Human
cuguuucaaacuuuacu

SEQ ID NO: 2444553 - RNA, 17 nt, Human
cuguuuagcagcagccu

SEQ ID NO: 2444554 - RNA, 20 nt, Human
cuguuuagcagcagccuuua

SEQ ID NO: 2444555 - RNA, 15 nt, Human
cuguugcccacguuu

SEQ ID NO: 2444556 - RNA, 18 nt, Human
cuguuuagauaauacacc

SEQ ID NO: 2444557 - RNA, 14 nt, Human
cuguuuagauaaua

SEQ ID NO: 2444558 - RNA, 17 nt, Human
cuguuuagauaauacac

SEQ ID NO: 2444559 - RNA, 17 nt, Human
cuguugcccaggcuggc

SEQ ID NO: 2444560 - RNA, 13 nt, Human
cuguugccagaga

SEQ ID NO: 2444561 - RNA, 17 nt, Human
cuguugccagagaugga

SEQ ID NO: 2444562 - RNA, 20 nt, Human
cuguuuuuacccauaucccc

SEQ ID NO: 2444563 - RNA, 15 nt, Human
cuguuuuuacccaua

SEQ ID NO: 2444564 - RNA, 12 nt, Human
cuguuuuucaca

SEQ ID NO: 2444565 - RNA, 13 nt, Human
cuguuuuucacau

SEQ ID NO: 2444566 - RNA, 15 nt, Human
cuguuuuucacauuu

SEQ ID NO: 2444567 - RNA, 17 nt, Human
cuguuuuucagggaggu

SEQ ID NO: 2444568 - RNA, 14 nt, Human
cuuaaaaaaugucc

SEQ ID NO: 2444569 - RNA, 16 nt, Human
cuuaaaaaguggaaaa

SEQ ID NO: 2444570 - RNA, 17 nt, Human
cuuaaaaaguggaaaaa

SEQ ID NO: 2444571 - RNA, 21 nt, Human
cuguuuucucucggcucccca

SEQ ID NO: 2444572 - RNA, 23 nt, Human
cuguuuuccuuucucaccgcagu

SEQ ID NO: 2444573 - RNA, 17 nt, Human
cuguuuuuaaaaaucau

SEQ ID NO: 2444574 - RNA, 15 nt, Human
cuguuuuuaagcugu

SEQ ID NO: 2444575 - RNA, 22 nt, Human
cuguuuuuacccauauccccuc

SEQ ID NO: 2444576 - RNA, 13 nt, Human
cuguuuuuaccca

SEQ ID NO: 2444577 - RNA, 23 nt, Human
cuguuuuuaagcuguuuccauag

SEQ ID NO: 2444578 - RNA, 19 nt, Human
cuguuuuuaagcuguuucc

SEQ ID NO: 2444579 - RNA, 18 nt, Human
cuguuuuuaagcuguuuc

SEQ ID NO: 2444580 - RNA, 17 nt, Human
cuguuuuuaagcuguuu

SEQ ID NO: 2444581 - RNA, 16 nt, Human
cuguuuuuaagcuguu

SEQ ID NO: 2444582 - RNA, 17 nt, Human
cuguuuuccucccuucu

SEQ ID NO: 2444583 - RNA, 19 nt, Human
cuguuuuccucccuucugc

SEQ ID NO: 2444584 - RNA, 20 nt, Human
cuguuuuccucccuucugcu

SEQ ID NO: 2444585 - RNA, 21 nt, Human
cuguuuuccucccuucugcua

SEQ ID NO: 2444586 - RNA, 18 nt, Human
cuguuuuccuuucucacc

SEQ ID NO: 2444587 - RNA, 16 nt, Human
cuguuuuccuuucuca

SEQ ID NO: 2444588 - RNA, 14 nt, Human
cuguuuuccuuucu

SEQ ID NO: 2444589 - RNA, 23 nt, Human
cuguuuuccucccuucugcuacu

SEQ ID NO: 2444590 - RNA, 12 nt, Human
cuguuuuccucc

SEQ ID NO: 2444591 - RNA, 14 nt, Human
cuguuuuccucccu

SEQ ID NO: 2444592 - RNA, 15 nt, Human
cuguuuuccucccuu

SEQ ID NO: 2444593 - RNA, 16 nt, Human
cuguuuuccucccuuc

SEQ ID NO: 2444594 - RNA, 13 nt, Human
cuguuuucccuga

SEQ ID NO: 2444595 - RNA, 15 nt, Human
cuguuuuauaauuuu

SEQ ID NO: 2444596 - RNA, 18 nt, Human
cuguuuuagguuaaaaaa

SEQ ID NO: 2444597 - RNA, 16 nt, Human
cuguuugggccccucu

SEQ ID NO: 2444598 - RNA, 20 nt, Human
cuguuugggccccucuccca

SEQ ID NO: 2444599 - RNA, 11 nt, Human
cuguuugucau

SEQ ID NO: 2444600 - RNA, 17 nt, Human
cuguuugucuucucccc

SEQ ID NO: 2444601 - RNA, 16 nt, Human
cuguuugucuucuccc

SEQ ID NO: 2444602 - RNA, 12 nt, Human
cuguuuguuaug

SEQ ID NO: 2444603 - RNA, 14 nt, Human
cuguuuuauaauuu

SEQ ID NO: 2444604 - RNA, 22 nt, Human
cuguuuuacaaaaaagaaaaga

SEQ ID NO: 2444605 - RNA, 18 nt, Human
cuguuugucuucucccca

SEQ ID NO: 2444606 - RNA, 13 nt, Human
cuucccugacuca

SEQ ID NO: 2444607 - RNA, 20 nt, Human
cuucccugacucauucugaa

SEQ ID NO: 2444608 - RNA, 22 nt, Human
cuucccuaucuuugccacccuc

SEQ ID NO: 2444609 - RNA, 23 nt, Human
cuucccuagcuuuagacccuggg

SEQ ID NO: 2444610 - RNA, 14 nt, Human
cuucccugacucau

SEQ ID NO: 2444611 - RNA, 10 nt, Human
cuucccuggc

SEQ ID NO: 2444612 - RNA, 11 nt, Human
cuucccuggcu

SEQ ID NO: 2444613 - RNA, 17 nt, Human
cuucccugggcugugcu

SEQ ID NO: 2444614 - RNA, 13 nt, Human
cuucccugggcug

SEQ ID NO: 2444615 - RNA, 12 nt, Human
cuucccugggcu

SEQ ID NO: 2444616 - RNA, 12 nt, Human
cuucccuggcuu

SEQ ID NO: 2444617 - RNA, 15 nt, Human
cuuccuaguuuucuc

SEQ ID NO: 2444618 - RNA, 17 nt, Human
cuuccuaguuuucuccu

SEQ ID NO: 2444619 - RNA, 23 nt, Human
cuuccuaguuuucuccucccagg

SEQ ID NO: 2444620 - RNA, 18 nt, Human
cuucccugggcugugcua

SEQ ID NO: 2444621 - RNA, 13 nt, Human
cuuccucacugcc

SEQ ID NO: 2444622 - RNA, 22 nt, Human
cuuccuaguuuucuccucccag

SEQ ID NO: 2444623 - RNA, 18 nt, Human
cuuccuauaugcacuuau

SEQ ID NO: 2444624 - RNA, 20 nt, Human
cuuccugcguccuccucacc

SEQ ID NO: 2444625 - RNA, 18 nt, Human
cuuccugcguccuccuca

SEQ ID NO: 2444626 - RNA, 21 nt, Human
cuuccugcguccuccucaccu

SEQ ID NO: 2444627 - RNA, 13 nt, Human
cuuccucacuucc

SEQ ID NO: 2444628 - RNA, 16 nt, Human
cuuccucacugcccaa

SEQ ID NO: 2444629 - RNA, 14 nt, Human
cuuccucacuucca

SEQ ID NO: 2444630 - RNA, 17 nt, Human
cuuccugcccuacagag

SEQ ID NO: 2444631 - RNA, 16 nt, Human
cuuccugcguccuccu

SEQ ID NO: 2444632 - RNA, 19 nt, Human
cuuccugcccuacagaggu

SEQ ID NO: 2444633 - RNA, 15 nt, Human
cuuccugcguccucc

SEQ ID NO: 2444634 - RNA, 14 nt, Human
cuuccuggagacug

SEQ ID NO: 2444635 - RNA, 22 nt, Human
cuuccuggagacugcccagcua

SEQ ID NO: 2444636 - RNA, 22 nt, Human
cuuccugucccaccucuucucu

SEQ ID NO: 2444637 - RNA, 17 nt, Human
cuuccugucccaccucu

SEQ ID NO: 2444638 - RNA, 18 nt, Human
cuuccuguccagcuccaa

SEQ ID NO: 2444639 - RNA, 13 nt, Human
cuuccugugacuu

SEQ ID NO: 2444640 - RNA, 21 nt, Human
cuuccugucccaccucuucuc

SEQ ID NO: 2444641 - RNA, 20 nt, Human
cuuccugucuuccugcauuc

SEQ ID NO: 2444642 - RNA, 16 nt, Human
cuuccugugacuucag

SEQ ID NO: 2444643 - RNA, 12 nt, Human
cuucccccucca

SEQ ID NO: 2444644 - RNA, 18 nt, Human
cuucccccauagccaccc

SEQ ID NO: 2444645 - RNA, 14 nt, Human
cuucccccauagcc

SEQ ID NO: 2444646 - RNA, 15 nt, Human
cuucccccauagcca

SEQ ID NO: 2444647 - RNA, 16 nt, Human
cuucccccauagccac

SEQ ID NO: 2444648 - RNA, 18 nt, Human
cuuccccaucuucuaaac

SEQ ID NO: 2444649 - RNA, 14 nt, Human
cuuccccagcgucc

SEQ ID NO: 2444650 - RNA, 13 nt, Human
cuuccccagccuc

SEQ ID NO: 2444651 - RNA, 14 nt, Human
cuuccccagccucu

SEQ ID NO: 2444652 - RNA, 14 nt, Human
cuuccccaugggaa

SEQ ID NO: 2444653 - RNA, 13 nt, Human
cuuccccauggga

SEQ ID NO: 2444654 - RNA, 12 nt, Human
cuuccccauggg

SEQ ID NO: 2444655 - RNA, 17 nt, Human
cuucccuaucuuugcca

SEQ ID NO: 2444656 - RNA, 18 nt, Human
cuucccuaucuuugccac

SEQ ID NO: 2444657 - RNA, 16 nt, Human
cuucccuaucuuugcc

SEQ ID NO: 2444658 - RNA, 17 nt, Human
cuucccuaccucaggca

SEQ ID NO: 2444659 - RNA, 20 nt, Human
cuucccuaccucaggcagga

SEQ ID NO: 2444660 - RNA, 22 nt, Human
cuucccuagcuuuagacccugg

SEQ ID NO: 2444661 - RNA, 21 nt, Human
cuucccuagcuuuagacccug

SEQ ID NO: 2444662 - RNA, 20 nt, Human
cuucccuagaggguuccugu

SEQ ID NO: 2444663 - RNA, 23 nt, Human
cuucccuagaggguuccuguaga

SEQ ID NO: 2444664 - RNA, 15 nt, Human
cuucccccuccaauc

SEQ ID NO: 2444665 - RNA, 16 nt, Human
cuucccccucccaggg

SEQ ID NO: 2444666 - RNA, 15 nt, Human
cuucccuaccucagg

SEQ ID NO: 2444667 - RNA, 16 nt, Human
cuucccuaccucaggc

SEQ ID NO: 2444668 - RNA, 13 nt, Human
cuucccuaccuca

SEQ ID NO: 2444669 - RNA, 20 nt, Human
cuucccccgcaaugugcccc

SEQ ID NO: 2444670 - RNA, 15 nt, Human
cuuccacugagggca

SEQ ID NO: 2444671 - RNA, 18 nt, Human
cuuccacugagggcaguc

SEQ ID NO: 2444672 - RNA, 20 nt, Human
cuuccacuuuuuuuuguaug

SEQ ID NO: 2444673 - RNA, 20 nt, Human
cuuccagagaguccucugga

SEQ ID NO: 2444674 - RNA, 21 nt, Human
cuuccagagaguccucuggau

SEQ ID NO: 2444675 - RNA, 18 nt, Human
cuuccagagaguccucug

SEQ ID NO: 2444676 - RNA, 17 nt, Human
cuuccagaaucccaaga

SEQ ID NO: 2444677 - RNA, 16 nt, Human
cuuccagaaucccaag

SEQ ID NO: 2444678 - RNA, 17 nt, Human
cuuccagaagugugauu

SEQ ID NO: 2444679 - RNA, 16 nt, Human
cuuccagaagugugau

SEQ ID NO: 2444680 - RNA, 15 nt, Human
cuuccagaaguguga

SEQ ID NO: 2444681 - RNA, 21 nt, Human
cuuccacuuuuuuuuguaugu

SEQ ID NO: 2444682 - RNA, 23 nt, Human
cuuccccacugcacacaccucag

SEQ ID NO: 2444683 - RNA, 14 nt, Human
cuuccccacugccu

SEQ ID NO: 2444684 - RNA, 16 nt, Human
cuuccccacugccugc

SEQ ID NO: 2444685 - RNA, 19 nt, Human
cuuccccacugccugccca

SEQ ID NO: 2444686 - RNA, 20 nt, Human
cuuccccacugccugcccac

SEQ ID NO: 2444687 - RNA, 22 nt, Human
cuuccccacugccugcccaccc

SEQ ID NO: 2444688 - RNA, 19 nt, Human
cuuccccagaaaggagacu

SEQ ID NO: 2444689 - RNA, 18 nt, Human
cuuccccacugcacacac

SEQ ID NO: 2444690 - RNA, 11 nt, Human
cuuccccacug

SEQ ID NO: 2444691 - RNA, 15 nt, Human
cuuccccacccucag

SEQ ID NO: 2444692 - RNA, 16 nt, Human
cuuccccaaauaauau

SEQ ID NO: 2444693 - RNA, 23 nt, Human
cuucccaugacccaggcugggca

SEQ ID NO: 2444694 - RNA, 18 nt, Human
cuucccauuguggcuccu

SEQ ID NO: 2444695 - RNA, 15 nt, Human
cuucccauuguggcu

SEQ ID NO: 2444696 - RNA, 15 nt, Human
cuucgccaccugggu

SEQ ID NO: 2444697 - RNA, 19 nt, Human
cuucgcgugcccucgcugc

SEQ ID NO: 2444698 - RNA, 17 nt, Human
cuucgcuccugugucuu

SEQ ID NO: 2444699 - RNA, 21 nt, Human
cuucgcuucuugccucugugc

SEQ ID NO: 2444700 - RNA, 20 nt, Human
cuucgcuucuugccucugug

SEQ ID NO: 2444701 - RNA, 18 nt, Human
cuucgcuucuugccucug

SEQ ID NO: 2444702 - RNA, 17 nt, Human
cuucgcuucuugccucu

SEQ ID NO: 2444703 - RNA, 16 nt, Human
cuucgcuucuugccuc

SEQ ID NO: 2444704 - RNA, 15 nt, Human
cuucgcuucuugccu

SEQ ID NO: 2444705 - RNA, 16 nt, Human
cuucgcuccugugucu

SEQ ID NO: 2444706 - RNA, 19 nt, Human
cuucgcaucaaaagacaau

SEQ ID NO: 2444707 - RNA, 17 nt, Human
cuucgcaucaaaagaca

SEQ ID NO: 2444708 - RNA, 16 nt, Human
cuucgcaucaaaagac

SEQ ID NO: 2444709 - RNA, 15 nt, Human
cuucgcaucaaaaga

SEQ ID NO: 2444710 - RNA, 16 nt, Human
cuucgcaggcaugucc

SEQ ID NO: 2444711 - RNA, 14 nt, Human
cuuccuuuucccug

SEQ ID NO: 2444712 - RNA, 23 nt, Human
cuucgcaucaaaagacaauucuu

SEQ ID NO: 2444713 - RNA, 22 nt, Human
cuucgcaucaaaagacaauucu

SEQ ID NO: 2444714 - RNA, 21 nt, Human
cuucgcaucaaaagacaauuc

SEQ ID NO: 2444715 - RNA, 20 nt, Human
cuucgcaucaaaagacaauu

SEQ ID NO: 2444716 - RNA, 14 nt, Human
cuucgccaccuggg

SEQ ID NO: 2444717 - RNA, 16 nt, Human
cuucgauacaccgggc

SEQ ID NO: 2444718 - RNA, 21 nt, Human
cuucgauacaccgggccugga

SEQ ID NO: 2444719 - RNA, 17 nt, Human
cuuccuuuuaucaguag

SEQ ID NO: 2444720 - RNA, 21 nt, Human
cuuccuuuuagccuaguucau

SEQ ID NO: 2444721 - RNA, 18 nt, Human
cuuccuuucuuucucucu

SEQ ID NO: 2444722 - RNA, 22 nt, Human
cuuccuuuguuuuuuuuuccug

SEQ ID NO: 2444723 - RNA, 13 nt, Human
cuuccuucauuuc

SEQ ID NO: 2444724 - RNA, 15 nt, Human
cuuccuucauuuccu

SEQ ID NO: 2444725 - RNA, 16 nt, Human
cuuccuucauuuccuc

SEQ ID NO: 2444726 - RNA, 13 nt, Human
cuuccuucccacc

SEQ ID NO: 2444727 - RNA, 12 nt, Human
cuuccuucccac

SEQ ID NO: 2444728 - RNA, 19 nt, Human
cuuccuuggcaucacaggg

SEQ ID NO: 2444729 - RNA, 13 nt, Human
cuuccuuggcuuu

SEQ ID NO: 2444730 - RNA, 16 nt, Human
cuuccuguuugggccc

SEQ ID NO: 2444731 - RNA, 16 nt, Human
cuuccuguuuuucaca

SEQ ID NO: 2444732 - RNA, 17 nt, Human
cuuccuguuuuucacau

SEQ ID NO: 2444733 - RNA, 18 nt, Human
cuuccuguuuuucacauu

SEQ ID NO: 2444734 - RNA, 15 nt, Human
cuuccugugugucca

SEQ ID NO: 2444735 - RNA, 23 nt, Human
cuuccuguguguccaaaacugcc

SEQ ID NO: 2444736 - RNA, 23 nt, Human
cuuccuguuuuucacauuuuccu

SEQ ID NO: 2444737 - RNA, 19 nt, Human
cuuccuuaauucacuccca

SEQ ID NO: 2444738 - RNA, 14 nt, Human
cuuccuguucugaa

SEQ ID NO: 2444739 - RNA, 21 nt, Human
cuuccuuaauucacucccaca

SEQ ID NO: 2444740 - RNA, 15 nt, Human
cuuccuucaccucug

SEQ ID NO: 2444741 - RNA, 23 nt, Human
cuucgggaagagaggaguucaau

SEQ ID NO: 2444742 - RNA, 22 nt, Human
cuucgggaagagaggaguucaa

SEQ ID NO: 2444743 - RNA, 21 nt, Human
cuucgggaagagaggaguuca

SEQ ID NO: 2444744 - RNA, 18 nt, Human
cuucgggaagagaggagu

SEQ ID NO: 2444745 - RNA, 17 nt, Human
cuucgggaagagaggag

SEQ ID NO: 2444746 - RNA, 15 nt, Human
cuucgggaagagagg

SEQ ID NO: 2444747 - RNA, 19 nt, Human
cuucgggaggucgaggcag

SEQ ID NO: 2444748 - RNA, 20 nt, Human
cuucggccuccauccugagg

SEQ ID NO: 2444749 - RNA, 22 nt, Human
cuucgcgguggaaggcccgagg

SEQ ID NO: 2444750 - RNA, 19 nt, Human
cuucggaaaccuuggugua

SEQ ID NO: 2444751 - RNA, 23 nt, Human
cuucguacaguucuucgggaaga

SEQ ID NO: 2444752 - RNA, 16 nt, Human
cuucguacaguucuuc

SEQ ID NO: 2444753 - RNA, 14 nt, Human
cuucguacaguucu

SEQ ID NO: 2444754 - RNA, 21 nt, Human
cuucgucuuucccauggggag

SEQ ID NO: 2444755 - RNA, 14 nt, Human
cuucgucuuuccca

SEQ ID NO: 2444756 - RNA, 22 nt, Human
cuucgugggaucugccccuccc

SEQ ID NO: 2444757 - RNA, 21 nt, Human
cuucgugggaucugccccucc

SEQ ID NO: 2444758 - RNA, 21 nt, Human
cuucgugcggaaucagcuucu

SEQ ID NO: 2444759 - RNA, 22 nt, Human
cuucgucuuucccauggggagg

SEQ ID NO: 2444760 - RNA, 13 nt, Human
cuucguacaguuc

SEQ ID NO: 2444761 - RNA, 12 nt, Human
cuucguacaguu

SEQ ID NO: 2444762 - RNA, 19 nt, Human
cuucggggaacuccuggaa

SEQ ID NO: 2444763 - RNA, 16 nt, Human
cuucgggcugugcccg

SEQ ID NO: 2444764 - RNA, 18 nt, Human
cuucggggaacuccugga

SEQ ID NO: 2444765 - RNA, 16 nt, Human
cuucucacugccaugc

SEQ ID NO: 2444766 - RNA, 23 nt, Human
cuucgugggaucugccccucccu

SEQ ID NO: 2444767 - RNA, 16 nt, Human
cuucucagaaggcaaa

SEQ ID NO: 2444768 - RNA, 13 nt, Human
cuucucagaaucu

SEQ ID NO: 2444769 - RNA, 22 nt, Human
cuucucagaaggcaaaugacuu

SEQ ID NO: 2444770 - RNA, 21 nt, Human
cuucucacugccaugccagcu

SEQ ID NO: 2444771 - RNA, 17 nt, Human
cuucucauuucaccccu

SEQ ID NO: 2444772 - RNA, 15 nt, Human
cuucucauuucaccc

SEQ ID NO: 2444773 - RNA, 21 nt, Human
cuucucauuccaacagugagu

SEQ ID NO: 2444774 - RNA, 20 nt, Human
cuucucauuccaacagugag

SEQ ID NO: 2444775 - RNA, 14 nt, Human
cuucucauuucacc

SEQ ID NO: 2444776 - RNA, 14 nt, Human
cuucucaugaucca

SEQ ID NO: 2444777 - RNA, 18 nt, Human
cuucucaucacuccccuc

SEQ ID NO: 2444778 - RNA, 13 nt, Human
cuucucaucacuc

SEQ ID NO: 2444779 - RNA, 12 nt, Human
cuucucaucugu

SEQ ID NO: 2444780 - RNA, 17 nt, Human
cuucucauccugcaggc

SEQ ID NO: 2444781 - RNA, 16 nt, Human
cuucucauccugcagg

SEQ ID NO: 2444782 - RNA, 15 nt, Human
cuucucauccugcag

SEQ ID NO: 2444783 - RNA, 15 nt, Human
cuuccacaagagccc

SEQ ID NO: 2444784 - RNA, 14 nt, Human
cuuccacaagagcc

SEQ ID NO: 2444785 - RNA, 13 nt, Human
cuuccacaagagc

SEQ ID NO: 2444786 - RNA, 13 nt, Human
cuuccaaagcaca

SEQ ID NO: 2444787 - RNA, 18 nt, Human
cuucauuugugucaaugg

SEQ ID NO: 2444788 - RNA, 14 nt, Human
cuucauuuguguca

SEQ ID NO: 2444789 - RNA, 13 nt, Human
cuucauuuguguc

SEQ ID NO: 2444790 - RNA, 11 nt, Human
cuucauuugug

SEQ ID NO: 2444791 - RNA, 16 nt, Human
cuucauuagagcaggc

SEQ ID NO: 2444792 - RNA, 24 nt, Human
cuucauuugggaugcuacucuagu

SEQ ID NO: 2444793 - RNA, 15 nt, Human
cuucauuagagcagg

SEQ ID NO: 2444794 - RNA, 20 nt, Human
cuucauuaccuuuuuugaua

SEQ ID NO: 2444795 - RNA, 17 nt, Human
cuucauuaauaauaaau

SEQ ID NO: 2444796 - RNA, 18 nt, Human
cuucauuugggaugcuac

SEQ ID NO: 2444797 - RNA, 17 nt, Human
cuucauuuuuccuaaca

SEQ ID NO: 2444798 - RNA, 16 nt, Human
cuucauuuuuccuaac

SEQ ID NO: 2444799 - RNA, 14 nt, Human
cuucauuuuuccua

SEQ ID NO: 2444800 - RNA, 13 nt, Human
cuucauuuuuccu

SEQ ID NO: 2444801 - RNA, 23 nt, Human
cuucaugucaacuucuggcuccu

SEQ ID NO: 2444802 - RNA, 20 nt, Human
cuucaugucaacuucuggcu

SEQ ID NO: 2444803 - RNA, 16 nt, Human
cuucauuaauaauaaa

SEQ ID NO: 2444804 - RNA, 20 nt, Human
cuucauuaagcccucuucca

SEQ ID NO: 2444805 - RNA, 15 nt, Human
cuucauggcagaagg

SEQ ID NO: 2444806 - RNA, 21 nt, Human
cuucauggcagaaggcaaacc

SEQ ID NO: 2444807 - RNA, 23 nt, Human
cuucauggaugggggaacucaga

SEQ ID NO: 2444808 - RNA, 15 nt, Human
cuucagugcccacca

SEQ ID NO: 2444809 - RNA, 13 nt, Human
cuucauggauggg

SEQ ID NO: 2444810 - RNA, 11 nt, Human
cuucagugccc

SEQ ID NO: 2444811 - RNA, 13 nt, Human
cuucagugcccac

SEQ ID NO: 2444812 - RNA, 19 nt, Human
cuucagugcaucugggaag

SEQ ID NO: 2444813 - RNA, 23 nt, Human
cuucaguauguugucaaagagag

SEQ ID NO: 2444814 - RNA, 14 nt, Human
cuucagugccaaaa

SEQ ID NO: 2444815 - RNA, 15 nt, Human
cuucaguaagccgug

SEQ ID NO: 2444816 - RNA, 19 nt, Human
cuucaguauguugucaaag

SEQ ID NO: 2444817 - RNA, 15 nt, Human
cuucagguucuuagu

SEQ ID NO: 2444818 - RNA, 19 nt, Human
cuucagguucuuaguguca

SEQ ID NO: 2444819 - RNA, 22 nt, Human
cuucaguauguugucaaagaga

SEQ ID NO: 2444820 - RNA, 21 nt, Human
cuucagcaguaccuauaaagu

SEQ ID NO: 2444821 - RNA, 18 nt, Human
cuucagcauauuuauagc

SEQ ID NO: 2444822 - RNA, 14 nt, Human
cuucagccucccga

SEQ ID NO: 2444823 - RNA, 15 nt, Human
cuucagccugaaaga

SEQ ID NO: 2444824 - RNA, 20 nt, Human
cuucagccuccccaccuucu

SEQ ID NO: 2444825 - RNA, 20 nt, Human
cuucagccucuuucuguccc

SEQ ID NO: 2444826 - RNA, 14 nt, Human
cuucagccugaggc

SEQ ID NO: 2444827 - RNA, 20 nt, Human
cuucagccucccgaguagcu

SEQ ID NO: 2444828 - RNA, 16 nt, Human
cuucagccucccgagu

SEQ ID NO: 2444829 - RNA, 15 nt, Human
cuucagcugacuuuu

SEQ ID NO: 2444830 - RNA, 19 nt, Human
cuucagcugacuuuucugu

SEQ ID NO: 2444831 - RNA, 16 nt, Human
cuucagcgguuuauau

SEQ ID NO: 2444832 - RNA, 15 nt, Human
cuucagccugaggcu

SEQ ID NO: 2444833 - RNA, 16 nt, Human
cuucagccugaggcug

SEQ ID NO: 2444834 - RNA, 20 nt, Human
cuucagccugaggcugagac

SEQ ID NO: 2444835 - RNA, 22 nt, Human
cuucagccugaggcugagacug

SEQ ID NO: 2444836 - RNA, 14 nt, Human
cuucaguaagccgu

SEQ ID NO: 2444837 - RNA, 22 nt, Human
cuucagguuaucgaaauaacaa

SEQ ID NO: 2444838 - RNA, 21 nt, Human
cuucagguuaucgaaauaaca

SEQ ID NO: 2444839 - RNA, 20 nt, Human
cuucagguuaucgaaauaac

SEQ ID NO: 2444840 - RNA, 16 nt, Human
cuucagguggaaaaac

SEQ ID NO: 2444841 - RNA, 18 nt, Human
cuucagcuucuucaucuu

SEQ ID NO: 2444842 - RNA, 19 nt, Human
cuucagcuguacuucgucu

SEQ ID NO: 2444843 - RNA, 13 nt, Human
cuucagcuucuuc

SEQ ID NO: 2444844 - RNA, 16 nt, Human
cuucaggagggagcau

SEQ ID NO: 2444845 - RNA, 18 nt, Human
cuucaggucaggaguucg

SEQ ID NO: 2444846 - RNA, 22 nt, Human
cuuagucacugagacagcccgg

SEQ ID NO: 2444847 - RNA, 17 nt, Human
cuuagucacugccugca

SEQ ID NO: 2444848 - RNA, 16 nt, Human
cuuagucacugccugc

SEQ ID NO: 2444849 - RNA, 15 nt, Human
cuuagucacugccug

SEQ ID NO: 2444850 - RNA, 14 nt, Human
cuuagucacugccu

SEQ ID NO: 2444851 - RNA, 13 nt, Human
cuuagucacugcc

SEQ ID NO: 2444852 - RNA, 23 nt, Human
cuuaguaaugcuacgugugauuu

SEQ ID NO: 2444853 - RNA, 20 nt, Human
cuuagucacugagacagccc

SEQ ID NO: 2444854 - RNA, 21 nt, Human
cuuagucacugagacagcccg

SEQ ID NO: 2444855 - RNA, 16 nt, Human
cuucaaauccauccag

SEQ ID NO: 2444856 - RNA, 14 nt, Human
cuucaaauccaucc

SEQ ID NO: 2444857 - RNA, 23 nt, Human
cuuagucacugccugcagagguc

SEQ ID NO: 2444858 - RNA, 17 nt, Human
cuucaaauccauccaga

SEQ ID NO: 2444859 - RNA, 19 nt, Human
cuucaaauuagaagacauu

SEQ ID NO: 2444860 - RNA, 13 nt, Human
cuucaaauuagaa

SEQ ID NO: 2444861 - RNA, 17 nt, Human
cuucaaauccuugaaga

SEQ ID NO: 2444862 - RNA, 15 nt, Human
cuucaaauauuuccc

SEQ ID NO: 2444863 - RNA, 20 nt, Human
cuucaaggauccugagccag

SEQ ID NO: 2444864 - RNA, 19 nt, Human
cuucaaggauccugagcca

SEQ ID NO: 2444865 - RNA, 18 nt, Human
cuucaaggauccugagcc

SEQ ID NO: 2444866 - RNA, 17 nt, Human
cuucaaggauccugagc

SEQ ID NO: 2444867 - RNA, 18 nt, Human
cuucaagaucauguaccc

SEQ ID NO: 2444868 - RNA, 17 nt, Human
cuucaagaccuucacca

SEQ ID NO: 2444869 - RNA, 18 nt, Human
cuucaagaacucugggcu

SEQ ID NO: 2444870 - RNA, 16 nt, Human
cuucaacucccugccc

SEQ ID NO: 2444871 - RNA, 23 nt, Human
cuucaacagacccccucuagaaa

SEQ ID NO: 2444872 - RNA, 17 nt, Human
cuucaacugaccagccu

SEQ ID NO: 2444873 - RNA, 23 nt, Human
cuucaacugaccagccuccaugc

SEQ ID NO: 2444874 - RNA, 20 nt, Human
cuucaacugaccagccucca

SEQ ID NO: 2444875 - RNA, 14 nt, Human
cuucacauauugau

SEQ ID NO: 2444876 - RNA, 23 nt, Human
cuucacauauugauuuccguuaa

SEQ ID NO: 2444877 - RNA, 11 nt, Human
cuucagagagc

SEQ ID NO: 2444878 - RNA, 24 nt, Human
cuucagagacuccugcaggcagcc

SEQ ID NO: 2444879 - RNA, 17 nt, Human
cuucacauacccucccc

SEQ ID NO: 2444880 - RNA, 22 nt, Human
cuucacauaagcucagaaucca

SEQ ID NO: 2444881 - RNA, 20 nt, Human
cuucacauaagcucagaauc

SEQ ID NO: 2444882 - RNA, 14 nt, Human
cuucacaguguuuc

SEQ ID NO: 2444883 - RNA, 14 nt, Human
cuucacauaguuuu

SEQ ID NO: 2444884 - RNA, 13 nt, Human
cuucacauaguuu

SEQ ID NO: 2444885 - RNA, 20 nt, Human
cuucacauccuguguuucua

SEQ ID NO: 2444886 - RNA, 20 nt, Human
cuucagagcugacacaggau

SEQ ID NO: 2444887 - RNA, 18 nt, Human
cuucagagcugacacagg

SEQ ID NO: 2444888 - RNA, 14 nt, Human
cuucagagcugaca

SEQ ID NO: 2444889 - RNA, 12 nt, Human
cuucagagcuga

SEQ ID NO: 2444890 - RNA, 21 nt, Human
cuucagaggcccucgcugcca

SEQ ID NO: 2444891 - RNA, 23 nt, Human
cuucagaggcccucgcugccagc

SEQ ID NO: 2444892 - RNA, 14 nt, Human
cuucagagagcugg

SEQ ID NO: 2444893 - RNA, 15 nt, Human
cuucagagagcuggu

SEQ ID NO: 2444894 - RNA, 16 nt, Human
cuucagagagcuggua

SEQ ID NO: 2444895 - RNA, 22 nt, Human
cuucagagagcugguaguuagu

SEQ ID NO: 2444896 - RNA, 12 nt, Human
cuucagagcagg

SEQ ID NO: 2444897 - RNA, 18 nt, Human
cuucagauuuguguuaua

SEQ ID NO: 2444898 - RNA, 20 nt, Human
cuucagaucagugcuugagu

SEQ ID NO: 2444899 - RNA, 18 nt, Human
cuucagauggaaacucuu

SEQ ID NO: 2444900 - RNA, 15 nt, Human
cuucagaucagugcu

SEQ ID NO: 2444901 - RNA, 17 nt, Human
cuucagaucagugcuug

SEQ ID NO: 2444902 - RNA, 22 nt, Human
cuucaaggauccugagccagau

SEQ ID NO: 2444903 - RNA, 21 nt, Human
cuucaaggauccugagccaga

SEQ ID NO: 2444904 - RNA, 23 nt, Human
cuucaaggauccugagccagauu

SEQ ID NO: 2444905 - RNA, 14 nt, Human
cuucacaaagccca

SEQ ID NO: 2444906 - RNA, 15 nt, Human
cuucacaaagcccaa

SEQ ID NO: 2444907 - RNA, 17 nt, Human
cuucacaaagcccaagg

SEQ ID NO: 2444908 - RNA, 12 nt, Human
cuucacaacaga

SEQ ID NO: 2444909 - RNA, 14 nt, Human
cuucacaacagauu

SEQ ID NO: 2444910 - RNA, 15 nt, Human
cuucacaaauucuca

SEQ ID NO: 2444911 - RNA, 23 nt, Human
cuucacaaagcccaagggaucug

SEQ ID NO: 2444912 - RNA, 16 nt, Human
cuucacacacaggcaa

SEQ ID NO: 2444913 - RNA, 17 nt, Human
cuucacacacaggcaac

SEQ ID NO: 2444914 - RNA, 12 nt, Human
cuucacaguguu

SEQ ID NO: 2444915 - RNA, 13 nt, Human
cuucacaguguuu

SEQ ID NO: 2444916 - RNA, 18 nt, Human
cugucuucccaggguagc

SEQ ID NO: 2444917 - RNA, 14 nt, Human
cugucuuccugcau

SEQ ID NO: 2444918 - RNA, 16 nt, Human
cugucuuccugcauuc

SEQ ID NO: 2444919 - RNA, 17 nt, Human
cugucuucucaggcucu

SEQ ID NO: 2444920 - RNA, 23 nt, Human
cugucuucccaggguagcccgcc

SEQ ID NO: 2444921 - RNA, 16 nt, Human
cugucuucccagggua

SEQ ID NO: 2444922 - RNA, 15 nt, Human
cugucuucccagggu

SEQ ID NO: 2444923 - RNA, 18 nt, Human
cugucuuccugcauucac

SEQ ID NO: 2444924 - RNA, 14 nt, Human
cugucuucccaggg

SEQ ID NO: 2444925 - RNA, 13 nt, Human
cugucuucccagg

SEQ ID NO: 2444926 - RNA, 12 nt, Human
cugucuucccag

SEQ ID NO: 2444927 - RNA, 11 nt, Human
cugucuuccca

SEQ ID NO: 2444928 - RNA, 22 nt, Human
cugucuucauagcagauuuuaa

SEQ ID NO: 2444929 - RNA, 18 nt, Human
cugucuucaccugauuca

SEQ ID NO: 2444930 - RNA, 22 nt, Human
cugucuucaccugauucaacua

SEQ ID NO: 2444931 - RNA, 19 nt, Human
cugucuucauagcagauuu

SEQ ID NO: 2444932 - RNA, 17 nt, Human
cugucuucaccugauuc

SEQ ID NO: 2444933 - RNA, 15 nt, Human
cugucuucaagggcu

SEQ ID NO: 2444934 - RNA, 23 nt, Human
cugucuucacagcucuguguugc

SEQ ID NO: 2444935 - RNA, 18 nt, Human
cugucuucacaacagauu

SEQ ID NO: 2444936 - RNA, 18 nt, Human
cugucuguuacacuggag

SEQ ID NO: 2444937 - RNA, 16 nt, Human
cugucuguuacacugg

SEQ ID NO: 2444938 - RNA, 17 nt, Human
cugucuucaacagcucc

SEQ ID NO: 2444939 - RNA, 14 nt, Human
cugucuucaagggc

SEQ ID NO: 2444940 - RNA, 19 nt, Human
cugucuucacagcucugug

SEQ ID NO: 2444941 - RNA, 18 nt, Human
cugucuucaguaagccgu

SEQ ID NO: 2444942 - RNA, 20 nt, Human
cugucuuuccuagauggcag

SEQ ID NO: 2444943 - RNA, 23 nt, Human
cugucuuucugagcacacuuuag

SEQ ID NO: 2444944 - RNA, 15 nt, Human
cugugaaaggaaaga

SEQ ID NO: 2444945 - RNA, 21 nt, Human
cugucuuuuuucuaaaguaaa

SEQ ID NO: 2444946 - RNA, 21 nt, Human
cugucuucuucaggguccuga

SEQ ID NO: 2444947 - RNA, 11 nt, Human
cugucuuuccu

SEQ ID NO: 2444948 - RNA, 13 nt, Human
cugucuuuccuag

SEQ ID NO: 2444949 - RNA, 14 nt, Human
cugucuuuccuaga

SEQ ID NO: 2444950 - RNA, 16 nt, Human
cugucuuucagauaca

SEQ ID NO: 2444951 - RNA, 20 nt, Human
cugucuuucagauacauggu

SEQ ID NO: 2444952 - RNA, 15 nt, Human
cugucuuucagauac

SEQ ID NO: 2444953 - RNA, 16 nt, Human
cugucuuuaaggaaaa

SEQ ID NO: 2444954 - RNA, 15 nt, Human
cugucugguggcccc

SEQ ID NO: 2444955 - RNA, 13 nt, Human
cugucugguggcc

SEQ ID NO: 2444956 - RNA, 15 nt, Human
cugucuggccaggcc

SEQ ID NO: 2444957 - RNA, 20 nt, Human
cugucuggcugaggauuuca

SEQ ID NO: 2444958 - RNA, 15 nt, Human
cugucugcucagaca

SEQ ID NO: 2444959 - RNA, 14 nt, Human
cugucuguaccuaa

SEQ ID NO: 2444960 - RNA, 18 nt, Human
cugucugguuuuaacaau

SEQ ID NO: 2444961 - RNA, 17 nt, Human
cugucugguuuuaacaa

SEQ ID NO: 2444962 - RNA, 16 nt, Human
cugucugguuuuaaca

SEQ ID NO: 2444963 - RNA, 23 nt, Human
cugucugguuucaccgaggacau

SEQ ID NO: 2444964 - RNA, 23 nt, Human
cugucugguggccccguuucugg

SEQ ID NO: 2444965 - RNA, 22 nt, Human
cugucuguagagggcccuggug

SEQ ID NO: 2444966 - RNA, 20 nt, Human
cugucuguagagggcccugg

SEQ ID NO: 2444967 - RNA, 19 nt, Human
cugucuguagagggcccug

SEQ ID NO: 2444968 - RNA, 16 nt, Human
cugucuguagagggcc

SEQ ID NO: 2444969 - RNA, 16 nt, Human
cugucugucucuccau

SEQ ID NO: 2444970 - RNA, 20 nt, Human
cugucugucucuccaucugu

SEQ ID NO: 2444971 - RNA, 15 nt, Human
cugucuguuacacug

SEQ ID NO: 2444972 - RNA, 20 nt, Human
cugucauuugagcagggcuc

SEQ ID NO: 2444973 - RNA, 18 nt, Human
cugucaauuacaggaagu

SEQ ID NO: 2444974 - RNA, 22 nt, Human
cugucauuugagcagggcucag

SEQ ID NO: 2444975 - RNA, 21 nt, Human
cugucauuugagcagggcuca

SEQ ID NO: 2444976 - RNA, 21 nt, Human
cugucugaucugugcuuucca

SEQ ID NO: 2444977 - RNA, 16 nt, Human
cugucugaucugugcu

SEQ ID NO: 2444978 - RNA, 17 nt, Human
cugucugaucugugcuu

SEQ ID NO: 2444979 - RNA, 14 nt, Human
cugucugccagcca

SEQ ID NO: 2444980 - RNA, 23 nt, Human
cugucauuugagcagggcucagc

SEQ ID NO: 2444981 - RNA, 15 nt, Human
cugucugccagccag

SEQ ID NO: 2444982 - RNA, 16 nt, Human
cugucugccagccagc

SEQ ID NO: 2444983 - RNA, 17 nt, Human
cugucugccagccagca

SEQ ID NO: 2444984 - RNA, 20 nt, Human
cugucugccagccagcagcc

SEQ ID NO: 2444985 - RNA, 21 nt, Human
cugucugccagccagcagcca

SEQ ID NO: 2444986 - RNA, 14 nt, Human
cugucugccagggc

SEQ ID NO: 2444987 - RNA, 18 nt, Human
cugugcccacaucccagg

SEQ ID NO: 2444988 - RNA, 14 nt, Human
cugugcccaaguug

SEQ ID NO: 2444989 - RNA, 22 nt, Human
cugugccauuuuguauuuuacu

SEQ ID NO: 2444990 - RNA, 15 nt, Human
cugugccaugugcca

SEQ ID NO: 2444991 - RNA, 17 nt, Human
cugugcccacccuccac

SEQ ID NO: 2444992 - RNA, 23 nt, Human
cugugcccacccuccacucuccu

SEQ ID NO: 2444993 - RNA, 22 nt, Human
cugugcccacaucccaggcuuc

SEQ ID NO: 2444994 - RNA, 19 nt, Human
cugugcccacaucccaggc

SEQ ID NO: 2444995 - RNA, 23 nt, Human
cugugcccacaucccaggcuuca

SEQ ID NO: 2444996 - RNA, 12 nt, Human
cugugcccaugg

SEQ ID NO: 2444997 - RNA, 19 nt, Human
cugugcccuaaaguguauu

SEQ ID NO: 2444998 - RNA, 21 nt, Human
cugugccccaugccuguccag

SEQ ID NO: 2444999 - RNA, 18 nt, Human
cugugcccaugggcacug

SEQ ID NO: 2445000 - RNA, 15 nt, Human
cugugcccaugggca

SEQ ID NO: 2445001 - RNA, 13 nt, Human
cugugcccauggg

SEQ ID NO: 2445002 - RNA, 17 nt, Human
cugugcccagagauggg

SEQ ID NO: 2445003 - RNA, 21 nt, Human
cugugcccaugggcacugcug

SEQ ID NO: 2445004 - RNA, 20 nt, Human
cugugcccaugggcacugcu

SEQ ID NO: 2445005 - RNA, 17 nt, Human
cugugccccaugccugu

SEQ ID NO: 2445006 - RNA, 14 nt, Human
cugugccaugugcc

SEQ ID NO: 2445007 - RNA, 21 nt, Human
cugugccacucaccgaagcca

SEQ ID NO: 2445008 - RNA, 23 nt, Human
cugugccacccugggcucugugg

SEQ ID NO: 2445009 - RNA, 22 nt, Human
cugugccacccugggcucugug

SEQ ID NO: 2445010 - RNA, 16 nt, Human
cugugcagucacugga

SEQ ID NO: 2445011 - RNA, 15 nt, Human
cugugcagggaggag

SEQ ID NO: 2445012 - RNA, 22 nt, Human
cugugcagggaggagguggcag

SEQ ID NO: 2445013 - RNA, 17 nt, Human
cugugcacgcaguggcc

SEQ ID NO: 2445014 - RNA, 12 nt, Human
cugugcacgcag

SEQ ID NO: 2445015 - RNA, 14 nt, Human
cugugcaccaagca

SEQ ID NO: 2445016 - RNA, 14 nt, Human
cugugcacugccca

SEQ ID NO: 2445017 - RNA, 18 nt, Human
cugugcacgcaguggccu

SEQ ID NO: 2445018 - RNA, 21 nt, Human
cugugcacaucugugucuugu

SEQ ID NO: 2445019 - RNA, 16 nt, Human
cugugcaaauccuuga

SEQ ID NO: 2445020 - RNA, 22 nt, Human
cugugauuccacuacaccuggc

SEQ ID NO: 2445021 - RNA, 19 nt, Human
cugugcagccgcugagcga

SEQ ID NO: 2445022 - RNA, 21 nt, Human
cugugcagccgcugagcgagg

SEQ ID NO: 2445023 - RNA, 23 nt, Human
cugugcagccuguccugggcugg

SEQ ID NO: 2445024 - RNA, 13 nt, Human
cugugcagggagg

SEQ ID NO: 2445025 - RNA, 16 nt, Human
cugugcagccgcugag

SEQ ID NO: 2445026 - RNA, 17 nt, Human
cugugcagccgcugagc

SEQ ID NO: 2445027 - RNA, 22 nt, Human
cugugcagccccgccuccaggc

SEQ ID NO: 2445028 - RNA, 14 nt, Human
cugugcagccccgc

SEQ ID NO: 2445029 - RNA, 22 nt, Human
cugugaaaggaaagagggaggu

SEQ ID NO: 2445030 - RNA, 16 nt, Human
cugugaaaggaaagag

SEQ ID NO: 2445031 - RNA, 18 nt, Human
cugugaaaguacauuugg

SEQ ID NO: 2445032 - RNA, 19 nt, Human
cugugaaaaaaaaaaugcu

SEQ ID NO: 2445033 - RNA, 15 nt, Human
cugugaaacuggcac

SEQ ID NO: 2445034 - RNA, 12 nt, Human
cugugaaauagu

SEQ ID NO: 2445035 - RNA, 16 nt, Human
cugugaaaugcuggca

SEQ ID NO: 2445036 - RNA, 23 nt, Human
cugugaaacuggcacugaauuaa

SEQ ID NO: 2445037 - RNA, 17 nt, Human
cugugagcccagcuggg

SEQ ID NO: 2445038 - RNA, 13 nt, Human
cugugagccccug

SEQ ID NO: 2445039 - RNA, 15 nt, Human
cugugagcccagcug

SEQ ID NO: 2445040 - RNA, 16 nt, Human
cugugaacgauuuaga

SEQ ID NO: 2445041 - RNA, 18 nt, Human
cugugaacauggacucuu

SEQ ID NO: 2445042 - RNA, 17 nt, Human
cugugagccuuggcugu

SEQ ID NO: 2445043 - RNA, 13 nt, Human
cugugaggcaggg

SEQ ID NO: 2445044 - RNA, 14 nt, Human
cugugaggcagggg

SEQ ID NO: 2445045 - RNA, 15 nt, Human
cugugaggccccugg

SEQ ID NO: 2445046 - RNA, 18 nt, Human
cugugaggcaggggcgga

SEQ ID NO: 2445047 - RNA, 21 nt, Human
cugugagccccugguccugag

SEQ ID NO: 2445048 - RNA, 16 nt, Human
cugugagccccugguc

SEQ ID NO: 2445049 - RNA, 15 nt, Human
cugugagccccuggu

SEQ ID NO: 2445050 - RNA, 14 nt, Human
cugugagccccugg

SEQ ID NO: 2445051 - RNA, 15 nt, Human
cugugagccuuggcu

SEQ ID NO: 2445052 - RNA, 12 nt, Human
cugugagccuug

SEQ ID NO: 2445053 - RNA, 21 nt, Human
cugugauggggcccugccucc

SEQ ID NO: 2445054 - RNA, 16 nt, Human
cugugauggggcccug

SEQ ID NO: 2445055 - RNA, 23 nt, Human
cugugauggggcccugccuccuu

SEQ ID NO: 2445056 - RNA, 16 nt, Human
cugugauugugccuac

SEQ ID NO: 2445057 - RNA, 16 nt, Human
cugugaggcuguccug

SEQ ID NO: 2445058 - RNA, 15 nt, Human
cugugaggcuguccu

SEQ ID NO: 2445059 - RNA, 18 nt, Human
cugugaggccccuggaca

SEQ ID NO: 2445060 - RNA, 17 nt, Human
cugugaggccccuggac

SEQ ID NO: 2445061 - RNA, 12 nt, Human
cugugaggcugu

SEQ ID NO: 2445062 - RNA, 15 nt, Human
cugugauggggcccu

SEQ ID NO: 2445063 - RNA, 17 nt, Human
cugugaugauccucaua

SEQ ID NO: 2445064 - RNA, 22 nt, Human
cugugaugaggggaggggggca

SEQ ID NO: 2445065 - RNA, 14 nt, Human
cugugaugccacac

SEQ ID NO: 2445066 - RNA, 16 nt, Human
cugugaugccacacag

SEQ ID NO: 2445067 - RNA, 18 nt, Human
cugugaugcuuugaagua

SEQ ID NO: 2445068 - RNA, 17 nt, Human
cugugaugccacacaga

SEQ ID NO: 2445069 - RNA, 18 nt, Human
cuguguguguguaugugg

SEQ ID NO: 2445070 - RNA, 20 nt, Human
cuguguguguguaugugggg

SEQ ID NO: 2445071 - RNA, 18 nt, Human
cuguguguuuaugugugu

SEQ ID NO: 2445072 - RNA, 20 nt, Human
cuguguguuuaugugugugu

SEQ ID NO: 2445073 - RNA, 15 nt, Human
cuguguguguguaug

SEQ ID NO: 2445074 - RNA, 16 nt, Human
cuguguguguguaugu

SEQ ID NO: 2445075 - RNA, 14 nt, Human
cuguguguguguau

SEQ ID NO: 2445076 - RNA, 18 nt, Human
cuguguucgacucagccu

SEQ ID NO: 2445077 - RNA, 13 nt, Human
cuguguuccuggc

SEQ ID NO: 2445078 - RNA, 12 nt, Human
cuguguuccugg

SEQ ID NO: 2445079 - RNA, 22 nt, Human
cuguguucgacucagccucagg

SEQ ID NO: 2445080 - RNA, 21 nt, Human
cuguguucgacucagccucag

SEQ ID NO: 2445081 - RNA, 20 nt, Human
cuguguucgacucagccuca

SEQ ID NO: 2445082 - RNA, 13 nt, Human
cuguguugccaag

SEQ ID NO: 2445083 - RNA, 20 nt, Human
cuguguucuggugaggccuu

SEQ ID NO: 2445084 - RNA, 21 nt, Human
cuguguguguguauguggggg

SEQ ID NO: 2445085 - RNA, 16 nt, Human
cuguguguuuucauaa

SEQ ID NO: 2445086 - RNA, 18 nt, Human
cuguguguuuucauaaua

SEQ ID NO: 2445087 - RNA, 19 nt, Human
cuguguguuuucauaauaa

SEQ ID NO: 2445088 - RNA, 23 nt, Human
cuguguuuuugcuaucacacagu

SEQ ID NO: 2445089 - RNA, 19 nt, Human
cuguuaaaagaugaaaaua

SEQ ID NO: 2445090 - RNA, 15 nt, Human
cuguuaaaagaugaa

SEQ ID NO: 2445091 - RNA, 16 nt, Human
cuguuaaaagaugaaa

SEQ ID NO: 2445092 - RNA, 19 nt, Human
cuguguugccaagcuccaa

SEQ ID NO: 2445093 - RNA, 17 nt, Human
cuguguugccaagcucc

SEQ ID NO: 2445094 - RNA, 16 nt, Human
cuguguugccaagcuc

SEQ ID NO: 2445095 - RNA, 14 nt, Human
cuguguugccaagc

SEQ ID NO: 2445096 - RNA, 21 nt, Human
cuguguugccaagcuccaagc

SEQ ID NO: 2445097 - RNA, 14 nt, Human
cuguguugccaugu

SEQ ID NO: 2445098 - RNA, 18 nt, Human
cuguguugcgugucgugg

SEQ ID NO: 2445099 - RNA, 14 nt, Human
cuguguugucucua

SEQ ID NO: 2445100 - RNA, 20 nt, Human
cuguguugcgugucgugggu

SEQ ID NO: 2445101 - RNA, 19 nt, Human
cuguguugucucuagagca

SEQ ID NO: 2445102 - RNA, 22 nt, Human
cuguguuuugaaugguguugua

SEQ ID NO: 2445103 - RNA, 15 nt, Human
cuguguuuuugaaau

SEQ ID NO: 2445104 - RNA, 14 nt, Human
cugugugccuucgc

SEQ ID NO: 2445105 - RNA, 15 nt, Human
cuguguguccaaaac

SEQ ID NO: 2445106 - RNA, 19 nt, Human
cuguguguccaaaacugcc

SEQ ID NO: 2445107 - RNA, 21 nt, Human
cuguguguccaaaacugccuc

SEQ ID NO: 2445108 - RNA, 17 nt, Human
cugugugugaugugcau

SEQ ID NO: 2445109 - RNA, 22 nt, Human
cuguguguccaaaacugccuca

SEQ ID NO: 2445110 - RNA, 14 nt, Human
cugugugcucagga

SEQ ID NO: 2445111 - RNA, 21 nt, Human
cugugugcaccuuaccaacuu

SEQ ID NO: 2445112 - RNA, 16 nt, Human
cugugugcacaaauau

SEQ ID NO: 2445113 - RNA, 17 nt, Human
cugugugcagugaaggu

SEQ ID NO: 2445114 - RNA, 15 nt, Human
cugugugcagugaag

SEQ ID NO: 2445115 - RNA, 19 nt, Human
cugugugaugaacuuucuc

SEQ ID NO: 2445116 - RNA, 18 nt, Human
cugugugaugaacuuucu

SEQ ID NO: 2445117 - RNA, 21 nt, Human
cugugugauugacagcuuugc

SEQ ID NO: 2445118 - RNA, 23 nt, Human
cugugugauugacagcuuugcug

SEQ ID NO: 2445119 - RNA, 22 nt, Human
cugugugauugacagcuuugcu

SEQ ID NO: 2445120 - RNA, 18 nt, Human
cugugugcaagugugugc

SEQ ID NO: 2445121 - RNA, 16 nt, Human
cugugugaugaacuuu

SEQ ID NO: 2445122 - RNA, 15 nt, Human
cugugugaugaacuu

SEQ ID NO: 2445123 - RNA, 18 nt, Human
cugugugacucaaaccaa

SEQ ID NO: 2445124 - RNA, 19 nt, Human
cugugugacaucaguggca

SEQ ID NO: 2445125 - RNA, 16 nt, Human
cugugguuuuccccuc

SEQ ID NO: 2445126 - RNA, 21 nt, Human
cugugguuguuuuagcuccuu

SEQ ID NO: 2445127 - RNA, 21 nt, Human
cugugguuuuccccucccugg

SEQ ID NO: 2445128 - RNA, 20 nt, Human
cugugguuuuccccucccug

SEQ ID NO: 2445129 - RNA, 19 nt, Human
cugugguuuuccccucccu

SEQ ID NO: 2445130 - RNA, 18 nt, Human
cugugguuuuccccuccc

SEQ ID NO: 2445131 - RNA, 23 nt, Human
cugugguuuuccccucccugggu

SEQ ID NO: 2445132 - RNA, 22 nt, Human
cugugguuuuccccucccuggg

SEQ ID NO: 2445133 - RNA, 16 nt, Human
cuguguaaaaagagag

SEQ ID NO: 2445134 - RNA, 14 nt, Human
cuguguaaaguuag

SEQ ID NO: 2445135 - RNA, 13 nt, Human
cuguguaaaguua

SEQ ID NO: 2445136 - RNA, 12 nt, Human
cuguguaaaguu

SEQ ID NO: 2445137 - RNA, 11 nt, Human
cuguguaaagu

SEQ ID NO: 2445138 - RNA, 17 nt, Human
cuguguaaaaagagagc

SEQ ID NO: 2445139 - RNA, 16 nt, Human
cuguguaacagcuccu

SEQ ID NO: 2445140 - RNA, 15 nt, Human
cuguguaacagcucc

SEQ ID NO: 2445141 - RNA, 17 nt, Human
cuguguaacagcuccuu

SEQ ID NO: 2445142 - RNA, 18 nt, Human
cuguguaaaguuagucua

SEQ ID NO: 2445143 - RNA, 15 nt, Human
cuguguaaaguuagu

SEQ ID NO: 2445144 - RNA, 14 nt, Human
cuguguaacagcuc

SEQ ID NO: 2445145 - RNA, 13 nt, Human
cuguguaacagcu

SEQ ID NO: 2445146 - RNA, 20 nt, Human
cugugucuuuuuucacuaca

SEQ ID NO: 2445147 - RNA, 12 nt, Human
cugugugaaaua

SEQ ID NO: 2445148 - RNA, 19 nt, Human
cugugugaaauaccagugu

SEQ ID NO: 2445149 - RNA, 21 nt, Human
cugugugaaauaccagugugg

SEQ ID NO: 2445150 - RNA, 20 nt, Human
cugugucuuucacagcuccu

SEQ ID NO: 2445151 - RNA, 13 nt, Human
cugugugaaaaug

SEQ ID NO: 2445152 - RNA, 13 nt, Human
cuguggagaaaua

SEQ ID NO: 2445153 - RNA, 12 nt, Human
cuguggaagcaa

SEQ ID NO: 2445154 - RNA, 23 nt, Human
cuguggaaaguguaaagcauucc

SEQ ID NO: 2445155 - RNA, 13 nt, Human
cuguggaagggac

SEQ ID NO: 2445156 - RNA, 18 nt, Human
cuguggaaucuggaguga

SEQ ID NO: 2445157 - RNA, 14 nt, Human
cuguggaagggacu

SEQ ID NO: 2445158 - RNA, 16 nt, Human
cuguggaagggacuag

SEQ ID NO: 2445159 - RNA, 17 nt, Human
cugugccucugccuguc

SEQ ID NO: 2445160 - RNA, 16 nt, Human
cugugccucugccugu

SEQ ID NO: 2445161 - RNA, 11 nt, Human
cugugccucug

SEQ ID NO: 2445162 - RNA, 16 nt, Human
cugugcccugguggag

SEQ ID NO: 2445163 - RNA, 15 nt, Human
cugugcccuggugga

SEQ ID NO: 2445164 - RNA, 13 nt, Human
cugugcccuggug

SEQ ID NO: 2445165 - RNA, 12 nt, Human
cugugcccuggu

SEQ ID NO: 2445166 - RNA, 17 nt, Human
cugugcccuuauucagg

SEQ ID NO: 2445167 - RNA, 17 nt, Human
cugugcccugguggaga

SEQ ID NO: 2445168 - RNA, 18 nt, Human
cugugccuaacaccagcg

SEQ ID NO: 2445169 - RNA, 11 nt, Human
cugugcccugg

SEQ ID NO: 2445170 - RNA, 15 nt, Human
cugugcccucuugau

SEQ ID NO: 2445171 - RNA, 15 nt, Human
cugugccucugccug

SEQ ID NO: 2445172 - RNA, 14 nt, Human
cugugccucugccu

SEQ ID NO: 2445173 - RNA, 13 nt, Human
cugugccucugcc

SEQ ID NO: 2445174 - RNA, 12 nt, Human
cugugccucugc

SEQ ID NO: 2445175 - RNA, 24 nt, Human
cuguggaucaaauccagccugcug

SEQ ID NO: 2445176 - RNA, 14 nt, Human
cuguggaucaaauc

SEQ ID NO: 2445177 - RNA, 23 nt, Human
cuguggaggaaggauuguaaaaa

SEQ ID NO: 2445178 - RNA, 22 nt, Human
cuguggaggaaggauuguaaaa

SEQ ID NO: 2445179 - RNA, 21 nt, Human
cuguggaggaaggauuguaaa

SEQ ID NO: 2445180 - RNA, 20 nt, Human
cuguggaggaaggauuguaa

SEQ ID NO: 2445181 - RNA, 19 nt, Human
cuguggaggaaggauugua

SEQ ID NO: 2445182 - RNA, 17 nt, Human
cuguggaggaaggauug

SEQ ID NO: 2445183 - RNA, 16 nt, Human
cuguggaggaaggauu

SEQ ID NO: 2445184 - RNA, 14 nt, Human
cuguggagacuggg

SEQ ID NO: 2445185 - RNA, 15 nt, Human
cuguggagcccgcac

SEQ ID NO: 2445186 - RNA, 22 nt, Human
cuguggagcccgcacccccacc

SEQ ID NO: 2445187 - RNA, 15 nt, Human
cuguggaggaaggau

SEQ ID NO: 2445188 - RNA, 14 nt, Human
cuguggaggaagga

SEQ ID NO: 2445189 - RNA, 23 nt, Human
cuguggagcccgcacccccaccc

SEQ ID NO: 2445190 - RNA, 20 nt, Human
cuguggccccacccugggcc

SEQ ID NO: 2445191 - RNA, 18 nt, Human
cuguggccccacccuggg

SEQ ID NO: 2445192 - RNA, 17 nt, Human
cuguggccccacccugg

SEQ ID NO: 2445193 - RNA, 16 nt, Human
cuguggccccacccug

SEQ ID NO: 2445194 - RNA, 21 nt, Human
cuguggccccacccugggccc

SEQ ID NO: 2445195 - RNA, 15 nt, Human
cuguggaugagcccu

SEQ ID NO: 2445196 - RNA, 17 nt, Human
cuguggaugagcccuca

SEQ ID NO: 2445197 - RNA, 15 nt, Human
cuguggaucagagau

SEQ ID NO: 2445198 - RNA, 22 nt, Human
cuguggagguacacucuuauag

SEQ ID NO: 2445199 - RNA, 16 nt, Human
cuguggucacagcgga

SEQ ID NO: 2445200 - RNA, 22 nt, Human
cugugguccugaauucuuuccc

SEQ ID NO: 2445201 - RNA, 22 nt, Human
cuguggguuucuaaagcugcca

SEQ ID NO: 2445202 - RNA, 15 nt, Human
cugugggugacccag

SEQ ID NO: 2445203 - RNA, 23 nt, Human
cugugguaguacuccugcaaaau

SEQ ID NO: 2445204 - RNA, 15 nt, Human
cuguggugugucccc

SEQ ID NO: 2445205 - RNA, 22 nt, Human
cuguggugugucccccucuguc

SEQ ID NO: 2445206 - RNA, 14 nt, Human
cugugguguguccc

SEQ ID NO: 2445207 - RNA, 23 nt, Human
cuguggugcaaaagcagaaaaua

SEQ ID NO: 2445208 - RNA, 22 nt, Human
cuguggugcaaaagcagaaaau

SEQ ID NO: 2445209 - RNA, 22 nt, Human
cugugggaucccucugggcacu

SEQ ID NO: 2445210 - RNA, 14 nt, Human
cugugggaugggau

SEQ ID NO: 2445211 - RNA, 24 nt, Human
cugugggggugagggucccaugug

SEQ ID NO: 2445212 - RNA, 23 nt, Human
cugugggggugagggucccaugu

SEQ ID NO: 2445213 - RNA, 22 nt, Human
cugugggcacgcugugggcagg

SEQ ID NO: 2445214 - RNA, 20 nt, Human
cugugggcaggugggagcuu

SEQ ID NO: 2445215 - RNA, 21 nt, Human
cuguggguuucuaaagcugcc

SEQ ID NO: 2445216 - RNA, 15 nt, Human
cuguggguaguauga

SEQ ID NO: 2445217 - RNA, 23 nt, Human
cuguggggugugcacaucucugc

SEQ ID NO: 2445218 - RNA, 22 nt, Human
cugugggugaagacagagggaa

SEQ ID NO: 2445219 - RNA, 20 nt, Human
cuguggccguuaucuggaag

SEQ ID NO: 2445220 - RNA, 19 nt, Human
cuguggccguuaucuggaa

SEQ ID NO: 2445221 - RNA, 21 nt, Human
cuguggccguuaucuggaagu

SEQ ID NO: 2445222 - RNA, 11 nt, Human
cuguggccugg

SEQ ID NO: 2445223 - RNA, 22 nt, Human
cuguggcuucuuaaucuuuuca

SEQ ID NO: 2445224 - RNA, 19 nt, Human
cuguggcuuucagccucug

SEQ ID NO: 2445225 - RNA, 18 nt, Human
cuguggcuuucagccucu

SEQ ID NO: 2445226 - RNA, 14 nt, Human
cugugggagccugc

SEQ ID NO: 2445227 - RNA, 16 nt, Human
cugugggaaggccagc

SEQ ID NO: 2445228 - RNA, 15 nt, Human
cugugggaaggccag

SEQ ID NO: 2445229 - RNA, 18 nt, Human
cugugggaaggccagcug

SEQ ID NO: 2445230 - RNA, 20 nt, Human
cugugggaaggccagcugcc

SEQ ID NO: 2445231 - RNA, 23 nt, Human
cugugggaacgagaggggaagag

SEQ ID NO: 2445232 - RNA, 21 nt, Human
cugugggaacgagaggggaag

SEQ ID NO: 2445233 - RNA, 20 nt, Human
cugugggaacgagaggggaa

SEQ ID NO: 2445234 - RNA, 18 nt, Human
cugggcuggcucccucuu

SEQ ID NO: 2445235 - RNA, 16 nt, Human
cugggcuggcucccuc

SEQ ID NO: 2445236 - RNA, 12 nt, Human
cugggcuggcuc

SEQ ID NO: 2445237 - RNA, 17 nt, Human
cugggcugccaugugaa

SEQ ID NO: 2445238 - RNA, 20 nt, Human
cugggcugccaugugaagag

SEQ ID NO: 2445239 - RNA, 19 nt, Human
cugggcugcuacccagaaa

SEQ ID NO: 2445240 - RNA, 18 nt, Human
cugggcugggugcgaccc

SEQ ID NO: 2445241 - RNA, 12 nt, Human
cugggcugggug

SEQ ID NO: 2445242 - RNA, 20 nt, Human
cugggcuggggccugauggg

SEQ ID NO: 2445243 - RNA, 18 nt, Human
cugggcuggggccugaug

SEQ ID NO: 2445244 - RNA, 15 nt, Human
cugggcuggggccug

SEQ ID NO: 2445245 - RNA, 12 nt, Human
cugggcugugcu

SEQ ID NO: 2445246 - RNA, 22 nt, Human
cugggcugggugcgaccccauc

SEQ ID NO: 2445247 - RNA, 21 nt, Human
cugggcugguggcucccggag

SEQ ID NO: 2445248 - RNA, 13 nt, Human
cugggcuguuggc

SEQ ID NO: 2445249 - RNA, 13 nt, Human
cugggcugugcua

SEQ ID NO: 2445250 - RNA, 15 nt, Human
cugggcuguuggcac

SEQ ID NO: 2445251 - RNA, 14 nt, Human
cugggcuguuggca

SEQ ID NO: 2445252 - RNA, 15 nt, Human
cugggcuucaguggc

SEQ ID NO: 2445253 - RNA, 22 nt, Human
cugggcuuggggaccagagcug

SEQ ID NO: 2445254 - RNA, 18 nt, Human
cugggcuugucuguagau

SEQ ID NO: 2445255 - RNA, 14 nt, Human
cugggggcugggca

SEQ ID NO: 2445256 - RNA, 18 nt, Human
cugggggcugggcagagg

SEQ ID NO: 2445257 - RNA, 15 nt, Human
cugggggugccagga

SEQ ID NO: 2445258 - RNA, 19 nt, Human
cugggggugccaggaccag

SEQ ID NO: 2445259 - RNA, 14 nt, Human
cugggggugggcca

SEQ ID NO: 2445260 - RNA, 15 nt, Human
cugggggugggccag

SEQ ID NO: 2445261 - RNA, 16 nt, Human
cugggggugggccagg

SEQ ID NO: 2445262 - RNA, 14 nt, Human
cugggggugccagg

SEQ ID NO: 2445263 - RNA, 16 nt, Human
cugggggccucuucug

SEQ ID NO: 2445264 - RNA, 23 nt, Human
cugggcuuuuuuuuucucuuucu

SEQ ID NO: 2445265 - RNA, 20 nt, Human
cugggcuuggggcuuccuaa

SEQ ID NO: 2445266 - RNA, 19 nt, Human
cugggcuuggggcuuccua

SEQ ID NO: 2445267 - RNA, 22 nt, Human
cuggguuuggaccccagcuggg

SEQ ID NO: 2445268 - RNA, 21 nt, Human
cuggguuuggaccccagcugg

SEQ ID NO: 2445269 - RNA, 20 nt, Human
cuggguuuggaccccagcug

SEQ ID NO: 2445270 - RNA, 19 nt, Human
cuggguccuuuucagaagu

SEQ ID NO: 2445271 - RNA, 19 nt, Human
cuggguuuggaccccagcu

SEQ ID NO: 2445272 - RNA, 15 nt, Human
cugggucgcccugga

SEQ ID NO: 2445273 - RNA, 22 nt, Human
cuggguuuuguauucucugagc

SEQ ID NO: 2445274 - RNA, 20 nt, Human
cuggguuuuguauucucuga

SEQ ID NO: 2445275 - RNA, 23 nt, Human
cuggguuuggaccccagcuggga

SEQ ID NO: 2445276 - RNA, 20 nt, Human
cuggguuuucuuaaccaucu

SEQ ID NO: 2445277 - RNA, 19 nt, Human
cugguaaacuauuugucuu

SEQ ID NO: 2445278 - RNA, 16 nt, Human
cugguaaacuauuugu

SEQ ID NO: 2445279 - RNA, 18 nt, Human
cugguaacaguucauguu

SEQ ID NO: 2445280 - RNA, 19 nt, Human
cugguauauccaaaagcuu

SEQ ID NO: 2445281 - RNA, 20 nt, Human
cugguauauccaaaagcuuu

SEQ ID NO: 2445282 - RNA, 18 nt, Human
cugguauauccaaaagcu

SEQ ID NO: 2445283 - RNA, 15 nt, Human
cugguaaucuugcuc

SEQ ID NO: 2445284 - RNA, 19 nt, Human
cugguaauauugacuugua

SEQ ID NO: 2445285 - RNA, 15 nt, Human
cugguaauauugacu

SEQ ID NO: 2445286 - RNA, 17 nt, Human
cugguaauuuguaucug

SEQ ID NO: 2445287 - RNA, 13 nt, Human
cugggucgcccug

SEQ ID NO: 2445288 - RNA, 23 nt, Human
cuggguccuugcaccccucacuc

SEQ ID NO: 2445289 - RNA, 18 nt, Human
cuggguccuugcaccccu

SEQ ID NO: 2445290 - RNA, 21 nt, Human
cuggguccaggggaugggagg

SEQ ID NO: 2445291 - RNA, 22 nt, Human
cuggguccaggggaugggaggu

SEQ ID NO: 2445292 - RNA, 17 nt, Human
cugggguucagccccuc

SEQ ID NO: 2445293 - RNA, 19 nt, Human
cugggguucagccccuccu

SEQ ID NO: 2445294 - RNA, 20 nt, Human
cugggguucagccccuccuc

SEQ ID NO: 2445295 - RNA, 21 nt, Human
cugggguucagccccuccucu

SEQ ID NO: 2445296 - RNA, 23 nt, Human
cugggguucagccccuccucugc

SEQ ID NO: 2445297 - RNA, 16 nt, Human
cuggguaaaugcagcg

SEQ ID NO: 2445298 - RNA, 22 nt, Human
cugggguucagccccuccucug

SEQ ID NO: 2445299 - RNA, 20 nt, Human
cugggguggggucaugcccu

SEQ ID NO: 2445300 - RNA, 13 nt, Human
cuggggugggguc

SEQ ID NO: 2445301 - RNA, 14 nt, Human
cuggggugggguca

SEQ ID NO: 2445302 - RNA, 16 nt, Human
cuggggugugggaggc

SEQ ID NO: 2445303 - RNA, 19 nt, Human
cuggggugugggaggcccg

SEQ ID NO: 2445304 - RNA, 13 nt, Human
cugggguucagcc

SEQ ID NO: 2445305 - RNA, 15 nt, Human
cugggguucagcccc

SEQ ID NO: 2445306 - RNA, 23 nt, Human
cuggggguucuuucuuccucugc

SEQ ID NO: 2445307 - RNA, 20 nt, Human
cuggggguucuuucuuccuc

SEQ ID NO: 2445308 - RNA, 16 nt, Human
cugggguaccaagaga

SEQ ID NO: 2445309 - RNA, 17 nt, Human
cugggggugggccaggc

SEQ ID NO: 2445310 - RNA, 21 nt, Human
cugggguaccaagagacuccu

SEQ ID NO: 2445311 - RNA, 16 nt, Human
cuggggguugcggggg

SEQ ID NO: 2445312 - RNA, 20 nt, Human
cugggguggggauagggagc

SEQ ID NO: 2445313 - RNA, 23 nt, Human
cugggccccugccucucugcagg

SEQ ID NO: 2445314 - RNA, 20 nt, Human
cugggccccugccucucugc

SEQ ID NO: 2445315 - RNA, 13 nt, Human
cugggcccucucu

SEQ ID NO: 2445316 - RNA, 14 nt, Human
cugggcccucucug

SEQ ID NO: 2445317 - RNA, 15 nt, Human
cugggcccucucugc

SEQ ID NO: 2445318 - RNA, 18 nt, Human
cugggcccucucugcucu

SEQ ID NO: 2445319 - RNA, 21 nt, Human
cugggcaaggaggccacguga

SEQ ID NO: 2445320 - RNA, 15 nt, Human
cugggcaaggaggcc

SEQ ID NO: 2445321 - RNA, 19 nt, Human
cugggccccugccucucug

SEQ ID NO: 2445322 - RNA, 17 nt, Human
cugggauuuacacuuga

SEQ ID NO: 2445323 - RNA, 15 nt, Human
cugggcaaagccuag

SEQ ID NO: 2445324 - RNA, 15 nt, Human
cugggcaacagagca

SEQ ID NO: 2445325 - RNA, 18 nt, Human
cugggcaacagagcaaga

SEQ ID NO: 2445326 - RNA, 23 nt, Human
cugggauucuacuuuaagcacua

SEQ ID NO: 2445327 - RNA, 22 nt, Human
cugggauucuacuuuaagcacu

SEQ ID NO: 2445328 - RNA, 21 nt, Human
cugggauucuacuuuaagcac

SEQ ID NO: 2445329 - RNA, 18 nt, Human
cugggauucuacuuuaag

SEQ ID NO: 2445330 - RNA, 20 nt, Human
cugggauucccaccaagguc

SEQ ID NO: 2445331 - RNA, 17 nt, Human
cugggauucuacuuuaa

SEQ ID NO: 2445332 - RNA, 15 nt, Human
cugggauucccacca

SEQ ID NO: 2445333 - RNA, 15 nt, Human
cugggaugggccugc

SEQ ID NO: 2445334 - RNA, 17 nt, Human
cugggauucccaccaag

SEQ ID NO: 2445335 - RNA, 14 nt, Human
cugggauuccuccc

SEQ ID NO: 2445336 - RNA, 12 nt, Human
cugcuccacccu

SEQ ID NO: 2445337 - RNA, 13 nt, Human
cugcuccacccuu

SEQ ID NO: 2445338 - RNA, 14 nt, Human
cugcuccacccuug

SEQ ID NO: 2445339 - RNA, 15 nt, Human
cugcuccacccuugg

SEQ ID NO: 2445340 - RNA, 16 nt, Human
cugcuccacccuuggc

SEQ ID NO: 2445341 - RNA, 17 nt, Human
cugcuccacccuuggcc

SEQ ID NO: 2445342 - RNA, 18 nt, Human
cugcuccacccuuggccu

SEQ ID NO: 2445343 - RNA, 19 nt, Human
cugcuccacccuuggccug

SEQ ID NO: 2445344 - RNA, 11 nt, Human
cugcuccacca

SEQ ID NO: 2445345 - RNA, 13 nt, Human
cugcuccaccaca

SEQ ID NO: 2445346 - RNA, 16 nt, Human
cugcuccaccacaucc

SEQ ID NO: 2445347 - RNA, 11 nt, Human
cugcuccaccc

SEQ ID NO: 2445348 - RNA, 16 nt, Human
cugcuccacaguguug

SEQ ID NO: 2445349 - RNA, 14 nt, Human
cugcuccacagugu

SEQ ID NO: 2445350 - RNA, 13 nt, Human
cugcuccacagug

SEQ ID NO: 2445351 - RNA, 12 nt, Human
cugcuccacagu

SEQ ID NO: 2445352 - RNA, 19 nt, Human
cugcuccacagccauccca

SEQ ID NO: 2445353 - RNA, 22 nt, Human
cugggaugggccugcuuccugu

SEQ ID NO: 2445354 - RNA, 20 nt, Human
cugcuccacccuuggccugu

SEQ ID NO: 2445355 - RNA, 21 nt, Human
cugcuccacccuuggccuguc

SEQ ID NO: 2445356 - RNA, 16 nt, Human
cugggaugggccugcu

SEQ ID NO: 2445357 - RNA, 21 nt, Human
cugcuccacaguguuggcgag

SEQ ID NO: 2445358 - RNA, 14 nt, Human
cugggauguccaca

SEQ ID NO: 2445359 - RNA, 21 nt, Human
cugggauguccacagaugccu

SEQ ID NO: 2445360 - RNA, 20 nt, Human
cugggauguggcugcagcag

SEQ ID NO: 2445361 - RNA, 15 nt, Human
cugggauguggcugc

SEQ ID NO: 2445362 - RNA, 14 nt, Human
cugggauguuucug

SEQ ID NO: 2445363 - RNA, 21 nt, Human
cugggauuacaagcgugagcc

SEQ ID NO: 2445364 - RNA, 18 nt, Human
cugggauuacaggcguga

SEQ ID NO: 2445365 - RNA, 20 nt, Human
cugggauuacaggcaugagc

SEQ ID NO: 2445366 - RNA, 22 nt, Human
cugggauguggcugcagcagcg

SEQ ID NO: 2445367 - RNA, 19 nt, Human
cugggauguuucugucaca

SEQ ID NO: 2445368 - RNA, 19 nt, Human
cugggcugagccccuaccc

SEQ ID NO: 2445369 - RNA, 18 nt, Human
cugggcugagccccuacc

SEQ ID NO: 2445370 - RNA, 17 nt, Human
cugggcugagccccuac

SEQ ID NO: 2445371 - RNA, 15 nt, Human
cugggcugagccccu

SEQ ID NO: 2445372 - RNA, 12 nt, Human
cugggcugaggg

SEQ ID NO: 2445373 - RNA, 13 nt, Human
cugggcugaggga

SEQ ID NO: 2445374 - RNA, 16 nt, Human
cugggcugagggagcc

SEQ ID NO: 2445375 - RNA, 18 nt, Human
cugggcugagggagccug

SEQ ID NO: 2445376 - RNA, 19 nt, Human
cugggcugagggagccugg

SEQ ID NO: 2445377 - RNA, 23 nt, Human
cugggcugagggagccuggcccc

SEQ ID NO: 2445378 - RNA, 18 nt, Human
cugggcucugugggcugc

SEQ ID NO: 2445379 - RNA, 16 nt, Human
cugggcucugugggcu

SEQ ID NO: 2445380 - RNA, 15 nt, Human
cugggcucugugggc

SEQ ID NO: 2445381 - RNA, 14 nt, Human
cugggcucuguggg

SEQ ID NO: 2445382 - RNA, 21 nt, Human
cugggcucugugggcugcacu

SEQ ID NO: 2445383 - RNA, 20 nt, Human
cugggcucugugggcugcac

SEQ ID NO: 2445384 - RNA, 18 nt, Human
cugggcugaacacuccaa

SEQ ID NO: 2445385 - RNA, 12 nt, Human
cugggcugacug

SEQ ID NO: 2445386 - RNA, 22 nt, Human
cugggcucugugggcugcacuc

SEQ ID NO: 2445387 - RNA, 15 nt, Human
cugggcugacuggga

SEQ ID NO: 2445388 - RNA, 14 nt, Human
cugggcugagcccc

SEQ ID NO: 2445389 - RNA, 13 nt, Human
cugggcugagccc

SEQ ID NO: 2445390 - RNA, 12 nt, Human
cugggcugagcc

SEQ ID NO: 2445391 - RNA, 13 nt, Human
cugggcugagaga

SEQ ID NO: 2445392 - RNA, 15 nt, Human
cugggcucugccacc

SEQ ID NO: 2445393 - RNA, 14 nt, Human
cugggcucugccac

SEQ ID NO: 2445394 - RNA, 13 nt, Human
cugggcucugcca

SEQ ID NO: 2445395 - RNA, 23 nt, Human
cugggcucugcaauuccccucug

SEQ ID NO: 2445396 - RNA, 22 nt, Human
cugggcucugcaauuccccucu

SEQ ID NO: 2445397 - RNA, 15 nt, Human
cugggcucuccaccu

SEQ ID NO: 2445398 - RNA, 16 nt, Human
cugggcucuccaccuc

SEQ ID NO: 2445399 - RNA, 17 nt, Human
cugggcucuccaccuca

SEQ ID NO: 2445400 - RNA, 18 nt, Human
cugggcucuccaccucag

SEQ ID NO: 2445401 - RNA, 19 nt, Human
cugggcucuccaccucagc

SEQ ID NO: 2445402 - RNA, 20 nt, Human
cugggcucuccaccucagcc

SEQ ID NO: 2445403 - RNA, 21 nt, Human
cugggcucuccaccucagccu

SEQ ID NO: 2445404 - RNA, 20 nt, Human
cugggcucugccacccuacc

SEQ ID NO: 2445405 - RNA, 17 nt, Human
cugggcucugccacccu

SEQ ID NO: 2445406 - RNA, 13 nt, Human
cugggcucugccc

SEQ ID NO: 2445407 - RNA, 17 nt, Human
cugggcucugccccagc

SEQ ID NO: 2445408 - RNA, 18 nt, Human
cugggcucugccccagcu

SEQ ID NO: 2445409 - RNA, 13 nt, Human
cugggcucugugg

SEQ ID NO: 2445410 - RNA, 16 nt, Human
cugggcucugggagca

SEQ ID NO: 2445411 - RNA, 18 nt, Human
cugggcucugggagcagc

SEQ ID NO: 2445412 - RNA, 15 nt, Human
cugggcucugggagc

SEQ ID NO: 2445413 - RNA, 21 nt, Human
cugggcucugccacccuaccu

SEQ ID NO: 2445414 - RNA, 23 nt, Human
cugggcucugccccagcucuggc

SEQ ID NO: 2445415 - RNA, 15 nt, Human
cugggcucggaggcu

SEQ ID NO: 2445416 - RNA, 13 nt, Human
cugggcucggagg

SEQ ID NO: 2445417 - RNA, 17 nt, Human
cugggcuccuccagggu

SEQ ID NO: 2445418 - RNA, 21 nt, Human
cugggcuccuaaccuuccugu

SEQ ID NO: 2445419 - RNA, 21 nt, Human
cugggcucggaggcugccccc

SEQ ID NO: 2445420 - RNA, 18 nt, Human
cugggcucggaggcugcc

SEQ ID NO: 2445421 - RNA, 17 nt, Human
cugggcucggaggcugc

SEQ ID NO: 2445422 - RNA, 16 nt, Human
cugggcucggaggcug

SEQ ID NO: 2445423 - RNA, 17 nt, Human
cugggcucgucuuugca

SEQ ID NO: 2445424 - RNA, 12 nt, Human
cugggcucucca

SEQ ID NO: 2445425 - RNA, 13 nt, Human
cugggcucuccac

SEQ ID NO: 2445426 - RNA, 14 nt, Human
cugggcucuccacc

SEQ ID NO: 2445427 - RNA, 14 nt, Human
cugggcuccuccag

SEQ ID NO: 2445428 - RNA, 15 nt, Human
cugggcuccuccagg

SEQ ID NO: 2445429 - RNA, 13 nt, Human
cugggccugcaga

SEQ ID NO: 2445430 - RNA, 22 nt, Human
cugggcccugacauuggagccu

SEQ ID NO: 2445431 - RNA, 18 nt, Human
cugguggcagugggagcu

SEQ ID NO: 2445432 - RNA, 14 nt, Human
cugguggcaguggg

SEQ ID NO: 2445433 - RNA, 20 nt, Human
cugguggcagcucaccucuc

SEQ ID NO: 2445434 - RNA, 15 nt, Human
cugguggcagcugcg

SEQ ID NO: 2445435 - RNA, 18 nt, Human
cugguggcagcucaccuc

SEQ ID NO: 2445436 - RNA, 17 nt, Human
cugguggcagcucaccu

SEQ ID NO: 2445437 - RNA, 17 nt, Human
cugguauuccugccucc

SEQ ID NO: 2445438 - RNA, 15 nt, Human
cugguauuccugccu

SEQ ID NO: 2445439 - RNA, 14 nt, Human
cugguauuccugcc

SEQ ID NO: 2445440 - RNA, 16 nt, Human
cugguggcagcucacc

SEQ ID NO: 2445441 - RNA, 12 nt, Human
cuggugguucac

SEQ ID NO: 2445442 - RNA, 20 nt, Human
cuggugguucacucuuggag

SEQ ID NO: 2445443 - RNA, 21 nt, Human
cuggugguucacucuuggagc

SEQ ID NO: 2445444 - RNA, 23 nt, Human
cuggugguucacucuuggagccu

SEQ ID NO: 2445445 - RNA, 20 nt, Human
cuggugguuucacggugcca

SEQ ID NO: 2445446 - RNA, 18 nt, Human
cuggugguuucacggugc

SEQ ID NO: 2445447 - RNA, 21 nt, Human
cuggugguuucacggugccag

SEQ ID NO: 2445448 - RNA, 15 nt, Human
cuggugguugcuguu

SEQ ID NO: 2445449 - RNA, 16 nt, Human
cuggugguuucacggu

SEQ ID NO: 2445450 - RNA, 20 nt, Human
cuggugguugcuguuuuccu

SEQ ID NO: 2445451 - RNA, 19 nt, Human
cugguguccugaccacccu

SEQ ID NO: 2445452 - RNA, 18 nt, Human
cugguguccugaccaccc

SEQ ID NO: 2445453 - RNA, 17 nt, Human
cugguguccugaccacc

SEQ ID NO: 2445454 - RNA, 16 nt, Human
cugguguccugaccac

SEQ ID NO: 2445455 - RNA, 15 nt, Human
cugguguccugacca

SEQ ID NO: 2445456 - RNA, 14 nt, Human
cugguguccugacc

SEQ ID NO: 2445457 - RNA, 13 nt, Human
cugguguccugac

SEQ ID NO: 2445458 - RNA, 18 nt, Human
cuggugucacuuacuguu

SEQ ID NO: 2445459 - RNA, 15 nt, Human
cuggugucacuuacu

SEQ ID NO: 2445460 - RNA, 12 nt, Human
cugguguccuga

SEQ ID NO: 2445461 - RNA, 22 nt, Human
cuguacagagcccacgccccca

SEQ ID NO: 2445462 - RNA, 18 nt, Human
cuguacagagcccacgcc

SEQ ID NO: 2445463 - RNA, 15 nt, Human
cuguacagagcccac

SEQ ID NO: 2445464 - RNA, 14 nt, Human
cuguacagagccca

SEQ ID NO: 2445465 - RNA, 14 nt, Human
cuguaauuugugau

SEQ ID NO: 2445466 - RNA, 15 nt, Human
cuguaauuugugaua

SEQ ID NO: 2445467 - RNA, 22 nt, Human
cuguaauuccuaccucccugca

SEQ ID NO: 2445468 - RNA, 16 nt, Human
cuguaauuccuaccuc

SEQ ID NO: 2445469 - RNA, 18 nt, Human
cuguaaucccagcuacuu

SEQ ID NO: 2445470 - RNA, 22 nt, Human
cuguaaucccagcuacucggga

SEQ ID NO: 2445471 - RNA, 15 nt, Human
cuguaaucccagcag

SEQ ID NO: 2445472 - RNA, 19 nt, Human
cuguaaucccagcuacuca

SEQ ID NO: 2445473 - RNA, 19 nt, Human
cuguaaucccagcuacucg

SEQ ID NO: 2445474 - RNA, 17 nt, Human
cuggugucugcuuucuc

SEQ ID NO: 2445475 - RNA, 22 nt, Human
cugguguccugaccacccuccc

SEQ ID NO: 2445476 - RNA, 21 nt, Human
cugguguccugaccacccucc

SEQ ID NO: 2445477 - RNA, 20 nt, Human
cugguguccugaccacccuc

SEQ ID NO: 2445478 - RNA, 23 nt, Human
cugguuaauauuuauaggucacu

SEQ ID NO: 2445479 - RNA, 21 nt, Human
cugguuagagguucccuuuga

SEQ ID NO: 2445480 - RNA, 22 nt, Human
cugguuagagguucccuuugac

SEQ ID NO: 2445481 - RNA, 14 nt, Human
cugguuagaaaugc

SEQ ID NO: 2445482 - RNA, 16 nt, Human
cuggugugaacuaaac

SEQ ID NO: 2445483 - RNA, 23 nt, Human
cugguuagaaaugcagaauccua

SEQ ID NO: 2445484 - RNA, 23 nt, Human
cuggugucugcuuucuccauugu

SEQ ID NO: 2445485 - RNA, 19 nt, Human
cuguaauccuagcacuuug

SEQ ID NO: 2445486 - RNA, 20 nt, Human
cuguaaucccagcacuuugg

SEQ ID NO: 2445487 - RNA, 19 nt, Human
cuguaaucccagcacuugg

SEQ ID NO: 2445488 - RNA, 16 nt, Human
cuguaaucccagcacu

SEQ ID NO: 2445489 - RNA, 20 nt, Human
cuguaaucccagcaugcuga

SEQ ID NO: 2445490 - RNA, 14 nt, Human
cuguaaucccagcu

SEQ ID NO: 2445491 - RNA, 13 nt, Human
cuguaaucccagc

SEQ ID NO: 2445492 - RNA, 14 nt, Human
cuguaaucccagca

SEQ ID NO: 2445493 - RNA, 17 nt, Human
cuguaaucccagcacuu

SEQ ID NO: 2445494 - RNA, 15 nt, Human
cuguaaucccagcac

SEQ ID NO: 2445495 - RNA, 21 nt, Human
cuguacuccucccaggcgccc

SEQ ID NO: 2445496 - RNA, 19 nt, Human
cuguacuccucccaggcgc

SEQ ID NO: 2445497 - RNA, 16 nt, Human
cuguacuccucccagg

SEQ ID NO: 2445498 - RNA, 15 nt, Human
cuguacuccucccag

SEQ ID NO: 2445499 - RNA, 18 nt, Human
cuguacucgcuugugcag

SEQ ID NO: 2445500 - RNA, 12 nt, Human
cuguaguuuuau

SEQ ID NO: 2445501 - RNA, 20 nt, Human
cuguaguugcguggacucug

SEQ ID NO: 2445502 - RNA, 17 nt, Human
cuguacucgcuugugca

SEQ ID NO: 2445503 - RNA, 21 nt, Human
cuguacuagagaucugguuuu

SEQ ID NO: 2445504 - RNA, 20 nt, Human
cuguacucaggaggcugagg

SEQ ID NO: 2445505 - RNA, 21 nt, Human
cuguaguuaggaaauaaaacc

SEQ ID NO: 2445506 - RNA, 22 nt, Human
cuguaguuaggaaauaaaaccu

SEQ ID NO: 2445507 - RNA, 20 nt, Human
cuguacgucugacaggcaau

SEQ ID NO: 2445508 - RNA, 19 nt, Human
cuguacgucugacaggcaa

SEQ ID NO: 2445509 - RNA, 14 nt, Human
cuguacuccuccca

SEQ ID NO: 2445510 - RNA, 17 nt, Human
cuguacuagagaucugg

SEQ ID NO: 2445511 - RNA, 13 nt, Human
cuguacuagagau

SEQ ID NO: 2445512 - RNA, 13 nt, Human
cuguacucaggag

SEQ ID NO: 2445513 - RNA, 23 nt, Human
cuguaccuuuugaggagccccag

SEQ ID NO: 2445514 - RNA, 17 nt, Human
cuguacauagccuauau

SEQ ID NO: 2445515 - RNA, 14 nt, Human
cuguacaucuauuu

SEQ ID NO: 2445516 - RNA, 20 nt, Human
cuguacauauuugagacuag

SEQ ID NO: 2445517 - RNA, 19 nt, Human
cuguacauagccuauauuu

SEQ ID NO: 2445518 - RNA, 19 nt, Human
cuguaauuuaguuauugau

SEQ ID NO: 2445519 - RNA, 16 nt, Human
cuguaauuuaguuauu

SEQ ID NO: 2445520 - RNA, 13 nt, Human
cuguaauuuaguu

SEQ ID NO: 2445521 - RNA, 16 nt, Human
cuguaauuguguguga

SEQ ID NO: 2445522 - RNA, 17 nt, Human
cuguacaugaaaacaca

SEQ ID NO: 2445523 - RNA, 20 nt, Human
cuguacaugaaaacacauuu

SEQ ID NO: 2445524 - RNA, 21 nt, Human
cuguacaugaaaacacauuuu

SEQ ID NO: 2445525 - RNA, 18 nt, Human
cuguacgucugacaggca

SEQ ID NO: 2445526 - RNA, 16 nt, Human
cuguacgucugacagg

SEQ ID NO: 2445527 - RNA, 15 nt, Human
cuguacgucugacag

SEQ ID NO: 2445528 - RNA, 14 nt, Human
cuguacgucugaca

SEQ ID NO: 2445529 - RNA, 23 nt, Human
cuguaguuuuaucacauguaugu

SEQ ID NO: 2445530 - RNA, 22 nt, Human
cuguaguuuuaucacauguaug

SEQ ID NO: 2445531 - RNA, 21 nt, Human
cuguaguuuuaucacauguau

SEQ ID NO: 2445532 - RNA, 17 nt, Human
cuguauaaaaucagcca

SEQ ID NO: 2445533 - RNA, 11 nt, Human
cuguauaaaau

SEQ ID NO: 2445534 - RNA, 19 nt, Human
cuguauaaaaucagccaau

SEQ ID NO: 2445535 - RNA, 13 nt, Human
cuguauaaauagg

SEQ ID NO: 2445536 - RNA, 20 nt, Human
cuguauaaauaggagaggau

SEQ ID NO: 2445537 - RNA, 19 nt, Human
cuguauaaauaggagagga

SEQ ID NO: 2445538 - RNA, 16 nt, Human
cuguauaaauaggaga

SEQ ID NO: 2445539 - RNA, 15 nt, Human
cuguauaaauaggag

SEQ ID NO: 2445540 - RNA, 14 nt, Human
cuguauaaauagga

SEQ ID NO: 2445541 - RNA, 20 nt, Human
cuguaucccaugagccucag

SEQ ID NO: 2445542 - RNA, 12 nt, Human
cuguauugaauc

SEQ ID NO: 2445543 - RNA, 21 nt, Human
cuguauucucaaacacaguua

SEQ ID NO: 2445544 - RNA, 18 nt, Human
cuguauucucaaacacag

SEQ ID NO: 2445545 - RNA, 13 nt, Human
cuguauucucaaa

SEQ ID NO: 2445546 - RNA, 19 nt, Human
cuguauuagucacagagau

SEQ ID NO: 2445547 - RNA, 17 nt, Human
cuguauuagucacagag

SEQ ID NO: 2445548 - RNA, 22 nt, Human
cuguaucccaugagccucagca

SEQ ID NO: 2445549 - RNA, 21 nt, Human
cuguaucccaugagccucagc

SEQ ID NO: 2445550 - RNA, 16 nt, Human
cugucaauuacaggaa

SEQ ID NO: 2445551 - RNA, 15 nt, Human
cugucaauuacagga

SEQ ID NO: 2445552 - RNA, 21 nt, Human
cugucaaaacaaguuuuucug

SEQ ID NO: 2445553 - RNA, 19 nt, Human
cugucaaaacaaguuuuuc

SEQ ID NO: 2445554 - RNA, 22 nt, Human
cuguauuuuuuuuucuaagaga

SEQ ID NO: 2445555 - RNA, 21 nt, Human
cuguauuuuuuuuucuaagag

SEQ ID NO: 2445556 - RNA, 18 nt, Human
cuguauuuuuuuuucuaa

SEQ ID NO: 2445557 - RNA, 13 nt, Human
cugucaauuacag

SEQ ID NO: 2445558 - RNA, 17 nt, Human
cugucaaaauaauuuua

SEQ ID NO: 2445559 - RNA, 16 nt, Human
cugucaaaauaauuuu

SEQ ID NO: 2445560 - RNA, 14 nt, Human
cugucaaacaaagc

SEQ ID NO: 2445561 - RNA, 17 nt, Human
cugucaaacaaagccag

SEQ ID NO: 2445562 - RNA, 20 nt, Human
cuguauugaaucauguagua

SEQ ID NO: 2445563 - RNA, 17 nt, Human
cuguauugaaucaugua

SEQ ID NO: 2445564 - RNA, 14 nt, Human
cuguauugaaucau

SEQ ID NO: 2445565 - RNA, 13 nt, Human
cuguauugaauca

SEQ ID NO: 2445566 - RNA, 15 nt, Human
cuguauugaugacag

SEQ ID NO: 2445567 - RNA, 21 nt, Human
cuguauugaaucauguaguau

SEQ ID NO: 2445568 - RNA, 15 nt, Human
cuguauuuaauuuug

SEQ ID NO: 2445569 - RNA, 14 nt, Human
cuguauuuaauuuu

SEQ ID NO: 2445570 - RNA, 23 nt, Human
cuguauuuuauuuagacaagaga

SEQ ID NO: 2445571 - RNA, 20 nt, Human
cuguauuuuguuuuugucuu

SEQ ID NO: 2445572 - RNA, 21 nt, Human
cuguauuuuuaccuuuuuccu

SEQ ID NO: 2445573 - RNA, 20 nt, Human
cuguauuuuguauuguuuca

SEQ ID NO: 2445574 - RNA, 14 nt, Human
cuuuauguguaaau

SEQ ID NO: 2445575 - RNA, 12 nt, Human
cuuuauguguaa

SEQ ID NO: 2445576 - RNA, 23 nt, Human
cuuuauguggaaaacagaacauc

SEQ ID NO: 2445577 - RNA, 18 nt, Human
cuuuauguggaaaacaga

SEQ ID NO: 2445578 - RNA, 12 nt, Human
cuuuauaaacuu

SEQ ID NO: 2445579 - RNA, 13 nt, Human
cuuuauaaauaaa

SEQ ID NO: 2445580 - RNA, 11 nt, Human
cuuuauaaaua

SEQ ID NO: 2445581 - RNA, 13 nt, Human
cuuuauaaacuuu

SEQ ID NO: 2445582 - RNA, 15 nt, Human
cuuuaguuuuuguga

SEQ ID NO: 2445583 - RNA, 13 nt, Human
cuuuaguuuuugu

SEQ ID NO: 2445584 - RNA, 20 nt, Human
cuuuauguuacuacaugcac

SEQ ID NO: 2445585 - RNA, 22 nt, Human
cuuuauguugcggugagaacuc

SEQ ID NO: 2445586 - RNA, 21 nt, Human
cuuuauuaaauacaaaacuuc

SEQ ID NO: 2445587 - RNA, 18 nt, Human
cuuuauuaaaaucuuaaa

SEQ ID NO: 2445588 - RNA, 13 nt, Human
cuuuauuaaaauc

SEQ ID NO: 2445589 - RNA, 20 nt, Human
cuuuauuaaucacuauuguu

SEQ ID NO: 2445590 - RNA, 14 nt, Human
cuuuauuacccccu

SEQ ID NO: 2445591 - RNA, 20 nt, Human
cuuuauuacccccuccuuca

SEQ ID NO: 2445592 - RNA, 22 nt, Human
cuuuauuacccccuccuucaga

SEQ ID NO: 2445593 - RNA, 15 nt, Human
cuuuauuaaucacua

SEQ ID NO: 2445594 - RNA, 20 nt, Human
cuuuauucuggcagaggagg

SEQ ID NO: 2445595 - RNA, 20 nt, Human
cuuuauuccagaaugcugua

SEQ ID NO: 2445596 - RNA, 16 nt, Human
cuuuauucaaguaaaa

SEQ ID NO: 2445597 - RNA, 21 nt, Human
cuuuauuuucuauaauuuaaa

SEQ ID NO: 2445598 - RNA, 11 nt, Human
cuuuauuuucu

SEQ ID NO: 2445599 - RNA, 21 nt, Human
cuuucagggggguugugaggc

SEQ ID NO: 2445600 - RNA, 12 nt, Human
cuuucagguacu

SEQ ID NO: 2445601 - RNA, 16 nt, Human
cuuuauuggcugagau

SEQ ID NO: 2445602 - RNA, 23 nt, Human
cuuuauuccagaaugcuguacau

SEQ ID NO: 2445603 - RNA, 16 nt, Human
cuuuauugagaaagag

SEQ ID NO: 2445604 - RNA, 15 nt, Human
cuuuauugagaaaga

SEQ ID NO: 2445605 - RNA, 13 nt, Human
cuuuauugagaaa

SEQ ID NO: 2445606 - RNA, 18 nt, Human
cuuuauuggcugagauau

SEQ ID NO: 2445607 - RNA, 18 nt, Human
cuuuauuguguuugucau

SEQ ID NO: 2445608 - RNA, 16 nt, Human
cuuuauuguguuuguc

SEQ ID NO: 2445609 - RNA, 20 nt, Human
cuuuauuguguuugucauua

SEQ ID NO: 2445610 - RNA, 19 nt, Human
cuuuauuguguuugucauu

SEQ ID NO: 2445611 - RNA, 23 nt, Human
cuuuauuguguuugucauuagcc

SEQ ID NO: 2445612 - RNA, 14 nt, Human
cuuuauugugaucu

SEQ ID NO: 2445613 - RNA, 18 nt, Human
cuuuccaaaugcccagcu

SEQ ID NO: 2445614 - RNA, 19 nt, Human
cuuuccaaaugcccagcuu

SEQ ID NO: 2445615 - RNA, 13 nt, Human
cuuuccacagaag

SEQ ID NO: 2445616 - RNA, 22 nt, Human
cuuuccaaaugcccagcuuaaa

SEQ ID NO: 2445617 - RNA, 23 nt, Human
cuuuccaccacagccagcaccug

SEQ ID NO: 2445618 - RNA, 22 nt, Human
cuuuccaccacagccagcaccu

SEQ ID NO: 2445619 - RNA, 21 nt, Human
cuuuccaccacagccagcacc

SEQ ID NO: 2445620 - RNA, 17 nt, Human
cuuuccaccacagccag

SEQ ID NO: 2445621 - RNA, 15 nt, Human
cuuuccaccacagcc

SEQ ID NO: 2445622 - RNA, 15 nt, Human
cuuuccaaggcuucu

SEQ ID NO: 2445623 - RNA, 16 nt, Human
cuuucccaacucuagc

SEQ ID NO: 2445624 - RNA, 17 nt, Human
cuuuccacccccucccu

SEQ ID NO: 2445625 - RNA, 20 nt, Human
cuuuccacccccucccuggc

SEQ ID NO: 2445626 - RNA, 21 nt, Human
cuuuccacaccuggcacugcu

SEQ ID NO: 2445627 - RNA, 14 nt, Human
cuuuccacccccuc

SEQ ID NO: 2445628 - RNA, 15 nt, Human
cuuuccacccccucc

SEQ ID NO: 2445629 - RNA, 16 nt, Human
cuuuccacccccuccc

SEQ ID NO: 2445630 - RNA, 19 nt, Human
cuuucauuuuuuuccaggc

SEQ ID NO: 2445631 - RNA, 16 nt, Human
cuuucauuuuuuucca

SEQ ID NO: 2445632 - RNA, 15 nt, Human
cuuucauuuuuuucc

SEQ ID NO: 2445633 - RNA, 22 nt, Human
cuuucauuuuuuuccaggcugg

SEQ ID NO: 2445634 - RNA, 20 nt, Human
cuuucauuuuuuuccaggcu

SEQ ID NO: 2445635 - RNA, 13 nt, Human
cuuucauuuucug

SEQ ID NO: 2445636 - RNA, 14 nt, Human
cuuucauuuucugu

SEQ ID NO: 2445637 - RNA, 17 nt, Human
cuuucauuuucuguuug

SEQ ID NO: 2445638 - RNA, 21 nt, Human
cuuucaucaaucauuguacag

SEQ ID NO: 2445639 - RNA, 20 nt, Human
cuuucaucaaucauuguaca

SEQ ID NO: 2445640 - RNA, 22 nt, Human
cuuucaucaaucauuguacagu

SEQ ID NO: 2445641 - RNA, 18 nt, Human
cuuucaucaaucauugua

SEQ ID NO: 2445642 - RNA, 14 nt, Human
cuuucauauuuuag

SEQ ID NO: 2445643 - RNA, 17 nt, Human
cuuucauuuacuguggc

SEQ ID NO: 2445644 - RNA, 18 nt, Human
cuuucauuuacuguggcu

SEQ ID NO: 2445645 - RNA, 18 nt, Human
cuuucauuucuugaggua

SEQ ID NO: 2445646 - RNA, 17 nt, Human
cuuucauacugaagaug

SEQ ID NO: 2445647 - RNA, 17 nt, Human
cuuucagugaaagcauc

SEQ ID NO: 2445648 - RNA, 15 nt, Human
cuuucagugaaagca

SEQ ID NO: 2445649 - RNA, 18 nt, Human
cuuucauaaucuuugcuu

SEQ ID NO: 2445650 - RNA, 17 nt, Human
cuuucauaaucuuugcu

SEQ ID NO: 2445651 - RNA, 18 nt, Human
cuuguguguuucacuuuu

SEQ ID NO: 2445652 - RNA, 17 nt, Human
cuuguguguuucacuuu

SEQ ID NO: 2445653 - RNA, 13 nt, Human
cuuguguguuuca

SEQ ID NO: 2445654 - RNA, 19 nt, Human
cuuguguuaaguaugugua

SEQ ID NO: 2445655 - RNA, 21 nt, Human
cuuguguguuuauugucaaag

SEQ ID NO: 2445656 - RNA, 19 nt, Human
cuuguuggagccugcaggg

SEQ ID NO: 2445657 - RNA, 18 nt, Human
cuuguuggagccugcagg

SEQ ID NO: 2445658 - RNA, 21 nt, Human
cuuguuggauuuuugucuugu

SEQ ID NO: 2445659 - RNA, 19 nt, Human
cuuguguguuuugagagua

SEQ ID NO: 2445660 - RNA, 19 nt, Human
cuuguguguuucacuuuua

SEQ ID NO: 2445661 - RNA, 15 nt, Human
cuuguuggagccugc

SEQ ID NO: 2445662 - RNA, 16 nt, Human
cuuguuguuuuacuaa

SEQ ID NO: 2445663 - RNA, 21 nt, Human
cuuguuguuuuacuaaagaaa

SEQ ID NO: 2445664 - RNA, 19 nt, Human
cuuguuguuuuacuaaaga

SEQ ID NO: 2445665 - RNA, 22 nt, Human
cuuguuuacagcacuacucugu

SEQ ID NO: 2445666 - RNA, 19 nt, Human
cuuguuuacagcacuacuc

SEQ ID NO: 2445667 - RNA, 14 nt, Human
cuuguuuucaguuu

SEQ ID NO: 2445668 - RNA, 13 nt, Human
cuuguuguuguua

SEQ ID NO: 2445669 - RNA, 22 nt, Human
cuuguugggauuccugacccag

SEQ ID NO: 2445670 - RNA, 21 nt, Human
cuuguugggauuccugaccca

SEQ ID NO: 2445671 - RNA, 20 nt, Human
cuuguugggauuccugaccc

SEQ ID NO: 2445672 - RNA, 18 nt, Human
cuuguugggauuccugac

SEQ ID NO: 2445673 - RNA, 23 nt, Human
cuuguuggauuuuugucuugugu

SEQ ID NO: 2445674 - RNA, 15 nt, Human
cuuguggacuaaaag

SEQ ID NO: 2445675 - RNA, 15 nt, Human
cuuguaaauacacca

SEQ ID NO: 2445676 - RNA, 12 nt, Human
cuuguaaauaca

SEQ ID NO: 2445677 - RNA, 19 nt, Human
cuuguggacuaaaagauau

SEQ ID NO: 2445678 - RNA, 18 nt, Human
cuuguggacuaaaagaua

SEQ ID NO: 2445679 - RNA, 17 nt, Human
cuuguggacuaaaagau

SEQ ID NO: 2445680 - RNA, 16 nt, Human
cuuguggacuaaaaga

SEQ ID NO: 2445681 - RNA, 23 nt, Human
cuugggggacagggcuggcccag

SEQ ID NO: 2445682 - RNA, 24 nt, Human
cuugggggaugacuagaggcaggg

SEQ ID NO: 2445683 - RNA, 12 nt, Human
cuuguaaauaaa

SEQ ID NO: 2445684 - RNA, 19 nt, Human
cuuguaaauaaagcccugg

SEQ ID NO: 2445685 - RNA, 17 nt, Human
cuuguaaauaaagcccu

SEQ ID NO: 2445686 - RNA, 16 nt, Human
cuuguaaauaaagccc

SEQ ID NO: 2445687 - RNA, 15 nt, Human
cuuguaaauaaagcc

SEQ ID NO: 2445688 - RNA, 20 nt, Human
cuuguguguuuauugucaaa

SEQ ID NO: 2445689 - RNA, 16 nt, Human
cuuguggauguuuuaa

SEQ ID NO: 2445690 - RNA, 15 nt, Human
cuuguggauguuuua

SEQ ID NO: 2445691 - RNA, 19 nt, Human
cuuguggagccccacacug

SEQ ID NO: 2445692 - RNA, 16 nt, Human
cuuguggagccccaca

SEQ ID NO: 2445693 - RNA, 14 nt, Human
cuuguggagcccca

SEQ ID NO: 2445694 - RNA, 13 nt, Human
cuuguggagcccc

SEQ ID NO: 2445695 - RNA, 12 nt, Human
cuuguggagccc

SEQ ID NO: 2445696 - RNA, 13 nt, Human
cuuguaaauacac

SEQ ID NO: 2445697 - RNA, 22 nt, Human
cuuguggauguuuuaauuccau

SEQ ID NO: 2445698 - RNA, 14 nt, Human
cuuguggccuggga

SEQ ID NO: 2445699 - RNA, 22 nt, Human
cuuuaaacucagggacagagcc

SEQ ID NO: 2445700 - RNA, 19 nt, Human
cuuuaaacucagggacaga

SEQ ID NO: 2445701 - RNA, 16 nt, Human
cuuuaaacucagggac

SEQ ID NO: 2445702 - RNA, 15 nt, Human
cuuuaaacucaggga

SEQ ID NO: 2445703 - RNA, 13 nt, Human
cuuuaaacucagg

SEQ ID NO: 2445704 - RNA, 21 nt, Human
cuuguuuuuuuuuuccacuua

SEQ ID NO: 2445705 - RNA, 20 nt, Human
cuuguuuuuuuuuuccacuu

SEQ ID NO: 2445706 - RNA, 19 nt, Human
cuuguuuuuuuuuuccacu

SEQ ID NO: 2445707 - RNA, 16 nt, Human
cuuguuuuugcacaug

SEQ ID NO: 2445708 - RNA, 12 nt, Human
cuuguuuuugca

SEQ ID NO: 2445709 - RNA, 18 nt, Human
cuuguuuuuccacuacug

SEQ ID NO: 2445710 - RNA, 14 nt, Human
cuuguuuucuggga

SEQ ID NO: 2445711 - RNA, 14 nt, Human
cuuguuuucuugcc

SEQ ID NO: 2445712 - RNA, 17 nt, Human
cuuguuuucuugccaau

SEQ ID NO: 2445713 - RNA, 18 nt, Human
cuuguuuucuugccaaug

SEQ ID NO: 2445714 - RNA, 18 nt, Human
cuuuaaagggauggcaag

SEQ ID NO: 2445715 - RNA, 21 nt, Human
cuuuaaaggaaaaaauguugg

SEQ ID NO: 2445716 - RNA, 13 nt, Human
cuuuaaaggaaaa

SEQ ID NO: 2445717 - RNA, 19 nt, Human
cuuuaaaggaaaaaauguu

SEQ ID NO: 2445718 - RNA, 12 nt, Human
cuuuacuguuug

SEQ ID NO: 2445719 - RNA, 18 nt, Human
cuuuaaaggaaaaaaugu

SEQ ID NO: 2445720 - RNA, 14 nt, Human
cuuuaaaggaaaaa

SEQ ID NO: 2445721 - RNA, 20 nt, Human
cuuuaaagggauggcaagau

SEQ ID NO: 2445722 - RNA, 14 nt, Human
cuuuacuguuuguu

SEQ ID NO: 2445723 - RNA, 15 nt, Human
cuuuacuguuuguua

SEQ ID NO: 2445724 - RNA, 17 nt, Human
cuuuagugguggccauu

SEQ ID NO: 2445725 - RNA, 14 nt, Human
cuuuaguggcuuca

SEQ ID NO: 2445726 - RNA, 20 nt, Human
cuuuagugaucacagcagcu

SEQ ID NO: 2445727 - RNA, 20 nt, Human
cuuuagugaacguggacucc

SEQ ID NO: 2445728 - RNA, 15 nt, Human
cuuuagucugcaaaa

SEQ ID NO: 2445729 - RNA, 14 nt, Human
cuuuagucugcaaa

SEQ ID NO: 2445730 - RNA, 14 nt, Human
cuuuacuuuuaaac

SEQ ID NO: 2445731 - RNA, 19 nt, Human
cuuguaaaggaauuuaaaa

SEQ ID NO: 2445732 - RNA, 16 nt, Human
cuuggggggcugaggu

SEQ ID NO: 2445733 - RNA, 22 nt, Human
cuuggggggcugaggugggagg

SEQ ID NO: 2445734 - RNA, 22 nt, Human
cuuggggaccagagcugccacc

SEQ ID NO: 2445735 - RNA, 18 nt, Human
cuuggggaauuuccucua

SEQ ID NO: 2445736 - RNA, 17 nt, Human
cuuggggaauuuccucu

SEQ ID NO: 2445737 - RNA, 15 nt, Human
cuuggggacaucucu

SEQ ID NO: 2445738 - RNA, 19 nt, Human
cuuggggaguuaagaccug

SEQ ID NO: 2445739 - RNA, 20 nt, Human
cuuggggaguuaagaccugg

SEQ ID NO: 2445740 - RNA, 22 nt, Human
cuugggggacagggcuggccca

SEQ ID NO: 2445741 - RNA, 21 nt, Human
cuugggggacagggcuggccc

SEQ ID NO: 2445742 - RNA, 18 nt, Human
cuugggggacagggcugg

SEQ ID NO: 2445743 - RNA, 15 nt, Human
cuuggggggcugagg

SEQ ID NO: 2445744 - RNA, 13 nt, Human
cuugggcuucauc

SEQ ID NO: 2445745 - RNA, 23 nt, Human
cuugggcagagcuggcucugagc

SEQ ID NO: 2445746 - RNA, 22 nt, Human
cuugggcagagcuggcucugag

SEQ ID NO: 2445747 - RNA, 19 nt, Human
cuugggaggaagcagaaua

SEQ ID NO: 2445748 - RNA, 14 nt, Human
cuugggccacugug

SEQ ID NO: 2445749 - RNA, 21 nt, Human
cuuggggaccagagcugccac

SEQ ID NO: 2445750 - RNA, 20 nt, Human
cuuggggaccagagcugcca

SEQ ID NO: 2445751 - RNA, 22 nt, Human
cuugggcuucauccuccucaga

SEQ ID NO: 2445752 - RNA, 20 nt, Human
cuuggggacaggggcaggag

SEQ ID NO: 2445753 - RNA, 19 nt, Human
cuugggcuuccauuugugu

SEQ ID NO: 2445754 - RNA, 23 nt, Human
cuugggcuuccauuugugugugu

SEQ ID NO: 2445755 - RNA, 16 nt, Human
cuuggggaauuuccuc

SEQ ID NO: 2445756 - RNA, 18 nt, Human
cuuggggaacaagggugg

SEQ ID NO: 2445757 - RNA, 12 nt, Human
cuuggagggcau

SEQ ID NO: 2445758 - RNA, 23 nt, Human
cuuggagggcaugaagacagaua

SEQ ID NO: 2445759 - RNA, 22 nt, Human
cuuggaggaaggaaacccagcu

SEQ ID NO: 2445760 - RNA, 15 nt, Human
cuuggagcugagccu

SEQ ID NO: 2445761 - RNA, 18 nt, Human
cuuggagcugagccucuc

SEQ ID NO: 2445762 - RNA, 21 nt, Human
cuuggagcugagccucucacc

SEQ ID NO: 2445763 - RNA, 15 nt, Human
cuuggaggccagcca

SEQ ID NO: 2445764 - RNA, 19 nt, Human
cuuggaggguugguccucu

SEQ ID NO: 2445765 - RNA, 18 nt, Human
cuuggaggguugguccuc

SEQ ID NO: 2445766 - RNA, 23 nt, Human
cuuggagggucccaagcugggcc

SEQ ID NO: 2445767 - RNA, 22 nt, Human
cuuggagggucccaagcugggc

SEQ ID NO: 2445768 - RNA, 21 nt, Human
cuuggagggucccaagcuggg

SEQ ID NO: 2445769 - RNA, 19 nt, Human
cuuggagggucccaagcug

SEQ ID NO: 2445770 - RNA, 18 nt, Human
cuuggagggucccaagcu

SEQ ID NO: 2445771 - RNA, 17 nt, Human
cuuggagggucccaagc

SEQ ID NO: 2445772 - RNA, 14 nt, Human
cuuggagggaccaa

SEQ ID NO: 2445773 - RNA, 15 nt, Human
cuuggaggcugucuu

SEQ ID NO: 2445774 - RNA, 15 nt, Human
cuuggagggucccaa

SEQ ID NO: 2445775 - RNA, 16 nt, Human
cuuggcugcagggagu

SEQ ID NO: 2445776 - RNA, 17 nt, Human
cuuggagguagcuuuga

SEQ ID NO: 2445777 - RNA, 18 nt, Human
cuuggaguauuggggucu

SEQ ID NO: 2445778 - RNA, 24 nt, Human
cuuggaggguugguccucuugccu

SEQ ID NO: 2445779 - RNA, 22 nt, Human
cuugggaagcugaggcgggaga

SEQ ID NO: 2445780 - RNA, 10 nt, Human
cuugggaaug

SEQ ID NO: 2445781 - RNA, 18 nt, Human
cuugggaauggauccugg

SEQ ID NO: 2445782 - RNA, 23 nt, Human
cuugggaccgccagauggggccu

SEQ ID NO: 2445783 - RNA, 17 nt, Human
cuugggacuggguuugg

SEQ ID NO: 2445784 - RNA, 15 nt, Human
cuugggacuggguuu

SEQ ID NO: 2445785 - RNA, 20 nt, Human
cuugggcagagcuggcucug

SEQ ID NO: 2445786 - RNA, 19 nt, Human
cuugggcagagcuggcucu

SEQ ID NO: 2445787 - RNA, 18 nt, Human
cuugggcagagcuggcuc

SEQ ID NO: 2445788 - RNA, 15 nt, Human
cuugggcagagcugg

SEQ ID NO: 2445789 - RNA, 18 nt, Human
cuugggaggaagcagaau

SEQ ID NO: 2445790 - RNA, 17 nt, Human
cuugggaggaagcagaa

SEQ ID NO: 2445791 - RNA, 14 nt, Human
cuugggcagagcug

SEQ ID NO: 2445792 - RNA, 16 nt, Human
cuugggaggaagcaga

SEQ ID NO: 2445793 - RNA, 15 nt, Human
cuugggaggaagcag

SEQ ID NO: 2445794 - RNA, 14 nt, Human
cuugggaggaagca

SEQ ID NO: 2445795 - RNA, 17 nt, Human
cuuggcugcagggaguc

SEQ ID NO: 2445796 - RNA, 17 nt, Human
cuuggcugcuuggccuu

SEQ ID NO: 2445797 - RNA, 14 nt, Human
cuuggcugcuuggc

SEQ ID NO: 2445798 - RNA, 14 nt, Human
cuuggcugcaggga

SEQ ID NO: 2445799 - RNA, 15 nt, Human
cuuggcuuucauguu

SEQ ID NO: 2445800 - RNA, 14 nt, Human
cuuggcuuucaugu

SEQ ID NO: 2445801 - RNA, 19 nt, Human
cuugggaaauaugaaugcc

SEQ ID NO: 2445802 - RNA, 12 nt, Human
cuugggaaauau

SEQ ID NO: 2445803 - RNA, 11 nt, Human
cuugggaaaua

SEQ ID NO: 2445804 - RNA, 22 nt, Human
cuuggcuuucauuauuaguacu

SEQ ID NO: 2445805 - RNA, 20 nt, Human
cuuggcuuuuacugaagccu

SEQ ID NO: 2445806 - RNA, 16 nt, Human
cuugccagagauccaa

SEQ ID NO: 2445807 - RNA, 23 nt, Human
cuugccagagauccaaaagaagc

SEQ ID NO: 2445808 - RNA, 15 nt, Human
cuugccacugccucu

SEQ ID NO: 2445809 - RNA, 14 nt, Human
cuugccacugccuc

SEQ ID NO: 2445810 - RNA, 11 nt, Human
cuugccagaga

SEQ ID NO: 2445811 - RNA, 12 nt, Human
cuugccagagau

SEQ ID NO: 2445812 - RNA, 16 nt, Human
cuugccagacaugugg

SEQ ID NO: 2445813 - RNA, 18 nt, Human
cuucucauuucaccccuc

SEQ ID NO: 2445814 - RNA, 13 nt, Human
cuugccacugccu

SEQ ID NO: 2445815 - RNA, 21 nt, Human
cuucuccacccugcucuccga

SEQ ID NO: 2445816 - RNA, 18 nt, Human
cuucuccacccugcucuc

SEQ ID NO: 2445817 - RNA, 17 nt, Human
cuucuccacccugcucu

SEQ ID NO: 2445818 - RNA, 15 nt, Human
cuugcccaccccacc

SEQ ID NO: 2445819 - RNA, 14 nt, Human
cuugcccaccccac

SEQ ID NO: 2445820 - RNA, 14 nt, Human
cuugcccacaccga

SEQ ID NO: 2445821 - RNA, 22 nt, Human
cuugcccaccccacccccaccc

SEQ ID NO: 2445822 - RNA, 13 nt, Human
cuugcccagagau

SEQ ID NO: 2445823 - RNA, 19 nt, Human
cuugcccagagaugccucc

SEQ ID NO: 2445824 - RNA, 21 nt, Human
cuugcccagagaugccuccac

SEQ ID NO: 2445825 - RNA, 19 nt, Human
cuugccccccaccccagcc

SEQ ID NO: 2445826 - RNA, 13 nt, Human
cuugccccccacc

SEQ ID NO: 2445827 - RNA, 14 nt, Human
cuugccccccaccc

SEQ ID NO: 2445828 - RNA, 15 nt, Human
cuugccccccacccc

SEQ ID NO: 2445829 - RNA, 16 nt, Human
cuugccccccacccca

SEQ ID NO: 2445830 - RNA, 23 nt, Human
cuugcccagagaugccuccaccg

SEQ ID NO: 2445831 - RNA, 22 nt, Human
cuugcccagagaugccuccacc

SEQ ID NO: 2445832 - RNA, 14 nt, Human
cuugcucugcugac

SEQ ID NO: 2445833 - RNA, 13 nt, Human
cuugcucugcuga

SEQ ID NO: 2445834 - RNA, 17 nt, Human
cuugcccggauucuggg

SEQ ID NO: 2445835 - RNA, 21 nt, Human
cuugccccggccccggcccca

SEQ ID NO: 2445836 - RNA, 18 nt, Human
cuugccccggccccggcc

SEQ ID NO: 2445837 - RNA, 18 nt, Human
cuugcccggauucuggga

SEQ ID NO: 2445838 - RNA, 20 nt, Human
cuugcccggauucugggagg

SEQ ID NO: 2445839 - RNA, 13 nt, Human
cuugcccugaccu

SEQ ID NO: 2445840 - RNA, 12 nt, Human
cuugcccugacc

SEQ ID NO: 2445841 - RNA, 17 nt, Human
cuugcuguccuaggcca

SEQ ID NO: 2445842 - RNA, 20 nt, Human
cuugcuguccuaggccacac

SEQ ID NO: 2445843 - RNA, 18 nt, Human
cuugcccugaccucccag

SEQ ID NO: 2445844 - RNA, 17 nt, Human
cuugcccugaccuccca

SEQ ID NO: 2445845 - RNA, 15 nt, Human
cuugcccugaccucc

SEQ ID NO: 2445846 - RNA, 14 nt, Human
cuugcccugaccuc

SEQ ID NO: 2445847 - RNA, 19 nt, Human
cuugcccugaccucccagc

SEQ ID NO: 2445848 - RNA, 16 nt, Human
cuugcuguccuaggcc

SEQ ID NO: 2445849 - RNA, 17 nt, Human
cuugcucugcugacaga

SEQ ID NO: 2445850 - RNA, 16 nt, Human
cuugcucugcugacag

SEQ ID NO: 2445851 - RNA, 18 nt, Human
cuugcuguuuuguucugu

SEQ ID NO: 2445852 - RNA, 15 nt, Human
cuugcuguccuaggc

SEQ ID NO: 2445853 - RNA, 20 nt, Human
cuugcuucaaccccaugaga

SEQ ID NO: 2445854 - RNA, 14 nt, Human
cuuggaaaaaguga

SEQ ID NO: 2445855 - RNA, 17 nt, Human
cuugcuuuucuguauuu

SEQ ID NO: 2445856 - RNA, 15 nt, Human
cuugcuuauuugaca

SEQ ID NO: 2445857 - RNA, 16 nt, Human
cuuggaaaaagugaug

SEQ ID NO: 2445858 - RNA, 20 nt, Human
cuuggaaaaauccagaaaga

SEQ ID NO: 2445859 - RNA, 22 nt, Human
cuuggaaaaauccagaaagaaa

SEQ ID NO: 2445860 - RNA, 14 nt, Human
cuuggaaaccugcc

SEQ ID NO: 2445861 - RNA, 16 nt, Human
cuuggaaaugggagac

SEQ ID NO: 2445862 - RNA, 21 nt, Human
cuuggaaagaaacaaccguug

SEQ ID NO: 2445863 - RNA, 23 nt, Human
cuuggaaagcaucaccucaggcc

SEQ ID NO: 2445864 - RNA, 15 nt, Human
cuuggaaaggaccag

SEQ ID NO: 2445865 - RNA, 23 nt, Human
cuuggaaaccugcccugccugag

SEQ ID NO: 2445866 - RNA, 22 nt, Human
cuuggaaaccugcccugccuga

SEQ ID NO: 2445867 - RNA, 21 nt, Human
cuuggaaaccugcccugccug

SEQ ID NO: 2445868 - RNA, 20 nt, Human
cuuggaaaccugcccugccu

SEQ ID NO: 2445869 - RNA, 18 nt, Human
cuuggaaaccugcccugc

SEQ ID NO: 2445870 - RNA, 17 nt, Human
cuuggaaaccugcccug

SEQ ID NO: 2445871 - RNA, 16 nt, Human
cuuggaaaccugcccu

SEQ ID NO: 2445872 - RNA, 15 nt, Human
cuuggaaaccugccc

SEQ ID NO: 2445873 - RNA, 21 nt, Human
cuuggaaagcaucaccucagg

SEQ ID NO: 2445874 - RNA, 22 nt, Human
cuuggaaagcaucaccucaggc

SEQ ID NO: 2445875 - RNA, 20 nt, Human
cuuggaaagcaucaccucag

SEQ ID NO: 2445876 - RNA, 21 nt, Human
cuuggaaacuggaugagguca

SEQ ID NO: 2445877 - RNA, 15 nt, Human
cuuggaagagccugc

SEQ ID NO: 2445878 - RNA, 13 nt, Human
cuuggagcugagc

SEQ ID NO: 2445879 - RNA, 19 nt, Human
cuuggaagagccugcaggu

SEQ ID NO: 2445880 - RNA, 12 nt, Human
cuuggagcugag

SEQ ID NO: 2445881 - RNA, 13 nt, Human
cuuggaggaagga

SEQ ID NO: 2445882 - RNA, 13 nt, Human
cuuggaagcuccg

SEQ ID NO: 2445883 - RNA, 18 nt, Human
cuuuggacagaagcagcu

SEQ ID NO: 2445884 - RNA, 19 nt, Human
cuuuggacagaagcagcuc

SEQ ID NO: 2445885 - RNA, 20 nt, Human
cuuuggacagaagcagcucu

SEQ ID NO: 2445886 - RNA, 21 nt, Human
cuuuggacagaagcagcucuu

SEQ ID NO: 2445887 - RNA, 16 nt, Human
cuuuggacccugaggc

SEQ ID NO: 2445888 - RNA, 15 nt, Human
cuuuggacccugagg

SEQ ID NO: 2445889 - RNA, 18 nt, Human
cuuuggacccugaggccc

SEQ ID NO: 2445890 - RNA, 17 nt, Human
cuuuggacccugaggcc

SEQ ID NO: 2445891 - RNA, 19 nt, Human
cuuuggacccugaggccca

SEQ ID NO: 2445892 - RNA, 20 nt, Human
cuuuggaccuaaauggccuc

SEQ ID NO: 2445893 - RNA, 16 nt, Human
cuuuggcugcaugcga

SEQ ID NO: 2445894 - RNA, 17 nt, Human
cuuugcucuucaagaaa

SEQ ID NO: 2445895 - RNA, 13 nt, Human
cuuugcucugggu

SEQ ID NO: 2445896 - RNA, 14 nt, Human
cuuugcucuuucuu

SEQ ID NO: 2445897 - RNA, 16 nt, Human
cuuucccauggggagg

SEQ ID NO: 2445898 - RNA, 13 nt, Human
cuuugcuccuccc

SEQ ID NO: 2445899 - RNA, 16 nt, Human
cuuucccaucuuccaa

SEQ ID NO: 2445900 - RNA, 13 nt, Human
cuuugcugcuaca

SEQ ID NO: 2445901 - RNA, 11 nt, Human
cuuugcugcua

SEQ ID NO: 2445902 - RNA, 10 nt, Human
cuuugcugcu

SEQ ID NO: 2445903 - RNA, 19 nt, Human
cuuugcugcugaaggcuca

SEQ ID NO: 2445904 - RNA, 18 nt, Human
cuuugcugagccuguaaa

SEQ ID NO: 2445905 - RNA, 11 nt, Human
cuuugcugcca

SEQ ID NO: 2445906 - RNA, 21 nt, Human
cuuugcugugaggcuguccug

SEQ ID NO: 2445907 - RNA, 17 nt, Human
cuuugcugugaggcugu

SEQ ID NO: 2445908 - RNA, 11 nt, Human
cuuugcugcug

SEQ ID NO: 2445909 - RNA, 22 nt, Human
cuuugcugugaggcuguccugu

SEQ ID NO: 2445910 - RNA, 17 nt, Human
cuuuggaaggagugaga

SEQ ID NO: 2445911 - RNA, 15 nt, Human
cuuuggaaggaguga

SEQ ID NO: 2445912 - RNA, 17 nt, Human
cuuugugauuuuuguaa

SEQ ID NO: 2445913 - RNA, 18 nt, Human
cuuugugauuuuuguaau

SEQ ID NO: 2445914 - RNA, 19 nt, Human
cuuugugauuuuuguaauu

SEQ ID NO: 2445915 - RNA, 19 nt, Human
cuuugucuaaaacaauaaa

SEQ ID NO: 2445916 - RNA, 15 nt, Human
cuuugucuaaaacaa

SEQ ID NO: 2445917 - RNA, 15 nt, Human
cuuuguucuggcucu

SEQ ID NO: 2445918 - RNA, 14 nt, Human
cuuuguucuggcuc

SEQ ID NO: 2445919 - RNA, 18 nt, Human
cuuuguucauagcccagu

SEQ ID NO: 2445920 - RNA, 23 nt, Human
cuuuguucucagcucccccuguc

SEQ ID NO: 2445921 - RNA, 20 nt, Human
cuuuguucucagcucccccu

SEQ ID NO: 2445922 - RNA, 17 nt, Human
cuuuguucucagcuccc

SEQ ID NO: 2445923 - RNA, 14 nt, Human
cuuuguucucagcu

SEQ ID NO: 2445924 - RNA, 18 nt, Human
cuuuguucuaaagaugga

SEQ ID NO: 2445925 - RNA, 22 nt, Human
cuuuguccccaccgcagacagg

SEQ ID NO: 2445926 - RNA, 22 nt, Human
cuuugggagaaaacgucuugcu

SEQ ID NO: 2445927 - RNA, 13 nt, Human
cuuugggaauguu

SEQ ID NO: 2445928 - RNA, 23 nt, Human
cuuugggaauauuugaaucuugu

SEQ ID NO: 2445929 - RNA, 15 nt, Human
cuuugucccggggcu

SEQ ID NO: 2445930 - RNA, 14 nt, Human
cuuugugauuuuug

SEQ ID NO: 2445931 - RNA, 17 nt, Human
cuuuguccuuuuuguua

SEQ ID NO: 2445932 - RNA, 18 nt, Human
cuuuguccccaccgcaga

SEQ ID NO: 2445933 - RNA, 13 nt, Human
cuuugggaggcca

SEQ ID NO: 2445934 - RNA, 20 nt, Human
cuuugggaauauuugaaucu

SEQ ID NO: 2445935 - RNA, 19 nt, Human
cuuugggaauauuugaauc

SEQ ID NO: 2445936 - RNA, 18 nt, Human
cuuugggaauauuugaau

SEQ ID NO: 2445937 - RNA, 17 nt, Human
cuuugggaauauuugaa

SEQ ID NO: 2445938 - RNA, 13 nt, Human
cuuugggaagggg

SEQ ID NO: 2445939 - RNA, 22 nt, Human
cuuugggaaaggagaaguuaag

SEQ ID NO: 2445940 - RNA, 15 nt, Human
cuuugggaaaggaga

SEQ ID NO: 2445941 - RNA, 20 nt, Human
cuuuuacguccaucucuugu

SEQ ID NO: 2445942 - RNA, 14 nt, Human
cuuuuaauuuuccu

SEQ ID NO: 2445943 - RNA, 13 nt, Human
cuuuuacauacug

SEQ ID NO: 2445944 - RNA, 14 nt, Human
cuuuuaccaugccc

SEQ ID NO: 2445945 - RNA, 16 nt, Human
cuuuuaccaugccccu

SEQ ID NO: 2445946 - RNA, 14 nt, Human
cuuuuacauacugc

SEQ ID NO: 2445947 - RNA, 17 nt, Human
cuuuuacauacugcugu

SEQ ID NO: 2445948 - RNA, 18 nt, Human
cuuuguuuguugucagcu

SEQ ID NO: 2445949 - RNA, 20 nt, Human
cuuuguuuguugucagcuga

SEQ ID NO: 2445950 - RNA, 18 nt, Human
cuuuguuucguggggagg

SEQ ID NO: 2445951 - RNA, 17 nt, Human
cuuuguuucguggggag

SEQ ID NO: 2445952 - RNA, 17 nt, Human
cuuuguuucaaccaagu

SEQ ID NO: 2445953 - RNA, 18 nt, Human
cuuuucagcuucugcugg

SEQ ID NO: 2445954 - RNA, 17 nt, Human
cuuuucagcuucugcug

SEQ ID NO: 2445955 - RNA, 16 nt, Human
cuuuucagcuucugcu

SEQ ID NO: 2445956 - RNA, 14 nt, Human
cuuuucagcuucug

SEQ ID NO: 2445957 - RNA, 19 nt, Human
cuuuucagaagugagcuuu

SEQ ID NO: 2445958 - RNA, 21 nt, Human
cuuuucagaagugagcuuugc

SEQ ID NO: 2445959 - RNA, 23 nt, Human
cuuuucagcgauguaugcagcua

SEQ ID NO: 2445960 - RNA, 20 nt, Human
cuuuucauaaccuagccuua

SEQ ID NO: 2445961 - RNA, 20 nt, Human
cuuuucacugcuggcugccu

SEQ ID NO: 2445962 - RNA, 18 nt, Human
cuuuucacugcuggcugc

SEQ ID NO: 2445963 - RNA, 17 nt, Human
cuuuucacugcuggcug

SEQ ID NO: 2445964 - RNA, 23 nt, Human
cuuuuacucaugaucuugugaca

SEQ ID NO: 2445965 - RNA, 23 nt, Human
cuuuucagcuucugcugggcugg

SEQ ID NO: 2445966 - RNA, 19 nt, Human
cuuuucagcuucugcuggg

SEQ ID NO: 2445967 - RNA, 22 nt, Human
cuuuucauaaccuagccuuaga

SEQ ID NO: 2445968 - RNA, 17 nt, Human
cuuuucaucugggaaag

SEQ ID NO: 2445969 - RNA, 16 nt, Human
cuuuucaucugggaaa

SEQ ID NO: 2445970 - RNA, 13 nt, Human
cuuuucaucuggg

SEQ ID NO: 2445971 - RNA, 23 nt, Human
cuuuucuugcaugaggcuagugu

SEQ ID NO: 2445972 - RNA, 18 nt, Human
cuuuucuugcaugaggcu

SEQ ID NO: 2445973 - RNA, 13 nt, Human
cuuuucuguauuu

SEQ ID NO: 2445974 - RNA, 16 nt, Human
cuuuucuuucagccaa

SEQ ID NO: 2445975 - RNA, 19 nt, Human
cuuuucuggaauguaauca

SEQ ID NO: 2445976 - RNA, 19 nt, Human
cuuuucugcccuggcugcu

SEQ ID NO: 2445977 - RNA, 18 nt, Human
cuuuucuggaauguaauc

SEQ ID NO: 2445978 - RNA, 18 nt, Human
cuuuucuguccgagcuuu

SEQ ID NO: 2445979 - RNA, 23 nt, Human
cuuuucuguccgagcuuugaaaa

SEQ ID NO: 2445980 - RNA, 14 nt, Human
cuuuuccccggucc

SEQ ID NO: 2445981 - RNA, 18 nt, Human
cuuuucccacuguuuaag

SEQ ID NO: 2445982 - RNA, 22 nt, Human
cuuuucccucuuuggcuccccu

SEQ ID NO: 2445983 - RNA, 20 nt, Human
cuuuucccucuuuggcuccc

SEQ ID NO: 2445984 - RNA, 14 nt, Human
cuuuuccccugucc

SEQ ID NO: 2445985 - RNA, 15 nt, Human
cuuuucccugcuucc

SEQ ID NO: 2445986 - RNA, 14 nt, Human
cuuuucccugcuuc

SEQ ID NO: 2445987 - RNA, 13 nt, Human
cuuuucccugcuu

SEQ ID NO: 2445988 - RNA, 16 nt, Human
cuuuucuacccuagcc

SEQ ID NO: 2445989 - RNA, 18 nt, Human
cuuuucuaggcuacaauu

SEQ ID NO: 2445990 - RNA, 22 nt, Human
cuuuucuacccuagccauuccu

SEQ ID NO: 2445991 - RNA, 18 nt, Human
cuuuucuacccuagccau

SEQ ID NO: 2445992 - RNA, 17 nt, Human
cuuuucuacccuagcca

SEQ ID NO: 2445993 - RNA, 18 nt, Human
cuuuucccugcuuccagg

SEQ ID NO: 2445994 - RNA, 20 nt, Human
cuuuucccugcuuccaggaa

SEQ ID NO: 2445995 - RNA, 20 nt, Human
cuuuucuauuuucccucgcu

SEQ ID NO: 2445996 - RNA, 14 nt, Human
cuuuucuauuuucc

SEQ ID NO: 2445997 - RNA, 13 nt, Human
cuuuucuauuuuc

SEQ ID NO: 2445998 - RNA, 21 nt, Human
cuuuucuagcccgaauacaaa

SEQ ID NO: 2445999 - RNA, 17 nt, Human
cuuuucuccaauaucag

SEQ ID NO: 2446000 - RNA, 13 nt, Human
cuuuucucagcug

SEQ ID NO: 2446001 - RNA, 17 nt, Human
cuuuucucugguaauau

SEQ ID NO: 2446002 - RNA, 21 nt, Human
cuuuucuccaauaucagugcu

SEQ ID NO: 2446003 - RNA, 15 nt, Human
cuuuucuccaugagu

SEQ ID NO: 2446004 - RNA, 14 nt, Human
cuuuucucuuucuc

SEQ ID NO: 2446005 - RNA, 13 nt, Human
cuuuucucuuucu

SEQ ID NO: 2446006 - RNA, 14 nt, Human
gaaaacaugcuaca

SEQ ID NO: 2446007 - RNA, 15 nt, Human
gaaaacaugcuacac

SEQ ID NO: 2446008 - RNA, 12 nt, Human
gaaaacaugcua

SEQ ID NO: 2446009 - RNA, 19 nt, Human
gaaaacaucacugaaaugc

SEQ ID NO: 2446010 - RNA, 22 nt, Human
gaaaacaauaacgauaaaagac

SEQ ID NO: 2446011 - RNA, 13 nt, Human
gaaaacacauuuu

SEQ ID NO: 2446012 - RNA, 15 nt, Human
gaaaacaagugcugg

SEQ ID NO: 2446013 - RNA, 18 nt, Human
gaaaacauuguuccagau

SEQ ID NO: 2446014 - RNA, 11 nt, Human
gaaaacauugu

SEQ ID NO: 2446015 - RNA, 20 nt, Human
gaaaacauucugauuuggaa

SEQ ID NO: 2446016 - RNA, 12 nt, Human
gaaaacaucugg

SEQ ID NO: 2446017 - RNA, 17 nt, Human
gaaaacauuccauccuu

SEQ ID NO: 2446018 - RNA, 19 nt, Human
gaaaaccaagccguggcuu

SEQ ID NO: 2446019 - RNA, 18 nt, Human
gaaaaccaagccguggcu

SEQ ID NO: 2446020 - RNA, 12 nt, Human
gaaaacauuguu

SEQ ID NO: 2446021 - RNA, 21 nt, Human
gaaaaccaagccguggcuucc

SEQ ID NO: 2446022 - RNA, 16 nt, Human
gaaaaccaucacauga

SEQ ID NO: 2446023 - RNA, 16 nt, Human
gaaaacguggcugcuu

SEQ ID NO: 2446024 - RNA, 15 nt, Human
gaaaacguggcugcu

SEQ ID NO: 2446025 - RNA, 18 nt, Human
gaaaacguggcugcuuca

SEQ ID NO: 2446026 - RNA, 11 nt, Human
gaaaacccacc

SEQ ID NO: 2446027 - RNA, 12 nt, Human
gaaaacccagag

SEQ ID NO: 2446028 - RNA, 23 nt, Human
gaaaaaggaugcacagaguuguu

SEQ ID NO: 2446029 - RNA, 17 nt, Human
gaaaaaggaugcacaga

SEQ ID NO: 2446030 - RNA, 23 nt, Human
gaaaaagugauggagcagagcaa

SEQ ID NO: 2446031 - RNA, 12 nt, Human
gaaaaagugaug

SEQ ID NO: 2446032 - RNA, 21 nt, Human
gaaaaagucauccaaucuaac

SEQ ID NO: 2446033 - RNA, 19 nt, Human
gaaaaagucauccaaucua

SEQ ID NO: 2446034 - RNA, 19 nt, Human
gaaaaaguuaaacauugaa

SEQ ID NO: 2446035 - RNA, 21 nt, Human
cuuuuuugauaaaguuucuca

SEQ ID NO: 2446036 - RNA, 18 nt, Human
gaaaaagucauccaaucu

SEQ ID NO: 2446037 - RNA, 15 nt, Human
cuuuuuuggcugcug

SEQ ID NO: 2446038 - RNA, 14 nt, Human
cuuuuuuggcugcu

SEQ ID NO: 2446039 - RNA, 16 nt, Human
cuuuuuucuuauuuaa

SEQ ID NO: 2446040 - RNA, 19 nt, Human
cuuuuuugauaaaguuucu

SEQ ID NO: 2446041 - RNA, 18 nt, Human
cuuuuuugauaaaguuuc

SEQ ID NO: 2446042 - RNA, 17 nt, Human
cuuuuuugauaaaguuu

SEQ ID NO: 2446043 - RNA, 16 nt, Human
cuuuuuucuuuaagau

SEQ ID NO: 2446044 - RNA, 13 nt, Human
cuuuuuuccuccu

SEQ ID NO: 2446045 - RNA, 20 nt, Human
cuuuuuugaaauaauaaauc

SEQ ID NO: 2446046 - RNA, 21 nt, Human
cuuuugagugccuuacacaau

SEQ ID NO: 2446047 - RNA, 16 nt, Human
cuuuugagcauuuaga

SEQ ID NO: 2446048 - RNA, 22 nt, Human
cuuuucuuuagagcauugccau

SEQ ID NO: 2446049 - RNA, 13 nt, Human
cuuuugacaugug

SEQ ID NO: 2446050 - RNA, 10 nt, Human
cuuuugaccu

SEQ ID NO: 2446051 - RNA, 14 nt, Human
cuuuugacaugugg

SEQ ID NO: 2446052 - RNA, 18 nt, Human
cuuuugacuuaaagcaga

SEQ ID NO: 2446053 - RNA, 18 nt, Human
cuuuuuuccuuaauccag

SEQ ID NO: 2446054 - RNA, 14 nt, Human
cuuuuuucuaaagu

SEQ ID NO: 2446055 - RNA, 15 nt, Human
cuuuuuucacuacau

SEQ ID NO: 2446056 - RNA, 22 nt, Human
cuuuuuucauggacacuuugaa

SEQ ID NO: 2446057 - RNA, 19 nt, Human
gaaaagcuauuagccagga

SEQ ID NO: 2446058 - RNA, 17 nt, Human
gaaaagcuauuagccag

SEQ ID NO: 2446059 - RNA, 14 nt, Human
gaaaagcuauuagc

SEQ ID NO: 2446060 - RNA, 11 nt, Human
gaaaagcuauu

SEQ ID NO: 2446061 - RNA, 22 nt, Human
gaaaagcuauuagccaggauca

SEQ ID NO: 2446062 - RNA, 20 nt, Human
gaaaagcuauuagccaggau

SEQ ID NO: 2446063 - RNA, 14 nt, Human
gaaaagcugaaucc

SEQ ID NO: 2446064 - RNA, 18 nt, Human
gaaaauaagaauagaaau

SEQ ID NO: 2446065 - RNA, 18 nt, Human
gaaaauaaucauucuuau

SEQ ID NO: 2446066 - RNA, 19 nt, Human
gaaaauauacuguaaagaa

SEQ ID NO: 2446067 - RNA, 20 nt, Human
gaaaauauacuguaaagaaa

SEQ ID NO: 2446068 - RNA, 18 nt, Human
gaaaauauacuguaaaga

SEQ ID NO: 2446069 - RNA, 13 nt, Human
gaaaauaauuguu

SEQ ID NO: 2446070 - RNA, 19 nt, Human
gaaaauaacgauaaaagac

SEQ ID NO: 2446071 - RNA, 17 nt, Human
gaaaagcugcugacagu

SEQ ID NO: 2446072 - RNA, 13 nt, Human
gaaaagcugcuga

SEQ ID NO: 2446073 - RNA, 19 nt, Human
gaaaaucuuauaauuuaaa

SEQ ID NO: 2446074 - RNA, 16 nt, Human
gaaaaucagccugcuc

SEQ ID NO: 2446075 - RNA, 18 nt, Human
gaaaaucagccugcucca

SEQ ID NO: 2446076 - RNA, 17 nt, Human
gaaaauauuauguguuu

SEQ ID NO: 2446077 - RNA, 14 nt, Human
gaaaaucagccugc

SEQ ID NO: 2446078 - RNA, 12 nt, Human
gaaaauaucacu

SEQ ID NO: 2446079 - RNA, 21 nt, Human
gaaaauauacuguaaagaaag

SEQ ID NO: 2446080 - RNA, 23 nt, Human
gaaaauauacuguaaagaaagag

SEQ ID NO: 2446081 - RNA, 12 nt, Human
gaaaauaugcau

SEQ ID NO: 2446082 - RNA, 15 nt, Human
gaaaauaugcaucua

SEQ ID NO: 2446083 - RNA, 14 nt, Human
gaaacacagaaacc

SEQ ID NO: 2446084 - RNA, 15 nt, Human
gaaaaucaaauacau

SEQ ID NO: 2446085 - RNA, 14 nt, Human
gaaaaucaaauaca

SEQ ID NO: 2446086 - RNA, 18 nt, Human
gaaaauauuuuuuauaua

SEQ ID NO: 2446087 - RNA, 19 nt, Human
gaaaaucaaauacauacuu

SEQ ID NO: 2446088 - RNA, 20 nt, Human
gaaaaucuuauaauuuaaaa

SEQ ID NO: 2446089 - RNA, 21 nt, Human
gaaacaccuucucuggagcca

SEQ ID NO: 2446090 - RNA, 18 nt, Human
gaaacacccucacacugg

SEQ ID NO: 2446091 - RNA, 19 nt, Human
gaaacacccucacacuggg

SEQ ID NO: 2446092 - RNA, 22 nt, Human
gaaacacccucacacugggacu

SEQ ID NO: 2446093 - RNA, 14 nt, Human
gaaacaccuucucu

SEQ ID NO: 2446094 - RNA, 18 nt, Human
gaaacacuggggcuggca

SEQ ID NO: 2446095 - RNA, 22 nt, Human
gaaacacugggcuucuagaacc

SEQ ID NO: 2446096 - RNA, 15 nt, Human
gaaacagcucgacuu

SEQ ID NO: 2446097 - RNA, 20 nt, Human
gaaacagcucgacuuuaaaa

SEQ ID NO: 2446098 - RNA, 18 nt, Human
gaaacagcuaaugggaca

SEQ ID NO: 2446099 - RNA, 20 nt, Human
gaaacagaucuccuggcaaa

SEQ ID NO: 2446100 - RNA, 20 nt, Human
gaaacagaggagagucccag

SEQ ID NO: 2446101 - RNA, 16 nt, Human
gaaacacuuugcauaa

SEQ ID NO: 2446102 - RNA, 15 nt, Human
gaaacacuggggcug

SEQ ID NO: 2446103 - RNA, 14 nt, Human
gaaacagaaacaaa

SEQ ID NO: 2446104 - RNA, 22 nt, Human
gaaacagaaacaaaaacacuaa

SEQ ID NO: 2446105 - RNA, 14 nt, Human
gaaacagagacagg

SEQ ID NO: 2446106 - RNA, 16 nt, Human
gaaacagagacaggcc

SEQ ID NO: 2446107 - RNA, 17 nt, Human
gaaacagagacaggccc

SEQ ID NO: 2446108 - RNA, 19 nt, Human
gaaacagaggagaguccca

SEQ ID NO: 2446109 - RNA, 19 nt, Human
gaaacagagacaggcccaa

SEQ ID NO: 2446110 - RNA, 12 nt, Human
gaaacagaggcu

SEQ ID NO: 2446111 - RNA, 18 nt, Human
gaauacuguuaaaggaaa

SEQ ID NO: 2446112 - RNA, 20 nt, Human
gaauacuguuaaaggaaaaa

SEQ ID NO: 2446113 - RNA, 19 nt, Human
gaauacuuuugcccuuuga

SEQ ID NO: 2446114 - RNA, 14 nt, Human
gaauacuuuuuaca

SEQ ID NO: 2446115 - RNA, 20 nt, Human
gaauacuuuuuacaauuaaa

SEQ ID NO: 2446116 - RNA, 23 nt, Human
gaauagaaauaaaggaugugauu

SEQ ID NO: 2446117 - RNA, 14 nt, Human
gaauacuuuauaaa

SEQ ID NO: 2446118 - RNA, 22 nt, Human
gaauaauguaaaauguugaaua

SEQ ID NO: 2446119 - RNA, 14 nt, Human
gaauaauguaaaau

SEQ ID NO: 2446120 - RNA, 18 nt, Human
gaauaauuauuuauuuaa

SEQ ID NO: 2446121 - RNA, 13 nt, Human
gaauaauuauuua

SEQ ID NO: 2446122 - RNA, 20 nt, Human
gaauaauuauuuauuuaaua

SEQ ID NO: 2446123 - RNA, 21 nt, Human
gaauaaugguaccagauaaaa

SEQ ID NO: 2446124 - RNA, 20 nt, Human
gaauaaugguaccagauaaa

SEQ ID NO: 2446125 - RNA, 13 nt, Human
gaauaaugggcuu

SEQ ID NO: 2446126 - RNA, 22 nt, Human
gaauaaucuuuggguaacuuca

SEQ ID NO: 2446127 - RNA, 14 nt, Human
gaauaaugaaugga

SEQ ID NO: 2446128 - RNA, 16 nt, Human
gaauaaguuauugcag

SEQ ID NO: 2446129 - RNA, 14 nt, Human
gaauaaguuauugc

SEQ ID NO: 2446130 - RNA, 13 nt, Human
gaauaaguuauug

SEQ ID NO: 2446131 - RNA, 12 nt, Human
gaauaaguuauu

SEQ ID NO: 2446132 - RNA, 20 nt, Human
gaauaagugccaggauggaa

SEQ ID NO: 2446133 - RNA, 20 nt, Human
gaauaauccuaaacauauga

SEQ ID NO: 2446134 - RNA, 19 nt, Human
gaauaaguuauugcaguuu

SEQ ID NO: 2446135 - RNA, 18 nt, Human
gaauaaguuauugcaguu

SEQ ID NO: 2446136 - RNA, 21 nt, Human
gaauaauaaaaguauauauau

SEQ ID NO: 2446137 - RNA, 19 nt, Human
gaauaauaaaaguauauau

SEQ ID NO: 2446138 - RNA, 15 nt, Human
gaauaaucuuugggu

SEQ ID NO: 2446139 - RNA, 14 nt, Human
gaauaaaugucuuu

SEQ ID NO: 2446140 - RNA, 11 nt, Human
gaauaaauguc

SEQ ID NO: 2446141 - RNA, 21 nt, Human
gaauaaauaugccucuccuuu

SEQ ID NO: 2446142 - RNA, 15 nt, Human
gaauaaauugcuccu

SEQ ID NO: 2446143 - RNA, 20 nt, Human
gaauaagccauucugacuca

SEQ ID NO: 2446144 - RNA, 21 nt, Human
gaauaagccauucugacucau

SEQ ID NO: 2446145 - RNA, 22 nt, Human
gaauaagccauucugacucaua

SEQ ID NO: 2446146 - RNA, 12 nt, Human
gaauaaggccuu

SEQ ID NO: 2446147 - RNA, 14 nt, Human
gaauaacauguaau

SEQ ID NO: 2446148 - RNA, 13 nt, Human
gaauaaaauugua

SEQ ID NO: 2446149 - RNA, 21 nt, Human
gaauaaaauuauuuuggauuu

SEQ ID NO: 2446150 - RNA, 17 nt, Human
gaauaaaauuauuuugg

SEQ ID NO: 2446151 - RNA, 23 nt, Human
gaauaaaauguugaaaagucaaa

SEQ ID NO: 2446152 - RNA, 12 nt, Human
gaauaaacuaga

SEQ ID NO: 2446153 - RNA, 22 nt, Human
gaauaaaauuguaaaauuguau

SEQ ID NO: 2446154 - RNA, 16 nt, Human
gaauaaacuagauuac

SEQ ID NO: 2446155 - RNA, 19 nt, Human
gaauaaacuagauuacauu

SEQ ID NO: 2446156 - RNA, 15 nt, Human
gaauaaagcaauuuu

SEQ ID NO: 2446157 - RNA, 14 nt, Human
gaauaaagcaauuu

SEQ ID NO: 2446158 - RNA, 13 nt, Human
gaauaaagcaauu

SEQ ID NO: 2446159 - RNA, 12 nt, Human
gaauaaagcaau

SEQ ID NO: 2446160 - RNA, 14 nt, Human
gaauaaagacaccu

SEQ ID NO: 2446161 - RNA, 22 nt, Human
gaauaaagcaauuuuccuugaa

SEQ ID NO: 2446162 - RNA, 19 nt, Human
gaauaaagcaauuuuccuu

SEQ ID NO: 2446163 - RNA, 18 nt, Human
gaauaaagcaauuuuccu

SEQ ID NO: 2446164 - RNA, 17 nt, Human
gaauaaagcaauuuucc

SEQ ID NO: 2446165 - RNA, 16 nt, Human
gaauaaagcaauuuuc

SEQ ID NO: 2446166 - RNA, 21 nt, Human
gaauaaagcaauuuuccuuga

SEQ ID NO: 2446167 - RNA, 20 nt, Human
gaauaaagcaauuuuccuug

SEQ ID NO: 2446168 - RNA, 17 nt, Human
gaauaaagccugcuuuu

SEQ ID NO: 2446169 - RNA, 13 nt, Human
gaauaaaguucug

SEQ ID NO: 2446170 - RNA, 14 nt, Human
gaauaaaguucuga

SEQ ID NO: 2446171 - RNA, 20 nt, Human
gaauaaaguucugaguguuu

SEQ ID NO: 2446172 - RNA, 19 nt, Human
gaauaaauaugccucuccu

SEQ ID NO: 2446173 - RNA, 16 nt, Human
gaauaaauaugccucu

SEQ ID NO: 2446174 - RNA, 12 nt, Human
gaauaaauaugc

SEQ ID NO: 2446175 - RNA, 11 nt, Human
gaauaaauaug

SEQ ID NO: 2446176 - RNA, 22 nt, Human
gaauaaauaaauguaucuuauu

SEQ ID NO: 2446177 - RNA, 14 nt, Human
gaauaaaguugaag

SEQ ID NO: 2446178 - RNA, 16 nt, Human
gaauaaaguugaagcu

SEQ ID NO: 2446179 - RNA, 17 nt, Human
gaaguuuacauuguaaa

SEQ ID NO: 2446180 - RNA, 16 nt, Human
gaaguuuacauuguaa

SEQ ID NO: 2446181 - RNA, 20 nt, Human
gaagguuuguguuuuucugc

SEQ ID NO: 2446182 - RNA, 12 nt, Human
gaagguuguaag

SEQ ID NO: 2446183 - RNA, 13 nt, Human
gaagguugaagag

SEQ ID NO: 2446184 - RNA, 15 nt, Human
gaagguugugaugaa

SEQ ID NO: 2446185 - RNA, 20 nt, Human
gaagguuugguguguggaga

SEQ ID NO: 2446186 - RNA, 20 nt, Human
gaagguuuacaauuuacaaa

SEQ ID NO: 2446187 - RNA, 20 nt, Human
gaagguuuacucuguggcca

SEQ ID NO: 2446188 - RNA, 16 nt, Human
gaagguuuguauauug

SEQ ID NO: 2446189 - RNA, 16 nt, Human
gaagguuuguguuuuu

SEQ ID NO: 2446190 - RNA, 15 nt, Human
gaagguuuguauauu

SEQ ID NO: 2446191 - RNA, 12 nt, Human
gaauaaaauuuu

SEQ ID NO: 2446192 - RNA, 21 nt, Human
gaauaaaauguugaaaaguca

SEQ ID NO: 2446193 - RNA, 17 nt, Human
gaauaaaauguugaaaa

SEQ ID NO: 2446194 - RNA, 15 nt, Human
gaauaaaauguugaa

SEQ ID NO: 2446195 - RNA, 21 nt, Human
gaaguuuccuuggcuggugca

SEQ ID NO: 2446196 - RNA, 12 nt, Human
gaaguuucugcc

SEQ ID NO: 2446197 - RNA, 14 nt, Human
gaaguuucacauga

SEQ ID NO: 2446198 - RNA, 18 nt, Human
gaaguuuaauugacuuau

SEQ ID NO: 2446199 - RNA, 15 nt, Human
gaauagaugcugacu

SEQ ID NO: 2446200 - RNA, 19 nt, Human
gaauagcaaggugcucaca

SEQ ID NO: 2446201 - RNA, 15 nt, Human
gaauagccacauuug

SEQ ID NO: 2446202 - RNA, 18 nt, Human
gaauagccacauuuggaa

SEQ ID NO: 2446203 - RNA, 23 nt, Human
gaauagccacauuuggaauacuu

SEQ ID NO: 2446204 - RNA, 14 nt, Human
gaauagcugggacu

SEQ ID NO: 2446205 - RNA, 18 nt, Human
gaaucacucuuguggaug

SEQ ID NO: 2446206 - RNA, 19 nt, Human
gaaucacucuuguggaugu

SEQ ID NO: 2446207 - RNA, 13 nt, Human
gaaucagaaacag

SEQ ID NO: 2446208 - RNA, 21 nt, Human
gaaucaauaauauauuuucug

SEQ ID NO: 2446209 - RNA, 11 nt, Human
gaaucaauaau

SEQ ID NO: 2446210 - RNA, 15 nt, Human
gaauagcugggacua

SEQ ID NO: 2446211 - RNA, 17 nt, Human
gaauccacucccaggca

SEQ ID NO: 2446212 - RNA, 18 nt, Human
gaaucccccuugccaccc

SEQ ID NO: 2446213 - RNA, 17 nt, Human
gaaucccccuugccacc

SEQ ID NO: 2446214 - RNA, 14 nt, Human
gaaucccccuugcc

SEQ ID NO: 2446215 - RNA, 17 nt, Human
gaauccccucccuguca

SEQ ID NO: 2446216 - RNA, 16 nt, Human
gaauccccgaaggugc

SEQ ID NO: 2446217 - RNA, 23 nt, Human
gaaucccccuugccaccccaccc

SEQ ID NO: 2446218 - RNA, 16 nt, Human
gaauccccucccuguc

SEQ ID NO: 2446219 - RNA, 24 nt, Human
gaauccacccauccuaccaaugca

SEQ ID NO: 2446220 - RNA, 15 nt, Human
gaauccacccauccu

SEQ ID NO: 2446221 - RNA, 17 nt, Human
gaauccaagugaacacu

SEQ ID NO: 2446222 - RNA, 16 nt, Human
gaauccaagcgagguc

SEQ ID NO: 2446223 - RNA, 13 nt, Human
gaauccaaacuug

SEQ ID NO: 2446224 - RNA, 12 nt, Human
gaauccaaacuu

SEQ ID NO: 2446225 - RNA, 22 nt, Human
gaaucauuucuauuucuccucc

SEQ ID NO: 2446226 - RNA, 14 nt, Human
gaaucauuuguuca

SEQ ID NO: 2446227 - RNA, 23 nt, Human
gaaucauuuguucaaagcuguug

SEQ ID NO: 2446228 - RNA, 19 nt, Human
gaaucagaucauuucaaaa

SEQ ID NO: 2446229 - RNA, 13 nt, Human
gaaucagaacuca

SEQ ID NO: 2446230 - RNA, 18 nt, Human
gaaucagacccuacccca

SEQ ID NO: 2446231 - RNA, 22 nt, Human
gaaucagacccuaccccaccac

SEQ ID NO: 2446232 - RNA, 23 nt, Human
gaaucagacccuaccccaccacg

SEQ ID NO: 2446233 - RNA, 19 nt, Human
gaaucagacuucacacugc

SEQ ID NO: 2446234 - RNA, 14 nt, Human
gaaugaaagaguaa

SEQ ID NO: 2446235 - RNA, 12 nt, Human
gaaugaaagagu

SEQ ID NO: 2446236 - RNA, 21 nt, Human
gaaugaaacccccacacacac

SEQ ID NO: 2446237 - RNA, 21 nt, Human
gaaugccucaaugugaccagg

SEQ ID NO: 2446238 - RNA, 19 nt, Human
gaaugaaagggcccagaga

SEQ ID NO: 2446239 - RNA, 14 nt, Human
gaaugccuccugca

SEQ ID NO: 2446240 - RNA, 14 nt, Human
gaaugaaagcuccu

SEQ ID NO: 2446241 - RNA, 22 nt, Human
gaaugaaagaguaaaggaaaug

SEQ ID NO: 2446242 - RNA, 22 nt, Human
gaaugccucaaugugaccaggg

SEQ ID NO: 2446243 - RNA, 13 nt, Human
gaaugccuccucc

SEQ ID NO: 2446244 - RNA, 18 nt, Human
gaaugccugagugccugg

SEQ ID NO: 2446245 - RNA, 16 nt, Human
gaaugccugagugccu

SEQ ID NO: 2446246 - RNA, 19 nt, Human
gaaugccugagugccuggc

SEQ ID NO: 2446247 - RNA, 23 nt, Human
gaaugcggcaagaaggaauugac

SEQ ID NO: 2446248 - RNA, 22 nt, Human
gaaugcucaaguuuuucagaaa

SEQ ID NO: 2446249 - RNA, 14 nt, Human
gaaucuugucucaa

SEQ ID NO: 2446250 - RNA, 13 nt, Human
gaaucuugucuca

SEQ ID NO: 2446251 - RNA, 20 nt, Human
gaaucuugucucaaugcuca

SEQ ID NO: 2446252 - RNA, 18 nt, Human
gaaucuugucucaaugcu

SEQ ID NO: 2446253 - RNA, 16 nt, Human
gaaucuugucucaaug

SEQ ID NO: 2446254 - RNA, 15 nt, Human
gaaucuugucucaau

SEQ ID NO: 2446255 - RNA, 19 nt, Human
gaaugaaacccccacacac

SEQ ID NO: 2446256 - RNA, 20 nt, Human
gaaugaaacccccacacaca

SEQ ID NO: 2446257 - RNA, 16 nt, Human
gaaugaaacccccaca

SEQ ID NO: 2446258 - RNA, 21 nt, Human
gaaucuugucucaaugcucau

SEQ ID NO: 2446259 - RNA, 14 nt, Human
gaaugaaagggccc

SEQ ID NO: 2446260 - RNA, 20 nt, Human
gaauccuaggcuccacccca

SEQ ID NO: 2446261 - RNA, 15 nt, Human
gaauccuagggccug

SEQ ID NO: 2446262 - RNA, 23 nt, Human
gaauccuacacaccuaagggaca

SEQ ID NO: 2446263 - RNA, 22 nt, Human
gaauccuguccucagcuucuua

SEQ ID NO: 2446264 - RNA, 17 nt, Human
gaaucuauauuuaacaa

SEQ ID NO: 2446265 - RNA, 16 nt, Human
gaaucuauuuaaguaa

SEQ ID NO: 2446266 - RNA, 15 nt, Human
gaaucuauuuaagua

SEQ ID NO: 2446267 - RNA, 19 nt, Human
gaaucuaugccaaagauca

SEQ ID NO: 2446268 - RNA, 15 nt, Human
gaaucuaugccaaag

SEQ ID NO: 2446269 - RNA, 12 nt, Human
gaaucuaugcca

SEQ ID NO: 2446270 - RNA, 21 nt, Human
gaaucuaucugcuuaugcagu

SEQ ID NO: 2446271 - RNA, 15 nt, Human
gaaucuauuauacug

SEQ ID NO: 2446272 - RNA, 22 nt, Human
gaaucuaugccaaagaucacuu

SEQ ID NO: 2446273 - RNA, 13 nt, Human
gaaucuauuuaag

SEQ ID NO: 2446274 - RNA, 22 nt, Human
gaaucuggagaccagggagccu

SEQ ID NO: 2446275 - RNA, 16 nt, Human
gaaucuggagaccagg

SEQ ID NO: 2446276 - RNA, 18 nt, Human
gaaucuggagaccaggga

SEQ ID NO: 2446277 - RNA, 16 nt, Human
gaaucucaaauaacua

SEQ ID NO: 2446278 - RNA, 21 nt, Human
gaaucuauuauacuguauuaa

SEQ ID NO: 2446279 - RNA, 22 nt, Human
gaagcccaggaaaggcuccagg

SEQ ID NO: 2446280 - RNA, 21 nt, Human
gaagcccaggaaaggcuccag

SEQ ID NO: 2446281 - RNA, 20 nt, Human
gaagcccaggaaaggcucca

SEQ ID NO: 2446282 - RNA, 18 nt, Human
gaagcccaauaaaccucu

SEQ ID NO: 2446283 - RNA, 19 nt, Human
gaagcccaauaaaccucuu

SEQ ID NO: 2446284 - RNA, 21 nt, Human
gaagccgcuggggccaguugg

SEQ ID NO: 2446285 - RNA, 18 nt, Human
gaagccggcggcccaagc

SEQ ID NO: 2446286 - RNA, 15 nt, Human
gaagccggcggccca

SEQ ID NO: 2446287 - RNA, 16 nt, Human
gaagccggaggguguu

SEQ ID NO: 2446288 - RNA, 20 nt, Human
gaagccggcggcccaagccc

SEQ ID NO: 2446289 - RNA, 16 nt, Human
gaagccgggaacagac

SEQ ID NO: 2446290 - RNA, 20 nt, Human
gaagccgugcucgccccagc

SEQ ID NO: 2446291 - RNA, 16 nt, Human
gaagccgugcccugcc

SEQ ID NO: 2446292 - RNA, 17 nt, Human
gaagccgugcccugccc

SEQ ID NO: 2446293 - RNA, 19 nt, Human
gaagccgugcccugccccc

SEQ ID NO: 2446294 - RNA, 12 nt, Human
gaagccucuggc

SEQ ID NO: 2446295 - RNA, 10 nt, Human
gaagccuuug

SEQ ID NO: 2446296 - RNA, 11 nt, Human
gaagccuuugu

SEQ ID NO: 2446297 - RNA, 13 nt, Human
gaagccuuuggga

SEQ ID NO: 2446298 - RNA, 15 nt, Human
gaagccuuuccugua

SEQ ID NO: 2446299 - RNA, 18 nt, Human
gaagccuuugggaagggg

SEQ ID NO: 2446300 - RNA, 16 nt, Human
gaagcgagcacugacc

SEQ ID NO: 2446301 - RNA, 21 nt, Human
gaagccuuggggcugaugcag

SEQ ID NO: 2446302 - RNA, 16 nt, Human
gaagccuccccagcuc

SEQ ID NO: 2446303 - RNA, 17 nt, Human
gaagccucuggcuagag

SEQ ID NO: 2446304 - RNA, 13 nt, Human
gaagccucuggcu

SEQ ID NO: 2446305 - RNA, 14 nt, Human
gaagccucuggcua

SEQ ID NO: 2446306 - RNA, 22 nt, Human
gaagcuuguguauccauuauca

SEQ ID NO: 2446307 - RNA, 23 nt, Human
gaagcuucuuaaaugagaaggaa

SEQ ID NO: 2446308 - RNA, 22 nt, Human
gaagcgcgccacucgcuucccc

SEQ ID NO: 2446309 - RNA, 15 nt, Human
gaagcuuugaaggcc

SEQ ID NO: 2446310 - RNA, 14 nt, Human
gaagcuuucugucu

SEQ ID NO: 2446311 - RNA, 14 nt, Human
gaagcuuucaguau

SEQ ID NO: 2446312 - RNA, 23 nt, Human
gaagcuuguguauccauuaucau

SEQ ID NO: 2446313 - RNA, 18 nt, Human
gaagcuuuuaugugaaac

SEQ ID NO: 2446314 - RNA, 15 nt, Human
gaaggaaaaaugugu

SEQ ID NO: 2446315 - RNA, 18 nt, Human
gaaggaaaaggcagggag

SEQ ID NO: 2446316 - RNA, 17 nt, Human
gaagacugcauuauauu

SEQ ID NO: 2446317 - RNA, 15 nt, Human
gaagaagagggagag

SEQ ID NO: 2446318 - RNA, 21 nt, Human
gaagacucauucuucuguacg

SEQ ID NO: 2446319 - RNA, 19 nt, Human
gaagacucauucuucugua

SEQ ID NO: 2446320 - RNA, 16 nt, Human
gaagccagcaggcucu

SEQ ID NO: 2446321 - RNA, 15 nt, Human
gaagccagcaggcuc

SEQ ID NO: 2446322 - RNA, 22 nt, Human
gaagccacgguguucugugaua

SEQ ID NO: 2446323 - RNA, 23 nt, Human
gaagacucuaccagacuguguau

SEQ ID NO: 2446324 - RNA, 15 nt, Human
gaagacucuaccaga

SEQ ID NO: 2446325 - RNA, 13 nt, Human
gaagacucuacca

SEQ ID NO: 2446326 - RNA, 15 nt, Human
gaagccacugaagcu

SEQ ID NO: 2446327 - RNA, 18 nt, Human
gaagccacugaagcuggg

SEQ ID NO: 2446328 - RNA, 19 nt, Human
gaagccaggaauuucccag

SEQ ID NO: 2446329 - RNA, 21 nt, Human
gaagccaggaauuucccagga

SEQ ID NO: 2446330 - RNA, 23 nt, Human
gaagccaggaauuucccaggacc

SEQ ID NO: 2446331 - RNA, 24 nt, Human
gaagccaggaauuucccaggaccc

SEQ ID NO: 2446332 - RNA, 22 nt, Human
gaagccagcuuucccugccucu

SEQ ID NO: 2446333 - RNA, 12 nt, Human
gaagccagccuu

SEQ ID NO: 2446334 - RNA, 20 nt, Human
gaagccagccuucuuccauc

SEQ ID NO: 2446335 - RNA, 22 nt, Human
gaagccacuuucuacaggccag

SEQ ID NO: 2446336 - RNA, 23 nt, Human
gaagccagcaggcucucaggcca

SEQ ID NO: 2446337 - RNA, 10 nt, Human
gaagcccaga

SEQ ID NO: 2446338 - RNA, 12 nt, Human
gaagcccagaau

SEQ ID NO: 2446339 - RNA, 14 nt, Human
gaagccauugucuu

SEQ ID NO: 2446340 - RNA, 13 nt, Human
gaagccauugucu

SEQ ID NO: 2446341 - RNA, 15 nt, Human
gaagcccaagugaaa

SEQ ID NO: 2446342 - RNA, 16 nt, Human
gaagcccaagugaaau

SEQ ID NO: 2446343 - RNA, 16 nt, Human
gaagccauugucuucg

SEQ ID NO: 2446344 - RNA, 14 nt, Human
gaagcccaauaaac

SEQ ID NO: 2446345 - RNA, 14 nt, Human
gaagccaggagcaa

SEQ ID NO: 2446346 - RNA, 13 nt, Human
gaagccaggagca

SEQ ID NO: 2446347 - RNA, 12 nt, Human
gaagccaggagc

SEQ ID NO: 2446348 - RNA, 18 nt, Human
gaagccaggagcaaaugu

SEQ ID NO: 2446349 - RNA, 15 nt, Human
gaagccaggagcaaa

SEQ ID NO: 2446350 - RNA, 22 nt, Human
gaagccaggagcaaauguuucu

SEQ ID NO: 2446351 - RNA, 18 nt, Human
gaagccagugcggcaggu

SEQ ID NO: 2446352 - RNA, 12 nt, Human
gaagccauuguc

SEQ ID NO: 2446353 - RNA, 12 nt, Human
gaaggauacaaa

SEQ ID NO: 2446354 - RNA, 19 nt, Human
gaaggauacaaaagcaugu

SEQ ID NO: 2446355 - RNA, 14 nt, Human
gaaggcaaaugacu

SEQ ID NO: 2446356 - RNA, 15 nt, Human
gaaggcaaagcacga

SEQ ID NO: 2446357 - RNA, 21 nt, Human
gaaggauacaaaagcauguga

SEQ ID NO: 2446358 - RNA, 13 nt, Human
gaaggaguuuuau

SEQ ID NO: 2446359 - RNA, 20 nt, Human
gaaggagccccauuccuggg

SEQ ID NO: 2446360 - RNA, 21 nt, Human
gaaggagccccauuccuggga

SEQ ID NO: 2446361 - RNA, 22 nt, Human
gaaggagccccauuccugggaa

SEQ ID NO: 2446362 - RNA, 16 nt, Human
gaaggagagaaagugg

SEQ ID NO: 2446363 - RNA, 13 nt, Human
gaaggagagaaag

SEQ ID NO: 2446364 - RNA, 12 nt, Human
gaaggagagaaa

SEQ ID NO: 2446365 - RNA, 23 nt, Human
gaaggagacucaccucugccuca

SEQ ID NO: 2446366 - RNA, 21 nt, Human
gaaggagagaaagugggugag

SEQ ID NO: 2446367 - RNA, 20 nt, Human
gaaggagagaaaguggguga

SEQ ID NO: 2446368 - RNA, 15 nt, Human
gaaggagagaagggg

SEQ ID NO: 2446369 - RNA, 16 nt, Human
gaaggagagaagggga

SEQ ID NO: 2446370 - RNA, 18 nt, Human
gaaggagagaaggggagg

SEQ ID NO: 2446371 - RNA, 20 nt, Human
gaaggagagaaggggaggag

SEQ ID NO: 2446372 - RNA, 13 nt, Human
gaaggagagccug

SEQ ID NO: 2446373 - RNA, 15 nt, Human
gaaggagagccugcu

SEQ ID NO: 2446374 - RNA, 16 nt, Human
gaaggagagccugcug

SEQ ID NO: 2446375 - RNA, 17 nt, Human
gaaggaaacccagcucu

SEQ ID NO: 2446376 - RNA, 14 nt, Human
gaaggaaacccagc

SEQ ID NO: 2446377 - RNA, 18 nt, Human
gaaggaaacccagcucug

SEQ ID NO: 2446378 - RNA, 14 nt, Human
gaaggaaaaugaua

SEQ ID NO: 2446379 - RNA, 23 nt, Human
gaaggacccggaggggccuggca

SEQ ID NO: 2446380 - RNA, 17 nt, Human
gaaggagaaggaaggag

SEQ ID NO: 2446381 - RNA, 15 nt, Human
gaaggagacagagcu

SEQ ID NO: 2446382 - RNA, 18 nt, Human
gaaggagacagagcuggu

SEQ ID NO: 2446383 - RNA, 15 nt, Human
gaaggagacucaccu

SEQ ID NO: 2446384 - RNA, 17 nt, Human
gaaggagacucaccucu

SEQ ID NO: 2446385 - RNA, 20 nt, Human
gaaggagacucaccucugcc

SEQ ID NO: 2446386 - RNA, 22 nt, Human
gaaggagacucaccucugccuc

SEQ ID NO: 2446387 - RNA, 19 nt, Human
gaaggacugugacaggcag

SEQ ID NO: 2446388 - RNA, 18 nt, Human
gaaggacugugacaggca

SEQ ID NO: 2446389 - RNA, 22 nt, Human
gaaggacugugacaggcagcag

SEQ ID NO: 2446390 - RNA, 21 nt, Human
gaaggacugugacaggcagca

SEQ ID NO: 2446391 - RNA, 23 nt, Human
gaaggacugugacaggcagcaga

SEQ ID NO: 2446392 - RNA, 16 nt, Human
gaaggagaaggaagga

SEQ ID NO: 2446393 - RNA, 15 nt, Human
gaaggaccuccugag

SEQ ID NO: 2446394 - RNA, 20 nt, Human
gaaggaaaaggcagggagcg

SEQ ID NO: 2446395 - RNA, 15 nt, Human
gaaggccccgcccag

SEQ ID NO: 2446396 - RNA, 14 nt, Human
gaaggccccgccca

SEQ ID NO: 2446397 - RNA, 16 nt, Human
gaaggccccgcccagg

SEQ ID NO: 2446398 - RNA, 13 nt, Human
gaaggguaaagaa

SEQ ID NO: 2446399 - RNA, 17 nt, Human
gaaggaggugagggaug

SEQ ID NO: 2446400 - RNA, 16 nt, Human
gaagguucugguguga

SEQ ID NO: 2446401 - RNA, 20 nt, Human
gaagguucuggugugaacua

SEQ ID NO: 2446402 - RNA, 20 nt, Human
gaaggguuuuccacccugga

SEQ ID NO: 2446403 - RNA, 13 nt, Human
gaagguaaaauug

SEQ ID NO: 2446404 - RNA, 14 nt, Human
gaaggguccuuccc

SEQ ID NO: 2446405 - RNA, 17 nt, Human
gaagggugguggagcca

SEQ ID NO: 2446406 - RNA, 21 nt, Human
gaaggguccuucccucucccc

SEQ ID NO: 2446407 - RNA, 15 nt, Human
gaaggguuuguggcu

SEQ ID NO: 2446408 - RNA, 21 nt, Human
gaaggguuuguggcugggggc

SEQ ID NO: 2446409 - RNA, 14 nt, Human
gaaggcagggaggg

SEQ ID NO: 2446410 - RNA, 13 nt, Human
gaaggccacaugu

SEQ ID NO: 2446411 - RNA, 22 nt, Human
gaaggccagcugccccagccag

SEQ ID NO: 2446412 - RNA, 13 nt, Human
gaaggcagggagg

SEQ ID NO: 2446413 - RNA, 13 nt, Human
gaaggcagggaaa

SEQ ID NO: 2446414 - RNA, 17 nt, Human
gaaggcaagagggggug

SEQ ID NO: 2446415 - RNA, 16 nt, Human
gaaggcaagagggggu

SEQ ID NO: 2446416 - RNA, 14 nt, Human
gaaggcaagagggg

SEQ ID NO: 2446417 - RNA, 12 nt, Human
gaaggcaaaaaa

SEQ ID NO: 2446418 - RNA, 15 nt, Human
gaaggcaaaugacuu

SEQ ID NO: 2446419 - RNA, 16 nt, Human
gaaggcaaaugacuuu

SEQ ID NO: 2446420 - RNA, 23 nt, Human
gaaggcaagaggggguggagggg

SEQ ID NO: 2446421 - RNA, 22 nt, Human
gaaggcaagaggggguggaggg

SEQ ID NO: 2446422 - RNA, 24 nt, Human
gaaggcacuaaaaagagcuguccu

SEQ ID NO: 2446423 - RNA, 15 nt, Human
gaaggcagaaagcaa

SEQ ID NO: 2446424 - RNA, 18 nt, Human
gaaggcagaaagcaaaau

SEQ ID NO: 2446425 - RNA, 13 nt, Human
gaaggcaggaaga

SEQ ID NO: 2446426 - RNA, 16 nt, Human
gaaggcagccaccagc

SEQ ID NO: 2446427 - RNA, 13 nt, Human
gaaggcaaugcca

SEQ ID NO: 2446428 - RNA, 17 nt, Human
gaaggcagcagguggca

SEQ ID NO: 2446429 - RNA, 12 nt, Human
gaaauugacaga

SEQ ID NO: 2446430 - RNA, 21 nt, Human
gaaauugacacaaguggaccu

SEQ ID NO: 2446431 - RNA, 17 nt, Human
gaaauucuccuggaggu

SEQ ID NO: 2446432 - RNA, 15 nt, Human
gaaauuggcuggaug

SEQ ID NO: 2446433 - RNA, 14 nt, Human
gaaauuggcuggau

SEQ ID NO: 2446434 - RNA, 22 nt, Human
gaaauuggaacagaauguuuua

SEQ ID NO: 2446435 - RNA, 17 nt, Human
gaaauuggaacagaaug

SEQ ID NO: 2446436 - RNA, 17 nt, Human
gaaauugccugacgaac

SEQ ID NO: 2446437 - RNA, 13 nt, Human
gaaauugacagau

SEQ ID NO: 2446438 - RNA, 19 nt, Human
gaaauugcauuuccugaca

SEQ ID NO: 2446439 - RNA, 22 nt, Human
gaaauuguuuaaguguuguaaa

SEQ ID NO: 2446440 - RNA, 19 nt, Human
gaaauuuaaaagacacugu

SEQ ID NO: 2446441 - RNA, 20 nt, Human
gaaauugucuagcagagcag

SEQ ID NO: 2446442 - RNA, 21 nt, Human
gaaauugucuagcagagcagg

SEQ ID NO: 2446443 - RNA, 13 nt, Human
gaaauuuaaaaga

SEQ ID NO: 2446444 - RNA, 22 nt, Human
gaaauuuaauauagcuauuuuu

SEQ ID NO: 2446445 - RNA, 16 nt, Human
gaaauuuaauucaugu

SEQ ID NO: 2446446 - RNA, 20 nt, Human
gaaauuuaauucauguuucu

SEQ ID NO: 2446447 - RNA, 21 nt, Human
gaaauuuaauucauguuucuu

SEQ ID NO: 2446448 - RNA, 15 nt, Human
gaaauuugauuucua

SEQ ID NO: 2446449 - RNA, 23 nt, Human
gaaauuuaauucauguuucuuaa

SEQ ID NO: 2446450 - RNA, 17 nt, Human
gaaauuuguuauaauga

SEQ ID NO: 2446451 - RNA, 15 nt, Human
gaaauuuuauaugcu

SEQ ID NO: 2446452 - RNA, 19 nt, Human
gaaauuuuauaugcuuacu

SEQ ID NO: 2446453 - RNA, 22 nt, Human
gaaauuuuaaccuaugauauuu

SEQ ID NO: 2446454 - RNA, 21 nt, Human
gaaauuuucuagacuuucugu

SEQ ID NO: 2446455 - RNA, 14 nt, Human
gaaauuuuccaaug

SEQ ID NO: 2446456 - RNA, 21 nt, Human
gaaauuugauuucuauucaag

SEQ ID NO: 2446457 - RNA, 22 nt, Human
gaaauuuuauaugcuuacugau

SEQ ID NO: 2446458 - RNA, 20 nt, Human
gaaauuuucuagacuuucug

SEQ ID NO: 2446459 - RNA, 18 nt, Human
gaaauuuucuagacuuuc

SEQ ID NO: 2446460 - RNA, 16 nt, Human
gaacacugggggaggg

SEQ ID NO: 2446461 - RNA, 17 nt, Human
gaacacugggggagggg

SEQ ID NO: 2446462 - RNA, 16 nt, Human
gaaauucuccuggagg

SEQ ID NO: 2446463 - RNA, 15 nt, Human
gaaauucuccuggag

SEQ ID NO: 2446464 - RNA, 14 nt, Human
gaaauucuccugga

SEQ ID NO: 2446465 - RNA, 16 nt, Human
gaaauuccuguagcau

SEQ ID NO: 2446466 - RNA, 15 nt, Human
gaaauuccuguagca

SEQ ID NO: 2446467 - RNA, 19 nt, Human
gaaauuccuguagcaucuu

SEQ ID NO: 2446468 - RNA, 20 nt, Human
gaaauuaccagaguuguucu

SEQ ID NO: 2446469 - RNA, 17 nt, Human
gaaauuacacccaaaga

SEQ ID NO: 2446470 - RNA, 17 nt, Human
gaaauuaagaaggcaaa

SEQ ID NO: 2446471 - RNA, 18 nt, Human
gaaauuaagaaggcaaaa

SEQ ID NO: 2446472 - RNA, 22 nt, Human
gaaauuaagaaggcaaaaaugu

SEQ ID NO: 2446473 - RNA, 13 nt, Human
gaaauuaagaaga

SEQ ID NO: 2446474 - RNA, 15 nt, Human
gaaauuaagaagaaa

SEQ ID NO: 2446475 - RNA, 16 nt, Human
gaaauuaagaagaaac

SEQ ID NO: 2446476 - RNA, 20 nt, Human
gaaaugguuguauuagaugu

SEQ ID NO: 2446477 - RNA, 19 nt, Human
gaaaugguuguauuagaug

SEQ ID NO: 2446478 - RNA, 18 nt, Human
gaaaugguuguauuagau

SEQ ID NO: 2446479 - RNA, 17 nt, Human
gaaaugguuguauuaga

SEQ ID NO: 2446480 - RNA, 15 nt, Human
gaaaugguuguauua

SEQ ID NO: 2446481 - RNA, 14 nt, Human
gaaaugguuguauu

SEQ ID NO: 2446482 - RNA, 21 nt, Human
gaaaugguaugagcugagggg

SEQ ID NO: 2446483 - RNA, 17 nt, Human
gaaaugguaugagcuga

SEQ ID NO: 2446484 - RNA, 13 nt, Human
gaaaugguuguau

SEQ ID NO: 2446485 - RNA, 22 nt, Human
gaaauguuauuuuuuaauuauu

SEQ ID NO: 2446486 - RNA, 16 nt, Human
gaaauguguuucugua

SEQ ID NO: 2446487 - RNA, 22 nt, Human
gaaauguaagggaaacugccag

SEQ ID NO: 2446488 - RNA, 21 nt, Human
gaaauguuauuuuuuaauuau

SEQ ID NO: 2446489 - RNA, 14 nt, Human
gaaaugggcagagc

SEQ ID NO: 2446490 - RNA, 22 nt, Human
gaaaugcuuguggauugagggu

SEQ ID NO: 2446491 - RNA, 16 nt, Human
gaaauggcuuugugau

SEQ ID NO: 2446492 - RNA, 17 nt, Human
gaaauggaauacugaag

SEQ ID NO: 2446493 - RNA, 17 nt, Human
gaaauggcuugaagcca

SEQ ID NO: 2446494 - RNA, 20 nt, Human
gaaaugggcagagcagagac

SEQ ID NO: 2446495 - RNA, 16 nt, Human
gaaaugguaugagcug

SEQ ID NO: 2446496 - RNA, 19 nt, Human
gaaaugggacuuaacuccu

SEQ ID NO: 2446497 - RNA, 17 nt, Human
gaaaugggacuuaacuc

SEQ ID NO: 2446498 - RNA, 18 nt, Human
gaaauggcuugaagccaa

SEQ ID NO: 2446499 - RNA, 16 nt, Human
gaaauauuauguuaaa

SEQ ID NO: 2446500 - RNA, 13 nt, Human
gaaauauuauguu

SEQ ID NO: 2446501 - RNA, 16 nt, Human
gaaaugcugccugccu

SEQ ID NO: 2446502 - RNA, 15 nt, Human
gaaaugcugccugcc

SEQ ID NO: 2446503 - RNA, 16 nt, Human
gaaauauugcuggggu

SEQ ID NO: 2446504 - RNA, 15 nt, Human
gaaauauucccuaga

SEQ ID NO: 2446505 - RNA, 19 nt, Human
gaaauauuaaacccuggau

SEQ ID NO: 2446506 - RNA, 19 nt, Human
gaaaugcugggcugacggu

SEQ ID NO: 2446507 - RNA, 17 nt, Human
gaaaugcugccugccug

SEQ ID NO: 2446508 - RNA, 15 nt, Human
gaaaugcugggcuga

SEQ ID NO: 2446509 - RNA, 23 nt, Human
gaaaugcugguuuuucaguuuuc

SEQ ID NO: 2446510 - RNA, 18 nt, Human
gaaauaagaaaaaucaug

SEQ ID NO: 2446511 - RNA, 16 nt, Human
gaaauaagaaaaauca

SEQ ID NO: 2446512 - RNA, 21 nt, Human
gaaauaagaaaaaucauguuu

SEQ ID NO: 2446513 - RNA, 14 nt, Human
gaaauaagaaaaau

SEQ ID NO: 2446514 - RNA, 22 nt, Human
gaaauaacuccuucuuguagua

SEQ ID NO: 2446515 - RNA, 21 nt, Human
gaaauaaauguaucauagaaa

SEQ ID NO: 2446516 - RNA, 14 nt, Human
gaaauaaauagcua

SEQ ID NO: 2446517 - RNA, 15 nt, Human
gaaauaaauagcuau

SEQ ID NO: 2446518 - RNA, 17 nt, Human
gaaauaaauagcuauau

SEQ ID NO: 2446519 - RNA, 21 nt, Human
gaaauaaauagcuauauccau

SEQ ID NO: 2446520 - RNA, 20 nt, Human
gaaauaacaauguuaaggaa

SEQ ID NO: 2446521 - RNA, 18 nt, Human
gaaauaacaauguuaagg

SEQ ID NO: 2446522 - RNA, 17 nt, Human
gaaauaacaauguuaag

SEQ ID NO: 2446523 - RNA, 16 nt, Human
gaaauaacaauguuaa

SEQ ID NO: 2446524 - RNA, 15 nt, Human
gaaauaacaauguua

SEQ ID NO: 2446525 - RNA, 18 nt, Human
gaaauaacaagucgauga

SEQ ID NO: 2446526 - RNA, 23 nt, Human
gaaauaaauagcuauauccaugu

SEQ ID NO: 2446527 - RNA, 11 nt, Human
gaaauaauaaa

SEQ ID NO: 2446528 - RNA, 14 nt, Human
gaaauaauaugcau

SEQ ID NO: 2446529 - RNA, 13 nt, Human
gaaauaauaugca

SEQ ID NO: 2446530 - RNA, 13 nt, Human
gaaauaauaaauc

SEQ ID NO: 2446531 - RNA, 14 nt, Human
gaaauaauaaaucu

SEQ ID NO: 2446532 - RNA, 17 nt, Human
gaaauaauaaaucuggu

SEQ ID NO: 2446533 - RNA, 15 nt, Human
gaaauaauaugcauu

SEQ ID NO: 2446534 - RNA, 19 nt, Human
gaaauaauguacaucuggc

SEQ ID NO: 2446535 - RNA, 18 nt, Human
gaaacauaaauaaaauga

SEQ ID NO: 2446536 - RNA, 17 nt, Human
gaaacauaaauaaaaug

SEQ ID NO: 2446537 - RNA, 15 nt, Human
gaaacauaaauaaaa

SEQ ID NO: 2446538 - RNA, 13 nt, Human
gaaacauaaauaa

SEQ ID NO: 2446539 - RNA, 22 nt, Human
gaaacauaaauaaaaugaccag

SEQ ID NO: 2446540 - RNA, 23 nt, Human
gaaacaucaguuacucugaaggg

SEQ ID NO: 2446541 - RNA, 19 nt, Human
gaaacaucaguuacucuga

SEQ ID NO: 2446542 - RNA, 20 nt, Human
gaaacaucaguuacucugaa

SEQ ID NO: 2446543 - RNA, 22 nt, Human
gaaacaggaccacaaaaaugaa

SEQ ID NO: 2446544 - RNA, 13 nt, Human
gaaacaggagaga

SEQ ID NO: 2446545 - RNA, 17 nt, Human
gaaacaggagagaaagg

SEQ ID NO: 2446546 - RNA, 15 nt, Human
gaaacaugguuuuga

SEQ ID NO: 2446547 - RNA, 20 nt, Human
gaaacaugacucguauaugu

SEQ ID NO: 2446548 - RNA, 17 nt, Human
gaaauaaaguuugcuua

SEQ ID NO: 2446549 - RNA, 18 nt, Human
gaaauaaaguuggugaca

SEQ ID NO: 2446550 - RNA, 17 nt, Human
gaaauacauggacaaua

SEQ ID NO: 2446551 - RNA, 12 nt, Human
gaaauacauauu

SEQ ID NO: 2446552 - RNA, 16 nt, Human
gaaauacuacuuacca

SEQ ID NO: 2446553 - RNA, 19 nt, Human
gaaauacuacuccuguaau

SEQ ID NO: 2446554 - RNA, 21 nt, Human
gaaauacuacuuaccauaugu

SEQ ID NO: 2446555 - RNA, 21 nt, Human
gaaauacauauuuccaagaag

SEQ ID NO: 2446556 - RNA, 17 nt, Human
gaaauacauauuuccaa

SEQ ID NO: 2446557 - RNA, 16 nt, Human
gaaauacuacuccugu

SEQ ID NO: 2446558 - RNA, 22 nt, Human
gaaauacagauuuugauagcaa

SEQ ID NO: 2446559 - RNA, 17 nt, Human
gaaauacagauuuugau

SEQ ID NO: 2446560 - RNA, 19 nt, Human
gaaauacacaaguaaacau

SEQ ID NO: 2446561 - RNA, 18 nt, Human
gaaauacacaaguaaaca

SEQ ID NO: 2446562 - RNA, 21 nt, Human
gaaauacaauucuacauuguc

SEQ ID NO: 2446563 - RNA, 15 nt, Human
gaaauacuauuuaaa

SEQ ID NO: 2446564 - RNA, 14 nt, Human
gaaauacuauuuaa

SEQ ID NO: 2446565 - RNA, 15 nt, Human
gaaauacuguuugag

SEQ ID NO: 2446566 - RNA, 23 nt, Human
gaaauagaaaaacccugccccca

SEQ ID NO: 2446567 - RNA, 21 nt, Human
gaaauagaaaaacccugcccc

SEQ ID NO: 2446568 - RNA, 20 nt, Human
gaaauagaaaaacccugccc

SEQ ID NO: 2446569 - RNA, 19 nt, Human
gaaauagaaaaacccugcc

SEQ ID NO: 2446570 - RNA, 19 nt, Human
gaaauacuguuugagguuu

SEQ ID NO: 2446571 - RNA, 18 nt, Human
gaaauacugcaagaaaau

SEQ ID NO: 2446572 - RNA, 20 nt, Human
gaaauagaaauuuccagaga

SEQ ID NO: 2446573 - RNA, 18 nt, Human
gaaauagacaguauauuu

SEQ ID NO: 2446574 - RNA, 20 nt, Human
gaaauagcuccguggagcag

SEQ ID NO: 2446575 - RNA, 19 nt, Human
gaaauagacaguauauuua

SEQ ID NO: 2446576 - RNA, 22 nt, Human
gaaauaugauuuuauuugacaa

SEQ ID NO: 2446577 - RNA, 15 nt, Human
gaaauaugauuuuau

SEQ ID NO: 2446578 - RNA, 17 nt, Human
gaaauaugcacaauagc

SEQ ID NO: 2446579 - RNA, 18 nt, Human
gaaauaugcacaauagca

SEQ ID NO: 2446580 - RNA, 13 nt, Human
gaaauaugcaucu

SEQ ID NO: 2446581 - RNA, 14 nt, Human
gaaauaucuguauu

SEQ ID NO: 2446582 - RNA, 14 nt, Human
gaaauaugauuuua

SEQ ID NO: 2446583 - RNA, 14 nt, Human
gaaauaugaaugcc

SEQ ID NO: 2446584 - RNA, 20 nt, Human
gaaauaugaagaacugagga

SEQ ID NO: 2446585 - RNA, 21 nt, Human
gaaauaucugaaaauguaugu

SEQ ID NO: 2446586 - RNA, 22 nt, Human
gaaauaguguggaaauuaagaa

SEQ ID NO: 2446587 - RNA, 17 nt, Human
gaaauagucugugugaa

SEQ ID NO: 2446588 - RNA, 15 nt, Human
gaaauagucugugug

SEQ ID NO: 2446589 - RNA, 13 nt, Human
gaaauauaauuga

SEQ ID NO: 2446590 - RNA, 18 nt, Human
gaaauaguucaaagccaa

SEQ ID NO: 2446591 - RNA, 15 nt, Human
gaaauauacacacag

SEQ ID NO: 2446592 - RNA, 17 nt, Human
gaaauauacacacagca

SEQ ID NO: 2446593 - RNA, 16 nt, Human
gaacucaaauggggcc

SEQ ID NO: 2446594 - RNA, 19 nt, Human
gaacucaaauggggccaga

SEQ ID NO: 2446595 - RNA, 20 nt, Human
gaacucaaauggggccagau

SEQ ID NO: 2446596 - RNA, 22 nt, Human
gaacucaaauggggccagaucc

SEQ ID NO: 2446597 - RNA, 23 nt, Human
gaacucaaauggggccagaucca

SEQ ID NO: 2446598 - RNA, 22 nt, Human
gaacucaucuagguaaauuaca

SEQ ID NO: 2446599 - RNA, 14 nt, Human
gaacucccuuucaa

SEQ ID NO: 2446600 - RNA, 15 nt, Human
gaacucaacuuugac

SEQ ID NO: 2446601 - RNA, 13 nt, Human
gaacucauuccug

SEQ ID NO: 2446602 - RNA, 14 nt, Human
gaacucauuccugc

SEQ ID NO: 2446603 - RNA, 22 nt, Human
gaacucauuccugccugucucc

SEQ ID NO: 2446604 - RNA, 15 nt, Human
gaacucccuuucaac

SEQ ID NO: 2446605 - RNA, 22 nt, Human
gaacuggguacuuguggacaca

SEQ ID NO: 2446606 - RNA, 17 nt, Human
gaacuguccagagagca

SEQ ID NO: 2446607 - RNA, 16 nt, Human
gaacuguccagagagc

SEQ ID NO: 2446608 - RNA, 15 nt, Human
gaacuguccagagag

SEQ ID NO: 2446609 - RNA, 14 nt, Human
gaacuguccagaga

SEQ ID NO: 2446610 - RNA, 22 nt, Human
gaacuguccagagagcaacucu

SEQ ID NO: 2446611 - RNA, 17 nt, Human
gaacugucucucaugaa

SEQ ID NO: 2446612 - RNA, 20 nt, Human
gaacuggucaccaugaaacu

SEQ ID NO: 2446613 - RNA, 19 nt, Human
gaacucccagcaacacaag

SEQ ID NO: 2446614 - RNA, 13 nt, Human
gaacuguccagag

SEQ ID NO: 2446615 - RNA, 11 nt, Human
gaacucccagc

SEQ ID NO: 2446616 - RNA, 17 nt, Human
gaacucccagcaacaca

SEQ ID NO: 2446617 - RNA, 16 nt, Human
gaacucauuccugccu

SEQ ID NO: 2446618 - RNA, 21 nt, Human
gaacuugcagcugauguugga

SEQ ID NO: 2446619 - RNA, 12 nt, Human
gaacuugcaugg

SEQ ID NO: 2446620 - RNA, 12 nt, Human
gaacuugacaau

SEQ ID NO: 2446621 - RNA, 18 nt, Human
gaacuucgcaucaaaaga

SEQ ID NO: 2446622 - RNA, 23 nt, Human
gaacuuccagguguuacuguaau

SEQ ID NO: 2446623 - RNA, 22 nt, Human
gaacuuccagauccuggaaauc

SEQ ID NO: 2446624 - RNA, 15 nt, Human
gaacuuauucuguag

SEQ ID NO: 2446625 - RNA, 18 nt, Human
gaacuguccagagagcaa

SEQ ID NO: 2446626 - RNA, 17 nt, Human
gaacuuacauuguucaa

SEQ ID NO: 2446627 - RNA, 21 nt, Human
gaacugucucucaugaaccuc

SEQ ID NO: 2446628 - RNA, 22 nt, Human
gaacugugaggguaaaggcuau

SEQ ID NO: 2446629 - RNA, 20 nt, Human
gaacuuauccuaaaacaaau

SEQ ID NO: 2446630 - RNA, 12 nt, Human
gaacuugguucc

SEQ ID NO: 2446631 - RNA, 23 nt, Human
gaacuugguucccauuugcuccu

SEQ ID NO: 2446632 - RNA, 21 nt, Human
gaacuuguaaaggaauuuaaa

SEQ ID NO: 2446633 - RNA, 16 nt, Human
gaacuuggcgcugccc

SEQ ID NO: 2446634 - RNA, 15 nt, Human
gaacuuggcgcugcc

SEQ ID NO: 2446635 - RNA, 13 nt, Human
gaacuuggcgcug

SEQ ID NO: 2446636 - RNA, 22 nt, Human
gaacuugcugcugagugcacca

SEQ ID NO: 2446637 - RNA, 19 nt, Human
gaacuuggaaagaaaugcc

SEQ ID NO: 2446638 - RNA, 15 nt, Human
gaagaaacagaucuc

SEQ ID NO: 2446639 - RNA, 18 nt, Human
gaagaaaauugcugugcc

SEQ ID NO: 2446640 - RNA, 19 nt, Human
gaagaacugcaggcccugg

SEQ ID NO: 2446641 - RNA, 21 nt, Human
gaagaagcaccaaucaugaau

SEQ ID NO: 2446642 - RNA, 22 nt, Human
gaagaagagggagagguggagc

SEQ ID NO: 2446643 - RNA, 14 nt, Human
gaagaagagggaga

SEQ ID NO: 2446644 - RNA, 16 nt, Human
gaagaacuugcaugga

SEQ ID NO: 2446645 - RNA, 22 nt, Human
gaagaacuguguuucaaguuca

SEQ ID NO: 2446646 - RNA, 22 nt, Human
gaagaaaacuccuuuagcaggu

SEQ ID NO: 2446647 - RNA, 14 nt, Human
gaagaaaacaucua

SEQ ID NO: 2446648 - RNA, 17 nt, Human
gaacuuggaggcaccau

SEQ ID NO: 2446649 - RNA, 15 nt, Human
gaacuuggaggcacc

SEQ ID NO: 2446650 - RNA, 22 nt, Human
gaagaaaacaucuauucucucc

SEQ ID NO: 2446651 - RNA, 20 nt, Human
gaagaaaagugggccagugu

SEQ ID NO: 2446652 - RNA, 17 nt, Human
gaagaaaauugcugugc

SEQ ID NO: 2446653 - RNA, 22 nt, Human
gaacuagaguuuagcuggaaaa

SEQ ID NO: 2446654 - RNA, 21 nt, Human
gaacuagaguuuagcuggaaa

SEQ ID NO: 2446655 - RNA, 22 nt, Human
gaacgugacugccccaacuccu

SEQ ID NO: 2446656 - RNA, 14 nt, Human
gaacgugacugccc

SEQ ID NO: 2446657 - RNA, 16 nt, Human
gaacguggcucugcug

SEQ ID NO: 2446658 - RNA, 17 nt, Human
gaacguggcucugcugg

SEQ ID NO: 2446659 - RNA, 16 nt, Human
gaacgggguccuucaa

SEQ ID NO: 2446660 - RNA, 15 nt, Human
gaacgguaaauuucu

SEQ ID NO: 2446661 - RNA, 17 nt, Human
gaacgguaaauuucugu

SEQ ID NO: 2446662 - RNA, 15 nt, Human
gaacggggagaaaag

SEQ ID NO: 2446663 - RNA, 13 nt, Human
gaacuauuagagc

SEQ ID NO: 2446664 - RNA, 17 nt, Human
gaacuauggacggugcu

SEQ ID NO: 2446665 - RNA, 15 nt, Human
gaacuaugaacuaca

SEQ ID NO: 2446666 - RNA, 18 nt, Human
gaacuauuccccagcagg

SEQ ID NO: 2446667 - RNA, 21 nt, Human
gaacuauggacggugcuccag

SEQ ID NO: 2446668 - RNA, 15 nt, Human
gaacuauuggagggu

SEQ ID NO: 2446669 - RNA, 20 nt, Human
gaacuauuccccagcagggu

SEQ ID NO: 2446670 - RNA, 22 nt, Human
gaacuauuggagggugggagag

SEQ ID NO: 2446671 - RNA, 15 nt, Human
gaacuauaaagaagu

SEQ ID NO: 2446672 - RNA, 22 nt, Human
gaacuagccaccaacucuugca

SEQ ID NO: 2446673 - RNA, 23 nt, Human
gaacuagccaccaacucuugcag

SEQ ID NO: 2446674 - RNA, 15 nt, Human
gaaccuguagagcua

SEQ ID NO: 2446675 - RNA, 12 nt, Human
gaaccugugucc

SEQ ID NO: 2446676 - RNA, 20 nt, Human
gaaccuguccuugcacacuc

SEQ ID NO: 2446677 - RNA, 12 nt, Human
gaaccuguccuu

SEQ ID NO: 2446678 - RNA, 13 nt, Human
gaaccuggagggg

SEQ ID NO: 2446679 - RNA, 21 nt, Human
gaaccuggagggcuggaaucu

SEQ ID NO: 2446680 - RNA, 16 nt, Human
gaaccuggagggcuag

SEQ ID NO: 2446681 - RNA, 15 nt, Human
gaaccuggagggcua

SEQ ID NO: 2446682 - RNA, 17 nt, Human
gaaccuggaggggcuag

SEQ ID NO: 2446683 - RNA, 16 nt, Human
gaaccuggaggggcua

SEQ ID NO: 2446684 - RNA, 15 nt, Human
gaaccuggaguuccu

SEQ ID NO: 2446685 - RNA, 16 nt, Human
gaaccuggaacuuggg

SEQ ID NO: 2446686 - RNA, 15 nt, Human
gaaccuggagagcua

SEQ ID NO: 2446687 - RNA, 12 nt, Human
gaaccuggaacu

SEQ ID NO: 2446688 - RNA, 12 nt, Human
gaaccuggagag

SEQ ID NO: 2446689 - RNA, 13 nt, Human
gaaccuuguuauu

SEQ ID NO: 2446690 - RNA, 18 nt, Human
gaaccuuguuauuucuca

SEQ ID NO: 2446691 - RNA, 22 nt, Human
gaacggggcucuucucauuuca

SEQ ID NO: 2446692 - RNA, 19 nt, Human
gaacggggcucuucucauu

SEQ ID NO: 2446693 - RNA, 22 nt, Human
gaacggagccccaggccucugu

SEQ ID NO: 2446694 - RNA, 23 nt, Human
gaacggagccccaggccucugug

SEQ ID NO: 2446695 - RNA, 14 nt, Human
gaacggggagaaaa

SEQ ID NO: 2446696 - RNA, 19 nt, Human
gaaccuugugccuggcuca

SEQ ID NO: 2446697 - RNA, 18 nt, Human
gaaccuugugccuggcuc

SEQ ID NO: 2446698 - RNA, 17 nt, Human
gaaccuugugccuggcu

SEQ ID NO: 2446699 - RNA, 16 nt, Human
gaaccuugugccuggc

SEQ ID NO: 2446700 - RNA, 14 nt, Human
gaaccuugugccug

SEQ ID NO: 2446701 - RNA, 18 nt, Human
gaaccuucuggccuccca

SEQ ID NO: 2446702 - RNA, 21 nt, Human
gaaccuucuggccucccacag

SEQ ID NO: 2446703 - RNA, 21 nt, Human
gaaccacaucuugcucugcug

SEQ ID NO: 2446704 - RNA, 16 nt, Human
gaacagacuggaagca

SEQ ID NO: 2446705 - RNA, 15 nt, Human
gaacagacuggaagc

SEQ ID NO: 2446706 - RNA, 17 nt, Human
gaacagacaacagaagu

SEQ ID NO: 2446707 - RNA, 18 nt, Human
gaacagacaacagaaguc

SEQ ID NO: 2446708 - RNA, 19 nt, Human
gaacagacaacagaaguca

SEQ ID NO: 2446709 - RNA, 15 nt, Human
gaacagacaggagaa

SEQ ID NO: 2446710 - RNA, 16 nt, Human
gaacagacaggagaaa

SEQ ID NO: 2446711 - RNA, 14 nt, Human
gaacagaaggauga

SEQ ID NO: 2446712 - RNA, 19 nt, Human
gaacagaaggaugaaugag

SEQ ID NO: 2446713 - RNA, 15 nt, Human
gaacagaauguuuua

SEQ ID NO: 2446714 - RNA, 14 nt, Human
gaacagaauguuuu

SEQ ID NO: 2446715 - RNA, 12 nt, Human
gaacagaauguu

SEQ ID NO: 2446716 - RNA, 18 nt, Human
gaacacugggggagggga

SEQ ID NO: 2446717 - RNA, 20 nt, Human
gaacacugggggaggggaca

SEQ ID NO: 2446718 - RNA, 13 nt, Human
gaacagaaauacc

SEQ ID NO: 2446719 - RNA, 15 nt, Human
gaacacuuuuaauaa

SEQ ID NO: 2446720 - RNA, 12 nt, Human
gaacagaaggau

SEQ ID NO: 2446721 - RNA, 15 nt, Human
gaaccuaccuucauu

SEQ ID NO: 2446722 - RNA, 19 nt, Human
gaaccguuuugaagcuacu

SEQ ID NO: 2446723 - RNA, 20 nt, Human
gaaccuaacuccccacccca

SEQ ID NO: 2446724 - RNA, 17 nt, Human
gaaccguuuugaagcua

SEQ ID NO: 2446725 - RNA, 18 nt, Human
gaaccguuuugaagcuac

SEQ ID NO: 2446726 - RNA, 17 nt, Human
gaaccugacguagcugc

SEQ ID NO: 2446727 - RNA, 12 nt, Human
gaaccugacccc

SEQ ID NO: 2446728 - RNA, 14 nt, Human
gaaccuagaagggc

SEQ ID NO: 2446729 - RNA, 17 nt, Human
gaaccucuuccccagaa

SEQ ID NO: 2446730 - RNA, 11 nt, Human
gaaccugaccc

SEQ ID NO: 2446731 - RNA, 17 nt, Human
gaaccaccacacccagc

SEQ ID NO: 2446732 - RNA, 16 nt, Human
gaaccaccacacccag

SEQ ID NO: 2446733 - RNA, 18 nt, Human
gaacagacaggagaaaug

SEQ ID NO: 2446734 - RNA, 17 nt, Human
gaacagacaggagaaau

SEQ ID NO: 2446735 - RNA, 13 nt, Human
gaaccgcaggaag

SEQ ID NO: 2446736 - RNA, 20 nt, Human
gaaccgcaggaagcugcucc

SEQ ID NO: 2446737 - RNA, 14 nt, Human
gaaccgcaggaagc

SEQ ID NO: 2446738 - RNA, 15 nt, Human
gaaccgcaggaagcu

SEQ ID NO: 2446739 - RNA, 15 nt, Human
gaaccgcugaauaug

SEQ ID NO: 2446740 - RNA, 16 nt, Human
gaaccgcaggaagcug

SEQ ID NO: 2446741 - RNA, 20 nt, Human
cucugccucugacacacagc

SEQ ID NO: 2446742 - RNA, 19 nt, Human
cucugccucugacacacag

SEQ ID NO: 2446743 - RNA, 21 nt, Human
cucugccucccaucacccgcu

SEQ ID NO: 2446744 - RNA, 22 nt, Human
cucugccggcucuuuccuugcu

SEQ ID NO: 2446745 - RNA, 16 nt, Human
cucugccucugacaca

SEQ ID NO: 2446746 - RNA, 20 nt, Human
cucuggauuauauuaugaag

SEQ ID NO: 2446747 - RNA, 19 nt, Human
cucuggauuauauuaugaa

SEQ ID NO: 2446748 - RNA, 10 nt, Human
cucugccuga

SEQ ID NO: 2446749 - RNA, 20 nt, Human
cucuggauggcaccagaggc

SEQ ID NO: 2446750 - RNA, 19 nt, Human
cucuggauggcaccagagg

SEQ ID NO: 2446751 - RNA, 16 nt, Human
cucuggauggcaccag

SEQ ID NO: 2446752 - RNA, 15 nt, Human
cucuggauggcacca

SEQ ID NO: 2446753 - RNA, 13 nt, Human
cucuggauggcac

SEQ ID NO: 2446754 - RNA, 17 nt, Human
cucugccucugccugca

SEQ ID NO: 2446755 - RNA, 19 nt, Human
cucuggcauuagaauuauu

SEQ ID NO: 2446756 - RNA, 18 nt, Human
cucuggcauuagaauuau

SEQ ID NO: 2446757 - RNA, 19 nt, Human
cucuggcaguucuggaaug

SEQ ID NO: 2446758 - RNA, 23 nt, Human
cucuggcagcucagagagggugg

SEQ ID NO: 2446759 - RNA, 22 nt, Human
cucuggauuggagauagggaaa

SEQ ID NO: 2446760 - RNA, 18 nt, Human
cucuggauugugggaauu

SEQ ID NO: 2446761 - RNA, 22 nt, Human
cucuggccuucggccuccaucc

SEQ ID NO: 2446762 - RNA, 15 nt, Human
cucuggccccaaggg

SEQ ID NO: 2446763 - RNA, 14 nt, Human
cucuggccccaagg

SEQ ID NO: 2446764 - RNA, 24 nt, Human
cucuggcccucuaccccugaucug

SEQ ID NO: 2446765 - RNA, 13 nt, Human
cucuggcccugcc

SEQ ID NO: 2446766 - RNA, 16 nt, Human
cucuggccuuuuccua

SEQ ID NO: 2446767 - RNA, 15 nt, Human
cucuggccuuuuccu

SEQ ID NO: 2446768 - RNA, 21 nt, Human
cucuggccuucggccuccauc

SEQ ID NO: 2446769 - RNA, 23 nt, Human
cucuggcauuagaauuauuuaaa

SEQ ID NO: 2446770 - RNA, 20 nt, Human
cucuggcauuagaauuauuu

SEQ ID NO: 2446771 - RNA, 10 nt, Human
cucuggccag

SEQ ID NO: 2446772 - RNA, 15 nt, Human
cucuggccaggaugg

SEQ ID NO: 2446773 - RNA, 13 nt, Human
cucuggccccaag

SEQ ID NO: 2446774 - RNA, 19 nt, Human
cucuggccaggauggaggg

SEQ ID NO: 2446775 - RNA, 22 nt, Human
cucuguccugggagugagcugg

SEQ ID NO: 2446776 - RNA, 15 nt, Human
cucuguccugggagu

SEQ ID NO: 2446777 - RNA, 13 nt, Human
cucuguccuggga

SEQ ID NO: 2446778 - RNA, 14 nt, Human
cucuguccugggag

SEQ ID NO: 2446779 - RNA, 20 nt, Human
cucugggccauucuccacag

SEQ ID NO: 2446780 - RNA, 15 nt, Human
cucugggcaggaccu

SEQ ID NO: 2446781 - RNA, 14 nt, Human
cucuggcguguggg

SEQ ID NO: 2446782 - RNA, 17 nt, Human
cucugggagaggauuuu

SEQ ID NO: 2446783 - RNA, 16 nt, Human
cucuggcgacaguuuu

SEQ ID NO: 2446784 - RNA, 14 nt, Human
cucuggcuagaggc

SEQ ID NO: 2446785 - RNA, 23 nt, Human
cucugggcaggaccucagagucc

SEQ ID NO: 2446786 - RNA, 23 nt, Human
cucugggccaagucaaagacauu

SEQ ID NO: 2446787 - RNA, 17 nt, Human
cucugggcugccaugug

SEQ ID NO: 2446788 - RNA, 14 nt, Human
cucuggggacuccg

SEQ ID NO: 2446789 - RNA, 20 nt, Human
cucuggggccacacagaaac

SEQ ID NO: 2446790 - RNA, 17 nt, Human
cucuggggccacacaga

SEQ ID NO: 2446791 - RNA, 15 nt, Human
cucugucgcccaggc

SEQ ID NO: 2446792 - RNA, 13 nt, Human
cucugucgcccag

SEQ ID NO: 2446793 - RNA, 18 nt, Human
cucugucgcccaggcugg

SEQ ID NO: 2446794 - RNA, 22 nt, Human
cucugucgcccaggcuggagug

SEQ ID NO: 2446795 - RNA, 17 nt, Human
cucugucgcccagucug

SEQ ID NO: 2446796 - RNA, 16 nt, Human
cucugucuuguguuuc

SEQ ID NO: 2446797 - RNA, 15 nt, Human
cucugucuuguguuu

SEQ ID NO: 2446798 - RNA, 23 nt, Human
cucugucuucuuugcccacaaug

SEQ ID NO: 2446799 - RNA, 19 nt, Human
cucugucgcccagucugga

SEQ ID NO: 2446800 - RNA, 18 nt, Human
cucugucgcccagucugg

SEQ ID NO: 2446801 - RNA, 23 nt, Human
cucugugucagguggggcagcuu

SEQ ID NO: 2446802 - RNA, 22 nt, Human
cucugugucagguggggcagcu

SEQ ID NO: 2446803 - RNA, 21 nt, Human
cucugugucagguggggcagc

SEQ ID NO: 2446804 - RNA, 20 nt, Human
cucugugucagguggggcag

SEQ ID NO: 2446805 - RNA, 14 nt, Human
cucugugaccaaug

SEQ ID NO: 2446806 - RNA, 15 nt, Human
cucugugaccaaugu

SEQ ID NO: 2446807 - RNA, 17 nt, Human
cucugugaccaaugucu

SEQ ID NO: 2446808 - RNA, 18 nt, Human
cucugugaccaaugucuu

SEQ ID NO: 2446809 - RNA, 21 nt, Human
cucugugaacgauuuagaaag

SEQ ID NO: 2446810 - RNA, 18 nt, Human
cucugugaacgauuuaga

SEQ ID NO: 2446811 - RNA, 18 nt, Human
cucugugaacccuaugag

SEQ ID NO: 2446812 - RNA, 18 nt, Human
cucugugaagcauucgag

SEQ ID NO: 2446813 - RNA, 23 nt, Human
cucugugaacgauuuagaaagaa

SEQ ID NO: 2446814 - RNA, 24 nt, Human
cucugugaccucaggcacuagccu

SEQ ID NO: 2446815 - RNA, 19 nt, Human
cucugugaccucaggcacu

SEQ ID NO: 2446816 - RNA, 16 nt, Human
cucugugaccucaggc

SEQ ID NO: 2446817 - RNA, 14 nt, Human
cucugugaccucag

SEQ ID NO: 2446818 - RNA, 19 nt, Human
cucugugaccaaugucuug

SEQ ID NO: 2446819 - RNA, 19 nt, Human
cucugugucagguggggca

SEQ ID NO: 2446820 - RNA, 15 nt, Human
cucugugaccugccc

SEQ ID NO: 2446821 - RNA, 23 nt, Human
cucugugaccugccccgcccagc

SEQ ID NO: 2446822 - RNA, 21 nt, Human
cucuguuguccuccccuuggg

SEQ ID NO: 2446823 - RNA, 20 nt, Human
cucuguuguccuccccuugg

SEQ ID NO: 2446824 - RNA, 17 nt, Human
cucuguuguccuccccu

SEQ ID NO: 2446825 - RNA, 12 nt, Human
cucuguuguccu

SEQ ID NO: 2446826 - RNA, 22 nt, Human
cucuguugcccaggcuggagug

SEQ ID NO: 2446827 - RNA, 20 nt, Human
cucuguugcccaggcuggag

SEQ ID NO: 2446828 - RNA, 16 nt, Human
cucuguguccuucccu

SEQ ID NO: 2446829 - RNA, 14 nt, Human
cucuguguccuucc

SEQ ID NO: 2446830 - RNA, 17 nt, Human
cucuguguccuucccug

SEQ ID NO: 2446831 - RNA, 15 nt, Human
cucugugugcacaaa

SEQ ID NO: 2446832 - RNA, 17 nt, Human
cucugugugcacaaaua

SEQ ID NO: 2446833 - RNA, 19 nt, Human
cucuuaagaagacugcauu

SEQ ID NO: 2446834 - RNA, 21 nt, Human
cucuuaagccaucuugguaaa

SEQ ID NO: 2446835 - RNA, 20 nt, Human
cucuuaagccaucuugguaa

SEQ ID NO: 2446836 - RNA, 14 nt, Human
cucuuaagccaucu

SEQ ID NO: 2446837 - RNA, 13 nt, Human
cucuuaagccauc

SEQ ID NO: 2446838 - RNA, 17 nt, Human
cucuuaaaaaauaaaaa

SEQ ID NO: 2446839 - RNA, 18 nt, Human
cucuuaaaaaauaaaaac

SEQ ID NO: 2446840 - RNA, 12 nt, Human
cucuuaagccau

SEQ ID NO: 2446841 - RNA, 19 nt, Human
cucuuaaaaaauaaaaacu

SEQ ID NO: 2446842 - RNA, 16 nt, Human
cucuuaaaaaauaaaa

SEQ ID NO: 2446843 - RNA, 22 nt, Human
cucuguuguccuccccuugggc

SEQ ID NO: 2446844 - RNA, 16 nt, Human
cucuguuucuccuucu

SEQ ID NO: 2446845 - RNA, 14 nt, Human
cucuguuucucuuu

SEQ ID NO: 2446846 - RNA, 14 nt, Human
cucuuccugcaagg

SEQ ID NO: 2446847 - RNA, 22 nt, Human
cucuuccucugaggcuggaucc

SEQ ID NO: 2446848 - RNA, 17 nt, Human
cucuuccucugaggcug

SEQ ID NO: 2446849 - RNA, 16 nt, Human
cucuuccucugaggcu

SEQ ID NO: 2446850 - RNA, 13 nt, Human
cucuuccucugag

SEQ ID NO: 2446851 - RNA, 12 nt, Human
cucuuccucuga

SEQ ID NO: 2446852 - RNA, 11 nt, Human
cucuuccucug

SEQ ID NO: 2446853 - RNA, 19 nt, Human
cucuuccccuugcccuugc

SEQ ID NO: 2446854 - RNA, 18 nt, Human
cucuuccccuugcccuug

SEQ ID NO: 2446855 - RNA, 16 nt, Human
cucuuccccuugcccu

SEQ ID NO: 2446856 - RNA, 15 nt, Human
cucuuccccuugccc

SEQ ID NO: 2446857 - RNA, 23 nt, Human
cucuuccccuugcccuugcccug

SEQ ID NO: 2446858 - RNA, 12 nt, Human
cucuuccccucu

SEQ ID NO: 2446859 - RNA, 16 nt, Human
cucuuccccucucaga

SEQ ID NO: 2446860 - RNA, 14 nt, Human
cucuuccccucuca

SEQ ID NO: 2446861 - RNA, 12 nt, Human
cucuuccccaga

SEQ ID NO: 2446862 - RNA, 21 nt, Human
cucuuccccagaaaggagacu

SEQ ID NO: 2446863 - RNA, 16 nt, Human
cucuuccaucaugucc

SEQ ID NO: 2446864 - RNA, 17 nt, Human
cucuuaauuguucauuu

SEQ ID NO: 2446865 - RNA, 22 nt, Human
cucuuaaguuucucagcuccca

SEQ ID NO: 2446866 - RNA, 19 nt, Human
cucuuaaguuucucagcuc

SEQ ID NO: 2446867 - RNA, 18 nt, Human
cucuuaaguuucucagcu

SEQ ID NO: 2446868 - RNA, 14 nt, Human
cucuuaaguuucuc

SEQ ID NO: 2446869 - RNA, 12 nt, Human
cucuuaaguuuc

SEQ ID NO: 2446870 - RNA, 22 nt, Human
cucuuaagccaucuugguaaau

SEQ ID NO: 2446871 - RNA, 22 nt, Human
cucuuaagcuuccgccgucuca

SEQ ID NO: 2446872 - RNA, 13 nt, Human
cucuucuccaggc

SEQ ID NO: 2446873 - RNA, 15 nt, Human
cucuucuccaggcug

SEQ ID NO: 2446874 - RNA, 19 nt, Human
cucuucucauuucaccccu

SEQ ID NO: 2446875 - RNA, 15 nt, Human
cucuucucauuucac

SEQ ID NO: 2446876 - RNA, 12 nt, Human
cucuucucauuu

SEQ ID NO: 2446877 - RNA, 11 nt, Human
cucuucucauu

SEQ ID NO: 2446878 - RNA, 13 nt, Human
cucuucuccacug

SEQ ID NO: 2446879 - RNA, 12 nt, Human
cucuucuccacu

SEQ ID NO: 2446880 - RNA, 16 nt, Human
cucuuccuuuuaucag

SEQ ID NO: 2446881 - RNA, 23 nt, Human
cucuuccuugaagaacugcaggc

SEQ ID NO: 2446882 - RNA, 10 nt, Human
cucuuccugu

SEQ ID NO: 2446883 - RNA, 20 nt, Human
cucuucguuucagugucaaa

SEQ ID NO: 2446884 - RNA, 18 nt, Human
cucuuccuugcuguguca

SEQ ID NO: 2446885 - RNA, 15 nt, Human
cucuucuagagccgu

SEQ ID NO: 2446886 - RNA, 17 nt, Human
cucuucuauuuuguaaa

SEQ ID NO: 2446887 - RNA, 19 nt, Human
cucuucuauuuuguaaacu

SEQ ID NO: 2446888 - RNA, 15 nt, Human
cucuucucaagugcc

SEQ ID NO: 2446889 - RNA, 14 nt, Human
cucuucucaagugc

SEQ ID NO: 2446890 - RNA, 20 nt, Human
cucugccagugacagacagg

SEQ ID NO: 2446891 - RNA, 15 nt, Human
cucugccagugacag

SEQ ID NO: 2446892 - RNA, 14 nt, Human
cucugccagugaca

SEQ ID NO: 2446893 - RNA, 13 nt, Human
cucugccagugac

SEQ ID NO: 2446894 - RNA, 19 nt, Human
cucugccaaaggaugugau

SEQ ID NO: 2446895 - RNA, 14 nt, Human
cucugccaaaggau

SEQ ID NO: 2446896 - RNA, 23 nt, Human
cucugcauuugucuauucuccag

SEQ ID NO: 2446897 - RNA, 22 nt, Human
cucugcauuugucuauucucca

SEQ ID NO: 2446898 - RNA, 19 nt, Human
cucugcauuugucuauucu

SEQ ID NO: 2446899 - RNA, 14 nt, Human
cucugcauuugucu

SEQ ID NO: 2446900 - RNA, 23 nt, Human
cucugcaugcggcccagcccggc

SEQ ID NO: 2446901 - RNA, 15 nt, Human
cucugcauucuagua

SEQ ID NO: 2446902 - RNA, 20 nt, Human
cucugcaugcggcccagccc

SEQ ID NO: 2446903 - RNA, 19 nt, Human
cucugcaugcggcccagcc

SEQ ID NO: 2446904 - RNA, 18 nt, Human
cucugcaugcggcccagc

SEQ ID NO: 2446905 - RNA, 17 nt, Human
cucugcaugcggcccag

SEQ ID NO: 2446906 - RNA, 22 nt, Human
cucugcaugcggcccagcccgg

SEQ ID NO: 2446907 - RNA, 21 nt, Human
cucugcaugcggcccagcccg

SEQ ID NO: 2446908 - RNA, 14 nt, Human
cucugcauucuagu

SEQ ID NO: 2446909 - RNA, 16 nt, Human
cucugcaugcggccca

SEQ ID NO: 2446910 - RNA, 14 nt, Human
cucugcaucugacc

SEQ ID NO: 2446911 - RNA, 13 nt, Human
cucugcaucugac

SEQ ID NO: 2446912 - RNA, 22 nt, Human
cucugcaucuacucccaaguau

SEQ ID NO: 2446913 - RNA, 20 nt, Human
cucugcaucuacucccaagu

SEQ ID NO: 2446914 - RNA, 19 nt, Human
cucugcaucuacucccaag

SEQ ID NO: 2446915 - RNA, 17 nt, Human
cucugcaucuacuccca

SEQ ID NO: 2446916 - RNA, 18 nt, Human
cucugcaggucccuaaua

SEQ ID NO: 2446917 - RNA, 21 nt, Human
cucugcaggucccuaauaaag

SEQ ID NO: 2446918 - RNA, 12 nt, Human
cucugaguguga

SEQ ID NO: 2446919 - RNA, 17 nt, Human
cucugaguaucuccucg

SEQ ID NO: 2446920 - RNA, 10 nt, Human
cucugcacaa

SEQ ID NO: 2446921 - RNA, 14 nt, Human
cucugauaagagaa

SEQ ID NO: 2446922 - RNA, 17 nt, Human
cucugauacccagagca

SEQ ID NO: 2446923 - RNA, 13 nt, Human
cucugcacaagcu

SEQ ID NO: 2446924 - RNA, 20 nt, Human
cucugcaggucccuaauaaa

SEQ ID NO: 2446925 - RNA, 19 nt, Human
cucugcaggucccuaauaa

SEQ ID NO: 2446926 - RNA, 14 nt, Human
cucugcacaagcug

SEQ ID NO: 2446927 - RNA, 15 nt, Human
cucugcacaagcugc

SEQ ID NO: 2446928 - RNA, 17 nt, Human
cucugcccacucccugc

SEQ ID NO: 2446929 - RNA, 16 nt, Human
cucugcccacucccug

SEQ ID NO: 2446930 - RNA, 15 nt, Human
cucugcccacucccu

SEQ ID NO: 2446931 - RNA, 13 nt, Human
cucugcccacucc

SEQ ID NO: 2446932 - RNA, 20 nt, Human
cucugcccacucccugcaac

SEQ ID NO: 2446933 - RNA, 18 nt, Human
cucugcccacucccugca

SEQ ID NO: 2446934 - RNA, 17 nt, Human
cucugccccauccucca

SEQ ID NO: 2446935 - RNA, 21 nt, Human
cucugccccauccuccagcag

SEQ ID NO: 2446936 - RNA, 22 nt, Human
cucugccccauccuccagcagg

SEQ ID NO: 2446937 - RNA, 24 nt, Human
cucugccccauccuccagcaggga

SEQ ID NO: 2446938 - RNA, 20 nt, Human
cucugcccaacccuucccuc

SEQ ID NO: 2446939 - RNA, 15 nt, Human
cucugccccauccuc

SEQ ID NO: 2446940 - RNA, 14 nt, Human
cucugcccaacccu

SEQ ID NO: 2446941 - RNA, 17 nt, Human
cucugccucccaucacc

SEQ ID NO: 2446942 - RNA, 16 nt, Human
cucugccucccaucac

SEQ ID NO: 2446943 - RNA, 14 nt, Human
cucugccucccauc

SEQ ID NO: 2446944 - RNA, 13 nt, Human
cucugccucccau

SEQ ID NO: 2446945 - RNA, 12 nt, Human
cucugcccuugg

SEQ ID NO: 2446946 - RNA, 20 nt, Human
cucugcccuaaugcgcaggc

SEQ ID NO: 2446947 - RNA, 21 nt, Human
cucugccgcaauacaggaacc

SEQ ID NO: 2446948 - RNA, 18 nt, Human
cucugccgcaauacagga

SEQ ID NO: 2446949 - RNA, 21 nt, Human
cucugcccuuguucccuaggg

SEQ ID NO: 2446950 - RNA, 19 nt, Human
cucugcccuuguucccuag

SEQ ID NO: 2446951 - RNA, 17 nt, Human
cucugcccccugcuggc

SEQ ID NO: 2446952 - RNA, 12 nt, Human
cucugcccccug

SEQ ID NO: 2446953 - RNA, 23 nt, Human
cucugccggcucuuuccuugcuc

SEQ ID NO: 2446954 - RNA, 20 nt, Human
cucugccggcucuuuccuug

SEQ ID NO: 2446955 - RNA, 18 nt, Human
cucugccggcucuuuccu

SEQ ID NO: 2446956 - RNA, 15 nt, Human
cucugccggcucuuu

SEQ ID NO: 2446957 - RNA, 14 nt, Human
cucugccggcucuu

SEQ ID NO: 2446958 - RNA, 20 nt, Human
cucugccgcaauacaggaac

SEQ ID NO: 2446959 - RNA, 13 nt, Human
cucugccggcucu

SEQ ID NO: 2446960 - RNA, 16 nt, Human
cucugacccagugaga

SEQ ID NO: 2446961 - RNA, 12 nt, Human
cucugaccccuc

SEQ ID NO: 2446962 - RNA, 18 nt, Human
cucugaccccuccucacu

SEQ ID NO: 2446963 - RNA, 16 nt, Human
cucugaccccuccuca

SEQ ID NO: 2446964 - RNA, 14 nt, Human
cucugaccccuccu

SEQ ID NO: 2446965 - RNA, 13 nt, Human
cucugaccccucc

SEQ ID NO: 2446966 - RNA, 21 nt, Human
cucugaccccuccucacuggc

SEQ ID NO: 2446967 - RNA, 17 nt, Human
cucugaccgaaacagcg

SEQ ID NO: 2446968 - RNA, 19 nt, Human
cucugaccgaaacagcgcu

SEQ ID NO: 2446969 - RNA, 14 nt, Human
cucugaccugcacu

SEQ ID NO: 2446970 - RNA, 12 nt, Human
cucugaccugca

SEQ ID NO: 2446971 - RNA, 17 nt, Human
cucugaccucuuggcca

SEQ ID NO: 2446972 - RNA, 23 nt, Human
cucugaccuacucgagggacuua

SEQ ID NO: 2446973 - RNA, 22 nt, Human
cucugaccgaaacagcgcuggg

SEQ ID NO: 2446974 - RNA, 23 nt, Human
cucugaccgaaacagcgcugggu

SEQ ID NO: 2446975 - RNA, 21 nt, Human
cucugagacucgcgacaaugc

SEQ ID NO: 2446976 - RNA, 17 nt, Human
cucugacucagggcucc

SEQ ID NO: 2446977 - RNA, 20 nt, Human
cucugacucagggcuccugg

SEQ ID NO: 2446978 - RNA, 21 nt, Human
cucugacucagggcuccuggg

SEQ ID NO: 2446979 - RNA, 15 nt, Human
cucugacucucaaau

SEQ ID NO: 2446980 - RNA, 15 nt, Human
cucugacucagggcu

SEQ ID NO: 2446981 - RNA, 16 nt, Human
cucugacucagggcuc

SEQ ID NO: 2446982 - RNA, 14 nt, Human
cucugacucagggc

SEQ ID NO: 2446983 - RNA, 16 nt, Human
cucugaccugcaggcc

SEQ ID NO: 2446984 - RNA, 15 nt, Human
cucugaccugcacug

SEQ ID NO: 2446985 - RNA, 13 nt, Human
cucugaccugcag

SEQ ID NO: 2446986 - RNA, 14 nt, Human
cucugaccugcagg

SEQ ID NO: 2446987 - RNA, 15 nt, Human
cucugaccugcaggc

SEQ ID NO: 2446988 - RNA, 14 nt, Human
cucugaggacacua

SEQ ID NO: 2446989 - RNA, 12 nt, Human
cucugaggacac

SEQ ID NO: 2446990 - RNA, 19 nt, Human
cucugaggugccuguccca

SEQ ID NO: 2446991 - RNA, 15 nt, Human
cucugaggugccugu

SEQ ID NO: 2446992 - RNA, 22 nt, Human
cucugaggugccugucccaccc

SEQ ID NO: 2446993 - RNA, 16 nt, Human
cucugaguaucuccuc

SEQ ID NO: 2446994 - RNA, 16 nt, Human
cucugaggacacuaac

SEQ ID NO: 2446995 - RNA, 23 nt, Human
cucugagacucgcgacaaugcaa

SEQ ID NO: 2446996 - RNA, 18 nt, Human
cucugacucucaaaucuu

SEQ ID NO: 2446997 - RNA, 16 nt, Human
cucugacucucaaauc

SEQ ID NO: 2446998 - RNA, 20 nt, Human
cucugagacucgcgacaaug

SEQ ID NO: 2446999 - RNA, 13 nt, Human
cucugagcuuugc

SEQ ID NO: 2447000 - RNA, 16 nt, Human
cucugagcugugcagg

SEQ ID NO: 2447001 - RNA, 17 nt, Human
cucugagcuuugcaugu

SEQ ID NO: 2447002 - RNA, 19 nt, Human
cucugacacacagcucugu

SEQ ID NO: 2447003 - RNA, 23 nt, Human
cucugacagaagaaccccagggu

SEQ ID NO: 2447004 - RNA, 18 nt, Human
cucugacacacagcucug

SEQ ID NO: 2447005 - RNA, 17 nt, Human
cucugacacacagcucu

SEQ ID NO: 2447006 - RNA, 16 nt, Human
cucugacacacagcuc

SEQ ID NO: 2447007 - RNA, 15 nt, Human
cucugacacacagcu

SEQ ID NO: 2447008 - RNA, 21 nt, Human
cucugacaacagacuucugaa

SEQ ID NO: 2447009 - RNA, 22 nt, Human
cucugacaacagacuucugaaa

SEQ ID NO: 2447010 - RNA, 14 nt, Human
cucugacacacagc

SEQ ID NO: 2447011 - RNA, 14 nt, Human
cucugaagggaggu

SEQ ID NO: 2447012 - RNA, 13 nt, Human
cucugaagggagg

SEQ ID NO: 2447013 - RNA, 17 nt, Human
cucugaagggcaucaug

SEQ ID NO: 2447014 - RNA, 19 nt, Human
cucugaagggcaucaugca

SEQ ID NO: 2447015 - RNA, 22 nt, Human
cucugaagggcaucaugcaucu

SEQ ID NO: 2447016 - RNA, 22 nt, Human
cucugaaggacauugcggacag

SEQ ID NO: 2447017 - RNA, 23 nt, Human
cucgcugaugcugggcugggugc

SEQ ID NO: 2447018 - RNA, 22 nt, Human
cucgcugaugcugggcugggug

SEQ ID NO: 2447019 - RNA, 21 nt, Human
cucgcugaugcugggcugggu

SEQ ID NO: 2447020 - RNA, 20 nt, Human
cucgcugaugcugggcuggg

SEQ ID NO: 2447021 - RNA, 12 nt, Human
cucgcugccagc

SEQ ID NO: 2447022 - RNA, 18 nt, Human
cucgcugcacaaauacuc

SEQ ID NO: 2447023 - RNA, 23 nt, Human
cucugaagugaaacugcuuguuu

SEQ ID NO: 2447024 - RNA, 19 nt, Human
cucugaagugaaacugcuu

SEQ ID NO: 2447025 - RNA, 23 nt, Human
cucugaagucacaucacaggaca

SEQ ID NO: 2447026 - RNA, 23 nt, Human
cucugaagggcaucaugcaucuu

SEQ ID NO: 2447027 - RNA, 13 nt, Human
cucugaagucaca

SEQ ID NO: 2447028 - RNA, 18 nt, Human
cucugaaugguccagggu

SEQ ID NO: 2447029 - RNA, 17 nt, Human
cucugaaugguccaggg

SEQ ID NO: 2447030 - RNA, 21 nt, Human
cucugaauuaguccuugcuug

SEQ ID NO: 2447031 - RNA, 20 nt, Human
cucugaauuaguccuugcuu

SEQ ID NO: 2447032 - RNA, 16 nt, Human
cucugacaacagacuu

SEQ ID NO: 2447033 - RNA, 19 nt, Human
cucugaauuugagauacaa

SEQ ID NO: 2447034 - RNA, 14 nt, Human
cugagccagauuuc

SEQ ID NO: 2447035 - RNA, 13 nt, Human
cugagccagauuu

SEQ ID NO: 2447036 - RNA, 23 nt, Human
cugagccaguucaguaccuggag

SEQ ID NO: 2447037 - RNA, 20 nt, Human
cugagcagugaaugauucag

SEQ ID NO: 2447038 - RNA, 22 nt, Human
cugagccaagcuagaauucccu

SEQ ID NO: 2447039 - RNA, 12 nt, Human
cugagcaggugu

SEQ ID NO: 2447040 - RNA, 18 nt, Human
cugagcaggaccucugaa

SEQ ID NO: 2447041 - RNA, 13 nt, Human
cugagcagggaga

SEQ ID NO: 2447042 - RNA, 23 nt, Human
cugagcaccugcuucaugcucag

SEQ ID NO: 2447043 - RNA, 17 nt, Human
cugagcaccugcuucau

SEQ ID NO: 2447044 - RNA, 16 nt, Human
cugagcaccugcuuca

SEQ ID NO: 2447045 - RNA, 19 nt, Human
cugagcacauucuggcuca

SEQ ID NO: 2447046 - RNA, 13 nt, Human
cugagcaccugcu

SEQ ID NO: 2447047 - RNA, 17 nt, Human
cugagcaagagcuggca

SEQ ID NO: 2447048 - RNA, 16 nt, Human
cugagcaagagcuggc

SEQ ID NO: 2447049 - RNA, 15 nt, Human
cugagcaagagcugg

SEQ ID NO: 2447050 - RNA, 14 nt, Human
cugagcaagagcug

SEQ ID NO: 2447051 - RNA, 16 nt, Human
cugagcaaugucugug

SEQ ID NO: 2447052 - RNA, 20 nt, Human
cugagcaagagcuggcaaag

SEQ ID NO: 2447053 - RNA, 15 nt, Human
cugagcaaugucugu

SEQ ID NO: 2447054 - RNA, 17 nt, Human
cugagcacacuuuagug

SEQ ID NO: 2447055 - RNA, 19 nt, Human
cugagcaaugucugugcua

SEQ ID NO: 2447056 - RNA, 18 nt, Human
cugagcaaugucugugcu

SEQ ID NO: 2447057 - RNA, 17 nt, Human
cugagcaaugucugugc

SEQ ID NO: 2447058 - RNA, 13 nt, Human
cugagcaccaggg

SEQ ID NO: 2447059 - RNA, 16 nt, Human
cugagcaggauuuuaa

SEQ ID NO: 2447060 - RNA, 16 nt, Human
cugagcaggaccucug

SEQ ID NO: 2447061 - RNA, 23 nt, Human
cugagcagagucuugcuaccuca

SEQ ID NO: 2447062 - RNA, 22 nt, Human
cugagcagagucuugcuaccuc

SEQ ID NO: 2447063 - RNA, 21 nt, Human
cugagcagacuggugagcaga

SEQ ID NO: 2447064 - RNA, 22 nt, Human
cugagcagacuggugagcagac

SEQ ID NO: 2447065 - RNA, 16 nt, Human
cugagcagacugguga

SEQ ID NO: 2447066 - RNA, 17 nt, Human
cugagcagacuggugag

SEQ ID NO: 2447067 - RNA, 16 nt, Human
cugagaugugaacaca

SEQ ID NO: 2447068 - RNA, 20 nt, Human
cugagaugugaacacaucag

SEQ ID NO: 2447069 - RNA, 22 nt, Human
cugagacagcccgggcucugcc

SEQ ID NO: 2447070 - RNA, 21 nt, Human
cugagacagcccgggcucugc

SEQ ID NO: 2447071 - RNA, 19 nt, Human
cugagaaagacuauucaaa

SEQ ID NO: 2447072 - RNA, 20 nt, Human
cugagaaagacuauucaaac

SEQ ID NO: 2447073 - RNA, 19 nt, Human
cugagacagcccgggcucu

SEQ ID NO: 2447074 - RNA, 20 nt, Human
cugagacagcccgggcucug

SEQ ID NO: 2447075 - RNA, 21 nt, Human
cugagauuucaucugcucucc

SEQ ID NO: 2447076 - RNA, 20 nt, Human
cugagauuucaucugcucuc

SEQ ID NO: 2447077 - RNA, 19 nt, Human
cugagauuucaucugcucu

SEQ ID NO: 2447078 - RNA, 18 nt, Human
cugagauuucaucugcuc

SEQ ID NO: 2447079 - RNA, 16 nt, Human
cugagauuucaucugc

SEQ ID NO: 2447080 - RNA, 15 nt, Human
cugagauuucaucug

SEQ ID NO: 2447081 - RNA, 14 nt, Human
cugagauuucaucu

SEQ ID NO: 2447082 - RNA, 21 nt, Human
cugagaugugaacacaucagc

SEQ ID NO: 2447083 - RNA, 23 nt, Human
cugagauuauaggcaccuaccac

SEQ ID NO: 2447084 - RNA, 19 nt, Human
cugagauuauuuuaaucua

SEQ ID NO: 2447085 - RNA, 21 nt, Human
cugagcaaauguggcuccugg

SEQ ID NO: 2447086 - RNA, 20 nt, Human
cugagcaaauguggcuccug

SEQ ID NO: 2447087 - RNA, 17 nt, Human
cugagcaaauguggcuc

SEQ ID NO: 2447088 - RNA, 15 nt, Human
cugagcaaauguggc

SEQ ID NO: 2447089 - RNA, 20 nt, Human
cugagcaacucuugauuauc

SEQ ID NO: 2447090 - RNA, 12 nt, Human
cugagcaagagc

SEQ ID NO: 2447091 - RNA, 12 nt, Human
cugagcaaagca

SEQ ID NO: 2447092 - RNA, 22 nt, Human
cugagauuucaucugcucuccu

SEQ ID NO: 2447093 - RNA, 16 nt, Human
cugagcaacagaguga

SEQ ID NO: 2447094 - RNA, 23 nt, Human
cugagcaacagagugagacccug

SEQ ID NO: 2447095 - RNA, 24 nt, Human
cugagcaacagagugagacccugu

SEQ ID NO: 2447096 - RNA, 20 nt, Human
cugacucgucugacugugug

SEQ ID NO: 2447097 - RNA, 18 nt, Human
cugacucgguuucuccaa

SEQ ID NO: 2447098 - RNA, 17 nt, Human
cugacucgguuucucca

SEQ ID NO: 2447099 - RNA, 16 nt, Human
cugacucgguuucucc

SEQ ID NO: 2447100 - RNA, 19 nt, Human
cugacuccucuaagccacu

SEQ ID NO: 2447101 - RNA, 17 nt, Human
cugacuccucuaagcca

SEQ ID NO: 2447102 - RNA, 15 nt, Human
cugacucgguuucuc

SEQ ID NO: 2447103 - RNA, 13 nt, Human
cugacuccuuaga

SEQ ID NO: 2447104 - RNA, 15 nt, Human
cugacuccuuagaga

SEQ ID NO: 2447105 - RNA, 12 nt, Human
cugacugggagu

SEQ ID NO: 2447106 - RNA, 16 nt, Human
cugacugaugcuuuca

SEQ ID NO: 2447107 - RNA, 19 nt, Human
cugacugauguugagggaa

SEQ ID NO: 2447108 - RNA, 22 nt, Human
cugacuacugggcaaagagugu

SEQ ID NO: 2447109 - RNA, 16 nt, Human
cugacuacugggcaaa

SEQ ID NO: 2447110 - RNA, 15 nt, Human
cugacuacugggcaa

SEQ ID NO: 2447111 - RNA, 17 nt, Human
cugacuacuggcucuca

SEQ ID NO: 2447112 - RNA, 16 nt, Human
cugacucagggcuccu

SEQ ID NO: 2447113 - RNA, 18 nt, Human
cugacucagggcuccugg

SEQ ID NO: 2447114 - RNA, 19 nt, Human
cugacucagggcuccuggg

SEQ ID NO: 2447115 - RNA, 21 nt, Human
cugacucagggcuccuggguu

SEQ ID NO: 2447116 - RNA, 16 nt, Human
cugacucauucugaag

SEQ ID NO: 2447117 - RNA, 13 nt, Human
cugacuccagugg

SEQ ID NO: 2447118 - RNA, 15 nt, Human
cugacucagggcucc

SEQ ID NO: 2447119 - RNA, 12 nt, Human
cugagaaagacu

SEQ ID NO: 2447120 - RNA, 13 nt, Human
cugagaaagacua

SEQ ID NO: 2447121 - RNA, 15 nt, Human
cugagaaagacuauu

SEQ ID NO: 2447122 - RNA, 18 nt, Human
cugagaaagacuauucaa

SEQ ID NO: 2447123 - RNA, 22 nt, Human
cugacuggugcuauaggcugga

SEQ ID NO: 2447124 - RNA, 17 nt, Human
cugacuguacuccuccc

SEQ ID NO: 2447125 - RNA, 18 nt, Human
cugacuuugcucuuucuu

SEQ ID NO: 2447126 - RNA, 21 nt, Human
cugagaaaagcuuugaacccu

SEQ ID NO: 2447127 - RNA, 18 nt, Human
cugacagacacaggcccg

SEQ ID NO: 2447128 - RNA, 17 nt, Human
cugacagacacaggccc

SEQ ID NO: 2447129 - RNA, 16 nt, Human
cugaccagcagcgccu

SEQ ID NO: 2447130 - RNA, 20 nt, Human
cugaccagcagcgccuuucc

SEQ ID NO: 2447131 - RNA, 21 nt, Human
cugaccagcagcgccuuuccc

SEQ ID NO: 2447132 - RNA, 22 nt, Human
cugaccagcagcgccuuuccca

SEQ ID NO: 2447133 - RNA, 17 nt, Human
cugaccagccuccaugc

SEQ ID NO: 2447134 - RNA, 14 nt, Human
cugaauuucuuuug

SEQ ID NO: 2447135 - RNA, 16 nt, Human
cugacagacacaggcc

SEQ ID NO: 2447136 - RNA, 14 nt, Human
cugaauuuucacau

SEQ ID NO: 2447137 - RNA, 13 nt, Human
cugaauuuucaca

SEQ ID NO: 2447138 - RNA, 20 nt, Human
cugaauuuucacaugaacau

SEQ ID NO: 2447139 - RNA, 21 nt, Human
cugaauuuggccugcacuaau

SEQ ID NO: 2447140 - RNA, 23 nt, Human
cugaccagccuccaugcugccuc

SEQ ID NO: 2447141 - RNA, 21 nt, Human
cugaccagccuccaugcugcc

SEQ ID NO: 2447142 - RNA, 23 nt, Human
cugaccaguuuaaccugaugcag

SEQ ID NO: 2447143 - RNA, 21 nt, Human
cugacgaacuuccauggcccu

SEQ ID NO: 2447144 - RNA, 23 nt, Human
cugaccuuugucaucuuucuucu

SEQ ID NO: 2447145 - RNA, 21 nt, Human
cugaccuuugucaucuuucuu

SEQ ID NO: 2447146 - RNA, 22 nt, Human
cugacggaagccaacuuggcuu

SEQ ID NO: 2447147 - RNA, 21 nt, Human
cugacggaagccaacuuggcu

SEQ ID NO: 2447148 - RNA, 16 nt, Human
cugacggaagccaacu

SEQ ID NO: 2447149 - RNA, 16 nt, Human
cugacgcaacccacgu

SEQ ID NO: 2447150 - RNA, 23 nt, Human
cugacggaagccaacuuggcuuu

SEQ ID NO: 2447151 - RNA, 15 nt, Human
cugacggccagggag

SEQ ID NO: 2447152 - RNA, 19 nt, Human
cugacggccagggagaagc

SEQ ID NO: 2447153 - RNA, 20 nt, Human
cugacggccagggagaagcu

SEQ ID NO: 2447154 - RNA, 21 nt, Human
cugacggccagggagaagcuc

SEQ ID NO: 2447155 - RNA, 23 nt, Human
cugacgugccuuuugcaccccuc

SEQ ID NO: 2447156 - RNA, 22 nt, Human
cugacgugccuuuugcaccccu

SEQ ID NO: 2447157 - RNA, 20 nt, Human
cugacgugccuuuugcaccc

SEQ ID NO: 2447158 - RNA, 18 nt, Human
cugacgugccuuuugcac

SEQ ID NO: 2447159 - RNA, 17 nt, Human
cugacgugccuuuugca

SEQ ID NO: 2447160 - RNA, 14 nt, Human
cugacgugccuuuu

SEQ ID NO: 2447161 - RNA, 22 nt, Human
cugacguagcugcaaaggacag

SEQ ID NO: 2447162 - RNA, 18 nt, Human
cugacggugcagucuggg

SEQ ID NO: 2447163 - RNA, 18 nt, Human
cugacguagcugcaaagg

SEQ ID NO: 2447164 - RNA, 23 nt, Human
cugacguagcugcaaaggacaga

SEQ ID NO: 2447165 - RNA, 16 nt, Human
cugacggugcagucug

SEQ ID NO: 2447166 - RNA, 21 nt, Human
cugacggggaggaaccacugc

SEQ ID NO: 2447167 - RNA, 15 nt, Human
cucuucucuuccugu

SEQ ID NO: 2447168 - RNA, 14 nt, Human
cucuucucuuccug

SEQ ID NO: 2447169 - RNA, 22 nt, Human
cucuucugacgugccuuuugca

SEQ ID NO: 2447170 - RNA, 20 nt, Human
cucuucugacgugccuuuug

SEQ ID NO: 2447171 - RNA, 12 nt, Human
cucuucugagcu

SEQ ID NO: 2447172 - RNA, 17 nt, Human
cucuucugacgugccuu

SEQ ID NO: 2447173 - RNA, 16 nt, Human
cucuucucuuccugua

SEQ ID NO: 2447174 - RNA, 16 nt, Human
cucuucugacgugccu

SEQ ID NO: 2447175 - RNA, 14 nt, Human
cucuucuccccaga

SEQ ID NO: 2447176 - RNA, 13 nt, Human
cucuucuccccag

SEQ ID NO: 2447177 - RNA, 16 nt, Human
cucuucuccaggcugu

SEQ ID NO: 2447178 - RNA, 23 nt, Human
cucuuuggucuacacugugcuga

SEQ ID NO: 2447179 - RNA, 22 nt, Human
cucuuuggucuacacugugcug

SEQ ID NO: 2447180 - RNA, 15 nt, Human
cucuucugagcuauu

SEQ ID NO: 2447181 - RNA, 18 nt, Human
cucuucugagcuauuuca

SEQ ID NO: 2447182 - RNA, 21 nt, Human
cucuucugagcuauuucaucu

SEQ ID NO: 2447183 - RNA, 22 nt, Human
cucuucugagcuauuucaucua

SEQ ID NO: 2447184 - RNA, 23 nt, Human
cucuucugagcuauuucaucuau

SEQ ID NO: 2447185 - RNA, 16 nt, Human
cucuucugcaucuugg

SEQ ID NO: 2447186 - RNA, 20 nt, Human
cucuucugccggcccugggg

SEQ ID NO: 2447187 - RNA, 12 nt, Human
cucuucugcucc

SEQ ID NO: 2447188 - RNA, 19 nt, Human
cucuuuguucucagcuccc

SEQ ID NO: 2447189 - RNA, 17 nt, Human
cucuuuguucucagcuc

SEQ ID NO: 2447190 - RNA, 22 nt, Human
cucuuugucuaaaacaauaaaa

SEQ ID NO: 2447191 - RNA, 16 nt, Human
cucuuugucuaaaaca

SEQ ID NO: 2447192 - RNA, 17 nt, Human
cucuuugucuaaaacaa

SEQ ID NO: 2447193 - RNA, 18 nt, Human
cucuuugucuaaaacaau

SEQ ID NO: 2447194 - RNA, 21 nt, Human
cucuuugucuaaaacaauaaa

SEQ ID NO: 2447195 - RNA, 12 nt, Human
cucuuuguaaga

SEQ ID NO: 2447196 - RNA, 14 nt, Human
cucuuugucuaaaa

SEQ ID NO: 2447197 - RNA, 21 nt, Human
cucuucugccggcccuggggc

SEQ ID NO: 2447198 - RNA, 20 nt, Human
cucuuuguucuaaagaugga

SEQ ID NO: 2447199 - RNA, 23 nt, Human
cugaaagggacgcuacccgggaa

SEQ ID NO: 2447200 - RNA, 14 nt, Human
cucuuuucaaaaca

SEQ ID NO: 2447201 - RNA, 23 nt, Human
cugaaagugaaaguccagaaacu

SEQ ID NO: 2447202 - RNA, 19 nt, Human
cugaaagugaaaguccaga

SEQ ID NO: 2447203 - RNA, 20 nt, Human
cugaaaugcugcauuuuaau

SEQ ID NO: 2447204 - RNA, 17 nt, Human
cugaaauucuccuggag

SEQ ID NO: 2447205 - RNA, 16 nt, Human
cugaaauucuccugga

SEQ ID NO: 2447206 - RNA, 15 nt, Human
cugaaauucuccugg

SEQ ID NO: 2447207 - RNA, 14 nt, Human
cugaaauucuccug

SEQ ID NO: 2447208 - RNA, 19 nt, Human
cugaaauucuccuggaggu

SEQ ID NO: 2447209 - RNA, 18 nt, Human
cugaaauucuccuggagg

SEQ ID NO: 2447210 - RNA, 19 nt, Human
cugaaauuuuauaugcuua

SEQ ID NO: 2447211 - RNA, 22 nt, Human
cugaaauuuuauaugcuuacug

SEQ ID NO: 2447212 - RNA, 12 nt, Human
cugaacaagaau

SEQ ID NO: 2447213 - RNA, 13 nt, Human
cugaacaagaauu

SEQ ID NO: 2447214 - RNA, 14 nt, Human
cugaacaagaauug

SEQ ID NO: 2447215 - RNA, 16 nt, Human
cugaacaagaauugga

SEQ ID NO: 2447216 - RNA, 21 nt, Human
cugaacaaacuaucagaggaa

SEQ ID NO: 2447217 - RNA, 16 nt, Human
cugaacaaaaaauaaa

SEQ ID NO: 2447218 - RNA, 16 nt, Human
cugaacaauucucucu

SEQ ID NO: 2447219 - RNA, 19 nt, Human
cugaacaauaggcuguucc

SEQ ID NO: 2447220 - RNA, 21 nt, Human
cugaacaauaggcuguuccca

SEQ ID NO: 2447221 - RNA, 14 nt, Human
cugaacauugcaua

SEQ ID NO: 2447222 - RNA, 16 nt, Human
cugaaaugcugcauuu

SEQ ID NO: 2447223 - RNA, 20 nt, Human
cugaacauccuuccuuccca

SEQ ID NO: 2447224 - RNA, 17 nt, Human
cugaacauccuuccuuc

SEQ ID NO: 2447225 - RNA, 15 nt, Human
cugaacauuccagag

SEQ ID NO: 2447226 - RNA, 13 nt, Human
cugaacuuugcug

SEQ ID NO: 2447227 - RNA, 14 nt, Human
cugaacuuugcuga

SEQ ID NO: 2447228 - RNA, 21 nt, Human
cugaacuuugcugagccugua

SEQ ID NO: 2447229 - RNA, 15 nt, Human
cugaagaaccagucc

SEQ ID NO: 2447230 - RNA, 22 nt, Human
cugaagaaccaguccccccacc

SEQ ID NO: 2447231 - RNA, 14 nt, Human
cugaagaaccaguc

SEQ ID NO: 2447232 - RNA, 13 nt, Human
cugaagaacagua

SEQ ID NO: 2447233 - RNA, 14 nt, Human
cugaaccaucccug

SEQ ID NO: 2447234 - RNA, 16 nt, Human
cugaaccaucccugau

SEQ ID NO: 2447235 - RNA, 14 nt, Human
cugaacccugugcu

SEQ ID NO: 2447236 - RNA, 13 nt, Human
cugaacccugugc

SEQ ID NO: 2447237 - RNA, 12 nt, Human
cugaacuuugcu

SEQ ID NO: 2447238 - RNA, 21 nt, Human
cugaaccccgucgaggggcuc

SEQ ID NO: 2447239 - RNA, 16 nt, Human
cugaaccccucccucc

SEQ ID NO: 2447240 - RNA, 22 nt, Human
cugaaugcuuauagguggccuc

SEQ ID NO: 2447241 - RNA, 21 nt, Human
cugaaugcuuauagguggccu

SEQ ID NO: 2447242 - RNA, 19 nt, Human
cugaaugcuuauagguggc

SEQ ID NO: 2447243 - RNA, 16 nt, Human
cugaaugcugcuacuu

SEQ ID NO: 2447244 - RNA, 16 nt, Human
cugaaugguccagggu

SEQ ID NO: 2447245 - RNA, 15 nt, Human
cugaaugguccaggg

SEQ ID NO: 2447246 - RNA, 14 nt, Human
cugaaugguccagg

SEQ ID NO: 2447247 - RNA, 22 nt, Human
cugaauggaagguuuguauauu

SEQ ID NO: 2447248 - RNA, 21 nt, Human
cugaauaaauaccucuuagcu

SEQ ID NO: 2447249 - RNA, 20 nt, Human
cugaaugaggucagcauguc

SEQ ID NO: 2447250 - RNA, 15 nt, Human
cugaauaaauaccuc

SEQ ID NO: 2447251 - RNA, 23 nt, Human
cugaaugccucaaugugaccagg

SEQ ID NO: 2447252 - RNA, 22 nt, Human
cugaaugccucaaugugaccag

SEQ ID NO: 2447253 - RNA, 17 nt, Human
cugaaugcucugugcga

SEQ ID NO: 2447254 - RNA, 12 nt, Human
cugaaugcucug

SEQ ID NO: 2447255 - RNA, 19 nt, Human
cugaaugguuuucaaaaua

SEQ ID NO: 2447256 - RNA, 20 nt, Human
cugaaugguuuucaaaauaa

SEQ ID NO: 2447257 - RNA, 22 nt, Human
cugaaugguuccaugccugagg

SEQ ID NO: 2447258 - RNA, 11 nt, Human
cugaauguucu

SEQ ID NO: 2447259 - RNA, 12 nt, Human
cugaauguucug

SEQ ID NO: 2447260 - RNA, 13 nt, Human
cugaauguucuga

SEQ ID NO: 2447261 - RNA, 14 nt, Human
cugaauguucugac

SEQ ID NO: 2447262 - RNA, 16 nt, Human
cugaauguucugacau

SEQ ID NO: 2447263 - RNA, 18 nt, Human
cugaaugguuccaugccu

SEQ ID NO: 2447264 - RNA, 18 nt, Human
cugaaugguccaggguug

SEQ ID NO: 2447265 - RNA, 11 nt, Human
cugaauguauu

SEQ ID NO: 2447266 - RNA, 24 nt, Human
cugaauuauaagaggcugauaauu

SEQ ID NO: 2447267 - RNA, 14 nt, Human
cugaauuauaagag

SEQ ID NO: 2447268 - RNA, 23 nt, Human
cugaauuaucuauacauaucuuu

SEQ ID NO: 2447269 - RNA, 12 nt, Human
cugaauuucuuu

SEQ ID NO: 2447270 - RNA, 12 nt, Human
cugaauuauuuu

SEQ ID NO: 2447271 - RNA, 18 nt, Human
cugaauguuuauuccuug

SEQ ID NO: 2447272 - RNA, 16 nt, Human
cugaauguuuauuccu

SEQ ID NO: 2447273 - RNA, 19 nt, Human
cugaauguuuauuccuuga

SEQ ID NO: 2447274 - RNA, 19 nt, Human
cugaauguugggacugcua

SEQ ID NO: 2447275 - RNA, 16 nt, Human
cugaauguugggacug

SEQ ID NO: 2447276 - RNA, 15 nt, Human
cugaauguugggacu

SEQ ID NO: 2447277 - RNA, 22 nt, Human
cugaauguucugacauuaacag

SEQ ID NO: 2447278 - RNA, 23 nt, Human
cugaauguucugacauuaacagu

SEQ ID NO: 2447279 - RNA, 17 nt, Human
cugaauguucugacauu

SEQ ID NO: 2447280 - RNA, 18 nt, Human
cugaauguucugacauua

SEQ ID NO: 2447281 - RNA, 19 nt, Human
cugaauguucugacauuaa

SEQ ID NO: 2447282 - RNA, 20 nt, Human
cugaauguucugacauuaac

SEQ ID NO: 2447283 - RNA, 17 nt, Human
cugaauuaaucaucuau

SEQ ID NO: 2447284 - RNA, 20 nt, Human
cugaauuaaugacagagcca

SEQ ID NO: 2447285 - RNA, 22 nt, Human
cugaauuaguccuugcuuggcu

SEQ ID NO: 2447286 - RNA, 20 nt, Human
cugaauuaguccuugcuugg

SEQ ID NO: 2447287 - RNA, 19 nt, Human
cugaauuaguccuugcuug

SEQ ID NO: 2447288 - RNA, 18 nt, Human
cugaauuaguccuugcuu

SEQ ID NO: 2447289 - RNA, 22 nt, Human
cugaauuaaugacagagccagu

SEQ ID NO: 2447290 - RNA, 17 nt, Human
cugaauuaguccuugcu

SEQ ID NO: 2447291 - RNA, 21 nt, Human
cugaauuaaugacagagccag

SEQ ID NO: 2447292 - RNA, 14 nt, Human
cugaagaagauggu

SEQ ID NO: 2447293 - RNA, 17 nt, Human
cugaagucacacaguga

SEQ ID NO: 2447294 - RNA, 19 nt, Human
cugaagucacacagugagu

SEQ ID NO: 2447295 - RNA, 18 nt, Human
cugaagucacacagugag

SEQ ID NO: 2447296 - RNA, 15 nt, Human
cugaagucacugcac

SEQ ID NO: 2447297 - RNA, 14 nt, Human
cugaagucacugca

SEQ ID NO: 2447298 - RNA, 13 nt, Human
cugaagucacugc

SEQ ID NO: 2447299 - RNA, 21 nt, Human
cugaagucacaucacaggaca

SEQ ID NO: 2447300 - RNA, 22 nt, Human
cugaagucacaucacaggacac

SEQ ID NO: 2447301 - RNA, 21 nt, Human
cugaagucacacagugagucg

SEQ ID NO: 2447302 - RNA, 19 nt, Human
cugaagucacaucacagga

SEQ ID NO: 2447303 - RNA, 20 nt, Human
cugaagucuuuguacagaca

SEQ ID NO: 2447304 - RNA, 17 nt, Human
cugaagucuuuguacag

SEQ ID NO: 2447305 - RNA, 13 nt, Human
cugaagucugaaa

SEQ ID NO: 2447306 - RNA, 15 nt, Human
cugaagucugaaauu

SEQ ID NO: 2447307 - RNA, 14 nt, Human
cugaagucugaaau

SEQ ID NO: 2447308 - RNA, 22 nt, Human
cugaagucccagauacuugggg

SEQ ID NO: 2447309 - RNA, 17 nt, Human
cugaaguucagcugcau

SEQ ID NO: 2447310 - RNA, 14 nt, Human
cugaaguucaccau

SEQ ID NO: 2447311 - RNA, 21 nt, Human
cugaaguguuucacgagagcc

SEQ ID NO: 2447312 - RNA, 16 nt, Human
cugaaguuaacagaga

SEQ ID NO: 2447313 - RNA, 13 nt, Human
cugaaguuucaca

SEQ ID NO: 2447314 - RNA, 22 nt, Human
cugaaguuggagugaguguggc

SEQ ID NO: 2447315 - RNA, 13 nt, Human
cugccccugcccc

SEQ ID NO: 2447316 - RNA, 11 nt, Human
cugccccugcc

SEQ ID NO: 2447317 - RNA, 14 nt, Human
cugccccugccccg

SEQ ID NO: 2447318 - RNA, 10 nt, Human
cugccccugc

SEQ ID NO: 2447319 - RNA, 17 nt, Human
cugccccaaccugcuga

SEQ ID NO: 2447320 - RNA, 21 nt, Human
cugccccuccucucugcccua

SEQ ID NO: 2447321 - RNA, 20 nt, Human
cugccccuccucucugcccu

SEQ ID NO: 2447322 - RNA, 21 nt, Human
cugccccaaacaaauaugcaa

SEQ ID NO: 2447323 - RNA, 13 nt, Human
cugccgcagcccu

SEQ ID NO: 2447324 - RNA, 12 nt, Human
cugccgcagccc

SEQ ID NO: 2447325 - RNA, 15 nt, Human
cugccgcaccccaga

SEQ ID NO: 2447326 - RNA, 14 nt, Human
cugccgcaccccag

SEQ ID NO: 2447327 - RNA, 16 nt, Human
cugccccugccccguc

SEQ ID NO: 2447328 - RNA, 17 nt, Human
cugccccugccccguca

SEQ ID NO: 2447329 - RNA, 15 nt, Human
cugccgcagagcugg

SEQ ID NO: 2447330 - RNA, 14 nt, Human
cugccgcagagcug

SEQ ID NO: 2447331 - RNA, 13 nt, Human
cugccgcagagcu

SEQ ID NO: 2447332 - RNA, 16 nt, Human
cugccgcaccccagag

SEQ ID NO: 2447333 - RNA, 17 nt, Human
cugccgcaccccagagu

SEQ ID NO: 2447334 - RNA, 22 nt, Human
cugccgcagcccugcagagggc

SEQ ID NO: 2447335 - RNA, 21 nt, Human
cugccgcagcccugcagaggg

SEQ ID NO: 2447336 - RNA, 20 nt, Human
cugccgcagcccugcagagg

SEQ ID NO: 2447337 - RNA, 19 nt, Human
cugccgcagcccugcagag

SEQ ID NO: 2447338 - RNA, 16 nt, Human
cugccgccccacccag

SEQ ID NO: 2447339 - RNA, 18 nt, Human
cugccgcagagcuggccg

SEQ ID NO: 2447340 - RNA, 16 nt, Human
cugccgcagagcuggc

SEQ ID NO: 2447341 - RNA, 23 nt, Human
cugccgcagcccugcagagggca

SEQ ID NO: 2447342 - RNA, 14 nt, Human
cugccgccucccag

SEQ ID NO: 2447343 - RNA, 15 nt, Human
cugccgccucccagc

SEQ ID NO: 2447344 - RNA, 16 nt, Human
cugccgccucccagcc

SEQ ID NO: 2447345 - RNA, 18 nt, Human
cugccgccucccagccug

SEQ ID NO: 2447346 - RNA, 19 nt, Human
cugccgccucccagccugg

SEQ ID NO: 2447347 - RNA, 19 nt, Human
cugccuaggaauucccagc

SEQ ID NO: 2447348 - RNA, 19 nt, Human
cugccuaaguggcugcuga

SEQ ID NO: 2447349 - RNA, 15 nt, Human
cugccggcccugggg

SEQ ID NO: 2447350 - RNA, 16 nt, Human
cugccggcccuggggc

SEQ ID NO: 2447351 - RNA, 21 nt, Human
cugccggcccuggggcuaggc

SEQ ID NO: 2447352 - RNA, 20 nt, Human
cugccuaaguggcugcugac

SEQ ID NO: 2447353 - RNA, 15 nt, Human
cugccuacugcaucg

SEQ ID NO: 2447354 - RNA, 13 nt, Human
cugccuacucacg

SEQ ID NO: 2447355 - RNA, 14 nt, Human
cugccuacugcauc

SEQ ID NO: 2447356 - RNA, 14 nt, Human
cugccuacucacga

SEQ ID NO: 2447357 - RNA, 18 nt, Human
cugccucagccucccaag

SEQ ID NO: 2447358 - RNA, 10 nt, Human
cugccucagg

SEQ ID NO: 2447359 - RNA, 17 nt, Human
cugccucagccucccga

SEQ ID NO: 2447360 - RNA, 19 nt, Human
cugccucagccucccaaag

SEQ ID NO: 2447361 - RNA, 15 nt, Human
cugccucagccuccc

SEQ ID NO: 2447362 - RNA, 16 nt, Human
cugccuaggcugaccu

SEQ ID NO: 2447363 - RNA, 18 nt, Human
cugccucucugcaggucc

SEQ ID NO: 2447364 - RNA, 17 nt, Human
cugccucucugcagguc

SEQ ID NO: 2447365 - RNA, 16 nt, Human
cugccucucugcaggu

SEQ ID NO: 2447366 - RNA, 15 nt, Human
cugccucucugcagg

SEQ ID NO: 2447367 - RNA, 23 nt, Human
cugccuccagggcuggacugagg

SEQ ID NO: 2447368 - RNA, 22 nt, Human
cugccuccagggcuggacugag

SEQ ID NO: 2447369 - RNA, 20 nt, Human
cugccuccagggcuggacug

SEQ ID NO: 2447370 - RNA, 19 nt, Human
cugccuccagggcuggacu

SEQ ID NO: 2447371 - RNA, 18 nt, Human
cugccuccagggcuggac

SEQ ID NO: 2447372 - RNA, 17 nt, Human
cugccuccagggcugga

SEQ ID NO: 2447373 - RNA, 16 nt, Human
cugccuccagggcugg

SEQ ID NO: 2447374 - RNA, 15 nt, Human
cugccuccagggcug

SEQ ID NO: 2447375 - RNA, 14 nt, Human
cugccuccagaaug

SEQ ID NO: 2447376 - RNA, 16 nt, Human
cugccuccacucccac

SEQ ID NO: 2447377 - RNA, 17 nt, Human
cugccuccacucccacu

SEQ ID NO: 2447378 - RNA, 19 nt, Human
cugccuccacucccacuuc

SEQ ID NO: 2447379 - RNA, 18 nt, Human
cugccuccacucccacuu

SEQ ID NO: 2447380 - RNA, 14 nt, Human
cugccuccagggcu

SEQ ID NO: 2447381 - RNA, 22 nt, Human
cugccuccagaauggucuuucu

SEQ ID NO: 2447382 - RNA, 17 nt, Human
cugcggcugcugugugc

SEQ ID NO: 2447383 - RNA, 16 nt, Human
cugcggcugcugugug

SEQ ID NO: 2447384 - RNA, 17 nt, Human
cugcgggaugguccugg

SEQ ID NO: 2447385 - RNA, 18 nt, Human
cugcgggaugguccuggg

SEQ ID NO: 2447386 - RNA, 19 nt, Human
cugcgggaugguccugggg

SEQ ID NO: 2447387 - RNA, 15 nt, Human
cugcggccugcugga

SEQ ID NO: 2447388 - RNA, 22 nt, Human
cugcggagugaagaggggcagc

SEQ ID NO: 2447389 - RNA, 14 nt, Human
cugcggcaucagau

SEQ ID NO: 2447390 - RNA, 21 nt, Human
cugcggcacccuugcgcuuuu

SEQ ID NO: 2447391 - RNA, 23 nt, Human
cugcggagugaagaggggcagcc

SEQ ID NO: 2447392 - RNA, 21 nt, Human
cugcggagugaagaggggcag

SEQ ID NO: 2447393 - RNA, 20 nt, Human
cugcggagugaagaggggca

SEQ ID NO: 2447394 - RNA, 19 nt, Human
cugcggagugaagaggggc

SEQ ID NO: 2447395 - RNA, 18 nt, Human
cugcggagugaagagggg

SEQ ID NO: 2447396 - RNA, 18 nt, Human
cugcgaaggggcccuggu

SEQ ID NO: 2447397 - RNA, 19 nt, Human
cugcgaaggggcccugguc

SEQ ID NO: 2447398 - RNA, 20 nt, Human
cugcggagagaggccuuguc

SEQ ID NO: 2447399 - RNA, 24 nt, Human
cugccuuuauuguguuugucauua

SEQ ID NO: 2447400 - RNA, 22 nt, Human
cugccuuuauuguguuugucau

SEQ ID NO: 2447401 - RNA, 22 nt, Human
cugccuucuucuuuuugcuguu

SEQ ID NO: 2447402 - RNA, 22 nt, Human
cugccuugaagccacugaagcu

SEQ ID NO: 2447403 - RNA, 17 nt, Human
cugcgaaggggcccugg

SEQ ID NO: 2447404 - RNA, 21 nt, Human
cugccuuugcuccucccaugu

SEQ ID NO: 2447405 - RNA, 18 nt, Human
cugccuuuggcagaguuc

SEQ ID NO: 2447406 - RNA, 18 nt, Human
cugcgguccacccaggag

SEQ ID NO: 2447407 - RNA, 20 nt, Human
cugcgggaugguccuggggc

SEQ ID NO: 2447408 - RNA, 22 nt, Human
cugcgggaugguccuggggcuc

SEQ ID NO: 2447409 - RNA, 20 nt, Human
cugcgguccacccaggagcc

SEQ ID NO: 2447410 - RNA, 19 nt, Human
cugcgguccacccaggagc

SEQ ID NO: 2447411 - RNA, 19 nt, Human
cugcguccuccucaccuca

SEQ ID NO: 2447412 - RNA, 18 nt, Human
cugcguccuccucaccuc

SEQ ID NO: 2447413 - RNA, 17 nt, Human
cugcguccuccucaccu

SEQ ID NO: 2447414 - RNA, 15 nt, Human
cugcguccuccucac

SEQ ID NO: 2447415 - RNA, 14 nt, Human
cugcguccuccuca

SEQ ID NO: 2447416 - RNA, 13 nt, Human
cugcguccuccuc

SEQ ID NO: 2447417 - RNA, 19 nt, Human
cugcgucaugcuuguguua

SEQ ID NO: 2447418 - RNA, 19 nt, Human
cugcggcugcugugugccu

SEQ ID NO: 2447419 - RNA, 14 nt, Human
cugcgucuggaggg

SEQ ID NO: 2447420 - RNA, 24 nt, Human
cugcguccuccucaccucaugccc

SEQ ID NO: 2447421 - RNA, 22 nt, Human
cugcgucuggaggggccccugc

SEQ ID NO: 2447422 - RNA, 18 nt, Human
cugcgucuggaggggccc

SEQ ID NO: 2447423 - RNA, 16 nt, Human
cugcgucuggaggggc

SEQ ID NO: 2447424 - RNA, 15 nt, Human
cugcgucuggagggg

SEQ ID NO: 2447425 - RNA, 19 nt, Human
cugcgugacaauaaaacau

SEQ ID NO: 2447426 - RNA, 13 nt, Human
cugcgucuguguu

SEQ ID NO: 2447427 - RNA, 15 nt, Human
cugcguggggacagg

SEQ ID NO: 2447428 - RNA, 15 nt, Human
cugcgugccugugga

SEQ ID NO: 2447429 - RNA, 23 nt, Human
cugcgucuggaggggccccugcu

SEQ ID NO: 2447430 - RNA, 22 nt, Human
cugccugcccaggccccugcca

SEQ ID NO: 2447431 - RNA, 21 nt, Human
cugccugcccaggccccugcc

SEQ ID NO: 2447432 - RNA, 22 nt, Human
cugccugccccgcccccagucc

SEQ ID NO: 2447433 - RNA, 18 nt, Human
cugccugccccgccccca

SEQ ID NO: 2447434 - RNA, 15 nt, Human
cugccugccccgccc

SEQ ID NO: 2447435 - RNA, 14 nt, Human
cugccugccccgcc

SEQ ID NO: 2447436 - RNA, 13 nt, Human
cugccuccaggaa

SEQ ID NO: 2447437 - RNA, 21 nt, Human
cugccugccccgcccccaguc

SEQ ID NO: 2447438 - RNA, 19 nt, Human
cugccugccccgcccccag

SEQ ID NO: 2447439 - RNA, 21 nt, Human
cugccucugacacacagcucu

SEQ ID NO: 2447440 - RNA, 18 nt, Human
cugccucugacacacagc

SEQ ID NO: 2447441 - RNA, 17 nt, Human
cugccucugacacacag

SEQ ID NO: 2447442 - RNA, 13 nt, Human
cugccuucugucc

SEQ ID NO: 2447443 - RNA, 12 nt, Human
cugccuucuguc

SEQ ID NO: 2447444 - RNA, 20 nt, Human
cugccuucuggauucuuggc

SEQ ID NO: 2447445 - RNA, 23 nt, Human
cugccuucgcuucuugccucugu

SEQ ID NO: 2447446 - RNA, 21 nt, Human
cugccuucgcuucuugccucu

SEQ ID NO: 2447447 - RNA, 21 nt, Human
cugccuucuguccugguguca

SEQ ID NO: 2447448 - RNA, 17 nt, Human
cugccuucuguccuggu

SEQ ID NO: 2447449 - RNA, 16 nt, Human
cugccuucuguccugg

SEQ ID NO: 2447450 - RNA, 15 nt, Human
cugccuucuguccug

SEQ ID NO: 2447451 - RNA, 21 nt, Human
cugccuucuucuuuuugcugu

SEQ ID NO: 2447452 - RNA, 15 nt, Human
cugccuucuucuuuu

SEQ ID NO: 2447453 - RNA, 24 nt, Human
cugccuucuucggggaacuccugg

SEQ ID NO: 2447454 - RNA, 16 nt, Human
cugccuugaagccacu

SEQ ID NO: 2447455 - RNA, 20 nt, Human
cugccuugaagccacugaag

SEQ ID NO: 2447456 - RNA, 21 nt, Human
cugccuugaagccacugaagc

SEQ ID NO: 2447457 - RNA, 12 nt, Human
cugccuggcagg

SEQ ID NO: 2447458 - RNA, 20 nt, Human
cugccuucgcuucuugccuc

SEQ ID NO: 2447459 - RNA, 11 nt, Human
cugccuggagc

SEQ ID NO: 2447460 - RNA, 22 nt, Human
cugccuggagacuuagggcacc

SEQ ID NO: 2447461 - RNA, 18 nt, Human
cugccuggacuagaggga

SEQ ID NO: 2447462 - RNA, 19 nt, Human
cugcaguugccagucaccc

SEQ ID NO: 2447463 - RNA, 16 nt, Human
cugcacuggaguccag

SEQ ID NO: 2447464 - RNA, 23 nt, Human
cugcacuugcagacucuacagag

SEQ ID NO: 2447465 - RNA, 22 nt, Human
cugcaguugccagucaccccgg

SEQ ID NO: 2447466 - RNA, 21 nt, Human
cugcaguugccagucaccccg

SEQ ID NO: 2447467 - RNA, 17 nt, Human
cugcaguugccagucac

SEQ ID NO: 2447468 - RNA, 20 nt, Human
cugcaucagcugcugaaaca

SEQ ID NO: 2447469 - RNA, 19 nt, Human
cugcaucuuggggacaucu

SEQ ID NO: 2447470 - RNA, 16 nt, Human
cugcaucuuggggaca

SEQ ID NO: 2447471 - RNA, 14 nt, Human
cugcaucuugggga

SEQ ID NO: 2447472 - RNA, 13 nt, Human
cugcaucuugggg

SEQ ID NO: 2447473 - RNA, 21 nt, Human
cugcaucugggauucccacca

SEQ ID NO: 2447474 - RNA, 22 nt, Human
cugcaucugaccagcagcgccu

SEQ ID NO: 2447475 - RNA, 21 nt, Human
cugcaucuagaggcuuccuuc

SEQ ID NO: 2447476 - RNA, 16 nt, Human
cugcaucugaccagca

SEQ ID NO: 2447477 - RNA, 17 nt, Human
cugcaucugaccagcag

SEQ ID NO: 2447478 - RNA, 18 nt, Human
cugcaucugaccagcagc

SEQ ID NO: 2447479 - RNA, 19 nt, Human
cugcaucugaccagcagcg

SEQ ID NO: 2447480 - RNA, 20 nt, Human
cugcaucugaccagcagcgc

SEQ ID NO: 2447481 - RNA, 21 nt, Human
cugcaucugaccagcagcgcc

SEQ ID NO: 2447482 - RNA, 22 nt, Human
cugcaucguuucaucuuccaac

SEQ ID NO: 2447483 - RNA, 18 nt, Human
cugcaucuacucccaagu

SEQ ID NO: 2447484 - RNA, 17 nt, Human
cugcaucuacucccaag

SEQ ID NO: 2447485 - RNA, 20 nt, Human
cugcaucuagaggcuuccuu

SEQ ID NO: 2447486 - RNA, 15 nt, Human
cugcaucuacuccca

SEQ ID NO: 2447487 - RNA, 19 nt, Human
cugcauccuccgccucccg

SEQ ID NO: 2447488 - RNA, 23 nt, Human
cugcauccuccaagaaucuaucu

SEQ ID NO: 2447489 - RNA, 17 nt, Human
cugcauccuccaagaau

SEQ ID NO: 2447490 - RNA, 20 nt, Human
cugcauccguaguucccuga

SEQ ID NO: 2447491 - RNA, 21 nt, Human
cugcauccguaguucccugaa

SEQ ID NO: 2447492 - RNA, 12 nt, Human
cugcauccccuu

SEQ ID NO: 2447493 - RNA, 16 nt, Human
cugcauccccuuggcu

SEQ ID NO: 2447494 - RNA, 15 nt, Human
cugcauccccuuggc

SEQ ID NO: 2447495 - RNA, 22 nt, Human
cugcauccccuuggcugugagg

SEQ ID NO: 2447496 - RNA, 19 nt, Human
cugcauccguaguucccug

SEQ ID NO: 2447497 - RNA, 20 nt, Human
cugcauccuccgccucccgg

SEQ ID NO: 2447498 - RNA, 16 nt, Human
cugcaucguuucaucu

SEQ ID NO: 2447499 - RNA, 22 nt, Human
cugcaugcgggcuuccuccugg

SEQ ID NO: 2447500 - RNA, 18 nt, Human
cugcaugcgggcuuccuc

SEQ ID NO: 2447501 - RNA, 21 nt, Human
cugcaugcggcccagcccggc

SEQ ID NO: 2447502 - RNA, 12 nt, Human
cugcaugcugcu

SEQ ID NO: 2447503 - RNA, 13 nt, Human
cugcaugcugcug

SEQ ID NO: 2447504 - RNA, 15 nt, Human
cugcaugcugcugga

SEQ ID NO: 2447505 - RNA, 21 nt, Human
cugcaugcuggguucugcaca

SEQ ID NO: 2447506 - RNA, 19 nt, Human
cugcaugcuggguucugca

SEQ ID NO: 2447507 - RNA, 18 nt, Human
cugcaugcugcuggacag

SEQ ID NO: 2447508 - RNA, 22 nt, Human
cugcaugcugcuggacaguauc

SEQ ID NO: 2447509 - RNA, 20 nt, Human
cugcaugcggcccagcccgg

SEQ ID NO: 2447510 - RNA, 18 nt, Human
cugcaugcggcccagccc

SEQ ID NO: 2447511 - RNA, 17 nt, Human
cugcaugcggcccagcc

SEQ ID NO: 2447512 - RNA, 16 nt, Human
cugcaugcggcccagc

SEQ ID NO: 2447513 - RNA, 15 nt, Human
cugcaugcggcccag

SEQ ID NO: 2447514 - RNA, 14 nt, Human
cugcaugcggccca

SEQ ID NO: 2447515 - RNA, 23 nt, Human
cugcaugcgagugcucauuucag

SEQ ID NO: 2447516 - RNA, 23 nt, Human
cugcaugccuggucuuuccucug

SEQ ID NO: 2447517 - RNA, 22 nt, Human
cugcaugccuggucuuuccucu

SEQ ID NO: 2447518 - RNA, 20 nt, Human
cugcaugccuggucuuuccu

SEQ ID NO: 2447519 - RNA, 21 nt, Human
cugcaucuuggggacaucucu

SEQ ID NO: 2447520 - RNA, 23 nt, Human
cugccacacaaacguauguaaau

SEQ ID NO: 2447521 - RNA, 22 nt, Human
cugccacacaaacguauguaaa

SEQ ID NO: 2447522 - RNA, 12 nt, Human
cugccacacagg

SEQ ID NO: 2447523 - RNA, 15 nt, Human
cugccacacaaacgu

SEQ ID NO: 2447524 - RNA, 13 nt, Human
cugccacacaaac

SEQ ID NO: 2447525 - RNA, 16 nt, Human
cugccacaccugagcc

SEQ ID NO: 2447526 - RNA, 15 nt, Human
cugccacaccugagc

SEQ ID NO: 2447527 - RNA, 22 nt, Human
cugccacacgucugacccucuc

SEQ ID NO: 2447528 - RNA, 23 nt, Human
cugccacacgucugacccucucc

SEQ ID NO: 2447529 - RNA, 15 nt, Human
cugccaccugcugcu

SEQ ID NO: 2447530 - RNA, 14 nt, Human
cugccaccuggggc

SEQ ID NO: 2447531 - RNA, 15 nt, Human
cugccaccuggggca

SEQ ID NO: 2447532 - RNA, 16 nt, Human
cugccaccuggggcag

SEQ ID NO: 2447533 - RNA, 18 nt, Human
cugccaccuggggcaguc

SEQ ID NO: 2447534 - RNA, 19 nt, Human
cugccaaugggagcucaug

SEQ ID NO: 2447535 - RNA, 18 nt, Human
cugccaaugggagcucau

SEQ ID NO: 2447536 - RNA, 21 nt, Human
cugcauguaaacacgccugca

SEQ ID NO: 2447537 - RNA, 11 nt, Human
cugccaggcau

SEQ ID NO: 2447538 - RNA, 13 nt, Human
cugccaggcaugg

SEQ ID NO: 2447539 - RNA, 19 nt, Human
cugccacucacuaggcccc

SEQ ID NO: 2447540 - RNA, 24 nt, Human
cugccacucacacagccaggugcc

SEQ ID NO: 2447541 - RNA, 16 nt, Human
cugccacuucccaggu

SEQ ID NO: 2447542 - RNA, 13 nt, Human
cugccacuuccca

SEQ ID NO: 2447543 - RNA, 19 nt, Human
cugccacuuugguacaugg

SEQ ID NO: 2447544 - RNA, 20 nt, Human
cugccacucacacagccagg

SEQ ID NO: 2447545 - RNA, 18 nt, Human
cugccacucacacagcca

SEQ ID NO: 2447546 - RNA, 16 nt, Human
cugccacucacuaggc

SEQ ID NO: 2447547 - RNA, 15 nt, Human
cugccacucacacag

SEQ ID NO: 2447548 - RNA, 13 nt, Human
cugccacucacac

SEQ ID NO: 2447549 - RNA, 16 nt, Human
cugccacucaggccca

SEQ ID NO: 2447550 - RNA, 23 nt, Human
cugccacucaggcccaaagccuc

SEQ ID NO: 2447551 - RNA, 12 nt, Human
cugccacucaca

SEQ ID NO: 2447552 - RNA, 17 nt, Human
cugccaucuucccagca

SEQ ID NO: 2447553 - RNA, 16 nt, Human
cugccaucuucccagc

SEQ ID NO: 2447554 - RNA, 15 nt, Human
cugccaucuucccag

SEQ ID NO: 2447555 - RNA, 14 nt, Human
cugccaucuuccca

SEQ ID NO: 2447556 - RNA, 23 nt, Human
cugccaucuuaguuuggauucuu

SEQ ID NO: 2447557 - RNA, 22 nt, Human
cugccaucuuaguuuggauucu

SEQ ID NO: 2447558 - RNA, 14 nt, Human
cugccaugccagcu

SEQ ID NO: 2447559 - RNA, 23 nt, Human
cugccaggccagccuccgagagg

SEQ ID NO: 2447560 - RNA, 22 nt, Human
cugccaggccagccuccgagag

SEQ ID NO: 2447561 - RNA, 20 nt, Human
cugccaggccagccuccgag

SEQ ID NO: 2447562 - RNA, 19 nt, Human
cugccaggccagccuccga

SEQ ID NO: 2447563 - RNA, 19 nt, Human
cugccaucuuaguuuggau

SEQ ID NO: 2447564 - RNA, 18 nt, Human
cugccaggccagccuccg

SEQ ID NO: 2447565 - RNA, 17 nt, Human
cugccaggccagccucc

SEQ ID NO: 2447566 - RNA, 16 nt, Human
cugccaggccagccuc

SEQ ID NO: 2447567 - RNA, 15 nt, Human
cugccaggccagccu

SEQ ID NO: 2447568 - RNA, 13 nt, Human
cugccaggccagc

SEQ ID NO: 2447569 - RNA, 20 nt, Human
cugccaggcagggguggggg

SEQ ID NO: 2447570 - RNA, 17 nt, Human
cugccaggcaggggugg

SEQ ID NO: 2447571 - RNA, 23 nt, Human
cugccacuuugguacauggccag

SEQ ID NO: 2447572 - RNA, 15 nt, Human
cugcccaccuggccu

SEQ ID NO: 2447573 - RNA, 14 nt, Human
cugcccaccuggcc

SEQ ID NO: 2447574 - RNA, 13 nt, Human
cugcccaccuggc

SEQ ID NO: 2447575 - RNA, 15 nt, Human
cugccaugccagcuu

SEQ ID NO: 2447576 - RNA, 16 nt, Human
cugccaugcagggccu

SEQ ID NO: 2447577 - RNA, 18 nt, Human
cugccaucuucccagcag

SEQ ID NO: 2447578 - RNA, 15 nt, Human
cugccaugcagggcc

SEQ ID NO: 2447579 - RNA, 16 nt, Human
cugcccacucccugca

SEQ ID NO: 2447580 - RNA, 15 nt, Human
cugcccacucccugc

SEQ ID NO: 2447581 - RNA, 14 nt, Human
cugcccacucccug

SEQ ID NO: 2447582 - RNA, 22 nt, Human
cugcccaccuggccucugcacu

SEQ ID NO: 2447583 - RNA, 20 nt, Human
cugcccaccuggccucugca

SEQ ID NO: 2447584 - RNA, 19 nt, Human
cugcccaccuggccucugc

SEQ ID NO: 2447585 - RNA, 18 nt, Human
cugcccaccuggccucug

SEQ ID NO: 2447586 - RNA, 17 nt, Human
cugcccaccuggccucu

SEQ ID NO: 2447587 - RNA, 22 nt, Human
cugcccagaguugcugggagcu

SEQ ID NO: 2447588 - RNA, 17 nt, Human
cugcccagccuccaagc

SEQ ID NO: 2447589 - RNA, 18 nt, Human
cugcccagaccccucugg

SEQ ID NO: 2447590 - RNA, 21 nt, Human
cugcccagaccccucuggcca

SEQ ID NO: 2447591 - RNA, 22 nt, Human
cugcccagaccccucuggccag

SEQ ID NO: 2447592 - RNA, 23 nt, Human
cugcccagaccccucuggccagg

SEQ ID NO: 2447593 - RNA, 18 nt, Human
cugcccagaguugcuggg

SEQ ID NO: 2447594 - RNA, 18 nt, Human
cugcccacucccugcaac

SEQ ID NO: 2447595 - RNA, 17 nt, Human
cugccaugcagggccuc

SEQ ID NO: 2447596 - RNA, 12 nt, Human
cugcccaccugu

SEQ ID NO: 2447597 - RNA, 18 nt, Human
cugcccaugccaccgcuu

SEQ ID NO: 2447598 - RNA, 20 nt, Human
cugcccaucugggaaaauac

SEQ ID NO: 2447599 - RNA, 18 nt, Human
cugcccaucugggaaaau

SEQ ID NO: 2447600 - RNA, 16 nt, Human
cugcccauggacaggc

SEQ ID NO: 2447601 - RNA, 18 nt, Human
cugcccauggacaggcug

SEQ ID NO: 2447602 - RNA, 22 nt, Human
cugcccaugucgcgcucagcau

SEQ ID NO: 2447603 - RNA, 21 nt, Human
cugcccaugucgcgcucagca

SEQ ID NO: 2447604 - RNA, 20 nt, Human
cugcccauggacaggcuggc

SEQ ID NO: 2447605 - RNA, 15 nt, Human
cugccccaaacaaau

SEQ ID NO: 2447606 - RNA, 15 nt, Human
cugcccaucacaggg

SEQ ID NO: 2447607 - RNA, 18 nt, Human
cugcccaucacaggguug

SEQ ID NO: 2447608 - RNA, 22 nt, Human
cugcccaucacaggguugggcc

SEQ ID NO: 2447609 - RNA, 14 nt, Human
cugcccagcuuggg

SEQ ID NO: 2447610 - RNA, 18 nt, Human
cugcccagaucccagaag

SEQ ID NO: 2447611 - RNA, 13 nt, Human
cugcccagcuugg

SEQ ID NO: 2447612 - RNA, 22 nt, Human
cugauuuuuuuuuccuucagug

SEQ ID NO: 2447613 - RNA, 21 nt, Human
cugauuuuuuuuuccuucagu

SEQ ID NO: 2447614 - RNA, 17 nt, Human
cugcaaaaauauuuaua

SEQ ID NO: 2447615 - RNA, 20 nt, Human
cugcaaaaauauuuauaaaa

SEQ ID NO: 2447616 - RNA, 21 nt, Human
cugcaaaaauauuuauaaaac

SEQ ID NO: 2447617 - RNA, 15 nt, Human
cugcaaaaauauuua

SEQ ID NO: 2447618 - RNA, 23 nt, Human
cugauuuuuuuuuccuucagugc

SEQ ID NO: 2447619 - RNA, 22 nt, Human
cugcaaagaucuguccucagcc

SEQ ID NO: 2447620 - RNA, 23 nt, Human
cugcaaagaucuguccucagccu

SEQ ID NO: 2447621 - RNA, 13 nt, Human
cugcaaagcccag

SEQ ID NO: 2447622 - RNA, 15 nt, Human
cugcaaagcccagcu

SEQ ID NO: 2447623 - RNA, 20 nt, Human
cugcaaacucacugcucaag

SEQ ID NO: 2447624 - RNA, 16 nt, Human
cugcaaacucacugcu

SEQ ID NO: 2447625 - RNA, 19 nt, Human
cugcaaacgcugccugccg

SEQ ID NO: 2447626 - RNA, 19 nt, Human
cugcaaacgcugccugccc

SEQ ID NO: 2447627 - RNA, 20 nt, Human
cugcaaacgcugccugccca

SEQ ID NO: 2447628 - RNA, 18 nt, Human
cugcaaacgcugccugcc

SEQ ID NO: 2447629 - RNA, 20 nt, Human
cugauuuuuuuuuccuucag

SEQ ID NO: 2447630 - RNA, 19 nt, Human
cugauuuuuuuuuccuuca

SEQ ID NO: 2447631 - RNA, 18 nt, Human
cugauuuuuuuuuccuuc

SEQ ID NO: 2447632 - RNA, 16 nt, Human
cugauuuuuuuuuccu

SEQ ID NO: 2447633 - RNA, 21 nt, Human
cugauuuucaaagcuuuuucc

SEQ ID NO: 2447634 - RNA, 15 nt, Human
cugauuuuuuuuccu

SEQ ID NO: 2447635 - RNA, 19 nt, Human
cugauuuuuuuuccuuuua

SEQ ID NO: 2447636 - RNA, 20 nt, Human
cugauuuuuuuuccuuuuaa

SEQ ID NO: 2447637 - RNA, 18 nt, Human
cugauuuucaaagcuuuu

SEQ ID NO: 2447638 - RNA, 14 nt, Human
cugauuuggaaaaa

SEQ ID NO: 2447639 - RNA, 12 nt, Human
cugauuuuaaca

SEQ ID NO: 2447640 - RNA, 13 nt, Human
cugauuuuaacaa

SEQ ID NO: 2447641 - RNA, 14 nt, Human
cugauuuuaacaau

SEQ ID NO: 2447642 - RNA, 17 nt, Human
cugauuuuaacaauaac

SEQ ID NO: 2447643 - RNA, 22 nt, Human
cugauuuuaacaauaacuacug

SEQ ID NO: 2447644 - RNA, 21 nt, Human
cugauggugcaaugaccuuuc

SEQ ID NO: 2447645 - RNA, 20 nt, Human
cugauggugcaaugaccuuu

SEQ ID NO: 2447646 - RNA, 19 nt, Human
cugauggugcaaugaccuu

SEQ ID NO: 2447647 - RNA, 17 nt, Human
cugauggugcaaugacc

SEQ ID NO: 2447648 - RNA, 21 nt, Human
cugauuguaacguugcugugg

SEQ ID NO: 2447649 - RNA, 20 nt, Human
cugauuguaacguugcugug

SEQ ID NO: 2447650 - RNA, 18 nt, Human
cugauuguaacguugcug

SEQ ID NO: 2447651 - RNA, 14 nt, Human
cugauuguaacguu

SEQ ID NO: 2447652 - RNA, 13 nt, Human
cugauuguauuua

SEQ ID NO: 2447653 - RNA, 17 nt, Human
cugauugugucucuugg

SEQ ID NO: 2447654 - RNA, 19 nt, Human
cugauggucagcucccuuc

SEQ ID NO: 2447655 - RNA, 17 nt, Human
cugauuggugcaacccu

SEQ ID NO: 2447656 - RNA, 14 nt, Human
cugauggucagcuc

SEQ ID NO: 2447657 - RNA, 18 nt, Human
cugauccuggaggcccag

SEQ ID NO: 2447658 - RNA, 16 nt, Human
cugauggucagcuccc

SEQ ID NO: 2447659 - RNA, 15 nt, Human
cugauggucagcucc

SEQ ID NO: 2447660 - RNA, 21 nt, Human
cugauuugcugggcaguuuuu

SEQ ID NO: 2447661 - RNA, 11 nt, Human
cugauuugcaa

SEQ ID NO: 2447662 - RNA, 11 nt, Human
cugauuugcug

SEQ ID NO: 2447663 - RNA, 16 nt, Human
cugauuugcaaaaaaa

SEQ ID NO: 2447664 - RNA, 12 nt, Human
cugauuucagga

SEQ ID NO: 2447665 - RNA, 14 nt, Human
cugauuuccuuugg

SEQ ID NO: 2447666 - RNA, 21 nt, Human
cugauugugucucuugguccu

SEQ ID NO: 2447667 - RNA, 12 nt, Human
cugauuuacagu

SEQ ID NO: 2447668 - RNA, 23 nt, Human
cugauuguaacguugcuguggga

SEQ ID NO: 2447669 - RNA, 17 nt, Human
cugauuguuucauugcg

SEQ ID NO: 2447670 - RNA, 16 nt, Human
cugauuuaggagaagc

SEQ ID NO: 2447671 - RNA, 17 nt, Human
cugauuuaggagaagcc

SEQ ID NO: 2447672 - RNA, 18 nt, Human
cugauuuaggagaagcca

SEQ ID NO: 2447673 - RNA, 20 nt, Human
cugauuuaggagaagccagg

SEQ ID NO: 2447674 - RNA, 22 nt, Human
cugauuuaggagaagccaggaa

SEQ ID NO: 2447675 - RNA, 21 nt, Human
cugauuuaggagaagccagga

SEQ ID NO: 2447676 - RNA, 13 nt, Human
cugauuucacaac

SEQ ID NO: 2447677 - RNA, 21 nt, Human
cugcacaguuuucuggcugga

SEQ ID NO: 2447678 - RNA, 23 nt, Human
cugcacaugaaucccacccacau

SEQ ID NO: 2447679 - RNA, 22 nt, Human
cugcacaugaaucccacccaca

SEQ ID NO: 2447680 - RNA, 23 nt, Human
cugcacaugacucgggggugggg

SEQ ID NO: 2447681 - RNA, 22 nt, Human
cugcacaugacucggggguggg

SEQ ID NO: 2447682 - RNA, 23 nt, Human
cugcacaugucuuguacaugugu

SEQ ID NO: 2447683 - RNA, 21 nt, Human
cugcacaugucuuguacaugu

SEQ ID NO: 2447684 - RNA, 20 nt, Human
cugcacccccuccugcugca

SEQ ID NO: 2447685 - RNA, 16 nt, Human
cugcacaugucuugua

SEQ ID NO: 2447686 - RNA, 14 nt, Human
cugcacaugucuug

SEQ ID NO: 2447687 - RNA, 21 nt, Human
cugcacaugcagcugcacccu

SEQ ID NO: 2447688 - RNA, 20 nt, Human
cugcacaugcagcugcaccc

SEQ ID NO: 2447689 - RNA, 14 nt, Human
cugcacacagcacg

SEQ ID NO: 2447690 - RNA, 20 nt, Human
cugcacacgcuccuuccucu

SEQ ID NO: 2447691 - RNA, 11 nt, Human
cugcacagagc

SEQ ID NO: 2447692 - RNA, 20 nt, Human
cugcacacaccucagaggcu

SEQ ID NO: 2447693 - RNA, 22 nt, Human
cugcacacgcuccuuccucuga

SEQ ID NO: 2447694 - RNA, 18 nt, Human
cugcacaguuuucuggcu

SEQ ID NO: 2447695 - RNA, 22 nt, Human
cugcacagugcaucucagccca

SEQ ID NO: 2447696 - RNA, 23 nt, Human
cugcacagauggauuugccugug

SEQ ID NO: 2447697 - RNA, 20 nt, Human
cugcacagauggauuugccu

SEQ ID NO: 2447698 - RNA, 20 nt, Human
cugcacagagcucuccagcu

SEQ ID NO: 2447699 - RNA, 18 nt, Human
cugcacagagcucuccag

SEQ ID NO: 2447700 - RNA, 14 nt, Human
cugcacagagcucu

SEQ ID NO: 2447701 - RNA, 13 nt, Human
cugcacagagcuc

SEQ ID NO: 2447702 - RNA, 23 nt, Human
cugcacagagcucuccagcucca

SEQ ID NO: 2447703 - RNA, 21 nt, Human
cugcacagagcucuccagcuc

SEQ ID NO: 2447704 - RNA, 12 nt, Human
cugcacagaugg

SEQ ID NO: 2447705 - RNA, 13 nt, Human
cugcacagaugga

SEQ ID NO: 2447706 - RNA, 18 nt, Human
cugcaauaaggggagagu

SEQ ID NO: 2447707 - RNA, 19 nt, Human
cugcaagugacaucucuuu

SEQ ID NO: 2447708 - RNA, 19 nt, Human
cugcaagucaguccaggau

SEQ ID NO: 2447709 - RNA, 22 nt, Human
cugcacaauaaaaauguuuaac

SEQ ID NO: 2447710 - RNA, 19 nt, Human
cugcacacaccucagaggc

SEQ ID NO: 2447711 - RNA, 15 nt, Human
cugcacacaccucag

SEQ ID NO: 2447712 - RNA, 13 nt, Human
cugcacacagcac

SEQ ID NO: 2447713 - RNA, 22 nt, Human
cugcacaagcugcacccucagg

SEQ ID NO: 2447714 - RNA, 15 nt, Human
cugcacaauaaaaau

SEQ ID NO: 2447715 - RNA, 18 nt, Human
cugcacaauaaaaauguu

SEQ ID NO: 2447716 - RNA, 15 nt, Human
cugcacuccccugcu

SEQ ID NO: 2447717 - RNA, 14 nt, Human
cugcacuccccugc

SEQ ID NO: 2447718 - RNA, 23 nt, Human
cugcaccggcuggccuggccccu

SEQ ID NO: 2447719 - RNA, 12 nt, Human
cugcaccgggcc

SEQ ID NO: 2447720 - RNA, 13 nt, Human
cugcacccucagg

SEQ ID NO: 2447721 - RNA, 14 nt, Human
cugcacccucaggc

SEQ ID NO: 2447722 - RNA, 22 nt, Human
cugcaccggcuggccuggcccc

SEQ ID NO: 2447723 - RNA, 20 nt, Human
cugcaccggcuggccuggcc

SEQ ID NO: 2447724 - RNA, 18 nt, Human
cugcacugagcagagucu

SEQ ID NO: 2447725 - RNA, 14 nt, Human
cugcacugagcaga

SEQ ID NO: 2447726 - RNA, 22 nt, Human
cugcacucugugcccaugggca

SEQ ID NO: 2447727 - RNA, 21 nt, Human
cugcacucugugcccaugggc

SEQ ID NO: 2447728 - RNA, 20 nt, Human
cugcacucugugcccauggg

SEQ ID NO: 2447729 - RNA, 18 nt, Human
cugcacucugugcccaug

SEQ ID NO: 2447730 - RNA, 17 nt, Human
cugcacucugugcccau

SEQ ID NO: 2447731 - RNA, 19 nt, Human
cugcacucuuaagcuuccg

SEQ ID NO: 2447732 - RNA, 15 nt, Human
cugcacugaugcugc

SEQ ID NO: 2447733 - RNA, 17 nt, Human
cugcacugaugcugccc

SEQ ID NO: 2447734 - RNA, 18 nt, Human
cugcacugaugcugcccc

SEQ ID NO: 2447735 - RNA, 19 nt, Human
cugcacugaugcugccccu

SEQ ID NO: 2447736 - RNA, 18 nt, Human
cugcacuugcagacucua

SEQ ID NO: 2447737 - RNA, 17 nt, Human
cugcacuccccugcugg

SEQ ID NO: 2447738 - RNA, 16 nt, Human
cugcacuccccugcug

SEQ ID NO: 2447739 - RNA, 21 nt, Human
cugcaccccuucucuccuccc

SEQ ID NO: 2447740 - RNA, 20 nt, Human
cugcaccccuucucuccucc

SEQ ID NO: 2447741 - RNA, 19 nt, Human
cugcaccccuucucuccuc

SEQ ID NO: 2447742 - RNA, 16 nt, Human
cugcacucugugccca

SEQ ID NO: 2447743 - RNA, 15 nt, Human
cugcacucugugccc

SEQ ID NO: 2447744 - RNA, 14 nt, Human
cugcacucugugcc

SEQ ID NO: 2447745 - RNA, 13 nt, Human
cugcacucugugc

SEQ ID NO: 2447746 - RNA, 23 nt, Human
cugcacucuaacccuaggcauca

SEQ ID NO: 2447747 - RNA, 19 nt, Human
cugauaagagaaucaacau

SEQ ID NO: 2447748 - RNA, 23 nt, Human
cugauaacuagauggugcugaga

SEQ ID NO: 2447749 - RNA, 24 nt, Human
cugauaacuagauggugcugagaa

SEQ ID NO: 2447750 - RNA, 18 nt, Human
cugauaacuagauggugc

SEQ ID NO: 2447751 - RNA, 19 nt, Human
cugauaacuagauggugcu

SEQ ID NO: 2447752 - RNA, 20 nt, Human
cugauaacuagauggugcug

SEQ ID NO: 2447753 - RNA, 21 nt, Human
cugauaacuagauggugcuga

SEQ ID NO: 2447754 - RNA, 22 nt, Human
cugauaacaaccuggagaccag

SEQ ID NO: 2447755 - RNA, 18 nt, Human
cugauaacaaccuggaga

SEQ ID NO: 2447756 - RNA, 17 nt, Human
cugauaacaaccuggag

SEQ ID NO: 2447757 - RNA, 16 nt, Human
cugauaacaaccugga

SEQ ID NO: 2447758 - RNA, 14 nt, Human
cugaguuccugcau

SEQ ID NO: 2447759 - RNA, 16 nt, Human
cugaguuccugcaugc

SEQ ID NO: 2447760 - RNA, 20 nt, Human
cugaguugacuugacagaac

SEQ ID NO: 2447761 - RNA, 17 nt, Human
cugaguuucauucuccu

SEQ ID NO: 2447762 - RNA, 21 nt, Human
cugaguugguguugacaugug

SEQ ID NO: 2447763 - RNA, 20 nt, Human
cugaguuucauucuccugcc

SEQ ID NO: 2447764 - RNA, 19 nt, Human
cugaguuucauucuccugc

SEQ ID NO: 2447765 - RNA, 21 nt, Human
cugaguuucauucuccugccu

SEQ ID NO: 2447766 - RNA, 18 nt, Human
cugaguuucauucuccug

SEQ ID NO: 2447767 - RNA, 19 nt, Human
cugagucugaaggcugggu

SEQ ID NO: 2447768 - RNA, 18 nt, Human
cugagucugaaggcuggg

SEQ ID NO: 2447769 - RNA, 20 nt, Human
cugagucccaggcugagccu

SEQ ID NO: 2447770 - RNA, 17 nt, Human
cugagucugaaggcugg

SEQ ID NO: 2447771 - RNA, 21 nt, Human
cugagucccaggagcugccca

SEQ ID NO: 2447772 - RNA, 17 nt, Human
cugagucccaggagcug

SEQ ID NO: 2447773 - RNA, 16 nt, Human
cugagucccaggagcu

SEQ ID NO: 2447774 - RNA, 21 nt, Human
cugaguccaagaggguccuuu

SEQ ID NO: 2447775 - RNA, 20 nt, Human
cugagucaugaucucccugc

SEQ ID NO: 2447776 - RNA, 21 nt, Human
cugagucaugaucucccugcc

SEQ ID NO: 2447777 - RNA, 18 nt, Human
cugagucauggccgggug

SEQ ID NO: 2447778 - RNA, 22 nt, Human
cugagucaugaucucccugccg

SEQ ID NO: 2447779 - RNA, 15 nt, Human
cugaguuccuagcca

SEQ ID NO: 2447780 - RNA, 16 nt, Human
cugaguuccuagccac

SEQ ID NO: 2447781 - RNA, 17 nt, Human
cugaguuccuagccacc

SEQ ID NO: 2447782 - RNA, 18 nt, Human
cugaguuccuagccaccg

SEQ ID NO: 2447783 - RNA, 22 nt, Human
cugagucugcuauauuuucaug

SEQ ID NO: 2447784 - RNA, 17 nt, Human
cugagucugcuauauuu

SEQ ID NO: 2447785 - RNA, 22 nt, Human
cugagucccaggagcugcccag

SEQ ID NO: 2447786 - RNA, 21 nt, Human
cugagucugcuauauuuucau

SEQ ID NO: 2447787 - RNA, 17 nt, Human
cugaguuacauugucau

SEQ ID NO: 2447788 - RNA, 15 nt, Human
cugagugaaccugua

SEQ ID NO: 2447789 - RNA, 13 nt, Human
cugagugaaccug

SEQ ID NO: 2447790 - RNA, 23 nt, Human
cugauauuuuaccucuuauugca

SEQ ID NO: 2447791 - RNA, 17 nt, Human
cugauauuuuaccucuu

SEQ ID NO: 2447792 - RNA, 22 nt, Human
cugauauuucccuccccugggg

SEQ ID NO: 2447793 - RNA, 22 nt, Human
cugauauugccgcacuagggga

SEQ ID NO: 2447794 - RNA, 19 nt, Human
cugauauugccgcacuagg

SEQ ID NO: 2447795 - RNA, 20 nt, Human
cugauauucaaauggacaaa

SEQ ID NO: 2447796 - RNA, 19 nt, Human
cugauauuccaugaaugua

SEQ ID NO: 2447797 - RNA, 18 nt, Human
cugauauuccaugaaugu

SEQ ID NO: 2447798 - RNA, 15 nt, Human
cugaucaccugcccu

SEQ ID NO: 2447799 - RNA, 17 nt, Human
cugaucaaugacagagc

SEQ ID NO: 2447800 - RNA, 15 nt, Human
cugaucaaugacaga

SEQ ID NO: 2447801 - RNA, 18 nt, Human
cugaucaagucaccggag

SEQ ID NO: 2447802 - RNA, 14 nt, Human
cugaucaaugacag

SEQ ID NO: 2447803 - RNA, 22 nt, Human
cugaucaagucaccggagcuuu

SEQ ID NO: 2447804 - RNA, 22 nt, Human
cugauaugauuuaaaacaugua

SEQ ID NO: 2447805 - RNA, 23 nt, Human
cugauaugauuuaaaacauguaa

SEQ ID NO: 2447806 - RNA, 21 nt, Human
cugauaugauuuaaaacaugu

SEQ ID NO: 2447807 - RNA, 19 nt, Human
cugauaugauuuaaaacau

SEQ ID NO: 2447808 - RNA, 18 nt, Human
cugauaugauuuaaaaca

SEQ ID NO: 2447809 - RNA, 16 nt, Human
cugauaugauuuaaaa

SEQ ID NO: 2447810 - RNA, 16 nt, Human
cugauauauuuuacaa

SEQ ID NO: 2447811 - RNA, 18 nt, Human
cugauauauuuuacaauu

SEQ ID NO: 2447812 - RNA, 14 nt, Human
cugauacccagagc

SEQ ID NO: 2447813 - RNA, 22 nt, Human
cugauauauguguuuuucacau

SEQ ID NO: 2447814 - RNA, 15 nt, Human
cugauauauguguuu

SEQ ID NO: 2447815 - RNA, 21 nt, Human
cugauauauguguuuuucaca

SEQ ID NO: 2447816 - RNA, 15 nt, Human
cugauaauuccagug

SEQ ID NO: 2447817 - RNA, 14 nt, Human
cugauaauaauuga

SEQ ID NO: 2447818 - RNA, 16 nt, Human
cugauggugcaaugac

SEQ ID NO: 2447819 - RNA, 15 nt, Human
cugauggugcaauga

SEQ ID NO: 2447820 - RNA, 14 nt, Human
cugauggugcaaug

SEQ ID NO: 2447821 - RNA, 15 nt, Human
cugauccuggaggcc

SEQ ID NO: 2447822 - RNA, 17 nt, Human
cugauccuggaggccca

SEQ ID NO: 2447823 - RNA, 12 nt, Human
cugauccuggag

SEQ ID NO: 2447824 - RNA, 21 nt, Human
cugauccuaguuccaccauca

SEQ ID NO: 2447825 - RNA, 20 nt, Human
cugauccuaguuccaccauc

SEQ ID NO: 2447826 - RNA, 15 nt, Human
cugaucccucuacag

SEQ ID NO: 2447827 - RNA, 13 nt, Human
cugaucagucuaa

SEQ ID NO: 2447828 - RNA, 14 nt, Human
cugaucagagccgu

SEQ ID NO: 2447829 - RNA, 17 nt, Human
cugaucagaccacggcu

SEQ ID NO: 2447830 - RNA, 20 nt, Human
cugaucagagccgugguccu

SEQ ID NO: 2447831 - RNA, 19 nt, Human
cugagcccgggcugccugg

SEQ ID NO: 2447832 - RNA, 18 nt, Human
cugagcccgggcugccug

SEQ ID NO: 2447833 - RNA, 17 nt, Human
cugagcccgggcugccu

SEQ ID NO: 2447834 - RNA, 16 nt, Human
cugagcccgggcugcc

SEQ ID NO: 2447835 - RNA, 15 nt, Human
cugagcccgggcugc

SEQ ID NO: 2447836 - RNA, 14 nt, Human
cugagcccgggcug

SEQ ID NO: 2447837 - RNA, 20 nt, Human
cugagccccuuccuugcucu

SEQ ID NO: 2447838 - RNA, 19 nt, Human
cugagccccuuccuugcuc

SEQ ID NO: 2447839 - RNA, 13 nt, Human
cugagccccuguc

SEQ ID NO: 2447840 - RNA, 15 nt, Human
cugagccccugucua

SEQ ID NO: 2447841 - RNA, 16 nt, Human
cugagccccugucuag

SEQ ID NO: 2447842 - RNA, 22 nt, Human
cugagccccugucuagagaggg

SEQ ID NO: 2447843 - RNA, 16 nt, Human
cugagccccuuccuug

SEQ ID NO: 2447844 - RNA, 14 nt, Human
cugagccccuuccu

SEQ ID NO: 2447845 - RNA, 13 nt, Human
cugagccccuucc

SEQ ID NO: 2447846 - RNA, 23 nt, Human
cugagccccugucuagagaggga

SEQ ID NO: 2447847 - RNA, 24 nt, Human
cugaggcccuucucuccagccccu

SEQ ID NO: 2447848 - RNA, 23 nt, Human
cugagcccgggcugccugggcug

SEQ ID NO: 2447849 - RNA, 22 nt, Human
cugagcccgggcugccugggcu

SEQ ID NO: 2447850 - RNA, 21 nt, Human
cugagcccgggcugccugggc

SEQ ID NO: 2447851 - RNA, 20 nt, Human
cugagcccgggcugccuggg

SEQ ID NO: 2447852 - RNA, 21 nt, Human
cugaggccuaaaaguaaacau

SEQ ID NO: 2447853 - RNA, 19 nt, Human
cugaggccuaaaaguaaac

SEQ ID NO: 2447854 - RNA, 18 nt, Human
cugagccccgcagaccuc

SEQ ID NO: 2447855 - RNA, 17 nt, Human
cugagccccgcagaccu

SEQ ID NO: 2447856 - RNA, 22 nt, Human
cugagcccccccaacacugugc

SEQ ID NO: 2447857 - RNA, 21 nt, Human
cugagcccccccaacacugug

SEQ ID NO: 2447858 - RNA, 14 nt, Human
cugagccccuaccc

SEQ ID NO: 2447859 - RNA, 13 nt, Human
cugagccccuacc

SEQ ID NO: 2447860 - RNA, 22 nt, Human
cugagccccgcagaccucccca

SEQ ID NO: 2447861 - RNA, 21 nt, Human
cugagccccgcagaccucccc

SEQ ID NO: 2447862 - RNA, 23 nt, Human
cugagccccgcagaccuccccag

SEQ ID NO: 2447863 - RNA, 22 nt, Human
cugagccccuaccccacaccag

SEQ ID NO: 2447864 - RNA, 19 nt, Human
cugagccccuaccccacac

SEQ ID NO: 2447865 - RNA, 17 nt, Human
cugagccccuaccccac

SEQ ID NO: 2447866 - RNA, 15 nt, Human
cugagccccuacccc

SEQ ID NO: 2447867 - RNA, 12 nt, Human
cugagccccugu

SEQ ID NO: 2447868 - RNA, 22 nt, Human
cugagccccugggacugcugcu

SEQ ID NO: 2447869 - RNA, 16 nt, Human
cugagccccugggacu

SEQ ID NO: 2447870 - RNA, 19 nt, Human
cugagccccugggacugcu

SEQ ID NO: 2447871 - RNA, 23 nt, Human
cugaggccugggccgcugccacg

SEQ ID NO: 2447872 - RNA, 22 nt, Human
cugaggccugggccgcugccac

SEQ ID NO: 2447873 - RNA, 19 nt, Human
cugaggccugggccgcugc

SEQ ID NO: 2447874 - RNA, 15 nt, Human
cugaggccugggccg

SEQ ID NO: 2447875 - RNA, 14 nt, Human
cugaggccugggcc

SEQ ID NO: 2447876 - RNA, 22 nt, Human
cugaggccuggacuuuccugca

SEQ ID NO: 2447877 - RNA, 20 nt, Human
cugaggccuggacuuuccug

SEQ ID NO: 2447878 - RNA, 19 nt, Human
cugaggccuggacuuuccu

SEQ ID NO: 2447879 - RNA, 15 nt, Human
cugaggccuggacuu

SEQ ID NO: 2447880 - RNA, 12 nt, Human
cugaggccugga

SEQ ID NO: 2447881 - RNA, 22 nt, Human
cugaggccugagcgcuccugcc

SEQ ID NO: 2447882 - RNA, 18 nt, Human
cugaggccugagcgcucc

SEQ ID NO: 2447883 - RNA, 15 nt, Human
cugaggccuccagcu

SEQ ID NO: 2447884 - RNA, 23 nt, Human
cugaggccuaaaaguaaacauua

SEQ ID NO: 2447885 - RNA, 17 nt, Human
cugaggccugagcgcuc

SEQ ID NO: 2447886 - RNA, 21 nt, Human
cugaggcuccacuuggucugu

SEQ ID NO: 2447887 - RNA, 23 nt, Human
cugaggcucugacccagugagau

SEQ ID NO: 2447888 - RNA, 22 nt, Human
cugaggcucugacccagugaga

SEQ ID NO: 2447889 - RNA, 20 nt, Human
cugaggcuccugugcuacuu

SEQ ID NO: 2447890 - RNA, 17 nt, Human
cugaggcuccugugcua

SEQ ID NO: 2447891 - RNA, 15 nt, Human
cugaggcucuuucug

SEQ ID NO: 2447892 - RNA, 16 nt, Human
cugaggcucuuucugg

SEQ ID NO: 2447893 - RNA, 15 nt, Human
cugaggcuccacuug

SEQ ID NO: 2447894 - RNA, 17 nt, Human
cugaggcgggagaauca

SEQ ID NO: 2447895 - RNA, 18 nt, Human
cugaggccuuaucauuca

SEQ ID NO: 2447896 - RNA, 16 nt, Human
cugaggcucagggaaa

SEQ ID NO: 2447897 - RNA, 18 nt, Human
cugaggcggguggaucac

SEQ ID NO: 2447898 - RNA, 22 nt, Human
cugaggcugggcucccuuccca

SEQ ID NO: 2447899 - RNA, 17 nt, Human
cugaggcugggcucccu

SEQ ID NO: 2447900 - RNA, 16 nt, Human
cugaggcugggcuccc

SEQ ID NO: 2447901 - RNA, 15 nt, Human
cugaggcugggcucc

SEQ ID NO: 2447902 - RNA, 17 nt, Human
cugaggcuggcacagga

SEQ ID NO: 2447903 - RNA, 18 nt, Human
cugaggcuggcacaggac

SEQ ID NO: 2447904 - RNA, 19 nt, Human
cugaggcuggcacaggaca

SEQ ID NO: 2447905 - RNA, 20 nt, Human
cugaggcuggcacaggacau

SEQ ID NO: 2447906 - RNA, 13 nt, Human
cugaggcugggcu

SEQ ID NO: 2447907 - RNA, 11 nt, Human
cugaggcuggc

SEQ ID NO: 2447908 - RNA, 13 nt, Human
cugaggcuggcac

SEQ ID NO: 2447909 - RNA, 15 nt, Human
cugaggcuggauccu

SEQ ID NO: 2447910 - RNA, 15 nt, Human
cugaggcugagacug

SEQ ID NO: 2447911 - RNA, 18 nt, Human
cugaggcucuuucugggc

SEQ ID NO: 2447912 - RNA, 20 nt, Human
cugaggcucuuucugggcca

SEQ ID NO: 2447913 - RNA, 20 nt, Human
cugagggaggaggccaccuc

SEQ ID NO: 2447914 - RNA, 19 nt, Human
cugagggaggaggccaccu

SEQ ID NO: 2447915 - RNA, 18 nt, Human
cugagggaggaggccacc

SEQ ID NO: 2447916 - RNA, 17 nt, Human
cugagggaggaggccac

SEQ ID NO: 2447917 - RNA, 16 nt, Human
cugagggaggaggcca

SEQ ID NO: 2447918 - RNA, 15 nt, Human
cugagggaggaggcc

SEQ ID NO: 2447919 - RNA, 13 nt, Human
cugagggaggagg

SEQ ID NO: 2447920 - RNA, 23 nt, Human
cugagggacucugaagccucugg

SEQ ID NO: 2447921 - RNA, 22 nt, Human
cugagggaggaggccaccucuc

SEQ ID NO: 2447922 - RNA, 21 nt, Human
cugagggaggaggccaccucu

SEQ ID NO: 2447923 - RNA, 15 nt, Human
cugagggaucuuuac

SEQ ID NO: 2447924 - RNA, 16 nt, Human
cugagggauggacuga

SEQ ID NO: 2447925 - RNA, 23 nt, Human
cugagggaggaggccaccucucc

SEQ ID NO: 2447926 - RNA, 22 nt, Human
cugagucacccaugaagacagg

SEQ ID NO: 2447927 - RNA, 20 nt, Human
cugagucacccaugaagaca

SEQ ID NO: 2447928 - RNA, 22 nt, Human
cugagucacccuaccugugccu

SEQ ID NO: 2447929 - RNA, 23 nt, Human
cugagucacccuaccugugccug

SEQ ID NO: 2447930 - RNA, 18 nt, Human
cugagucaugaucucccu

SEQ ID NO: 2447931 - RNA, 19 nt, Human
cugagucaugaucucccug

SEQ ID NO: 2447932 - RNA, 14 nt, Human
cugaggcuuccaga

SEQ ID NO: 2447933 - RNA, 14 nt, Human
cugaggcuguagga

SEQ ID NO: 2447934 - RNA, 18 nt, Human
cugaggcuuccagagagu

SEQ ID NO: 2447935 - RNA, 15 nt, Human
cugagggaccagcca

SEQ ID NO: 2447936 - RNA, 20 nt, Human
cugaggcuguggucacagcg

SEQ ID NO: 2447937 - RNA, 19 nt, Human
cugaggcuguggucacagc

SEQ ID NO: 2447938 - RNA, 17 nt, Human
cugaggcuguggucaca

SEQ ID NO: 2447939 - RNA, 14 nt, Human
cugaggcugugguc

SEQ ID NO: 2447940 - RNA, 13 nt, Human
cugaggcuguggu

SEQ ID NO: 2447941 - RNA, 21 nt, Human
cugaggcuggauccuagccuu

SEQ ID NO: 2447942 - RNA, 11 nt, Human
cugaggcugua

SEQ ID NO: 2447943 - RNA, 22 nt, Human
cugagggacucugaagccucug

SEQ ID NO: 2447944 - RNA, 21 nt, Human
cugagggacucugaagccucu

SEQ ID NO: 2447945 - RNA, 12 nt, Human
cugagggagccu

SEQ ID NO: 2447946 - RNA, 20 nt, Human
cugagggacucugaagccuc

SEQ ID NO: 2447947 - RNA, 16 nt, Human
cugagggacucugaag

SEQ ID NO: 2447948 - RNA, 14 nt, Human
cugagggacucuga

SEQ ID NO: 2447949 - RNA, 18 nt, Human
cugagggaccagccaaga

SEQ ID NO: 2447950 - RNA, 13 nt, Human
cugagggagccug

SEQ ID NO: 2447951 - RNA, 17 nt, Human
cugagggagccuggccc

SEQ ID NO: 2447952 - RNA, 15 nt, Human
cuccucuccccagca

SEQ ID NO: 2447953 - RNA, 13 nt, Human
cuccucuccccag

SEQ ID NO: 2447954 - RNA, 17 nt, Human
cuccugccgcagagcug

SEQ ID NO: 2447955 - RNA, 16 nt, Human
cuccugccgcagagcu

SEQ ID NO: 2447956 - RNA, 14 nt, Human
cuccugccgcagag

SEQ ID NO: 2447957 - RNA, 14 nt, Human
cuccucuccccagc

SEQ ID NO: 2447958 - RNA, 23 nt, Human
cuccucucccauugucccucugc

SEQ ID NO: 2447959 - RNA, 14 nt, Human
cuccugccuacuca

SEQ ID NO: 2447960 - RNA, 16 nt, Human
cuccugccuacucacg

SEQ ID NO: 2447961 - RNA, 18 nt, Human
cuccugccgcagagcugg

SEQ ID NO: 2447962 - RNA, 13 nt, Human
cuccugccuacuc

SEQ ID NO: 2447963 - RNA, 11 nt, Human
cuccugccuca

SEQ ID NO: 2447964 - RNA, 12 nt, Human
cuccugccucag

SEQ ID NO: 2447965 - RNA, 16 nt, Human
cuccugccucagccuc

SEQ ID NO: 2447966 - RNA, 17 nt, Human
cuccugccucagccucc

SEQ ID NO: 2447967 - RNA, 12 nt, Human
cuccugcugcag

SEQ ID NO: 2447968 - RNA, 22 nt, Human
cuccugcugcaccaacccagcc

SEQ ID NO: 2447969 - RNA, 16 nt, Human
cuccugcugcagaggg

SEQ ID NO: 2447970 - RNA, 21 nt, Human
cuccugcugcaccaacccagc

SEQ ID NO: 2447971 - RNA, 19 nt, Human
cuccugcugcaccaaccca

SEQ ID NO: 2447972 - RNA, 18 nt, Human
cuccugcugcaccaaccc

SEQ ID NO: 2447973 - RNA, 14 nt, Human
cuccugcugcacca

SEQ ID NO: 2447974 - RNA, 18 nt, Human
cuccugcuacucuguucc

SEQ ID NO: 2447975 - RNA, 13 nt, Human
cuccugcugcacc

SEQ ID NO: 2447976 - RNA, 22 nt, Human
cuccugccucgaacuggcugca

SEQ ID NO: 2447977 - RNA, 21 nt, Human
cuccugccucgaacuggcugc

SEQ ID NO: 2447978 - RNA, 20 nt, Human
cuccugccucgaacuggcug

SEQ ID NO: 2447979 - RNA, 18 nt, Human
cuccugccucgaacuggc

SEQ ID NO: 2447980 - RNA, 19 nt, Human
cuccugccucagccucccg

SEQ ID NO: 2447981 - RNA, 21 nt, Human
cuccugccucagccuccugag

SEQ ID NO: 2447982 - RNA, 17 nt, Human
cuccuuaucaaaggaca

SEQ ID NO: 2447983 - RNA, 22 nt, Human
cuccuuaucaaaggacaccauu

SEQ ID NO: 2447984 - RNA, 16 nt, Human
cuccuuagucuucuca

SEQ ID NO: 2447985 - RNA, 20 nt, Human
cuccuuagagacaucaaaau

SEQ ID NO: 2447986 - RNA, 21 nt, Human
cuccuuagagacaucaaaauc

SEQ ID NO: 2447987 - RNA, 23 nt, Human
cuccuucccaaaggacuccaccc

SEQ ID NO: 2447988 - RNA, 22 nt, Human
cuccuucccaaaggacuccacc

SEQ ID NO: 2447989 - RNA, 13 nt, Human
cuccuucccaaag

SEQ ID NO: 2447990 - RNA, 14 nt, Human
cuccuuccaguguc

SEQ ID NO: 2447991 - RNA, 17 nt, Human
cuccuuagucuucucau

SEQ ID NO: 2447992 - RNA, 19 nt, Human
cuccuuagucuucucauag

SEQ ID NO: 2447993 - RNA, 17 nt, Human
cuccuucccaucgcugu

SEQ ID NO: 2447994 - RNA, 16 nt, Human
cuccuucccaucgcug

SEQ ID NO: 2447995 - RNA, 24 nt, Human
cuccugugugugcgccuacaggag

SEQ ID NO: 2447996 - RNA, 23 nt, Human
cuccugugugugcgccuacagga

SEQ ID NO: 2447997 - RNA, 11 nt, Human
cuccuggacuc

SEQ ID NO: 2447998 - RNA, 18 nt, Human
cuccuggacauuuuuuca

SEQ ID NO: 2447999 - RNA, 20 nt, Human
cuccuggaagcuguguccuu

SEQ ID NO: 2448000 - RNA, 23 nt, Human
cuccuggaagcuguguccuugca

SEQ ID NO: 2448001 - RNA, 21 nt, Human
cuccugugugugcgccuacag

SEQ ID NO: 2448002 - RNA, 20 nt, Human
cuccuggaaaggcucagucu

SEQ ID NO: 2448003 - RNA, 22 nt, Human
cuccuggaaaggcucagucuca

SEQ ID NO: 2448004 - RNA, 23 nt, Human
cuccuggaaaggcucagucucag

SEQ ID NO: 2448005 - RNA, 24 nt, Human
cuccuggaaaggcucagucucagg

SEQ ID NO: 2448006 - RNA, 18 nt, Human
cuccuggaaaggcucagu

SEQ ID NO: 2448007 - RNA, 19 nt, Human
cuccuggaaaggcucaguc

SEQ ID NO: 2448008 - RNA, 17 nt, Human
cuccuggaaaggcucag

SEQ ID NO: 2448009 - RNA, 14 nt, Human
cuccuggaaauauu

SEQ ID NO: 2448010 - RNA, 15 nt, Human
cuccuggaagcugug

SEQ ID NO: 2448011 - RNA, 17 nt, Human
cuccuggaagcuguguc

SEQ ID NO: 2448012 - RNA, 11 nt, Human
cuccuggaaau

SEQ ID NO: 2448013 - RNA, 19 nt, Human
cucgagcaugccuggaugg

SEQ ID NO: 2448014 - RNA, 16 nt, Human
cucgagcaugccugga

SEQ ID NO: 2448015 - RNA, 15 nt, Human
cucgagcaugccugg

SEQ ID NO: 2448016 - RNA, 13 nt, Human
cucgagcaugccu

SEQ ID NO: 2448017 - RNA, 19 nt, Human
cuccuucgcaggcaugucc

SEQ ID NO: 2448018 - RNA, 21 nt, Human
cuccuugggcacuuuuuaauu

SEQ ID NO: 2448019 - RNA, 22 nt, Human
cuccuuggugccuggccuggca

SEQ ID NO: 2448020 - RNA, 19 nt, Human
cuccuuggugccuggccug

SEQ ID NO: 2448021 - RNA, 15 nt, Human
cuccuuggugccugg

SEQ ID NO: 2448022 - RNA, 19 nt, Human
cucgagaacuuucauuuuu

SEQ ID NO: 2448023 - RNA, 15 nt, Human
cucgagcaacugcug

SEQ ID NO: 2448024 - RNA, 21 nt, Human
cucgagacacagugaagcaaa

SEQ ID NO: 2448025 - RNA, 17 nt, Human
cucgagcaguccugccu

SEQ ID NO: 2448026 - RNA, 17 nt, Human
cuccuugggcccuuuga

SEQ ID NO: 2448027 - RNA, 18 nt, Human
cuccuugggcccuuugag

SEQ ID NO: 2448028 - RNA, 19 nt, Human
cuccuugggcccuuugagu

SEQ ID NO: 2448029 - RNA, 14 nt, Human
cuccuuggugccug

SEQ ID NO: 2448030 - RNA, 23 nt, Human
cuccuuggugucgggcaugacac

SEQ ID NO: 2448031 - RNA, 15 nt, Human
cuccuuccugugugu

SEQ ID NO: 2448032 - RNA, 18 nt, Human
cuccuuccuucaccucug

SEQ ID NO: 2448033 - RNA, 14 nt, Human
cuccuuccuugacc

SEQ ID NO: 2448034 - RNA, 17 nt, Human
cuccuuccuugaccagc

SEQ ID NO: 2448035 - RNA, 18 nt, Human
cuccuuccuugaccagca

SEQ ID NO: 2448036 - RNA, 13 nt, Human
cuccuugggcccu

SEQ ID NO: 2448037 - RNA, 16 nt, Human
cuccuugggcccuuug

SEQ ID NO: 2448038 - RNA, 12 nt, Human
cuccuugggccc

SEQ ID NO: 2448039 - RNA, 22 nt, Human
cuccuuccuugcuguccuaggc

SEQ ID NO: 2448040 - RNA, 13 nt, Human
cuccuuccuggag

SEQ ID NO: 2448041 - RNA, 14 nt, Human
cuccuuccuggaga

SEQ ID NO: 2448042 - RNA, 20 nt, Human
cuccuuccuggagcccagag

SEQ ID NO: 2448043 - RNA, 21 nt, Human
cuccuuccugccaccugcugc

SEQ ID NO: 2448044 - RNA, 16 nt, Human
cuccuuccugccaccu

SEQ ID NO: 2448045 - RNA, 13 nt, Human
cuccuuccugugu

SEQ ID NO: 2448046 - RNA, 14 nt, Human
cuccuuccugucuu

SEQ ID NO: 2448047 - RNA, 15 nt, Human
cuccuuccugucuuc

SEQ ID NO: 2448048 - RNA, 16 nt, Human
cuccuuccugucuucc

SEQ ID NO: 2448049 - RNA, 17 nt, Human
cuccuuccugucuuccu

SEQ ID NO: 2448050 - RNA, 23 nt, Human
cuccuuccuggagcccagaggag

SEQ ID NO: 2448051 - RNA, 13 nt, Human
cuccuuccugucu

SEQ ID NO: 2448052 - RNA, 12 nt, Human
cuccuuccuguc

SEQ ID NO: 2448053 - RNA, 13 nt, Human
cucgagggcaggg

SEQ ID NO: 2448054 - RNA, 23 nt, Human
cucgagggcagggaccacacccu

SEQ ID NO: 2448055 - RNA, 18 nt, Human
cucgagggcagggaccac

SEQ ID NO: 2448056 - RNA, 23 nt, Human
cucgaggacuguauuugugacua

SEQ ID NO: 2448057 - RNA, 22 nt, Human
cucgaggacuguauuugugacu

SEQ ID NO: 2448058 - RNA, 20 nt, Human
cucgaggacuguauuuguga

SEQ ID NO: 2448059 - RNA, 17 nt, Human
cucgaggacuguauuug

SEQ ID NO: 2448060 - RNA, 16 nt, Human
cucgaggacuguauuu

SEQ ID NO: 2448061 - RNA, 22 nt, Human
cucgagcaugccuggauggggc

SEQ ID NO: 2448062 - RNA, 23 nt, Human
cucgagcaguccugccucagccu

SEQ ID NO: 2448063 - RNA, 13 nt, Human
cucgcaagcuggg

SEQ ID NO: 2448064 - RNA, 14 nt, Human
cucgcaagcugggu

SEQ ID NO: 2448065 - RNA, 15 nt, Human
cucgcaccuuuccaa

SEQ ID NO: 2448066 - RNA, 14 nt, Human
cucgcaccuuucca

SEQ ID NO: 2448067 - RNA, 20 nt, Human
cucgcagagaggccaggugc

SEQ ID NO: 2448068 - RNA, 14 nt, Human
cucgcagagaggcc

SEQ ID NO: 2448069 - RNA, 16 nt, Human
cucgauuuuguaucug

SEQ ID NO: 2448070 - RNA, 15 nt, Human
cucgauuuuguaucu

SEQ ID NO: 2448071 - RNA, 14 nt, Human
cucgauuuuguauc

SEQ ID NO: 2448072 - RNA, 13 nt, Human
cucgauuuuguau

SEQ ID NO: 2448073 - RNA, 19 nt, Human
cucgauuuuguaucugcag

SEQ ID NO: 2448074 - RNA, 18 nt, Human
cucgauuuuguaucugca

SEQ ID NO: 2448075 - RNA, 20 nt, Human
cucgauuuuguaucugcagg

SEQ ID NO: 2448076 - RNA, 22 nt, Human
cucgauuuuaucuuucgcacag

SEQ ID NO: 2448077 - RNA, 14 nt, Human
cucgauuucuccag

SEQ ID NO: 2448078 - RNA, 23 nt, Human
cucgaggguuggguucaucugag

SEQ ID NO: 2448079 - RNA, 17 nt, Human
cucgauucauauugaau

SEQ ID NO: 2448080 - RNA, 22 nt, Human
cucgcuauugucaccagggcug

SEQ ID NO: 2448081 - RNA, 20 nt, Human
cucgccuggccugaggucuc

SEQ ID NO: 2448082 - RNA, 15 nt, Human
cucgcucugucaccc

SEQ ID NO: 2448083 - RNA, 13 nt, Human
cucgcucugucac

SEQ ID NO: 2448084 - RNA, 12 nt, Human
cucgcucuguca

SEQ ID NO: 2448085 - RNA, 23 nt, Human
cucgcucugucgcccaggcugga

SEQ ID NO: 2448086 - RNA, 19 nt, Human
cucgcugaugcugggcugg

SEQ ID NO: 2448087 - RNA, 18 nt, Human
cucgcugaugcugggcug

SEQ ID NO: 2448088 - RNA, 17 nt, Human
cucgcugaugcugggcu

SEQ ID NO: 2448089 - RNA, 16 nt, Human
cucgcugaugcugggc

SEQ ID NO: 2448090 - RNA, 17 nt, Human
cucgccuggccugaggu

SEQ ID NO: 2448091 - RNA, 16 nt, Human
cucgccuggccugagg

SEQ ID NO: 2448092 - RNA, 23 nt, Human
cucgccugacaaccacuggucug

SEQ ID NO: 2448093 - RNA, 15 nt, Human
cucgccuucaucucc

SEQ ID NO: 2448094 - RNA, 16 nt, Human
cucgccgucugugaau

SEQ ID NO: 2448095 - RNA, 15 nt, Human
cucgccgucugugaa

SEQ ID NO: 2448096 - RNA, 20 nt, Human
cucgcccugcgguagauggg

SEQ ID NO: 2448097 - RNA, 12 nt, Human
cucgcccugggu

SEQ ID NO: 2448098 - RNA, 13 nt, Human
cucgcccuggguc

SEQ ID NO: 2448099 - RNA, 15 nt, Human
cucgcccugggucua

SEQ ID NO: 2448100 - RNA, 23 nt, Human
cucgcccgcccacuguccugggc

SEQ ID NO: 2448101 - RNA, 22 nt, Human
cucgcccgcccacuguccuggg

SEQ ID NO: 2448102 - RNA, 18 nt, Human
cucgcauaggaccuuucc

SEQ ID NO: 2448103 - RNA, 16 nt, Human
cuccgacugcuaggga

SEQ ID NO: 2448104 - RNA, 17 nt, Human
cucccuuguucucuaag

SEQ ID NO: 2448105 - RNA, 14 nt, Human
cucccuuguucucu

SEQ ID NO: 2448106 - RNA, 21 nt, Human
cucccuugguggcaagagccc

SEQ ID NO: 2448107 - RNA, 20 nt, Human
cucccuugguggcaagagcc

SEQ ID NO: 2448108 - RNA, 18 nt, Human
cucccuuggguucugaua

SEQ ID NO: 2448109 - RNA, 17 nt, Human
cucccuuggguucugau

SEQ ID NO: 2448110 - RNA, 13 nt, Human
cucccuugggcuc

SEQ ID NO: 2448111 - RNA, 14 nt, Human
cucccuugggcucc

SEQ ID NO: 2448112 - RNA, 18 nt, Human
cucccuugggcucccugu

SEQ ID NO: 2448113 - RNA, 19 nt, Human
cucccuuggggccuaugca

SEQ ID NO: 2448114 - RNA, 17 nt, Human
cucccuguuccccagag

SEQ ID NO: 2448115 - RNA, 18 nt, Human
cucccuguuccccagaga

SEQ ID NO: 2448116 - RNA, 20 nt, Human
cucccuuggauuguccccga

SEQ ID NO: 2448117 - RNA, 16 nt, Human
cucccuguuccccaga

SEQ ID NO: 2448118 - RNA, 17 nt, Human
cucccugucggccuggu

SEQ ID NO: 2448119 - RNA, 18 nt, Human
cucccuguccuccucgga

SEQ ID NO: 2448120 - RNA, 18 nt, Human
cucccugguucugaugau

SEQ ID NO: 2448121 - RNA, 19 nt, Human
cucccuguaaccucuucag

SEQ ID NO: 2448122 - RNA, 21 nt, Human
cucccuguaggaagucauccu

SEQ ID NO: 2448123 - RNA, 11 nt, Human
cucccuguccu

SEQ ID NO: 2448124 - RNA, 13 nt, Human
cucccuguccucc

SEQ ID NO: 2448125 - RNA, 14 nt, Human
cucccuguccuccu

SEQ ID NO: 2448126 - RNA, 15 nt, Human
cucccuguccuccuc

SEQ ID NO: 2448127 - RNA, 16 nt, Human
cucccuguccuccucg

SEQ ID NO: 2448128 - RNA, 16 nt, Human
cuccgagagggagaga

SEQ ID NO: 2448129 - RNA, 22 nt, Human
cuccgagaggugggccagucug

SEQ ID NO: 2448130 - RNA, 18 nt, Human
cuccgagaggugggccag

SEQ ID NO: 2448131 - RNA, 17 nt, Human
cuccgagaggugggcca

SEQ ID NO: 2448132 - RNA, 15 nt, Human
cuccgagaggugggc

SEQ ID NO: 2448133 - RNA, 14 nt, Human
cuccgagagguggg

SEQ ID NO: 2448134 - RNA, 13 nt, Human
cuccgagaggugg

SEQ ID NO: 2448135 - RNA, 14 nt, Human
cuccgagagggaga

SEQ ID NO: 2448136 - RNA, 13 nt, Human
cuccgaggccagu

SEQ ID NO: 2448137 - RNA, 15 nt, Human
cuccgauccuuccuc

SEQ ID NO: 2448138 - RNA, 16 nt, Human
cuccgauccuuccucc

SEQ ID NO: 2448139 - RNA, 14 nt, Human
cuccuauccugguu

SEQ ID NO: 2448140 - RNA, 14 nt, Human
cuccgccagccucc

SEQ ID NO: 2448141 - RNA, 22 nt, Human
cuccuaucagaaguuucucagc

SEQ ID NO: 2448142 - RNA, 13 nt, Human
cuccgccagccuc

SEQ ID NO: 2448143 - RNA, 12 nt, Human
cuccgccagccu

SEQ ID NO: 2448144 - RNA, 15 nt, Human
cuccgcaguuccugu

SEQ ID NO: 2448145 - RNA, 12 nt, Human
cuccuaugugua

SEQ ID NO: 2448146 - RNA, 22 nt, Human
cuccuauucaguucccagaauc

SEQ ID NO: 2448147 - RNA, 13 nt, Human
cuccuauguguaa

SEQ ID NO: 2448148 - RNA, 18 nt, Human
cuccuaucuguguuuuga

SEQ ID NO: 2448149 - RNA, 15 nt, Human
cuccuaucuguguuu

SEQ ID NO: 2448150 - RNA, 14 nt, Human
cuccuaucuguguu

SEQ ID NO: 2448151 - RNA, 13 nt, Human
cuccuaucugugu

SEQ ID NO: 2448152 - RNA, 17 nt, Human
cuccuaugaucucaggu

SEQ ID NO: 2448153 - RNA, 18 nt, Human
cuccucagaucuucugug

SEQ ID NO: 2448154 - RNA, 14 nt, Human
cuccucaacucacc

SEQ ID NO: 2448155 - RNA, 22 nt, Human
cuccuauucucuuaauuuuucu

SEQ ID NO: 2448156 - RNA, 22 nt, Human
cuccucccacccggcugcagag

SEQ ID NO: 2448157 - RNA, 20 nt, Human
cuccucccacccggcugcag

SEQ ID NO: 2448158 - RNA, 17 nt, Human
cuccucccaggcgcccc

SEQ ID NO: 2448159 - RNA, 19 nt, Human
cuccucccuuuuuccuugu

SEQ ID NO: 2448160 - RNA, 12 nt, Human
cuccucccagga

SEQ ID NO: 2448161 - RNA, 12 nt, Human
cuccuccuagcc

SEQ ID NO: 2448162 - RNA, 23 nt, Human
cuccucccaggcgccccuucccc

SEQ ID NO: 2448163 - RNA, 22 nt, Human
cuccucccaggcgccccuuccc

SEQ ID NO: 2448164 - RNA, 13 nt, Human
cuccucucccauc

SEQ ID NO: 2448165 - RNA, 12 nt, Human
cuccucucccau

SEQ ID NO: 2448166 - RNA, 15 nt, Human
cuccucuccaggcac

SEQ ID NO: 2448167 - RNA, 13 nt, Human
cuccucuccaggc

SEQ ID NO: 2448168 - RNA, 21 nt, Human
cuccucucccaucccccugcc

SEQ ID NO: 2448169 - RNA, 15 nt, Human
cuccucucccauccc

SEQ ID NO: 2448170 - RNA, 23 nt, Human
cuccucucccaucccccugcccu

SEQ ID NO: 2448171 - RNA, 21 nt, Human
cuccucucccauugucccucu

SEQ ID NO: 2448172 - RNA, 20 nt, Human
cuccuccgugcuuccucagu

SEQ ID NO: 2448173 - RNA, 13 nt, Human
cuccuccucccug

SEQ ID NO: 2448174 - RNA, 12 nt, Human
cuccucuccagg

SEQ ID NO: 2448175 - RNA, 14 nt, Human
cuccuccucccugc

SEQ ID NO: 2448176 - RNA, 19 nt, Human
cuccuccuggacuccugca

SEQ ID NO: 2448177 - RNA, 14 nt, Human
cuccuccuggacuc

SEQ ID NO: 2448178 - RNA, 15 nt, Human
cuccuccuggacucc

SEQ ID NO: 2448179 - RNA, 15 nt, Human
cuccuccucccugca

SEQ ID NO: 2448180 - RNA, 14 nt, Human
cuccuccuccccca

SEQ ID NO: 2448181 - RNA, 15 nt, Human
cuccuccucccccag

SEQ ID NO: 2448182 - RNA, 15 nt, Human
cuccuccagagucag

SEQ ID NO: 2448183 - RNA, 13 nt, Human
cuccuccagaguc

SEQ ID NO: 2448184 - RNA, 15 nt, Human
cuccucccacccggc

SEQ ID NO: 2448185 - RNA, 17 nt, Human
cuccuccacucuccccc

SEQ ID NO: 2448186 - RNA, 15 nt, Human
cuccuccagccgcca

SEQ ID NO: 2448187 - RNA, 21 nt, Human
cuccucacaacauggugucug

SEQ ID NO: 2448188 - RNA, 14 nt, Human
cuccucacccccag

SEQ ID NO: 2448189 - RNA, 14 nt, Human
cuccucagggaugg

SEQ ID NO: 2448190 - RNA, 22 nt, Human
cuccucagggauggccguuggc

SEQ ID NO: 2448191 - RNA, 18 nt, Human
cuccucaggguugagguc

SEQ ID NO: 2448192 - RNA, 20 nt, Human
cuccucauccagggcucuga

SEQ ID NO: 2448193 - RNA, 23 nt, Human
cuccucaggguugagguccagcc

SEQ ID NO: 2448194 - RNA, 16 nt, Human
cuccucauccagggcu

SEQ ID NO: 2448195 - RNA, 21 nt, Human
cuccccagcaagugagagcug

SEQ ID NO: 2448196 - RNA, 15 nt, Human
cuccccagcaggugg

SEQ ID NO: 2448197 - RNA, 16 nt, Human
cuccccagcagguggg

SEQ ID NO: 2448198 - RNA, 12 nt, Human
cuccccuccucc

SEQ ID NO: 2448199 - RNA, 20 nt, Human
cuccccuccuccuggacucc

SEQ ID NO: 2448200 - RNA, 19 nt, Human
cuccccagcauuccagccc

SEQ ID NO: 2448201 - RNA, 12 nt, Human
cuccccuccucu

SEQ ID NO: 2448202 - RNA, 19 nt, Human
cuccccagcagguggggag

SEQ ID NO: 2448203 - RNA, 14 nt, Human
cuccauccugaggc

SEQ ID NO: 2448204 - RNA, 13 nt, Human
cuccauccugagg

SEQ ID NO: 2448205 - RNA, 23 nt, Human
cuccccagcaagugagagcuggg

SEQ ID NO: 2448206 - RNA, 22 nt, Human
cuccccagcaagugagagcugg

SEQ ID NO: 2448207 - RNA, 11 nt, Human
cuccccuuccc

SEQ ID NO: 2448208 - RNA, 14 nt, Human
cuccccuugagcug

SEQ ID NO: 2448209 - RNA, 16 nt, Human
cuccccuugagcugag

SEQ ID NO: 2448210 - RNA, 15 nt, Human
cuccccuucccugca

SEQ ID NO: 2448211 - RNA, 16 nt, Human
cuccccuucccugcaa

SEQ ID NO: 2448212 - RNA, 19 nt, Human
cuccccuuccucacugccc

SEQ ID NO: 2448213 - RNA, 14 nt, Human
cuccccugcccugc

SEQ ID NO: 2448214 - RNA, 12 nt, Human
cuccccugcccu

SEQ ID NO: 2448215 - RNA, 13 nt, Human
cuccccugcccug

SEQ ID NO: 2448216 - RNA, 23 nt, Human
cuccccugcccccaggacugggc

SEQ ID NO: 2448217 - RNA, 22 nt, Human
cuccccugcccccaggacuggg

SEQ ID NO: 2448218 - RNA, 21 nt, Human
cuccccugcccccaggacugg

SEQ ID NO: 2448219 - RNA, 20 nt, Human
cuccccugcccccaggacug

SEQ ID NO: 2448220 - RNA, 19 nt, Human
cuccccugcccccaggacu

SEQ ID NO: 2448221 - RNA, 18 nt, Human
cuccccugcccccaggac

SEQ ID NO: 2448222 - RNA, 17 nt, Human
cuccccugcccccagga

SEQ ID NO: 2448223 - RNA, 16 nt, Human
cuccccugcccccagg

SEQ ID NO: 2448224 - RNA, 15 nt, Human
cuccccugcccccag

SEQ ID NO: 2448225 - RNA, 14 nt, Human
cuccccugccccca

SEQ ID NO: 2448226 - RNA, 13 nt, Human
cuccccugccccc

SEQ ID NO: 2448227 - RNA, 14 nt, Human
cuccccugccauuu

SEQ ID NO: 2448228 - RNA, 17 nt, Human
cuccccuccucuccccu

SEQ ID NO: 2448229 - RNA, 16 nt, Human
cuccccuccucucccc

SEQ ID NO: 2448230 - RNA, 15 nt, Human
cuccccuccuugccu

SEQ ID NO: 2448231 - RNA, 21 nt, Human
cuccccugccagggcagggcc

SEQ ID NO: 2448232 - RNA, 20 nt, Human
cucccgggcccucccuugga

SEQ ID NO: 2448233 - RNA, 19 nt, Human
cucccgggcccucccuugg

SEQ ID NO: 2448234 - RNA, 22 nt, Human
cucccgggcccucccuuggaaa

SEQ ID NO: 2448235 - RNA, 16 nt, Human
cucccgggcccucccu

SEQ ID NO: 2448236 - RNA, 15 nt, Human
cucccgggcccuccc

SEQ ID NO: 2448237 - RNA, 21 nt, Human
cucccgccccuuccccgaggg

SEQ ID NO: 2448238 - RNA, 18 nt, Human
cuccccuugggcggcuga

SEQ ID NO: 2448239 - RNA, 21 nt, Human
cucccgccagacuguuagaaa

SEQ ID NO: 2448240 - RNA, 16 nt, Human
cucccgccccuuccca

SEQ ID NO: 2448241 - RNA, 14 nt, Human
cucccgucagggcc

SEQ ID NO: 2448242 - RNA, 21 nt, Human
cucccgguucuuccagugguu

SEQ ID NO: 2448243 - RNA, 16 nt, Human
cucccgguucuuccag

SEQ ID NO: 2448244 - RNA, 15 nt, Human
cucccgguucuucca

SEQ ID NO: 2448245 - RNA, 21 nt, Human
cucccggugcccaagaauaga

SEQ ID NO: 2448246 - RNA, 15 nt, Human
cucccggugcccaag

SEQ ID NO: 2448247 - RNA, 15 nt, Human
cuccccuugggcggc

SEQ ID NO: 2448248 - RNA, 13 nt, Human
cuccccuugggcg

SEQ ID NO: 2448249 - RNA, 12 nt, Human
cuccccuugggc

SEQ ID NO: 2448250 - RNA, 20 nt, Human
cucccgaguagcugggacua

SEQ ID NO: 2448251 - RNA, 19 nt, Human
cucccgaguagcugggacu

SEQ ID NO: 2448252 - RNA, 17 nt, Human
cucccugccccccagcc

SEQ ID NO: 2448253 - RNA, 23 nt, Human
cucccugccccccagcccuccuu

SEQ ID NO: 2448254 - RNA, 14 nt, Human
cucccugccccucc

SEQ ID NO: 2448255 - RNA, 13 nt, Human
cucccugccccuc

SEQ ID NO: 2448256 - RNA, 21 nt, Human
cucccgucagggcccaagucc

SEQ ID NO: 2448257 - RNA, 19 nt, Human
cucccgucagggcccaagu

SEQ ID NO: 2448258 - RNA, 16 nt, Human
cucccgucagggccca

SEQ ID NO: 2448259 - RNA, 15 nt, Human
cucccgucagggccc

SEQ ID NO: 2448260 - RNA, 14 nt, Human
cucccuaaacugua

SEQ ID NO: 2448261 - RNA, 22 nt, Human
cucccugcaucugaccagcagc

SEQ ID NO: 2448262 - RNA, 23 nt, Human
cucccugcaucugaccagcagcg

SEQ ID NO: 2448263 - RNA, 21 nt, Human
cucccugccccucccuucaac

SEQ ID NO: 2448264 - RNA, 20 nt, Human
cucccugccccucccuucaa

SEQ ID NO: 2448265 - RNA, 18 nt, Human
cucccugccccucccuuc

SEQ ID NO: 2448266 - RNA, 17 nt, Human
cucccugccccucccuu

SEQ ID NO: 2448267 - RNA, 15 nt, Human
cucccugccuccagg

SEQ ID NO: 2448268 - RNA, 16 nt, Human
cucccugccuccagga

SEQ ID NO: 2448269 - RNA, 10 nt, Human
cucccugccg

SEQ ID NO: 2448270 - RNA, 15 nt, Human
cucccugccgccuca

SEQ ID NO: 2448271 - RNA, 16 nt, Human
cucccugccgccucaa

SEQ ID NO: 2448272 - RNA, 18 nt, Human
cucccugccgccucaaug

SEQ ID NO: 2448273 - RNA, 19 nt, Human
cucccugccgccucaaugu

SEQ ID NO: 2448274 - RNA, 14 nt, Human
cucccugccuccag

SEQ ID NO: 2448275 - RNA, 17 nt, Human
cucagggucccuggugg

SEQ ID NO: 2448276 - RNA, 16 nt, Human
cucagggucccuggug

SEQ ID NO: 2448277 - RNA, 15 nt, Human
cucagggucccuggu

SEQ ID NO: 2448278 - RNA, 15 nt, Human
cucagggcuccuggg

SEQ ID NO: 2448279 - RNA, 17 nt, Human
cucagggcuccuggguu

SEQ ID NO: 2448280 - RNA, 16 nt, Human
cucagggcugacacgu

SEQ ID NO: 2448281 - RNA, 18 nt, Human
cucagggucccugguggc

SEQ ID NO: 2448282 - RNA, 16 nt, Human
cucaggugagaagcag

SEQ ID NO: 2448283 - RNA, 19 nt, Human
cucaggugagaagcagagg

SEQ ID NO: 2448284 - RNA, 20 nt, Human
cucaggugagaagcagagga

SEQ ID NO: 2448285 - RNA, 10 nt, Human
cucagggcag

SEQ ID NO: 2448286 - RNA, 13 nt, Human
cucagggccuggc

SEQ ID NO: 2448287 - RNA, 15 nt, Human
cucagggccuggcuc

SEQ ID NO: 2448288 - RNA, 14 nt, Human
cucagggccuggcu

SEQ ID NO: 2448289 - RNA, 13 nt, Human
cucagggcuccug

SEQ ID NO: 2448290 - RNA, 16 nt, Human
cucagggcuccugccu

SEQ ID NO: 2448291 - RNA, 15 nt, Human
cucagggcuccugcc

SEQ ID NO: 2448292 - RNA, 14 nt, Human
cucagggcuccugc

SEQ ID NO: 2448293 - RNA, 22 nt, Human
cucagggcuaaacgggcauugc

SEQ ID NO: 2448294 - RNA, 23 nt, Human
cucagggcuccugccuucugucc

SEQ ID NO: 2448295 - RNA, 22 nt, Human
cucagggcuccugccuucuguc

SEQ ID NO: 2448296 - RNA, 14 nt, Human
cucagggcuccugg

SEQ ID NO: 2448297 - RNA, 16 nt, Human
cucagggccuggcuca

SEQ ID NO: 2448298 - RNA, 15 nt, Human
cucagggccuggucg

SEQ ID NO: 2448299 - RNA, 12 nt, Human
cucagccagaga

SEQ ID NO: 2448300 - RNA, 11 nt, Human
cucagccagca

SEQ ID NO: 2448301 - RNA, 13 nt, Human
cucagccagcacu

SEQ ID NO: 2448302 - RNA, 16 nt, Human
cucagccagccccauc

SEQ ID NO: 2448303 - RNA, 14 nt, Human
cucagccagagaag

SEQ ID NO: 2448304 - RNA, 23 nt, Human
cucagccaagcacagugguggca

SEQ ID NO: 2448305 - RNA, 20 nt, Human
cucagccaagcacaguggug

SEQ ID NO: 2448306 - RNA, 18 nt, Human
cucagccaagcacagugg

SEQ ID NO: 2448307 - RNA, 21 nt, Human
cucagcagcgaccaccccugc

SEQ ID NO: 2448308 - RNA, 23 nt, Human
cucagcagcgaccaccccugccu

SEQ ID NO: 2448309 - RNA, 18 nt, Human
cucagcauccuggcaccc

SEQ ID NO: 2448310 - RNA, 19 nt, Human
cucaggaggcugaggcaga

SEQ ID NO: 2448311 - RNA, 19 nt, Human
cucagcccacauagugaug

SEQ ID NO: 2448312 - RNA, 15 nt, Human
cucagccaugaggag

SEQ ID NO: 2448313 - RNA, 21 nt, Human
cucagccaugaggaguugcug

SEQ ID NO: 2448314 - RNA, 20 nt, Human
cucaggaggcugaggcagaa

SEQ ID NO: 2448315 - RNA, 20 nt, Human
cucaggaggcugaggcagga

SEQ ID NO: 2448316 - RNA, 22 nt, Human
cucaggaggcugaggcaggagg

SEQ ID NO: 2448317 - RNA, 18 nt, Human
cucaggaguuugagacca

SEQ ID NO: 2448318 - RNA, 23 nt, Human
cucaggaguuugagaccaaccug

SEQ ID NO: 2448319 - RNA, 18 nt, Human
cucagggaccacagcaag

SEQ ID NO: 2448320 - RNA, 17 nt, Human
cucagggaccacagcaa

SEQ ID NO: 2448321 - RNA, 16 nt, Human
cucagggaccacagca

SEQ ID NO: 2448322 - RNA, 15 nt, Human
cucagggaccacagc

SEQ ID NO: 2448323 - RNA, 19 nt, Human
cucagggaccacagcaagg

SEQ ID NO: 2448324 - RNA, 22 nt, Human
cucagggauggccguuggccac

SEQ ID NO: 2448325 - RNA, 15 nt, Human
cucaggcagcucaag

SEQ ID NO: 2448326 - RNA, 14 nt, Human
cucaggcagcucaa

SEQ ID NO: 2448327 - RNA, 23 nt, Human
cucaggcacuagccuuuggcucu

SEQ ID NO: 2448328 - RNA, 21 nt, Human
cucagggacagagacaccugc

SEQ ID NO: 2448329 - RNA, 12 nt, Human
cucagggaccac

SEQ ID NO: 2448330 - RNA, 19 nt, Human
cucagggacagagccaugc

SEQ ID NO: 2448331 - RNA, 18 nt, Human
cucagggacagagccaug

SEQ ID NO: 2448332 - RNA, 16 nt, Human
cucagggacagagcca

SEQ ID NO: 2448333 - RNA, 15 nt, Human
cucagggacagagcc

SEQ ID NO: 2448334 - RNA, 14 nt, Human
cucagggacagagc

SEQ ID NO: 2448335 - RNA, 22 nt, Human
cucagggacagagacaccugca

SEQ ID NO: 2448336 - RNA, 23 nt, Human
cucagggacagagacaccugcac

SEQ ID NO: 2448337 - RNA, 13 nt, Human
cucaggaucucuu

SEQ ID NO: 2448338 - RNA, 15 nt, Human
cucaggaugcccagg

SEQ ID NO: 2448339 - RNA, 14 nt, Human
cucaggaugcccag

SEQ ID NO: 2448340 - RNA, 23 nt, Human
cucaggaggcugaggcagaagaa

SEQ ID NO: 2448341 - RNA, 23 nt, Human
cucaggaggcugaggcaggagga

SEQ ID NO: 2448342 - RNA, 16 nt, Human
cucaggaggcugaggg

SEQ ID NO: 2448343 - RNA, 19 nt, Human
cucaggcacuagccuuugg

SEQ ID NO: 2448344 - RNA, 18 nt, Human
cucaggcacuagccuuug

SEQ ID NO: 2448345 - RNA, 15 nt, Human
cucaggcacuagccu

SEQ ID NO: 2448346 - RNA, 14 nt, Human
cucaggcacuagcc

SEQ ID NO: 2448347 - RNA, 21 nt, Human
cucaggcaaggucuggccuca

SEQ ID NO: 2448348 - RNA, 19 nt, Human
cucaggauuucgugggucu

SEQ ID NO: 2448349 - RNA, 16 nt, Human
cucaggaugcccaggg

SEQ ID NO: 2448350 - RNA, 19 nt, Human
cucaggaugcccagggcca

SEQ ID NO: 2448351 - RNA, 22 nt, Human
cucaggaugcccagggccacuc

SEQ ID NO: 2448352 - RNA, 19 nt, Human
cucaucucuuagcuccccu

SEQ ID NO: 2448353 - RNA, 17 nt, Human
cucaucucuuagcuccc

SEQ ID NO: 2448354 - RNA, 16 nt, Human
cucaucucucugccca

SEQ ID NO: 2448355 - RNA, 17 nt, Human
cucaucucucugcccaa

SEQ ID NO: 2448356 - RNA, 18 nt, Human
cucaucucuaacagcuca

SEQ ID NO: 2448357 - RNA, 20 nt, Human
cucaucucuaacagcucagg

SEQ ID NO: 2448358 - RNA, 22 nt, Human
cucaucucuaacagcucaggau

SEQ ID NO: 2448359 - RNA, 23 nt, Human
cucaucucuaacagcucaggauc

SEQ ID NO: 2448360 - RNA, 24 nt, Human
cucaucucuaacagcucaggaucu

SEQ ID NO: 2448361 - RNA, 15 nt, Human
cucauccucauaccc

SEQ ID NO: 2448362 - RNA, 21 nt, Human
cucaucccuaaugcugcagau

SEQ ID NO: 2448363 - RNA, 17 nt, Human
cucauccgaggcagggu

SEQ ID NO: 2448364 - RNA, 22 nt, Human
cucaucauucucugucucaucc

SEQ ID NO: 2448365 - RNA, 23 nt, Human
cucauccccaggggucccagcca

SEQ ID NO: 2448366 - RNA, 16 nt, Human
cucaucccguguucuc

SEQ ID NO: 2448367 - RNA, 22 nt, Human
cucaucccgagcaccuccacau

SEQ ID NO: 2448368 - RNA, 18 nt, Human
cucaucccuaaugcugca

SEQ ID NO: 2448369 - RNA, 22 nt, Human
cucaucaggaugaacccaggac

SEQ ID NO: 2448370 - RNA, 19 nt, Human
cucaucccguguucuccuu

SEQ ID NO: 2448371 - RNA, 14 nt, Human
cucauccgaggcag

SEQ ID NO: 2448372 - RNA, 15 nt, Human
cucauccgaggcagg

SEQ ID NO: 2448373 - RNA, 17 nt, Human
cucaucauucucugucu

SEQ ID NO: 2448374 - RNA, 18 nt, Human
cucaucauucucugucuc

SEQ ID NO: 2448375 - RNA, 19 nt, Human
cucaucauucucugucuca

SEQ ID NO: 2448376 - RNA, 20 nt, Human
cucaucauucucugucucau

SEQ ID NO: 2448377 - RNA, 14 nt, Human
cucaucauucucug

SEQ ID NO: 2448378 - RNA, 15 nt, Human
cucaucauucucugu

SEQ ID NO: 2448379 - RNA, 13 nt, Human
cucaucauucucu

SEQ ID NO: 2448380 - RNA, 16 nt, Human
cucaucauaaaauaaa

SEQ ID NO: 2448381 - RNA, 21 nt, Human
cucaucaccaacgucugugcc

SEQ ID NO: 2448382 - RNA, 16 nt, Human
cucaucaacugaauga

SEQ ID NO: 2448383 - RNA, 13 nt, Human
cucaucaacugaa

SEQ ID NO: 2448384 - RNA, 20 nt, Human
cucauauccccuauuuaaca

SEQ ID NO: 2448385 - RNA, 23 nt, Human
cucauaguaugguggcuggguug

SEQ ID NO: 2448386 - RNA, 21 nt, Human
cucauauccaguauuguuccu

SEQ ID NO: 2448387 - RNA, 15 nt, Human
cucauaucaguuugc

SEQ ID NO: 2448388 - RNA, 19 nt, Human
cucauauauaucuaucuua

SEQ ID NO: 2448389 - RNA, 16 nt, Human
cucaucacuccccucc

SEQ ID NO: 2448390 - RNA, 15 nt, Human
cucaucacuccccuc

SEQ ID NO: 2448391 - RNA, 14 nt, Human
cucaucacuccccu

SEQ ID NO: 2448392 - RNA, 14 nt, Human
cucaucaacugaau

SEQ ID NO: 2448393 - RNA, 22 nt, Human
cucaucaccaacgucugugcca

SEQ ID NO: 2448394 - RNA, 20 nt, Human
cucaucaggaugaacccagg

SEQ ID NO: 2448395 - RNA, 16 nt, Human
cucaucaggaugaacc

SEQ ID NO: 2448396 - RNA, 13 nt, Human
cucaucaggauga

SEQ ID NO: 2448397 - RNA, 12 nt, Human
cucaucaggaug

SEQ ID NO: 2448398 - RNA, 15 nt, Human
cucaucacuggauga

SEQ ID NO: 2448399 - RNA, 17 nt, Human
cucaucacuccccucca

SEQ ID NO: 2448400 - RNA, 24 nt, Human
cucaucaguguccucuugcucaaa

SEQ ID NO: 2448401 - RNA, 12 nt, Human
cucaucauaaaa

SEQ ID NO: 2448402 - RNA, 14 nt, Human
cucaucauaaaaua

SEQ ID NO: 2448403 - RNA, 15 nt, Human
cucaucauaaaauaa

SEQ ID NO: 2448404 - RNA, 21 nt, Human
cucauacccacccccacccaa

SEQ ID NO: 2448405 - RNA, 19 nt, Human
cucauacccacccccaccc

SEQ ID NO: 2448406 - RNA, 18 nt, Human
cucauacccacccccacc

SEQ ID NO: 2448407 - RNA, 16 nt, Human
cucauacccaccccca

SEQ ID NO: 2448408 - RNA, 19 nt, Human
cucaggugauccacccacc

SEQ ID NO: 2448409 - RNA, 18 nt, Human
cucaggugauccacccac

SEQ ID NO: 2448410 - RNA, 20 nt, Human
cucaggugauccacccaccu

SEQ ID NO: 2448411 - RNA, 13 nt, Human
cucauagcccuca

SEQ ID NO: 2448412 - RNA, 17 nt, Human
cucauagcccucacccu

SEQ ID NO: 2448413 - RNA, 15 nt, Human
cucauagcacuuccc

SEQ ID NO: 2448414 - RNA, 12 nt, Human
cucauagcauua

SEQ ID NO: 2448415 - RNA, 14 nt, Human
cucauagcauuaac

SEQ ID NO: 2448416 - RNA, 16 nt, Human
cucauagcauuaacua

SEQ ID NO: 2448417 - RNA, 18 nt, Human
cucauagcauuaacuaau

SEQ ID NO: 2448418 - RNA, 20 nt, Human
cucauagcccucacccuggg

SEQ ID NO: 2448419 - RNA, 21 nt, Human
cucauagcccucacccugggg

SEQ ID NO: 2448420 - RNA, 21 nt, Human
cucauaguaugguggcugggu

SEQ ID NO: 2448421 - RNA, 13 nt, Human
cucauacugugcu

SEQ ID NO: 2448422 - RNA, 17 nt, Human
cucauacguccaccaug

SEQ ID NO: 2448423 - RNA, 15 nt, Human
cucauacguccacca

SEQ ID NO: 2448424 - RNA, 14 nt, Human
cucauacguccacc

SEQ ID NO: 2448425 - RNA, 18 nt, Human
cucauaccuuuaaaggaa

SEQ ID NO: 2448426 - RNA, 16 nt, Human
cucauaccuuuaaagg

SEQ ID NO: 2448427 - RNA, 22 nt, Human
cucauacucaccucaccccacu

SEQ ID NO: 2448428 - RNA, 15 nt, Human
cucauacccaccccc

SEQ ID NO: 2448429 - RNA, 14 nt, Human
cucauacucaccuc

SEQ ID NO: 2448430 - RNA, 18 nt, Human
cuccauccaaggccaggu

SEQ ID NO: 2448431 - RNA, 14 nt, Human
cuccauccaaggcc

SEQ ID NO: 2448432 - RNA, 13 nt, Human
cuccauccaaggc

SEQ ID NO: 2448433 - RNA, 12 nt, Human
cuccauccaagg

SEQ ID NO: 2448434 - RNA, 20 nt, Human
cuccauccacaugggagccg

SEQ ID NO: 2448435 - RNA, 12 nt, Human
cuccauccugag

SEQ ID NO: 2448436 - RNA, 23 nt, Human
cuccaggagcagccacauuccug

SEQ ID NO: 2448437 - RNA, 18 nt, Human
cuccaggagcagccacau

SEQ ID NO: 2448438 - RNA, 20 nt, Human
cuccaggcacccuucuuucc

SEQ ID NO: 2448439 - RNA, 16 nt, Human
cuccaggcacccuucu

SEQ ID NO: 2448440 - RNA, 19 nt, Human
cuccaggauugaagagcau

SEQ ID NO: 2448441 - RNA, 21 nt, Human
cuccaggcacccuucuuuccu

SEQ ID NO: 2448442 - RNA, 11 nt, Human
cuccaggcagg

SEQ ID NO: 2448443 - RNA, 19 nt, Human
cuccaucaguuagagcuga

SEQ ID NO: 2448444 - RNA, 18 nt, Human
cuccaucaguuagagcug

SEQ ID NO: 2448445 - RNA, 15 nt, Human
cuccaucagcuguaa

SEQ ID NO: 2448446 - RNA, 17 nt, Human
cuccaggagcagccaca

SEQ ID NO: 2448447 - RNA, 16 nt, Human
cuccaggagcagccac

SEQ ID NO: 2448448 - RNA, 15 nt, Human
cuccaggagcagcca

SEQ ID NO: 2448449 - RNA, 14 nt, Human
cuccaggagcagcc

SEQ ID NO: 2448450 - RNA, 13 nt, Human
cuccaggagcagc

SEQ ID NO: 2448451 - RNA, 11 nt, Human
cuccaggagca

SEQ ID NO: 2448452 - RNA, 20 nt, Human
cuccagcuuguggagcccca

SEQ ID NO: 2448453 - RNA, 19 nt, Human
cuccagcuuguggagcccc

SEQ ID NO: 2448454 - RNA, 21 nt, Human
cuccagcuuguggagccccac

SEQ ID NO: 2448455 - RNA, 12 nt, Human
cuccaggaacca

SEQ ID NO: 2448456 - RNA, 18 nt, Human
cuccaggaaccacaccac

SEQ ID NO: 2448457 - RNA, 22 nt, Human
cuccaggagaggagcgggaccu

SEQ ID NO: 2448458 - RNA, 14 nt, Human
cuccaggagaggag

SEQ ID NO: 2448459 - RNA, 13 nt, Human
cuccaggagagga

SEQ ID NO: 2448460 - RNA, 11 nt, Human
cuccagcuucu

SEQ ID NO: 2448461 - RNA, 20 nt, Human
cuccaggaaugccuccuccc

SEQ ID NO: 2448462 - RNA, 17 nt, Human
cuccagccccuggaugc

SEQ ID NO: 2448463 - RNA, 16 nt, Human
cuccagccccuggaug

SEQ ID NO: 2448464 - RNA, 14 nt, Human
cuccagccuggcuc

SEQ ID NO: 2448465 - RNA, 13 nt, Human
cuccagccuggcu

SEQ ID NO: 2448466 - RNA, 12 nt, Human
cuccagccuggc

SEQ ID NO: 2448467 - RNA, 22 nt, Human
cuccagccuggacccccagcuu

SEQ ID NO: 2448468 - RNA, 21 nt, Human
cuccagccuggacccccagcu

SEQ ID NO: 2448469 - RNA, 20 nt, Human
cuccagccuggacccccagc

SEQ ID NO: 2448470 - RNA, 18 nt, Human
cuccacguucugcucauc

SEQ ID NO: 2448471 - RNA, 20 nt, Human
cuccagccccuggaugcagc

SEQ ID NO: 2448472 - RNA, 18 nt, Human
cuccagcuuguggagccc

SEQ ID NO: 2448473 - RNA, 12 nt, Human
cuccagcuugug

SEQ ID NO: 2448474 - RNA, 22 nt, Human
cuccagcuucugguacucuccu

SEQ ID NO: 2448475 - RNA, 21 nt, Human
cuccagcuucugguacucucc

SEQ ID NO: 2448476 - RNA, 20 nt, Human
cuccagcuucugguacucuc

SEQ ID NO: 2448477 - RNA, 19 nt, Human
cuccagcuucugguacucu

SEQ ID NO: 2448478 - RNA, 13 nt, Human
cuccagcuucugg

SEQ ID NO: 2448479 - RNA, 14 nt, Human
cuccagcucaccag

SEQ ID NO: 2448480 - RNA, 12 nt, Human
cuccagccuggg

SEQ ID NO: 2448481 - RNA, 13 nt, Human
cuccagccugggc

SEQ ID NO: 2448482 - RNA, 14 nt, Human
cuccagccugggca

SEQ ID NO: 2448483 - RNA, 20 nt, Human
cuccagccugggcaacacag

SEQ ID NO: 2448484 - RNA, 13 nt, Human
cuccaccugccag

SEQ ID NO: 2448485 - RNA, 12 nt, Human
cuccaccugcca

SEQ ID NO: 2448486 - RNA, 22 nt, Human
cuccaccugcucccaggccagu

SEQ ID NO: 2448487 - RNA, 23 nt, Human
cuccacccugucccccagcucug

SEQ ID NO: 2448488 - RNA, 22 nt, Human
cuccaccucuucaccccccacu

SEQ ID NO: 2448489 - RNA, 18 nt, Human
cuccaccugcucccaggc

SEQ ID NO: 2448490 - RNA, 14 nt, Human
cuccaccugccagg

SEQ ID NO: 2448491 - RNA, 13 nt, Human
cuccaccugcucu

SEQ ID NO: 2448492 - RNA, 15 nt, Human
cuccaccuugcgggg

SEQ ID NO: 2448493 - RNA, 18 nt, Human
cuccacguucaccccucc

SEQ ID NO: 2448494 - RNA, 16 nt, Human
cuccacguucaccccu

SEQ ID NO: 2448495 - RNA, 15 nt, Human
cuccagccccuggau

SEQ ID NO: 2448496 - RNA, 16 nt, Human
cuccacguucugcuca

SEQ ID NO: 2448497 - RNA, 17 nt, Human
cuccacguucugcucau

SEQ ID NO: 2448498 - RNA, 15 nt, Human
cuccacguucugcuc

SEQ ID NO: 2448499 - RNA, 20 nt, Human
cuccacguucaccccuccac

SEQ ID NO: 2448500 - RNA, 12 nt, Human
cuccaaagaaau

SEQ ID NO: 2448501 - RNA, 21 nt, Human
cuccaaacugacucuuaagaa

SEQ ID NO: 2448502 - RNA, 13 nt, Human
cuccaaagaaaug

SEQ ID NO: 2448503 - RNA, 23 nt, Human
cuccaaagaggugacugggcccu

SEQ ID NO: 2448504 - RNA, 16 nt, Human
cuccaaaagcacuuac

SEQ ID NO: 2448505 - RNA, 15 nt, Human
cuccaaaagcacuua

SEQ ID NO: 2448506 - RNA, 23 nt, Human
cuccaaacugaagcagccucucc

SEQ ID NO: 2448507 - RNA, 15 nt, Human
cuccaaaauaaaacu

SEQ ID NO: 2448508 - RNA, 16 nt, Human
cuccaaaauaaaacuu

SEQ ID NO: 2448509 - RNA, 16 nt, Human
cuccaaaacuccugcc

SEQ ID NO: 2448510 - RNA, 20 nt, Human
cucauuuuuuuaauuuauua

SEQ ID NO: 2448511 - RNA, 18 nt, Human
cucauuuuuuuaauuuau

SEQ ID NO: 2448512 - RNA, 17 nt, Human
cucauuugggguagcua

SEQ ID NO: 2448513 - RNA, 20 nt, Human
cucauuugggguagcuagag

SEQ ID NO: 2448514 - RNA, 17 nt, Human
cucauuacuuuugaagu

SEQ ID NO: 2448515 - RNA, 23 nt, Human
cucauuacuuuaccacccccaca

SEQ ID NO: 2448516 - RNA, 17 nt, Human
cucauuugucacacacu

SEQ ID NO: 2448517 - RNA, 21 nt, Human
cucauuuccaagcaaguauua

SEQ ID NO: 2448518 - RNA, 21 nt, Human
cucauguuuuccauuguuuga

SEQ ID NO: 2448519 - RNA, 18 nt, Human
cucauguuuuccauuguu

SEQ ID NO: 2448520 - RNA, 15 nt, Human
cucauuaaugacacu

SEQ ID NO: 2448521 - RNA, 16 nt, Human
cucauuaaugacacuu

SEQ ID NO: 2448522 - RNA, 12 nt, Human
cucaucugcuca

SEQ ID NO: 2448523 - RNA, 15 nt, Human
cucaucucuguccca

SEQ ID NO: 2448524 - RNA, 12 nt, Human
cucaucugcugg

SEQ ID NO: 2448525 - RNA, 12 nt, Human
cucaucucuucu

SEQ ID NO: 2448526 - RNA, 15 nt, Human
cucaucucuucuuuu

SEQ ID NO: 2448527 - RNA, 22 nt, Human
cucaucucuuagcuccccucca

SEQ ID NO: 2448528 - RNA, 20 nt, Human
cucaucucuuagcuccccuc

SEQ ID NO: 2448529 - RNA, 16 nt, Human
cucauguuuucaacug

SEQ ID NO: 2448530 - RNA, 17 nt, Human
cucauguuuucaacugc

SEQ ID NO: 2448531 - RNA, 17 nt, Human
cucaucugcucagcagc

SEQ ID NO: 2448532 - RNA, 17 nt, Human
cucauguuuuccauugu

SEQ ID NO: 2448533 - RNA, 13 nt, Human
cucauguuuucca

SEQ ID NO: 2448534 - RNA, 18 nt, Human
cucauguuuucaacugcc

SEQ ID NO: 2448535 - RNA, 20 nt, Human
cucauguuuucaacugccaa

SEQ ID NO: 2448536 - RNA, 13 nt, Human
cucauuaaaaaaa

SEQ ID NO: 2448537 - RNA, 13 nt, Human
cuccacccugcuc

SEQ ID NO: 2448538 - RNA, 23 nt, Human
cuccaccaagccuggucagccca

SEQ ID NO: 2448539 - RNA, 16 nt, Human
cuccacaucugccuua

SEQ ID NO: 2448540 - RNA, 12 nt, Human
cuccaccaaccc

SEQ ID NO: 2448541 - RNA, 17 nt, Human
cuccacaucugccuuaa

SEQ ID NO: 2448542 - RNA, 15 nt, Human
cuccacaucugccuu

SEQ ID NO: 2448543 - RNA, 14 nt, Human
cuccacaucugccu

SEQ ID NO: 2448544 - RNA, 13 nt, Human
cuccacaucugcc

SEQ ID NO: 2448545 - RNA, 22 nt, Human
cuccacauccuuucuaaacaag

SEQ ID NO: 2448546 - RNA, 14 nt, Human
cuccacauccucca

SEQ ID NO: 2448547 - RNA, 15 nt, Human
cuccacauccuccac

SEQ ID NO: 2448548 - RNA, 17 nt, Human
cuccacauccuccacgu

SEQ ID NO: 2448549 - RNA, 14 nt, Human
cuccacauccuuuc

SEQ ID NO: 2448550 - RNA, 20 nt, Human
cuccacacccucucccagga

SEQ ID NO: 2448551 - RNA, 15 nt, Human
cuccacccugcucuc

SEQ ID NO: 2448552 - RNA, 15 nt, Human
cuccaccaccacugg

SEQ ID NO: 2448553 - RNA, 12 nt, Human
cuccaccaccac

SEQ ID NO: 2448554 - RNA, 14 nt, Human
cuccacccuggccg

SEQ ID NO: 2448555 - RNA, 13 nt, Human
cuccaccaaccca

SEQ ID NO: 2448556 - RNA, 20 nt, Human
cuccaccaacccaucagaag

SEQ ID NO: 2448557 - RNA, 13 nt, Human
cuccaccacaucc

SEQ ID NO: 2448558 - RNA, 18 nt, Human
cuccacccugucccccag

SEQ ID NO: 2448559 - RNA, 17 nt, Human
cuccacccuguccccca

SEQ ID NO: 2448560 - RNA, 15 nt, Human
cuccacccugucccc

SEQ ID NO: 2448561 - RNA, 14 nt, Human
cuccacccuguccc

SEQ ID NO: 2448562 - RNA, 13 nt, Human
cuccacccugucc

SEQ ID NO: 2448563 - RNA, 15 nt, Human
cuccacccuggccga

SEQ ID NO: 2448564 - RNA, 22 nt, Human
cuccacccugucccccagcucu

SEQ ID NO: 2448565 - RNA, 20 nt, Human
cuccacccugucccccagcu

SEQ ID NO: 2448566 - RNA, 12 nt, Human
cuccacccuugg

SEQ ID NO: 2448567 - RNA, 16 nt, Human
cuccaauccugccccc

SEQ ID NO: 2448568 - RNA, 15 nt, Human
cuccaauccugcccc

SEQ ID NO: 2448569 - RNA, 14 nt, Human
cuccaauccugccc

SEQ ID NO: 2448570 - RNA, 19 nt, Human
cuccaauaucagugcucga

SEQ ID NO: 2448571 - RNA, 21 nt, Human
cuccaaugcuguuaucccugc

SEQ ID NO: 2448572 - RNA, 17 nt, Human
cuccaauaucagugcuc

SEQ ID NO: 2448573 - RNA, 16 nt, Human
cuccaauaucagugcu

SEQ ID NO: 2448574 - RNA, 22 nt, Human
cuccaagugccagaggugggca

SEQ ID NO: 2448575 - RNA, 21 nt, Human
cuccaagugccagaggugggc

SEQ ID NO: 2448576 - RNA, 22 nt, Human
cuccaaucccaccaacccucag

SEQ ID NO: 2448577 - RNA, 20 nt, Human
cuccaagugccagagguggg

SEQ ID NO: 2448578 - RNA, 19 nt, Human
cuccaagugccagaggugg

SEQ ID NO: 2448579 - RNA, 18 nt, Human
cuccaagugccagaggug

SEQ ID NO: 2448580 - RNA, 16 nt, Human
cuccaagugccagagg

SEQ ID NO: 2448581 - RNA, 15 nt, Human
cuccaagugccagag

SEQ ID NO: 2448582 - RNA, 14 nt, Human
cuccaagugccaga

SEQ ID NO: 2448583 - RNA, 21 nt, Human
cuccaagucucaguggcuuca

SEQ ID NO: 2448584 - RNA, 17 nt, Human
cuccaagucucaguggc

SEQ ID NO: 2448585 - RNA, 16 nt, Human
cuccaagucucagugg

SEQ ID NO: 2448586 - RNA, 14 nt, Human
cuccaaaggccccc

SEQ ID NO: 2448587 - RNA, 22 nt, Human
cuccaaaggaagucuaggagcu

SEQ ID NO: 2448588 - RNA, 15 nt, Human
cuccaagucucagug

SEQ ID NO: 2448589 - RNA, 13 nt, Human
cuccacauccucc

SEQ ID NO: 2448590 - RNA, 17 nt, Human
cuccacacccucuccca

SEQ ID NO: 2448591 - RNA, 23 nt, Human
cuccacacacagcugggcugugg

SEQ ID NO: 2448592 - RNA, 20 nt, Human
cuccacaccauucaggucuu

SEQ ID NO: 2448593 - RNA, 21 nt, Human
cuccacacacagcugggcugu

SEQ ID NO: 2448594 - RNA, 18 nt, Human
cuccacaccauucagguc

SEQ ID NO: 2448595 - RNA, 17 nt, Human
cuccaauuaaggauuuu

SEQ ID NO: 2448596 - RNA, 20 nt, Human
cuccaauuaaggauuuuaug

SEQ ID NO: 2448597 - RNA, 22 nt, Human
cuccaauuaaggauuuuaugcu

SEQ ID NO: 2448598 - RNA, 22 nt, Human
cucacaguccuuaccagcagag

SEQ ID NO: 2448599 - RNA, 19 nt, Human
cucacaguccuuaccagca

SEQ ID NO: 2448600 - RNA, 17 nt, Human
cucacaguccuuaccag

SEQ ID NO: 2448601 - RNA, 12 nt, Human
cucacauuuaug

SEQ ID NO: 2448602 - RNA, 20 nt, Human
cucaccacuacaucacuuga

SEQ ID NO: 2448603 - RNA, 22 nt, Human
cucacauuuauucugcucacau

SEQ ID NO: 2448604 - RNA, 19 nt, Human
cucacauuuauucugcuca

SEQ ID NO: 2448605 - RNA, 15 nt, Human
cucacauuuauucug

SEQ ID NO: 2448606 - RNA, 15 nt, Human
cucaccagccccagu

SEQ ID NO: 2448607 - RNA, 14 nt, Human
cucaccagccccag

SEQ ID NO: 2448608 - RNA, 13 nt, Human
cucaccagcccca

SEQ ID NO: 2448609 - RNA, 22 nt, Human
cucaccaggggcaggcacagca

SEQ ID NO: 2448610 - RNA, 21 nt, Human
cucaccaggggcaggcacagc

SEQ ID NO: 2448611 - RNA, 20 nt, Human
cucaccaggggcaggcacag

SEQ ID NO: 2448612 - RNA, 15 nt, Human
cucaccaggggcagg

SEQ ID NO: 2448613 - RNA, 13 nt, Human
cucaccaggggca

SEQ ID NO: 2448614 - RNA, 14 nt, Human
cucaccaggggcag

SEQ ID NO: 2448615 - RNA, 13 nt, Human
cucaccaggaagg

SEQ ID NO: 2448616 - RNA, 18 nt, Human
cucaccagccccagugcc

SEQ ID NO: 2448617 - RNA, 17 nt, Human
cucaccagccccagugc

SEQ ID NO: 2448618 - RNA, 17 nt, Human
cucaagugauucuccug

SEQ ID NO: 2448619 - RNA, 16 nt, Human
cucaagucuucccuga

SEQ ID NO: 2448620 - RNA, 17 nt, Human
cucaagucuucccugau

SEQ ID NO: 2448621 - RNA, 18 nt, Human
cucaagucuucccugauc

SEQ ID NO: 2448622 - RNA, 21 nt, Human
cucaaguccucuuuucugaga

SEQ ID NO: 2448623 - RNA, 23 nt, Human
cucaagaagcaggcuacacugac

SEQ ID NO: 2448624 - RNA, 14 nt, Human
cucaagaagcaggc

SEQ ID NO: 2448625 - RNA, 13 nt, Human
cucaagaagcagg

SEQ ID NO: 2448626 - RNA, 22 nt, Human
cucaagaagacauggagacucc

SEQ ID NO: 2448627 - RNA, 21 nt, Human
cucaagaagacauggagacuc

SEQ ID NO: 2448628 - RNA, 20 nt, Human
cucaagaagacauggagacu

SEQ ID NO: 2448629 - RNA, 15 nt, Human
cucaagaagcaggcu

SEQ ID NO: 2448630 - RNA, 23 nt, Human
cucaaccuaccaccccuuccugu

SEQ ID NO: 2448631 - RNA, 21 nt, Human
cucaagaaauaaaaggaagcc

SEQ ID NO: 2448632 - RNA, 22 nt, Human
cucaagaaauaaaaggaagcca

SEQ ID NO: 2448633 - RNA, 23 nt, Human
cucaagaaauaaaaggaagccaa

SEQ ID NO: 2448634 - RNA, 19 nt, Human
cucaagaagacauggagac

SEQ ID NO: 2448635 - RNA, 15 nt, Human
cucacagccucugac

SEQ ID NO: 2448636 - RNA, 14 nt, Human
cucacagccucuga

SEQ ID NO: 2448637 - RNA, 13 nt, Human
cucacagccucug

SEQ ID NO: 2448638 - RNA, 12 nt, Human
cucacagccucu

SEQ ID NO: 2448639 - RNA, 11 nt, Human
cucacagccuc

SEQ ID NO: 2448640 - RNA, 19 nt, Human
cucacaccgcgucugguga

SEQ ID NO: 2448641 - RNA, 22 nt, Human
cucacagccucugaccccuccu

SEQ ID NO: 2448642 - RNA, 21 nt, Human
cucacagccucugaccccucc

SEQ ID NO: 2448643 - RNA, 19 nt, Human
cucacagccucugaccccu

SEQ ID NO: 2448644 - RNA, 16 nt, Human
cucacagccucugacc

SEQ ID NO: 2448645 - RNA, 15 nt, Human
cucacaguccuuacc

SEQ ID NO: 2448646 - RNA, 24 nt, Human
cucacacaugagcaucaggccagg

SEQ ID NO: 2448647 - RNA, 22 nt, Human
cucacacaugagcaucaggcca

SEQ ID NO: 2448648 - RNA, 23 nt, Human
cucacacccaccguccgcccugc

SEQ ID NO: 2448649 - RNA, 22 nt, Human
cucacacccaccguccgcccug

SEQ ID NO: 2448650 - RNA, 15 nt, Human
cucacacccaccguc

SEQ ID NO: 2448651 - RNA, 13 nt, Human
cucacacccaccg

SEQ ID NO: 2448652 - RNA, 12 nt, Human
cucacacccacc

SEQ ID NO: 2448653 - RNA, 23 nt, Human
cucacaccaggcuugccugcagg

SEQ ID NO: 2448654 - RNA, 19 nt, Human
cuauugucaccagggcugg

SEQ ID NO: 2448655 - RNA, 16 nt, Human
cuauuguagcauuucu

SEQ ID NO: 2448656 - RNA, 12 nt, Human
cuauuguacaga

SEQ ID NO: 2448657 - RNA, 16 nt, Human
cuauucucaccaggaa

SEQ ID NO: 2448658 - RNA, 17 nt, Human
cuauuguaaauauguuu

SEQ ID NO: 2448659 - RNA, 14 nt, Human
cuauuguagagcca

SEQ ID NO: 2448660 - RNA, 23 nt, Human
cuauugugauuugacuguuuuua

SEQ ID NO: 2448661 - RNA, 20 nt, Human
cuauugugauuugacuguuu

SEQ ID NO: 2448662 - RNA, 11 nt, Human
cuauuuaaugg

SEQ ID NO: 2448663 - RNA, 19 nt, Human
cuauugugauuugacuguu

SEQ ID NO: 2448664 - RNA, 18 nt, Human
cuauugugauuugacugu

SEQ ID NO: 2448665 - RNA, 17 nt, Human
cuauugugauuugacug

SEQ ID NO: 2448666 - RNA, 14 nt, Human
cuauugugauuuga

SEQ ID NO: 2448667 - RNA, 15 nt, Human
cuauugucauuaaag

SEQ ID NO: 2448668 - RNA, 14 nt, Human
cuauugucauuaaa

SEQ ID NO: 2448669 - RNA, 13 nt, Human
cuauugugauuug

SEQ ID NO: 2448670 - RNA, 22 nt, Human
cuauuguccccuagcaaggcau

SEQ ID NO: 2448671 - RNA, 12 nt, Human
cuauuuaaugga

SEQ ID NO: 2448672 - RNA, 20 nt, Human
cuauuguuacucugguucuu

SEQ ID NO: 2448673 - RNA, 16 nt, Human
cuauuguuacucuggu

SEQ ID NO: 2448674 - RNA, 13 nt, Human
cuauuuagcauga

SEQ ID NO: 2448675 - RNA, 18 nt, Human
cuauuuagcaugacaagc

SEQ ID NO: 2448676 - RNA, 17 nt, Human
cuauuuaguuuuuguaa

SEQ ID NO: 2448677 - RNA, 20 nt, Human
cuauuuaguuuuuguaauuu

SEQ ID NO: 2448678 - RNA, 22 nt, Human
cuauuuaguuuuuguaauuuau

SEQ ID NO: 2448679 - RNA, 23 nt, Human
cuauuuaguuuuuguaauuuauu

SEQ ID NO: 2448680 - RNA, 11 nt, Human
cuauuuaugaa

SEQ ID NO: 2448681 - RNA, 17 nt, Human
cuauuuauauguacaug

SEQ ID NO: 2448682 - RNA, 23 nt, Human
cuauuuagcaugacaagccccag

SEQ ID NO: 2448683 - RNA, 21 nt, Human
cuauuuaucuguaguaaacua

SEQ ID NO: 2448684 - RNA, 16 nt, Human
cuauuuaucuguguuu

SEQ ID NO: 2448685 - RNA, 19 nt, Human
cuauuuaucuguguuuuug

SEQ ID NO: 2448686 - RNA, 22 nt, Human
cuauuuaucuguguuuuugaaa

SEQ ID NO: 2448687 - RNA, 21 nt, Human
cuauucaguucccagaaucaa

SEQ ID NO: 2448688 - RNA, 18 nt, Human
cuauucaguucccagaau

SEQ ID NO: 2448689 - RNA, 22 nt, Human
cuauucccacaccuccacaguu

SEQ ID NO: 2448690 - RNA, 20 nt, Human
cuauucccacaccuccacag

SEQ ID NO: 2448691 - RNA, 19 nt, Human
cuauucccacaccuccaca

SEQ ID NO: 2448692 - RNA, 14 nt, Human
cuauuccuccuggg

SEQ ID NO: 2448693 - RNA, 17 nt, Human
cuauuccccagcagggu

SEQ ID NO: 2448694 - RNA, 14 nt, Human
cuauucuauugcag

SEQ ID NO: 2448695 - RNA, 15 nt, Human
cuauucucaccagga

SEQ ID NO: 2448696 - RNA, 16 nt, Human
cuauuucagugccaau

SEQ ID NO: 2448697 - RNA, 17 nt, Human
cuauuuccauuccagaa

SEQ ID NO: 2448698 - RNA, 14 nt, Human
cuauuuccauucca

SEQ ID NO: 2448699 - RNA, 23 nt, Human
cuauuuccccaggggaaaaugaa

SEQ ID NO: 2448700 - RNA, 22 nt, Human
cuauuuccccaggggaaaauga

SEQ ID NO: 2448701 - RNA, 21 nt, Human
cuauuuccccaggggaaaaug

SEQ ID NO: 2448702 - RNA, 12 nt, Human
cuauuucuaguu

SEQ ID NO: 2448703 - RNA, 19 nt, Human
cucaaaucguccagcgacc

SEQ ID NO: 2448704 - RNA, 13 nt, Human
cucaaaucuauuc

SEQ ID NO: 2448705 - RNA, 16 nt, Human
cucaaaucuauucaga

SEQ ID NO: 2448706 - RNA, 15 nt, Human
cucaaaucuauucag

SEQ ID NO: 2448707 - RNA, 22 nt, Human
cucaaaucuauucagacaagca

SEQ ID NO: 2448708 - RNA, 17 nt, Human
cucaaaugacccaaaga

SEQ ID NO: 2448709 - RNA, 21 nt, Human
cucaaaucuuuuagucauuau

SEQ ID NO: 2448710 - RNA, 16 nt, Human
cucaaaugcucagacc

SEQ ID NO: 2448711 - RNA, 17 nt, Human
cucaaccuccugggcua

SEQ ID NO: 2448712 - RNA, 15 nt, Human
cucaaccuccugggc

SEQ ID NO: 2448713 - RNA, 22 nt, Human
cucaaccuaccaccccuuccug

SEQ ID NO: 2448714 - RNA, 13 nt, Human
cucaaccuccugg

SEQ ID NO: 2448715 - RNA, 20 nt, Human
cucaacacccaacugucucg

SEQ ID NO: 2448716 - RNA, 23 nt, Human
cucaacaagggagagaccucauc

SEQ ID NO: 2448717 - RNA, 21 nt, Human
cucaacaccucugcacaagcu

SEQ ID NO: 2448718 - RNA, 22 nt, Human
cucaacaagggagagaccucau

SEQ ID NO: 2448719 - RNA, 19 nt, Human
cucaacaagggagagaccu

SEQ ID NO: 2448720 - RNA, 15 nt, Human
cucaacaagggagag

SEQ ID NO: 2448721 - RNA, 19 nt, Human
cucaacaaagcacaguguu

SEQ ID NO: 2448722 - RNA, 15 nt, Human
cucaacaaagcacag

SEQ ID NO: 2448723 - RNA, 19 nt, Human
cucaaaugcucagaccagc

SEQ ID NO: 2448724 - RNA, 21 nt, Human
cucagcaccccuuccaugugg

SEQ ID NO: 2448725 - RNA, 20 nt, Human
cucagcaccccuuccaugug

SEQ ID NO: 2448726 - RNA, 17 nt, Human
cucagcaccccuuccau

SEQ ID NO: 2448727 - RNA, 16 nt, Human
cucagcaccccuucca

SEQ ID NO: 2448728 - RNA, 15 nt, Human
cucagcaccccuucc

SEQ ID NO: 2448729 - RNA, 13 nt, Human
cucagcaccccuu

SEQ ID NO: 2448730 - RNA, 12 nt, Human
cucagcaccccu

SEQ ID NO: 2448731 - RNA, 12 nt, Human
cucagcacuugg

SEQ ID NO: 2448732 - RNA, 17 nt, Human
cucagcauccuggcacc

SEQ ID NO: 2448733 - RNA, 16 nt, Human
cucagcauccuggcac

SEQ ID NO: 2448734 - RNA, 12 nt, Human
cucagcagcccu

SEQ ID NO: 2448735 - RNA, 13 nt, Human
cucagcagcccuc

SEQ ID NO: 2448736 - RNA, 14 nt, Human
cucagcagcccucc

SEQ ID NO: 2448737 - RNA, 15 nt, Human
cucagcagcccuccu

SEQ ID NO: 2448738 - RNA, 16 nt, Human
cucagcagcccuccuc

SEQ ID NO: 2448739 - RNA, 17 nt, Human
cucagcagcccuccuca

SEQ ID NO: 2448740 - RNA, 18 nt, Human
cucagcagcccuccucac

SEQ ID NO: 2448741 - RNA, 21 nt, Human
cucagcagcccuccucacccc

SEQ ID NO: 2448742 - RNA, 20 nt, Human
cucagcagcgaccaccccug

SEQ ID NO: 2448743 - RNA, 19 nt, Human
cucagcagcgaccaccccu

SEQ ID NO: 2448744 - RNA, 18 nt, Human
cucagcagcgaccacccc

SEQ ID NO: 2448745 - RNA, 19 nt, Human
cucagcagcccuccucacc

SEQ ID NO: 2448746 - RNA, 18 nt, Human
cucagaucugucugauag

SEQ ID NO: 2448747 - RNA, 17 nt, Human
cucagauuauuuuuccu

SEQ ID NO: 2448748 - RNA, 15 nt, Human
cucagaucugucuga

SEQ ID NO: 2448749 - RNA, 19 nt, Human
cucagauccuuguuucaaa

SEQ ID NO: 2448750 - RNA, 17 nt, Human
cucagauccuuguuuca

SEQ ID NO: 2448751 - RNA, 15 nt, Human
cucagaucuucugug

SEQ ID NO: 2448752 - RNA, 14 nt, Human
cucagcacaaggcc

SEQ ID NO: 2448753 - RNA, 20 nt, Human
cucagcacaaggccaucugg

SEQ ID NO: 2448754 - RNA, 21 nt, Human
cucacugccaggccagccucc

SEQ ID NO: 2448755 - RNA, 20 nt, Human
cucacugccaggccagccuc

SEQ ID NO: 2448756 - RNA, 19 nt, Human
cucacugccaggccagccu

SEQ ID NO: 2448757 - RNA, 18 nt, Human
cucacugccaggccagcc

SEQ ID NO: 2448758 - RNA, 15 nt, Human
cucacugccaggcca

SEQ ID NO: 2448759 - RNA, 14 nt, Human
cucacugccaggcc

SEQ ID NO: 2448760 - RNA, 20 nt, Human
cucacuguugcccaggcugg

SEQ ID NO: 2448761 - RNA, 19 nt, Human
cucacugccaugccagcuu

SEQ ID NO: 2448762 - RNA, 22 nt, Human
cucacugccaugccagcuuauc

SEQ ID NO: 2448763 - RNA, 22 nt, Human
cucagacuuuggaaaaugcauu

SEQ ID NO: 2448764 - RNA, 22 nt, Human
cucacugccaggccagccuccg

SEQ ID NO: 2448765 - RNA, 23 nt, Human
cucagagaauuucuaccauuuca

SEQ ID NO: 2448766 - RNA, 17 nt, Human
cucagacuuuggaaaau

SEQ ID NO: 2448767 - RNA, 22 nt, Human
cucacuguugcccaggcuggcg

SEQ ID NO: 2448768 - RNA, 21 nt, Human
cucacuguugcccaggcuggc

SEQ ID NO: 2448769 - RNA, 15 nt, Human
cucagauccagggac

SEQ ID NO: 2448770 - RNA, 16 nt, Human
cucagauccagggaca

SEQ ID NO: 2448771 - RNA, 17 nt, Human
cucagauccagggacag

SEQ ID NO: 2448772 - RNA, 18 nt, Human
cucagauccagggacaga

SEQ ID NO: 2448773 - RNA, 20 nt, Human
cucagauccagggacagagg

SEQ ID NO: 2448774 - RNA, 22 nt, Human
cucagauccagggacagaggcc

SEQ ID NO: 2448775 - RNA, 15 nt, Human
cucagauccuuguuu

SEQ ID NO: 2448776 - RNA, 21 nt, Human
cucagaucaguguaccauuug

SEQ ID NO: 2448777 - RNA, 10 nt, Human
cucagaucca

SEQ ID NO: 2448778 - RNA, 13 nt, Human
cucagauccaggg

SEQ ID NO: 2448779 - RNA, 14 nt, Human
cucagauccaggga

SEQ ID NO: 2448780 - RNA, 20 nt, Human
cucagaucacuacugcaguc

SEQ ID NO: 2448781 - RNA, 17 nt, Human
cucagaucaguguacca

SEQ ID NO: 2448782 - RNA, 18 nt, Human
cucagaucacuacugcag

SEQ ID NO: 2448783 - RNA, 17 nt, Human
cucagaucacuacugca

SEQ ID NO: 2448784 - RNA, 17 nt, Human
cucagauauuuauauuu

SEQ ID NO: 2448785 - RNA, 23 nt, Human
cucagagagggcaggcaugaagu

SEQ ID NO: 2448786 - RNA, 15 nt, Human
cucagagagggcagg

SEQ ID NO: 2448787 - RNA, 13 nt, Human
cucagagagggca

SEQ ID NO: 2448788 - RNA, 15 nt, Human
cucagagagcaccau

SEQ ID NO: 2448789 - RNA, 14 nt, Human
cucagagagggugg

SEQ ID NO: 2448790 - RNA, 14 nt, Human
cucagauauuuaua

SEQ ID NO: 2448791 - RNA, 18 nt, Human
cucagagucggaacggag

SEQ ID NO: 2448792 - RNA, 15 nt, Human
cucagaguccaggcc

SEQ ID NO: 2448793 - RNA, 18 nt, Human
cucagaguccaggcccca

SEQ ID NO: 2448794 - RNA, 17 nt, Human
cucagagucggaacgga

SEQ ID NO: 2448795 - RNA, 13 nt, Human
cucagagugcaag

SEQ ID NO: 2448796 - RNA, 13 nt, Human
cucacugccaggc

SEQ ID NO: 2448797 - RNA, 17 nt, Human
cucacugcaaccuccgc

SEQ ID NO: 2448798 - RNA, 13 nt, Human
cucacugcagccu

SEQ ID NO: 2448799 - RNA, 22 nt, Human
cucacugagaagauugugaaua

SEQ ID NO: 2448800 - RNA, 21 nt, Human
cucacugaaaacaucuggaag

SEQ ID NO: 2448801 - RNA, 14 nt, Human
cucacugaaaccag

SEQ ID NO: 2448802 - RNA, 12 nt, Human
cucacugcagcc

SEQ ID NO: 2448803 - RNA, 21 nt, Human
cucacucugucgcccagucug

SEQ ID NO: 2448804 - RNA, 13 nt, Human
cucacucugucgc

SEQ ID NO: 2448805 - RNA, 19 nt, Human
cucacugaaaacaucugga

SEQ ID NO: 2448806 - RNA, 18 nt, Human
cucacugaaaacaucugg

SEQ ID NO: 2448807 - RNA, 17 nt, Human
cucacugaaaacaucug

SEQ ID NO: 2448808 - RNA, 13 nt, Human
cucacugaaaaca

SEQ ID NO: 2448809 - RNA, 16 nt, Human
cucacucuugccaacc

SEQ ID NO: 2448810 - RNA, 15 nt, Human
cucacucuggccuca

SEQ ID NO: 2448811 - RNA, 14 nt, Human
cucacucuugccaa

SEQ ID NO: 2448812 - RNA, 22 nt, Human
cucacucugucgcccagucugg

SEQ ID NO: 2448813 - RNA, 14 nt, Human
cucacucuggccuc

SEQ ID NO: 2448814 - RNA, 12 nt, Human
cucacucugucg

SEQ ID NO: 2448815 - RNA, 11 nt, Human
cucacucuguc

SEQ ID NO: 2448816 - RNA, 11 nt, Human
cucacuccugu

SEQ ID NO: 2448817 - RNA, 22 nt, Human
cucacuccugagaccccuggcc

SEQ ID NO: 2448818 - RNA, 20 nt, Human
cucacuccugagaccccugg

SEQ ID NO: 2448819 - RNA, 14 nt, Human
cucacuccugagac

SEQ ID NO: 2448820 - RNA, 20 nt, Human
cucacuccuguuacuuaccu

SEQ ID NO: 2448821 - RNA, 12 nt, Human
cucacuccuguu

SEQ ID NO: 2448822 - RNA, 13 nt, Human
cucacuccuugaa

SEQ ID NO: 2448823 - RNA, 19 nt, Human
cucacuccuaccugguaau

SEQ ID NO: 2448824 - RNA, 23 nt, Human
cucacucccuucuaccugccacu

SEQ ID NO: 2448825 - RNA, 22 nt, Human
cucacucccuucuaccugccac

SEQ ID NO: 2448826 - RNA, 12 nt, Human
cucacuccugag

SEQ ID NO: 2448827 - RNA, 17 nt, Human
cucacuccuaccuggua

SEQ ID NO: 2448828 - RNA, 16 nt, Human
cucacuccuaccuggu

SEQ ID NO: 2448829 - RNA, 20 nt, Human
cucacuauguugcccaggca

SEQ ID NO: 2448830 - RNA, 19 nt, Human
cucacuauguugcccaggc

SEQ ID NO: 2448831 - RNA, 17 nt, Human
cucacccccagcuuugc

SEQ ID NO: 2448832 - RNA, 18 nt, Human
cucacccccagcuuugcu

SEQ ID NO: 2448833 - RNA, 14 nt, Human
cucacccccagcuu

SEQ ID NO: 2448834 - RNA, 21 nt, Human
cucacccccaaggggcagucu

SEQ ID NO: 2448835 - RNA, 22 nt, Human
cucacccccaaggggcagucug

SEQ ID NO: 2448836 - RNA, 19 nt, Human
cucaccccaucccacaccc

SEQ ID NO: 2448837 - RNA, 21 nt, Human
cucaccccaucccacacccug

SEQ ID NO: 2448838 - RNA, 22 nt, Human
cucaccccaucccacacccugg

SEQ ID NO: 2448839 - RNA, 17 nt, Human
cucacccccaaggggca

SEQ ID NO: 2448840 - RNA, 24 nt, Human
cucaccaguguccccuccacuguc

SEQ ID NO: 2448841 - RNA, 23 nt, Human
cucaccaguguccccuccacugu

SEQ ID NO: 2448842 - RNA, 20 nt, Human
cucaccaguguccccuccac

SEQ ID NO: 2448843 - RNA, 23 nt, Human
cucaccaggggcaggcacagcac

SEQ ID NO: 2448844 - RNA, 14 nt, Human
cucaccaucugugc

SEQ ID NO: 2448845 - RNA, 14 nt, Human
cucaccauguaaaa

SEQ ID NO: 2448846 - RNA, 15 nt, Human
cucaccccagcccca

SEQ ID NO: 2448847 - RNA, 22 nt, Human
cucacccacuuuggccuccguu

SEQ ID NO: 2448848 - RNA, 12 nt, Human
cucaccccaucc

SEQ ID NO: 2448849 - RNA, 13 nt, Human
cucaccccauccc

SEQ ID NO: 2448850 - RNA, 12 nt, Human
cucacuccacca

SEQ ID NO: 2448851 - RNA, 14 nt, Human
cucacuccaccacc

SEQ ID NO: 2448852 - RNA, 16 nt, Human
cucacuccaccaccca

SEQ ID NO: 2448853 - RNA, 17 nt, Human
cucacuccaccacccaa

SEQ ID NO: 2448854 - RNA, 20 nt, Human
cucacuccaccacccaaaag

SEQ ID NO: 2448855 - RNA, 15 nt, Human
cucacuccuaccugg

SEQ ID NO: 2448856 - RNA, 13 nt, Human
cucacuccuaccu

SEQ ID NO: 2448857 - RNA, 15 nt, Human
cucacucccagucca

SEQ ID NO: 2448858 - RNA, 15 nt, Human
cucacucccuuccca

SEQ ID NO: 2448859 - RNA, 21 nt, Human
cucacucccuucccauaagcu

SEQ ID NO: 2448860 - RNA, 22 nt, Human
cucacuauguugcccaggcagg

SEQ ID NO: 2448861 - RNA, 21 nt, Human
cucacuauguugcccaggcag

SEQ ID NO: 2448862 - RNA, 23 nt, Human
cucacuauguugcccaggcaggu

SEQ ID NO: 2448863 - RNA, 19 nt, Human
cucacccccagcuuugcua

SEQ ID NO: 2448864 - RNA, 23 nt, Human
cuaggucucggacuaagccuacc

SEQ ID NO: 2448865 - RNA, 12 nt, Human
cuaggucugaua

SEQ ID NO: 2448866 - RNA, 24 nt, Human
cuaggugacagagugagacucugu

SEQ ID NO: 2448867 - RNA, 19 nt, Human
cuagguggcaaggcugugc

SEQ ID NO: 2448868 - RNA, 17 nt, Human
cuagguggcaaggcugu

SEQ ID NO: 2448869 - RNA, 22 nt, Human
cuaggugcccuuggaggccagc

SEQ ID NO: 2448870 - RNA, 18 nt, Human
cuaggugcccuuggaggc

SEQ ID NO: 2448871 - RNA, 23 nt, Human
cuagguggcaaggcugugcuccc

SEQ ID NO: 2448872 - RNA, 13 nt, Human
cuaggugggccag

SEQ ID NO: 2448873 - RNA, 15 nt, Human
cuaggugggccagcc

SEQ ID NO: 2448874 - RNA, 17 nt, Human
cuaggugggccagcccc

SEQ ID NO: 2448875 - RNA, 18 nt, Human
cuaggugggccagccccu

SEQ ID NO: 2448876 - RNA, 19 nt, Human
cuaggugggccagccccuc

SEQ ID NO: 2448877 - RNA, 21 nt, Human
cuaggugggccagccccuccc

SEQ ID NO: 2448878 - RNA, 23 nt, Human
cuaggugggccagccccucccac

SEQ ID NO: 2448879 - RNA, 14 nt, Human
cuagguacuucagg

SEQ ID NO: 2448880 - RNA, 15 nt, Human
cuagguaggguuuaa

SEQ ID NO: 2448881 - RNA, 17 nt, Human
cuaggucagcuugcugc

SEQ ID NO: 2448882 - RNA, 18 nt, Human
cuaggugacagagugaga

SEQ ID NO: 2448883 - RNA, 14 nt, Human
cuaggugacagagu

SEQ ID NO: 2448884 - RNA, 23 nt, Human
cgcccaguuggguggaugccugg

SEQ ID NO: 2448885 - RNA, 12 nt, Human
cgccccacccag

SEQ ID NO: 2448886 - RNA, 13 nt, Human
cgcccauguguga

SEQ ID NO: 2448887 - RNA, 22 nt, Human
cuagguaaauuacaguuccuag

SEQ ID NO: 2448888 - RNA, 21 nt, Human
cgccccagaucaccagcccgg

SEQ ID NO: 2448889 - RNA, 20 nt, Human
cgccccagauaccagccccu

SEQ ID NO: 2448890 - RNA, 19 nt, Human
cgccccagauaccagcccc

SEQ ID NO: 2448891 - RNA, 13 nt, Human
cgccccacccaga

SEQ ID NO: 2448892 - RNA, 20 nt, Human
cgccaucccagccccaauga

SEQ ID NO: 2448893 - RNA, 15 nt, Human
cgccaugcuccuggc

SEQ ID NO: 2448894 - RNA, 22 nt, Human
cgcccaguuggguggaugccug

SEQ ID NO: 2448895 - RNA, 17 nt, Human
cgccaucccagccccaa

SEQ ID NO: 2448896 - RNA, 11 nt, Human
cgccagggccc

SEQ ID NO: 2448897 - RNA, 18 nt, Human
cuagugacccggaggcca

SEQ ID NO: 2448898 - RNA, 14 nt, Human
cuagugacccggag

SEQ ID NO: 2448899 - RNA, 18 nt, Human
cuagugacuuguguccca

SEQ ID NO: 2448900 - RNA, 21 nt, Human
cuagugagcagucaggaaaga

SEQ ID NO: 2448901 - RNA, 14 nt, Human
cuagugaaugaauc

SEQ ID NO: 2448902 - RNA, 21 nt, Human
cuagugaaggcuucucucugu

SEQ ID NO: 2448903 - RNA, 20 nt, Human
cuagucccuuccacaccccc

SEQ ID NO: 2448904 - RNA, 17 nt, Human
cuagugaaggcuucucu

SEQ ID NO: 2448905 - RNA, 15 nt, Human
cuagucccuuccccu

SEQ ID NO: 2448906 - RNA, 17 nt, Human
cuagucccuuccccucc

SEQ ID NO: 2448907 - RNA, 18 nt, Human
cuagugaaagaggcagcu

SEQ ID NO: 2448908 - RNA, 19 nt, Human
cuagugaaagaggcagcuu

SEQ ID NO: 2448909 - RNA, 20 nt, Human
cuagugaaacucguuaauuu

SEQ ID NO: 2448910 - RNA, 13 nt, Human
cuagucauaaccu

SEQ ID NO: 2448911 - RNA, 18 nt, Human
cuagucagagagaguguu

SEQ ID NO: 2448912 - RNA, 15 nt, Human
cuagucccuuccaca

SEQ ID NO: 2448913 - RNA, 14 nt, Human
cuaguccagugacc

SEQ ID NO: 2448914 - RNA, 14 nt, Human
cuagucccuucccc

SEQ ID NO: 2448915 - RNA, 16 nt, Human
cuaguaauuggaaagg

SEQ ID NO: 2448916 - RNA, 16 nt, Human
cuaguacuaacuccua

SEQ ID NO: 2448917 - RNA, 15 nt, Human
cuagucaagcuccuc

SEQ ID NO: 2448918 - RNA, 16 nt, Human
cuagucaagcuccucc

SEQ ID NO: 2448919 - RNA, 19 nt, Human
cuagucaagcuccuccucc

SEQ ID NO: 2448920 - RNA, 22 nt, Human
cuagucaagcuccuccucccug

SEQ ID NO: 2448921 - RNA, 23 nt, Human
cuagucaagcuccuccucccugc

SEQ ID NO: 2448922 - RNA, 13 nt, Human
cuagucagagaga

SEQ ID NO: 2448923 - RNA, 16 nt, Human
cuagucagagagagug

SEQ ID NO: 2448924 - RNA, 19 nt, Human
cuagguuuaacucagauca

SEQ ID NO: 2448925 - RNA, 18 nt, Human
cuagguuuaacucagauc

SEQ ID NO: 2448926 - RNA, 16 nt, Human
cuagguuuaacucaga

SEQ ID NO: 2448927 - RNA, 15 nt, Human
cuagguuuaacucag

SEQ ID NO: 2448928 - RNA, 14 nt, Human
cuagguuuaacuca

SEQ ID NO: 2448929 - RNA, 12 nt, Human
cuagguuuaacu

SEQ ID NO: 2448930 - RNA, 13 nt, Human
cuagguucuaaaa

SEQ ID NO: 2448931 - RNA, 16 nt, Human
cuaguaagugccuucc

SEQ ID NO: 2448932 - RNA, 15 nt, Human
cuaguaagugccuuc

SEQ ID NO: 2448933 - RNA, 18 nt, Human
cuaguaagugccuuccau

SEQ ID NO: 2448934 - RNA, 17 nt, Human
cuaguaagugccuucca

SEQ ID NO: 2448935 - RNA, 22 nt, Human
cuagguuuaacucagaucacua

SEQ ID NO: 2448936 - RNA, 20 nt, Human
cuagguuuaacucagaucac

SEQ ID NO: 2448937 - RNA, 16 nt, Human
cuaguaaaaauacaaa

SEQ ID NO: 2448938 - RNA, 14 nt, Human
cuagugcugugaaa

SEQ ID NO: 2448939 - RNA, 17 nt, Human
cuagugcugugaaaaaa

SEQ ID NO: 2448940 - RNA, 13 nt, Human
cuagugcugugaa

SEQ ID NO: 2448941 - RNA, 16 nt, Human
cuagugcaaaucauag

SEQ ID NO: 2448942 - RNA, 20 nt, Human
cuagugacuugugucccaug

SEQ ID NO: 2448943 - RNA, 19 nt, Human
cuagugacuugugucccau

SEQ ID NO: 2448944 - RNA, 13 nt, Human
cuagugcaaauca

SEQ ID NO: 2448945 - RNA, 22 nt, Human
cuaguggcuguccagugcccau

SEQ ID NO: 2448946 - RNA, 20 nt, Human
cuaguggcuguccagugccc

SEQ ID NO: 2448947 - RNA, 19 nt, Human
cuaguggcuguccagugcc

SEQ ID NO: 2448948 - RNA, 18 nt, Human
cuaguggcuguccagugc

SEQ ID NO: 2448949 - RNA, 17 nt, Human
cuaguggcuguccagug

SEQ ID NO: 2448950 - RNA, 16 nt, Human
cuaguggcuguccagu

SEQ ID NO: 2448951 - RNA, 15 nt, Human
cuaguggcuguccag

SEQ ID NO: 2448952 - RNA, 14 nt, Human
cuaguggcugucca

SEQ ID NO: 2448953 - RNA, 23 nt, Human
cuagugcuuuccuuuuuuaaaaa

SEQ ID NO: 2448954 - RNA, 21 nt, Human
cuagugcuuuccuuuuuuaaa

SEQ ID NO: 2448955 - RNA, 22 nt, Human
cuagugcuuuccuuuuuuaaaa

SEQ ID NO: 2448956 - RNA, 22 nt, Human
cuagugcugugaaaaaaaaaau

SEQ ID NO: 2448957 - RNA, 13 nt, Human
cuagugcuuuccu

SEQ ID NO: 2448958 - RNA, 13 nt, Human
cuagugcagcuga

SEQ ID NO: 2448959 - RNA, 19 nt, Human
cuauaaucccagcacuuug

SEQ ID NO: 2448960 - RNA, 15 nt, Human
cuaguggcuucaaaa

SEQ ID NO: 2448961 - RNA, 17 nt, Human
cuaguggggucucccuc

SEQ ID NO: 2448962 - RNA, 18 nt, Human
cuaguggggucucccucu

SEQ ID NO: 2448963 - RNA, 19 nt, Human
cuaguggggucucccucuc

SEQ ID NO: 2448964 - RNA, 20 nt, Human
cuaguggggucucccucucc

SEQ ID NO: 2448965 - RNA, 21 nt, Human
cuaguggggucucccucuccu

SEQ ID NO: 2448966 - RNA, 22 nt, Human
cuaguggggucucccucuccug

SEQ ID NO: 2448967 - RNA, 12 nt, Human
cuauaaugaagc

SEQ ID NO: 2448968 - RNA, 16 nt, Human
cuauaauguaagcucu

SEQ ID NO: 2448969 - RNA, 22 nt, Human
cuauaauuuaccugaagucuuu

SEQ ID NO: 2448970 - RNA, 19 nt, Human
cuauaaugaagcuuuauac

SEQ ID NO: 2448971 - RNA, 15 nt, Human
cuauaaugaagcuuu

SEQ ID NO: 2448972 - RNA, 21 nt, Human
cuauaauguaagcucuacuga

SEQ ID NO: 2448973 - RNA, 10 nt, Human
cuauagcacc

SEQ ID NO: 2448974 - RNA, 19 nt, Human
cuauagacccgaggaaacu

SEQ ID NO: 2448975 - RNA, 12 nt, Human
cuauagacucua

SEQ ID NO: 2448976 - RNA, 17 nt, Human
cuauacauaucuuuauu

SEQ ID NO: 2448977 - RNA, 20 nt, Human
cuauacauaucuuuauuaau

SEQ ID NO: 2448978 - RNA, 22 nt, Human
cuauacauaucuuuauuaauca

SEQ ID NO: 2448979 - RNA, 14 nt, Human
cuauacauaucuuu

SEQ ID NO: 2448980 - RNA, 15 nt, Human
cuauacauaucuuua

SEQ ID NO: 2448981 - RNA, 15 nt, Human
cuauacaacuggaca

SEQ ID NO: 2448982 - RNA, 14 nt, Human
cuaucuguguuuug

SEQ ID NO: 2448983 - RNA, 21 nt, Human
cuaucugucugguggccccgu

SEQ ID NO: 2448984 - RNA, 18 nt, Human
cuaucugucugguggccc

SEQ ID NO: 2448985 - RNA, 17 nt, Human
cuaucugucugguggcc

SEQ ID NO: 2448986 - RNA, 16 nt, Human
cuaucugucugguggc

SEQ ID NO: 2448987 - RNA, 14 nt, Human
cuaucugucuggug

SEQ ID NO: 2448988 - RNA, 11 nt, Human
cuaucugucug

SEQ ID NO: 2448989 - RNA, 21 nt, Human
cuaucuggucaaccuccugga

SEQ ID NO: 2448990 - RNA, 22 nt, Human
cuaucuggucaaccuccuggac

SEQ ID NO: 2448991 - RNA, 12 nt, Human
cuauauuugggc

SEQ ID NO: 2448992 - RNA, 22 nt, Human
cuauauuugggccugcuccaga

SEQ ID NO: 2448993 - RNA, 22 nt, Human
cuauauuuagauuguuaaaaua

SEQ ID NO: 2448994 - RNA, 23 nt, Human
cuauauuuagauuguuaaaauaa

SEQ ID NO: 2448995 - RNA, 12 nt, Human
cuauauuuacag

SEQ ID NO: 2448996 - RNA, 16 nt, Human
cuauauuuacagugaa

SEQ ID NO: 2448997 - RNA, 15 nt, Human
cuauauuuacaguga

SEQ ID NO: 2448998 - RNA, 13 nt, Human
cuauauuuagauu

SEQ ID NO: 2448999 - RNA, 16 nt, Human
cuauauuuaacaagau

SEQ ID NO: 2449000 - RNA, 15 nt, Human
cuauauuguacacac

SEQ ID NO: 2449001 - RNA, 14 nt, Human
cuauauuguacaca

SEQ ID NO: 2449002 - RNA, 21 nt, Human
cuauaggugcuacaaaaacac

SEQ ID NO: 2449003 - RNA, 22 nt, Human
cuauaggugcuacaaaaacaca

SEQ ID NO: 2449004 - RNA, 20 nt, Human
cuauaggugcuacaaaaaca

SEQ ID NO: 2449005 - RNA, 17 nt, Human
cuauagccuaggugaca

SEQ ID NO: 2449006 - RNA, 15 nt, Human
cuauagcccaggucc

SEQ ID NO: 2449007 - RNA, 19 nt, Human
cuauaugauuuauaguuug

SEQ ID NO: 2449008 - RNA, 12 nt, Human
cuauaugugaau

SEQ ID NO: 2449009 - RNA, 21 nt, Human
cuauauguaguauaaagaaaa

SEQ ID NO: 2449010 - RNA, 14 nt, Human
cuauauguacuugu

SEQ ID NO: 2449011 - RNA, 19 nt, Human
cuauauggcaagaaagcug

SEQ ID NO: 2449012 - RNA, 13 nt, Human
cuauauggcaaga

SEQ ID NO: 2449013 - RNA, 18 nt, Human
cuauauuguuugcuaagc

SEQ ID NO: 2449014 - RNA, 18 nt, Human
cuauaugugaauccucuu

SEQ ID NO: 2449015 - RNA, 21 nt, Human
cuauauguacuugucaaagaa

SEQ ID NO: 2449016 - RNA, 19 nt, Human
cuauauguuuguauaauga

SEQ ID NO: 2449017 - RNA, 13 nt, Human
cuauauuguacac

SEQ ID NO: 2449018 - RNA, 22 nt, Human
cuauuagccaggaucauggugu

SEQ ID NO: 2449019 - RNA, 16 nt, Human
cuauuagccaggauca

SEQ ID NO: 2449020 - RNA, 13 nt, Human
cuauuagccaguc

SEQ ID NO: 2449021 - RNA, 14 nt, Human
cuauuagacuguag

SEQ ID NO: 2449022 - RNA, 23 nt, Human
cuauuacugucugguuuuaacaa

SEQ ID NO: 2449023 - RNA, 16 nt, Human
cuauuagccacaaaau

SEQ ID NO: 2449024 - RNA, 18 nt, Human
cuauguaacaaaccugca

SEQ ID NO: 2449025 - RNA, 22 nt, Human
cuauguaaaugcaucuguccuc

SEQ ID NO: 2449026 - RNA, 17 nt, Human
cuauuaccaugagaaga

SEQ ID NO: 2449027 - RNA, 15 nt, Human
cuauuagagaagaga

SEQ ID NO: 2449028 - RNA, 18 nt, Human
cuauucaaacagucucag

SEQ ID NO: 2449029 - RNA, 16 nt, Human
cuauucaaacagucuc

SEQ ID NO: 2449030 - RNA, 23 nt, Human
cuauucaaacagucucaggaaau

SEQ ID NO: 2449031 - RNA, 17 nt, Human
cuauucaguucccagaa

SEQ ID NO: 2449032 - RNA, 23 nt, Human
cuauucaagguggccaaauuauu

SEQ ID NO: 2449033 - RNA, 13 nt, Human
cuauucagacaag

SEQ ID NO: 2449034 - RNA, 19 nt, Human
cuauucaguggcgagaaau

SEQ ID NO: 2449035 - RNA, 22 nt, Human
cuauucaagguggccaaauuau

SEQ ID NO: 2449036 - RNA, 11 nt, Human
cuauucacaac

SEQ ID NO: 2449037 - RNA, 21 nt, Human
cuauggugccaauggaaccuc

SEQ ID NO: 2449038 - RNA, 15 nt, Human
cuauggugccaaugg

SEQ ID NO: 2449039 - RNA, 14 nt, Human
cuauggugccaaug

SEQ ID NO: 2449040 - RNA, 21 nt, Human
cuauggugagaugcagcugga

SEQ ID NO: 2449041 - RNA, 20 nt, Human
cuauggugagaugcagcugg

SEQ ID NO: 2449042 - RNA, 19 nt, Human
cuauggugagaugcagcug

SEQ ID NO: 2449043 - RNA, 21 nt, Human
cuauggucgggagacagcauc

SEQ ID NO: 2449044 - RNA, 17 nt, Human
cuauggucgggagacag

SEQ ID NO: 2449045 - RNA, 12 nt, Human
cuauggucaucu

SEQ ID NO: 2449046 - RNA, 16 nt, Human
cuaugggagccccagg

SEQ ID NO: 2449047 - RNA, 19 nt, Human
cuaugggggcacugaggac

SEQ ID NO: 2449048 - RNA, 17 nt, Human
cuaugggagccccaggg

SEQ ID NO: 2449049 - RNA, 23 nt, Human
cuaugggacucaaugcacugaca

SEQ ID NO: 2449050 - RNA, 13 nt, Human
cuaugggagcccc

SEQ ID NO: 2449051 - RNA, 14 nt, Human
cuaugggagcccca

SEQ ID NO: 2449052 - RNA, 15 nt, Human
cuaugggagccccag

SEQ ID NO: 2449053 - RNA, 22 nt, Human
cuaugggacucaaugcacugac

SEQ ID NO: 2449054 - RNA, 18 nt, Human
cuaugggacucaaugcac

SEQ ID NO: 2449055 - RNA, 23 nt, Human
cuauggacggugcuccaggcagg

SEQ ID NO: 2449056 - RNA, 22 nt, Human
cuauggacggugcuccaggcag

SEQ ID NO: 2449057 - RNA, 19 nt, Human
cuauggacggugcuccagg

SEQ ID NO: 2449058 - RNA, 17 nt, Human
cuauggaagcauauugu

SEQ ID NO: 2449059 - RNA, 19 nt, Human
cuaugcugccuaggcugac

SEQ ID NO: 2449060 - RNA, 21 nt, Human
cuaugcugguaggcuccugcc

SEQ ID NO: 2449061 - RNA, 22 nt, Human
cuaugaucccagcacuuuggga

SEQ ID NO: 2449062 - RNA, 14 nt, Human
cuaugcugccuagg

SEQ ID NO: 2449063 - RNA, 13 nt, Human
cuauggccugugg

SEQ ID NO: 2449064 - RNA, 17 nt, Human
cuauggcuggccacugc

SEQ ID NO: 2449065 - RNA, 23 nt, Human
cuauggcuggccacugcacagag

SEQ ID NO: 2449066 - RNA, 14 nt, Human
cuauggauggcuuc

SEQ ID NO: 2449067 - RNA, 15 nt, Human
cuauggauggcuucu

SEQ ID NO: 2449068 - RNA, 10 nt, Human
cuauggaugu

SEQ ID NO: 2449069 - RNA, 16 nt, Human
cuauggauggcuucua

SEQ ID NO: 2449070 - RNA, 18 nt, Human
cuauggaugugggguccc

SEQ ID NO: 2449071 - RNA, 11 nt, Human
cuauggaugug

SEQ ID NO: 2449072 - RNA, 24 nt, Human
cuauggaugugggguccccaucau

SEQ ID NO: 2449073 - RNA, 21 nt, Human
cuaugcacauauggacucugc

SEQ ID NO: 2449074 - RNA, 20 nt, Human
cuaugcacauauggacucug

SEQ ID NO: 2449075 - RNA, 20 nt, Human
cuaugcagagguccacaaca

SEQ ID NO: 2449076 - RNA, 18 nt, Human
cuaugcacauauggacuc

SEQ ID NO: 2449077 - RNA, 13 nt, Human
cuaugcacauaug

SEQ ID NO: 2449078 - RNA, 23 nt, Human
cuaugauauuuucugugccugaa

SEQ ID NO: 2449079 - RNA, 21 nt, Human
cuaugaucccagcacuuuggg

SEQ ID NO: 2449080 - RNA, 20 nt, Human
cuaugcauggugccccagga

SEQ ID NO: 2449081 - RNA, 21 nt, Human
cuaugcauggugccccaggac

SEQ ID NO: 2449082 - RNA, 22 nt, Human
cuaugcauggugccccaggacc

SEQ ID NO: 2449083 - RNA, 23 nt, Human
cuaugcauggugccccaggacca

SEQ ID NO: 2449084 - RNA, 13 nt, Human
cuaugcauggugc

SEQ ID NO: 2449085 - RNA, 19 nt, Human
cuaugcauggugccccagg

SEQ ID NO: 2449086 - RNA, 22 nt, Human
cuaugcacauauggacucugca

SEQ ID NO: 2449087 - RNA, 20 nt, Human
cuaugcauaucaguugagcu

SEQ ID NO: 2449088 - RNA, 15 nt, Human
cuaugagggccuuga

SEQ ID NO: 2449089 - RNA, 17 nt, Human
cuaugagggccuugagu

SEQ ID NO: 2449090 - RNA, 20 nt, Human
cuaugauaugguaaaaguua

SEQ ID NO: 2449091 - RNA, 16 nt, Human
cuaucuguuuacagug

SEQ ID NO: 2449092 - RNA, 21 nt, Human
cuaugagaauugggauuacau

SEQ ID NO: 2449093 - RNA, 13 nt, Human
cuaugagggccuu

SEQ ID NO: 2449094 - RNA, 23 nt, Human
cuaugaggaauaauuauuuauuu

SEQ ID NO: 2449095 - RNA, 22 nt, Human
cuaugaggaauaauuauuuauu

SEQ ID NO: 2449096 - RNA, 14 nt, Human
gaggcugggcuccc

SEQ ID NO: 2449097 - RNA, 13 nt, Human
gaggcugggcucc

SEQ ID NO: 2449098 - RNA, 23 nt, Human
gaggcuaaauuacucaggaagaa

SEQ ID NO: 2449099 - RNA, 20 nt, Human
gaggcgggccagccaggcgg

SEQ ID NO: 2449100 - RNA, 19 nt, Human
gaggcggguggaucacuug

SEQ ID NO: 2449101 - RNA, 21 nt, Human
gaggcuuccugcguccuccuc

SEQ ID NO: 2449102 - RNA, 15 nt, Human
gaggcuuccugcguc

SEQ ID NO: 2449103 - RNA, 13 nt, Human
gaggcuuccugcg

SEQ ID NO: 2449104 - RNA, 23 nt, Human
gaggcuuccagagaguccucugg

SEQ ID NO: 2449105 - RNA, 18 nt, Human
gaggcuucuccgccagcc

SEQ ID NO: 2449106 - RNA, 15 nt, Human
gaggcuucuccgcca

SEQ ID NO: 2449107 - RNA, 14 nt, Human
gaggcuuccuucau

SEQ ID NO: 2449108 - RNA, 22 nt, Human
gaggcuuccagagaguccucug

SEQ ID NO: 2449109 - RNA, 21 nt, Human
gaggcuuccagagaguccucu

SEQ ID NO: 2449110 - RNA, 20 nt, Human
gaggcuuccagagaguccuc

SEQ ID NO: 2449111 - RNA, 16 nt, Human
gaggcuuccagagagu

SEQ ID NO: 2449112 - RNA, 22 nt, Human
gaggcuuagcuuugcucugcca

SEQ ID NO: 2449113 - RNA, 15 nt, Human
gaggcugggcucccu

SEQ ID NO: 2449114 - RNA, 17 nt, Human
gaggcuguucccaccag

SEQ ID NO: 2449115 - RNA, 14 nt, Human
gaggccuucucuga

SEQ ID NO: 2449116 - RNA, 19 nt, Human
gaggcggaucuuuggacag

SEQ ID NO: 2449117 - RNA, 19 nt, Human
gaggcggagaguacaguga

SEQ ID NO: 2449118 - RNA, 20 nt, Human
gaggccuuaucauucauucu

SEQ ID NO: 2449119 - RNA, 20 nt, Human
gaggcggagcuugcagugag

SEQ ID NO: 2449120 - RNA, 19 nt, Human
gaggcgggccagccaggcg

SEQ ID NO: 2449121 - RNA, 17 nt, Human
gaggcgggccagccagg

SEQ ID NO: 2449122 - RNA, 16 nt, Human
gaggcgggccagccag

SEQ ID NO: 2449123 - RNA, 15 nt, Human
gaggcgggccagcca

SEQ ID NO: 2449124 - RNA, 12 nt, Human
gaggcgggugga

SEQ ID NO: 2449125 - RNA, 19 nt, Human
gaggcggguggaucaccug

SEQ ID NO: 2449126 - RNA, 14 nt, Human
gaggcgggccagcc

SEQ ID NO: 2449127 - RNA, 13 nt, Human
gaggcgggccagc

SEQ ID NO: 2449128 - RNA, 20 nt, Human
gaggcgggagaaucauguga

SEQ ID NO: 2449129 - RNA, 15 nt, Human
gaggcgggagaauca

SEQ ID NO: 2449130 - RNA, 20 nt, Human
gaggccugggccgcugccac

SEQ ID NO: 2449131 - RNA, 16 nt, Human
gaggccugggccgcug

SEQ ID NO: 2449132 - RNA, 16 nt, Human
gaggccuggccaggca

SEQ ID NO: 2449133 - RNA, 15 nt, Human
gaggccuggccaggc

SEQ ID NO: 2449134 - RNA, 14 nt, Human
gaggccugggccgc

SEQ ID NO: 2449135 - RNA, 14 nt, Human
gaggccuggccagg

SEQ ID NO: 2449136 - RNA, 13 nt, Human
gaggccuggccag

SEQ ID NO: 2449137 - RNA, 18 nt, Human
gaggccuggaguaacaca

SEQ ID NO: 2449138 - RNA, 23 nt, Human
gaggccugcccucagggaucuug

SEQ ID NO: 2449139 - RNA, 20 nt, Human
gaggccuggacuuuccugca

SEQ ID NO: 2449140 - RNA, 19 nt, Human
gaggccuggacuuuccugc

SEQ ID NO: 2449141 - RNA, 17 nt, Human
gaggccuggccaggcac

SEQ ID NO: 2449142 - RNA, 22 nt, Human
gaggccugggccgcugccacgu

SEQ ID NO: 2449143 - RNA, 21 nt, Human
gaggccugggccgcugccacg

SEQ ID NO: 2449144 - RNA, 18 nt, Human
gaggccuuaucauucauu

SEQ ID NO: 2449145 - RNA, 23 nt, Human
gaggcccuucucuccagccccug

SEQ ID NO: 2449146 - RNA, 14 nt, Human
gaggcccuucucuc

SEQ ID NO: 2449147 - RNA, 24 nt, Human
gaggcccuucucuccagccccugg

SEQ ID NO: 2449148 - RNA, 22 nt, Human
gaggcccuucucuccagccccu

SEQ ID NO: 2449149 - RNA, 20 nt, Human
gaggccugcccucagggauc

SEQ ID NO: 2449150 - RNA, 16 nt, Human
gaggccugcccgggcg

SEQ ID NO: 2449151 - RNA, 13 nt, Human
gaggccugcccgg

SEQ ID NO: 2449152 - RNA, 12 nt, Human
gaggccugcccg

SEQ ID NO: 2449153 - RNA, 20 nt, Human
gaggccugccuccagggcug

SEQ ID NO: 2449154 - RNA, 19 nt, Human
gaggccugccuccagggcu

SEQ ID NO: 2449155 - RNA, 18 nt, Human
gaggccuggacuuuccug

SEQ ID NO: 2449156 - RNA, 13 nt, Human
gaggccuggacuu

SEQ ID NO: 2449157 - RNA, 22 nt, Human
gaggccugccuccagggcugga

SEQ ID NO: 2449158 - RNA, 21 nt, Human
gaggccugccuccagggcugg

SEQ ID NO: 2449159 - RNA, 22 nt, Human
gaggccugaggaugagcuggaa

SEQ ID NO: 2449160 - RNA, 21 nt, Human
gaggccugaggaugagcugga

SEQ ID NO: 2449161 - RNA, 20 nt, Human
gaggccugaggaugagcugg

SEQ ID NO: 2449162 - RNA, 13 nt, Human
gaggccugaggau

SEQ ID NO: 2449163 - RNA, 20 nt, Human
gaggccugagcgcuccugcc

SEQ ID NO: 2449164 - RNA, 22 nt, Human
gaggccgcuagaggccugagga

SEQ ID NO: 2449165 - RNA, 20 nt, Human
gaggccgcuagaggccugag

SEQ ID NO: 2449166 - RNA, 15 nt, Human
gaggccgcuagaggc

SEQ ID NO: 2449167 - RNA, 16 nt, Human
gaggccggggccgggu

SEQ ID NO: 2449168 - RNA, 19 nt, Human
gaggccgggugcucagggc

SEQ ID NO: 2449169 - RNA, 20 nt, Human
gaggcccucgggcccagccc

SEQ ID NO: 2449170 - RNA, 19 nt, Human
gaggcccucgggcccagcc

SEQ ID NO: 2449171 - RNA, 18 nt, Human
gaggcccucgggcccagc

SEQ ID NO: 2449172 - RNA, 17 nt, Human
gaggcccucgggcccag

SEQ ID NO: 2449173 - RNA, 19 nt, Human
gaggcccucuggaguggcc

SEQ ID NO: 2449174 - RNA, 21 nt, Human
gaggcccucgggcccagcccc

SEQ ID NO: 2449175 - RNA, 17 nt, Human
gaggcccucuggagugg

SEQ ID NO: 2449176 - RNA, 16 nt, Human
gaggcccucgggccca

SEQ ID NO: 2449177 - RNA, 17 nt, Human
gaggcccucgcugccag

SEQ ID NO: 2449178 - RNA, 13 nt, Human
gaggcccggccuc

SEQ ID NO: 2449179 - RNA, 20 nt, Human
gaggcccgcaugcggcccag

SEQ ID NO: 2449180 - RNA, 22 nt, Human
gaggccccuauguaguccgugc

SEQ ID NO: 2449181 - RNA, 21 nt, Human
gaggcccccagcccagggcuc

SEQ ID NO: 2449182 - RNA, 17 nt, Human
gaggccaguaccuuucc

SEQ ID NO: 2449183 - RNA, 24 nt, Human
gaggccccuauguaguccgugcug

SEQ ID NO: 2449184 - RNA, 20 nt, Human
gaggccccuucuagguggca

SEQ ID NO: 2449185 - RNA, 19 nt, Human
gaggccccuucuagguggc

SEQ ID NO: 2449186 - RNA, 15 nt, Human
gaggccccuggccca

SEQ ID NO: 2449187 - RNA, 13 nt, Human
gaggccccuggac

SEQ ID NO: 2449188 - RNA, 20 nt, Human
gaggccccugucucagggug

SEQ ID NO: 2449189 - RNA, 20 nt, Human
gaggcccccagcccagggcu

SEQ ID NO: 2449190 - RNA, 19 nt, Human
gaggcccccagcccagggc

SEQ ID NO: 2449191 - RNA, 17 nt, Human
gaggcccccagcccagg

SEQ ID NO: 2449192 - RNA, 16 nt, Human
gaggcccccagcccag

SEQ ID NO: 2449193 - RNA, 14 nt, Human
gaggccaggugcag

SEQ ID NO: 2449194 - RNA, 19 nt, Human
gaggccagggcagagugag

SEQ ID NO: 2449195 - RNA, 15 nt, Human
gaggcccccagccca

SEQ ID NO: 2449196 - RNA, 16 nt, Human
gagggagggcuccaga

SEQ ID NO: 2449197 - RNA, 14 nt, Human
gagggagugacaga

SEQ ID NO: 2449198 - RNA, 14 nt, Human
gagggagguaagga

SEQ ID NO: 2449199 - RNA, 13 nt, Human
gagggagugacag

SEQ ID NO: 2449200 - RNA, 22 nt, Human
gagggcacagaaaauggaagac

SEQ ID NO: 2449201 - RNA, 14 nt, Human
gagggcacagaaaa

SEQ ID NO: 2449202 - RNA, 23 nt, Human
gagggcacagaaaauggaagaca

SEQ ID NO: 2449203 - RNA, 20 nt, Human
gagggcacauuccuugccug

SEQ ID NO: 2449204 - RNA, 23 nt, Human
gagggagguguuuaaagagaggu

SEQ ID NO: 2449205 - RNA, 18 nt, Human
gagggagguguuuaaaga

SEQ ID NO: 2449206 - RNA, 15 nt, Human
gagggagguguuuaa

SEQ ID NO: 2449207 - RNA, 12 nt, Human
gagggcacuggu

SEQ ID NO: 2449208 - RNA, 20 nt, Human
gaggggccuggcagccgugc

SEQ ID NO: 2449209 - RNA, 18 nt, Human
gaggggccuggcagccgu

SEQ ID NO: 2449210 - RNA, 14 nt, Human
gaggggccuggcag

SEQ ID NO: 2449211 - RNA, 13 nt, Human
gaggggccuggca

SEQ ID NO: 2449212 - RNA, 22 nt, Human
gaggggccucuuaugggcuggg

SEQ ID NO: 2449213 - RNA, 16 nt, Human
gagggcagaggcugga

SEQ ID NO: 2449214 - RNA, 22 nt, Human
gagggcagaaagguucugcccg

SEQ ID NO: 2449215 - RNA, 21 nt, Human
gagggcagaaagguucugccc

SEQ ID NO: 2449216 - RNA, 20 nt, Human
gagggcagaaagguucugcc

SEQ ID NO: 2449217 - RNA, 17 nt, Human
gagggcagaaagguucu

SEQ ID NO: 2449218 - RNA, 15 nt, Human
gagggcacuggagcu

SEQ ID NO: 2449219 - RNA, 23 nt, Human
gagggcacauuccuugccugcac

SEQ ID NO: 2449220 - RNA, 18 nt, Human
gagggcacugguggcccg

SEQ ID NO: 2449221 - RNA, 16 nt, Human
gagggcacugguggcc

SEQ ID NO: 2449222 - RNA, 22 nt, Human
gagggcagcagaaggggguggu

SEQ ID NO: 2449223 - RNA, 21 nt, Human
gagggcagcagaagggggugg

SEQ ID NO: 2449224 - RNA, 12 nt, Human
gaggggccucuu

SEQ ID NO: 2449225 - RNA, 19 nt, Human
gagggcagcagaagggggu

SEQ ID NO: 2449226 - RNA, 15 nt, Human
gagggcagaggcugg

SEQ ID NO: 2449227 - RNA, 23 nt, Human
gagggcagaaagguucugcccgg

SEQ ID NO: 2449228 - RNA, 14 nt, Human
gagggcagaggcug

SEQ ID NO: 2449229 - RNA, 20 nt, Human
gaggcuuuggauuugacauu

SEQ ID NO: 2449230 - RNA, 21 nt, Human
gagggaaagcccagaaaagga

SEQ ID NO: 2449231 - RNA, 14 nt, Human
gaggcuuuggauuu

SEQ ID NO: 2449232 - RNA, 16 nt, Human
gaggcuuuggauuuga

SEQ ID NO: 2449233 - RNA, 19 nt, Human
gaggcuugucagagcuggg

SEQ ID NO: 2449234 - RNA, 21 nt, Human
gaggcuugucagagcugggag

SEQ ID NO: 2449235 - RNA, 17 nt, Human
gaggcuugucagagcug

SEQ ID NO: 2449236 - RNA, 22 nt, Human
gaggcuugggaccgccagaugg

SEQ ID NO: 2449237 - RNA, 18 nt, Human
gaggcuugucagagcugg

SEQ ID NO: 2449238 - RNA, 18 nt, Human
gaggcuugggaccgccag

SEQ ID NO: 2449239 - RNA, 20 nt, Human
gaggcuugcugagaggggcu

SEQ ID NO: 2449240 - RNA, 15 nt, Human
gaggcuuggaaagca

SEQ ID NO: 2449241 - RNA, 22 nt, Human
gaggcuucuccgccagccuccu

SEQ ID NO: 2449242 - RNA, 21 nt, Human
gaggcuucuccgccagccucc

SEQ ID NO: 2449243 - RNA, 20 nt, Human
gaggcuucuccgccagccuc

SEQ ID NO: 2449244 - RNA, 19 nt, Human
gaggcuucuccgccagccu

SEQ ID NO: 2449245 - RNA, 23 nt, Human
gaggcuucuccgccagccuccuc

SEQ ID NO: 2449246 - RNA, 16 nt, Human
gaggcuucuucagauc

SEQ ID NO: 2449247 - RNA, 15 nt, Human
gaggcuugcugagag

SEQ ID NO: 2449248 - RNA, 22 nt, Human
gaggcuucuucagaucagugcu

SEQ ID NO: 2449249 - RNA, 17 nt, Human
gagggaccaacugggcc

SEQ ID NO: 2449250 - RNA, 18 nt, Human
gagggaccaacugggccc

SEQ ID NO: 2449251 - RNA, 19 nt, Human
gagggaccaacugggccca

SEQ ID NO: 2449252 - RNA, 16 nt, Human
gagggaaugaaccugg

SEQ ID NO: 2449253 - RNA, 21 nt, Human
gagggaauccccgaaggugcu

SEQ ID NO: 2449254 - RNA, 18 nt, Human
gagggaauugaggucugc

SEQ ID NO: 2449255 - RNA, 19 nt, Human
gagggaacagacaggagaa

SEQ ID NO: 2449256 - RNA, 15 nt, Human
gagggaacagacagg

SEQ ID NO: 2449257 - RNA, 18 nt, Human
gagggaacagacaggaga

SEQ ID NO: 2449258 - RNA, 15 nt, Human
gagggagggcuccag

SEQ ID NO: 2449259 - RNA, 15 nt, Human
gagggagggagggcu

SEQ ID NO: 2449260 - RNA, 17 nt, Human
gagggaggcaagcccug

SEQ ID NO: 2449261 - RNA, 14 nt, Human
gagggagggagggc

SEQ ID NO: 2449262 - RNA, 21 nt, Human
gagggacucugaagccucugg

SEQ ID NO: 2449263 - RNA, 20 nt, Human
gagggacucugaagccucug

SEQ ID NO: 2449264 - RNA, 19 nt, Human
gagggacucugaagccucu

SEQ ID NO: 2449265 - RNA, 18 nt, Human
gagggacucugaagccuc

SEQ ID NO: 2449266 - RNA, 23 nt, Human
gagggacucugaagccucuggga

SEQ ID NO: 2449267 - RNA, 22 nt, Human
gagggacucugaagccucuggg

SEQ ID NO: 2449268 - RNA, 16 nt, Human
gagggacgccuggggg

SEQ ID NO: 2449269 - RNA, 23 nt, Human
gagggacgccugggggugccagg

SEQ ID NO: 2449270 - RNA, 14 nt, Human
gagggacucugaag

SEQ ID NO: 2449271 - RNA, 12 nt, Human
gagggaccagcc

SEQ ID NO: 2449272 - RNA, 16 nt, Human
gagggaccagccaaga

SEQ ID NO: 2449273 - RNA, 13 nt, Human
gagggaccucucc

SEQ ID NO: 2449274 - RNA, 14 nt, Human
gagggaccucuccc

SEQ ID NO: 2449275 - RNA, 15 nt, Human
gagggaccucuccca

SEQ ID NO: 2449276 - RNA, 14 nt, Human
gagggacgccuggg

SEQ ID NO: 2449277 - RNA, 15 nt, Human
gagggacgccugggg

SEQ ID NO: 2449278 - RNA, 17 nt, Human
gagggaccucucccagg

SEQ ID NO: 2449279 - RNA, 18 nt, Human
gagggaccucucccaggg

SEQ ID NO: 2449280 - RNA, 13 nt, Human
gaggccagccuug

SEQ ID NO: 2449281 - RNA, 13 nt, Human
gaggccagggcag

SEQ ID NO: 2449282 - RNA, 15 nt, Human
gaggccagggcagag

SEQ ID NO: 2449283 - RNA, 12 nt, Human
gaggccaggagu

SEQ ID NO: 2449284 - RNA, 22 nt, Human
gaggccaggaguuugagaccag

SEQ ID NO: 2449285 - RNA, 12 nt, Human
gaggccagccuu

SEQ ID NO: 2449286 - RNA, 23 nt, Human
gaggcaggaggauugcuugagcc

SEQ ID NO: 2449287 - RNA, 22 nt, Human
gaggcagccccauucugccugc

SEQ ID NO: 2449288 - RNA, 23 nt, Human
gaggcagcgugaaagcagaugag

SEQ ID NO: 2449289 - RNA, 21 nt, Human
gaggcagcgugaaagcagaug

SEQ ID NO: 2449290 - RNA, 23 nt, Human
gaggcagccccauucugccugcc

SEQ ID NO: 2449291 - RNA, 13 nt, Human
gaggcagcagugu

SEQ ID NO: 2449292 - RNA, 20 nt, Human
gaggcagcagugugaggcca

SEQ ID NO: 2449293 - RNA, 21 nt, Human
gaggcagcagugugaggccag

SEQ ID NO: 2449294 - RNA, 22 nt, Human
gaggcagcagugugaggccagg

SEQ ID NO: 2449295 - RNA, 13 nt, Human
gaggcagccccau

SEQ ID NO: 2449296 - RNA, 12 nt, Human
gaggcagacagc

SEQ ID NO: 2449297 - RNA, 15 nt, Human
gaggcagacagcagc

SEQ ID NO: 2449298 - RNA, 16 nt, Human
gaggcagacagcagcu

SEQ ID NO: 2449299 - RNA, 19 nt, Human
gaggcagagguugcaguga

SEQ ID NO: 2449300 - RNA, 20 nt, Human
gaggcagaaaauugcacaau

SEQ ID NO: 2449301 - RNA, 16 nt, Human
gaggcagaaaauugca

SEQ ID NO: 2449302 - RNA, 18 nt, Human
gaggcacugaagugcuua

SEQ ID NO: 2449303 - RNA, 23 nt, Human
gaggcagaagaauugaacccagg

SEQ ID NO: 2449304 - RNA, 18 nt, Human
gaggauugcuugagccca

SEQ ID NO: 2449305 - RNA, 19 nt, Human
gaggauugcuugagcccag

SEQ ID NO: 2449306 - RNA, 22 nt, Human
gaggauugcuugagcccaggag

SEQ ID NO: 2449307 - RNA, 21 nt, Human
gaggcaaugucaggaacagaa

SEQ ID NO: 2449308 - RNA, 23 nt, Human
gaggcaaugucaggaacagaagg

SEQ ID NO: 2449309 - RNA, 24 nt, Human
gaggcacacagcugcagagacaga

SEQ ID NO: 2449310 - RNA, 20 nt, Human
gaggcacacagcugcagaga

SEQ ID NO: 2449311 - RNA, 14 nt, Human
gaggaugggcucgc

SEQ ID NO: 2449312 - RNA, 13 nt, Human
gaggaugggcucg

SEQ ID NO: 2449313 - RNA, 16 nt, Human
gaggauucuaugaggc

SEQ ID NO: 2449314 - RNA, 17 nt, Human
gaggauucuaugaggca

SEQ ID NO: 2449315 - RNA, 16 nt, Human
gaggauugcuugagcu

SEQ ID NO: 2449316 - RNA, 20 nt, Human
gaggauguucugggacacag

SEQ ID NO: 2449317 - RNA, 17 nt, Human
gaggauguucugggaca

SEQ ID NO: 2449318 - RNA, 20 nt, Human
gaggauggccucugcuaagc

SEQ ID NO: 2449319 - RNA, 15 nt, Human
gaggaugggaaggag

SEQ ID NO: 2449320 - RNA, 19 nt, Human
gaggaugggaaggagggag

SEQ ID NO: 2449321 - RNA, 17 nt, Human
gaggaucacuggagccc

SEQ ID NO: 2449322 - RNA, 20 nt, Human
gaggauggccagugucuguc

SEQ ID NO: 2449323 - RNA, 18 nt, Human
gaggauauauuuucacuu

SEQ ID NO: 2449324 - RNA, 20 nt, Human
gaggaguuucgagguagagu

SEQ ID NO: 2449325 - RNA, 23 nt, Human
gaggauaggaguucacuucaucu

SEQ ID NO: 2449326 - RNA, 19 nt, Human
gaggaucacagugcugaga

SEQ ID NO: 2449327 - RNA, 18 nt, Human
gaggaucacagugcugag

SEQ ID NO: 2449328 - RNA, 16 nt, Human
gaggaucacuggagcc

SEQ ID NO: 2449329 - RNA, 12 nt, Human
gaggauguucug

SEQ ID NO: 2449330 - RNA, 15 nt, Human
gaggaugucugggcc

SEQ ID NO: 2449331 - RNA, 20 nt, Human
gaggaugucacucagaugga

SEQ ID NO: 2449332 - RNA, 15 nt, Human
gaggaguacagguga

SEQ ID NO: 2449333 - RNA, 14 nt, Human
gaggagucuugugu

SEQ ID NO: 2449334 - RNA, 12 nt, Human
gaggaguucaau

SEQ ID NO: 2449335 - RNA, 11 nt, Human
gaggaguucaa

SEQ ID NO: 2449336 - RNA, 13 nt, Human
gaggagugaggaa

SEQ ID NO: 2449337 - RNA, 23 nt, Human
gaggaguuugggguaugggagag

SEQ ID NO: 2449338 - RNA, 17 nt, Human
gaggaguucaaugaucu

SEQ ID NO: 2449339 - RNA, 16 nt, Human
gaggaguucaaugauc

SEQ ID NO: 2449340 - RNA, 15 nt, Human
gaggaguucaaugau

SEQ ID NO: 2449341 - RNA, 14 nt, Human
gaggaguucaauga

SEQ ID NO: 2449342 - RNA, 19 nt, Human
gaggaguucaaugaucuag

SEQ ID NO: 2449343 - RNA, 18 nt, Human
gaggaguucaaugaucua

SEQ ID NO: 2449344 - RNA, 16 nt, Human
gaggaguuucgaggua

SEQ ID NO: 2449345 - RNA, 20 nt, Human
gaggagguggcagcccugua

SEQ ID NO: 2449346 - RNA, 22 nt, Human
gaggagguggcagcccuguagg

SEQ ID NO: 2449347 - RNA, 20 nt, Human
gaggagguuuggggucugcc

SEQ ID NO: 2449348 - RNA, 17 nt, Human
gaggagguuuaggucaa

SEQ ID NO: 2449349 - RNA, 18 nt, Human
gaggaggggccgcugcca

SEQ ID NO: 2449350 - RNA, 16 nt, Human
gaggaggggccgcugc

SEQ ID NO: 2449351 - RNA, 17 nt, Human
gaggaggggccgcugcc

SEQ ID NO: 2449352 - RNA, 17 nt, Human
gaggagggcggggggca

SEQ ID NO: 2449353 - RNA, 15 nt, Human
gaggagguggcagcc

SEQ ID NO: 2449354 - RNA, 18 nt, Human
gaggagguggcagcccug

SEQ ID NO: 2449355 - RNA, 19 nt, Human
gaggagguaaugaauuaaa

SEQ ID NO: 2449356 - RNA, 22 nt, Human
gaggaauuuucuuuguguagcu

SEQ ID NO: 2449357 - RNA, 14 nt, Human
gaggaauuucaccu

SEQ ID NO: 2449358 - RNA, 15 nt, Human
gaggacaaccauucc

SEQ ID NO: 2449359 - RNA, 20 nt, Human
gaggacaauucaugaacuuc

SEQ ID NO: 2449360 - RNA, 19 nt, Human
gaggacaauucaugaacuu

SEQ ID NO: 2449361 - RNA, 12 nt, Human
gaggacaauuca

SEQ ID NO: 2449362 - RNA, 14 nt, Human
gaggaauguauaug

SEQ ID NO: 2449363 - RNA, 13 nt, Human
gaggaauguauau

SEQ ID NO: 2449364 - RNA, 15 nt, Human
gaggaaugcuccccc

SEQ ID NO: 2449365 - RNA, 14 nt, Human
gaggaauggacaga

SEQ ID NO: 2449366 - RNA, 21 nt, Human
gaggaaugcucccccauccuc

SEQ ID NO: 2449367 - RNA, 17 nt, Human
gaggaaugaugaagcuu

SEQ ID NO: 2449368 - RNA, 13 nt, Human
gaggaaugcuccc

SEQ ID NO: 2449369 - RNA, 15 nt, Human
gaggaauccagaccc

SEQ ID NO: 2449370 - RNA, 20 nt, Human
gaggaaucgaggaaccagag

SEQ ID NO: 2449371 - RNA, 14 nt, Human
gaggaauccagacc

SEQ ID NO: 2449372 - RNA, 22 nt, Human
gaggaaucaugucaggccugug

SEQ ID NO: 2449373 - RNA, 21 nt, Human
gaggaaucaugucaggccugu

SEQ ID NO: 2449374 - RNA, 20 nt, Human
gaggaaucaugucaggccug

SEQ ID NO: 2449375 - RNA, 22 nt, Human
gaggaaucacucuuguggaugu

SEQ ID NO: 2449376 - RNA, 13 nt, Human
gaggaauaucaau

SEQ ID NO: 2449377 - RNA, 21 nt, Human
gaggaauaauuauuuauuuaa

SEQ ID NO: 2449378 - RNA, 23 nt, Human
gaggaauaugacggaagaacaua

SEQ ID NO: 2449379 - RNA, 19 nt, Human
gaggaaucacucuugugga

SEQ ID NO: 2449380 - RNA, 13 nt, Human
gaggaaggcaaga

SEQ ID NO: 2449381 - RNA, 16 nt, Human
gaggaaggauuguaaa

SEQ ID NO: 2449382 - RNA, 15 nt, Human
gaggaaggauuguaa

SEQ ID NO: 2449383 - RNA, 14 nt, Human
gaggaaggauugua

SEQ ID NO: 2449384 - RNA, 16 nt, Human
gaggaaggcaggaaga

SEQ ID NO: 2449385 - RNA, 21 nt, Human
gaggaaggcaagagggggugg

SEQ ID NO: 2449386 - RNA, 19 nt, Human
gaggaaggggccagaggcu

SEQ ID NO: 2449387 - RNA, 17 nt, Human
gaggaauaauuauuuau

SEQ ID NO: 2449388 - RNA, 19 nt, Human
gaggaauaguugagcccca

SEQ ID NO: 2449389 - RNA, 18 nt, Human
gaggaauaauuauuuauu

SEQ ID NO: 2449390 - RNA, 16 nt, Human
gaggaaggagagaagg

SEQ ID NO: 2449391 - RNA, 14 nt, Human
gaggaaggagagaa

SEQ ID NO: 2449392 - RNA, 22 nt, Human
gaggaaggaaacccagcucugg

SEQ ID NO: 2449393 - RNA, 21 nt, Human
gagcuucuguugcugccucau

SEQ ID NO: 2449394 - RNA, 22 nt, Human
gagcuucuuccaggugcccagc

SEQ ID NO: 2449395 - RNA, 15 nt, Human
gaggagccccagcua

SEQ ID NO: 2449396 - RNA, 14 nt, Human
gaggagccccagcu

SEQ ID NO: 2449397 - RNA, 18 nt, Human
gaggacagcuugagccgg

SEQ ID NO: 2449398 - RNA, 15 nt, Human
gaggacagcuugagc

SEQ ID NO: 2449399 - RNA, 14 nt, Human
gaggacagcugucc

SEQ ID NO: 2449400 - RNA, 17 nt, Human
gaggagcagugcaggca

SEQ ID NO: 2449401 - RNA, 23 nt, Human
gaggacagggaggugaccccagg

SEQ ID NO: 2449402 - RNA, 22 nt, Human
gaggacagggaggugaccccag

SEQ ID NO: 2449403 - RNA, 13 nt, Human
gaggacagcuguc

SEQ ID NO: 2449404 - RNA, 21 nt, Human
gaggacaauucaugaacuucg

SEQ ID NO: 2449405 - RNA, 13 nt, Human
gaggacagggagg

SEQ ID NO: 2449406 - RNA, 20 nt, Human
gaggaggccaccucuccaag

SEQ ID NO: 2449407 - RNA, 19 nt, Human
gaggaggccaccucuccaa

SEQ ID NO: 2449408 - RNA, 18 nt, Human
gaggaggccaccucucca

SEQ ID NO: 2449409 - RNA, 16 nt, Human
gaggaggccaccucuc

SEQ ID NO: 2449410 - RNA, 15 nt, Human
gaggaggccaccucu

SEQ ID NO: 2449411 - RNA, 14 nt, Human
gaggaggccaccuc

SEQ ID NO: 2449412 - RNA, 12 nt, Human
gaggaggccacc

SEQ ID NO: 2449413 - RNA, 17 nt, Human
gaggagggagagggagg

SEQ ID NO: 2449414 - RNA, 11 nt, Human
gaggagggaga

SEQ ID NO: 2449415 - RNA, 18 nt, Human
gaggaggcuccagagggc

SEQ ID NO: 2449416 - RNA, 21 nt, Human
gaggaggccugggggcaggga

SEQ ID NO: 2449417 - RNA, 13 nt, Human
gaggaggccucca

SEQ ID NO: 2449418 - RNA, 19 nt, Human
gaggagggaugcugccuga

SEQ ID NO: 2449419 - RNA, 20 nt, Human
gaggagggcgugacucaccc

SEQ ID NO: 2449420 - RNA, 15 nt, Human
gaggagcuuggggga

SEQ ID NO: 2449421 - RNA, 21 nt, Human
gaggagcuugggggaugacua

SEQ ID NO: 2449422 - RNA, 13 nt, Human
gaggaggaaggca

SEQ ID NO: 2449423 - RNA, 19 nt, Human
gaggaggaaggagagaagg

SEQ ID NO: 2449424 - RNA, 14 nt, Human
gaggaggaggaggu

SEQ ID NO: 2449425 - RNA, 16 nt, Human
gaggaggaaggcaaga

SEQ ID NO: 2449426 - RNA, 18 nt, Human
gaggaggcaauugggaug

SEQ ID NO: 2449427 - RNA, 11 nt, Human
gaggagcugcu

SEQ ID NO: 2449428 - RNA, 12 nt, Human
gaggagcugcug

SEQ ID NO: 2449429 - RNA, 13 nt, Human
gaggagcugcugg

SEQ ID NO: 2449430 - RNA, 15 nt, Human
gaggagcugcuggcu

SEQ ID NO: 2449431 - RNA, 18 nt, Human
gaggagcucaggacacua

SEQ ID NO: 2449432 - RNA, 18 nt, Human
gagcagccacauuccuga

SEQ ID NO: 2449433 - RNA, 21 nt, Human
gagcagacaggaggaaucaug

SEQ ID NO: 2449434 - RNA, 15 nt, Human
gagcagacaggagga

SEQ ID NO: 2449435 - RNA, 22 nt, Human
gagcagaccaccccgccugccc

SEQ ID NO: 2449436 - RNA, 11 nt, Human
gagcagagucu

SEQ ID NO: 2449437 - RNA, 20 nt, Human
gagcagagucuugcuaccuc

SEQ ID NO: 2449438 - RNA, 16 nt, Human
gagcagaggggcugaa

SEQ ID NO: 2449439 - RNA, 18 nt, Human
gagcagaugcagagagcc

SEQ ID NO: 2449440 - RNA, 16 nt, Human
gagcagaugcagagag

SEQ ID NO: 2449441 - RNA, 14 nt, Human
gagcagaugcagag

SEQ ID NO: 2449442 - RNA, 21 nt, Human
gagcagaugcagagagccauu

SEQ ID NO: 2449443 - RNA, 19 nt, Human
gagcagaugcagagagcca

SEQ ID NO: 2449444 - RNA, 19 nt, Human
gagcacuuaagagaauauu

SEQ ID NO: 2449445 - RNA, 18 nt, Human
gagcacuuaagagaauau

SEQ ID NO: 2449446 - RNA, 14 nt, Human
gagcacuugcugua

SEQ ID NO: 2449447 - RNA, 23 nt, Human
gagcagaacggagccccaggccu

SEQ ID NO: 2449448 - RNA, 17 nt, Human
gagcagaaguggagcug

SEQ ID NO: 2449449 - RNA, 14 nt, Human
gagcagacaggagg

SEQ ID NO: 2449450 - RNA, 15 nt, Human
gagcacuuaagagaa

SEQ ID NO: 2449451 - RNA, 16 nt, Human
gagcacuuaagagaau

SEQ ID NO: 2449452 - RNA, 17 nt, Human
gagcacuggguugacuu

SEQ ID NO: 2449453 - RNA, 12 nt, Human
gagcaccugcuu

SEQ ID NO: 2449454 - RNA, 14 nt, Human
gagcacuggagugc

SEQ ID NO: 2449455 - RNA, 20 nt, Human
gagcacuggagugcagggag

SEQ ID NO: 2449456 - RNA, 23 nt, Human
gagcaccugcuucaugcucagcc

SEQ ID NO: 2449457 - RNA, 13 nt, Human
gagcacuggguug

SEQ ID NO: 2449458 - RNA, 18 nt, Human
gagcaggagauugagaag

SEQ ID NO: 2449459 - RNA, 19 nt, Human
gagcaggacucuauuuuaa

SEQ ID NO: 2449460 - RNA, 17 nt, Human
gagcagcagugaaaaca

SEQ ID NO: 2449461 - RNA, 16 nt, Human
gagcagcagugaaaac

SEQ ID NO: 2449462 - RNA, 16 nt, Human
gagcaggaggccccug

SEQ ID NO: 2449463 - RNA, 23 nt, Human
gagcaggagauugagaaggagag

SEQ ID NO: 2449464 - RNA, 22 nt, Human
gagcaggagauugagaaggaga

SEQ ID NO: 2449465 - RNA, 20 nt, Human
gagcaggagauugagaagga

SEQ ID NO: 2449466 - RNA, 21 nt, Human
gagcaggaggccccuggccca

SEQ ID NO: 2449467 - RNA, 17 nt, Human
gagcaggaggccccugg

SEQ ID NO: 2449468 - RNA, 15 nt, Human
gagcaggcacaugga

SEQ ID NO: 2449469 - RNA, 21 nt, Human
gagcaggcuacugucagcucc

SEQ ID NO: 2449470 - RNA, 19 nt, Human
gagcaggccuugcgcuguu

SEQ ID NO: 2449471 - RNA, 19 nt, Human
gagcaggcacauggaggag

SEQ ID NO: 2449472 - RNA, 14 nt, Human
gagccaccgugccu

SEQ ID NO: 2449473 - RNA, 18 nt, Human
gagccaccgcgcccagcc

SEQ ID NO: 2449474 - RNA, 14 nt, Human
gagccaccaugccc

SEQ ID NO: 2449475 - RNA, 22 nt, Human
gagcaggcggugggcacccacc

SEQ ID NO: 2449476 - RNA, 18 nt, Human
gagcaggcggugggcacc

SEQ ID NO: 2449477 - RNA, 20 nt, Human
gagccaccgugccuggccac

SEQ ID NO: 2449478 - RNA, 14 nt, Human
gagccacuaacuag

SEQ ID NO: 2449479 - RNA, 12 nt, Human
gagcccaggccu

SEQ ID NO: 2449480 - RNA, 16 nt, Human
gagcccacgcccccac

SEQ ID NO: 2449481 - RNA, 15 nt, Human
gagcccacgccccca

SEQ ID NO: 2449482 - RNA, 12 nt, Human
gagcccacgccc

SEQ ID NO: 2449483 - RNA, 15 nt, Human
gagcccaggcgggag

SEQ ID NO: 2449484 - RNA, 13 nt, Human
gagcccaggcggg

SEQ ID NO: 2449485 - RNA, 21 nt, Human
gagccauuuugugaauggauu

SEQ ID NO: 2449486 - RNA, 16 nt, Human
gagccauuuugugaau

SEQ ID NO: 2449487 - RNA, 14 nt, Human
gagcccaggccucc

SEQ ID NO: 2449488 - RNA, 13 nt, Human
gagcccaggccuc

SEQ ID NO: 2449489 - RNA, 22 nt, Human
gagccacugcaccgggccacag

SEQ ID NO: 2449490 - RNA, 14 nt, Human
gagccacuccucug

SEQ ID NO: 2449491 - RNA, 15 nt, Human
gagccacuccucuga

SEQ ID NO: 2449492 - RNA, 21 nt, Human
gagccagaaccuggagggcua

SEQ ID NO: 2449493 - RNA, 16 nt, Human
gagccagaaccuggag

SEQ ID NO: 2449494 - RNA, 19 nt, Human
gagccaccaugcccagcuc

SEQ ID NO: 2449495 - RNA, 18 nt, Human
gagccagagaagugacag

SEQ ID NO: 2449496 - RNA, 17 nt, Human
gagccagagaagugaca

SEQ ID NO: 2449497 - RNA, 16 nt, Human
gagccagagaagugac

SEQ ID NO: 2449498 - RNA, 15 nt, Human
gagccagagaaguga

SEQ ID NO: 2449499 - RNA, 14 nt, Human
gagccagagaagug

SEQ ID NO: 2449500 - RNA, 13 nt, Human
gagccagagaagu

SEQ ID NO: 2449501 - RNA, 12 nt, Human
gagccagagaag

SEQ ID NO: 2449502 - RNA, 23 nt, Human
gagccagacucuggucuucuuug

SEQ ID NO: 2449503 - RNA, 23 nt, Human
gagccauauaaguuugaaggaaa

SEQ ID NO: 2449504 - RNA, 20 nt, Human
gagccagagaagugacaggg

SEQ ID NO: 2449505 - RNA, 19 nt, Human
gagccagagaagugacagg

SEQ ID NO: 2449506 - RNA, 22 nt, Human
gagccagagaagugacagggaa

SEQ ID NO: 2449507 - RNA, 22 nt, Human
gagccaucggugaaacuaacag

SEQ ID NO: 2449508 - RNA, 14 nt, Human
gagccauuuuguga

SEQ ID NO: 2449509 - RNA, 23 nt, Human
gagccauuuuggggggccccccu

SEQ ID NO: 2449510 - RNA, 21 nt, Human
gagccauuuuggggggccccc

SEQ ID NO: 2449511 - RNA, 11 nt, Human
gagcccacgcc

SEQ ID NO: 2449512 - RNA, 21 nt, Human
gagccauguagaagcugcauc

SEQ ID NO: 2449513 - RNA, 14 nt, Human
gagccaugcuggga

SEQ ID NO: 2449514 - RNA, 22 nt, Human
gagccaugauguggaguggggc

SEQ ID NO: 2449515 - RNA, 17 nt, Human
gagccaugcgcccccuc

SEQ ID NO: 2449516 - RNA, 22 nt, Human
gagccauggaccacgcaggaag

SEQ ID NO: 2449517 - RNA, 20 nt, Human
gagaucaaccccuucgcucc

SEQ ID NO: 2449518 - RNA, 17 nt, Human
gagauauuuuaaaauga

SEQ ID NO: 2449519 - RNA, 11 nt, Human
gagauauuuac

SEQ ID NO: 2449520 - RNA, 22 nt, Human
gagauauuuacaugaauugcau

SEQ ID NO: 2449521 - RNA, 22 nt, Human
gagauauuuauggggggagaac

SEQ ID NO: 2449522 - RNA, 14 nt, Human
gaaugcuguacauc

SEQ ID NO: 2449523 - RNA, 15 nt, Human
gaaugcuguacaucu

SEQ ID NO: 2449524 - RNA, 17 nt, Human
gaaugcuguacaucuau

SEQ ID NO: 2449525 - RNA, 20 nt, Human
gaaugcuguacaucuauuuu

SEQ ID NO: 2449526 - RNA, 16 nt, Human
gagauauggcagcgaa

SEQ ID NO: 2449527 - RNA, 17 nt, Human
gagauauggcagcgaaa

SEQ ID NO: 2449528 - RNA, 16 nt, Human
gagauaugcagaagga

SEQ ID NO: 2449529 - RNA, 22 nt, Human
gagauaucugagggaggaggcc

SEQ ID NO: 2449530 - RNA, 21 nt, Human
gagauaucugagggaggaggc

SEQ ID NO: 2449531 - RNA, 22 nt, Human
gaaugcugguuuuccuaaaugc

SEQ ID NO: 2449532 - RNA, 21 nt, Human
gaaugcugcccgcucugcaga

SEQ ID NO: 2449533 - RNA, 15 nt, Human
gaaugcugaaaccaa

SEQ ID NO: 2449534 - RNA, 13 nt, Human
gaaugcugaaacc

SEQ ID NO: 2449535 - RNA, 21 nt, Human
gaaugcugcaggacuugagaa

SEQ ID NO: 2449536 - RNA, 21 nt, Human
gaaugcggccgcauucccuga

SEQ ID NO: 2449537 - RNA, 11 nt, Human
gaaugcucccc

SEQ ID NO: 2449538 - RNA, 13 nt, Human
gaaugcuccccca

SEQ ID NO: 2449539 - RNA, 19 nt, Human
gaaugcucccccauccucc

SEQ ID NO: 2449540 - RNA, 20 nt, Human
gaaugcucccccauccuccc

SEQ ID NO: 2449541 - RNA, 21 nt, Human
gaaugcucccccauccucccc

SEQ ID NO: 2449542 - RNA, 22 nt, Human
gaaugcucccccauccuccccu

SEQ ID NO: 2449543 - RNA, 23 nt, Human
gaaugcucccccauccuccccuu

SEQ ID NO: 2449544 - RNA, 17 nt, Human
gaaugcugggacucagc

SEQ ID NO: 2449545 - RNA, 16 nt, Human
gaaugcugggacucag

SEQ ID NO: 2449546 - RNA, 14 nt, Human
gaaugcugggacuc

SEQ ID NO: 2449547 - RNA, 13 nt, Human
gaaugcugggacu

SEQ ID NO: 2449548 - RNA, 19 nt, Human
gaaugcugggacucagccu

SEQ ID NO: 2449549 - RNA, 18 nt, Human
gaaugcugggacucagcc

SEQ ID NO: 2449550 - RNA, 13 nt, Human
gaaugcuguacau

SEQ ID NO: 2449551 - RNA, 17 nt, Human
gaaugcugguuuuccua

SEQ ID NO: 2449552 - RNA, 18 nt, Human
gaaugcugguuuuccuaa

SEQ ID NO: 2449553 - RNA, 21 nt, Human
gagaucgugccguuacucucc

SEQ ID NO: 2449554 - RNA, 22 nt, Human
gagaucgugccguuacucucca

SEQ ID NO: 2449555 - RNA, 19 nt, Human
gagaucuaagccuuuccau

SEQ ID NO: 2449556 - RNA, 20 nt, Human
gagaucuaagccuuuccaua

SEQ ID NO: 2449557 - RNA, 23 nt, Human
gagaucuaaggaugucacagggc

SEQ ID NO: 2449558 - RNA, 21 nt, Human
gagaucuaagccuuuccauaa

SEQ ID NO: 2449559 - RNA, 20 nt, Human
gagaucgcgccacugcacuc

SEQ ID NO: 2449560 - RNA, 14 nt, Human
gagauccuccugca

SEQ ID NO: 2449561 - RNA, 13 nt, Human
gagauccuccugc

SEQ ID NO: 2449562 - RNA, 23 nt, Human
gagauccuccugcagaccacgcc

SEQ ID NO: 2449563 - RNA, 17 nt, Human
gagauccuccugcagac

SEQ ID NO: 2449564 - RNA, 13 nt, Human
gagaucagccugg

SEQ ID NO: 2449565 - RNA, 18 nt, Human
gagaucaaauggaaagga

SEQ ID NO: 2449566 - RNA, 17 nt, Human
gagaucaaauggaaagg

SEQ ID NO: 2449567 - RNA, 23 nt, Human
gagaucaaauggaaaggagagga

SEQ ID NO: 2449568 - RNA, 14 nt, Human
gagaucagccuggg

SEQ ID NO: 2449569 - RNA, 16 nt, Human
gagaucagccugggca

SEQ ID NO: 2449570 - RNA, 23 nt, Human
gagcaagacgcugugcugcccug

SEQ ID NO: 2449571 - RNA, 22 nt, Human
gagcaagacgcugugcugcccu

SEQ ID NO: 2449572 - RNA, 18 nt, Human
gagcaagacgcugugcug

SEQ ID NO: 2449573 - RNA, 21 nt, Human
gagcaagacgcugugcugccc

SEQ ID NO: 2449574 - RNA, 18 nt, Human
gagcaaagaucaaaauaa

SEQ ID NO: 2449575 - RNA, 14 nt, Human
gagcaaagaucaaa

SEQ ID NO: 2449576 - RNA, 22 nt, Human
gagcaaagaucaaaauaaaaag

SEQ ID NO: 2449577 - RNA, 13 nt, Human
gagcaaagcugau

SEQ ID NO: 2449578 - RNA, 13 nt, Human
gagcaaagaucaa

SEQ ID NO: 2449579 - RNA, 15 nt, Human
gagcaaacucugcug

SEQ ID NO: 2449580 - RNA, 12 nt, Human
gagcaaaauaau

SEQ ID NO: 2449581 - RNA, 21 nt, Human
gagaugaaaucuuacagcugg

SEQ ID NO: 2449582 - RNA, 16 nt, Human
gagaucugguuuugcu

SEQ ID NO: 2449583 - RNA, 19 nt, Human
gagcaaaaucgaugcagug

SEQ ID NO: 2449584 - RNA, 17 nt, Human
gagcaccuuagacaguc

SEQ ID NO: 2449585 - RNA, 21 nt, Human
gagcaccccucucugcaucug

SEQ ID NO: 2449586 - RNA, 19 nt, Human
gagcaccuuagacaguccc

SEQ ID NO: 2449587 - RNA, 14 nt, Human
gagcaccuccacau

SEQ ID NO: 2449588 - RNA, 19 nt, Human
gagcaccuccacauccucc

SEQ ID NO: 2449589 - RNA, 17 nt, Human
gagcaccccucucugca

SEQ ID NO: 2449590 - RNA, 16 nt, Human
gagcaccccucucugc

SEQ ID NO: 2449591 - RNA, 13 nt, Human
gagcaccagggga

SEQ ID NO: 2449592 - RNA, 13 nt, Human
gagcacaggcagc

SEQ ID NO: 2449593 - RNA, 20 nt, Human
gagcacagcccucccgcccc

SEQ ID NO: 2449594 - RNA, 18 nt, Human
gagcacagcccucccgcc

SEQ ID NO: 2449595 - RNA, 15 nt, Human
gagcacagcccuccc

SEQ ID NO: 2449596 - RNA, 14 nt, Human
gagcacagcccucc

SEQ ID NO: 2449597 - RNA, 13 nt, Human
gagcacagcccuc

SEQ ID NO: 2449598 - RNA, 12 nt, Human
gagcacagcccu

SEQ ID NO: 2449599 - RNA, 17 nt, Human
gagcacagaucuguuuc

SEQ ID NO: 2449600 - RNA, 15 nt, Human
gagcacaggcagcug

SEQ ID NO: 2449601 - RNA, 14 nt, Human
gagcacaggcagcu

SEQ ID NO: 2449602 - RNA, 13 nt, Human
gagcaccaggcac

SEQ ID NO: 2449603 - RNA, 15 nt, Human
gagcaccaggcacga

SEQ ID NO: 2449604 - RNA, 23 nt, Human
gagcaccaggcacgaacccaccu

SEQ ID NO: 2449605 - RNA, 20 nt, Human
gagcacacuuuaguggccga

SEQ ID NO: 2449606 - RNA, 18 nt, Human
gagcacacuuggcccaag

SEQ ID NO: 2449607 - RNA, 15 nt, Human
gagcacacuguagca

SEQ ID NO: 2449608 - RNA, 13 nt, Human
gagcacacuguag

SEQ ID NO: 2449609 - RNA, 14 nt, Human
gagcuacaaaugca

SEQ ID NO: 2449610 - RNA, 23 nt, Human
gagcuacacaggggaaaagagga

SEQ ID NO: 2449611 - RNA, 19 nt, Human
gagcuaaauuacaauuguc

SEQ ID NO: 2449612 - RNA, 21 nt, Human
gagcuaaauuacaauugucau

SEQ ID NO: 2449613 - RNA, 19 nt, Human
gagcuaacacuggccccua

SEQ ID NO: 2449614 - RNA, 14 nt, Human
gagcuaacacuggc

SEQ ID NO: 2449615 - RNA, 15 nt, Human
gagcuaacacuggcc

SEQ ID NO: 2449616 - RNA, 20 nt, Human
gagcuacuugggccauagcu

SEQ ID NO: 2449617 - RNA, 14 nt, Human
gagcucaggacacu

SEQ ID NO: 2449618 - RNA, 17 nt, Human
gagcucaggacacuaau

SEQ ID NO: 2449619 - RNA, 17 nt, Human
gagcuacgccugccucc

SEQ ID NO: 2449620 - RNA, 23 nt, Human
gagcuacgccugccuccccugug

SEQ ID NO: 2449621 - RNA, 18 nt, Human
gagcuacccgcagaguuc

SEQ ID NO: 2449622 - RNA, 13 nt, Human
gagcucuccagcu

SEQ ID NO: 2449623 - RNA, 19 nt, Human
gagcucuaugggcagaucu

SEQ ID NO: 2449624 - RNA, 22 nt, Human
gagcuccucugggcaggaccuc

SEQ ID NO: 2449625 - RNA, 19 nt, Human
gagcuccucuccuggagga

SEQ ID NO: 2449626 - RNA, 18 nt, Human
gagcuccucuccuggagg

SEQ ID NO: 2449627 - RNA, 17 nt, Human
gagcuccucuccuggag

SEQ ID NO: 2449628 - RNA, 16 nt, Human
gagcuccucuccugga

SEQ ID NO: 2449629 - RNA, 14 nt, Human
gagcuccucugggc

SEQ ID NO: 2449630 - RNA, 15 nt, Human
gagcuccucugggca

SEQ ID NO: 2449631 - RNA, 16 nt, Human
gagcuccucugggcag

SEQ ID NO: 2449632 - RNA, 18 nt, Human
gagcuccucugggcagga

SEQ ID NO: 2449633 - RNA, 18 nt, Human
gagcuccacucugcuucu

SEQ ID NO: 2449634 - RNA, 16 nt, Human
gagcuccacucugcuu

SEQ ID NO: 2449635 - RNA, 13 nt, Human
gagcuccacucug

SEQ ID NO: 2449636 - RNA, 12 nt, Human
gagcuccacucu

SEQ ID NO: 2449637 - RNA, 19 nt, Human
gagcucccggcguggugga

SEQ ID NO: 2449638 - RNA, 15 nt, Human
gagcuccucuccugg

SEQ ID NO: 2449639 - RNA, 20 nt, Human
gagcuccccaccaccccagc

SEQ ID NO: 2449640 - RNA, 22 nt, Human
gagcuccccaccaccccagcug

SEQ ID NO: 2449641 - RNA, 21 nt, Human
gagcuccacucugcuucucug

SEQ ID NO: 2449642 - RNA, 19 nt, Human
gagcuccccaccaccccag

SEQ ID NO: 2449643 - RNA, 15 nt, Human
gagcucugcagccca

SEQ ID NO: 2449644 - RNA, 16 nt, Human
gagcucugcagagcag

SEQ ID NO: 2449645 - RNA, 16 nt, Human
gagcucuucaggccuc

SEQ ID NO: 2449646 - RNA, 17 nt, Human
gagcucuucaggccucc

SEQ ID NO: 2449647 - RNA, 19 nt, Human
gagcucuucaggccucccu

SEQ ID NO: 2449648 - RNA, 13 nt, Human
gagcugccaccug

SEQ ID NO: 2449649 - RNA, 22 nt, Human
gagcucuucaggccucccucuc

SEQ ID NO: 2449650 - RNA, 16 nt, Human
gagcugccaccugccu

SEQ ID NO: 2449651 - RNA, 15 nt, Human
gagcugccaccugcc

SEQ ID NO: 2449652 - RNA, 11 nt, Human
gagcugcccuc

SEQ ID NO: 2449653 - RNA, 20 nt, Human
gagcugccauccagggaugc

SEQ ID NO: 2449654 - RNA, 21 nt, Human
gagcugcccagaguugcuggg

SEQ ID NO: 2449655 - RNA, 19 nt, Human
gagcuguuuauggccucag

SEQ ID NO: 2449656 - RNA, 23 nt, Human
gagcugcccuccuuguccaccca

SEQ ID NO: 2449657 - RNA, 21 nt, Human
gagcugcccuccuuguccacc

SEQ ID NO: 2449658 - RNA, 15 nt, Human
gagcugcccuccuug

SEQ ID NO: 2449659 - RNA, 15 nt, Human
gagcuuaacagugug

SEQ ID NO: 2449660 - RNA, 20 nt, Human
gagcuguuuauggccucagc

SEQ ID NO: 2449661 - RNA, 22 nt, Human
gagcuguuuauggccucagcug

SEQ ID NO: 2449662 - RNA, 18 nt, Human
gagcuucuguugcugccu

SEQ ID NO: 2449663 - RNA, 14 nt, Human
gagcuucuggcacu

SEQ ID NO: 2449664 - RNA, 16 nt, Human
gagcuucucugugaac

SEQ ID NO: 2449665 - RNA, 14 nt, Human
gagcuucucuguga

SEQ ID NO: 2449666 - RNA, 10 nt, Human
gagcuucucu

SEQ ID NO: 2449667 - RNA, 17 nt, Human
gagcuuagccaaugugg

SEQ ID NO: 2449668 - RNA, 16 nt, Human
gagcuucauggcagaa

SEQ ID NO: 2449669 - RNA, 18 nt, Human
gagcuuagugaaauuacu

SEQ ID NO: 2449670 - RNA, 19 nt, Human
gagcuucauggcagaaggc

SEQ ID NO: 2449671 - RNA, 13 nt, Human
gagcuucccugac

SEQ ID NO: 2449672 - RNA, 17 nt, Human
gagcuucccugacucau

SEQ ID NO: 2449673 - RNA, 21 nt, Human
gagccugcaaacucacugcuc

SEQ ID NO: 2449674 - RNA, 19 nt, Human
gagccuccugcccaguccc

SEQ ID NO: 2449675 - RNA, 18 nt, Human
gagccuccugcccagucc

SEQ ID NO: 2449676 - RNA, 17 nt, Human
gagccuccugcccaguc

SEQ ID NO: 2449677 - RNA, 22 nt, Human
gagccuccugcccuuaccugcc

SEQ ID NO: 2449678 - RNA, 20 nt, Human
gagccuccugcccuuaccug

SEQ ID NO: 2449679 - RNA, 15 nt, Human
gagccugcagggugg

SEQ ID NO: 2449680 - RNA, 15 nt, Human
gagccugcagagcug

SEQ ID NO: 2449681 - RNA, 12 nt, Human
gagccugcagag

SEQ ID NO: 2449682 - RNA, 13 nt, Human
gagccugcuggca

SEQ ID NO: 2449683 - RNA, 11 nt, Human
gagccugcugg

SEQ ID NO: 2449684 - RNA, 12 nt, Human
gagccugcuggc

SEQ ID NO: 2449685 - RNA, 17 nt, Human
gagccugcucccccacc

SEQ ID NO: 2449686 - RNA, 18 nt, Human
gagccugcucccccaccc

SEQ ID NO: 2449687 - RNA, 10 nt, Human
gagccugcug

SEQ ID NO: 2449688 - RNA, 19 nt, Human
gagccugcucccccacccc

SEQ ID NO: 2449689 - RNA, 23 nt, Human
gagccugcaggguggugcuggga

SEQ ID NO: 2449690 - RNA, 22 nt, Human
gagccugcaggguggugcuggg

SEQ ID NO: 2449691 - RNA, 20 nt, Human
gagccugcaggguggugcug

SEQ ID NO: 2449692 - RNA, 16 nt, Human
gagccugcaggguggu

SEQ ID NO: 2449693 - RNA, 16 nt, Human
gagccugccuggagcg

SEQ ID NO: 2449694 - RNA, 19 nt, Human
gagccugcggccugcugga

SEQ ID NO: 2449695 - RNA, 13 nt, Human
gagccugcucccc

SEQ ID NO: 2449696 - RNA, 17 nt, Human
gagcccugguggcagug

SEQ ID NO: 2449697 - RNA, 19 nt, Human
gagccucagcauccuggca

SEQ ID NO: 2449698 - RNA, 16 nt, Human
gagcccugguggcagu

SEQ ID NO: 2449699 - RNA, 15 nt, Human
gagcccugguggcag

SEQ ID NO: 2449700 - RNA, 15 nt, Human
gagccuccugcccag

SEQ ID NO: 2449701 - RNA, 14 nt, Human
gagccuccugccca

SEQ ID NO: 2449702 - RNA, 14 nt, Human
gagccuccugcccu

SEQ ID NO: 2449703 - RNA, 21 nt, Human
gagccucagcauccuggcacc

SEQ ID NO: 2449704 - RNA, 20 nt, Human
gagccucagcauccuggcac

SEQ ID NO: 2449705 - RNA, 13 nt, Human
gagccugggaggu

SEQ ID NO: 2449706 - RNA, 21 nt, Human
gagccugggaggucaaggcug

SEQ ID NO: 2449707 - RNA, 12 nt, Human
gagccuggugcc

SEQ ID NO: 2449708 - RNA, 16 nt, Human
gagccuggugcugcug

SEQ ID NO: 2449709 - RNA, 17 nt, Human
gagccuggugcugcugc

SEQ ID NO: 2449710 - RNA, 23 nt, Human
gagccuggcucuugugcuggaug

SEQ ID NO: 2449711 - RNA, 21 nt, Human
gagccuggcucuugugcugga

SEQ ID NO: 2449712 - RNA, 12 nt, Human
gagccuggcucu

SEQ ID NO: 2449713 - RNA, 23 nt, Human
gagccuggcuccguccaggagcc

SEQ ID NO: 2449714 - RNA, 15 nt, Human
gagccuggccagccu

SEQ ID NO: 2449715 - RNA, 15 nt, Human
gagccuggcaagaau

SEQ ID NO: 2449716 - RNA, 15 nt, Human
gagccuggagaagcu

SEQ ID NO: 2449717 - RNA, 14 nt, Human
gagccuggagaagc

SEQ ID NO: 2449718 - RNA, 13 nt, Human
gagccuggagaag

SEQ ID NO: 2449719 - RNA, 12 nt, Human
gagccuggagaa

SEQ ID NO: 2449720 - RNA, 23 nt, Human
gagccugcuggucacagccuccu

SEQ ID NO: 2449721 - RNA, 21 nt, Human
gagccugcuggucacagccuc

SEQ ID NO: 2449722 - RNA, 12 nt, Human
gagccugcuggu

SEQ ID NO: 2449723 - RNA, 15 nt, Human
gagccugcuggcacc

SEQ ID NO: 2449724 - RNA, 10 nt, Human
gagccuggca

SEQ ID NO: 2449725 - RNA, 12 nt, Human
gagcuacaaaug

SEQ ID NO: 2449726 - RNA, 13 nt, Human
gagcuacaaaugc

SEQ ID NO: 2449727 - RNA, 14 nt, Human
gagccuggugcccu

SEQ ID NO: 2449728 - RNA, 22 nt, Human
gagcgugggaggcgggagugga

SEQ ID NO: 2449729 - RNA, 21 nt, Human
gagcgugcuccagccuggcuc

SEQ ID NO: 2449730 - RNA, 20 nt, Human
gagcgugcuccagccuggcu

SEQ ID NO: 2449731 - RNA, 17 nt, Human
gagcgguggcccugucc

SEQ ID NO: 2449732 - RNA, 23 nt, Human
gagcgguggcccugucccuccca

SEQ ID NO: 2449733 - RNA, 14 nt, Human
gagcgguggcccug

SEQ ID NO: 2449734 - RNA, 23 nt, Human
gagcggucucaggcuggugggag

SEQ ID NO: 2449735 - RNA, 22 nt, Human
gagcggucucaggcugguggga

SEQ ID NO: 2449736 - RNA, 17 nt, Human
gagcggucucaggcugg

SEQ ID NO: 2449737 - RNA, 19 nt, Human
gagcggugcuguccucagg

SEQ ID NO: 2449738 - RNA, 12 nt, Human
gaguccccuguu

SEQ ID NO: 2449739 - RNA, 17 nt, Human
gaguccccucaccuccu

SEQ ID NO: 2449740 - RNA, 16 nt, Human
gaguccccucaccucc

SEQ ID NO: 2449741 - RNA, 11 nt, Human
gaguccccuca

SEQ ID NO: 2449742 - RNA, 18 nt, Human
gagucccagugggaggcg

SEQ ID NO: 2449743 - RNA, 16 nt, Human
gagucccagugggagg

SEQ ID NO: 2449744 - RNA, 14 nt, Human
gagucccaguggga

SEQ ID NO: 2449745 - RNA, 20 nt, Human
gagucccaggagcugcccag

SEQ ID NO: 2449746 - RNA, 19 nt, Human
gagucccaggagcugccca

SEQ ID NO: 2449747 - RNA, 18 nt, Human
gagucccaggcugagccu

SEQ ID NO: 2449748 - RNA, 19 nt, Human
gagucccaggcugagccuc

SEQ ID NO: 2449749 - RNA, 19 nt, Human
gaguccccucaccuccucu

SEQ ID NO: 2449750 - RNA, 18 nt, Human
gaguccccucaccuccuc

SEQ ID NO: 2449751 - RNA, 14 nt, Human
gagucccugccauc

SEQ ID NO: 2449752 - RNA, 23 nt, Human
gaguccccuguuuguuucugaaa

SEQ ID NO: 2449753 - RNA, 14 nt, Human
gaguccccuguuug

SEQ ID NO: 2449754 - RNA, 14 nt, Human
gaguagcugggacu

SEQ ID NO: 2449755 - RNA, 12 nt, Human
gaguagcuggga

SEQ ID NO: 2449756 - RNA, 23 nt, Human
gagucccagagcaggaggccccu

SEQ ID NO: 2449757 - RNA, 21 nt, Human
gagucccagagcaggaggccc

SEQ ID NO: 2449758 - RNA, 19 nt, Human
gagucccagagcaggaggc

SEQ ID NO: 2449759 - RNA, 18 nt, Human
gagucccagagcaggagg

SEQ ID NO: 2449760 - RNA, 23 nt, Human
gagucccacugccucagguuccu

SEQ ID NO: 2449761 - RNA, 22 nt, Human
gagucccacugccucagguucc

SEQ ID NO: 2449762 - RNA, 20 nt, Human
gagucccacugccucagguu

SEQ ID NO: 2449763 - RNA, 19 nt, Human
gagucccacugccucaggu

SEQ ID NO: 2449764 - RNA, 17 nt, Human
gagucccacugccucag

SEQ ID NO: 2449765 - RNA, 14 nt, Human
gagucccacugccu

SEQ ID NO: 2449766 - RNA, 13 nt, Human
gagucccacugcc

SEQ ID NO: 2449767 - RNA, 19 nt, Human
gagucaaaacucaaaugcu

SEQ ID NO: 2449768 - RNA, 20 nt, Human
gaguauuuaggcagauugaa

SEQ ID NO: 2449769 - RNA, 19 nt, Human
gagucaaaacuacaaauca

SEQ ID NO: 2449770 - RNA, 19 nt, Human
gagucaaaugguaggcauu

SEQ ID NO: 2449771 - RNA, 17 nt, Human
gagucgaggacagggag

SEQ ID NO: 2449772 - RNA, 18 nt, Human
gaguccccuccccggccc

SEQ ID NO: 2449773 - RNA, 13 nt, Human
gagucggaagggc

SEQ ID NO: 2449774 - RNA, 17 nt, Human
gagucguacagaaagcu

SEQ ID NO: 2449775 - RNA, 22 nt, Human
gagucguacagaaagcugccug

SEQ ID NO: 2449776 - RNA, 17 nt, Human
gagucguggggugugcu

SEQ ID NO: 2449777 - RNA, 19 nt, Human
gagucgucaucacuuuuca

SEQ ID NO: 2449778 - RNA, 14 nt, Human
gagucccgucagga

SEQ ID NO: 2449779 - RNA, 21 nt, Human
gagucucacuguugcccaggc

SEQ ID NO: 2449780 - RNA, 20 nt, Human
gagucucacuguugcccagg

SEQ ID NO: 2449781 - RNA, 21 nt, Human
gagucguggggugugcuggga

SEQ ID NO: 2449782 - RNA, 20 nt, Human
gagucguggggugugcuggg

SEQ ID NO: 2449783 - RNA, 19 nt, Human
gagucguggggugugcugg

SEQ ID NO: 2449784 - RNA, 18 nt, Human
gagucguggggugugcug

SEQ ID NO: 2449785 - RNA, 19 nt, Human
gagucucacuguugcccag

SEQ ID NO: 2449786 - RNA, 14 nt, Human
gagucucccaaggc

SEQ ID NO: 2449787 - RNA, 13 nt, Human
gagucucccaagg

SEQ ID NO: 2449788 - RNA, 20 nt, Human
gagucuccagugguugcugu

SEQ ID NO: 2449789 - RNA, 23 nt, Human
gagucgucaucacuuuucaguga

SEQ ID NO: 2449790 - RNA, 23 nt, Human
gagucucgcuauugucaccaggg

SEQ ID NO: 2449791 - RNA, 12 nt, Human
gagucuccugug

SEQ ID NO: 2449792 - RNA, 12 nt, Human
gagucucuucuc

SEQ ID NO: 2449793 - RNA, 23 nt, Human
gagucucacuguugcccaggcug

SEQ ID NO: 2449794 - RNA, 22 nt, Human
gagucucacuguugcccaggcu

SEQ ID NO: 2449795 - RNA, 17 nt, Human
gagucucuucuccacug

SEQ ID NO: 2449796 - RNA, 16 nt, Human
gagucucuucuccacu

SEQ ID NO: 2449797 - RNA, 15 nt, Human
gagucucuucuccac

SEQ ID NO: 2449798 - RNA, 14 nt, Human
gagucucuucucca

SEQ ID NO: 2449799 - RNA, 21 nt, Human
gagucugaaggcuggguucug

SEQ ID NO: 2449800 - RNA, 18 nt, Human
gagucucuucuccacugg

SEQ ID NO: 2449801 - RNA, 14 nt, Human
gagucugaagcaga

SEQ ID NO: 2449802 - RNA, 15 nt, Human
gaggggggcacaugc

SEQ ID NO: 2449803 - RNA, 19 nt, Human
gaggggggauuuccagcca

SEQ ID NO: 2449804 - RNA, 19 nt, Human
gaggggcucucagcucagc

SEQ ID NO: 2449805 - RNA, 22 nt, Human
gaggggggaggugggauccucc

SEQ ID NO: 2449806 - RNA, 15 nt, Human
gaggggguggccucc

SEQ ID NO: 2449807 - RNA, 18 nt, Human
gagguccacaacacacag

SEQ ID NO: 2449808 - RNA, 22 nt, Human
gaggucaggaguuagaggccag

SEQ ID NO: 2449809 - RNA, 15 nt, Human
gaggggggagguggg

SEQ ID NO: 2449810 - RNA, 16 nt, Human
gaggggcucucagcuc

SEQ ID NO: 2449811 - RNA, 12 nt, Human
gaggggcucuca

SEQ ID NO: 2449812 - RNA, 11 nt, Human
gaggggcucuc

SEQ ID NO: 2449813 - RNA, 16 nt, Human
gaggggcucaggaaaa

SEQ ID NO: 2449814 - RNA, 14 nt, Human
gaggggcuccugga

SEQ ID NO: 2449815 - RNA, 15 nt, Human
gaggggcuccuggaa

SEQ ID NO: 2449816 - RNA, 19 nt, Human
gaggggcgcuggcccagcc

SEQ ID NO: 2449817 - RNA, 18 nt, Human
gaggggcgcuggcccagc

SEQ ID NO: 2449818 - RNA, 17 nt, Human
gaggggcgcuggcccag

SEQ ID NO: 2449819 - RNA, 16 nt, Human
gaggggcgcuggccca

SEQ ID NO: 2449820 - RNA, 15 nt, Human
gaggggcgcuggccc

SEQ ID NO: 2449821 - RNA, 14 nt, Human
gaggggcgcuggcc

SEQ ID NO: 2449822 - RNA, 13 nt, Human
gaggggcgcuggc

SEQ ID NO: 2449823 - RNA, 16 nt, Human
gaggggcgcccaccuc

SEQ ID NO: 2449824 - RNA, 22 nt, Human
gaggggcgcuggcccagccggc

SEQ ID NO: 2449825 - RNA, 20 nt, Human
gaggggcgcuggcccagccg

SEQ ID NO: 2449826 - RNA, 15 nt, Human
gaggggcucaggaaa

SEQ ID NO: 2449827 - RNA, 16 nt, Human
gaggggcgggacccag

SEQ ID NO: 2449828 - RNA, 12 nt, Human
gaggggcuccug

SEQ ID NO: 2449829 - RNA, 13 nt, Human
gaggggcuccugg

SEQ ID NO: 2449830 - RNA, 22 nt, Human
gaggugggauccuccaggugca

SEQ ID NO: 2449831 - RNA, 21 nt, Human
gaggugggauccuccaggugc

SEQ ID NO: 2449832 - RNA, 19 nt, Human
gagguguuuaaagagaggu

SEQ ID NO: 2449833 - RNA, 14 nt, Human
gagguguuuaaaga

SEQ ID NO: 2449834 - RNA, 17 nt, Human
gaggugugggggcugca

SEQ ID NO: 2449835 - RNA, 16 nt, Human
gaggugugggggcugc

SEQ ID NO: 2449836 - RNA, 23 nt, Human
gaggugggcaggugguggcacug

SEQ ID NO: 2449837 - RNA, 21 nt, Human
gaggugggcaggugguggcac

SEQ ID NO: 2449838 - RNA, 17 nt, Human
gaggugggccagucugu

SEQ ID NO: 2449839 - RNA, 14 nt, Human
gaggugggcaggug

SEQ ID NO: 2449840 - RNA, 12 nt, Human
gaggugggcagg

SEQ ID NO: 2449841 - RNA, 11 nt, Human
gaggugggcag

SEQ ID NO: 2449842 - RNA, 18 nt, Human
gaggugggauccuccagg

SEQ ID NO: 2449843 - RNA, 23 nt, Human
gagguccagcccuggcugaagga

SEQ ID NO: 2449844 - RNA, 22 nt, Human
gagguccagcccuggcugaagg

SEQ ID NO: 2449845 - RNA, 20 nt, Human
gagguccagcccuggcugaa

SEQ ID NO: 2449846 - RNA, 19 nt, Human
gagguccagcccuggcuga

SEQ ID NO: 2449847 - RNA, 17 nt, Human
gagguccagcccuggcu

SEQ ID NO: 2449848 - RNA, 14 nt, Human
gaggggguggaggg

SEQ ID NO: 2449849 - RNA, 13 nt, Human
gaggggguggagg

SEQ ID NO: 2449850 - RNA, 12 nt, Human
gaggucccaggc

SEQ ID NO: 2449851 - RNA, 14 nt, Human
gaggucccaggcag

SEQ ID NO: 2449852 - RNA, 17 nt, Human
gaguacguugugcauuu

SEQ ID NO: 2449853 - RNA, 18 nt, Human
gaguacguugugcauuug

SEQ ID NO: 2449854 - RNA, 15 nt, Human
gaguacuacaguccu

SEQ ID NO: 2449855 - RNA, 20 nt, Human
gaguacguugugcauuuggu

SEQ ID NO: 2449856 - RNA, 19 nt, Human
gaguacuacaguccuccca

SEQ ID NO: 2449857 - RNA, 18 nt, Human
gaguacuacaguccuccc

SEQ ID NO: 2449858 - RNA, 20 nt, Human
gaguagcgguccaagccugc

SEQ ID NO: 2449859 - RNA, 15 nt, Human
gaguagcgguccaag

SEQ ID NO: 2449860 - RNA, 19 nt, Human
gaguagccgagagccugcu

SEQ ID NO: 2449861 - RNA, 21 nt, Human
gaguagccgagagccugcucc

SEQ ID NO: 2449862 - RNA, 12 nt, Human
gaguagcuggau

SEQ ID NO: 2449863 - RNA, 16 nt, Human
gaguacaggugaagca

SEQ ID NO: 2449864 - RNA, 18 nt, Human
gaguagccgagagccugc

SEQ ID NO: 2449865 - RNA, 19 nt, Human
gagguucaaagauauuuug

SEQ ID NO: 2449866 - RNA, 13 nt, Human
gagguuauagguc

SEQ ID NO: 2449867 - RNA, 22 nt, Human
gagguuaggaguucgagaccag

SEQ ID NO: 2449868 - RNA, 21 nt, Human
gagguguuuaaagagagguua

SEQ ID NO: 2449869 - RNA, 15 nt, Human
gagguuaaggcugag

SEQ ID NO: 2449870 - RNA, 19 nt, Human
gagguuaaggcugaggaaa

SEQ ID NO: 2449871 - RNA, 14 nt, Human
gagguucccuuuga

SEQ ID NO: 2449872 - RNA, 22 nt, Human
gagguuuguuuagaagaagugu

SEQ ID NO: 2449873 - RNA, 17 nt, Human
gagguucauuucaaaua

SEQ ID NO: 2449874 - RNA, 19 nt, Human
gagguuauaggucacuccu

SEQ ID NO: 2449875 - RNA, 22 nt, Human
gagguuauaggucacuccuggg

SEQ ID NO: 2449876 - RNA, 15 nt, Human
gagguuuuaaaguga

SEQ ID NO: 2449877 - RNA, 19 nt, Human
gagguuuuaaaaaaauccc

SEQ ID NO: 2449878 - RNA, 16 nt, Human
gaguacguugugcauu

SEQ ID NO: 2449879 - RNA, 12 nt, Human
gaguaaaggaaa

SEQ ID NO: 2449880 - RNA, 22 nt, Human
gauauauuaaaaauauaaaacu

SEQ ID NO: 2449881 - RNA, 21 nt, Human
gauauauuaaaaauauaaaac

SEQ ID NO: 2449882 - RNA, 20 nt, Human
gauauauuaaaaauauaaaa

SEQ ID NO: 2449883 - RNA, 18 nt, Human
gauauauuaaaaauauaa

SEQ ID NO: 2449884 - RNA, 17 nt, Human
gauauauuaaaaauaua

SEQ ID NO: 2449885 - RNA, 14 nt, Human
gauauauuaaaaau

SEQ ID NO: 2449886 - RNA, 13 nt, Human
gauauauuaaaaa

SEQ ID NO: 2449887 - RNA, 16 nt, Human
gauauauggauaaugc

SEQ ID NO: 2449888 - RNA, 14 nt, Human
gauauauuuuacaa

SEQ ID NO: 2449889 - RNA, 15 nt, Human
gauauauuuaaaaau

SEQ ID NO: 2449890 - RNA, 23 nt, Human
gauauauuuuacaauuuuuuauc

SEQ ID NO: 2449891 - RNA, 19 nt, Human
gauauauuuaaaaauauuu

SEQ ID NO: 2449892 - RNA, 22 nt, Human
gaucaaccccuucgcuccugug

SEQ ID NO: 2449893 - RNA, 21 nt, Human
gaucaaccccuucgcuccugu

SEQ ID NO: 2449894 - RNA, 19 nt, Human
gauauauguuuuugaaggc

SEQ ID NO: 2449895 - RNA, 22 nt, Human
gauauauguguuuuucacauuu

SEQ ID NO: 2449896 - RNA, 16 nt, Human
gauauagaacagugcu

SEQ ID NO: 2449897 - RNA, 20 nt, Human
gauauauguguuuuucacau

SEQ ID NO: 2449898 - RNA, 23 nt, Human
gauauaugcucugcauguuacau

SEQ ID NO: 2449899 - RNA, 12 nt, Human
gauauagaacag

SEQ ID NO: 2449900 - RNA, 18 nt, Human
gauauacuuuuuucuuau

SEQ ID NO: 2449901 - RNA, 17 nt, Human
gauauacucuagaugaa

SEQ ID NO: 2449902 - RNA, 23 nt, Human
gauagcauuuuugauuuaugcau

SEQ ID NO: 2449903 - RNA, 18 nt, Human
gauauacacggaugacuu

SEQ ID NO: 2449904 - RNA, 21 nt, Human
gauauaaguguguguuuuuca

SEQ ID NO: 2449905 - RNA, 22 nt, Human
gauagcauuuuugauuuaugca

SEQ ID NO: 2449906 - RNA, 17 nt, Human
gauagcauuuuugauuu

SEQ ID NO: 2449907 - RNA, 17 nt, Human
gauauaaguguguguuu

SEQ ID NO: 2449908 - RNA, 13 nt, Human
gauagccaaggcc

SEQ ID NO: 2449909 - RNA, 17 nt, Human
gauagcauugugaacug

SEQ ID NO: 2449910 - RNA, 15 nt, Human
gauagcauugugaac

SEQ ID NO: 2449911 - RNA, 19 nt, Human
gauagcacagacccugccc

SEQ ID NO: 2449912 - RNA, 12 nt, Human
gauagccaaggc

SEQ ID NO: 2449913 - RNA, 18 nt, Human
gauagcacagacccugcc

SEQ ID NO: 2449914 - RNA, 17 nt, Human
gauagcacagacccugc

SEQ ID NO: 2449915 - RNA, 12 nt, Human
gauagagggggg

SEQ ID NO: 2449916 - RNA, 13 nt, Human
gauacaaugcugu

SEQ ID NO: 2449917 - RNA, 18 nt, Human
gauacaaugcugugcccu

SEQ ID NO: 2449918 - RNA, 21 nt, Human
gauagacacauaugaggggga

SEQ ID NO: 2449919 - RNA, 20 nt, Human
gauagacacauaugaggggg

SEQ ID NO: 2449920 - RNA, 16 nt, Human
gauacaagauuagaag

SEQ ID NO: 2449921 - RNA, 22 nt, Human
gauacaauguauuuauuuaaaa

SEQ ID NO: 2449922 - RNA, 19 nt, Human
gauacacccaaaguaucag

SEQ ID NO: 2449923 - RNA, 19 nt, Human
gauaauguuaaauuuguaa

SEQ ID NO: 2449924 - RNA, 14 nt, Human
gauaauguuaaauu

SEQ ID NO: 2449925 - RNA, 13 nt, Human
gauaauguuaaau

SEQ ID NO: 2449926 - RNA, 12 nt, Human
gauaauguuaaa

SEQ ID NO: 2449927 - RNA, 17 nt, Human
gauacaaaagcauguga

SEQ ID NO: 2449928 - RNA, 20 nt, Human
gauacaacuucaagugcaug

SEQ ID NO: 2449929 - RNA, 21 nt, Human
gauaauguuaaauuuguaagu

SEQ ID NO: 2449930 - RNA, 21 nt, Human
gauaaucagugugucuaaauu

SEQ ID NO: 2449931 - RNA, 21 nt, Human
gauaaugugauauuauacaua

SEQ ID NO: 2449932 - RNA, 11 nt, Human
gauaauguuaa

SEQ ID NO: 2449933 - RNA, 15 nt, Human
gauaaugcuguugcc

SEQ ID NO: 2449934 - RNA, 20 nt, Human
gauaaugccggugagaauaa

SEQ ID NO: 2449935 - RNA, 19 nt, Human
gauaaugcuguugccucau

SEQ ID NO: 2449936 - RNA, 21 nt, Human
gauaaaaagauguucagucau

SEQ ID NO: 2449937 - RNA, 19 nt, Human
gaguuuuuguuuggagagc

SEQ ID NO: 2449938 - RNA, 21 nt, Human
gauaaucaacugggcugaaca

SEQ ID NO: 2449939 - RNA, 13 nt, Human
gauaaucagccuc

SEQ ID NO: 2449940 - RNA, 14 nt, Human
gauaaucagccucu

SEQ ID NO: 2449941 - RNA, 15 nt, Human
gauaaucagccucuu

SEQ ID NO: 2449942 - RNA, 16 nt, Human
gauaaucagccucuua

SEQ ID NO: 2449943 - RNA, 13 nt, Human
gaguuuuguuuua

SEQ ID NO: 2449944 - RNA, 19 nt, Human
gaguuuuguuuuaaaauua

SEQ ID NO: 2449945 - RNA, 18 nt, Human
gaguuuuuauggggcuga

SEQ ID NO: 2449946 - RNA, 19 nt, Human
gaguuuuuauggggcugaa

SEQ ID NO: 2449947 - RNA, 22 nt, Human
gaguuuuucccagcuacaccuu

SEQ ID NO: 2449948 - RNA, 22 nt, Human
gagugaacaaauuuacagagac

SEQ ID NO: 2449949 - RNA, 23 nt, Human
gagugaacaaauuuacagagaca

SEQ ID NO: 2449950 - RNA, 10 nt, Human
gaguggccug

SEQ ID NO: 2449951 - RNA, 12 nt, Human
gaguggccuggc

SEQ ID NO: 2449952 - RNA, 18 nt, Human
gaguggcauuggcagcag

SEQ ID NO: 2449953 - RNA, 20 nt, Human
gaguggcauggccaccacca

SEQ ID NO: 2449954 - RNA, 23 nt, Human
gaguggcauuggcagcaggugcu

SEQ ID NO: 2449955 - RNA, 11 nt, Human
gaguggccacu

SEQ ID NO: 2449956 - RNA, 21 nt, Human
gagucugcuauauuuucauga

SEQ ID NO: 2449957 - RNA, 18 nt, Human
gagucugcuauauuuuca

SEQ ID NO: 2449958 - RNA, 11 nt, Human
gagucugcaca

SEQ ID NO: 2449959 - RNA, 19 nt, Human
gagugaacaaauuuacaga

SEQ ID NO: 2449960 - RNA, 12 nt, Human
gagucugaugau

SEQ ID NO: 2449961 - RNA, 12 nt, Human
gagugggcccaa

SEQ ID NO: 2449962 - RNA, 23 nt, Human
gagugggggaucacagccucuga

SEQ ID NO: 2449963 - RNA, 13 nt, Human
gagugucuuucca

SEQ ID NO: 2449964 - RNA, 15 nt, Human
gagugucuuuccacg

SEQ ID NO: 2449965 - RNA, 19 nt, Human
gagugucuuuccacggagc

SEQ ID NO: 2449966 - RNA, 21 nt, Human
gagugucuuuccacggagcca

SEQ ID NO: 2449967 - RNA, 18 nt, Human
gagugggacagagucugg

SEQ ID NO: 2449968 - RNA, 19 nt, Human
gagugggggagagcaggcu

SEQ ID NO: 2449969 - RNA, 14 nt, Human
gaguggggcaguag

SEQ ID NO: 2449970 - RNA, 13 nt, Human
gaguggcuccucc

SEQ ID NO: 2449971 - RNA, 19 nt, Human
gaguggccuggccaggagc

SEQ ID NO: 2449972 - RNA, 20 nt, Human
gaguggccuggccaggagcu

SEQ ID NO: 2449973 - RNA, 13 nt, Human
gaguggccuggcc

SEQ ID NO: 2449974 - RNA, 14 nt, Human
gaguggccuggcca

SEQ ID NO: 2449975 - RNA, 15 nt, Human
gaguggccuggccag

SEQ ID NO: 2449976 - RNA, 18 nt, Human
gaguggccuggccaggag

SEQ ID NO: 2449977 - RNA, 17 nt, Human
gagugggacagagucug

SEQ ID NO: 2449978 - RNA, 15 nt, Human
gaguggcuccucccg

SEQ ID NO: 2449979 - RNA, 13 nt, Human
gaguuccuagcca

SEQ ID NO: 2449980 - RNA, 12 nt, Human
gaguuccugcau

SEQ ID NO: 2449981 - RNA, 18 nt, Human
gaguuccccaugcagaca

SEQ ID NO: 2449982 - RNA, 17 nt, Human
gaguuccaugaagacca

SEQ ID NO: 2449983 - RNA, 15 nt, Human
gaguuccaugaagac

SEQ ID NO: 2449984 - RNA, 23 nt, Human
gaguuccugcggagugaagaggg

SEQ ID NO: 2449985 - RNA, 15 nt, Human
gaguucuugugccau

SEQ ID NO: 2449986 - RNA, 21 nt, Human
gaguucuuaaggauugugaua

SEQ ID NO: 2449987 - RNA, 14 nt, Human
gaguuccugcaugc

SEQ ID NO: 2449988 - RNA, 21 nt, Human
gaguuccuugaucuguauaua

SEQ ID NO: 2449989 - RNA, 17 nt, Human
gaguucgagaccagccu

SEQ ID NO: 2449990 - RNA, 21 nt, Human
gaguugaaaaucuuauaauuu

SEQ ID NO: 2449991 - RNA, 14 nt, Human
gaguugaagacaga

SEQ ID NO: 2449992 - RNA, 13 nt, Human
gaguuuuccccac

SEQ ID NO: 2449993 - RNA, 16 nt, Human
gaguuuuggaugcagu

SEQ ID NO: 2449994 - RNA, 18 nt, Human
gaguuaucuaaaagaaau

SEQ ID NO: 2449995 - RNA, 16 nt, Human
gaguuaucuaaaagaa

SEQ ID NO: 2449996 - RNA, 23 nt, Human
gaguucaucuugaauuguaagga

SEQ ID NO: 2449997 - RNA, 18 nt, Human
gaguuagaggccagccug

SEQ ID NO: 2449998 - RNA, 20 nt, Human
gaguuagaggccagccuggc

SEQ ID NO: 2449999 - RNA, 17 nt, Human
gaguuaggcuauucaca

SEQ ID NO: 2450000 - RNA, 18 nt, Human
gaguuaggcuauucacaa

SEQ ID NO: 2450001 - RNA, 18 nt, Human
gaguuauauguucacugu

SEQ ID NO: 2450002 - RNA, 14 nt, Human
gaguuauauguuca

SEQ ID NO: 2450003 - RNA, 18 nt, Human
gaguuaguuucuuuggga

SEQ ID NO: 2450004 - RNA, 22 nt, Human
gagugggggagagcaggcuggc

SEQ ID NO: 2450005 - RNA, 22 nt, Human
gagugucuuuccacggagccac

SEQ ID NO: 2450006 - RNA, 17 nt, Human
gagugugccugaagucc

SEQ ID NO: 2450007 - RNA, 14 nt, Human
gaguuagacuguug

SEQ ID NO: 2450008 - RNA, 14 nt, Human
gaguuagaggccag

SEQ ID NO: 2450009 - RNA, 16 nt, Human
gaguuagaggccagcc

SEQ ID NO: 2450010 - RNA, 12 nt, Human
gaguuagacugu

SEQ ID NO: 2450011 - RNA, 17 nt, Human
gaguuacauuaauguua

SEQ ID NO: 2450012 - RNA, 15 nt, Human
gauggcaacagaucu

SEQ ID NO: 2450013 - RNA, 16 nt, Human
gauggcaacagaucug

SEQ ID NO: 2450014 - RNA, 17 nt, Human
gauggcaacagaucugg

SEQ ID NO: 2450015 - RNA, 21 nt, Human
gauggcaacagaucuggaacc

SEQ ID NO: 2450016 - RNA, 21 nt, Human
gauggcacuuagcuaucagaa

SEQ ID NO: 2450017 - RNA, 15 nt, Human
gauggcaccagaggc

SEQ ID NO: 2450018 - RNA, 14 nt, Human
gauggcaccagagg

SEQ ID NO: 2450019 - RNA, 22 nt, Human
gauggcaacagaucuggaaccu

SEQ ID NO: 2450020 - RNA, 16 nt, Human
gaugggaaagcauugu

SEQ ID NO: 2450021 - RNA, 21 nt, Human
gauggcacuuauaaccaaagc

SEQ ID NO: 2450022 - RNA, 13 nt, Human
gauggcaggaugg

SEQ ID NO: 2450023 - RNA, 17 nt, Human
gauggcaggauggccug

SEQ ID NO: 2450024 - RNA, 15 nt, Human
gauggcaggauggcc

SEQ ID NO: 2450025 - RNA, 15 nt, Human
gauggcagcuguuua

SEQ ID NO: 2450026 - RNA, 18 nt, Human
gauggcaggauggccugg

SEQ ID NO: 2450027 - RNA, 21 nt, Human
gaugggaacgcagaugaucca

SEQ ID NO: 2450028 - RNA, 23 nt, Human
gaugggaaugaggugggaggugg

SEQ ID NO: 2450029 - RNA, 22 nt, Human
gaugggaaugaagcuuguguau

SEQ ID NO: 2450030 - RNA, 18 nt, Human
gaugggaaugaagcuugu

SEQ ID NO: 2450031 - RNA, 16 nt, Human
gaugggaaugaagcuu

SEQ ID NO: 2450032 - RNA, 14 nt, Human
gaugggaaugaagc

SEQ ID NO: 2450033 - RNA, 13 nt, Human
gaugggaaugaag

SEQ ID NO: 2450034 - RNA, 21 nt, Human
gauggcuuugaaugcggccca

SEQ ID NO: 2450035 - RNA, 18 nt, Human
gaugggaaggagggaggu

SEQ ID NO: 2450036 - RNA, 22 nt, Human
gaugggcaacccccagccugcu

SEQ ID NO: 2450037 - RNA, 21 nt, Human
gaugggagcuccucuccugga

SEQ ID NO: 2450038 - RNA, 20 nt, Human
gaugggagcuccucuccugg

SEQ ID NO: 2450039 - RNA, 15 nt, Human
gaugggacugggagg

SEQ ID NO: 2450040 - RNA, 17 nt, Human
gaugggacugggagggc

SEQ ID NO: 2450041 - RNA, 14 nt, Human
gaugggacugggag

SEQ ID NO: 2450042 - RNA, 12 nt, Human
gaugcuccagcc

SEQ ID NO: 2450043 - RNA, 13 nt, Human
gaugcuccagcca

SEQ ID NO: 2450044 - RNA, 16 nt, Human
gaugcuccagccaacc

SEQ ID NO: 2450045 - RNA, 17 nt, Human
gaugcuccagccaaccc

SEQ ID NO: 2450046 - RNA, 22 nt, Human
gaugcuccagccaaccccugug

SEQ ID NO: 2450047 - RNA, 23 nt, Human
gaugcuccagccaaccccugugg

SEQ ID NO: 2450048 - RNA, 13 nt, Human
gaugcucccuccc

SEQ ID NO: 2450049 - RNA, 15 nt, Human
gaugcucccuccccu

SEQ ID NO: 2450050 - RNA, 20 nt, Human
gaugcucccuccccugcccu

SEQ ID NO: 2450051 - RNA, 21 nt, Human
gaugcucccuccccugcccug

SEQ ID NO: 2450052 - RNA, 21 nt, Human
gaugcucaggcuugaaaugca

SEQ ID NO: 2450053 - RNA, 22 nt, Human
gaugccugauugccaagcucag

SEQ ID NO: 2450054 - RNA, 14 nt, Human
gaugcucacagggc

SEQ ID NO: 2450055 - RNA, 14 nt, Human
gaugcucaggcuug

SEQ ID NO: 2450056 - RNA, 21 nt, Human
gaugccuggcgggguggggug

SEQ ID NO: 2450057 - RNA, 15 nt, Human
gaugccugauugcca

SEQ ID NO: 2450058 - RNA, 20 nt, Human
gaugccuccaccgcugccua

SEQ ID NO: 2450059 - RNA, 18 nt, Human
gaugcccuggagguggcu

SEQ ID NO: 2450060 - RNA, 19 nt, Human
gaugcccuggagguggcug

SEQ ID NO: 2450061 - RNA, 23 nt, Human
gaugccucaugauaugucagggc

SEQ ID NO: 2450062 - RNA, 12 nt, Human
gaugccuccacc

SEQ ID NO: 2450063 - RNA, 13 nt, Human
gaugccuccaccg

SEQ ID NO: 2450064 - RNA, 16 nt, Human
gaugccuccaccgcug

SEQ ID NO: 2450065 - RNA, 17 nt, Human
gaugccuccaccgcugc

SEQ ID NO: 2450066 - RNA, 21 nt, Human
gaugcauucuugguuggcugg

SEQ ID NO: 2450067 - RNA, 21 nt, Human
gaugccccgucccccucuggc

SEQ ID NO: 2450068 - RNA, 18 nt, Human
gaugcauuaaaagaaaau

SEQ ID NO: 2450069 - RNA, 12 nt, Human
gaugcccuggag

SEQ ID NO: 2450070 - RNA, 15 nt, Human
gaugcccuggaggug

SEQ ID NO: 2450071 - RNA, 22 nt, Human
gaugcaucuaccgcucuuggga

SEQ ID NO: 2450072 - RNA, 20 nt, Human
gaugcauggagauagcccca

SEQ ID NO: 2450073 - RNA, 21 nt, Human
gaugcauguuuuccagcuccu

SEQ ID NO: 2450074 - RNA, 20 nt, Human
gaugcauguuuuccagcucc

SEQ ID NO: 2450075 - RNA, 15 nt, Human
gaugcauuaaaagaa

SEQ ID NO: 2450076 - RNA, 16 nt, Human
gaugcauuaaaagaaa

SEQ ID NO: 2450077 - RNA, 17 nt, Human
gaugcauuaaaagaaaa

SEQ ID NO: 2450078 - RNA, 18 nt, Human
gaugcaguucugaagaag

SEQ ID NO: 2450079 - RNA, 13 nt, Human
gaugcaaugaaca

SEQ ID NO: 2450080 - RNA, 13 nt, Human
gaugcauggagau

SEQ ID NO: 2450081 - RNA, 21 nt, Human
gaugcaaucgguuuaaacaug

SEQ ID NO: 2450082 - RNA, 18 nt, Human
gaugcaaggaccaggacu

SEQ ID NO: 2450083 - RNA, 19 nt, Human
gaugcaaggaccaggacuc

SEQ ID NO: 2450084 - RNA, 17 nt, Human
gaugcaauguagagggg

SEQ ID NO: 2450085 - RNA, 18 nt, Human
gaugcaaugugcuacuga

SEQ ID NO: 2450086 - RNA, 14 nt, Human
gaugcaaagaaaau

SEQ ID NO: 2450087 - RNA, 21 nt, Human
gaugacucccuuaaaauagaa

SEQ ID NO: 2450088 - RNA, 17 nt, Human
gaugcaaagaggcaaga

SEQ ID NO: 2450089 - RNA, 14 nt, Human
gaugcaaagaggca

SEQ ID NO: 2450090 - RNA, 15 nt, Human
gaugcaaagaggcaa

SEQ ID NO: 2450091 - RNA, 17 nt, Human
gaugcaagauauuuaua

SEQ ID NO: 2450092 - RNA, 16 nt, Human
gaugcaaagaggcaag

SEQ ID NO: 2450093 - RNA, 14 nt, Human
gaugcaaggaccag

SEQ ID NO: 2450094 - RNA, 17 nt, Human
gaugcaaggaccaggac

SEQ ID NO: 2450095 - RNA, 22 nt, Human
gaugagaaagguugaagcacca

SEQ ID NO: 2450096 - RNA, 17 nt, Human
gaugacugaguccucgu

SEQ ID NO: 2450097 - RNA, 11 nt, Human
gaugagaaagg

SEQ ID NO: 2450098 - RNA, 12 nt, Human
gaugacugaguc

SEQ ID NO: 2450099 - RNA, 14 nt, Human
gaugacugaguccu

SEQ ID NO: 2450100 - RNA, 12 nt, Human
gaugacuaaaau

SEQ ID NO: 2450101 - RNA, 15 nt, Human
gaugacuaaaauauu

SEQ ID NO: 2450102 - RNA, 18 nt, Human
gaugacuaaaauauuuau

SEQ ID NO: 2450103 - RNA, 15 nt, Human
gaugacuagaggcag

SEQ ID NO: 2450104 - RNA, 21 nt, Human
gaugacgguauuaugcuucuu

SEQ ID NO: 2450105 - RNA, 20 nt, Human
gaugacgguauuaugcuucu

SEQ ID NO: 2450106 - RNA, 19 nt, Human
gaugacgguauuaugcuuc

SEQ ID NO: 2450107 - RNA, 14 nt, Human
gaugacuauggaaa

SEQ ID NO: 2450108 - RNA, 16 nt, Human
gaugacuagaggcagg

SEQ ID NO: 2450109 - RNA, 18 nt, Human
gaugacucccuuaaaaua

SEQ ID NO: 2450110 - RNA, 19 nt, Human
gauccugagccagauuuca

SEQ ID NO: 2450111 - RNA, 15 nt, Human
gauccugagccagau

SEQ ID NO: 2450112 - RNA, 14 nt, Human
gauccugagccaga

SEQ ID NO: 2450113 - RNA, 13 nt, Human
gauccugagccag

SEQ ID NO: 2450114 - RNA, 21 nt, Human
gauccucccaccucagccucc

SEQ ID NO: 2450115 - RNA, 20 nt, Human
gauccucccaccucagccuc

SEQ ID NO: 2450116 - RNA, 12 nt, Human
gauccuccaggu

SEQ ID NO: 2450117 - RNA, 19 nt, Human
gauccucccaccucagccu

SEQ ID NO: 2450118 - RNA, 14 nt, Human
gaucacgccacugc

SEQ ID NO: 2450119 - RNA, 13 nt, Human
gaucacgccacug

SEQ ID NO: 2450120 - RNA, 23 nt, Human
gaucaaccccuucgcuccugugu

SEQ ID NO: 2450121 - RNA, 14 nt, Human
gaucaagaaagugu

SEQ ID NO: 2450122 - RNA, 14 nt, Human
gaucaagcugugag

SEQ ID NO: 2450123 - RNA, 18 nt, Human
gauccuauucucaccagg

SEQ ID NO: 2450124 - RNA, 19 nt, Human
gauccuauucucaccagga

SEQ ID NO: 2450125 - RNA, 11 nt, Human
gauccuccagg

SEQ ID NO: 2450126 - RNA, 18 nt, Human
gauccuaguuccaccauc

SEQ ID NO: 2450127 - RNA, 15 nt, Human
gaucacgccacugca

SEQ ID NO: 2450128 - RNA, 12 nt, Human
gauccuuccucc

SEQ ID NO: 2450129 - RNA, 14 nt, Human
gauccuuuuauguu

SEQ ID NO: 2450130 - RNA, 19 nt, Human
gauccucacaaccaccuaa

SEQ ID NO: 2450131 - RNA, 20 nt, Human
gauccuauucucaccaggaa

SEQ ID NO: 2450132 - RNA, 23 nt, Human
gauccucauauggcccaguguca

SEQ ID NO: 2450133 - RNA, 18 nt, Human
gauccucccaccucagcc

SEQ ID NO: 2450134 - RNA, 15 nt, Human
gauccuuuuggaguc

SEQ ID NO: 2450135 - RNA, 17 nt, Human
gauccuuuuggagucag

SEQ ID NO: 2450136 - RNA, 17 nt, Human
gaucgaaccguuuugaa

SEQ ID NO: 2450137 - RNA, 20 nt, Human
gaucgcaagagccauguaga

SEQ ID NO: 2450138 - RNA, 13 nt, Human
gaucgcaguuugc

SEQ ID NO: 2450139 - RNA, 19 nt, Human
gaucuguuuugaaggcaaa

SEQ ID NO: 2450140 - RNA, 20 nt, Human
gaucuguuuugaaggcaaaa

SEQ ID NO: 2450141 - RNA, 23 nt, Human
gaucgcaucauugcacucuagcc

SEQ ID NO: 2450142 - RNA, 15 nt, Human
gaucgcaucauugca

SEQ ID NO: 2450143 - RNA, 18 nt, Human
gaucgcaguuugccuggu

SEQ ID NO: 2450144 - RNA, 13 nt, Human
gaucuuaaauuuu

SEQ ID NO: 2450145 - RNA, 12 nt, Human
gaucuuaaauuu

SEQ ID NO: 2450146 - RNA, 19 nt, Human
gaucuuaaauuuugugaua

SEQ ID NO: 2450147 - RNA, 14 nt, Human
gaucgcccccaccu

SEQ ID NO: 2450148 - RNA, 19 nt, Human
gaucuguuuuuaaaaauca

SEQ ID NO: 2450149 - RNA, 21 nt, Human
gaucuguuuuuaaaaaucaua

SEQ ID NO: 2450150 - RNA, 23 nt, Human
gaucuguuuuuaaaaaucauaaa

SEQ ID NO: 2450151 - RNA, 14 nt, Human
gaucuucaauggcu

SEQ ID NO: 2450152 - RNA, 14 nt, Human
gaucuucagagcag

SEQ ID NO: 2450153 - RNA, 16 nt, Human
gaucuucaauggcuuu

SEQ ID NO: 2450154 - RNA, 15 nt, Human
gaucuucaauggcuu

SEQ ID NO: 2450155 - RNA, 14 nt, Human
gaucuuuaaaauac

SEQ ID NO: 2450156 - RNA, 16 nt, Human
gaucuuugcagacagg

SEQ ID NO: 2450157 - RNA, 11 nt, Human
gaucuuucagg

SEQ ID NO: 2450158 - RNA, 12 nt, Human
gaucuuucagga

SEQ ID NO: 2450159 - RNA, 15 nt, Human
gaucuuucaggaaag

SEQ ID NO: 2450160 - RNA, 22 nt, Human
gaugaaaaagcauguacagugu

SEQ ID NO: 2450161 - RNA, 20 nt, Human
gaugaaaaagcauguacagu

SEQ ID NO: 2450162 - RNA, 19 nt, Human
gaugaaaaagcauguacag

SEQ ID NO: 2450163 - RNA, 18 nt, Human
gaugaaaaagcauguaca

SEQ ID NO: 2450164 - RNA, 17 nt, Human
gaugaaaaagcauguac

SEQ ID NO: 2450165 - RNA, 16 nt, Human
gaugaaaaagcaugua

SEQ ID NO: 2450166 - RNA, 15 nt, Human
gaugaaaaagcaugu

SEQ ID NO: 2450167 - RNA, 14 nt, Human
gaugaaaaauagca

SEQ ID NO: 2450168 - RNA, 15 nt, Human
gaugaaaaaauaaca

SEQ ID NO: 2450169 - RNA, 16 nt, Human
gaucuuuucaaguuaa

SEQ ID NO: 2450170 - RNA, 18 nt, Human
gaucuuucuuuccuuucu

SEQ ID NO: 2450171 - RNA, 19 nt, Human
gauguugaaaaaguucugc

SEQ ID NO: 2450172 - RNA, 21 nt, Human
gauguucuuucacccuuuucu

SEQ ID NO: 2450173 - RNA, 13 nt, Human
gauguuuuaauuc

SEQ ID NO: 2450174 - RNA, 21 nt, Human
gauguuuuaaggaugcuugua

SEQ ID NO: 2450175 - RNA, 14 nt, Human
gauguuuuccauga

SEQ ID NO: 2450176 - RNA, 23 nt, Human
gauguuuuccaugaguccccugu

SEQ ID NO: 2450177 - RNA, 15 nt, Human
gauguuuuccaugag

SEQ ID NO: 2450178 - RNA, 12 nt, Human
gauuaaauucuu

SEQ ID NO: 2450179 - RNA, 19 nt, Human
gauuaaauucuugcaaagu

SEQ ID NO: 2450180 - RNA, 21 nt, Human
gauuauuuuuucagaccgaaa

SEQ ID NO: 2450181 - RNA, 18 nt, Human
gauuauuuuuucagaccg

SEQ ID NO: 2450182 - RNA, 17 nt, Human
gauuauuuuuucagacc

SEQ ID NO: 2450183 - RNA, 13 nt, Human
gauuaagagccau

SEQ ID NO: 2450184 - RNA, 19 nt, Human
gauucaacagguuuuccug

SEQ ID NO: 2450185 - RNA, 14 nt, Human
gauuaaccucugca

SEQ ID NO: 2450186 - RNA, 17 nt, Human
gauuaaccucugcacua

SEQ ID NO: 2450187 - RNA, 22 nt, Human
gauuaagaucucagugguuaag

SEQ ID NO: 2450188 - RNA, 22 nt, Human
gauuaagagauggguuugacaa

SEQ ID NO: 2450189 - RNA, 21 nt, Human
gauguuuuacgucugggagaa

SEQ ID NO: 2450190 - RNA, 18 nt, Human
gauguuuuaauuccauga

SEQ ID NO: 2450191 - RNA, 23 nt, Human
gauguuuuagccauuguuggcuu

SEQ ID NO: 2450192 - RNA, 18 nt, Human
gauuaaccacuucagcug

SEQ ID NO: 2450193 - RNA, 19 nt, Human
gauuaaccacuucagcuga

SEQ ID NO: 2450194 - RNA, 21 nt, Human
gauuaaccacuucagcugacu

SEQ ID NO: 2450195 - RNA, 16 nt, Human
gauguucugggacaca

SEQ ID NO: 2450196 - RNA, 14 nt, Human
gauguguugugaua

SEQ ID NO: 2450197 - RNA, 12 nt, Human
gauguguuguga

SEQ ID NO: 2450198 - RNA, 14 nt, Human
gauguucugggaca

SEQ ID NO: 2450199 - RNA, 21 nt, Human
gauguguccugauaagcugag

SEQ ID NO: 2450200 - RNA, 13 nt, Human
gaugugugcaugu

SEQ ID NO: 2450201 - RNA, 12 nt, Human
gauguguacauc

SEQ ID NO: 2450202 - RNA, 22 nt, Human
gauguguacaucccauguaaca

SEQ ID NO: 2450203 - RNA, 16 nt, Human
gaugugcuuuucucca

SEQ ID NO: 2450204 - RNA, 21 nt, Human
gauguggaaaagccaagaggc

SEQ ID NO: 2450205 - RNA, 23 nt, Human
gauguggaaaagccaagaggcug

SEQ ID NO: 2450206 - RNA, 20 nt, Human
gaugugcuuguuaacugagu

SEQ ID NO: 2450207 - RNA, 11 nt, Human
gaugugcuuuu

SEQ ID NO: 2450208 - RNA, 21 nt, Human
gaugugcuuugcauuccuaca

SEQ ID NO: 2450209 - RNA, 19 nt, Human
gaugugcuuguuaacugag

SEQ ID NO: 2450210 - RNA, 15 nt, Human
gaugugccugggugg

SEQ ID NO: 2450211 - RNA, 15 nt, Human
gaugguggagggcca

SEQ ID NO: 2450212 - RNA, 20 nt, Human
gaugugccauuuuaaaaaaa

SEQ ID NO: 2450213 - RNA, 13 nt, Human
gaugugccugggu

SEQ ID NO: 2450214 - RNA, 23 nt, Human
gauggugcaaugaccuuucaaua

SEQ ID NO: 2450215 - RNA, 14 nt, Human
gaugguggagggcc

SEQ ID NO: 2450216 - RNA, 16 nt, Human
gauggugcugagaagc

SEQ ID NO: 2450217 - RNA, 17 nt, Human
gauggugcugagaagcu

SEQ ID NO: 2450218 - RNA, 12 nt, Human
gauggugcugag

SEQ ID NO: 2450219 - RNA, 14 nt, Human
gauggugcugagaa

SEQ ID NO: 2450220 - RNA, 14 nt, Human
gauggggaaggagg

SEQ ID NO: 2450221 - RNA, 20 nt, Human
gauggugcaaugaccuuuca

SEQ ID NO: 2450222 - RNA, 20 nt, Human
gaugggccugcuuccugucu

SEQ ID NO: 2450223 - RNA, 18 nt, Human
gaugggcuuguuuucuug

SEQ ID NO: 2450224 - RNA, 13 nt, Human
gauggggaaggag

SEQ ID NO: 2450225 - RNA, 17 nt, Human
gaugggcaugggguggg

SEQ ID NO: 2450226 - RNA, 23 nt, Human
gaugggagcuccucuccuggagg

SEQ ID NO: 2450227 - RNA, 22 nt, Human
gaugggagcuccucuccuggag

SEQ ID NO: 2450228 - RNA, 21 nt, Human
gaugggcauggggugggccuc

SEQ ID NO: 2450229 - RNA, 20 nt, Human
gaugggcauggggugggccu

SEQ ID NO: 2450230 - RNA, 22 nt, Human
gaugggcauggggugggccucu

SEQ ID NO: 2450231 - RNA, 15 nt, Human
gaugggccaccgccg

SEQ ID NO: 2450232 - RNA, 13 nt, Human
gaugggccaccgc

SEQ ID NO: 2450233 - RNA, 14 nt, Human
gaugggccaccgcc

SEQ ID NO: 2450234 - RNA, 16 nt, Human
gaugggcccaauucuu

SEQ ID NO: 2450235 - RNA, 20 nt, Human
gauuguccccgacccuugcc

SEQ ID NO: 2450236 - RNA, 13 nt, Human
gauugugccccug

SEQ ID NO: 2450237 - RNA, 21 nt, Human
gauugugaauauuuccauaug

SEQ ID NO: 2450238 - RNA, 23 nt, Human
gauugugggaauuaaggaaguga

SEQ ID NO: 2450239 - RNA, 15 nt, Human
gauuguccccgaccc

SEQ ID NO: 2450240 - RNA, 23 nt, Human
gauuguaacguugcugugggaac

SEQ ID NO: 2450241 - RNA, 22 nt, Human
gauuguaacguugcugugggaa

SEQ ID NO: 2450242 - RNA, 22 nt, Human
gauuggauuauuuaauaacauu

SEQ ID NO: 2450243 - RNA, 19 nt, Human
gauuguaacguugcugugg

SEQ ID NO: 2450244 - RNA, 21 nt, Human
gauuggauuauuuaauaacau

SEQ ID NO: 2450245 - RNA, 20 nt, Human
gauuggauuauuuaauaaca

SEQ ID NO: 2450246 - RNA, 13 nt, Human
gauuggauuauuu

SEQ ID NO: 2450247 - RNA, 20 nt, Human
gauuggauuauucauuuaaa

SEQ ID NO: 2450248 - RNA, 17 nt, Human
gauuggauuauucauuu

SEQ ID NO: 2450249 - RNA, 15 nt, Human
gauuggauuauucau

SEQ ID NO: 2450250 - RNA, 14 nt, Human
gauuggauuauuca

SEQ ID NO: 2450251 - RNA, 11 nt, Human
gauuggauuau

SEQ ID NO: 2450252 - RNA, 22 nt, Human
gauuggagauagggaaagaaag

SEQ ID NO: 2450253 - RNA, 22 nt, Human
gauuggauacgcaucagacaga

SEQ ID NO: 2450254 - RNA, 16 nt, Human
gauuggacggccugau

SEQ ID NO: 2450255 - RNA, 23 nt, Human
gauuggacggccugaugcucccu

SEQ ID NO: 2450256 - RNA, 21 nt, Human
gauugaaguauuuugcuggaa

SEQ ID NO: 2450257 - RNA, 23 nt, Human
gauugaaguauuuugcuggaaua

SEQ ID NO: 2450258 - RNA, 16 nt, Human
gauugacagcuuugcu

SEQ ID NO: 2450259 - RNA, 21 nt, Human
gauugaaaacuuuucucagau

SEQ ID NO: 2450260 - RNA, 20 nt, Human
gauugaaaacuuuucucaga

SEQ ID NO: 2450261 - RNA, 16 nt, Human
gauuauuuuuucagac

SEQ ID NO: 2450262 - RNA, 22 nt, Human
gauucuacuuuaagcacuacau

SEQ ID NO: 2450263 - RNA, 18 nt, Human
gauucuacuuuaagcacu

SEQ ID NO: 2450264 - RNA, 14 nt, Human
gauucuacuuuaag

SEQ ID NO: 2450265 - RNA, 15 nt, Human
gauucuaaugucuuc

SEQ ID NO: 2450266 - RNA, 23 nt, Human
gauucuacuuuaagcacuacaua

SEQ ID NO: 2450267 - RNA, 14 nt, Human
gauuggacauuuuc

SEQ ID NO: 2450268 - RNA, 18 nt, Human
gauugcuugagcucagga

SEQ ID NO: 2450269 - RNA, 23 nt, Human
gauugacgggacuguugguauug

SEQ ID NO: 2450270 - RNA, 17 nt, Human
gauugacagcuuugcug

SEQ ID NO: 2450271 - RNA, 19 nt, Human
gauugacagcuuugcugcu

SEQ ID NO: 2450272 - RNA, 19 nt, Human
gauuccugacccaggccgc

SEQ ID NO: 2450273 - RNA, 18 nt, Human
gauuccugacccaggccg

SEQ ID NO: 2450274 - RNA, 17 nt, Human
gauuccugacccaggcc

SEQ ID NO: 2450275 - RNA, 16 nt, Human
gauuccugacccaggc

SEQ ID NO: 2450276 - RNA, 15 nt, Human
gauuccugacccagg

SEQ ID NO: 2450277 - RNA, 13 nt, Human
gauuccugaccca

SEQ ID NO: 2450278 - RNA, 12 nt, Human
gauuccugaccc

SEQ ID NO: 2450279 - RNA, 19 nt, Human
gauucuaauuuuuaagcaa

SEQ ID NO: 2450280 - RNA, 23 nt, Human
gauucuaccacacagcagcaguu

SEQ ID NO: 2450281 - RNA, 15 nt, Human
gauuccugagccagu

SEQ ID NO: 2450282 - RNA, 13 nt, Human
gauucccagagca

SEQ ID NO: 2450283 - RNA, 19 nt, Human
gauucccagagacaggaaa

SEQ ID NO: 2450284 - RNA, 21 nt, Human
gauucccagagacaggaaaau

SEQ ID NO: 2450285 - RNA, 22 nt, Human
gauucccaccaaggucuucagc

SEQ ID NO: 2450286 - RNA, 16 nt, Human
gauucccaccaagguc

SEQ ID NO: 2450287 - RNA, 13 nt, Human
gauucccagagac

SEQ ID NO: 2450288 - RNA, 14 nt, Human
gauucccagagaca

SEQ ID NO: 2450289 - RNA, 17 nt, Human
gauucccaggaugagca

SEQ ID NO: 2450290 - RNA, 19 nt, Human
gauucccagagcaaaauaa

SEQ ID NO: 2450291 - RNA, 22 nt, Human
gauuccccauugccuccuccuu

SEQ ID NO: 2450292 - RNA, 21 nt, Human
gauuccccuaaccucauuccc

SEQ ID NO: 2450293 - RNA, 21 nt, Human
gauucccuccugcuacucugu

SEQ ID NO: 2450294 - RNA, 17 nt, Human
gauuccccauugccucc

SEQ ID NO: 2450295 - RNA, 14 nt, Human
gauucaaucuguaa

SEQ ID NO: 2450296 - RNA, 16 nt, Human
gauucaaucuguaaac

SEQ ID NO: 2450297 - RNA, 18 nt, Human
gauucaaucuguaaacug

SEQ ID NO: 2450298 - RNA, 21 nt, Human
gauucaaaauugacauugcuu

SEQ ID NO: 2450299 - RNA, 18 nt, Human
gauucaaucgacuggguu

SEQ ID NO: 2450300 - RNA, 12 nt, Human
gauucacacugu

SEQ ID NO: 2450301 - RNA, 21 nt, Human
gauucacaccugacucugaaa

SEQ ID NO: 2450302 - RNA, 23 nt, Human
gauucaacuaaaaaaaaaaaagu

SEQ ID NO: 2450303 - RNA, 14 nt, Human
gauucacaucugca

SEQ ID NO: 2450304 - RNA, 12 nt, Human
gauucagacagc

SEQ ID NO: 2450305 - RNA, 14 nt, Human
gauucaccugagca

SEQ ID NO: 2450306 - RNA, 21 nt, Human
gauucacccuguccaaacugc

SEQ ID NO: 2450307 - RNA, 22 nt, Human
gauucccaagcucugcuccucu

SEQ ID NO: 2450308 - RNA, 14 nt, Human
gauucagaagggga

SEQ ID NO: 2450309 - RNA, 12 nt, Human
gauucagaaauu

SEQ ID NO: 2450310 - RNA, 19 nt, Human
gccagacuggcacaguuuu

SEQ ID NO: 2450311 - RNA, 16 nt, Human
gccagagacacaagcc

SEQ ID NO: 2450312 - RNA, 19 nt, Human
gccagagacacaagccuuc

SEQ ID NO: 2450313 - RNA, 17 nt, Human
gccagagacacaagccu

SEQ ID NO: 2450314 - RNA, 10 nt, Human
gccagaggag

SEQ ID NO: 2450315 - RNA, 20 nt, Human
gccagagacacaagccuucg

SEQ ID NO: 2450316 - RNA, 15 nt, Human
gccagacucuggucu

SEQ ID NO: 2450317 - RNA, 24 nt, Human
gccagaggaacuguccagagagca

SEQ ID NO: 2450318 - RNA, 13 nt, Human
gccagacucuggu

SEQ ID NO: 2450319 - RNA, 22 nt, Human
gccacucugccucugccugcau

SEQ ID NO: 2450320 - RNA, 20 nt, Human
gccacuacacuccagccuga

SEQ ID NO: 2450321 - RNA, 21 nt, Human
gccacuacacuccagccugag

SEQ ID NO: 2450322 - RNA, 22 nt, Human
gccacuacacuccagccugagc

SEQ ID NO: 2450323 - RNA, 23 nt, Human
gccacuacacuccagccugagca

SEQ ID NO: 2450324 - RNA, 23 nt, Human
gccacuccucugacucagggcuc

SEQ ID NO: 2450325 - RNA, 15 nt, Human
gccacuccugaaccc

SEQ ID NO: 2450326 - RNA, 14 nt, Human
gccacucgcuuccc

SEQ ID NO: 2450327 - RNA, 18 nt, Human
gccacucgcuucccccau

SEQ ID NO: 2450328 - RNA, 23 nt, Human
gccacucgggaggcugagacagg

SEQ ID NO: 2450329 - RNA, 20 nt, Human
gccacucgggaggcugagac

SEQ ID NO: 2450330 - RNA, 12 nt, Human
gccacucugccu

SEQ ID NO: 2450331 - RNA, 15 nt, Human
gccagacuggcacag

SEQ ID NO: 2450332 - RNA, 18 nt, Human
gccagacuggcacaguuu

SEQ ID NO: 2450333 - RNA, 13 nt, Human
gccacucugccuc

SEQ ID NO: 2450334 - RNA, 14 nt, Human
gccacucugccucu

SEQ ID NO: 2450335 - RNA, 15 nt, Human
gccacucugccucug

SEQ ID NO: 2450336 - RNA, 17 nt, Human
gccacucugccucugcc

SEQ ID NO: 2450337 - RNA, 13 nt, Human
gccacucuuccaa

SEQ ID NO: 2450338 - RNA, 19 nt, Human
gccacucugccucugccug

SEQ ID NO: 2450339 - RNA, 21 nt, Human
gccacucugccucugccugca

SEQ ID NO: 2450340 - RNA, 14 nt, Human
gccacugaagcugg

SEQ ID NO: 2450341 - RNA, 15 nt, Human
gccacugaagcuggg

SEQ ID NO: 2450342 - RNA, 17 nt, Human
gccacugaagcugggau

SEQ ID NO: 2450343 - RNA, 23 nt, Human
gccagacggcacccacccagcac

SEQ ID NO: 2450344 - RNA, 18 nt, Human
gccagaugcaccagcccu

SEQ ID NO: 2450345 - RNA, 17 nt, Human
gccagaugcaccagccc

SEQ ID NO: 2450346 - RNA, 16 nt, Human
gccagaugcaccagcc

SEQ ID NO: 2450347 - RNA, 24 nt, Human
gccagaguuccugcggagugaaga

SEQ ID NO: 2450348 - RNA, 22 nt, Human
gccagaguuccugcggagugaa

SEQ ID NO: 2450349 - RNA, 18 nt, Human
gccagaguuccugcggag

SEQ ID NO: 2450350 - RNA, 13 nt, Human
gccagaguuccug

SEQ ID NO: 2450351 - RNA, 23 nt, Human
gccagaguggccuggccaggagc

SEQ ID NO: 2450352 - RNA, 24 nt, Human
gccagaguggccuggccaggagcu

SEQ ID NO: 2450353 - RNA, 20 nt, Human
gccagaggugggcagguggu

SEQ ID NO: 2450354 - RNA, 19 nt, Human
gccagaggugggcaggugg

SEQ ID NO: 2450355 - RNA, 17 nt, Human
gccagaggugggcaggu

SEQ ID NO: 2450356 - RNA, 16 nt, Human
gccagaggugggcagg

SEQ ID NO: 2450357 - RNA, 15 nt, Human
gccagaggugggcag

SEQ ID NO: 2450358 - RNA, 12 nt, Human
gccagagguggg

SEQ ID NO: 2450359 - RNA, 23 nt, Human
gccagagggagugacagaggcag

SEQ ID NO: 2450360 - RNA, 17 nt, Human
gccagaguccuuuccaa

SEQ ID NO: 2450361 - RNA, 22 nt, Human
gccagaggugggcagguggugg

SEQ ID NO: 2450362 - RNA, 13 nt, Human
gccagaguggccu

SEQ ID NO: 2450363 - RNA, 14 nt, Human
gccagaguggccug

SEQ ID NO: 2450364 - RNA, 15 nt, Human
gccagaguggccugg

SEQ ID NO: 2450365 - RNA, 17 nt, Human
gccagaguggccuggcc

SEQ ID NO: 2450366 - RNA, 18 nt, Human
gccagaguggccuggcca

SEQ ID NO: 2450367 - RNA, 19 nt, Human
gccagaguggccuggccag

SEQ ID NO: 2450368 - RNA, 22 nt, Human
gccagaguggccuggccaggag

SEQ ID NO: 2450369 - RNA, 17 nt, Human
gccagaggagagaggac

SEQ ID NO: 2450370 - RNA, 15 nt, Human
gccagaggagagagg

SEQ ID NO: 2450371 - RNA, 13 nt, Human
gccagaggagaga

SEQ ID NO: 2450372 - RNA, 12 nt, Human
gccagaggagag

SEQ ID NO: 2450373 - RNA, 22 nt, Human
gccagaggagagaggacccccu

SEQ ID NO: 2450374 - RNA, 19 nt, Human
gccagaggagagaggaccc

SEQ ID NO: 2450375 - RNA, 22 nt, Human
gccagagggagugacagaggca

SEQ ID NO: 2450376 - RNA, 21 nt, Human
gccagagggagugacagaggc

SEQ ID NO: 2450377 - RNA, 11 nt, Human
gccaccugggu

SEQ ID NO: 2450378 - RNA, 14 nt, Human
gccaccuggggcag

SEQ ID NO: 2450379 - RNA, 16 nt, Human
gccaccuggggcaguc

SEQ ID NO: 2450380 - RNA, 17 nt, Human
gccaccuggggcaguca

SEQ ID NO: 2450381 - RNA, 20 nt, Human
gccaccuggcauuccuucug

SEQ ID NO: 2450382 - RNA, 12 nt, Human
gccaccuggggc

SEQ ID NO: 2450383 - RNA, 15 nt, Human
gccacgauugcagga

SEQ ID NO: 2450384 - RNA, 20 nt, Human
gccaccugcggugcuaucuc

SEQ ID NO: 2450385 - RNA, 14 nt, Human
gccaccugcggugc

SEQ ID NO: 2450386 - RNA, 22 nt, Human
gccaccugcggugcuaucuccc

SEQ ID NO: 2450387 - RNA, 21 nt, Human
gccaccugcccccuucuccca

SEQ ID NO: 2450388 - RNA, 18 nt, Human
gccaccugcccccuucuc

SEQ ID NO: 2450389 - RNA, 20 nt, Human
gccaccugcccccuucuccc

SEQ ID NO: 2450390 - RNA, 23 nt, Human
gccaccugcccccuucucccaca

SEQ ID NO: 2450391 - RNA, 20 nt, Human
gccacgcccaacuaauuuuu

SEQ ID NO: 2450392 - RNA, 17 nt, Human
gccacggccaggccaga

SEQ ID NO: 2450393 - RNA, 18 nt, Human
gccacggccaggccagag

SEQ ID NO: 2450394 - RNA, 13 nt, Human
gccacuaagcaga

SEQ ID NO: 2450395 - RNA, 14 nt, Human
gccacuaagcagag

SEQ ID NO: 2450396 - RNA, 15 nt, Human
gccacuaagcagagg

SEQ ID NO: 2450397 - RNA, 16 nt, Human
gccacuaagcagagga

SEQ ID NO: 2450398 - RNA, 17 nt, Human
gccacuaagcagaggag

SEQ ID NO: 2450399 - RNA, 19 nt, Human
gccacuaagcagaggaggg

SEQ ID NO: 2450400 - RNA, 20 nt, Human
gccacuaagcagaggagggg

SEQ ID NO: 2450401 - RNA, 23 nt, Human
gccacuaagcagaggaggggccg

SEQ ID NO: 2450402 - RNA, 17 nt, Human
gccacuacacuccagcc

SEQ ID NO: 2450403 - RNA, 18 nt, Human
gccacuacacuccagccu

SEQ ID NO: 2450404 - RNA, 19 nt, Human
gccacuacacuccagccug

SEQ ID NO: 2450405 - RNA, 19 nt, Human
gccacggccaggccagagg

SEQ ID NO: 2450406 - RNA, 13 nt, Human
gccacgugccagg

SEQ ID NO: 2450407 - RNA, 22 nt, Human
gccacgggucuguguucgacuc

SEQ ID NO: 2450408 - RNA, 13 nt, Human
gccacggcagccu

SEQ ID NO: 2450409 - RNA, 23 nt, Human
gccaccucugcggaccccagcug

SEQ ID NO: 2450410 - RNA, 21 nt, Human
gccaccucugcggaccccagc

SEQ ID NO: 2450411 - RNA, 20 nt, Human
gccaccucugcggaccccag

SEQ ID NO: 2450412 - RNA, 14 nt, Human
gccaccucugcgga

SEQ ID NO: 2450413 - RNA, 11 nt, Human
gccaccucugc

SEQ ID NO: 2450414 - RNA, 16 nt, Human
gccaccucucuccuuu

SEQ ID NO: 2450415 - RNA, 13 nt, Human
gccaccucucucc

SEQ ID NO: 2450416 - RNA, 15 nt, Human
gccaccucucccuca

SEQ ID NO: 2450417 - RNA, 23 nt, Human
gccaccucuccaagggcuucugc

SEQ ID NO: 2450418 - RNA, 22 nt, Human
gccaccucuccaagggcuucug

SEQ ID NO: 2450419 - RNA, 18 nt, Human
gccaccucuccaagggcu

SEQ ID NO: 2450420 - RNA, 17 nt, Human
gccaccucuccaagggc

SEQ ID NO: 2450421 - RNA, 15 nt, Human
gccaccucuccaagg

SEQ ID NO: 2450422 - RNA, 14 nt, Human
gccaccucuccaag

SEQ ID NO: 2450423 - RNA, 13 nt, Human
gccaccucuccaa

SEQ ID NO: 2450424 - RNA, 12 nt, Human
gccaccucucca

SEQ ID NO: 2450425 - RNA, 20 nt, Human
gccaccucccugacccgucu

SEQ ID NO: 2450426 - RNA, 22 nt, Human
gccaccuccccuauccacccag

SEQ ID NO: 2450427 - RNA, 22 nt, Human
gccaccucugcggaccccagcu

SEQ ID NO: 2450428 - RNA, 20 nt, Human
gccaccugaggugggcccag

SEQ ID NO: 2450429 - RNA, 19 nt, Human
gccaccugaggugggccca

SEQ ID NO: 2450430 - RNA, 18 nt, Human
gccaccugaggugggccc

SEQ ID NO: 2450431 - RNA, 15 nt, Human
gccaccugagguggg

SEQ ID NO: 2450432 - RNA, 22 nt, Human
gccaccugaggugggcccagga

SEQ ID NO: 2450433 - RNA, 21 nt, Human
gccaccugaggugggcccagg

SEQ ID NO: 2450434 - RNA, 23 nt, Human
gccaccugaggugggcccaggac

SEQ ID NO: 2450435 - RNA, 17 nt, Human
gccaccugccuguuggg

SEQ ID NO: 2450436 - RNA, 13 nt, Human
gccaccugccccc

SEQ ID NO: 2450437 - RNA, 14 nt, Human
gccaccugcccccu

SEQ ID NO: 2450438 - RNA, 16 nt, Human
gccaccugcccccuuc

SEQ ID NO: 2450439 - RNA, 17 nt, Human
gccaccugcccccuucu

SEQ ID NO: 2450440 - RNA, 20 nt, Human
gccaccgcuuccggcuccug

SEQ ID NO: 2450441 - RNA, 17 nt, Human
gccaccgcgccuggccg

SEQ ID NO: 2450442 - RNA, 17 nt, Human
gccaccgugccuggcca

SEQ ID NO: 2450443 - RNA, 20 nt, Human
gccaccuaucucgugggaga

SEQ ID NO: 2450444 - RNA, 19 nt, Human
gccaccuaucucgugggag

SEQ ID NO: 2450445 - RNA, 15 nt, Human
gccaccuaucucgug

SEQ ID NO: 2450446 - RNA, 23 nt, Human
gccaccgcuuccggcuccugugc

SEQ ID NO: 2450447 - RNA, 22 nt, Human
gccaccgugccuggccacgccc

SEQ ID NO: 2450448 - RNA, 15 nt, Human
gccaccuccccuauc

SEQ ID NO: 2450449 - RNA, 17 nt, Human
gccaccuccccuaucca

SEQ ID NO: 2450450 - RNA, 20 nt, Human
gccaccuccccuauccaccc

SEQ ID NO: 2450451 - RNA, 21 nt, Human
gccaccuccccuauccaccca

SEQ ID NO: 2450452 - RNA, 12 nt, Human
gccaccuccccu

SEQ ID NO: 2450453 - RNA, 13 nt, Human
gccaccuccccua

SEQ ID NO: 2450454 - RNA, 17 nt, Human
gccaccuccccaggccg

SEQ ID NO: 2450455 - RNA, 22 nt, Human
gccaccuaucucgugggagagc

SEQ ID NO: 2450456 - RNA, 21 nt, Human
gccaccuaucucgugggagag

SEQ ID NO: 2450457 - RNA, 13 nt, Human
gccaccuccagaa

SEQ ID NO: 2450458 - RNA, 15 nt, Human
gccaccuccagaaac

SEQ ID NO: 2450459 - RNA, 11 nt, Human
gccaccucccc

SEQ ID NO: 2450460 - RNA, 15 nt, Human
gccaccuccccaggc

SEQ ID NO: 2450461 - RNA, 19 nt, Human
gccaccgccuccuacagcc

SEQ ID NO: 2450462 - RNA, 23 nt, Human
gccacaucuugaucugcucagcc

SEQ ID NO: 2450463 - RNA, 18 nt, Human
gccacaugagucccagug

SEQ ID NO: 2450464 - RNA, 16 nt, Human
gccacaugagucccag

SEQ ID NO: 2450465 - RNA, 14 nt, Human
gccacaugaguccc

SEQ ID NO: 2450466 - RNA, 17 nt, Human
gccaccgcgcccagccu

SEQ ID NO: 2450467 - RNA, 15 nt, Human
gccacaucaaagagg

SEQ ID NO: 2450468 - RNA, 12 nt, Human
gccacaguuguu

SEQ ID NO: 2450469 - RNA, 18 nt, Human
gccacaguagucuugaug

SEQ ID NO: 2450470 - RNA, 22 nt, Human
gccacaggccucccuguuugaa

SEQ ID NO: 2450471 - RNA, 21 nt, Human
gccaagggaugaaagagaagg

SEQ ID NO: 2450472 - RNA, 22 nt, Human
gccaagggaaaggggugcuuuu

SEQ ID NO: 2450473 - RNA, 19 nt, Human
gccaagggaaccugugucc

SEQ ID NO: 2450474 - RNA, 18 nt, Human
gccaagggaaccuguguc

SEQ ID NO: 2450475 - RNA, 22 nt, Human
gccaagguagccaucccaugaa

SEQ ID NO: 2450476 - RNA, 16 nt, Human
gccaagggcuuuguuu

SEQ ID NO: 2450477 - RNA, 14 nt, Human
gccaaggugggagg

SEQ ID NO: 2450478 - RNA, 15 nt, Human
gccaaggugggagga

SEQ ID NO: 2450479 - RNA, 23 nt, Human
gccaaggugggaggauugcuuga

SEQ ID NO: 2450480 - RNA, 16 nt, Human
gccaaggugggcugag

SEQ ID NO: 2450481 - RNA, 18 nt, Human
gccaaggugggcugagcc

SEQ ID NO: 2450482 - RNA, 19 nt, Human
gccaaggugggcugagccc

SEQ ID NO: 2450483 - RNA, 21 nt, Human
gccaaggugggcugagcccug

SEQ ID NO: 2450484 - RNA, 22 nt, Human
gccaaggugggcugagcccugg

SEQ ID NO: 2450485 - RNA, 23 nt, Human
gccaaggugggcugagcccuggc

SEQ ID NO: 2450486 - RNA, 20 nt, Human
gccaagguuuuauaaggcug

SEQ ID NO: 2450487 - RNA, 16 nt, Human
gccaaguaagaaagug

SEQ ID NO: 2450488 - RNA, 19 nt, Human
gcauuugaggucuguucuu

SEQ ID NO: 2450489 - RNA, 20 nt, Human
gcauuugaggucuguucuuu

SEQ ID NO: 2450490 - RNA, 22 nt, Human
gcauuuggugguuucagaaaug

SEQ ID NO: 2450491 - RNA, 23 nt, Human
gcauuuggugguuucagaaaugu

SEQ ID NO: 2450492 - RNA, 18 nt, Human
gccaagggaaaggggugc

SEQ ID NO: 2450493 - RNA, 12 nt, Human
gccaagggaaag

SEQ ID NO: 2450494 - RNA, 19 nt, Human
gccaaggcuggagugcagu

SEQ ID NO: 2450495 - RNA, 23 nt, Human
gcauuugucuauucuccagcuga

SEQ ID NO: 2450496 - RNA, 12 nt, Human
gcauuugugaaa

SEQ ID NO: 2450497 - RNA, 21 nt, Human
gccaaggcugggggaagaagc

SEQ ID NO: 2450498 - RNA, 16 nt, Human
gcauuugagaaaugca

SEQ ID NO: 2450499 - RNA, 15 nt, Human
gcauuugagaaaugc

SEQ ID NO: 2450500 - RNA, 13 nt, Human
gcauuugucaaug

SEQ ID NO: 2450501 - RNA, 12 nt, Human
gcauuugucuau

SEQ ID NO: 2450502 - RNA, 11 nt, Human
gcauuugucua

SEQ ID NO: 2450503 - RNA, 18 nt, Human
gcauuugucaaugacagu

SEQ ID NO: 2450504 - RNA, 22 nt, Human
gccaauguauugauaagagggc

SEQ ID NO: 2450505 - RNA, 20 nt, Human
gccaauggaaccuccuuucu

SEQ ID NO: 2450506 - RNA, 19 nt, Human
gccaauggaaccuccuuuc

SEQ ID NO: 2450507 - RNA, 18 nt, Human
gccaauggaaccuccuuu

SEQ ID NO: 2450508 - RNA, 21 nt, Human
gccaauggagacugucucaag

SEQ ID NO: 2450509 - RNA, 19 nt, Human
gccaauggagacugucuca

SEQ ID NO: 2450510 - RNA, 16 nt, Human
gccaauggagacuguc

SEQ ID NO: 2450511 - RNA, 21 nt, Human
gccaauccccuccuugggcac

SEQ ID NO: 2450512 - RNA, 19 nt, Human
gccaauccccuccuugggc

SEQ ID NO: 2450513 - RNA, 12 nt, Human
gccaaugagguc

SEQ ID NO: 2450514 - RNA, 19 nt, Human
gccaaugaggucugaaaug

SEQ ID NO: 2450515 - RNA, 22 nt, Human
gccaaugaggucugaaauggag

SEQ ID NO: 2450516 - RNA, 17 nt, Human
gccaauggaaccuccuu

SEQ ID NO: 2450517 - RNA, 13 nt, Human
gccaauggaaccu

SEQ ID NO: 2450518 - RNA, 18 nt, Human
gccaaugccccacuggca

SEQ ID NO: 2450519 - RNA, 15 nt, Human
gccaaucaagggcaa

SEQ ID NO: 2450520 - RNA, 18 nt, Human
gccaauauuaaaucugcu

SEQ ID NO: 2450521 - RNA, 18 nt, Human
gccaauccccuccuuggg

SEQ ID NO: 2450522 - RNA, 13 nt, Human
gccaauccccucc

SEQ ID NO: 2450523 - RNA, 23 nt, Human
gccaauauguauuguaaacaugu

SEQ ID NO: 2450524 - RNA, 17 nt, Human
gccaauauguauuguaa

SEQ ID NO: 2450525 - RNA, 13 nt, Human
gccaauauguauu

SEQ ID NO: 2450526 - RNA, 20 nt, Human
gccaaguuuauauacaauua

SEQ ID NO: 2450527 - RNA, 20 nt, Human
gccaauaauaauaccucccu

SEQ ID NO: 2450528 - RNA, 15 nt, Human
gccaaguuuauauac

SEQ ID NO: 2450529 - RNA, 17 nt, Human
gccaaguuuauauacaa

SEQ ID NO: 2450530 - RNA, 20 nt, Human
gccaagugcaggcuggcacc

SEQ ID NO: 2450531 - RNA, 14 nt, Human
gccaaguccagauu

SEQ ID NO: 2450532 - RNA, 12 nt, Human
gccaaguccaga

SEQ ID NO: 2450533 - RNA, 22 nt, Human
gccaagucagcuuugccuucca

SEQ ID NO: 2450534 - RNA, 20 nt, Human
gccaaguggggugcugggag

SEQ ID NO: 2450535 - RNA, 19 nt, Human
gccaaguggggugcuggga

SEQ ID NO: 2450536 - RNA, 23 nt, Human
gccaaguggggugcugggaggag

SEQ ID NO: 2450537 - RNA, 18 nt, Human
gccaaguggggugcuggg

SEQ ID NO: 2450538 - RNA, 13 nt, Human
gccaaguggggug

SEQ ID NO: 2450539 - RNA, 15 nt, Human
gccaagugcaggcug

SEQ ID NO: 2450540 - RNA, 16 nt, Human
gccaagugcaggcugg

SEQ ID NO: 2450541 - RNA, 15 nt, Human
gccaaguuccucuag

SEQ ID NO: 2450542 - RNA, 21 nt, Human
gccaaguuccucuagugcccu

SEQ ID NO: 2450543 - RNA, 12 nt, Human
gccaaguucuua

SEQ ID NO: 2450544 - RNA, 16 nt, Human
gccaauuuuucugcac

SEQ ID NO: 2450545 - RNA, 15 nt, Human
gccaauuuuucugca

SEQ ID NO: 2450546 - RNA, 13 nt, Human
gccaauuuuucug

SEQ ID NO: 2450547 - RNA, 11 nt, Human
gccaauuuuuc

SEQ ID NO: 2450548 - RNA, 23 nt, Human
gccaauuuuugccuucauuaccu

SEQ ID NO: 2450549 - RNA, 22 nt, Human
gccaauuuuucugcacugagca

SEQ ID NO: 2450550 - RNA, 15 nt, Human
gccacaaauaaaaug

SEQ ID NO: 2450551 - RNA, 16 nt, Human
gccacaagacccuugu

SEQ ID NO: 2450552 - RNA, 22 nt, Human
gccacaagacccuugugguccc

SEQ ID NO: 2450553 - RNA, 23 nt, Human
gccacaagaaauuugauuucuau

SEQ ID NO: 2450554 - RNA, 16 nt, Human
gccacaagaaauuuga

SEQ ID NO: 2450555 - RNA, 14 nt, Human
gccacaagaaauuu

SEQ ID NO: 2450556 - RNA, 21 nt, Human
gccacaacccuguuuuauacu

SEQ ID NO: 2450557 - RNA, 19 nt, Human
gccaauuauguuaaacuag

SEQ ID NO: 2450558 - RNA, 17 nt, Human
gccaauuauguuaaacu

SEQ ID NO: 2450559 - RNA, 16 nt, Human
gccaauuauguuaaac

SEQ ID NO: 2450560 - RNA, 15 nt, Human
gccaauuauguuaaa

SEQ ID NO: 2450561 - RNA, 14 nt, Human
gccaauuauguuaa

SEQ ID NO: 2450562 - RNA, 20 nt, Human
gccaaugugaacagcggcug

SEQ ID NO: 2450563 - RNA, 20 nt, Human
gccaauuauguuaaacuagc

SEQ ID NO: 2450564 - RNA, 15 nt, Human
gccaauucagacagg

SEQ ID NO: 2450565 - RNA, 17 nt, Human
gccaauucagacaggca

SEQ ID NO: 2450566 - RNA, 18 nt, Human
gccaauucagacaggcaa

SEQ ID NO: 2450567 - RNA, 20 nt, Human
gccaauuucaaguuccaagu

SEQ ID NO: 2450568 - RNA, 13 nt, Human
gccaauuccuaua

SEQ ID NO: 2450569 - RNA, 11 nt, Human
gccacacacac

SEQ ID NO: 2450570 - RNA, 12 nt, Human
gccacacacaca

SEQ ID NO: 2450571 - RNA, 13 nt, Human
gccacacacacag

SEQ ID NO: 2450572 - RNA, 14 nt, Human
gccacacacacaga

SEQ ID NO: 2450573 - RNA, 15 nt, Human
gccacacacacagaa

SEQ ID NO: 2450574 - RNA, 16 nt, Human
gccacacacacagaaa

SEQ ID NO: 2450575 - RNA, 17 nt, Human
gccacacacacagaaaa

SEQ ID NO: 2450576 - RNA, 18 nt, Human
gccacacacacagaaaau

SEQ ID NO: 2450577 - RNA, 14 nt, Human
gccacaaggacuuc

SEQ ID NO: 2450578 - RNA, 17 nt, Human
gccacaaggacuuccug

SEQ ID NO: 2450579 - RNA, 18 nt, Human
gccacaaggacuuccugu

SEQ ID NO: 2450580 - RNA, 19 nt, Human
gccacaaggacuuccuguc

SEQ ID NO: 2450581 - RNA, 18 nt, Human
gccacacaaacguuuacu

SEQ ID NO: 2450582 - RNA, 21 nt, Human
gccacaaggacuuccugucca

SEQ ID NO: 2450583 - RNA, 10 nt, Human
gccacacaca

SEQ ID NO: 2450584 - RNA, 19 nt, Human
gccacacaaacguuuacuu

SEQ ID NO: 2450585 - RNA, 19 nt, Human
gccacacacacagaaaaua

SEQ ID NO: 2450586 - RNA, 20 nt, Human
gccacacacacagaaaauau

SEQ ID NO: 2450587 - RNA, 21 nt, Human
gccacacacacagaaaauaua

SEQ ID NO: 2450588 - RNA, 22 nt, Human
gccacacacacagaaaauauac

SEQ ID NO: 2450589 - RNA, 13 nt, Human
gccacacagaaac

SEQ ID NO: 2450590 - RNA, 23 nt, Human
gccacacacacagaaaauauacu

SEQ ID NO: 2450591 - RNA, 23 nt, Human
gccacacaucacccuuaccaugu

SEQ ID NO: 2450592 - RNA, 19 nt, Human
gccacaccaagcugugcca

SEQ ID NO: 2450593 - RNA, 18 nt, Human
gccacaccaagcugugcc

SEQ ID NO: 2450594 - RNA, 17 nt, Human
gccacaccaagcugugc

SEQ ID NO: 2450595 - RNA, 16 nt, Human
gccacaccaagcugug

SEQ ID NO: 2450596 - RNA, 15 nt, Human
gccacaccaagcugu

SEQ ID NO: 2450597 - RNA, 14 nt, Human
gccacaccaagcug

SEQ ID NO: 2450598 - RNA, 13 nt, Human
gccacaccaagcu

SEQ ID NO: 2450599 - RNA, 23 nt, Human
gccacaccaagcugugccacccu

SEQ ID NO: 2450600 - RNA, 22 nt, Human
gccacaccaagcugugccaccc

SEQ ID NO: 2450601 - RNA, 21 nt, Human
gccacaccaagcugugccacc

SEQ ID NO: 2450602 - RNA, 20 nt, Human
gccacaccaagcugugccac

SEQ ID NO: 2450603 - RNA, 19 nt, Human
gccacaccaucuccuuuca

SEQ ID NO: 2450604 - RNA, 23 nt, Human
gccacagaggacucacuugccca

SEQ ID NO: 2450605 - RNA, 18 nt, Human
gccacagaagccaggagc

SEQ ID NO: 2450606 - RNA, 14 nt, Human
gccacagaagccag

SEQ ID NO: 2450607 - RNA, 23 nt, Human
gccacagagaaaguacuucucca

SEQ ID NO: 2450608 - RNA, 21 nt, Human
gccacagccuccccugccagg

SEQ ID NO: 2450609 - RNA, 19 nt, Human
gccacagaagccaggagca

SEQ ID NO: 2450610 - RNA, 23 nt, Human
gccacaggccugagauuucaucu

SEQ ID NO: 2450611 - RNA, 22 nt, Human
gccacaggccugagauuucauc

SEQ ID NO: 2450612 - RNA, 20 nt, Human
gccacaggccugagauuuca

SEQ ID NO: 2450613 - RNA, 15 nt, Human
gccacaggccugaga

SEQ ID NO: 2450614 - RNA, 21 nt, Human
gccacaggccucccuguuuga

SEQ ID NO: 2450615 - RNA, 17 nt, Human
gccacaggccucccugu

SEQ ID NO: 2450616 - RNA, 16 nt, Human
gccacaggccucccug

SEQ ID NO: 2450617 - RNA, 14 nt, Human
gccacaggccuccc

SEQ ID NO: 2450618 - RNA, 13 nt, Human
gccacaggccuga

SEQ ID NO: 2450619 - RNA, 12 nt, Human
gccacaggccug

SEQ ID NO: 2450620 - RNA, 13 nt, Human
gccacaggccucc

SEQ ID NO: 2450621 - RNA, 12 nt, Human
gccacaggccuc

SEQ ID NO: 2450622 - RNA, 12 nt, Human
gccacaggacac

SEQ ID NO: 2450623 - RNA, 18 nt, Human
gccacaggacacagucag

SEQ ID NO: 2450624 - RNA, 16 nt, Human
gccacagccuccccug

SEQ ID NO: 2450625 - RNA, 11 nt, Human
gccacagcucu

SEQ ID NO: 2450626 - RNA, 20 nt, Human
gccacagagaaaguacuucu

SEQ ID NO: 2450627 - RNA, 14 nt, Human
gccacagagaaagu

SEQ ID NO: 2450628 - RNA, 23 nt, Human
gccacacuucaggcucuucuccu

SEQ ID NO: 2450629 - RNA, 13 nt, Human
gccacagagaaag

SEQ ID NO: 2450630 - RNA, 18 nt, Human
gccacacuauuaccauga

SEQ ID NO: 2450631 - RNA, 14 nt, Human
gccacaccugagcc

SEQ ID NO: 2450632 - RNA, 13 nt, Human
gccacacucagca

SEQ ID NO: 2450633 - RNA, 16 nt, Human
gccacacucagcacaa

SEQ ID NO: 2450634 - RNA, 17 nt, Human
gccacacucagcacaag

SEQ ID NO: 2450635 - RNA, 16 nt, Human
gccacacccucccccg

SEQ ID NO: 2450636 - RNA, 13 nt, Human
gccacacccuccc

SEQ ID NO: 2450637 - RNA, 22 nt, Human
gccacacccucccccgccacuc

SEQ ID NO: 2450638 - RNA, 21 nt, Human
gccacacgucugacccucucc

SEQ ID NO: 2450639 - RNA, 22 nt, Human
gccacacuucaggcucuucucc

SEQ ID NO: 2450640 - RNA, 20 nt, Human
gccacacuucaggcucuucu

SEQ ID NO: 2450641 - RNA, 21 nt, Human
gccacacuauuaccaugagaa

SEQ ID NO: 2450642 - RNA, 19 nt, Human
gccacacucagcacaaggc

SEQ ID NO: 2450643 - RNA, 22 nt, Human
gccacacucugggcuccagagu

SEQ ID NO: 2450644 - RNA, 21 nt, Human
gccaugcugaggccugggccg

SEQ ID NO: 2450645 - RNA, 20 nt, Human
gccaugcugaggccugggcc

SEQ ID NO: 2450646 - RNA, 19 nt, Human
gccaugcugaggccugggc

SEQ ID NO: 2450647 - RNA, 18 nt, Human
gccaugcugaggccuggg

SEQ ID NO: 2450648 - RNA, 17 nt, Human
gccaugcugaggccugg

SEQ ID NO: 2450649 - RNA, 14 nt, Human
gccaugcugaggcc

SEQ ID NO: 2450650 - RNA, 15 nt, Human
gccaugcugaaggga

SEQ ID NO: 2450651 - RNA, 14 nt, Human
gccaugcugaaggg

SEQ ID NO: 2450652 - RNA, 13 nt, Human
gccaugcugaggc

SEQ ID NO: 2450653 - RNA, 22 nt, Human
gccaugggacagggaggacgcu

SEQ ID NO: 2450654 - RNA, 18 nt, Human
gccauggacucuacacug

SEQ ID NO: 2450655 - RNA, 20 nt, Human
gccauggacucuacacugug

SEQ ID NO: 2450656 - RNA, 22 nt, Human
gccauggacucuacacugugaa

SEQ ID NO: 2450657 - RNA, 23 nt, Human
gccauggacucuacacugugaac

SEQ ID NO: 2450658 - RNA, 16 nt, Human
gccaugcugggaagac

SEQ ID NO: 2450659 - RNA, 18 nt, Human
gccauggacagaagaagg

SEQ ID NO: 2450660 - RNA, 12 nt, Human
gccaugggacca

SEQ ID NO: 2450661 - RNA, 17 nt, Human
gccaugggaccaaaccu

SEQ ID NO: 2450662 - RNA, 13 nt, Human
gccaugggaccaa

SEQ ID NO: 2450663 - RNA, 21 nt, Human
gccaugggaccaaaccuagcc

SEQ ID NO: 2450664 - RNA, 23 nt, Human
gccaugggacagggaggacgcuc

SEQ ID NO: 2450665 - RNA, 14 nt, Human
gccauuuugugaau

SEQ ID NO: 2450666 - RNA, 13 nt, Human
gccauuuugugaa

SEQ ID NO: 2450667 - RNA, 16 nt, Human
gccauuuguguuuaua

SEQ ID NO: 2450668 - RNA, 17 nt, Human
gcccaagucccuguuuu

SEQ ID NO: 2450669 - RNA, 15 nt, Human
gcccaagucccuguu

SEQ ID NO: 2450670 - RNA, 14 nt, Human
gcccaaccuccuga

SEQ ID NO: 2450671 - RNA, 13 nt, Human
gcccaaccuccug

SEQ ID NO: 2450672 - RNA, 14 nt, Human
gcccaaccugcucu

SEQ ID NO: 2450673 - RNA, 14 nt, Human
gcccaagucccugu

SEQ ID NO: 2450674 - RNA, 23 nt, Human
gcccaacagacaccaucuuuugu

SEQ ID NO: 2450675 - RNA, 22 nt, Human
gcccaacaccagccccugcccc

SEQ ID NO: 2450676 - RNA, 14 nt, Human
gcccaacccugucu

SEQ ID NO: 2450677 - RNA, 13 nt, Human
gcccaacccuguc

SEQ ID NO: 2450678 - RNA, 16 nt, Human
gcccaacccuucccca

SEQ ID NO: 2450679 - RNA, 15 nt, Human
gcccaacccuucccc

SEQ ID NO: 2450680 - RNA, 16 nt, Human
gcccaacccugucugu

SEQ ID NO: 2450681 - RNA, 15 nt, Human
gcccaacccugucug

SEQ ID NO: 2450682 - RNA, 16 nt, Human
gcccaacccuucccuc

SEQ ID NO: 2450683 - RNA, 23 nt, Human
gcccaaccggggagcccccgccc

SEQ ID NO: 2450684 - RNA, 23 nt, Human
gcccaaaccaccagaagcccaga

SEQ ID NO: 2450685 - RNA, 18 nt, Human
gcccaacaccagccccug

SEQ ID NO: 2450686 - RNA, 17 nt, Human
gcccaacaccagccccu

SEQ ID NO: 2450687 - RNA, 14 nt, Human
gcccaacaccagcc

SEQ ID NO: 2450688 - RNA, 13 nt, Human
gcccaacaccagc

SEQ ID NO: 2450689 - RNA, 21 nt, Human
gcccaaaccaccagaagccca

SEQ ID NO: 2450690 - RNA, 22 nt, Human
gcccaaaccaccagaagcccag

SEQ ID NO: 2450691 - RNA, 18 nt, Human
gcccaaaaauaugguuga

SEQ ID NO: 2450692 - RNA, 19 nt, Human
gccauuuugugaauggauu

SEQ ID NO: 2450693 - RNA, 18 nt, Human
gccauuuugugaauggau

SEQ ID NO: 2450694 - RNA, 14 nt, Human
gccaugccacccug

SEQ ID NO: 2450695 - RNA, 19 nt, Human
gccaugccagcuuaucuca

SEQ ID NO: 2450696 - RNA, 13 nt, Human
gccaugccagcuu

SEQ ID NO: 2450697 - RNA, 18 nt, Human
gccaugccagcuuaucuc

SEQ ID NO: 2450698 - RNA, 18 nt, Human
gccaugaggaacaaggca

SEQ ID NO: 2450699 - RNA, 18 nt, Human
gccaugagcuccagaccc

SEQ ID NO: 2450700 - RNA, 19 nt, Human
gccaugagcuccagacccc

SEQ ID NO: 2450701 - RNA, 22 nt, Human
gccaugagcuccagacccccag

SEQ ID NO: 2450702 - RNA, 23 nt, Human
gccaugagcuccagacccccagc

SEQ ID NO: 2450703 - RNA, 18 nt, Human
gccaugaccuuacauuuc

SEQ ID NO: 2450704 - RNA, 20 nt, Human
gccaucugcccaggggugcc

SEQ ID NO: 2450705 - RNA, 23 nt, Human
gccaugagaugauacauccaaag

SEQ ID NO: 2450706 - RNA, 14 nt, Human
gccaugagcuccag

SEQ ID NO: 2450707 - RNA, 15 nt, Human
gccaugagcuccaga

SEQ ID NO: 2450708 - RNA, 16 nt, Human
gccaugagcuccagac

SEQ ID NO: 2450709 - RNA, 17 nt, Human
gccaugagcuccagacc

SEQ ID NO: 2450710 - RNA, 15 nt, Human
gccaucugcccaggg

SEQ ID NO: 2450711 - RNA, 14 nt, Human
gccaucugcccagg

SEQ ID NO: 2450712 - RNA, 13 nt, Human
gccaucugcccag

SEQ ID NO: 2450713 - RNA, 12 nt, Human
gccaucugccca

SEQ ID NO: 2450714 - RNA, 19 nt, Human
gccaucugcccaggggugc

SEQ ID NO: 2450715 - RNA, 17 nt, Human
gccaucugcccaggggu

SEQ ID NO: 2450716 - RNA, 21 nt, Human
gccaucugcgugacaauaaaa

SEQ ID NO: 2450717 - RNA, 19 nt, Human
gccaucucuggaugccuga

SEQ ID NO: 2450718 - RNA, 16 nt, Human
gccaucucuggaugcc

SEQ ID NO: 2450719 - RNA, 15 nt, Human
gccaucucuggaugc

SEQ ID NO: 2450720 - RNA, 12 nt, Human
gccaucucugga

SEQ ID NO: 2450721 - RNA, 22 nt, Human
gccaucuccacccccagcugcu

SEQ ID NO: 2450722 - RNA, 18 nt, Human
gccaucgccgggacucca

SEQ ID NO: 2450723 - RNA, 12 nt, Human
gccauccugucc

SEQ ID NO: 2450724 - RNA, 19 nt, Human
gccagugccuuaccuccug

SEQ ID NO: 2450725 - RNA, 23 nt, Human
gccaucgccgggacuccagaacc

SEQ ID NO: 2450726 - RNA, 19 nt, Human
gccaucgccgggacuccag

SEQ ID NO: 2450727 - RNA, 21 nt, Human
gccagugacuccaggagagga

SEQ ID NO: 2450728 - RNA, 10 nt, Human
gccagugccu

SEQ ID NO: 2450729 - RNA, 11 nt, Human
gccagugccuu

SEQ ID NO: 2450730 - RNA, 15 nt, Human
gccagugccuuaccu

SEQ ID NO: 2450731 - RNA, 17 nt, Human
gccagugccuuaccucc

SEQ ID NO: 2450732 - RNA, 17 nt, Human
gccagugaccugaggaa

SEQ ID NO: 2450733 - RNA, 18 nt, Human
gccagugaccugaggaag

SEQ ID NO: 2450734 - RNA, 16 nt, Human
gccagugacuccagga

SEQ ID NO: 2450735 - RNA, 15 nt, Human
gccagugacuccagg

SEQ ID NO: 2450736 - RNA, 13 nt, Human
gccagugacucca

SEQ ID NO: 2450737 - RNA, 20 nt, Human
gccagugaccugaggaagcg

SEQ ID NO: 2450738 - RNA, 20 nt, Human
gccagugaugcuaaagguug

SEQ ID NO: 2450739 - RNA, 19 nt, Human
gccagugaugcuaaagguu

SEQ ID NO: 2450740 - RNA, 18 nt, Human
gccagugacuccaggaga

SEQ ID NO: 2450741 - RNA, 17 nt, Human
gccagugacuccaggag

SEQ ID NO: 2450742 - RNA, 21 nt, Human
gccagauuucacucuccuugg

SEQ ID NO: 2450743 - RNA, 18 nt, Human
gccagauuucacucuccu

SEQ ID NO: 2450744 - RNA, 14 nt, Human
gccagauccagccu

SEQ ID NO: 2450745 - RNA, 12 nt, Human
gccagaugcuga

SEQ ID NO: 2450746 - RNA, 11 nt, Human
gccagaugcug

SEQ ID NO: 2450747 - RNA, 11 nt, Human
gccagauccag

SEQ ID NO: 2450748 - RNA, 16 nt, Human
gccagauuucacucuc

SEQ ID NO: 2450749 - RNA, 19 nt, Human
gccagauuuuccugaaaac

SEQ ID NO: 2450750 - RNA, 22 nt, Human
gccaggcugaccacagcacagc

SEQ ID NO: 2450751 - RNA, 13 nt, Human
gccaggcugcucu

SEQ ID NO: 2450752 - RNA, 14 nt, Human
gccaggcugcucuu

SEQ ID NO: 2450753 - RNA, 13 nt, Human
gccaggcuggguc

SEQ ID NO: 2450754 - RNA, 22 nt, Human
gccaggcugcucuugaacuccu

SEQ ID NO: 2450755 - RNA, 14 nt, Human
gccaggcugccaag

SEQ ID NO: 2450756 - RNA, 18 nt, Human
gccagggacagagggggu

SEQ ID NO: 2450757 - RNA, 16 nt, Human
gccagggacagagggg

SEQ ID NO: 2450758 - RNA, 13 nt, Human
gccagggacagag

SEQ ID NO: 2450759 - RNA, 22 nt, Human
gccaggcuggucucgaacuccu

SEQ ID NO: 2450760 - RNA, 23 nt, Human
gccagggacagaggggguggccu

SEQ ID NO: 2450761 - RNA, 18 nt, Human
gccagggaaguccccgag

SEQ ID NO: 2450762 - RNA, 14 nt, Human
gccagggagaagcu

SEQ ID NO: 2450763 - RNA, 15 nt, Human
gccagggagaagcuc

SEQ ID NO: 2450764 - RNA, 16 nt, Human
gccagggagaagcucc

SEQ ID NO: 2450765 - RNA, 20 nt, Human
gccagggagaagcuccucuc

SEQ ID NO: 2450766 - RNA, 21 nt, Human
gccagggagacagagcucaca

SEQ ID NO: 2450767 - RNA, 16 nt, Human
gccagggagacagagc

SEQ ID NO: 2450768 - RNA, 19 nt, Human
gccagguucuauuuggaau

SEQ ID NO: 2450769 - RNA, 18 nt, Human
gccagguucuauuuggaa

SEQ ID NO: 2450770 - RNA, 19 nt, Human
gccaggugggcgggcagca

SEQ ID NO: 2450771 - RNA, 18 nt, Human
gccaggugggcgggcagc

SEQ ID NO: 2450772 - RNA, 23 nt, Human
gccagguucuauuuggaauuuau

SEQ ID NO: 2450773 - RNA, 20 nt, Human
gccagguucuauuuggaauu

SEQ ID NO: 2450774 - RNA, 23 nt, Human
gccagguucuccguuagcuccug

SEQ ID NO: 2450775 - RNA, 16 nt, Human
gccagggugagagcug

SEQ ID NO: 2450776 - RNA, 15 nt, Human
gccagggugagagcu

SEQ ID NO: 2450777 - RNA, 21 nt, Human
gccaggggucucccuggagug

SEQ ID NO: 2450778 - RNA, 23 nt, Human
gccagggugagagcugcucugga

SEQ ID NO: 2450779 - RNA, 17 nt, Human
gccagggugagagcugc

SEQ ID NO: 2450780 - RNA, 18 nt, Human
gccagguggccacuccag

SEQ ID NO: 2450781 - RNA, 17 nt, Human
gccagguuuuuggucug

SEQ ID NO: 2450782 - RNA, 22 nt, Human
gccagguuucugcccacauugg

SEQ ID NO: 2450783 - RNA, 18 nt, Human
gccagucaccccggccac

SEQ ID NO: 2450784 - RNA, 17 nt, Human
gccagucaccccggcca

SEQ ID NO: 2450785 - RNA, 20 nt, Human
gccagucaccccggccaccu

SEQ ID NO: 2450786 - RNA, 14 nt, Human
gccaguauuuuuua

SEQ ID NO: 2450787 - RNA, 19 nt, Human
gccagguuuucuggguguc

SEQ ID NO: 2450788 - RNA, 13 nt, Human
gccagguuuucug

SEQ ID NO: 2450789 - RNA, 21 nt, Human
gccagggggacuagccccugu

SEQ ID NO: 2450790 - RNA, 19 nt, Human
gccaggggggugaggagcu

SEQ ID NO: 2450791 - RNA, 20 nt, Human
gccaggggggugaggagcug

SEQ ID NO: 2450792 - RNA, 21 nt, Human
gccaggggggugaggagcugg

SEQ ID NO: 2450793 - RNA, 18 nt, Human
gccaggggucucccugga

SEQ ID NO: 2450794 - RNA, 22 nt, Human
gccaggggggugaggagcuggg

SEQ ID NO: 2450795 - RNA, 22 nt, Human
gccagggccccucacccugccu

SEQ ID NO: 2450796 - RNA, 13 nt, Human
gccagggccaggg

SEQ ID NO: 2450797 - RNA, 20 nt, Human
gccagggggacuagccccug

SEQ ID NO: 2450798 - RNA, 19 nt, Human
gccagggggacuagccccu

SEQ ID NO: 2450799 - RNA, 21 nt, Human
gccagggcagagugagaccca

SEQ ID NO: 2450800 - RNA, 14 nt, Human
gccagggcagggcc

SEQ ID NO: 2450801 - RNA, 19 nt, Human
gccagggcagggccccagg

SEQ ID NO: 2450802 - RNA, 15 nt, Human
gccagggcagaguga

SEQ ID NO: 2450803 - RNA, 16 nt, Human
gccagggcagagugag

SEQ ID NO: 2450804 - RNA, 20 nt, Human
gccagggcaaugaugaauga

SEQ ID NO: 2450805 - RNA, 11 nt, Human
gccagggagcu

SEQ ID NO: 2450806 - RNA, 17 nt, Human
gcccagccccuucugac

SEQ ID NO: 2450807 - RNA, 16 nt, Human
gcccagccccuucuga

SEQ ID NO: 2450808 - RNA, 14 nt, Human
gcccagccccuucu

SEQ ID NO: 2450809 - RNA, 13 nt, Human
gcccagccccuuc

SEQ ID NO: 2450810 - RNA, 21 nt, Human
gcccagcccugcuggccgccu

SEQ ID NO: 2450811 - RNA, 17 nt, Human
gcccagcccugcuggcc

SEQ ID NO: 2450812 - RNA, 16 nt, Human
gcccagcccugcuggc

SEQ ID NO: 2450813 - RNA, 15 nt, Human
gcccagcccugcugg

SEQ ID NO: 2450814 - RNA, 13 nt, Human
gcccagcccugcu

SEQ ID NO: 2450815 - RNA, 12 nt, Human
gcccagcccugc

SEQ ID NO: 2450816 - RNA, 11 nt, Human
gcccagcccug

SEQ ID NO: 2450817 - RNA, 14 nt, Human
gcccagcccggcuc

SEQ ID NO: 2450818 - RNA, 12 nt, Human
gcccagcccucc

SEQ ID NO: 2450819 - RNA, 13 nt, Human
gcccagcccggcu

SEQ ID NO: 2450820 - RNA, 18 nt, Human
gcccagcccggaccuugg

SEQ ID NO: 2450821 - RNA, 16 nt, Human
gcccagcccuccccau

SEQ ID NO: 2450822 - RNA, 24 nt, Human
gcccagccccuucugacccaugcu

SEQ ID NO: 2450823 - RNA, 20 nt, Human
gcccagccccuucugaccca

SEQ ID NO: 2450824 - RNA, 13 nt, Human
gcccagcuggguc

SEQ ID NO: 2450825 - RNA, 14 nt, Human
gcccagcuggguca

SEQ ID NO: 2450826 - RNA, 15 nt, Human
gcccagcugggucag

SEQ ID NO: 2450827 - RNA, 18 nt, Human
gcccagcugggucaggca

SEQ ID NO: 2450828 - RNA, 19 nt, Human
gcccagcugggucaggcag

SEQ ID NO: 2450829 - RNA, 20 nt, Human
gcccagcugggucaggcagg

SEQ ID NO: 2450830 - RNA, 21 nt, Human
gcccagcuugaaaccuucacu

SEQ ID NO: 2450831 - RNA, 23 nt, Human
gcccagcugggcucugccacccu

SEQ ID NO: 2450832 - RNA, 21 nt, Human
gcccagcugggcucugccacc

SEQ ID NO: 2450833 - RNA, 19 nt, Human
gcccagcugggcucugcca

SEQ ID NO: 2450834 - RNA, 18 nt, Human
gcccagcugggcucugcc

SEQ ID NO: 2450835 - RNA, 16 nt, Human
gcccagcugggcucug

SEQ ID NO: 2450836 - RNA, 15 nt, Human
gcccagcugggcucu

SEQ ID NO: 2450837 - RNA, 14 nt, Human
gcccagcugggcuc

SEQ ID NO: 2450838 - RNA, 23 nt, Human
gcccagcggccccucccacacac

SEQ ID NO: 2450839 - RNA, 15 nt, Human
gcccagcuagcugca

SEQ ID NO: 2450840 - RNA, 18 nt, Human
gcccagcuauaccugugc

SEQ ID NO: 2450841 - RNA, 13 nt, Human
gcccagcugggcu

SEQ ID NO: 2450842 - RNA, 22 nt, Human
gcccagccggccucucuggccu

SEQ ID NO: 2450843 - RNA, 21 nt, Human
gcccagccggccucucuggcc

SEQ ID NO: 2450844 - RNA, 20 nt, Human
gcccagccggccucucuggc

SEQ ID NO: 2450845 - RNA, 19 nt, Human
gcccagccggccucucugg

SEQ ID NO: 2450846 - RNA, 24 nt, Human
gcccagccggccucucuggccucc

SEQ ID NO: 2450847 - RNA, 23 nt, Human
gcccagccggccucucuggccuc

SEQ ID NO: 2450848 - RNA, 18 nt, Human
gcccagccggccucucug

SEQ ID NO: 2450849 - RNA, 16 nt, Human
gcccagccggccucuc

SEQ ID NO: 2450850 - RNA, 15 nt, Human
gcccagccggccucu

SEQ ID NO: 2450851 - RNA, 13 nt, Human
gcccagccggccu

SEQ ID NO: 2450852 - RNA, 20 nt, Human
gcccagcggccccucccaca

SEQ ID NO: 2450853 - RNA, 19 nt, Human
gcccagcggccccucccac

SEQ ID NO: 2450854 - RNA, 18 nt, Human
gcccagcggccccuccca

SEQ ID NO: 2450855 - RNA, 17 nt, Human
gcccagcggccccuccc

SEQ ID NO: 2450856 - RNA, 16 nt, Human
gcccagcggccccucc

SEQ ID NO: 2450857 - RNA, 21 nt, Human
gcccaggaaaggcuccaggag

SEQ ID NO: 2450858 - RNA, 20 nt, Human
gcccaggaaaggcuccagga

SEQ ID NO: 2450859 - RNA, 19 nt, Human
gcccaggaaaggcuccagg

SEQ ID NO: 2450860 - RNA, 18 nt, Human
gcccaggaaaggcuccag

SEQ ID NO: 2450861 - RNA, 20 nt, Human
gcccaggcuggcgugcagug

SEQ ID NO: 2450862 - RNA, 19 nt, Human
gcccaggcuggcgugcagu

SEQ ID NO: 2450863 - RNA, 22 nt, Human
gcccaggcuggcgugcaguggu

SEQ ID NO: 2450864 - RNA, 16 nt, Human
gcccaggcugguuucg

SEQ ID NO: 2450865 - RNA, 15 nt, Human
gcccagcuugggccc

SEQ ID NO: 2450866 - RNA, 14 nt, Human
gcccagcuugggcc

SEQ ID NO: 2450867 - RNA, 13 nt, Human
gcccagcuugggc

SEQ ID NO: 2450868 - RNA, 17 nt, Human
gcccagcuggugggaag

SEQ ID NO: 2450869 - RNA, 21 nt, Human
gcccaggcuuagucacugaga

SEQ ID NO: 2450870 - RNA, 19 nt, Human
gcccaggcuuagucacuga

SEQ ID NO: 2450871 - RNA, 16 nt, Human
gcccaguccuggccug

SEQ ID NO: 2450872 - RNA, 15 nt, Human
gcccaguccuggccu

SEQ ID NO: 2450873 - RNA, 13 nt, Human
gcccaguccuggc

SEQ ID NO: 2450874 - RNA, 19 nt, Human
gcccagggacaccagccag

SEQ ID NO: 2450875 - RNA, 18 nt, Human
gcccagggacaccagcca

SEQ ID NO: 2450876 - RNA, 17 nt, Human
gcccagggacaccagcc

SEQ ID NO: 2450877 - RNA, 23 nt, Human
gcccaggcuuagucacugagaca

SEQ ID NO: 2450878 - RNA, 19 nt, Human
gcccagucuggaaugcagu

SEQ ID NO: 2450879 - RNA, 17 nt, Human
gcccaguccuuccaccu

SEQ ID NO: 2450880 - RNA, 15 nt, Human
gcccaguccuuccac

SEQ ID NO: 2450881 - RNA, 18 nt, Human
gcccaguccuggccuggc

SEQ ID NO: 2450882 - RNA, 17 nt, Human
gcccaguccuggccugg

SEQ ID NO: 2450883 - RNA, 14 nt, Human
gcccaguccuucca

SEQ ID NO: 2450884 - RNA, 15 nt, Human
gcccaguugggugga

SEQ ID NO: 2450885 - RNA, 19 nt, Human
gcccaguccuuccaccucg

SEQ ID NO: 2450886 - RNA, 18 nt, Human
gcccaguccuuccaccuc

SEQ ID NO: 2450887 - RNA, 21 nt, Human
gcccagagggccugcaaggga

SEQ ID NO: 2450888 - RNA, 20 nt, Human
gcccagagggccugcaaggg

SEQ ID NO: 2450889 - RNA, 22 nt, Human
gcccagagggccugcaagggag

SEQ ID NO: 2450890 - RNA, 16 nt, Human
gcccagagguaacaga

SEQ ID NO: 2450891 - RNA, 12 nt, Human
gcccagagguaa

SEQ ID NO: 2450892 - RNA, 21 nt, Human
gcccagagggcccaggcaggc

SEQ ID NO: 2450893 - RNA, 20 nt, Human
gcccagagguaacagaacag

SEQ ID NO: 2450894 - RNA, 18 nt, Human
gcccagagguaacagaac

SEQ ID NO: 2450895 - RNA, 22 nt, Human
gcccagagguaacagaacagcu

SEQ ID NO: 2450896 - RNA, 23 nt, Human
gcccagaguugcugggagcugaa

SEQ ID NO: 2450897 - RNA, 14 nt, Human
gcccagaguugcug

SEQ ID NO: 2450898 - RNA, 17 nt, Human
gcccagaucagcuccua

SEQ ID NO: 2450899 - RNA, 16 nt, Human
gcccagaucagcuccu

SEQ ID NO: 2450900 - RNA, 21 nt, Human
gcccagauguuuuacgucugg

SEQ ID NO: 2450901 - RNA, 15 nt, Human
gcccagaucccagaa

SEQ ID NO: 2450902 - RNA, 16 nt, Human
gcccagcauugcuggu

SEQ ID NO: 2450903 - RNA, 14 nt, Human
gcccagcauugcug

SEQ ID NO: 2450904 - RNA, 21 nt, Human
gcccagcacugcuugaggaaa

SEQ ID NO: 2450905 - RNA, 19 nt, Human
gcccagcauugcugguucu

SEQ ID NO: 2450906 - RNA, 18 nt, Human
gcccagcauugcugguuc

SEQ ID NO: 2450907 - RNA, 17 nt, Human
gcccagccaaacccugu

SEQ ID NO: 2450908 - RNA, 20 nt, Human
gcccagcacugcuugaggaa

SEQ ID NO: 2450909 - RNA, 21 nt, Human
gcccagcccccacagugcugu

SEQ ID NO: 2450910 - RNA, 15 nt, Human
gcccagcccccacag

SEQ ID NO: 2450911 - RNA, 23 nt, Human
gcccagcccccacagugcugucu

SEQ ID NO: 2450912 - RNA, 21 nt, Human
gcccagacacagaagaggcug

SEQ ID NO: 2450913 - RNA, 12 nt, Human
gcccagccccuu

SEQ ID NO: 2450914 - RNA, 11 nt, Human
gcccagccccu

SEQ ID NO: 2450915 - RNA, 16 nt, Human
gcccagcccagcuggu

SEQ ID NO: 2450916 - RNA, 14 nt, Human
gcccagcccagcug

SEQ ID NO: 2450917 - RNA, 15 nt, Human
gcccagcccagcugg

SEQ ID NO: 2450918 - RNA, 9 nt, Human
gcccagccc

SEQ ID NO: 2450919 - RNA, 20 nt, Human
gcccagccauuaccauggag

SEQ ID NO: 2450920 - RNA, 21 nt, Human
gcccagccauuaccauggaga

SEQ ID NO: 2450921 - RNA, 22 nt, Human
gcccagccauuaccauggagac

SEQ ID NO: 2450922 - RNA, 23 nt, Human
gcccagccauuaccauggagaca

SEQ ID NO: 2450923 - RNA, 20 nt, Human
gcccagccaaacccugucug

SEQ ID NO: 2450924 - RNA, 21 nt, Human
gcccagccaaacccugucuga

SEQ ID NO: 2450925 - RNA, 17 nt, Human
gcccagccaggccccag

SEQ ID NO: 2450926 - RNA, 16 nt, Human
gcccagccaggcccca

SEQ ID NO: 2450927 - RNA, 15 nt, Human
gcccagccaggcccc

SEQ ID NO: 2450928 - RNA, 14 nt, Human
gcccagccaggccc

SEQ ID NO: 2450929 - RNA, 19 nt, Human
gcccagagggccugcaagg

SEQ ID NO: 2450930 - RNA, 18 nt, Human
gcccagagggccugcaag

SEQ ID NO: 2450931 - RNA, 15 nt, Human
gcccagagggccugc

SEQ ID NO: 2450932 - RNA, 14 nt, Human
gcccagagggccug

SEQ ID NO: 2450933 - RNA, 16 nt, Human
gcccagaggagggcag

SEQ ID NO: 2450934 - RNA, 23 nt, Human
gcccagaggagggcagcagaagg

SEQ ID NO: 2450935 - RNA, 17 nt, Human
gcccagagcccagcucc

SEQ ID NO: 2450936 - RNA, 18 nt, Human
gcccagagcccagcucca

SEQ ID NO: 2450937 - RNA, 12 nt, Human
gcccagagggcc

SEQ ID NO: 2450938 - RNA, 13 nt, Human
gcccagagggccc

SEQ ID NO: 2450939 - RNA, 15 nt, Human
gcccagagggcccag

SEQ ID NO: 2450940 - RNA, 16 nt, Human
gcccagagggcccagg

SEQ ID NO: 2450941 - RNA, 20 nt, Human
gcccagagggcccaggcagg

SEQ ID NO: 2450942 - RNA, 15 nt, Human
gcccagagcccagcu

SEQ ID NO: 2450943 - RNA, 16 nt, Human
gcccagagcccagcuc

SEQ ID NO: 2450944 - RNA, 14 nt, Human
gcccagagcccagc

SEQ ID NO: 2450945 - RNA, 13 nt, Human
gcccagagcccag

SEQ ID NO: 2450946 - RNA, 23 nt, Human
gcccagagacauacuugaagggc

SEQ ID NO: 2450947 - RNA, 19 nt, Human
gcccagagacccaagcugc

SEQ ID NO: 2450948 - RNA, 10 nt, Human
gcccagagac

SEQ ID NO: 2450949 - RNA, 20 nt, Human
gcccagagacauacuugaag

SEQ ID NO: 2450950 - RNA, 15 nt, Human
gcccagagaagccaa

SEQ ID NO: 2450951 - RNA, 13 nt, Human
gcccagagaagcc

SEQ ID NO: 2450952 - RNA, 21 nt, Human
gcccaaugcacuuuguucugg

SEQ ID NO: 2450953 - RNA, 19 nt, Human
gcccaauaugcaguucugc

SEQ ID NO: 2450954 - RNA, 21 nt, Human
gcccaaguuguggugcugaca

SEQ ID NO: 2450955 - RNA, 18 nt, Human
gcccaaguuguggugcug

SEQ ID NO: 2450956 - RNA, 20 nt, Human
gcccaaguggcagagcuugg

SEQ ID NO: 2450957 - RNA, 18 nt, Human
gcccaauauuauaauuuu

SEQ ID NO: 2450958 - RNA, 12 nt, Human
gcccaauauuau

SEQ ID NO: 2450959 - RNA, 16 nt, Human
gcccagaccccucugg

SEQ ID NO: 2450960 - RNA, 19 nt, Human
gcccagaccccucuggcca

SEQ ID NO: 2450961 - RNA, 20 nt, Human
gcccagaccccucuggccag

SEQ ID NO: 2450962 - RNA, 21 nt, Human
gcccagaccccucuggccagg

SEQ ID NO: 2450963 - RNA, 20 nt, Human
gcccaauuggaggaaagcaa

SEQ ID NO: 2450964 - RNA, 15 nt, Human
gcccaauuggaggaa

SEQ ID NO: 2450965 - RNA, 14 nt, Human
gcccaauuggagga

SEQ ID NO: 2450966 - RNA, 14 nt, Human
gcccaaugaaauga

SEQ ID NO: 2450967 - RNA, 22 nt, Human
gcccaauucuuacaaacaugug

SEQ ID NO: 2450968 - RNA, 18 nt, Human
gcagagguugcagugagc

SEQ ID NO: 2450969 - RNA, 23 nt, Human
gcagagguaaaagugugagcagu

SEQ ID NO: 2450970 - RNA, 21 nt, Human
gcagagguccacaacacacag

SEQ ID NO: 2450971 - RNA, 12 nt, Human
gcagaggggcuu

SEQ ID NO: 2450972 - RNA, 16 nt, Human
gcagaggggcuuucug

SEQ ID NO: 2450973 - RNA, 18 nt, Human
gcagaggggcuuucugga

SEQ ID NO: 2450974 - RNA, 19 nt, Human
gcagaggggcuuucuggag

SEQ ID NO: 2450975 - RNA, 20 nt, Human
gcagagguaaaagugugagc

SEQ ID NO: 2450976 - RNA, 13 nt, Human
gcagagguaaaag

SEQ ID NO: 2450977 - RNA, 19 nt, Human
gcagagggguaggcagagc

SEQ ID NO: 2450978 - RNA, 20 nt, Human
gcagaggggcaggcccugca

SEQ ID NO: 2450979 - RNA, 20 nt, Human
gcagaggggcuuucuggaga

SEQ ID NO: 2450980 - RNA, 21 nt, Human
gcagaggggcuuucuggagag

SEQ ID NO: 2450981 - RNA, 23 nt, Human
gcagagguugcagugagccgaga

SEQ ID NO: 2450982 - RNA, 18 nt, Human
gcagaggucugugcugag

SEQ ID NO: 2450983 - RNA, 16 nt, Human
gcagaggucugugcug

SEQ ID NO: 2450984 - RNA, 15 nt, Human
gcagaggucugugcu

SEQ ID NO: 2450985 - RNA, 21 nt, Human
gcagagguaaaagugugagca

SEQ ID NO: 2450986 - RNA, 15 nt, Human
gcagagguggccaga

SEQ ID NO: 2450987 - RNA, 14 nt, Human
gcagagguggccag

SEQ ID NO: 2450988 - RNA, 15 nt, Human
gcagauccaggacua

SEQ ID NO: 2450989 - RNA, 23 nt, Human
gcagagguggccagagcugggag

SEQ ID NO: 2450990 - RNA, 14 nt, Human
gcagauccaggacu

SEQ ID NO: 2450991 - RNA, 15 nt, Human
gcagaucccagcuca

SEQ ID NO: 2450992 - RNA, 12 nt, Human
gcagaucccagc

SEQ ID NO: 2450993 - RNA, 14 nt, Human
gcagaucccagcuc

SEQ ID NO: 2450994 - RNA, 13 nt, Human
gcagaucugugcc

SEQ ID NO: 2450995 - RNA, 14 nt, Human
gcagaucugugccc

SEQ ID NO: 2450996 - RNA, 20 nt, Human
gcagaucugugccccaugcc

SEQ ID NO: 2450997 - RNA, 22 nt, Human
gcagaucugugccccaugccug

SEQ ID NO: 2450998 - RNA, 18 nt, Human
gcagauguccuugaugcu

SEQ ID NO: 2450999 - RNA, 13 nt, Human
gcagcagaagggg

SEQ ID NO: 2451000 - RNA, 22 nt, Human
gcagcagaaggggguggugucu

SEQ ID NO: 2451001 - RNA, 15 nt, Human
gcagcagaagggggu

SEQ ID NO: 2451002 - RNA, 20 nt, Human
gcagcagauuuuaggaaaug

SEQ ID NO: 2451003 - RNA, 13 nt, Human
gcagcagauuuua

SEQ ID NO: 2451004 - RNA, 15 nt, Human
gcagcagaggcacug

SEQ ID NO: 2451005 - RNA, 12 nt, Human
gcagcagaggca

SEQ ID NO: 2451006 - RNA, 19 nt, Human
gcagaugagguugcuagag

SEQ ID NO: 2451007 - RNA, 14 nt, Human
gcagaugagguugc

SEQ ID NO: 2451008 - RNA, 13 nt, Human
gcagaugauccau

SEQ ID NO: 2451009 - RNA, 14 nt, Human
gcagaugauccaug

SEQ ID NO: 2451010 - RNA, 15 nt, Human
gcagaugcaaagagg

SEQ ID NO: 2451011 - RNA, 16 nt, Human
gcagaugcaaagaggc

SEQ ID NO: 2451012 - RNA, 13 nt, Human
gcagaugacaaaa

SEQ ID NO: 2451013 - RNA, 15 nt, Human
gcagaugaccccucc

SEQ ID NO: 2451014 - RNA, 16 nt, Human
gcagaugaccccuccc

SEQ ID NO: 2451015 - RNA, 18 nt, Human
gcagauggagaccccuug

SEQ ID NO: 2451016 - RNA, 16 nt, Human
gcacuugcagacucua

SEQ ID NO: 2451017 - RNA, 14 nt, Human
gcacuugcagacuc

SEQ ID NO: 2451018 - RNA, 22 nt, Human
gcacuugcacgcccauguguga

SEQ ID NO: 2451019 - RNA, 21 nt, Human
gcacuugcacgcccaugugug

SEQ ID NO: 2451020 - RNA, 22 nt, Human
gcacuucgggaggucgaggcag

SEQ ID NO: 2451021 - RNA, 22 nt, Human
gcagacucuacagaggccaugg

SEQ ID NO: 2451022 - RNA, 19 nt, Human
gcagacucuacagaggcca

SEQ ID NO: 2451023 - RNA, 18 nt, Human
gcagacucuacagaggcc

SEQ ID NO: 2451024 - RNA, 17 nt, Human
gcagacucuacagaggc

SEQ ID NO: 2451025 - RNA, 23 nt, Human
gcagagaaagaagagacaggagg

SEQ ID NO: 2451026 - RNA, 22 nt, Human
gcagagaaagaagagacaggag

SEQ ID NO: 2451027 - RNA, 18 nt, Human
gcagagaaagaagagaca

SEQ ID NO: 2451028 - RNA, 16 nt, Human
gcagagaaagaagaga

SEQ ID NO: 2451029 - RNA, 15 nt, Human
gcagagaaagaagag

SEQ ID NO: 2451030 - RNA, 19 nt, Human
gcagagaccaucccugaag

SEQ ID NO: 2451031 - RNA, 17 nt, Human
gcagacuggugagcaga

SEQ ID NO: 2451032 - RNA, 13 nt, Human
gcagacugguggg

SEQ ID NO: 2451033 - RNA, 12 nt, Human
gcagacuggagg

SEQ ID NO: 2451034 - RNA, 13 nt, Human
gcagacuggaggg

SEQ ID NO: 2451035 - RNA, 14 nt, Human
gcagacuggagggg

SEQ ID NO: 2451036 - RNA, 15 nt, Human
gcagacuggagggga

SEQ ID NO: 2451037 - RNA, 21 nt, Human
gcagacugcugcuagagccag

SEQ ID NO: 2451038 - RNA, 21 nt, Human
gcagagaccaucccugaaggc

SEQ ID NO: 2451039 - RNA, 20 nt, Human
gcagagaccaucccugaagg

SEQ ID NO: 2451040 - RNA, 22 nt, Human
gcagagaccaucccugaaggcc

SEQ ID NO: 2451041 - RNA, 19 nt, Human
gcagaggggcaggcccugc

SEQ ID NO: 2451042 - RNA, 18 nt, Human
gcagaggggcaggcccug

SEQ ID NO: 2451043 - RNA, 17 nt, Human
gcagaggggcaggcccu

SEQ ID NO: 2451044 - RNA, 12 nt, Human
gcagagacuugg

SEQ ID NO: 2451045 - RNA, 13 nt, Human
gcagaggggcagg

SEQ ID NO: 2451046 - RNA, 17 nt, Human
gcagccucacaguccuu

SEQ ID NO: 2451047 - RNA, 15 nt, Human
gcagccucacagucc

SEQ ID NO: 2451048 - RNA, 16 nt, Human
gcagccgcugagcgag

SEQ ID NO: 2451049 - RNA, 17 nt, Human
gcagccgcugagcgagg

SEQ ID NO: 2451050 - RNA, 18 nt, Human
gcagcccuggagucaugc

SEQ ID NO: 2451051 - RNA, 12 nt, Human
gcagcccuugcu

SEQ ID NO: 2451052 - RNA, 14 nt, Human
gcagccgagcucgu

SEQ ID NO: 2451053 - RNA, 15 nt, Human
gcagcccuuggccag

SEQ ID NO: 2451054 - RNA, 15 nt, Human
gcagccgugaucaag

SEQ ID NO: 2451055 - RNA, 19 nt, Human
gcagccggcacagggucug

SEQ ID NO: 2451056 - RNA, 18 nt, Human
gcagccggcacagggucu

SEQ ID NO: 2451057 - RNA, 19 nt, Human
gcagccucacaguccuuac

SEQ ID NO: 2451058 - RNA, 18 nt, Human
gcagccucccauccaggg

SEQ ID NO: 2451059 - RNA, 20 nt, Human
gcagccucccauccagggcc

SEQ ID NO: 2451060 - RNA, 21 nt, Human
gcagccucccauccagggccc

SEQ ID NO: 2451061 - RNA, 14 nt, Human
gcagccucccucug

SEQ ID NO: 2451062 - RNA, 16 nt, Human
gcagccucccucugac

SEQ ID NO: 2451063 - RNA, 22 nt, Human
gcagccucccucugaccugcag

SEQ ID NO: 2451064 - RNA, 24 nt, Human
gcagcccugcuuugggcugcccug

SEQ ID NO: 2451065 - RNA, 16 nt, Human
gcagcccuggagucau

SEQ ID NO: 2451066 - RNA, 14 nt, Human
gcagcccuggaguc

SEQ ID NO: 2451067 - RNA, 14 nt, Human
gcagcccugcuuug

SEQ ID NO: 2451068 - RNA, 20 nt, Human
gcagcagggagggcuucugc

SEQ ID NO: 2451069 - RNA, 18 nt, Human
gcagcagggagggcuucu

SEQ ID NO: 2451070 - RNA, 19 nt, Human
gcagcagggagggcuucug

SEQ ID NO: 2451071 - RNA, 22 nt, Human
gcagcagccaucauaggaaggg

SEQ ID NO: 2451072 - RNA, 14 nt, Human
gcagcagccaucau

SEQ ID NO: 2451073 - RNA, 16 nt, Human
gcagcaggaggccagg

SEQ ID NO: 2451074 - RNA, 23 nt, Human
gcagcagcuuuuaauacagggua

SEQ ID NO: 2451075 - RNA, 14 nt, Human
gcagcucagagagg

SEQ ID NO: 2451076 - RNA, 21 nt, Human
gcagcucaccucucccuugga

SEQ ID NO: 2451077 - RNA, 20 nt, Human
gcagcucaccucucccuugg

SEQ ID NO: 2451078 - RNA, 17 nt, Human
gcagcucaccucucccu

SEQ ID NO: 2451079 - RNA, 16 nt, Human
gcagccucuccccagg

SEQ ID NO: 2451080 - RNA, 12 nt, Human
gcagccucuccc

SEQ ID NO: 2451081 - RNA, 23 nt, Human
gcagccucccucugaccugcagg

SEQ ID NO: 2451082 - RNA, 15 nt, Human
gcagccuccuccuga

SEQ ID NO: 2451083 - RNA, 14 nt, Human
gcagccuccuccug

SEQ ID NO: 2451084 - RNA, 18 nt, Human
gcagccuccuccugacca

SEQ ID NO: 2451085 - RNA, 16 nt, Human
gcagcucaccucuccc

SEQ ID NO: 2451086 - RNA, 20 nt, Human
gcagccucuccccaggucca

SEQ ID NO: 2451087 - RNA, 19 nt, Human
gcagcucagagaggguggg

SEQ ID NO: 2451088 - RNA, 18 nt, Human
gcagcucagagagggugg

SEQ ID NO: 2451089 - RNA, 15 nt, Human
gcaggaacucccagc

SEQ ID NO: 2451090 - RNA, 14 nt, Human
gcaggaacucccag

SEQ ID NO: 2451091 - RNA, 16 nt, Human
gcaggaacucccagca

SEQ ID NO: 2451092 - RNA, 18 nt, Human
gcaggaagcaacgaaggg

SEQ ID NO: 2451093 - RNA, 23 nt, Human
gcaggaaaugaaaaugucuugug

SEQ ID NO: 2451094 - RNA, 18 nt, Human
gcaggaaauggcugugga

SEQ ID NO: 2451095 - RNA, 16 nt, Human
gcagcucacuacccua

SEQ ID NO: 2451096 - RNA, 12 nt, Human
gcaggaaggaga

SEQ ID NO: 2451097 - RNA, 13 nt, Human
gcaggaaggagag

SEQ ID NO: 2451098 - RNA, 21 nt, Human
gcaggaagcauucagagagca

SEQ ID NO: 2451099 - RNA, 20 nt, Human
gcaggaagcauucagagagc

SEQ ID NO: 2451100 - RNA, 14 nt, Human
gcaggaagcucaga

SEQ ID NO: 2451101 - RNA, 17 nt, Human
gcaggaagcucagacug

SEQ ID NO: 2451102 - RNA, 18 nt, Human
gcaggaagcucagacugg

SEQ ID NO: 2451103 - RNA, 13 nt, Human
gcaggaagcugcu

SEQ ID NO: 2451104 - RNA, 15 nt, Human
gcaggaagcugcucc

SEQ ID NO: 2451105 - RNA, 16 nt, Human
gcaggaagcugcuccg

SEQ ID NO: 2451106 - RNA, 19 nt, Human
gcaggacucagcuccccag

SEQ ID NO: 2451107 - RNA, 21 nt, Human
gcaggaccuucgggcugugcc

SEQ ID NO: 2451108 - RNA, 15 nt, Human
gcaggaaggagagcc

SEQ ID NO: 2451109 - RNA, 20 nt, Human
gcaggaccuucgggcugugc

SEQ ID NO: 2451110 - RNA, 18 nt, Human
gcacuggcucucuccagg

SEQ ID NO: 2451111 - RNA, 17 nt, Human
gcacuggcucucuccag

SEQ ID NO: 2451112 - RNA, 16 nt, Human
gcacuggcucucucca

SEQ ID NO: 2451113 - RNA, 15 nt, Human
gcacuggcucucucc

SEQ ID NO: 2451114 - RNA, 15 nt, Human
gcacuggccugcacg

SEQ ID NO: 2451115 - RNA, 11 nt, Human
gcacuggccug

SEQ ID NO: 2451116 - RNA, 22 nt, Human
gcacugcugugcugugcccaag

SEQ ID NO: 2451117 - RNA, 21 nt, Human
gcacuacaugugguuuauaga

SEQ ID NO: 2451118 - RNA, 20 nt, Human
gcacuaccacuccugccaag

SEQ ID NO: 2451119 - RNA, 23 nt, Human
gcacugggaugagccgcugugag

SEQ ID NO: 2451120 - RNA, 19 nt, Human
gcacuggcucucuccagga

SEQ ID NO: 2451121 - RNA, 12 nt, Human
gcacugggcuug

SEQ ID NO: 2451122 - RNA, 21 nt, Human
gcacuguuccagccugcccuc

SEQ ID NO: 2451123 - RNA, 16 nt, Human
gcacuguuccagccug

SEQ ID NO: 2451124 - RNA, 15 nt, Human
gcacuguucccccug

SEQ ID NO: 2451125 - RNA, 18 nt, Human
gcacuguucccccugugc

SEQ ID NO: 2451126 - RNA, 19 nt, Human
gcacuguucccccugugca

SEQ ID NO: 2451127 - RNA, 20 nt, Human
gcacuguucccccugugcag

SEQ ID NO: 2451128 - RNA, 19 nt, Human
gcacuguuuuauuuuaauu

SEQ ID NO: 2451129 - RNA, 15 nt, Human
gcacugcuuccagug

SEQ ID NO: 2451130 - RNA, 14 nt, Human
gcacugcuuccagu

SEQ ID NO: 2451131 - RNA, 13 nt, Human
gcacugcuuccag

SEQ ID NO: 2451132 - RNA, 12 nt, Human
gcacugcuucca

SEQ ID NO: 2451133 - RNA, 12 nt, Human
gcacuacauuca

SEQ ID NO: 2451134 - RNA, 16 nt, Human
gcacuacauucauuua

SEQ ID NO: 2451135 - RNA, 22 nt, Human
gcacuauaauguaagcucuacu

SEQ ID NO: 2451136 - RNA, 20 nt, Human
gcacuauaauguaagcucua

SEQ ID NO: 2451137 - RNA, 14 nt, Human
gcacuauaauguaa

SEQ ID NO: 2451138 - RNA, 15 nt, Human
gcacuauaauguaag

SEQ ID NO: 2451139 - RNA, 19 nt, Human
gcacuaaggugugcucuga

SEQ ID NO: 2451140 - RNA, 13 nt, Human
gcacuacaugugg

SEQ ID NO: 2451141 - RNA, 16 nt, Human
gcacuacauaaacuga

SEQ ID NO: 2451142 - RNA, 15 nt, Human
gcacuacauaaacug

SEQ ID NO: 2451143 - RNA, 14 nt, Human
gcacuacauaaacu

SEQ ID NO: 2451144 - RNA, 19 nt, Human
gcacuaauuugauguuuac

SEQ ID NO: 2451145 - RNA, 22 nt, Human
gcacuaaaguauguaaaguaug

SEQ ID NO: 2451146 - RNA, 20 nt, Human
gcacuaaaguauguaaagua

SEQ ID NO: 2451147 - RNA, 19 nt, Human
gcacuaaaguauguaaagu

SEQ ID NO: 2451148 - RNA, 20 nt, Human
gcacuaaggugugcucugau

SEQ ID NO: 2451149 - RNA, 14 nt, Human
gcacgugugugcac

SEQ ID NO: 2451150 - RNA, 21 nt, Human
gcacgcuugcguaugucuguu

SEQ ID NO: 2451151 - RNA, 20 nt, Human
gcacgcuugcguaugucugu

SEQ ID NO: 2451152 - RNA, 19 nt, Human
gcacgcuugcguaugucug

SEQ ID NO: 2451153 - RNA, 12 nt, Human
gcacgcuguggg

SEQ ID NO: 2451154 - RNA, 16 nt, Human
gcacgcugugggcagg

SEQ ID NO: 2451155 - RNA, 20 nt, Human
gcacgcugugggcagguggg

SEQ ID NO: 2451156 - RNA, 22 nt, Human
gcacguuaugguguuucucccu

SEQ ID NO: 2451157 - RNA, 23 nt, Human
gcacgugggucuucagggggcca

SEQ ID NO: 2451158 - RNA, 14 nt, Human
gcacuaaagcagug

SEQ ID NO: 2451159 - RNA, 20 nt, Human
gcacuaaagcaguggacacc

SEQ ID NO: 2451160 - RNA, 16 nt, Human
gcacccgccucucccg

SEQ ID NO: 2451161 - RNA, 15 nt, Human
gcacccgccucuccc

SEQ ID NO: 2451162 - RNA, 13 nt, Human
gcacccgccucuc

SEQ ID NO: 2451163 - RNA, 22 nt, Human
gcaccccuucucuccuccccaa

SEQ ID NO: 2451164 - RNA, 21 nt, Human
gcaccccuucucuccucccca

SEQ ID NO: 2451165 - RNA, 20 nt, Human
gcaccccuucucuccucccc

SEQ ID NO: 2451166 - RNA, 19 nt, Human
gcaccccuucucuccuccc

SEQ ID NO: 2451167 - RNA, 18 nt, Human
gcaccccuucucuccucc

SEQ ID NO: 2451168 - RNA, 16 nt, Human
gcaccccuuccaugug

SEQ ID NO: 2451169 - RNA, 13 nt, Human
gcaccccuuccau

SEQ ID NO: 2451170 - RNA, 17 nt, Human
gcaccccuucucuccuc

SEQ ID NO: 2451171 - RNA, 13 nt, Human
gcaccccuucucu

SEQ ID NO: 2451172 - RNA, 12 nt, Human
gcaccccuucuc

SEQ ID NO: 2451173 - RNA, 16 nt, Human
gcacccucaggcaggu

SEQ ID NO: 2451174 - RNA, 19 nt, Human
gcacccucaggcagguggg

SEQ ID NO: 2451175 - RNA, 22 nt, Human
gcacgcccaugugugagugugu

SEQ ID NO: 2451176 - RNA, 12 nt, Human
gcacgcaguggc

SEQ ID NO: 2451177 - RNA, 15 nt, Human
gcacgcccaugugug

SEQ ID NO: 2451178 - RNA, 17 nt, Human
gcacgcccaugugugag

SEQ ID NO: 2451179 - RNA, 18 nt, Human
gcacgcccaugugugagu

SEQ ID NO: 2451180 - RNA, 16 nt, Human
gcacgcacacacacaa

SEQ ID NO: 2451181 - RNA, 17 nt, Human
gcacccuccccucccgu

SEQ ID NO: 2451182 - RNA, 15 nt, Human
gcacccuccccuccc

SEQ ID NO: 2451183 - RNA, 14 nt, Human
gcacccuccccucc

SEQ ID NO: 2451184 - RNA, 13 nt, Human
gcacccuccccuc

SEQ ID NO: 2451185 - RNA, 22 nt, Human
gcacccuccacccuguccccca

SEQ ID NO: 2451186 - RNA, 19 nt, Human
gcacccuccacccuguccc

SEQ ID NO: 2451187 - RNA, 18 nt, Human
gcacccuccacccugucc

SEQ ID NO: 2451188 - RNA, 17 nt, Human
gcacccuccacccuguc

SEQ ID NO: 2451189 - RNA, 16 nt, Human
gcacccuccacccugu

SEQ ID NO: 2451190 - RNA, 15 nt, Human
gcacccuccacccug

SEQ ID NO: 2451191 - RNA, 14 nt, Human
gcacccuccacccu

SEQ ID NO: 2451192 - RNA, 13 nt, Human
gcacccuccaccc

SEQ ID NO: 2451193 - RNA, 18 nt, Human
gcacccccuccugcugca

SEQ ID NO: 2451194 - RNA, 17 nt, Human
gcacccccuccugcugc

SEQ ID NO: 2451195 - RNA, 19 nt, Human
gcacccccuccugcugcag

SEQ ID NO: 2451196 - RNA, 16 nt, Human
gcacccccuccugcug

SEQ ID NO: 2451197 - RNA, 15 nt, Human
gcacccccuccugcu

SEQ ID NO: 2451198 - RNA, 19 nt, Human
gcaccauccgccagggccc

SEQ ID NO: 2451199 - RNA, 12 nt, Human
gcacccccuccu

SEQ ID NO: 2451200 - RNA, 14 nt, Human
gcacccccuggaga

SEQ ID NO: 2451201 - RNA, 13 nt, Human
gcaccccugucuc

SEQ ID NO: 2451202 - RNA, 13 nt, Human
gcaccccucccau

SEQ ID NO: 2451203 - RNA, 13 nt, Human
gcaccauccgcca

SEQ ID NO: 2451204 - RNA, 22 nt, Human
gcaccaucccuuuuugaagugu

SEQ ID NO: 2451205 - RNA, 21 nt, Human
gcaccaucccuuuuugaagug

SEQ ID NO: 2451206 - RNA, 21 nt, Human
gcaccagaggcugcagaaggc

SEQ ID NO: 2451207 - RNA, 18 nt, Human
gcaccauccgccagggcc

SEQ ID NO: 2451208 - RNA, 17 nt, Human
gcaccauccgccagggc

SEQ ID NO: 2451209 - RNA, 20 nt, Human
gcaccaucucugauuuucaa

SEQ ID NO: 2451210 - RNA, 17 nt, Human
gcaccaucucuccuccu

SEQ ID NO: 2451211 - RNA, 15 nt, Human
gcaccaucucuccuc

SEQ ID NO: 2451212 - RNA, 14 nt, Human
gcaccaucucuccu

SEQ ID NO: 2451213 - RNA, 14 nt, Human
gcaccagcagccug

SEQ ID NO: 2451214 - RNA, 21 nt, Human
gcaccagacacccaggacuua

SEQ ID NO: 2451215 - RNA, 15 nt, Human
gcaccagaggcugca

SEQ ID NO: 2451216 - RNA, 13 nt, Human
gcaccagcagccu

SEQ ID NO: 2451217 - RNA, 17 nt, Human
gcacagggucugcucuu

SEQ ID NO: 2451218 - RNA, 12 nt, Human
gcacagggucug

SEQ ID NO: 2451219 - RNA, 23 nt, Human
gcacagggucugcucuuucucug

SEQ ID NO: 2451220 - RNA, 18 nt, Human
gcacagggucugcucuuu

SEQ ID NO: 2451221 - RNA, 22 nt, Human
gcaccaacccagccgcugcccg

SEQ ID NO: 2451222 - RNA, 20 nt, Human
gcaccaacccagccgcugcc

SEQ ID NO: 2451223 - RNA, 18 nt, Human
gcaccaacccagccgcug

SEQ ID NO: 2451224 - RNA, 17 nt, Human
gcaccaacccagccgcu

SEQ ID NO: 2451225 - RNA, 16 nt, Human
gcaccaacccagccgc

SEQ ID NO: 2451226 - RNA, 15 nt, Human
gcaccaacccagccg

SEQ ID NO: 2451227 - RNA, 14 nt, Human
gcaccaacccagcc

SEQ ID NO: 2451228 - RNA, 19 nt, Human
gcaccaaaauaagaaaaga

SEQ ID NO: 2451229 - RNA, 20 nt, Human
gcaccaaaauaagaaaagau

SEQ ID NO: 2451230 - RNA, 17 nt, Human
gcaccaccaagccaagg

SEQ ID NO: 2451231 - RNA, 14 nt, Human
gcaccagacaccca

SEQ ID NO: 2451232 - RNA, 14 nt, Human
gcaccaccaagcca

SEQ ID NO: 2451233 - RNA, 15 nt, Human
gcaccagacacccag

SEQ ID NO: 2451234 - RNA, 16 nt, Human
gcaccagacacccagg

SEQ ID NO: 2451235 - RNA, 17 nt, Human
gcaccagacacccagga

SEQ ID NO: 2451236 - RNA, 18 nt, Human
gcaccagacacccaggac

SEQ ID NO: 2451237 - RNA, 19 nt, Human
gcaccagacacccaggacu

SEQ ID NO: 2451238 - RNA, 20 nt, Human
gcaccagacacccaggacuu

SEQ ID NO: 2451239 - RNA, 13 nt, Human
gcaccaccaagcc

SEQ ID NO: 2451240 - RNA, 17 nt, Human
gcaccacacucagcccu

SEQ ID NO: 2451241 - RNA, 15 nt, Human
gcaccacacucagcc

SEQ ID NO: 2451242 - RNA, 15 nt, Human
gcaccaagcaggaaa

SEQ ID NO: 2451243 - RNA, 18 nt, Human
gcacagccucuuagaugc

SEQ ID NO: 2451244 - RNA, 21 nt, Human
gcacagcuucauuuccugugu

SEQ ID NO: 2451245 - RNA, 22 nt, Human
gcacagcccucccgccccuucc

SEQ ID NO: 2451246 - RNA, 21 nt, Human
gcacagcccucccgccccuuc

SEQ ID NO: 2451247 - RNA, 19 nt, Human
gcacagcccucccgccccu

SEQ ID NO: 2451248 - RNA, 18 nt, Human
gcacagcccucccgcccc

SEQ ID NO: 2451249 - RNA, 14 nt, Human
gcacagcuugaccu

SEQ ID NO: 2451250 - RNA, 23 nt, Human
gcacagcuucauuuccugugucu

SEQ ID NO: 2451251 - RNA, 19 nt, Human
gcacagggcagcugggccc

SEQ ID NO: 2451252 - RNA, 18 nt, Human
gcacagggcagcugggcc

SEQ ID NO: 2451253 - RNA, 20 nt, Human
gcacagggcagcugggccca

SEQ ID NO: 2451254 - RNA, 17 nt, Human
gcacagggcagcugggc

SEQ ID NO: 2451255 - RNA, 16 nt, Human
gcacagggcagcuggg

SEQ ID NO: 2451256 - RNA, 15 nt, Human
gcacagggcagcugg

SEQ ID NO: 2451257 - RNA, 16 nt, Human
gcacagggcaguggga

SEQ ID NO: 2451258 - RNA, 21 nt, Human
gcacagcuugaccugaggcug

SEQ ID NO: 2451259 - RNA, 20 nt, Human
gcacagcuugaccugaggcu

SEQ ID NO: 2451260 - RNA, 19 nt, Human
gcacagcuugaccugaggc

SEQ ID NO: 2451261 - RNA, 18 nt, Human
gcacagcuugaccugagg

SEQ ID NO: 2451262 - RNA, 22 nt, Human
gcacagcuugaccugaggcugu

SEQ ID NO: 2451263 - RNA, 22 nt, Human
gcacagcaaggaggcuggcugg

SEQ ID NO: 2451264 - RNA, 19 nt, Human
gcacagcaaggaggcuggc

SEQ ID NO: 2451265 - RNA, 17 nt, Human
gcacagcaaggaggcug

SEQ ID NO: 2451266 - RNA, 14 nt, Human
gcacagcaaggagg

SEQ ID NO: 2451267 - RNA, 13 nt, Human
gcacagcagcauc

SEQ ID NO: 2451268 - RNA, 22 nt, Human
gcacagcagccuggggcuggcc

SEQ ID NO: 2451269 - RNA, 20 nt, Human
gauugugucucuugguccug

SEQ ID NO: 2451270 - RNA, 14 nt, Human
gauuguuaaaauaa

SEQ ID NO: 2451271 - RNA, 16 nt, Human
gcacagcaguuccgga

SEQ ID NO: 2451272 - RNA, 22 nt, Human
gcacagcaugagaggcucugug

SEQ ID NO: 2451273 - RNA, 15 nt, Human
gcacagccaaggacu

SEQ ID NO: 2451274 - RNA, 22 nt, Human
gcacagccaacacgcaccugcc

SEQ ID NO: 2451275 - RNA, 13 nt, Human
gcacagcaguucc

SEQ ID NO: 2451276 - RNA, 23 nt, Human
gcacagcaaggaggcuggcuggg

SEQ ID NO: 2451277 - RNA, 15 nt, Human
gcacagcagccuggg

SEQ ID NO: 2451278 - RNA, 15 nt, Human
gcacagccucuuaga

SEQ ID NO: 2451279 - RNA, 17 nt, Human
gcacagcccucccgccc

SEQ ID NO: 2451280 - RNA, 16 nt, Human
gcacagcccucccgcc

SEQ ID NO: 2451281 - RNA, 13 nt, Human
gcacagcccuccc

SEQ ID NO: 2451282 - RNA, 12 nt, Human
gcacagcccucc

SEQ ID NO: 2451283 - RNA, 11 nt, Human
gcacagcccuc

SEQ ID NO: 2451284 - RNA, 21 nt, Human
gcacagccauacggcacugaa

SEQ ID NO: 2451285 - RNA, 17 nt, Human
gcacagcccaaagaagg

SEQ ID NO: 2451286 - RNA, 21 nt, Human
gcaugccccggccaccucugc

SEQ ID NO: 2451287 - RNA, 20 nt, Human
gcaugccccggccaccucug

SEQ ID NO: 2451288 - RNA, 19 nt, Human
gcaugccccggccaccucu

SEQ ID NO: 2451289 - RNA, 18 nt, Human
gcaugccccggccaccuc

SEQ ID NO: 2451290 - RNA, 23 nt, Human
gcaugccccggccaccucugcgg

SEQ ID NO: 2451291 - RNA, 22 nt, Human
gcaugccccggccaccucugcg

SEQ ID NO: 2451292 - RNA, 14 nt, Human
gcaugccuggaugg

SEQ ID NO: 2451293 - RNA, 14 nt, Human
gcaugacauuucuu

SEQ ID NO: 2451294 - RNA, 17 nt, Human
gcaugccccggccaccu

SEQ ID NO: 2451295 - RNA, 16 nt, Human
gcaugccccggccacc

SEQ ID NO: 2451296 - RNA, 14 nt, Human
gcaugccccggcca

SEQ ID NO: 2451297 - RNA, 20 nt, Human
gcaugcccccucgugccagu

SEQ ID NO: 2451298 - RNA, 19 nt, Human
gcaugcccccucgugccag

SEQ ID NO: 2451299 - RNA, 18 nt, Human
gcaugcccccucgugcca

SEQ ID NO: 2451300 - RNA, 18 nt, Human
gcauguuaccuccuauaa

SEQ ID NO: 2451301 - RNA, 13 nt, Human
gcauguuacauaa

SEQ ID NO: 2451302 - RNA, 15 nt, Human
gcaugccuggauggg

SEQ ID NO: 2451303 - RNA, 21 nt, Human
gcauguguauuuccagugcaa

SEQ ID NO: 2451304 - RNA, 19 nt, Human
gcaugugugcgagugugug

SEQ ID NO: 2451305 - RNA, 11 nt, Human
gcaugugugug

SEQ ID NO: 2451306 - RNA, 16 nt, Human
gcaugugugugcucag

SEQ ID NO: 2451307 - RNA, 14 nt, Human
gcaugugugugcuc

SEQ ID NO: 2451308 - RNA, 19 nt, Human
gcauguguuugguucuggg

SEQ ID NO: 2451309 - RNA, 23 nt, Human
gcauuauguccacuguguauaga

SEQ ID NO: 2451310 - RNA, 19 nt, Human
gcauuauguccacugugua

SEQ ID NO: 2451311 - RNA, 19 nt, Human
gcauuaucuagauacugua

SEQ ID NO: 2451312 - RNA, 15 nt, Human
gcauuacgugagcca

SEQ ID NO: 2451313 - RNA, 22 nt, Human
gcauuaucuagauacuguauca

SEQ ID NO: 2451314 - RNA, 24 nt, Human
gcauuaucuagauacuguaucaug

SEQ ID NO: 2451315 - RNA, 23 nt, Human
gcauuaccgcguuguaaaauaua

SEQ ID NO: 2451316 - RNA, 20 nt, Human
gcauuaccgcguuguaaaau

SEQ ID NO: 2451317 - RNA, 19 nt, Human
gcauuaccgcguuguaaaa

SEQ ID NO: 2451318 - RNA, 18 nt, Human
gcauuaccgcguuguaaa

SEQ ID NO: 2451319 - RNA, 19 nt, Human
gcauuacagagaggagaaa

SEQ ID NO: 2451320 - RNA, 16 nt, Human
gcauuacauuuccaaa

SEQ ID NO: 2451321 - RNA, 14 nt, Human
gcauuaacuaaucu

SEQ ID NO: 2451322 - RNA, 18 nt, Human
gcauuaacuaaucuauug

SEQ ID NO: 2451323 - RNA, 22 nt, Human
gcauuaacuaaucuauuggguu

SEQ ID NO: 2451324 - RNA, 16 nt, Human
gcauuaacuucucugg

SEQ ID NO: 2451325 - RNA, 14 nt, Human
gcauuaacuucucu

SEQ ID NO: 2451326 - RNA, 14 nt, Human
gcauuacagagagg

SEQ ID NO: 2451327 - RNA, 23 nt, Human
gcauuaaauuuuagcaaagauau

SEQ ID NO: 2451328 - RNA, 18 nt, Human
gcauuaaauucacaaacu

SEQ ID NO: 2451329 - RNA, 22 nt, Human
gcauuaaauucacaaacuuuua

SEQ ID NO: 2451330 - RNA, 16 nt, Human
gcauguuccacuaacc

SEQ ID NO: 2451331 - RNA, 19 nt, Human
gcauuaaauauaauaugca

SEQ ID NO: 2451332 - RNA, 20 nt, Human
gcauguguuugguucugggg

SEQ ID NO: 2451333 - RNA, 22 nt, Human
gcauguguuugguucuggggcc

SEQ ID NO: 2451334 - RNA, 21 nt, Human
gcauuccccaggaggccagcc

SEQ ID NO: 2451335 - RNA, 20 nt, Human
gcauuccccaggaggccagc

SEQ ID NO: 2451336 - RNA, 19 nt, Human
gcauuccccaggaggccag

SEQ ID NO: 2451337 - RNA, 18 nt, Human
gcauuccccaggaggcca

SEQ ID NO: 2451338 - RNA, 17 nt, Human
gcauuccccaggaggcc

SEQ ID NO: 2451339 - RNA, 16 nt, Human
gcauuccccaggaggc

SEQ ID NO: 2451340 - RNA, 15 nt, Human
gcauuccccaggagg

SEQ ID NO: 2451341 - RNA, 14 nt, Human
gcauuccccaggag

SEQ ID NO: 2451342 - RNA, 18 nt, Human
gcauuugaggucuguucu

SEQ ID NO: 2451343 - RNA, 14 nt, Human
gcauuugagaaaug

SEQ ID NO: 2451344 - RNA, 13 nt, Human
gcauuugagaaau

SEQ ID NO: 2451345 - RNA, 22 nt, Human
gcauugagaacugcauauguuu

SEQ ID NO: 2451346 - RNA, 23 nt, Human
gcauugaccgcgacuaauuucaa

SEQ ID NO: 2451347 - RNA, 22 nt, Human
gcauugaccgcgacuaauuuca

SEQ ID NO: 2451348 - RNA, 19 nt, Human
gcauuccuucuuugauaau

SEQ ID NO: 2451349 - RNA, 16 nt, Human
gcauugaauauauuau

SEQ ID NO: 2451350 - RNA, 12 nt, Human
gcauugagaacu

SEQ ID NO: 2451351 - RNA, 21 nt, Human
gcauugagaacugcauauguu

SEQ ID NO: 2451352 - RNA, 22 nt, Human
gcauugaacacaaacuguaaau

SEQ ID NO: 2451353 - RNA, 23 nt, Human
gcauugaacacaaacuguaaaua

SEQ ID NO: 2451354 - RNA, 13 nt, Human
gcauuccuucuuu

SEQ ID NO: 2451355 - RNA, 22 nt, Human
gcauuccugauaugauuuaaaa

SEQ ID NO: 2451356 - RNA, 21 nt, Human
gcauuccugauaugauuuaaa

SEQ ID NO: 2451357 - RNA, 19 nt, Human
gcauuccugauaugauuua

SEQ ID NO: 2451358 - RNA, 15 nt, Human
gcauuccuucuuuga

SEQ ID NO: 2451359 - RNA, 14 nt, Human
gcauuccuucuuug

SEQ ID NO: 2451360 - RNA, 21 nt, Human
gcauugaacacaaacuguaaa

SEQ ID NO: 2451361 - RNA, 22 nt, Human
gcauuccccaggaggccagccu

SEQ ID NO: 2451362 - RNA, 22 nt, Human
gcauuauguccacuguguauag

SEQ ID NO: 2451363 - RNA, 21 nt, Human
gcauuauguccacuguguaua

SEQ ID NO: 2451364 - RNA, 13 nt, Human
gcauucccugagu

SEQ ID NO: 2451365 - RNA, 14 nt, Human
gcauucccugaguc

SEQ ID NO: 2451366 - RNA, 21 nt, Human
gcauucccugagucaccagga

SEQ ID NO: 2451367 - RNA, 22 nt, Human
gcauucccugagucaccaggaa

SEQ ID NO: 2451368 - RNA, 16 nt, Human
gcauuccuacaaagau

SEQ ID NO: 2451369 - RNA, 19 nt, Human
gcauuccuacaaagauguu

SEQ ID NO: 2451370 - RNA, 22 nt, Human
gcaugacacgaauauugcugau

SEQ ID NO: 2451371 - RNA, 13 nt, Human
gcaucuguccuca

SEQ ID NO: 2451372 - RNA, 22 nt, Human
gcaucuguauaaguaagaaaau

SEQ ID NO: 2451373 - RNA, 21 nt, Human
gcaucuguauaaguaagaaaa

SEQ ID NO: 2451374 - RNA, 23 nt, Human
gcaucuguauaaguaagaaaaua

SEQ ID NO: 2451375 - RNA, 21 nt, Human
gcaugacacgaauauugcuga

SEQ ID NO: 2451376 - RNA, 20 nt, Human
gcaugacacgaauauugcug

SEQ ID NO: 2451377 - RNA, 21 nt, Human
gcaugaaguaauaugcacaca

SEQ ID NO: 2451378 - RNA, 22 nt, Human
gcaugaaguaauaugcacacau

SEQ ID NO: 2451379 - RNA, 20 nt, Human
gcaugaaguaauaugcacac

SEQ ID NO: 2451380 - RNA, 13 nt, Human
gcaucuguauaag

SEQ ID NO: 2451381 - RNA, 11 nt, Human
gcaucuguaua

SEQ ID NO: 2451382 - RNA, 17 nt, Human
gcaucuggguagcugua

SEQ ID NO: 2451383 - RNA, 18 nt, Human
gcaucugcuaauaaaacc

SEQ ID NO: 2451384 - RNA, 18 nt, Human
gcaucugccccuccccca

SEQ ID NO: 2451385 - RNA, 23 nt, Human
gcaucugggauucccaccaaggu

SEQ ID NO: 2451386 - RNA, 20 nt, Human
gcaucugggauucccaccaa

SEQ ID NO: 2451387 - RNA, 16 nt, Human
gcaucugggauuccca

SEQ ID NO: 2451388 - RNA, 12 nt, Human
gcaucugccccu

SEQ ID NO: 2451389 - RNA, 14 nt, Human
gcaucugccccucc

SEQ ID NO: 2451390 - RNA, 15 nt, Human
gcaucugccccuccc

SEQ ID NO: 2451391 - RNA, 17 nt, Human
gcaucugccccuccccc

SEQ ID NO: 2451392 - RNA, 12 nt, Human
gcaucuccagga

SEQ ID NO: 2451393 - RNA, 20 nt, Human
gcaucuccaccugcucccag

SEQ ID NO: 2451394 - RNA, 18 nt, Human
gcaucuccaccugcuccc

SEQ ID NO: 2451395 - RNA, 17 nt, Human
gcaucuccaccugcucc

SEQ ID NO: 2451396 - RNA, 15 nt, Human
gcaucuccaccugcu

SEQ ID NO: 2451397 - RNA, 15 nt, Human
gcaucucagcccaca

SEQ ID NO: 2451398 - RNA, 14 nt, Human
gcaucuccaggaag

SEQ ID NO: 2451399 - RNA, 13 nt, Human
gcaucuccaggaa

SEQ ID NO: 2451400 - RNA, 12 nt, Human
gcaucucccaga

SEQ ID NO: 2451401 - RNA, 13 nt, Human
gcaucucccagau

SEQ ID NO: 2451402 - RNA, 21 nt, Human
gcaucucccagauaaugugaa

SEQ ID NO: 2451403 - RNA, 20 nt, Human
gcaucucccucacugaaacc

SEQ ID NO: 2451404 - RNA, 16 nt, Human
gcaucuccugugcaug

SEQ ID NO: 2451405 - RNA, 17 nt, Human
gcaucucccucacugaa

SEQ ID NO: 2451406 - RNA, 16 nt, Human
gcaucuccaggaaggc

SEQ ID NO: 2451407 - RNA, 15 nt, Human
gcaucuccugugcau

SEQ ID NO: 2451408 - RNA, 23 nt, Human
gcaucagcugcugaaacaacaaa

SEQ ID NO: 2451409 - RNA, 12 nt, Human
gcaucaggccag

SEQ ID NO: 2451410 - RNA, 22 nt, Human
gcaucagcugcugaaacaacaa

SEQ ID NO: 2451411 - RNA, 17 nt, Human
gcauacuucaaaaguau

SEQ ID NO: 2451412 - RNA, 16 nt, Human
gcauacuucaaaagua

SEQ ID NO: 2451413 - RNA, 14 nt, Human
gcauacuucaaaag

SEQ ID NO: 2451414 - RNA, 13 nt, Human
gcauacuucaaaa

SEQ ID NO: 2451415 - RNA, 18 nt, Human
gcaucaggccaggcccuc

SEQ ID NO: 2451416 - RNA, 21 nt, Human
gcaucagcuggcgucaugcaa

SEQ ID NO: 2451417 - RNA, 17 nt, Human
gcaucagcuggcgucau

SEQ ID NO: 2451418 - RNA, 18 nt, Human
gcauacuucaaaaguauu

SEQ ID NO: 2451419 - RNA, 23 nt, Human
gcaucaggccaggcccucugccc

SEQ ID NO: 2451420 - RNA, 12 nt, Human
gcaucaggguua

SEQ ID NO: 2451421 - RNA, 15 nt, Human
gcaucagugcccucc

SEQ ID NO: 2451422 - RNA, 13 nt, Human
gcaucauggcuau

SEQ ID NO: 2451423 - RNA, 20 nt, Human
gcaucauucuuguuaauuau

SEQ ID NO: 2451424 - RNA, 20 nt, Human
gcaucauuuugcauucaaau

SEQ ID NO: 2451425 - RNA, 22 nt, Human
gcaucauuauuugcagagacag

SEQ ID NO: 2451426 - RNA, 19 nt, Human
gcaucagucccuauguauu

SEQ ID NO: 2451427 - RNA, 23 nt, Human
gcaucagugcccuccaggauaga

SEQ ID NO: 2451428 - RNA, 12 nt, Human
gcaucucagccc

SEQ ID NO: 2451429 - RNA, 17 nt, Human
gcauccaccuccuucuc

SEQ ID NO: 2451430 - RNA, 14 nt, Human
gcaucucagcccac

SEQ ID NO: 2451431 - RNA, 13 nt, Human
gcaucucagccca

SEQ ID NO: 2451432 - RNA, 14 nt, Human
gcaucuaucucauc

SEQ ID NO: 2451433 - RNA, 12 nt, Human
gcauccaccucc

SEQ ID NO: 2451434 - RNA, 15 nt, Human
gcauccaaaggugcu

SEQ ID NO: 2451435 - RNA, 16 nt, Human
gcauccaccuccuucu

SEQ ID NO: 2451436 - RNA, 15 nt, Human
gcauccaccuccuuc

SEQ ID NO: 2451437 - RNA, 20 nt, Human
gcaguggugguuuucuguuc

SEQ ID NO: 2451438 - RNA, 21 nt, Human
gcaguggugguuuucuguucu

SEQ ID NO: 2451439 - RNA, 21 nt, Human
gcaguggugcgaucuggguuc

SEQ ID NO: 2451440 - RNA, 20 nt, Human
gcaguggugcgaucuggguu

SEQ ID NO: 2451441 - RNA, 19 nt, Human
gcaguggugguuuucuguu

SEQ ID NO: 2451442 - RNA, 22 nt, Human
gcaguggugcgaucuggguuca

SEQ ID NO: 2451443 - RNA, 20 nt, Human
gcaguucccccaaccucaga

SEQ ID NO: 2451444 - RNA, 16 nt, Human
gcauacuaauaaagua

SEQ ID NO: 2451445 - RNA, 21 nt, Human
gcaguugaaaagacuccaaag

SEQ ID NO: 2451446 - RNA, 19 nt, Human
gcauacguacacauuuuau

SEQ ID NO: 2451447 - RNA, 16 nt, Human
gcaguugaaaagacuc

SEQ ID NO: 2451448 - RNA, 19 nt, Human
gcaguugaaaagacuccaa

SEQ ID NO: 2451449 - RNA, 23 nt, Human
gcaguucccccaaccucagacuu

SEQ ID NO: 2451450 - RNA, 17 nt, Human
gcaguucagcaccaccc

SEQ ID NO: 2451451 - RNA, 19 nt, Human
gcaguucagcaccacccua

SEQ ID NO: 2451452 - RNA, 19 nt, Human
gcaguggugcgaucugggu

SEQ ID NO: 2451453 - RNA, 18 nt, Human
gcaguggugcgaucuggg

SEQ ID NO: 2451454 - RNA, 17 nt, Human
gcagugggccuggccag

SEQ ID NO: 2451455 - RNA, 21 nt, Human
gcagugggucccacuuccccu

SEQ ID NO: 2451456 - RNA, 19 nt, Human
gcagugggucccacuuccc

SEQ ID NO: 2451457 - RNA, 18 nt, Human
gcagugggucccacuucc

SEQ ID NO: 2451458 - RNA, 11 nt, Human
gcagugggucc

SEQ ID NO: 2451459 - RNA, 23 nt, Human
gcagugggucccacuuccccucc

SEQ ID NO: 2451460 - RNA, 22 nt, Human
gcagugggucccacuuccccuc

SEQ ID NO: 2451461 - RNA, 18 nt, Human
gcagugguaagcucuggc

SEQ ID NO: 2451462 - RNA, 19 nt, Human
gcaguggcugguccagggc

SEQ ID NO: 2451463 - RNA, 18 nt, Human
gcaguggcugguccaggg

SEQ ID NO: 2451464 - RNA, 15 nt, Human
gcaguggcuggucca

SEQ ID NO: 2451465 - RNA, 14 nt, Human
gcaguggcuggucc

SEQ ID NO: 2451466 - RNA, 20 nt, Human
gcaguggcugguccagggcu

SEQ ID NO: 2451467 - RNA, 21 nt, Human
gcagugggacagggcauggcc

SEQ ID NO: 2451468 - RNA, 16 nt, Human
gcagugggccuggcca

SEQ ID NO: 2451469 - RNA, 15 nt, Human
gcagugggccuggcc

SEQ ID NO: 2451470 - RNA, 11 nt, Human
gcagugggagc

SEQ ID NO: 2451471 - RNA, 19 nt, Human
gcaggucccuaauaaagcu

SEQ ID NO: 2451472 - RNA, 18 nt, Human
gcaggucccuaauaaagc

SEQ ID NO: 2451473 - RNA, 17 nt, Human
gcaggucccuaauaaag

SEQ ID NO: 2451474 - RNA, 16 nt, Human
gcaggucccuaauaaa

SEQ ID NO: 2451475 - RNA, 21 nt, Human
gcaggucccuaauaaagcugu

SEQ ID NO: 2451476 - RNA, 20 nt, Human
gcaggucccuaauaaagcug

SEQ ID NO: 2451477 - RNA, 23 nt, Human
gcaggucccuaauaaagcugugu

SEQ ID NO: 2451478 - RNA, 16 nt, Human
gcaguggcucacgccu

SEQ ID NO: 2451479 - RNA, 21 nt, Human
gcagggucccauuucucacug

SEQ ID NO: 2451480 - RNA, 17 nt, Human
gcagggucaggagaggg

SEQ ID NO: 2451481 - RNA, 19 nt, Human
gcagggcucugccccagag

SEQ ID NO: 2451482 - RNA, 21 nt, Human
gcagggcucugccccagaggc

SEQ ID NO: 2451483 - RNA, 23 nt, Human
gcagggcucucuuuccuucuugc

SEQ ID NO: 2451484 - RNA, 16 nt, Human
gcagggcucugcccca

SEQ ID NO: 2451485 - RNA, 12 nt, Human
gcagggcucuga

SEQ ID NO: 2451486 - RNA, 22 nt, Human
gcaggggaggguagagcggaga

SEQ ID NO: 2451487 - RNA, 14 nt, Human
gcagggucaggaga

SEQ ID NO: 2451488 - RNA, 15 nt, Human
gcagggguugcagug

SEQ ID NO: 2451489 - RNA, 15 nt, Human
gcagggucaggagag

SEQ ID NO: 2451490 - RNA, 16 nt, Human
gcagggucaggagagg

SEQ ID NO: 2451491 - RNA, 15 nt, Human
gcaggucccuaauaa

SEQ ID NO: 2451492 - RNA, 14 nt, Human
gcaggucccuaaua

SEQ ID NO: 2451493 - RNA, 16 nt, Human
gcagggucucacucug

SEQ ID NO: 2451494 - RNA, 19 nt, Human
gcaggguccuagaaauucc

SEQ ID NO: 2451495 - RNA, 14 nt, Human
gcagggcucaggau

SEQ ID NO: 2451496 - RNA, 13 nt, Human
gcagggcucagga

SEQ ID NO: 2451497 - RNA, 21 nt, Human
gcagggcucaggauuucgugg

SEQ ID NO: 2451498 - RNA, 12 nt, Human
gcagggcucagg

SEQ ID NO: 2451499 - RNA, 15 nt, Human
gcagggauuugagga

SEQ ID NO: 2451500 - RNA, 22 nt, Human
gcagggauugcugccacuuuuu

SEQ ID NO: 2451501 - RNA, 19 nt, Human
gcagggauugcugccacuu

SEQ ID NO: 2451502 - RNA, 14 nt, Human
gcagggauuugagg

SEQ ID NO: 2451503 - RNA, 15 nt, Human
gcagggauugcugcc

SEQ ID NO: 2451504 - RNA, 22 nt, Human
gcagggauuaaccucugcacua

SEQ ID NO: 2451505 - RNA, 19 nt, Human
gcagggauuaaccucugca

SEQ ID NO: 2451506 - RNA, 14 nt, Human
gcagggauccuggu

SEQ ID NO: 2451507 - RNA, 13 nt, Human
gcagggaugcccu

SEQ ID NO: 2451508 - RNA, 21 nt, Human
gcagggaugcccuggaggugg

SEQ ID NO: 2451509 - RNA, 23 nt, Human
gcagggaugcccuggagguggcu

SEQ ID NO: 2451510 - RNA, 14 nt, Human
gcagggaggggacu

SEQ ID NO: 2451511 - RNA, 15 nt, Human
gcagggaggggacua

SEQ ID NO: 2451512 - RNA, 21 nt, Human
gcaggcccugcacuguccugc

SEQ ID NO: 2451513 - RNA, 23 nt, Human
gcaggccucgaaaaccaucacau

SEQ ID NO: 2451514 - RNA, 23 nt, Human
gcaggcggugggcacccacccug

SEQ ID NO: 2451515 - RNA, 16 nt, Human
gcaggcggugggcacc

SEQ ID NO: 2451516 - RNA, 15 nt, Human
gcaggcggugggcac

SEQ ID NO: 2451517 - RNA, 14 nt, Human
gcaggcggugggca

SEQ ID NO: 2451518 - RNA, 21 nt, Human
gcaggcagcgccaagcaaccu

SEQ ID NO: 2451519 - RNA, 18 nt, Human
gcaggcagcgccaagcaa

SEQ ID NO: 2451520 - RNA, 22 nt, Human
gcaggcagcgccaagcaaccug

SEQ ID NO: 2451521 - RNA, 16 nt, Human
gcaggcagcgccaagc

SEQ ID NO: 2451522 - RNA, 13 nt, Human
gcaggcagcgcca

SEQ ID NO: 2451523 - RNA, 23 nt, Human
gcaggagaggagagccagagaag

SEQ ID NO: 2451524 - RNA, 9 nt, Human
gcaggcagu

SEQ ID NO: 2451525 - RNA, 13 nt, Human
gcaggcagggcug

SEQ ID NO: 2451526 - RNA, 17 nt, Human
gcaggcagccaggccac

SEQ ID NO: 2451527 - RNA, 18 nt, Human
gcaggcagccaggccaca

SEQ ID NO: 2451528 - RNA, 19 nt, Human
gcaggacugcacagcgucc

SEQ ID NO: 2451529 - RNA, 22 nt, Human
gcaggagaggagagccagagaa

SEQ ID NO: 2451530 - RNA, 20 nt, Human
gcaggagaggagagccagag

SEQ ID NO: 2451531 - RNA, 19 nt, Human
gcaggagaggagagccaga

SEQ ID NO: 2451532 - RNA, 18 nt, Human
gcaggagaggagagccag

SEQ ID NO: 2451533 - RNA, 17 nt, Human
gcaggagaggagagcca

SEQ ID NO: 2451534 - RNA, 16 nt, Human
gcaggagaggagagcc

SEQ ID NO: 2451535 - RNA, 13 nt, Human
gcaggagaggaga

SEQ ID NO: 2451536 - RNA, 22 nt, Human
gcaggagaaucacuugcacucc

SEQ ID NO: 2451537 - RNA, 20 nt, Human
gcaggcaugcaugugcuugu

SEQ ID NO: 2451538 - RNA, 17 nt, Human
gcaggcauagaggcuuc

SEQ ID NO: 2451539 - RNA, 16 nt, Human
gcaggcauguccugga

SEQ ID NO: 2451540 - RNA, 20 nt, Human
gcaggccaagagcagaggca

SEQ ID NO: 2451541 - RNA, 22 nt, Human
gcaggccaagagcagaggcagc

SEQ ID NO: 2451542 - RNA, 24 nt, Human
gcaggccaagagcagaggcagcga

SEQ ID NO: 2451543 - RNA, 21 nt, Human
gcaggccaaggccuucuccuc

SEQ ID NO: 2451544 - RNA, 20 nt, Human
gcaggccaaggccuucuccu

SEQ ID NO: 2451545 - RNA, 19 nt, Human
gcaggccaaggccuucucc

SEQ ID NO: 2451546 - RNA, 23 nt, Human
gcaggccaaggccuucuccuccc

SEQ ID NO: 2451547 - RNA, 20 nt, Human
gcaggccaagucaggcccuu

SEQ ID NO: 2451548 - RNA, 16 nt, Human
gcaggcccuggccucc

SEQ ID NO: 2451549 - RNA, 15 nt, Human
gcaggcccuggccuc

SEQ ID NO: 2451550 - RNA, 14 nt, Human
gcaggcccuggccu

SEQ ID NO: 2451551 - RNA, 12 nt, Human
gcaggcccuggc

SEQ ID NO: 2451552 - RNA, 23 nt, Human
gcaggcccugcacuguccugcuc

SEQ ID NO: 2451553 - RNA, 20 nt, Human
gcaggcccugcacuguccug

SEQ ID NO: 2451554 - RNA, 18 nt, Human
gcaggcccugcacugucc

SEQ ID NO: 2451555 - RNA, 15 nt, Human
gcaggcccugcacug

SEQ ID NO: 2451556 - RNA, 14 nt, Human
gcaggcccugcacu

SEQ ID NO: 2451557 - RNA, 12 nt, Human
gcaggcccugca

SEQ ID NO: 2451558 - RNA, 17 nt, Human
gcaggccaggccagcug

SEQ ID NO: 2451559 - RNA, 15 nt, Human
gcaggccaggccagc

SEQ ID NO: 2451560 - RNA, 16 nt, Human
gcaggccaggccagcu

SEQ ID NO: 2451561 - RNA, 22 nt, Human
gcuuguugggauuccugaccca

SEQ ID NO: 2451562 - RNA, 21 nt, Human
gcuuguugggauuccugaccc

SEQ ID NO: 2451563 - RNA, 20 nt, Human
gcuuguugggauuccugacc

SEQ ID NO: 2451564 - RNA, 18 nt, Human
gcuuguugggauuccuga

SEQ ID NO: 2451565 - RNA, 14 nt, Human
gcuuguuggauuuu

SEQ ID NO: 2451566 - RNA, 15 nt, Human
gcuuguuauuuauaa

SEQ ID NO: 2451567 - RNA, 18 nt, Human
gcuuguucccucucccug

SEQ ID NO: 2451568 - RNA, 21 nt, Human
gcuuguguguuucacuuuuag

SEQ ID NO: 2451569 - RNA, 20 nt, Human
gcuuguguguuucacuuuua

SEQ ID NO: 2451570 - RNA, 19 nt, Human
gcuuguguguuucacuuuu

SEQ ID NO: 2451571 - RNA, 16 nt, Human
gcuuguguguuucacu

SEQ ID NO: 2451572 - RNA, 15 nt, Human
gcuuguguguuucac

SEQ ID NO: 2451573 - RNA, 14 nt, Human
gcuuguguguuuca

SEQ ID NO: 2451574 - RNA, 22 nt, Human
gcuuguguauccauuaucaugu

SEQ ID NO: 2451575 - RNA, 20 nt, Human
gcuuguguauccauuaucau

SEQ ID NO: 2451576 - RNA, 12 nt, Human
gcuuguguuaag

SEQ ID NO: 2451577 - RNA, 19 nt, Human
gcuuguguauccauuauca

SEQ ID NO: 2451578 - RNA, 18 nt, Human
gcuuguguauccauuauc

SEQ ID NO: 2451579 - RNA, 11 nt, Human
gcuuguguauc

SEQ ID NO: 2451580 - RNA, 23 nt, Human
gcuuguggauugaggguaggagg

SEQ ID NO: 2451581 - RNA, 20 nt, Human
gcuuguggagccccacacug

SEQ ID NO: 2451582 - RNA, 19 nt, Human
gcuuguggagccccacacu

SEQ ID NO: 2451583 - RNA, 14 nt, Human
gcuuguggagcccc

SEQ ID NO: 2451584 - RNA, 22 nt, Human
gcuugugcagaaaacauuguuc

SEQ ID NO: 2451585 - RNA, 21 nt, Human
gcuugugcagaaaacauuguu

SEQ ID NO: 2451586 - RNA, 18 nt, Human
gcuugugcagaaaacauu

SEQ ID NO: 2451587 - RNA, 14 nt, Human
gcuugugcacaauu

SEQ ID NO: 2451588 - RNA, 15 nt, Human
gcuugugcaacaaua

SEQ ID NO: 2451589 - RNA, 14 nt, Human
gcuuggagcagagg

SEQ ID NO: 2451590 - RNA, 12 nt, Human
gcuuggacugga

SEQ ID NO: 2451591 - RNA, 16 nt, Human
gcuuggacggcugggc

SEQ ID NO: 2451592 - RNA, 14 nt, Human
gcuugcucauuuuu

SEQ ID NO: 2451593 - RNA, 23 nt, Human
gcuugcucuucagugggagaaaa

SEQ ID NO: 2451594 - RNA, 19 nt, Human
gcuugccugauauaaaugc

SEQ ID NO: 2451595 - RNA, 15 nt, Human
gcuugccucucuguu

SEQ ID NO: 2451596 - RNA, 16 nt, Human
gcuugcguaugucugu

SEQ ID NO: 2451597 - RNA, 22 nt, Human
gcuugcguuagaaugaggagga

SEQ ID NO: 2451598 - RNA, 23 nt, Human
gcuuggaagagccugcaggugcu

SEQ ID NO: 2451599 - RNA, 18 nt, Human
gcuuggaagagccugcag

SEQ ID NO: 2451600 - RNA, 15 nt, Human
gcuuggaagagccug

SEQ ID NO: 2451601 - RNA, 19 nt, Human
gcuuggaaagcaucaccuc

SEQ ID NO: 2451602 - RNA, 21 nt, Human
gcuuggaaagcaucaccucag

SEQ ID NO: 2451603 - RNA, 13 nt, Human
gcuugcugagagg

SEQ ID NO: 2451604 - RNA, 12 nt, Human
gcuugcugagag

SEQ ID NO: 2451605 - RNA, 12 nt, Human
gcuugcuuuucu

SEQ ID NO: 2451606 - RNA, 18 nt, Human
gcuuggaaacuggaugag

SEQ ID NO: 2451607 - RNA, 23 nt, Human
gcuugccucggcuccugcugcac

SEQ ID NO: 2451608 - RNA, 22 nt, Human
gcuugccucggcuccugcugca

SEQ ID NO: 2451609 - RNA, 21 nt, Human
gcuugccucggcuccugcugc

SEQ ID NO: 2451610 - RNA, 20 nt, Human
gcuugccucggcuccugcug

SEQ ID NO: 2451611 - RNA, 19 nt, Human
gcuugccucggcuccugcu

SEQ ID NO: 2451612 - RNA, 18 nt, Human
gcuugccucggcuccugc

SEQ ID NO: 2451613 - RNA, 16 nt, Human
gcuugccucggcuccu

SEQ ID NO: 2451614 - RNA, 15 nt, Human
gcuugccucggcucc

SEQ ID NO: 2451615 - RNA, 14 nt, Human
gcuugccugcaggc

SEQ ID NO: 2451616 - RNA, 13 nt, Human
gcuugccugcagg

SEQ ID NO: 2451617 - RNA, 13 nt, Human
gcuugccuagggc

SEQ ID NO: 2451618 - RNA, 17 nt, Human
gcuugccuagggccugg

SEQ ID NO: 2451619 - RNA, 21 nt, Human
gcuugccuagggccuggucca

SEQ ID NO: 2451620 - RNA, 14 nt, Human
gcuugccucggcuc

SEQ ID NO: 2451621 - RNA, 22 nt, Human
gcuugccuagggccugguccau

SEQ ID NO: 2451622 - RNA, 15 nt, Human
gcuucuuaaagaguu

SEQ ID NO: 2451623 - RNA, 14 nt, Human
gcuucuuaaaugag

SEQ ID NO: 2451624 - RNA, 16 nt, Human
gcuuuaaacucaggga

SEQ ID NO: 2451625 - RNA, 16 nt, Human
gcuuuaaacacccuuc

SEQ ID NO: 2451626 - RNA, 22 nt, Human
gcuuuaaacauugguucuugua

SEQ ID NO: 2451627 - RNA, 17 nt, Human
gcuuuaaacaaauucau

SEQ ID NO: 2451628 - RNA, 13 nt, Human
gcuuuaaacaaau

SEQ ID NO: 2451629 - RNA, 23 nt, Human
gcuuuaaaaacuauuuaacuuga

SEQ ID NO: 2451630 - RNA, 20 nt, Human
gcuuuaaaaacuauuuaacu

SEQ ID NO: 2451631 - RNA, 15 nt, Human
gcuuuaaaaacuauu

SEQ ID NO: 2451632 - RNA, 21 nt, Human
gcuuguuugcucaccuggggu

SEQ ID NO: 2451633 - RNA, 23 nt, Human
gcuuguuuucuugccaaugaggu

SEQ ID NO: 2451634 - RNA, 20 nt, Human
gcuuguuuacagcacuacuc

SEQ ID NO: 2451635 - RNA, 13 nt, Human
gcuuguuuacagc

SEQ ID NO: 2451636 - RNA, 24 nt, Human
gcuuguugggauuccugacccagg

SEQ ID NO: 2451637 - RNA, 23 nt, Human
gcuuguugggauuccugacccag

SEQ ID NO: 2451638 - RNA, 15 nt, Human
gcuuguuuccuagca

SEQ ID NO: 2451639 - RNA, 23 nt, Human
gcuuguuuccuagcacacacuuu

SEQ ID NO: 2451640 - RNA, 19 nt, Human
gcuuguuugcucaccuggg

SEQ ID NO: 2451641 - RNA, 15 nt, Human
gcuuucauguaaacu

SEQ ID NO: 2451642 - RNA, 20 nt, Human
gcuuucauguaaacugugca

SEQ ID NO: 2451643 - RNA, 21 nt, Human
gcuuucauguaaacugugcac

SEQ ID NO: 2451644 - RNA, 14 nt, Human
gcuuuccaaagcca

SEQ ID NO: 2451645 - RNA, 22 nt, Human
gcuuuaaacucagggacagagc

SEQ ID NO: 2451646 - RNA, 21 nt, Human
gcuuuaaacucagggacagag

SEQ ID NO: 2451647 - RNA, 18 nt, Human
gcuuuaaacucagggaca

SEQ ID NO: 2451648 - RNA, 19 nt, Human
gcuuuaaccauuaaaacug

SEQ ID NO: 2451649 - RNA, 12 nt, Human
gcuuucauguaa

SEQ ID NO: 2451650 - RNA, 18 nt, Human
gcuuucaugauuagcaag

SEQ ID NO: 2451651 - RNA, 12 nt, Human
gcuuucaguauu

SEQ ID NO: 2451652 - RNA, 12 nt, Human
gcuuucaugauu

SEQ ID NO: 2451653 - RNA, 15 nt, Human
gcuuuuaugugaaac

SEQ ID NO: 2451654 - RNA, 13 nt, Human
gcuuuuaugugaa

SEQ ID NO: 2451655 - RNA, 16 nt, Human
gcuuuguaggugucuc

SEQ ID NO: 2451656 - RNA, 16 nt, Human
gcuuuuauagaggcua

SEQ ID NO: 2451657 - RNA, 15 nt, Human
gcuuuguaggugucu

SEQ ID NO: 2451658 - RNA, 13 nt, Human
gcuuuuagacaga

SEQ ID NO: 2451659 - RNA, 16 nt, Human
gcuuuccauguugcug

SEQ ID NO: 2451660 - RNA, 19 nt, Human
gcuuuccauguugcugcca

SEQ ID NO: 2451661 - RNA, 11 nt, Human
gcuuuccagcu

SEQ ID NO: 2451662 - RNA, 18 nt, Human
gcuuuccacaccuggcac

SEQ ID NO: 2451663 - RNA, 14 nt, Human
gcuuuccagcucac

SEQ ID NO: 2451664 - RNA, 19 nt, Human
gcuuugggcugcccuggug

SEQ ID NO: 2451665 - RNA, 18 nt, Human
gcuuugggcugcccuggu

SEQ ID NO: 2451666 - RNA, 21 nt, Human
gcuuuccauguugcugccaac

SEQ ID NO: 2451667 - RNA, 20 nt, Human
gcuucaguggcagcugcuuu

SEQ ID NO: 2451668 - RNA, 14 nt, Human
gcuucauaaaugaa

SEQ ID NO: 2451669 - RNA, 19 nt, Human
gcuucaguuuccuggucug

SEQ ID NO: 2451670 - RNA, 18 nt, Human
gcuucaguuguuuucccg

SEQ ID NO: 2451671 - RNA, 15 nt, Human
gcuucaguuguuuuc

SEQ ID NO: 2451672 - RNA, 19 nt, Human
gcuucaguggcagcugcuu

SEQ ID NO: 2451673 - RNA, 17 nt, Human
gcuuaucaauaaaccug

SEQ ID NO: 2451674 - RNA, 23 nt, Human
gcuuaucaugcugucuuuacaug

SEQ ID NO: 2451675 - RNA, 21 nt, Human
gcuucauccuccucagaucuu

SEQ ID NO: 2451676 - RNA, 18 nt, Human
gcuucaucugucaagugg

SEQ ID NO: 2451677 - RNA, 13 nt, Human
gcuucaucuguca

SEQ ID NO: 2451678 - RNA, 14 nt, Human
gcuucaucuggcaa

SEQ ID NO: 2451679 - RNA, 10 nt, Human
gcuucauaca

SEQ ID NO: 2451680 - RNA, 22 nt, Human
gcuucauaaaugaagcagcuuu

SEQ ID NO: 2451681 - RNA, 18 nt, Human
gcuucauaaaugaagcag

SEQ ID NO: 2451682 - RNA, 11 nt, Human
gcuucauacac

SEQ ID NO: 2451683 - RNA, 18 nt, Human
gcuucaugcucagcccug

SEQ ID NO: 2451684 - RNA, 17 nt, Human
gcuucauggcagaaggc

SEQ ID NO: 2451685 - RNA, 14 nt, Human
gcuucaugcucagc

SEQ ID NO: 2451686 - RNA, 14 nt, Human
gcuucaugccagcu

SEQ ID NO: 2451687 - RNA, 16 nt, Human
gcuucaugacauuccu

SEQ ID NO: 2451688 - RNA, 17 nt, Human
gcuuauagguggccucu

SEQ ID NO: 2451689 - RNA, 15 nt, Human
gcuuauagguggccu

SEQ ID NO: 2451690 - RNA, 13 nt, Human
gcuuagaccucag

SEQ ID NO: 2451691 - RNA, 14 nt, Human
gcuuagaccucagc

SEQ ID NO: 2451692 - RNA, 15 nt, Human
gcuuagaccucagcc

SEQ ID NO: 2451693 - RNA, 16 nt, Human
gcuuagaccucagccu

SEQ ID NO: 2451694 - RNA, 20 nt, Human
gcuuauacacuuacacuuua

SEQ ID NO: 2451695 - RNA, 17 nt, Human
gcuuagaccucagccug

SEQ ID NO: 2451696 - RNA, 15 nt, Human
gcuuagacauaacaa

SEQ ID NO: 2451697 - RNA, 18 nt, Human
gcuuagaccucagccugu

SEQ ID NO: 2451698 - RNA, 17 nt, Human
gcuuacugauauauuuu

SEQ ID NO: 2451699 - RNA, 21 nt, Human
gcuuacugauauauuuuacaa

SEQ ID NO: 2451700 - RNA, 20 nt, Human
gcuuacuuuggaauacauuu

SEQ ID NO: 2451701 - RNA, 17 nt, Human
gcuuacuaagcuuugcc

SEQ ID NO: 2451702 - RNA, 23 nt, Human
gcuuacuaagcuuugccagcugc

SEQ ID NO: 2451703 - RNA, 21 nt, Human
gcuuacuacaugugggagcuu

SEQ ID NO: 2451704 - RNA, 19 nt, Human
gcuuacauuuuuacaauaa

SEQ ID NO: 2451705 - RNA, 15 nt, Human
gcuucugcuuuucug

SEQ ID NO: 2451706 - RNA, 14 nt, Human
gcuucugcuuuucu

SEQ ID NO: 2451707 - RNA, 13 nt, Human
gcuucugcuuuuc

SEQ ID NO: 2451708 - RNA, 21 nt, Human
gcuucugcuuuucugcccugg

SEQ ID NO: 2451709 - RNA, 20 nt, Human
gcuucugcuuuucugcccug

SEQ ID NO: 2451710 - RNA, 19 nt, Human
gcuucugcuuuucugcccu

SEQ ID NO: 2451711 - RNA, 16 nt, Human
gcuucugcuuuucugc

SEQ ID NO: 2451712 - RNA, 23 nt, Human
gcuucugcuuuucugcccuggcu

SEQ ID NO: 2451713 - RNA, 12 nt, Human
gcuucuggagcc

SEQ ID NO: 2451714 - RNA, 17 nt, Human
gcuucugcugggcuggg

SEQ ID NO: 2451715 - RNA, 16 nt, Human
gcuucugcugggcugg

SEQ ID NO: 2451716 - RNA, 22 nt, Human
gcuucugcugggcuggggccug

SEQ ID NO: 2451717 - RNA, 15 nt, Human
gcuucugcugggcug

SEQ ID NO: 2451718 - RNA, 14 nt, Human
gcuucugcugggcu

SEQ ID NO: 2451719 - RNA, 12 nt, Human
gcuucugcuggg

SEQ ID NO: 2451720 - RNA, 18 nt, Human
gcuucucauccugcaggc

SEQ ID NO: 2451721 - RNA, 13 nt, Human
gcuucugccugca

SEQ ID NO: 2451722 - RNA, 17 nt, Human
gcuucucauccugcagg

SEQ ID NO: 2451723 - RNA, 17 nt, Human
gcuucuguugcugccuc

SEQ ID NO: 2451724 - RNA, 18 nt, Human
gcuucuguugcugccuca

SEQ ID NO: 2451725 - RNA, 13 nt, Human
gcuucuggagccc

SEQ ID NO: 2451726 - RNA, 14 nt, Human
gcuucuggagcccu

SEQ ID NO: 2451727 - RNA, 17 nt, Human
gcuucuggagcccuugg

SEQ ID NO: 2451728 - RNA, 18 nt, Human
gcuucuggagcccuuggg

SEQ ID NO: 2451729 - RNA, 19 nt, Human
gcuucuguuuuauaauuuu

SEQ ID NO: 2451730 - RNA, 19 nt, Human
gcuucuguugcugccucau

SEQ ID NO: 2451731 - RNA, 16 nt, Human
gcuuccaagguggucu

SEQ ID NO: 2451732 - RNA, 15 nt, Human
gcuuccaaggugguc

SEQ ID NO: 2451733 - RNA, 21 nt, Human
gcuuccaaggcagaagcagca

SEQ ID NO: 2451734 - RNA, 12 nt, Human
gcuuccaauuuu

SEQ ID NO: 2451735 - RNA, 18 nt, Human
gcuuccaagguggucugc

SEQ ID NO: 2451736 - RNA, 16 nt, Human
gcuuccaccucacccc

SEQ ID NO: 2451737 - RNA, 15 nt, Human
gcuuccaccucaccc

SEQ ID NO: 2451738 - RNA, 14 nt, Human
gcuuccaccucacc

SEQ ID NO: 2451739 - RNA, 12 nt, Human
gcuuccaccuca

SEQ ID NO: 2451740 - RNA, 19 nt, Human
gcuuccagaaaaccccagc

SEQ ID NO: 2451741 - RNA, 18 nt, Human
gcuucauuuccugugucu

SEQ ID NO: 2451742 - RNA, 18 nt, Human
gcuucauuagagcaggcg

SEQ ID NO: 2451743 - RNA, 17 nt, Human
gcuucauuagagcaggc

SEQ ID NO: 2451744 - RNA, 16 nt, Human
gcuucauuagagcagg

SEQ ID NO: 2451745 - RNA, 15 nt, Human
gcuucauuagagcag

SEQ ID NO: 2451746 - RNA, 22 nt, Human
gcuuccagagaguccucuggau

SEQ ID NO: 2451747 - RNA, 21 nt, Human
gcuuccagagaguccucugga

SEQ ID NO: 2451748 - RNA, 20 nt, Human
gcuuccagagaguccucugg

SEQ ID NO: 2451749 - RNA, 19 nt, Human
gcuuccagagaguccucug

SEQ ID NO: 2451750 - RNA, 13 nt, Human
gcuuccagagagu

SEQ ID NO: 2451751 - RNA, 20 nt, Human
gcuuccaccucaccccacuu

SEQ ID NO: 2451752 - RNA, 19 nt, Human
gcuuccaccucaccccacu

SEQ ID NO: 2451753 - RNA, 17 nt, Human
gcuuccaccucacccca

SEQ ID NO: 2451754 - RNA, 22 nt, Human
gcuucucacugccaugccagcu

SEQ ID NO: 2451755 - RNA, 17 nt, Human
gcuucucacugccaugc

SEQ ID NO: 2451756 - RNA, 22 nt, Human
gcuuccagauugacgacaagug

SEQ ID NO: 2451757 - RNA, 16 nt, Human
gcuucucauacgucca

SEQ ID NO: 2451758 - RNA, 16 nt, Human
gcuucucauccugcag

SEQ ID NO: 2451759 - RNA, 22 nt, Human
gcugggcugagccccuacccca

SEQ ID NO: 2451760 - RNA, 20 nt, Human
gcugggcugagccccuaccc

SEQ ID NO: 2451761 - RNA, 19 nt, Human
gcugggcugagccccuacc

SEQ ID NO: 2451762 - RNA, 18 nt, Human
gcugggcugagccccuac

SEQ ID NO: 2451763 - RNA, 14 nt, Human
gcugggcugagccc

SEQ ID NO: 2451764 - RNA, 13 nt, Human
gcugggcugagcc

SEQ ID NO: 2451765 - RNA, 12 nt, Human
gcugggcugagc

SEQ ID NO: 2451766 - RNA, 21 nt, Human
gcugggcucugccacccuacc

SEQ ID NO: 2451767 - RNA, 20 nt, Human
gcugggcuucaguggcagcu

SEQ ID NO: 2451768 - RNA, 21 nt, Human
gcugggagggauagagggggg

SEQ ID NO: 2451769 - RNA, 13 nt, Human
gcugggcucucca

SEQ ID NO: 2451770 - RNA, 14 nt, Human
gcugggcucuccac

SEQ ID NO: 2451771 - RNA, 15 nt, Human
gcugggcucuccacc

SEQ ID NO: 2451772 - RNA, 15 nt, Human
gcugggcucugccac

SEQ ID NO: 2451773 - RNA, 14 nt, Human
gcugggcucugcca

SEQ ID NO: 2451774 - RNA, 13 nt, Human
gcugggcucugca

SEQ ID NO: 2451775 - RNA, 19 nt, Human
gcugggcucuccaccucag

SEQ ID NO: 2451776 - RNA, 20 nt, Human
gcugggcucuccaccucagc

SEQ ID NO: 2451777 - RNA, 21 nt, Human
gcugggcucuccaccucagcc

SEQ ID NO: 2451778 - RNA, 22 nt, Human
gcugggcucuccaccucagccu

SEQ ID NO: 2451779 - RNA, 22 nt, Human
gcugggcuucaguggcagcugc

SEQ ID NO: 2451780 - RNA, 21 nt, Human
gcugggcuucaguggcagcug

SEQ ID NO: 2451781 - RNA, 12 nt, Human
gcugggcugggg

SEQ ID NO: 2451782 - RNA, 22 nt, Human
gcugggcuuggcagcccggguc

SEQ ID NO: 2451783 - RNA, 13 nt, Human
gcugggcuggcuc

SEQ ID NO: 2451784 - RNA, 14 nt, Human
gcugggcugggcgc

SEQ ID NO: 2451785 - RNA, 15 nt, Human
gcuggccuggccccu

SEQ ID NO: 2451786 - RNA, 14 nt, Human
gcuggccuggcccc

SEQ ID NO: 2451787 - RNA, 12 nt, Human
gcuggccuggcc

SEQ ID NO: 2451788 - RNA, 13 nt, Human
gcuggccuggccc

SEQ ID NO: 2451789 - RNA, 21 nt, Human
gcugggcucccuucccaccuc

SEQ ID NO: 2451790 - RNA, 19 nt, Human
gcugggaugauuggagggg

SEQ ID NO: 2451791 - RNA, 12 nt, Human
gcugggaggcaa

SEQ ID NO: 2451792 - RNA, 15 nt, Human
gcugggaggcauggc

SEQ ID NO: 2451793 - RNA, 14 nt, Human
gcugggaggcaugg

SEQ ID NO: 2451794 - RNA, 21 nt, Human
gcugggaggcaagaggggugg

SEQ ID NO: 2451795 - RNA, 16 nt, Human
gcugggaggcaagagg

SEQ ID NO: 2451796 - RNA, 18 nt, Human
gcugggaguaguugucuu

SEQ ID NO: 2451797 - RNA, 20 nt, Human
gcugggaggcauggcccugg

SEQ ID NO: 2451798 - RNA, 19 nt, Human
gcugggagggauagagggg

SEQ ID NO: 2451799 - RNA, 19 nt, Human
gcuggucucgaacuccuga

SEQ ID NO: 2451800 - RNA, 22 nt, Human
gcuggucucgaacuccugaccu

SEQ ID NO: 2451801 - RNA, 23 nt, Human
gcuggucucgaacuccugaccuu

SEQ ID NO: 2451802 - RNA, 20 nt, Human
gcuggugagugaugcggcag

SEQ ID NO: 2451803 - RNA, 18 nt, Human
gcuggugagugaugcggc

SEQ ID NO: 2451804 - RNA, 20 nt, Human
gcuggugcagagcugaagau

SEQ ID NO: 2451805 - RNA, 19 nt, Human
gcuggugauggagguuuca

SEQ ID NO: 2451806 - RNA, 21 nt, Human
gcuggugauggagguuucaua

SEQ ID NO: 2451807 - RNA, 13 nt, Human
gcuggugcauuac

SEQ ID NO: 2451808 - RNA, 17 nt, Human
gcuggugcauuacagag

SEQ ID NO: 2451809 - RNA, 18 nt, Human
gcuggugcauuacagaga

SEQ ID NO: 2451810 - RNA, 14 nt, Human
gcuggugccagccu

SEQ ID NO: 2451811 - RNA, 13 nt, Human
gcuggugccagcc

SEQ ID NO: 2451812 - RNA, 20 nt, Human
gcuggugcauuacagagagg

SEQ ID NO: 2451813 - RNA, 22 nt, Human
gcuggugcauuacagagaggag

SEQ ID NO: 2451814 - RNA, 22 nt, Human
gcuggugccagccuuccucugc

SEQ ID NO: 2451815 - RNA, 15 nt, Human
gcuggugccagccuu

SEQ ID NO: 2451816 - RNA, 13 nt, Human
gcuggugcccgga

SEQ ID NO: 2451817 - RNA, 19 nt, Human
gcugguccagggcuaguga

SEQ ID NO: 2451818 - RNA, 14 nt, Human
gcugguccagggcu

SEQ ID NO: 2451819 - RNA, 16 nt, Human
gcugguccgugggacg

SEQ ID NO: 2451820 - RNA, 15 nt, Human
gcugguccgugggac

SEQ ID NO: 2451821 - RNA, 22 nt, Human
gcuggucauguguuugaacuuc

SEQ ID NO: 2451822 - RNA, 19 nt, Human
gcuggucucaaacuccuga

SEQ ID NO: 2451823 - RNA, 20 nt, Human
gcuggucucaaacuccugac

SEQ ID NO: 2451824 - RNA, 23 nt, Human
gcuggggaccugguacccuccug

SEQ ID NO: 2451825 - RNA, 16 nt, Human
gcuggggaccugguac

SEQ ID NO: 2451826 - RNA, 20 nt, Human
gcuggggaaguccucugggu

SEQ ID NO: 2451827 - RNA, 22 nt, Human
gcuggggacggggggccccagu

SEQ ID NO: 2451828 - RNA, 23 nt, Human
gcuggggacggggggccccaguc

SEQ ID NO: 2451829 - RNA, 14 nt, Human
gcuggggaugucuc

SEQ ID NO: 2451830 - RNA, 15 nt, Human
gcugggggccucagu

SEQ ID NO: 2451831 - RNA, 14 nt, Human
gcugggggccucag

SEQ ID NO: 2451832 - RNA, 17 nt, Human
gcuggggcaagucccug

SEQ ID NO: 2451833 - RNA, 18 nt, Human
gcugggggccucagugcc

SEQ ID NO: 2451834 - RNA, 18 nt, Human
gcuggucacugccaugga

SEQ ID NO: 2451835 - RNA, 15 nt, Human
gcuggucacugccau

SEQ ID NO: 2451836 - RNA, 22 nt, Human
gcuggucacagccuccucuguc

SEQ ID NO: 2451837 - RNA, 20 nt, Human
gcuggucacagccuccucug

SEQ ID NO: 2451838 - RNA, 13 nt, Human
gcuggucacugcc

SEQ ID NO: 2451839 - RNA, 18 nt, Human
gcuggucacagccuccuc

SEQ ID NO: 2451840 - RNA, 17 nt, Human
gcuggucacagccuccu

SEQ ID NO: 2451841 - RNA, 15 nt, Human
gcuggucacagccuc

SEQ ID NO: 2451842 - RNA, 13 nt, Human
gcuggucacagcc

SEQ ID NO: 2451843 - RNA, 22 nt, Human
gcuggucaaacaaacucucuga

SEQ ID NO: 2451844 - RNA, 15 nt, Human
gcuggugucaccuga

SEQ ID NO: 2451845 - RNA, 14 nt, Human
gcuggugucaccug

SEQ ID NO: 2451846 - RNA, 23 nt, Human
gcuggugccagccuuccucugca

SEQ ID NO: 2451847 - RNA, 22 nt, Human
gcuggugguuucacggugccag

SEQ ID NO: 2451848 - RNA, 14 nt, Human
gcuggugcccggag

SEQ ID NO: 2451849 - RNA, 17 nt, Human
gcugucagccauuccug

SEQ ID NO: 2451850 - RNA, 23 nt, Human
gcugucaucaauugaauggucag

SEQ ID NO: 2451851 - RNA, 14 nt, Human
gcugucaucugugc

SEQ ID NO: 2451852 - RNA, 15 nt, Human
gcugucaucugugca

SEQ ID NO: 2451853 - RNA, 16 nt, Human
gcugucaucugugcac

SEQ ID NO: 2451854 - RNA, 18 nt, Human
gcugucauaagaaugaau

SEQ ID NO: 2451855 - RNA, 13 nt, Human
gcugucaucucag

SEQ ID NO: 2451856 - RNA, 15 nt, Human
gcuguccccucuugc

SEQ ID NO: 2451857 - RNA, 12 nt, Human
gcuguccccucu

SEQ ID NO: 2451858 - RNA, 22 nt, Human
gcugucccaucuccacuguuau

SEQ ID NO: 2451859 - RNA, 16 nt, Human
gcuguccagugcccau

SEQ ID NO: 2451860 - RNA, 15 nt, Human
gcuguccagugccca

SEQ ID NO: 2451861 - RNA, 14 nt, Human
gcuguccagugccc

SEQ ID NO: 2451862 - RNA, 12 nt, Human
gcuguccagugc

SEQ ID NO: 2451863 - RNA, 23 nt, Human
gcuguccagugcccauuccucac

SEQ ID NO: 2451864 - RNA, 18 nt, Human
gcuguccagugcccauuc

SEQ ID NO: 2451865 - RNA, 22 nt, Human
gcuguccagacagccuguaucu

SEQ ID NO: 2451866 - RNA, 18 nt, Human
gcuguccagacagccugu

SEQ ID NO: 2451867 - RNA, 16 nt, Human
gcuguccagacagccu

SEQ ID NO: 2451868 - RNA, 15 nt, Human
gcuguccagacagcc

SEQ ID NO: 2451869 - RNA, 14 nt, Human
gcuguccagacagc

SEQ ID NO: 2451870 - RNA, 13 nt, Human
gcuguccagacag

SEQ ID NO: 2451871 - RNA, 12 nt, Human
gcuguccagaca

SEQ ID NO: 2451872 - RNA, 22 nt, Human
gcugucaucugugcacugccca

SEQ ID NO: 2451873 - RNA, 23 nt, Human
gcugucccuuacgugaguccugg

SEQ ID NO: 2451874 - RNA, 19 nt, Human
gcuguccccucuugcccca

SEQ ID NO: 2451875 - RNA, 18 nt, Human
gcuguccccucuugcccc

SEQ ID NO: 2451876 - RNA, 17 nt, Human
gcuguccccucuugccc

SEQ ID NO: 2451877 - RNA, 16 nt, Human
gcuguccccucuugcc

SEQ ID NO: 2451878 - RNA, 16 nt, Human
gcugucccuuuuccuu

SEQ ID NO: 2451879 - RNA, 23 nt, Human
gcuguccccucuugccccaaccc

SEQ ID NO: 2451880 - RNA, 20 nt, Human
gcuguccccucuugccccaa

SEQ ID NO: 2451881 - RNA, 13 nt, Human
gcuguccuaggcc

SEQ ID NO: 2451882 - RNA, 14 nt, Human
gcuguccuaggcca

SEQ ID NO: 2451883 - RNA, 16 nt, Human
gcuguccuaggccaca

SEQ ID NO: 2451884 - RNA, 17 nt, Human
gcuguguuugagcucug

SEQ ID NO: 2451885 - RNA, 17 nt, Human
gcuguguucuggugagg

SEQ ID NO: 2451886 - RNA, 14 nt, Human
gcuguguuccccaa

SEQ ID NO: 2451887 - RNA, 22 nt, Human
gcuguguguuaguucccaacau

SEQ ID NO: 2451888 - RNA, 18 nt, Human
gcuguguguuaguuccca

SEQ ID NO: 2451889 - RNA, 18 nt, Human
gcuguguuaaauaaaccu

SEQ ID NO: 2451890 - RNA, 22 nt, Human
gcugugugguuugguguguucc

SEQ ID NO: 2451891 - RNA, 13 nt, Human
gcugugugguuug

SEQ ID NO: 2451892 - RNA, 21 nt, Human
gcuuacaauuuuuuuaauuuu

SEQ ID NO: 2451893 - RNA, 19 nt, Human
gcuuacaauuuuuuuaauu

SEQ ID NO: 2451894 - RNA, 14 nt, Human
gcuuacaauuuuuu

SEQ ID NO: 2451895 - RNA, 12 nt, Human
gcuuacaauuuu

SEQ ID NO: 2451896 - RNA, 23 nt, Human
gcuuacaauuuuuuuaauuuugu

SEQ ID NO: 2451897 - RNA, 22 nt, Human
gcuuacaauuuuuuuaauuuug

SEQ ID NO: 2451898 - RNA, 18 nt, Human
gcuuacauuuuuacaaua

SEQ ID NO: 2451899 - RNA, 14 nt, Human
gcuuacauuuuuac

SEQ ID NO: 2451900 - RNA, 11 nt, Human
gcuuacauuuu

SEQ ID NO: 2451901 - RNA, 18 nt, Human
gcuuacacaucucagacc

SEQ ID NO: 2451902 - RNA, 20 nt, Human
gcuuacaauucccugcuguc

SEQ ID NO: 2451903 - RNA, 19 nt, Human
gcuuacaauucccugcugu

SEQ ID NO: 2451904 - RNA, 14 nt, Human
gcuuacaauucccu

SEQ ID NO: 2451905 - RNA, 18 nt, Human
gcuguuauuucuauuuuu

SEQ ID NO: 2451906 - RNA, 22 nt, Human
gcuuacaagccagcuggagaaa

SEQ ID NO: 2451907 - RNA, 13 nt, Human
gcuguuagagucc

SEQ ID NO: 2451908 - RNA, 16 nt, Human
gcugugugcucuccaa

SEQ ID NO: 2451909 - RNA, 16 nt, Human
gcuguguggcagucug

SEQ ID NO: 2451910 - RNA, 15 nt, Human
gcugugucucccuuc

SEQ ID NO: 2451911 - RNA, 13 nt, Human
gcugugggcaggu

SEQ ID NO: 2451912 - RNA, 22 nt, Human
gcuguggccagggugagagcug

SEQ ID NO: 2451913 - RNA, 14 nt, Human
gcugugggcaggug

SEQ ID NO: 2451914 - RNA, 16 nt, Human
gcugugucuaaacugc

SEQ ID NO: 2451915 - RNA, 15 nt, Human
gcugugucuaaacug

SEQ ID NO: 2451916 - RNA, 14 nt, Human
gcugugucuaaacu

SEQ ID NO: 2451917 - RNA, 14 nt, Human
gcugugggaacgag

SEQ ID NO: 2451918 - RNA, 15 nt, Human
gcuguggccugggca

SEQ ID NO: 2451919 - RNA, 21 nt, Human
gcuguggccagggugagagcu

SEQ ID NO: 2451920 - RNA, 19 nt, Human
gcuguggccagggugagag

SEQ ID NO: 2451921 - RNA, 14 nt, Human
gcuguggccugggc

SEQ ID NO: 2451922 - RNA, 13 nt, Human
gcuguggccaggg

SEQ ID NO: 2451923 - RNA, 17 nt, Human
gcuguggccagggugag

SEQ ID NO: 2451924 - RNA, 16 nt, Human
gcuguggccaggguga

SEQ ID NO: 2451925 - RNA, 14 nt, Human
gcuguggccagggu

SEQ ID NO: 2451926 - RNA, 19 nt, Human
gcuguccucagguggccau

SEQ ID NO: 2451927 - RNA, 18 nt, Human
gcuguccucagguggcca

SEQ ID NO: 2451928 - RNA, 13 nt, Human
gcuguccucaggu

SEQ ID NO: 2451929 - RNA, 12 nt, Human
gcugcccugccc

SEQ ID NO: 2451930 - RNA, 14 nt, Human
gcugcccugcccac

SEQ ID NO: 2451931 - RNA, 13 nt, Human
gcugcccugccca

SEQ ID NO: 2451932 - RNA, 21 nt, Human
gcugcccugcccaccuggccu

SEQ ID NO: 2451933 - RNA, 20 nt, Human
gcugcccugcccaccuggcc

SEQ ID NO: 2451934 - RNA, 18 nt, Human
gcugcccugcccaccugg

SEQ ID NO: 2451935 - RNA, 16 nt, Human
gcugcccugcccaccu

SEQ ID NO: 2451936 - RNA, 23 nt, Human
gcugcccugcccaccuggccucu

SEQ ID NO: 2451937 - RNA, 22 nt, Human
gcugcccugcccaccuggccuc

SEQ ID NO: 2451938 - RNA, 24 nt, Human
gcugcccugcccaccuggccucug

SEQ ID NO: 2451939 - RNA, 17 nt, Human
gcugcccuggcccugag

SEQ ID NO: 2451940 - RNA, 16 nt, Human
gcugcccuggcccuga

SEQ ID NO: 2451941 - RNA, 15 nt, Human
gcugcccuggcccug

SEQ ID NO: 2451942 - RNA, 14 nt, Human
gcugcccuggcccu

SEQ ID NO: 2451943 - RNA, 15 nt, Human
gcugcccugccacuu

SEQ ID NO: 2451944 - RNA, 15 nt, Human
gcugcccugcggccc

SEQ ID NO: 2451945 - RNA, 13 nt, Human
gcugcccuggccc

SEQ ID NO: 2451946 - RNA, 15 nt, Human
gcugcccuggugcug

SEQ ID NO: 2451947 - RNA, 14 nt, Human
gcugcccuggugcu

SEQ ID NO: 2451948 - RNA, 13 nt, Human
gcugcccuggugc

SEQ ID NO: 2451949 - RNA, 12 nt, Human
gcugcccuggug

SEQ ID NO: 2451950 - RNA, 19 nt, Human
gcugccuguucagcuccag

SEQ ID NO: 2451951 - RNA, 18 nt, Human
gcugccuguucagcucca

SEQ ID NO: 2451952 - RNA, 15 nt, Human
gcugccuuagaaccu

SEQ ID NO: 2451953 - RNA, 17 nt, Human
gcugcccuggugcugcc

SEQ ID NO: 2451954 - RNA, 23 nt, Human
gcugcccuggcccugaggugugg

SEQ ID NO: 2451955 - RNA, 19 nt, Human
gcugcccuggcccugaggu

SEQ ID NO: 2451956 - RNA, 20 nt, Human
gcugccuuagaaccuuucuu

SEQ ID NO: 2451957 - RNA, 22 nt, Human
gcugccuguucagcuccagcuc

SEQ ID NO: 2451958 - RNA, 20 nt, Human
gcugccuguucagcuccagc

SEQ ID NO: 2451959 - RNA, 21 nt, Human
gcugcgguccacccaggagcc

SEQ ID NO: 2451960 - RNA, 22 nt, Human
gcugcgguccacccaggagccc

SEQ ID NO: 2451961 - RNA, 15 nt, Human
gcugcggcacccuug

SEQ ID NO: 2451962 - RNA, 14 nt, Human
gcugcggcacccuu

SEQ ID NO: 2451963 - RNA, 15 nt, Human
gcugcgguccaccca

SEQ ID NO: 2451964 - RNA, 14 nt, Human
gcugcgguccaccc

SEQ ID NO: 2451965 - RNA, 15 nt, Human
gcugccuucccuagc

SEQ ID NO: 2451966 - RNA, 13 nt, Human
gcugccuucccua

SEQ ID NO: 2451967 - RNA, 12 nt, Human
gcugccuucccu

SEQ ID NO: 2451968 - RNA, 16 nt, Human
gcugccuucccuagcu

SEQ ID NO: 2451969 - RNA, 19 nt, Human
gcugccuucuggauucuug

SEQ ID NO: 2451970 - RNA, 17 nt, Human
gcugccuucuggauucu

SEQ ID NO: 2451971 - RNA, 16 nt, Human
gcugccuucuggauuc

SEQ ID NO: 2451972 - RNA, 17 nt, Human
gcugcgcuugcuuuucu

SEQ ID NO: 2451973 - RNA, 15 nt, Human
gcugcuacaaagaag

SEQ ID NO: 2451974 - RNA, 20 nt, Human
gcugcuaaucuucagggcac

SEQ ID NO: 2451975 - RNA, 15 nt, Human
gcugcuaaucuucag

SEQ ID NO: 2451976 - RNA, 18 nt, Human
gcugcuaaucuucagggc

SEQ ID NO: 2451977 - RNA, 22 nt, Human
gcugcgucuggaggggccccug

SEQ ID NO: 2451978 - RNA, 14 nt, Human
gcugcgugccugug

SEQ ID NO: 2451979 - RNA, 16 nt, Human
gcugcgucuggagggg

SEQ ID NO: 2451980 - RNA, 19 nt, Human
gcugcuacaaagaagacau

SEQ ID NO: 2451981 - RNA, 18 nt, Human
gcugcuacaaagaagaca

SEQ ID NO: 2451982 - RNA, 17 nt, Human
gcugcuacaaagaagac

SEQ ID NO: 2451983 - RNA, 16 nt, Human
gcugcuacaaagaaga

SEQ ID NO: 2451984 - RNA, 21 nt, Human
gcugcuacaaagaagacaugu

SEQ ID NO: 2451985 - RNA, 20 nt, Human
gcugcuacaaagaagacaug

SEQ ID NO: 2451986 - RNA, 12 nt, Human
gcugcuacccag

SEQ ID NO: 2451987 - RNA, 19 nt, Human
gcugcuacccucccugcug

SEQ ID NO: 2451988 - RNA, 18 nt, Human
gcugcuacccucccugcu

SEQ ID NO: 2451989 - RNA, 17 nt, Human
gcugcuacccucccugc

SEQ ID NO: 2451990 - RNA, 16 nt, Human
gcugcuacccucccug

SEQ ID NO: 2451991 - RNA, 14 nt, Human
gcugcuacccuccc

SEQ ID NO: 2451992 - RNA, 23 nt, Human
gcugcuacaaagaagacauguuu

SEQ ID NO: 2451993 - RNA, 14 nt, Human
gcugcuacccagaa

SEQ ID NO: 2451994 - RNA, 19 nt, Human
gcugcuuucuguugucauu

SEQ ID NO: 2451995 - RNA, 21 nt, Human
gcugcuuuccccuguggggau

SEQ ID NO: 2451996 - RNA, 20 nt, Human
gcugcuuuccccugugggga

SEQ ID NO: 2451997 - RNA, 19 nt, Human
gcugcuuuccccugugggg

SEQ ID NO: 2451998 - RNA, 22 nt, Human
gcugcuuuucccuaagccaagg

SEQ ID NO: 2451999 - RNA, 22 nt, Human
gcugcuuuugucuaugggacuc

SEQ ID NO: 2452000 - RNA, 23 nt, Human
gcugcuacccucccugcuguccc

SEQ ID NO: 2452001 - RNA, 22 nt, Human
gcugcuacccucccugcugucc

SEQ ID NO: 2452002 - RNA, 21 nt, Human
gcugcuacccucccugcuguc

SEQ ID NO: 2452003 - RNA, 20 nt, Human
gcugcuacccucccugcugu

SEQ ID NO: 2452004 - RNA, 18 nt, Human
gcugcuuuccccuguggg

SEQ ID NO: 2452005 - RNA, 17 nt, Human
gcugcuuuccccugugg

SEQ ID NO: 2452006 - RNA, 16 nt, Human
gcugcuuuccccugug

SEQ ID NO: 2452007 - RNA, 15 nt, Human
gcugcuuuccccugu

SEQ ID NO: 2452008 - RNA, 19 nt, Human
gcugcuugugucccuccug

SEQ ID NO: 2452009 - RNA, 23 nt, Human
gcugcuacuuaauuccuuucuca

SEQ ID NO: 2452010 - RNA, 22 nt, Human
gcugcuugugucccuccuggga

SEQ ID NO: 2452011 - RNA, 14 nt, Human
gcugcuuuccccug

SEQ ID NO: 2452012 - RNA, 18 nt, Human
gcuggaagauccugcggg

SEQ ID NO: 2452013 - RNA, 17 nt, Human
gcuggaagauccugcgg

SEQ ID NO: 2452014 - RNA, 15 nt, Human
gcuggaagauccugc

SEQ ID NO: 2452015 - RNA, 14 nt, Human
gcuggaagauccug

SEQ ID NO: 2452016 - RNA, 21 nt, Human
gcuggaacagauucacacugu

SEQ ID NO: 2452017 - RNA, 16 nt, Human
gcuggaacagauucac

SEQ ID NO: 2452018 - RNA, 23 nt, Human
gcuggaaugauuucagcucacug

SEQ ID NO: 2452019 - RNA, 19 nt, Human
gcuggaaucuggagagcua

SEQ ID NO: 2452020 - RNA, 16 nt, Human
gcuggaaucuggagag

SEQ ID NO: 2452021 - RNA, 21 nt, Human
gcuggaaucuggagagcuaga

SEQ ID NO: 2452022 - RNA, 13 nt, Human
gcuggaaggguca

SEQ ID NO: 2452023 - RNA, 21 nt, Human
gcuggaaaaguauguuagugc

SEQ ID NO: 2452024 - RNA, 19 nt, Human
gcugcuuuuugagguggca

SEQ ID NO: 2452025 - RNA, 18 nt, Human
gcugcuuuuugagguggc

SEQ ID NO: 2452026 - RNA, 12 nt, Human
gcugcuuuuccu

SEQ ID NO: 2452027 - RNA, 22 nt, Human
gcugcuuuuccuuggggcaggc

SEQ ID NO: 2452028 - RNA, 23 nt, Human
gcugcuuuuccuuggggcaggca

SEQ ID NO: 2452029 - RNA, 23 nt, Human
gcuggaaaaguauguuagugcaa

SEQ ID NO: 2452030 - RNA, 22 nt, Human
gcuggaaaagggucuugggaaa

SEQ ID NO: 2452031 - RNA, 15 nt, Human
gcuggaaaagggucu

SEQ ID NO: 2452032 - RNA, 23 nt, Human
gcuggaaaagggucuugggaaau

SEQ ID NO: 2452033 - RNA, 20 nt, Human
gcuggaaacagacucgauuc

SEQ ID NO: 2452034 - RNA, 23 nt, Human
gcuggaccuauguccuaaggaca

SEQ ID NO: 2452035 - RNA, 23 nt, Human
gcuggcacauuuccccagaccug

SEQ ID NO: 2452036 - RNA, 15 nt, Human
gcuggaccuugaacu

SEQ ID NO: 2452037 - RNA, 20 nt, Human
gcuggacaguaucacugucu

SEQ ID NO: 2452038 - RNA, 20 nt, Human
gcuggcacccaccguggagg

SEQ ID NO: 2452039 - RNA, 16 nt, Human
gcuggcacccaccgug

SEQ ID NO: 2452040 - RNA, 23 nt, Human
gcuggcacccaccguggaggagg

SEQ ID NO: 2452041 - RNA, 21 nt, Human
gcuggcacccaccguggagga

SEQ ID NO: 2452042 - RNA, 18 nt, Human
gcuggcaccgccuucucu

SEQ ID NO: 2452043 - RNA, 17 nt, Human
gcuggcagcucuccagu

SEQ ID NO: 2452044 - RNA, 16 nt, Human
gcuggcagcucuccag

SEQ ID NO: 2452045 - RNA, 15 nt, Human
gcuggcagcucucca

SEQ ID NO: 2452046 - RNA, 14 nt, Human
gcuggcagcucucc

SEQ ID NO: 2452047 - RNA, 17 nt, Human
gcuggcaccgccuucuc

SEQ ID NO: 2452048 - RNA, 13 nt, Human
gcuggcagcagag

SEQ ID NO: 2452049 - RNA, 13 nt, Human
gcuggcagcucuc

SEQ ID NO: 2452050 - RNA, 15 nt, Human
gcuggcagcagagug

SEQ ID NO: 2452051 - RNA, 23 nt, Human
gcuggcagcucuccagucaggag

SEQ ID NO: 2452052 - RNA, 18 nt, Human
gcuggcagcucuccaguc

SEQ ID NO: 2452053 - RNA, 17 nt, Human
gcuggcaguccuggaag

SEQ ID NO: 2452054 - RNA, 16 nt, Human
gcuggcauuugcaccu

SEQ ID NO: 2452055 - RNA, 21 nt, Human
gcuggccacugcacagagcuc

SEQ ID NO: 2452056 - RNA, 20 nt, Human
gcuggccacugcacagagcu

SEQ ID NO: 2452057 - RNA, 19 nt, Human
gcuggccacugcacagagc

SEQ ID NO: 2452058 - RNA, 13 nt, Human
gcuggccacugca

SEQ ID NO: 2452059 - RNA, 12 nt, Human
gcuggccacugc

SEQ ID NO: 2452060 - RNA, 13 nt, Human
gcuggcccugccc

SEQ ID NO: 2452061 - RNA, 14 nt, Human
gcuggcccagcccu

SEQ ID NO: 2452062 - RNA, 13 nt, Human
gcuggcccagccc

SEQ ID NO: 2452063 - RNA, 14 nt, Human
gcuggcccugcccu

SEQ ID NO: 2452064 - RNA, 15 nt, Human
gcuggcccugcccug

SEQ ID NO: 2452065 - RNA, 16 nt, Human
gcuggcccugcccugg

SEQ ID NO: 2452066 - RNA, 20 nt, Human
gcuggccgccucacccccuc

SEQ ID NO: 2452067 - RNA, 15 nt, Human
gcuggcccagcccug

SEQ ID NO: 2452068 - RNA, 20 nt, Human
gcuggccgaggguccuggcu

SEQ ID NO: 2452069 - RNA, 24 nt, Human
gcuggccgaggguccuggcuccug

SEQ ID NO: 2452070 - RNA, 19 nt, Human
gcuggcccuggcucccaca

SEQ ID NO: 2452071 - RNA, 15 nt, Human
gcuggccgagggucc

SEQ ID NO: 2452072 - RNA, 19 nt, Human
gcuggccgaggguccuggc

SEQ ID NO: 2452073 - RNA, 22 nt, Human
gcuggccagccccacagcccac

SEQ ID NO: 2452074 - RNA, 16 nt, Human
gcuggccagccccaca

SEQ ID NO: 2452075 - RNA, 15 nt, Human
gcuggccagccccac

SEQ ID NO: 2452076 - RNA, 14 nt, Human
gcuggccagcccca

SEQ ID NO: 2452077 - RNA, 13 nt, Human
gcuggccagcccc

SEQ ID NO: 2452078 - RNA, 15 nt, Human
gcuggccaguccagg

SEQ ID NO: 2452079 - RNA, 14 nt, Human
gcuggccaguccag

SEQ ID NO: 2452080 - RNA, 19 nt, Human
gcuggccagccccacagcc

SEQ ID NO: 2452081 - RNA, 18 nt, Human
gcuggccagccccacagc

SEQ ID NO: 2452082 - RNA, 21 nt, Human
gcuggccagccccacagccca

SEQ ID NO: 2452083 - RNA, 11 nt, Human
gcuggcccagc

SEQ ID NO: 2452084 - RNA, 12 nt, Human
gcuggcccagcc

SEQ ID NO: 2452085 - RNA, 14 nt, Human
gcuggcccagccaa

SEQ ID NO: 2452086 - RNA, 17 nt, Human
gcuggccaguccaggcu

SEQ ID NO: 2452087 - RNA, 16 nt, Human
gcuggccaguccaggc

SEQ ID NO: 2452088 - RNA, 23 nt, Human
gcugcaaaggguaucaggugcug

SEQ ID NO: 2452089 - RNA, 22 nt, Human
gcugcaaaggguaucaggugcu

SEQ ID NO: 2452090 - RNA, 21 nt, Human
gcugauucucagggucucugc

SEQ ID NO: 2452091 - RNA, 17 nt, Human
gcucuuucucugccagu

SEQ ID NO: 2452092 - RNA, 17 nt, Human
gcugauuuggugaccaa

SEQ ID NO: 2452093 - RNA, 15 nt, Human
gcugauuuuaacaau

SEQ ID NO: 2452094 - RNA, 14 nt, Human
gcugauuuuaacaa

SEQ ID NO: 2452095 - RNA, 20 nt, Human
gcugauuuuaacaauaacua

SEQ ID NO: 2452096 - RNA, 21 nt, Human
gcugauuaaaccaaggcuaga

SEQ ID NO: 2452097 - RNA, 14 nt, Human
gcugauuguauuua

SEQ ID NO: 2452098 - RNA, 20 nt, Human
gcugauucucagggucucug

SEQ ID NO: 2452099 - RNA, 20 nt, Human
gcugauguuggaagagaaag

SEQ ID NO: 2452100 - RNA, 21 nt, Human
gcugauguucaguguaauuuc

SEQ ID NO: 2452101 - RNA, 21 nt, Human
gcugaugaacuuauucuguag

SEQ ID NO: 2452102 - RNA, 16 nt, Human
gcugaucgugcuaaau

SEQ ID NO: 2452103 - RNA, 13 nt, Human
gcugauucucagg

SEQ ID NO: 2452104 - RNA, 18 nt, Human
gcugagaagcuuuugaau

SEQ ID NO: 2452105 - RNA, 14 nt, Human
gcugagacugcggg

SEQ ID NO: 2452106 - RNA, 15 nt, Human
gcugagacaggagaa

SEQ ID NO: 2452107 - RNA, 19 nt, Human
gcugagacuggauacugcc

SEQ ID NO: 2452108 - RNA, 20 nt, Human
gcugagacuggauacugccc

SEQ ID NO: 2452109 - RNA, 15 nt, Human
gcugagagaaaauaa

SEQ ID NO: 2452110 - RNA, 19 nt, Human
gcugagagaccaggagggc

SEQ ID NO: 2452111 - RNA, 14 nt, Human
gcugagagaaccuc

SEQ ID NO: 2452112 - RNA, 22 nt, Human
gcugagagaccaggagggcacu

SEQ ID NO: 2452113 - RNA, 14 nt, Human
gcugagagacccaa

SEQ ID NO: 2452114 - RNA, 15 nt, Human
gcugagagacccaag

SEQ ID NO: 2452115 - RNA, 17 nt, Human
gcugagagacccaagga

SEQ ID NO: 2452116 - RNA, 23 nt, Human
gcugagaacccugcguggggaca

SEQ ID NO: 2452117 - RNA, 14 nt, Human
gcugagaacacugu

SEQ ID NO: 2452118 - RNA, 18 nt, Human
gcugacuuugcucuuucu

SEQ ID NO: 2452119 - RNA, 20 nt, Human
gcugagagccccagcugaca

SEQ ID NO: 2452120 - RNA, 18 nt, Human
gcugagagccccagcuga

SEQ ID NO: 2452121 - RNA, 17 nt, Human
gcugagagccccagcug

SEQ ID NO: 2452122 - RNA, 15 nt, Human
gcugagagccccagc

SEQ ID NO: 2452123 - RNA, 14 nt, Human
gcugagagccccag

SEQ ID NO: 2452124 - RNA, 13 nt, Human
gcugagagcccca

SEQ ID NO: 2452125 - RNA, 14 nt, Human
gcugagagacuuuu

SEQ ID NO: 2452126 - RNA, 20 nt, Human
gcugagagacccaaggagga

SEQ ID NO: 2452127 - RNA, 22 nt, Human
gcugagagacccaaggaggaaa

SEQ ID NO: 2452128 - RNA, 16 nt, Human
gcugaucagugggccu

SEQ ID NO: 2452129 - RNA, 18 nt, Human
gcugauccagagcacaga

SEQ ID NO: 2452130 - RNA, 17 nt, Human
gcugauauauguguuuu

SEQ ID NO: 2452131 - RNA, 18 nt, Human
gcugauauauguguuuuu

SEQ ID NO: 2452132 - RNA, 20 nt, Human
gcugauauauguguuuuuca

SEQ ID NO: 2452133 - RNA, 17 nt, Human
gcugcaguugccaguca

SEQ ID NO: 2452134 - RNA, 17 nt, Human
gcugcauuuaaaagaua

SEQ ID NO: 2452135 - RNA, 18 nt, Human
gcugcauuuaaaagauac

SEQ ID NO: 2452136 - RNA, 19 nt, Human
gcugcauuuaaaagauaca

SEQ ID NO: 2452137 - RNA, 15 nt, Human
gcugccaaauuuugg

SEQ ID NO: 2452138 - RNA, 23 nt, Human
gcugcauuuuaauuuuaaccaaa

SEQ ID NO: 2452139 - RNA, 17 nt, Human
gcugccaaauuuuggcc

SEQ ID NO: 2452140 - RNA, 15 nt, Human
gcugccaaggccaga

SEQ ID NO: 2452141 - RNA, 14 nt, Human
gcugcaguugccag

SEQ ID NO: 2452142 - RNA, 13 nt, Human
gcugcaguugcca

SEQ ID NO: 2452143 - RNA, 22 nt, Human
gcugcaggggcucuggagagaa

SEQ ID NO: 2452144 - RNA, 13 nt, Human
gcugcaaaggaca

SEQ ID NO: 2452145 - RNA, 15 nt, Human
gcugcaaaggacaga

SEQ ID NO: 2452146 - RNA, 17 nt, Human
gcugcaaaagugagggc

SEQ ID NO: 2452147 - RNA, 21 nt, Human
gcugcaggggcucuggagaga

SEQ ID NO: 2452148 - RNA, 18 nt, Human
gcugcaguaugaaaauaa

SEQ ID NO: 2452149 - RNA, 20 nt, Human
gcugcagugacgugcaccug

SEQ ID NO: 2452150 - RNA, 23 nt, Human
gcugccacacuucaggcucuucu

SEQ ID NO: 2452151 - RNA, 22 nt, Human
gcugccacacuucaggcucuuc

SEQ ID NO: 2452152 - RNA, 21 nt, Human
gcugccacacuucaggcucuu

SEQ ID NO: 2452153 - RNA, 18 nt, Human
gcugccacacuucaggcu

SEQ ID NO: 2452154 - RNA, 17 nt, Human
gcugccacacuucaggc

SEQ ID NO: 2452155 - RNA, 15 nt, Human
gcugccacacuucag

SEQ ID NO: 2452156 - RNA, 20 nt, Human
gcugccaaugggagcucaug

SEQ ID NO: 2452157 - RNA, 16 nt, Human
gcugccaaggccagag

SEQ ID NO: 2452158 - RNA, 17 nt, Human
gcugccaaggccagagu

SEQ ID NO: 2452159 - RNA, 22 nt, Human
gcugcccuccuuguccacccac

SEQ ID NO: 2452160 - RNA, 21 nt, Human
gcugcccuccuuguccaccca

SEQ ID NO: 2452161 - RNA, 20 nt, Human
gcugcccuccuuguccaccc

SEQ ID NO: 2452162 - RNA, 16 nt, Human
gcugcccuccuugucc

SEQ ID NO: 2452163 - RNA, 22 nt, Human
gcugccacccaccucccugccu

SEQ ID NO: 2452164 - RNA, 23 nt, Human
gcugccacccaccucccugccuc

SEQ ID NO: 2452165 - RNA, 13 nt, Human
gcugccaccugcc

SEQ ID NO: 2452166 - RNA, 12 nt, Human
gcugccaccugc

SEQ ID NO: 2452167 - RNA, 17 nt, Human
gcugccacccaccuccc

SEQ ID NO: 2452168 - RNA, 19 nt, Human
gcugccacccaccucccug

SEQ ID NO: 2452169 - RNA, 20 nt, Human
gcugccacccaccucccugc

SEQ ID NO: 2452170 - RNA, 21 nt, Human
gcugccacccaccucccugcc

SEQ ID NO: 2452171 - RNA, 16 nt, Human
gcugccacaccugagc

SEQ ID NO: 2452172 - RNA, 14 nt, Human
gcugccacccaccu

SEQ ID NO: 2452173 - RNA, 19 nt, Human
gcugacagacacaggcccg

SEQ ID NO: 2452174 - RNA, 18 nt, Human
gcugacagacacaggccc

SEQ ID NO: 2452175 - RNA, 23 nt, Human
gcucuuuggggucagccagggcc

SEQ ID NO: 2452176 - RNA, 22 nt, Human
gcucuuuggggucagccagggc

SEQ ID NO: 2452177 - RNA, 21 nt, Human
gcucuuuggggucagccaggg

SEQ ID NO: 2452178 - RNA, 20 nt, Human
gcucuuuggggucagccagg

SEQ ID NO: 2452179 - RNA, 13 nt, Human
gcucuuugguaga

SEQ ID NO: 2452180 - RNA, 18 nt, Human
gcucuuugguagaaaagg

SEQ ID NO: 2452181 - RNA, 17 nt, Human
gcugacagacacaggcc

SEQ ID NO: 2452182 - RNA, 22 nt, Human
gcucuuugguagaaaaggcuag

SEQ ID NO: 2452183 - RNA, 20 nt, Human
gcugacagacacaggcccgg

SEQ ID NO: 2452184 - RNA, 13 nt, Human
gcugaccacagca

SEQ ID NO: 2452185 - RNA, 15 nt, Human
gcugaccaagagaga

SEQ ID NO: 2452186 - RNA, 16 nt, Human
gcugaccaagagagaa

SEQ ID NO: 2452187 - RNA, 20 nt, Human
gcugaccaagagagaaagaa

SEQ ID NO: 2452188 - RNA, 16 nt, Human
gcugacauucaccugc

SEQ ID NO: 2452189 - RNA, 17 nt, Human
gcugacauucaccugcc

SEQ ID NO: 2452190 - RNA, 22 nt, Human
gcugacauuguggcacauucuu

SEQ ID NO: 2452191 - RNA, 21 nt, Human
gcugacauuguggcacauucu

SEQ ID NO: 2452192 - RNA, 13 nt, Human
gcugaccaagaga

SEQ ID NO: 2452193 - RNA, 14 nt, Human
gcugaccaagagag

SEQ ID NO: 2452194 - RNA, 24 nt, Human
gcugacuucaucucccaccuagca

SEQ ID NO: 2452195 - RNA, 17 nt, Human
gcugacggugcagucug

SEQ ID NO: 2452196 - RNA, 19 nt, Human
gcugacuucaucucccacc

SEQ ID NO: 2452197 - RNA, 22 nt, Human
gcugacuguuuucucuugagag

SEQ ID NO: 2452198 - RNA, 13 nt, Human
gcugacggccagg

SEQ ID NO: 2452199 - RNA, 15 nt, Human
gcugacggccaggga

SEQ ID NO: 2452200 - RNA, 17 nt, Human
gcugacgaacuuccaug

SEQ ID NO: 2452201 - RNA, 19 nt, Human
gcugacgaacuuccauggc

SEQ ID NO: 2452202 - RNA, 14 nt, Human
gcugaccacagcac

SEQ ID NO: 2452203 - RNA, 16 nt, Human
gcugaccacagcacag

SEQ ID NO: 2452204 - RNA, 17 nt, Human
gcugaccacagcacagc

SEQ ID NO: 2452205 - RNA, 19 nt, Human
gcugaccacagcacagcca

SEQ ID NO: 2452206 - RNA, 22 nt, Human
gcugaccucuguuguccucccc

SEQ ID NO: 2452207 - RNA, 19 nt, Human
gcugaccucuguuguccuc

SEQ ID NO: 2452208 - RNA, 21 nt, Human
gcugaccacaggcaguuacuu

SEQ ID NO: 2452209 - RNA, 18 nt, Human
gcugaccucuguuguccu

SEQ ID NO: 2452210 - RNA, 22 nt, Human
gcugaccuuccucgcagagagg

SEQ ID NO: 2452211 - RNA, 20 nt, Human
gcugaccuuccucgcagaga

SEQ ID NO: 2452212 - RNA, 19 nt, Human
gcugaccuuccucgcagag

SEQ ID NO: 2452213 - RNA, 18 nt, Human
gcugaccuuccucgcaga

SEQ ID NO: 2452214 - RNA, 17 nt, Human
gcugaccuuccucgcag

SEQ ID NO: 2452215 - RNA, 15 nt, Human
gcugacgaacuucca

SEQ ID NO: 2452216 - RNA, 21 nt, Human
gcugaccuugaacuccugggc

SEQ ID NO: 2452217 - RNA, 23 nt, Human
gcugaccuuccucgcagagaggc

SEQ ID NO: 2452218 - RNA, 20 nt, Human
gcugaccuugaacuccuggg

SEQ ID NO: 2452219 - RNA, 23 nt, Human
gcugaccuugaacuccugggcuc

SEQ ID NO: 2452220 - RNA, 21 nt, Human
gcucucaggccagcugcuugg

SEQ ID NO: 2452221 - RNA, 22 nt, Human
gcucucaguuccgauuucccag

SEQ ID NO: 2452222 - RNA, 21 nt, Human
gcucgccucaggaaugggcug

SEQ ID NO: 2452223 - RNA, 13 nt, Human
gcucgccaugccg

SEQ ID NO: 2452224 - RNA, 14 nt, Human
gcucgauuuuguau

SEQ ID NO: 2452225 - RNA, 14 nt, Human
gcucuugaacuccu

SEQ ID NO: 2452226 - RNA, 16 nt, Human
gcucuugaacuccuga

SEQ ID NO: 2452227 - RNA, 19 nt, Human
gcucuugaacuccugaccu

SEQ ID NO: 2452228 - RNA, 21 nt, Human
gcucuugaacuccugaccuca

SEQ ID NO: 2452229 - RNA, 22 nt, Human
gcucuccaagucucaguggcuu

SEQ ID NO: 2452230 - RNA, 18 nt, Human
gcucuccaagucucagug

SEQ ID NO: 2452231 - RNA, 15 nt, Human
gcucuccaagcccag

SEQ ID NO: 2452232 - RNA, 18 nt, Human
gcucuccaagugccagag

SEQ ID NO: 2452233 - RNA, 17 nt, Human
gcucuccaagugccaga

SEQ ID NO: 2452234 - RNA, 16 nt, Human
gcucuccaagugccag

SEQ ID NO: 2452235 - RNA, 13 nt, Human
gcucuccaagugc

SEQ ID NO: 2452236 - RNA, 12 nt, Human
gcucuucuuaaa

SEQ ID NO: 2452237 - RNA, 19 nt, Human
gcucuccaagugccagagg

SEQ ID NO: 2452238 - RNA, 14 nt, Human
gcucuucugccggc

SEQ ID NO: 2452239 - RNA, 19 nt, Human
gcucuugcccuucccuguc

SEQ ID NO: 2452240 - RNA, 18 nt, Human
gcucuugcccuucccugu

SEQ ID NO: 2452241 - RNA, 17 nt, Human
gcucuugcccuucccug

SEQ ID NO: 2452242 - RNA, 16 nt, Human
gcucuugcccuucccu

SEQ ID NO: 2452243 - RNA, 12 nt, Human
gcucuugcccuu

SEQ ID NO: 2452244 - RNA, 19 nt, Human
gcucuugcuaaucaguguc

SEQ ID NO: 2452245 - RNA, 13 nt, Human
gcucuugcuaauc

SEQ ID NO: 2452246 - RNA, 23 nt, Human
gcucuugcccuucccugucccuc

SEQ ID NO: 2452247 - RNA, 22 nt, Human
gcucuugcccuucccugucccu

SEQ ID NO: 2452248 - RNA, 19 nt, Human
gcucuuggcagguacucag

SEQ ID NO: 2452249 - RNA, 19 nt, Human
gcucuugaugccuggcggg

SEQ ID NO: 2452250 - RNA, 20 nt, Human
gcucuugauaccccccucug

SEQ ID NO: 2452251 - RNA, 19 nt, Human
gcucuugauaccccccucu

SEQ ID NO: 2452252 - RNA, 17 nt, Human
gcucuugauaccccccu

SEQ ID NO: 2452253 - RNA, 14 nt, Human
gcucuucuucuuuc

SEQ ID NO: 2452254 - RNA, 21 nt, Human
gcucuucugccggcccugggg

SEQ ID NO: 2452255 - RNA, 23 nt, Human
gcucuugcuaaucagugucucac

SEQ ID NO: 2452256 - RNA, 20 nt, Human
gcucuugcuaaucagugucu

SEQ ID NO: 2452257 - RNA, 21 nt, Human
gcucuuucucugccagugaca

SEQ ID NO: 2452258 - RNA, 18 nt, Human
gcucuuucucugccagug

SEQ ID NO: 2452259 - RNA, 13 nt, Human
gcucuuucugggc

SEQ ID NO: 2452260 - RNA, 14 nt, Human
gcucuuucugggcc

SEQ ID NO: 2452261 - RNA, 18 nt, Human
gcucuuucugggccaagu

SEQ ID NO: 2452262 - RNA, 21 nt, Human
gcucuuugaaauagucugugu

SEQ ID NO: 2452263 - RNA, 23 nt, Human
gcucuuugaaauagucuguguga

SEQ ID NO: 2452264 - RNA, 18 nt, Human
gcucuuuggggucagcca

SEQ ID NO: 2452265 - RNA, 14 nt, Human
gcucuuuggagauc

SEQ ID NO: 2452266 - RNA, 21 nt, Human
gcgacaaugcaaaccaucauu

SEQ ID NO: 2452267 - RNA, 20 nt, Human
gcgacaaugcaaaccaucau

SEQ ID NO: 2452268 - RNA, 13 nt, Human
gcgacaaugcaaa

SEQ ID NO: 2452269 - RNA, 12 nt, Human
gcgacaaugcaa

SEQ ID NO: 2452270 - RNA, 20 nt, Human
gcgcaggcuggcccugcccu

SEQ ID NO: 2452271 - RNA, 21 nt, Human
gcgcaggcuggcccugcccug

SEQ ID NO: 2452272 - RNA, 16 nt, Human
gcgcagugccucuggu

SEQ ID NO: 2452273 - RNA, 15 nt, Human
gcgcagugccucugg

SEQ ID NO: 2452274 - RNA, 14 nt, Human
gcgcagugccucug

SEQ ID NO: 2452275 - RNA, 22 nt, Human
gcgcaggcuggcccugcccugg

SEQ ID NO: 2452276 - RNA, 18 nt, Human
gcgcaggcuggcccugcc

SEQ ID NO: 2452277 - RNA, 19 nt, Human
gcgcaggcuggcccugccc

SEQ ID NO: 2452278 - RNA, 17 nt, Human
gcgcaggcuggcccugc

SEQ ID NO: 2452279 - RNA, 13 nt, Human
gcgacaaagauga

SEQ ID NO: 2452280 - RNA, 18 nt, Human
gccuuucccaacucuagc

SEQ ID NO: 2452281 - RNA, 21 nt, Human
gccuuuccauaaggaauguag

SEQ ID NO: 2452282 - RNA, 22 nt, Human
gccuuuccauaaggaauguagc

SEQ ID NO: 2452283 - RNA, 19 nt, Human
gccuuucccaacucuagcu

SEQ ID NO: 2452284 - RNA, 21 nt, Human
gccuuuccuguagccuucugu

SEQ ID NO: 2452285 - RNA, 17 nt, Human
gccuuuccuguagccuu

SEQ ID NO: 2452286 - RNA, 22 nt, Human
gccuuucucccaggccaggcuc

SEQ ID NO: 2452287 - RNA, 18 nt, Human
gccuuucucccaggccag

SEQ ID NO: 2452288 - RNA, 19 nt, Human
gccuuucucgauuuuaucu

SEQ ID NO: 2452289 - RNA, 12 nt, Human
gccuuucugugu

SEQ ID NO: 2452290 - RNA, 23 nt, Human
gccuuucucccaggccaggcucc

SEQ ID NO: 2452291 - RNA, 14 nt, Human
gcgaauuuuaaaag

SEQ ID NO: 2452292 - RNA, 14 nt, Human
gcgaaucauuuguu

SEQ ID NO: 2452293 - RNA, 15 nt, Human
gcgaauuuuaaaaga

SEQ ID NO: 2452294 - RNA, 16 nt, Human
gcgaauuuuaaaagau

SEQ ID NO: 2452295 - RNA, 13 nt, Human
gccuuucugugug

SEQ ID NO: 2452296 - RNA, 14 nt, Human
gcgaaggggcccug

SEQ ID NO: 2452297 - RNA, 15 nt, Human
gcgaaggggcccugg

SEQ ID NO: 2452298 - RNA, 16 nt, Human
gcgaaggggcccuggu

SEQ ID NO: 2452299 - RNA, 15 nt, Human
gccuuacacaauggu

SEQ ID NO: 2452300 - RNA, 16 nt, Human
gccuuaaagaaagucg

SEQ ID NO: 2452301 - RNA, 20 nt, Human
gccugucugucucuccaucu

SEQ ID NO: 2452302 - RNA, 16 nt, Human
gccuuaaaacuuuaau

SEQ ID NO: 2452303 - RNA, 16 nt, Human
gccuuacacaaugguu

SEQ ID NO: 2452304 - RNA, 23 nt, Human
gccuucccuagcuuuagacccug

SEQ ID NO: 2452305 - RNA, 24 nt, Human
gccuucccuagcuuuagacccugg

SEQ ID NO: 2452306 - RNA, 17 nt, Human
gccuuaauuuucaguau

SEQ ID NO: 2452307 - RNA, 18 nt, Human
gccuuccccuugcccagg

SEQ ID NO: 2452308 - RNA, 14 nt, Human
gccuuccuccuggg

SEQ ID NO: 2452309 - RNA, 16 nt, Human
gccuuccuccugggcc

SEQ ID NO: 2452310 - RNA, 17 nt, Human
gccuuccuccugggccc

SEQ ID NO: 2452311 - RNA, 22 nt, Human
gccuuccuccugggcccucucu

SEQ ID NO: 2452312 - RNA, 20 nt, Human
gccuuccguaacccaacucu

SEQ ID NO: 2452313 - RNA, 13 nt, Human
gccuuccuccugg

SEQ ID NO: 2452314 - RNA, 17 nt, Human
gccuuccuccacauccu

SEQ ID NO: 2452315 - RNA, 13 nt, Human
gccuuccucucuc

SEQ ID NO: 2452316 - RNA, 16 nt, Human
gccuuccucucuccag

SEQ ID NO: 2452317 - RNA, 17 nt, Human
gccuuccucucuccaga

SEQ ID NO: 2452318 - RNA, 18 nt, Human
gccuuccucucuccagau

SEQ ID NO: 2452319 - RNA, 18 nt, Human
gccuuccuccacauccuu

SEQ ID NO: 2452320 - RNA, 16 nt, Human
gccuugguguccaccu

SEQ ID NO: 2452321 - RNA, 20 nt, Human
gccuuguaauucuaaaugaa

SEQ ID NO: 2452322 - RNA, 17 nt, Human
gccuuguaauucuaaau

SEQ ID NO: 2452323 - RNA, 22 nt, Human
gccuugguguccaccuggcccc

SEQ ID NO: 2452324 - RNA, 18 nt, Human
gccuugguucccuugugu

SEQ ID NO: 2452325 - RNA, 17 nt, Human
gccuugguguccaccug

SEQ ID NO: 2452326 - RNA, 18 nt, Human
gccuugguguccaccugg

SEQ ID NO: 2452327 - RNA, 19 nt, Human
gccuugguguccaccuggc

SEQ ID NO: 2452328 - RNA, 21 nt, Human
gccuugguguccaccuggccc

SEQ ID NO: 2452329 - RNA, 23 nt, Human
gccuuguccccugccugugccug

SEQ ID NO: 2452330 - RNA, 18 nt, Human
gccuuguccccugccugu

SEQ ID NO: 2452331 - RNA, 17 nt, Human
gccuugucccagaggcu

SEQ ID NO: 2452332 - RNA, 17 nt, Human
gccuugugucuacagag

SEQ ID NO: 2452333 - RNA, 15 nt, Human
gccuugugucuacag

SEQ ID NO: 2452334 - RNA, 12 nt, Human
gccuuguguaca

SEQ ID NO: 2452335 - RNA, 14 nt, Human
gcgguccacccagg

SEQ ID NO: 2452336 - RNA, 13 nt, Human
gcgguccacccag

SEQ ID NO: 2452337 - RNA, 21 nt, Human
gcgguagccagcacacagggc

SEQ ID NO: 2452338 - RNA, 22 nt, Human
gcgguagccagcacacagggca

SEQ ID NO: 2452339 - RNA, 23 nt, Human
gcgguagccagcacacagggcag

SEQ ID NO: 2452340 - RNA, 19 nt, Human
gcggugagaggggaacaga

SEQ ID NO: 2452341 - RNA, 18 nt, Human
gcggagaaccuugugccu

SEQ ID NO: 2452342 - RNA, 15 nt, Human
gcggacguuccagcc

SEQ ID NO: 2452343 - RNA, 16 nt, Human
gcggacguuccagccg

SEQ ID NO: 2452344 - RNA, 19 nt, Human
gcggguggaucaccugagg

SEQ ID NO: 2452345 - RNA, 23 nt, Human
gcggagaaccuugugccuggcuc

SEQ ID NO: 2452346 - RNA, 19 nt, Human
gcggagaaccuugugccug

SEQ ID NO: 2452347 - RNA, 14 nt, Human
gcgggugggggugg

SEQ ID NO: 2452348 - RNA, 15 nt, Human
gcgguagccagcaca

SEQ ID NO: 2452349 - RNA, 15 nt, Human
gcgggugggggugga

SEQ ID NO: 2452350 - RNA, 17 nt, Human
gcggggacagcuccuuc

SEQ ID NO: 2452351 - RNA, 15 nt, Human
gcggggacagcuccu

SEQ ID NO: 2452352 - RNA, 14 nt, Human
gcggggacagcucc

SEQ ID NO: 2452353 - RNA, 19 nt, Human
gcggagacggagucccacc

SEQ ID NO: 2452354 - RNA, 16 nt, Human
gcggagaaaggaaggg

SEQ ID NO: 2452355 - RNA, 13 nt, Human
gcggaccccagcu

SEQ ID NO: 2452356 - RNA, 20 nt, Human
gcggaccccagcugugagcc

SEQ ID NO: 2452357 - RNA, 14 nt, Human
gcggaccccagcug

SEQ ID NO: 2452358 - RNA, 21 nt, Human
gcggaccccagcugugagccu

SEQ ID NO: 2452359 - RNA, 14 nt, Human
gcggacguuccagc

SEQ ID NO: 2452360 - RNA, 21 nt, Human
gcgcugccccuggcagccccu

SEQ ID NO: 2452361 - RNA, 18 nt, Human
gcgcugccccuggcagcc

SEQ ID NO: 2452362 - RNA, 13 nt, Human
gcgccuucucccc

SEQ ID NO: 2452363 - RNA, 16 nt, Human
gcgcugccgcacccca

SEQ ID NO: 2452364 - RNA, 17 nt, Human
gcgcugccgcaccccag

SEQ ID NO: 2452365 - RNA, 19 nt, Human
gcgcugccgcaccccagag

SEQ ID NO: 2452366 - RNA, 21 nt, Human
gcgcugccgcaccccagagug

SEQ ID NO: 2452367 - RNA, 14 nt, Human
gcgcuggcccagcc

SEQ ID NO: 2452368 - RNA, 13 nt, Human
gcgcuggcccagc

SEQ ID NO: 2452369 - RNA, 12 nt, Human
gcgcuggcccag

SEQ ID NO: 2452370 - RNA, 11 nt, Human
gcgcuggccca

SEQ ID NO: 2452371 - RNA, 15 nt, Human
gcgcugccugugugg

SEQ ID NO: 2452372 - RNA, 14 nt, Human
gcgcugccugugug

SEQ ID NO: 2452373 - RNA, 19 nt, Human
gcgcugccugugugguguc

SEQ ID NO: 2452374 - RNA, 10 nt, Human
gcgcuggccc

SEQ ID NO: 2452375 - RNA, 17 nt, Human
gcgccgagucugucucu

SEQ ID NO: 2452376 - RNA, 16 nt, Human
gcgcccuuccucucca

SEQ ID NO: 2452377 - RNA, 18 nt, Human
gcgcccuuccucuccacc

SEQ ID NO: 2452378 - RNA, 14 nt, Human
gcgcccuuccucuc

SEQ ID NO: 2452379 - RNA, 12 nt, Human
gcgcccuuccuc

SEQ ID NO: 2452380 - RNA, 16 nt, Human
gcgcccucuguccuga

SEQ ID NO: 2452381 - RNA, 15 nt, Human
gcgcccucuguccug

SEQ ID NO: 2452382 - RNA, 14 nt, Human
gcgcccucuguccu

SEQ ID NO: 2452383 - RNA, 13 nt, Human
gcgcccucugucc

SEQ ID NO: 2452384 - RNA, 16 nt, Human
gcgcccgcugggcuga

SEQ ID NO: 2452385 - RNA, 15 nt, Human
gcgcccgcugggcug

SEQ ID NO: 2452386 - RNA, 14 nt, Human
gcgcccgcugggcu

SEQ ID NO: 2452387 - RNA, 13 nt, Human
gcgcccgcugggc

SEQ ID NO: 2452388 - RNA, 13 nt, Human
gcgcccuggaagc

SEQ ID NO: 2452389 - RNA, 14 nt, Human
gcgcccuggaagcc

SEQ ID NO: 2452390 - RNA, 21 nt, Human
gcgccuuaaggauguucuagc

SEQ ID NO: 2452391 - RNA, 16 nt, Human
gcgccugccccuccca

SEQ ID NO: 2452392 - RNA, 17 nt, Human
gcgccugccccucccag

SEQ ID NO: 2452393 - RNA, 16 nt, Human
gcgccuguagucccag

SEQ ID NO: 2452394 - RNA, 18 nt, Human
gcgccugccccucccaga

SEQ ID NO: 2452395 - RNA, 12 nt, Human
gcgccucugcaa

SEQ ID NO: 2452396 - RNA, 20 nt, Human
gcgccgagucugucucuguc

SEQ ID NO: 2452397 - RNA, 15 nt, Human
gcgccuccuuccuug

SEQ ID NO: 2452398 - RNA, 22 nt, Human
gcgccuccuuccuugcuguccu

SEQ ID NO: 2452399 - RNA, 19 nt, Human
gcgccuccauccaaggcca

SEQ ID NO: 2452400 - RNA, 18 nt, Human
gcgccgcaaaccacacug

SEQ ID NO: 2452401 - RNA, 17 nt, Human
gcgccgcaaaccacacu

SEQ ID NO: 2452402 - RNA, 14 nt, Human
gcgccaagcaaccu

SEQ ID NO: 2452403 - RNA, 18 nt, Human
gcgccaaauaaugucucu

SEQ ID NO: 2452404 - RNA, 18 nt, Human
gcgcagugcuucucuaca

SEQ ID NO: 2452405 - RNA, 21 nt, Human
gcgcagugccucuggucuggg

SEQ ID NO: 2452406 - RNA, 22 nt, Human
gcgcagugcuucucuacagacu

SEQ ID NO: 2452407 - RNA, 21 nt, Human
gcgccaagcaaccugggucca

SEQ ID NO: 2452408 - RNA, 21 nt, Human
gcgccacuacacuccagccug

SEQ ID NO: 2452409 - RNA, 22 nt, Human
gcgccacuacacuccagccuga

SEQ ID NO: 2452410 - RNA, 22 nt, Human
gcgccacuacacuccagccugg

SEQ ID NO: 2452411 - RNA, 14 nt, Human
gcgccaccauccug

SEQ ID NO: 2452412 - RNA, 24 nt, Human
gcgccacuacacuccagccugagc

SEQ ID NO: 2452413 - RNA, 16 nt, Human
gcgccacucgcuuccc

SEQ ID NO: 2452414 - RNA, 18 nt, Human
gcgccacucgcuuccccc

SEQ ID NO: 2452415 - RNA, 21 nt, Human
gcgcccccuccgcccugccac

SEQ ID NO: 2452416 - RNA, 22 nt, Human
gcgcccccuccgcccugccacu

SEQ ID NO: 2452417 - RNA, 13 nt, Human
gcgcccgcgcccg

SEQ ID NO: 2452418 - RNA, 13 nt, Human
gcgccccuucccc

SEQ ID NO: 2452419 - RNA, 23 nt, Human
gcgcccaguuggguggaugccug

SEQ ID NO: 2452420 - RNA, 23 nt, Human
gcgccacucgcuucccccauagc

SEQ ID NO: 2452421 - RNA, 22 nt, Human
gcgcccaguccuuccaccucga

SEQ ID NO: 2452422 - RNA, 21 nt, Human
gccuggcagccgugccuucag

SEQ ID NO: 2452423 - RNA, 20 nt, Human
gccuggcagccgugccuuca

SEQ ID NO: 2452424 - RNA, 12 nt, Human
gccuggcagccg

SEQ ID NO: 2452425 - RNA, 18 nt, Human
gccuggcacaucagaaag

SEQ ID NO: 2452426 - RNA, 13 nt, Human
gccuggcagaacu

SEQ ID NO: 2452427 - RNA, 18 nt, Human
gccuggcagaacugagcu

SEQ ID NO: 2452428 - RNA, 19 nt, Human
gccuggcagaacugagcuc

SEQ ID NO: 2452429 - RNA, 23 nt, Human
gccuggcacagugucugggcuga

SEQ ID NO: 2452430 - RNA, 22 nt, Human
gccuggcacagugucugggcug

SEQ ID NO: 2452431 - RNA, 21 nt, Human
gccuggcacagugucugggcu

SEQ ID NO: 2452432 - RNA, 16 nt, Human
gccuggcacagugucu

SEQ ID NO: 2452433 - RNA, 14 nt, Human
gccuggcacagugu

SEQ ID NO: 2452434 - RNA, 20 nt, Human
gccuggauucauuuccugcc

SEQ ID NO: 2452435 - RNA, 14 nt, Human
gccuggcacacauc

SEQ ID NO: 2452436 - RNA, 19 nt, Human
gccuggcacagggcagugg

SEQ ID NO: 2452437 - RNA, 18 nt, Human
gccuggcacagggcagug

SEQ ID NO: 2452438 - RNA, 22 nt, Human
gccuggccagaugcaccagccc

SEQ ID NO: 2452439 - RNA, 21 nt, Human
gccuggccagaugcaccagcc

SEQ ID NO: 2452440 - RNA, 16 nt, Human
gccuggccagaugcac

SEQ ID NO: 2452441 - RNA, 22 nt, Human
gccuggcagccgugccuucagc

SEQ ID NO: 2452442 - RNA, 20 nt, Human
gccuggccagaugcaccagc

SEQ ID NO: 2452443 - RNA, 14 nt, Human
gccuggccccucag

SEQ ID NO: 2452444 - RNA, 13 nt, Human
gccuggccccuca

SEQ ID NO: 2452445 - RNA, 16 nt, Human
gccuggccccaugguc

SEQ ID NO: 2452446 - RNA, 17 nt, Human
gccuggcccagcucccc

SEQ ID NO: 2452447 - RNA, 16 nt, Human
gccuggcccagcuccc

SEQ ID NO: 2452448 - RNA, 15 nt, Human
gccuggcccagcucc

SEQ ID NO: 2452449 - RNA, 14 nt, Human
gccuggcccagcuc

SEQ ID NO: 2452450 - RNA, 13 nt, Human
gccuggcccagcu

SEQ ID NO: 2452451 - RNA, 11 nt, Human
gccuggcccag

SEQ ID NO: 2452452 - RNA, 12 nt, Human
gccuggcccagc

SEQ ID NO: 2452453 - RNA, 22 nt, Human
gccuggcagaacugagcuccuc

SEQ ID NO: 2452454 - RNA, 13 nt, Human
gccugggccagag

SEQ ID NO: 2452455 - RNA, 16 nt, Human
gccugggccgcugcca

SEQ ID NO: 2452456 - RNA, 20 nt, Human
gccugggccacagggcgaga

SEQ ID NO: 2452457 - RNA, 17 nt, Human
gccuggcccccuguccu

SEQ ID NO: 2452458 - RNA, 15 nt, Human
gccuggcccccagcu

SEQ ID NO: 2452459 - RNA, 18 nt, Human
gccuggcccccagcugug

SEQ ID NO: 2452460 - RNA, 13 nt, Human
gccugggcagcau

SEQ ID NO: 2452461 - RNA, 19 nt, Human
gccugggcagcauagcaag

SEQ ID NO: 2452462 - RNA, 17 nt, Human
gccugggcagccaggcu

SEQ ID NO: 2452463 - RNA, 18 nt, Human
gccugggcagccaggcug

SEQ ID NO: 2452464 - RNA, 20 nt, Human
gccugggcagccaggcugcc

SEQ ID NO: 2452465 - RNA, 23 nt, Human
gccugggcagccaggcugccaag

SEQ ID NO: 2452466 - RNA, 17 nt, Human
gccugucugucucucca

SEQ ID NO: 2452467 - RNA, 14 nt, Human
gccugucugucucu

SEQ ID NO: 2452468 - RNA, 12 nt, Human
gccugucugucu

SEQ ID NO: 2452469 - RNA, 14 nt, Human
gccugucucuucca

SEQ ID NO: 2452470 - RNA, 13 nt, Human
gccugucucuucc

SEQ ID NO: 2452471 - RNA, 19 nt, Human
gccugucucauccccaggg

SEQ ID NO: 2452472 - RNA, 22 nt, Human
gccugucucauccccagggguc

SEQ ID NO: 2452473 - RNA, 16 nt, Human
gccuguccugggcugg

SEQ ID NO: 2452474 - RNA, 13 nt, Human
gccugucuccuuu

SEQ ID NO: 2452475 - RNA, 21 nt, Human
gccugucuccuuugcaggcuc

SEQ ID NO: 2452476 - RNA, 22 nt, Human
gccugucuccuuugcaggcuca

SEQ ID NO: 2452477 - RNA, 20 nt, Human
gccuguacucgcuugugcag

SEQ ID NO: 2452478 - RNA, 17 nt, Human
gccuguaaucccagcua

SEQ ID NO: 2452479 - RNA, 18 nt, Human
gccuguaaucccagcuac

SEQ ID NO: 2452480 - RNA, 19 nt, Human
gccuguacucgcuugugca

SEQ ID NO: 2452481 - RNA, 19 nt, Human
gccuguaaucccagcuacu

SEQ ID NO: 2452482 - RNA, 13 nt, Human
gccuguccugggc

SEQ ID NO: 2452483 - RNA, 17 nt, Human
gccugucucauccccag

SEQ ID NO: 2452484 - RNA, 18 nt, Human
gccugucucauccccagg

SEQ ID NO: 2452485 - RNA, 20 nt, Human
gccuguaauccuagcacuuu

SEQ ID NO: 2452486 - RNA, 16 nt, Human
gccuguaaucccagcu

SEQ ID NO: 2452487 - RNA, 16 nt, Human
gccuggucccugggag

SEQ ID NO: 2452488 - RNA, 15 nt, Human
gccuggucccuggga

SEQ ID NO: 2452489 - RNA, 15 nt, Human
gccuguaauccuagc

SEQ ID NO: 2452490 - RNA, 14 nt, Human
gccuggucccuggg

SEQ ID NO: 2452491 - RNA, 17 nt, Human
gccuggucacagggcau

SEQ ID NO: 2452492 - RNA, 22 nt, Human
gccugguccaugauggagucag

SEQ ID NO: 2452493 - RNA, 18 nt, Human
gccugggccgcugccacg

SEQ ID NO: 2452494 - RNA, 17 nt, Human
gccugggccgcugccac

SEQ ID NO: 2452495 - RNA, 21 nt, Human
gccugggccuccucacaacau

SEQ ID NO: 2452496 - RNA, 20 nt, Human
gccugggcgacagagcgaga

SEQ ID NO: 2452497 - RNA, 23 nt, Human
gccugggcucccuugugcguggg

SEQ ID NO: 2452498 - RNA, 14 nt, Human
gccuggucagccca

SEQ ID NO: 2452499 - RNA, 15 nt, Human
gccuggucagcccaa

SEQ ID NO: 2452500 - RNA, 20 nt, Human
gccugguauauccaaaagcu

SEQ ID NO: 2452501 - RNA, 13 nt, Human
gccuggucagccc

SEQ ID NO: 2452502 - RNA, 20 nt, Human
gccugggcuguuggcacuca

SEQ ID NO: 2452503 - RNA, 18 nt, Human
gccugggcuguuggcacu

SEQ ID NO: 2452504 - RNA, 15 nt, Human
gccugggcuguuggc

SEQ ID NO: 2452505 - RNA, 20 nt, Human
gccuggguuuaaggggagag

SEQ ID NO: 2452506 - RNA, 24 nt, Human
gccuggguggggcugcuccuccag

SEQ ID NO: 2452507 - RNA, 22 nt, Human
gccuggggcuccuuucuccagc

SEQ ID NO: 2452508 - RNA, 17 nt, Human
gccuggggcgggccccu

SEQ ID NO: 2452509 - RNA, 22 nt, Human
gccuggguggggcugcuccucc

SEQ ID NO: 2452510 - RNA, 23 nt, Human
gccuggguggggcugcuccucca

SEQ ID NO: 2452511 - RNA, 17 nt, Human
gccugagcgacagugag

SEQ ID NO: 2452512 - RNA, 20 nt, Human
gccugagcgacagugagacu

SEQ ID NO: 2452513 - RNA, 18 nt, Human
gccugaagucacacagug

SEQ ID NO: 2452514 - RNA, 17 nt, Human
gccugaagucacacagu

SEQ ID NO: 2452515 - RNA, 16 nt, Human
gccugaagucacacag

SEQ ID NO: 2452516 - RNA, 15 nt, Human
gccugaagucacaca

SEQ ID NO: 2452517 - RNA, 21 nt, Human
gcccaguuggguggaugccug

SEQ ID NO: 2452518 - RNA, 19 nt, Human
gcccaguuggguggaugcc

SEQ ID NO: 2452519 - RNA, 21 nt, Human
gcccaguccuggccuggcuuc

SEQ ID NO: 2452520 - RNA, 14 nt, Human
gccugagccuggcc

SEQ ID NO: 2452521 - RNA, 16 nt, Human
gccugagccuggccag

SEQ ID NO: 2452522 - RNA, 17 nt, Human
gccugagccuggccagc

SEQ ID NO: 2452523 - RNA, 22 nt, Human
gccugagcgcuccugccgcaga

SEQ ID NO: 2452524 - RNA, 12 nt, Human
gccugagcuggg

SEQ ID NO: 2452525 - RNA, 20 nt, Human
gccugaggaugagcuggaag

SEQ ID NO: 2452526 - RNA, 18 nt, Human
gccugaggaugagcugga

SEQ ID NO: 2452527 - RNA, 21 nt, Human
gccugaggaugagcuggaagg

SEQ ID NO: 2452528 - RNA, 13 nt, Human
gccugaggcugag

SEQ ID NO: 2452529 - RNA, 14 nt, Human
gccugaggcugaga

SEQ ID NO: 2452530 - RNA, 17 nt, Human
gccugagcucacucggc

SEQ ID NO: 2452531 - RNA, 14 nt, Human
gccugagcucacuc

SEQ ID NO: 2452532 - RNA, 23 nt, Human
gccugagcgcuccugccgcagag

SEQ ID NO: 2452533 - RNA, 17 nt, Human
gccugaggaugagcugg

SEQ ID NO: 2452534 - RNA, 23 nt, Human
gccugagcucacucggcacccug

SEQ ID NO: 2452535 - RNA, 14 nt, Human
gccugaggaugagc

SEQ ID NO: 2452536 - RNA, 19 nt, Human
gccugcaggugcugcugcg

SEQ ID NO: 2452537 - RNA, 16 nt, Human
gccugcaggugcugcu

SEQ ID NO: 2452538 - RNA, 14 nt, Human
gccugcaggugcug

SEQ ID NO: 2452539 - RNA, 24 nt, Human
gccugcaggguggugcugggacug

SEQ ID NO: 2452540 - RNA, 23 nt, Human
gccugcaggguggugcugggacu

SEQ ID NO: 2452541 - RNA, 22 nt, Human
gccugcaggguggugcugggac

SEQ ID NO: 2452542 - RNA, 21 nt, Human
gccugcaggguggugcuggga

SEQ ID NO: 2452543 - RNA, 20 nt, Human
gccugcaggguggugcuggg

SEQ ID NO: 2452544 - RNA, 19 nt, Human
gccugcaggguggugcugg

SEQ ID NO: 2452545 - RNA, 22 nt, Human
gccugcaggaccugccuguagc

SEQ ID NO: 2452546 - RNA, 10 nt, Human
gccugaggga

SEQ ID NO: 2452547 - RNA, 14 nt, Human
gccugaggcuggga

SEQ ID NO: 2452548 - RNA, 15 nt, Human
gccugaggcugagac

SEQ ID NO: 2452549 - RNA, 17 nt, Human
gccugaggcugagacug

SEQ ID NO: 2452550 - RNA, 18 nt, Human
gccugaggcugagacugc

SEQ ID NO: 2452551 - RNA, 13 nt, Human
gccugaggcuggg

SEQ ID NO: 2452552 - RNA, 13 nt, Human
gccuggaagacag

SEQ ID NO: 2452553 - RNA, 23 nt, Human
gccuggaagacagagaccuccug

SEQ ID NO: 2452554 - RNA, 22 nt, Human
gccuggaagacagagaccuccu

SEQ ID NO: 2452555 - RNA, 15 nt, Human
gccuggaagacagag

SEQ ID NO: 2452556 - RNA, 14 nt, Human
gccuggaagacaga

SEQ ID NO: 2452557 - RNA, 10 nt, Human
gccugcugca

SEQ ID NO: 2452558 - RNA, 11 nt, Human
gccugcugcau

SEQ ID NO: 2452559 - RNA, 18 nt, Human
gccugcugcauggggugg

SEQ ID NO: 2452560 - RNA, 23 nt, Human
gccugcugaaugauuuccaaaga

SEQ ID NO: 2452561 - RNA, 11 nt, Human
gccugcucccc

SEQ ID NO: 2452562 - RNA, 13 nt, Human
gccugcuccccca

SEQ ID NO: 2452563 - RNA, 15 nt, Human
gccugcucccccacc

SEQ ID NO: 2452564 - RNA, 16 nt, Human
gccugcucccccaccc

SEQ ID NO: 2452565 - RNA, 17 nt, Human
gccugcucccccacccc

SEQ ID NO: 2452566 - RNA, 19 nt, Human
gccugcucccccacccccu

SEQ ID NO: 2452567 - RNA, 17 nt, Human
gccugcaguccuggaag

SEQ ID NO: 2452568 - RNA, 21 nt, Human
gccugcaugcuggguucugca

SEQ ID NO: 2452569 - RNA, 22 nt, Human
gccugcucccagcagcccuaag

SEQ ID NO: 2452570 - RNA, 20 nt, Human
gccugcucccagcagcccua

SEQ ID NO: 2452571 - RNA, 16 nt, Human
gccugcauguaaacac

SEQ ID NO: 2452572 - RNA, 13 nt, Human
gccugcauucugc

SEQ ID NO: 2452573 - RNA, 18 nt, Human
gccuggauggggcugcac

SEQ ID NO: 2452574 - RNA, 16 nt, Human
gccuggauggggcugc

SEQ ID NO: 2452575 - RNA, 15 nt, Human
gccuggacccccagc

SEQ ID NO: 2452576 - RNA, 13 nt, Human
gccuggaccccca

SEQ ID NO: 2452577 - RNA, 17 nt, Human
gccuggacccccagcuu

SEQ ID NO: 2452578 - RNA, 20 nt, Human
gccuggacauuugccuugcu

SEQ ID NO: 2452579 - RNA, 16 nt, Human
gccuggcacacaucag

SEQ ID NO: 2452580 - RNA, 18 nt, Human
gccuggcaagugggugaa

SEQ ID NO: 2452581 - RNA, 13 nt, Human
gccuggcacacau

SEQ ID NO: 2452582 - RNA, 14 nt, Human
gccuggcacagggc

SEQ ID NO: 2452583 - RNA, 13 nt, Human
gccuggcacaggg

SEQ ID NO: 2452584 - RNA, 20 nt, Human
gccuggauggggcugcaccg

SEQ ID NO: 2452585 - RNA, 21 nt, Human
gccuggauucauuuccugccc

SEQ ID NO: 2452586 - RNA, 19 nt, Human
gccuggauucauuuccugc

SEQ ID NO: 2452587 - RNA, 18 nt, Human
gccuggauucauuuccug

SEQ ID NO: 2452588 - RNA, 16 nt, Human
gccuggauucauuucc

SEQ ID NO: 2452589 - RNA, 14 nt, Human
gccuggauucauuu

SEQ ID NO: 2452590 - RNA, 19 nt, Human
gcuccuuucuccagccagc

SEQ ID NO: 2452591 - RNA, 18 nt, Human
gcuccuuucuccagccag

SEQ ID NO: 2452592 - RNA, 17 nt, Human
gcuccuuucuccagcca

SEQ ID NO: 2452593 - RNA, 16 nt, Human
gcuccuuucuccagcc

SEQ ID NO: 2452594 - RNA, 14 nt, Human
gcuccuuucuccag

SEQ ID NO: 2452595 - RNA, 16 nt, Human
gcuccuuguuccuaga

SEQ ID NO: 2452596 - RNA, 19 nt, Human
gcucgagcaugccuggaug

SEQ ID NO: 2452597 - RNA, 21 nt, Human
gcucgagcaugccuggauggg

SEQ ID NO: 2452598 - RNA, 20 nt, Human
gcuccuuucuccagccagca

SEQ ID NO: 2452599 - RNA, 14 nt, Human
gcuccuuguuccua

SEQ ID NO: 2452600 - RNA, 17 nt, Human
gcuccuuuagcgcccag

SEQ ID NO: 2452601 - RNA, 14 nt, Human
gcuccuugggcccu

SEQ ID NO: 2452602 - RNA, 17 nt, Human
gcuccuugggcccuuug

SEQ ID NO: 2452603 - RNA, 19 nt, Human
gcuccuugggcccuuugag

SEQ ID NO: 2452604 - RNA, 13 nt, Human
gcuccuucugucc

SEQ ID NO: 2452605 - RNA, 18 nt, Human
gcuccuuccucugaggcu

SEQ ID NO: 2452606 - RNA, 18 nt, Human
gcuccuucccaucgcugu

SEQ ID NO: 2452607 - RNA, 13 nt, Human
gcuccuucccauc

SEQ ID NO: 2452608 - RNA, 23 nt, Human
gcuccuucccaggaguggaggag

SEQ ID NO: 2452609 - RNA, 20 nt, Human
gcuccuuccucugaggcuga

SEQ ID NO: 2452610 - RNA, 22 nt, Human
gcuccuuccucugaggcugaaa

SEQ ID NO: 2452611 - RNA, 14 nt, Human
gcuccuuccuggag

SEQ ID NO: 2452612 - RNA, 23 nt, Human
gcuccuuccuggagacugcccag

SEQ ID NO: 2452613 - RNA, 21 nt, Human
gcuccuucucucuuacauuga

SEQ ID NO: 2452614 - RNA, 15 nt, Human
gcuccuuccuucacc

SEQ ID NO: 2452615 - RNA, 13 nt, Human
gcuccuuccuguc

SEQ ID NO: 2452616 - RNA, 19 nt, Human
gcuccuuccugucuuccug

SEQ ID NO: 2452617 - RNA, 13 nt, Human
gcuccugugucuu

SEQ ID NO: 2452618 - RNA, 12 nt, Human
gcuccugugucu

SEQ ID NO: 2452619 - RNA, 22 nt, Human
gcuccguccaggagccugugcc

SEQ ID NO: 2452620 - RNA, 23 nt, Human
gcuccguccaggagccugugccu

SEQ ID NO: 2452621 - RNA, 17 nt, Human
gcuccgugccuccacca

SEQ ID NO: 2452622 - RNA, 16 nt, Human
gcuccgugccuccacc

SEQ ID NO: 2452623 - RNA, 15 nt, Human
gcuccgugccuccac

SEQ ID NO: 2452624 - RNA, 14 nt, Human
gcuccgugccucca

SEQ ID NO: 2452625 - RNA, 13 nt, Human
gcuccgugccucc

SEQ ID NO: 2452626 - RNA, 22 nt, Human
gcuccgugagugaaccaucauu

SEQ ID NO: 2452627 - RNA, 24 nt, Human
gcuccgcuuucuacccagcgagcc

SEQ ID NO: 2452628 - RNA, 22 nt, Human
gcuccuaacccuuaucaccagc

SEQ ID NO: 2452629 - RNA, 23 nt, Human
gcuccuaacccuuaucaccagcu

SEQ ID NO: 2452630 - RNA, 21 nt, Human
gcuccuacccaccgcccuugc

SEQ ID NO: 2452631 - RNA, 15 nt, Human
gcuccuaagcuucaa

SEQ ID NO: 2452632 - RNA, 13 nt, Human
gcuccuagaggga

SEQ ID NO: 2452633 - RNA, 14 nt, Human
gcuccuagagggag

SEQ ID NO: 2452634 - RNA, 14 nt, Human
gcuccuaucugugu

SEQ ID NO: 2452635 - RNA, 14 nt, Human
gcuccuagcagaga

SEQ ID NO: 2452636 - RNA, 15 nt, Human
gcuccuagagggagg

SEQ ID NO: 2452637 - RNA, 16 nt, Human
gcuccuagagggaggg

SEQ ID NO: 2452638 - RNA, 18 nt, Human
gcuccuagagggaggggc

SEQ ID NO: 2452639 - RNA, 19 nt, Human
gcuccuagagggaggggcc

SEQ ID NO: 2452640 - RNA, 15 nt, Human
gcuccuaucuguguu

SEQ ID NO: 2452641 - RNA, 18 nt, Human
gcuccucaacucaccuaa

SEQ ID NO: 2452642 - RNA, 18 nt, Human
gcuccucauccagggcuc

SEQ ID NO: 2452643 - RNA, 19 nt, Human
gcuccucaugguggguuca

SEQ ID NO: 2452644 - RNA, 21 nt, Human
gcuccucauccagggcucuga

SEQ ID NO: 2452645 - RNA, 14 nt, Human
gcuccuccagggcc

SEQ ID NO: 2452646 - RNA, 14 nt, Human
gcuccucccggugc

SEQ ID NO: 2452647 - RNA, 23 nt, Human
gcuccuggggguucuuucuuccu

SEQ ID NO: 2452648 - RNA, 19 nt, Human
gcuccuggucuugagaugu

SEQ ID NO: 2452649 - RNA, 13 nt, Human
gcuccuguccucc

SEQ ID NO: 2452650 - RNA, 11 nt, Human
gcuccucccac

SEQ ID NO: 2452651 - RNA, 20 nt, Human
gcuccuccagggugugugcu

SEQ ID NO: 2452652 - RNA, 15 nt, Human
gcuccuccagggcca

SEQ ID NO: 2452653 - RNA, 18 nt, Human
gcuccuccagggccacgu

SEQ ID NO: 2452654 - RNA, 22 nt, Human
gcuccuccagggccacgugcca

SEQ ID NO: 2452655 - RNA, 23 nt, Human
gcuccuccagggccacgugccag

SEQ ID NO: 2452656 - RNA, 22 nt, Human
gcuccugugcuuucccugaacu

SEQ ID NO: 2452657 - RNA, 16 nt, Human
gcuccugugcuuuccc

SEQ ID NO: 2452658 - RNA, 14 nt, Human
gcuccugugcuuuc

SEQ ID NO: 2452659 - RNA, 21 nt, Human
gcuccugugcuacuuugccuu

SEQ ID NO: 2452660 - RNA, 15 nt, Human
gcuccugugcccuua

SEQ ID NO: 2452661 - RNA, 13 nt, Human
gcuccugugcccu

SEQ ID NO: 2452662 - RNA, 12 nt, Human
gcuccugugccc

SEQ ID NO: 2452663 - RNA, 22 nt, Human
gcuccuguccucccauccccug

SEQ ID NO: 2452664 - RNA, 21 nt, Human
gcuccuguggccccacccugg

SEQ ID NO: 2452665 - RNA, 20 nt, Human
gcuccuguggccccacccug

SEQ ID NO: 2452666 - RNA, 15 nt, Human
gcuccuguggcccca

SEQ ID NO: 2452667 - RNA, 13 nt, Human
gcuccuguggccc

SEQ ID NO: 2452668 - RNA, 15 nt, Human
gcuccuguccuccca

SEQ ID NO: 2452669 - RNA, 14 nt, Human
gcuccugucugcca

SEQ ID NO: 2452670 - RNA, 16 nt, Human
gcuccugucugccagc

SEQ ID NO: 2452671 - RNA, 17 nt, Human
gcuccugucugccagcc

SEQ ID NO: 2452672 - RNA, 18 nt, Human
gcuccugucugccagcca

SEQ ID NO: 2452673 - RNA, 19 nt, Human
gcuccugucugccagccag

SEQ ID NO: 2452674 - RNA, 20 nt, Human
gcuccugucugccagccagc

SEQ ID NO: 2452675 - RNA, 21 nt, Human
gcuccugucugccagccagca

SEQ ID NO: 2452676 - RNA, 18 nt, Human
gcuccagucugcugcccu

SEQ ID NO: 2452677 - RNA, 20 nt, Human
gcuccagucugcugcccucc

SEQ ID NO: 2452678 - RNA, 21 nt, Human
gcuccagucugcugcccucca

SEQ ID NO: 2452679 - RNA, 17 nt, Human
gcuccagucugcugccc

SEQ ID NO: 2452680 - RNA, 21 nt, Human
gcuccagucaacaaacuauuu

SEQ ID NO: 2452681 - RNA, 21 nt, Human
gcuccagguggcucugaggug

SEQ ID NO: 2452682 - RNA, 18 nt, Human
gcuccagguggcucugag

SEQ ID NO: 2452683 - RNA, 16 nt, Human
gcuccagguggcucug

SEQ ID NO: 2452684 - RNA, 21 nt, Human
gcuccaggcaggcuaaggcgu

SEQ ID NO: 2452685 - RNA, 15 nt, Human
gcuccagguggcucu

SEQ ID NO: 2452686 - RNA, 15 nt, Human
gcucccacaggcccu

SEQ ID NO: 2452687 - RNA, 23 nt, Human
gcucccaagggauggugcccugu

SEQ ID NO: 2452688 - RNA, 12 nt, Human
gcucccaaggga

SEQ ID NO: 2452689 - RNA, 11 nt, Human
gcucccaaggg

SEQ ID NO: 2452690 - RNA, 23 nt, Human
gcuccgcuuucuacccagcgagc

SEQ ID NO: 2452691 - RNA, 22 nt, Human
gcuccgcuuucuacccagcgag

SEQ ID NO: 2452692 - RNA, 21 nt, Human
gcuccgcuuucuacccagcga

SEQ ID NO: 2452693 - RNA, 18 nt, Human
gcuccgcuuucuacccag

SEQ ID NO: 2452694 - RNA, 16 nt, Human
gcucccuucucuguag

SEQ ID NO: 2452695 - RNA, 15 nt, Human
gcucccuugugcgug

SEQ ID NO: 2452696 - RNA, 13 nt, Human
gcuccgccucugc

SEQ ID NO: 2452697 - RNA, 14 nt, Human
gcuccgccucugcu

SEQ ID NO: 2452698 - RNA, 17 nt, Human
gcuccgccucugcuggc

SEQ ID NO: 2452699 - RNA, 20 nt, Human
gcucccuucccaccucucuc

SEQ ID NO: 2452700 - RNA, 18 nt, Human
gcucccacaggcagcuuu

SEQ ID NO: 2452701 - RNA, 17 nt, Human
gcucccacaggcagcuu

SEQ ID NO: 2452702 - RNA, 15 nt, Human
gcucccuucucugua

SEQ ID NO: 2452703 - RNA, 16 nt, Human
gcucccacaggcagcu

SEQ ID NO: 2452704 - RNA, 15 nt, Human
gcucccacaggcagc

SEQ ID NO: 2452705 - RNA, 14 nt, Human
gcucccacaggcag

SEQ ID NO: 2452706 - RNA, 18 nt, Human
gcuccaggagcagccaca

SEQ ID NO: 2452707 - RNA, 17 nt, Human
gcuccaggagcagccac

SEQ ID NO: 2452708 - RNA, 16 nt, Human
gcuccaggagcagcca

SEQ ID NO: 2452709 - RNA, 15 nt, Human
gcuccaggagcagcc

SEQ ID NO: 2452710 - RNA, 17 nt, Human
gcuccaggccagggggc

SEQ ID NO: 2452711 - RNA, 18 nt, Human
gcuccaggccagggggcc

SEQ ID NO: 2452712 - RNA, 13 nt, Human
gcuccaggcaggc

SEQ ID NO: 2452713 - RNA, 24 nt, Human
gcuccaggcuccuuuagcgcccag

SEQ ID NO: 2452714 - RNA, 12 nt, Human
gcuccaggcucc

SEQ ID NO: 2452715 - RNA, 13 nt, Human
gcuccaaacccuc

SEQ ID NO: 2452716 - RNA, 21 nt, Human
gcuccagcuguucagcugguu

SEQ ID NO: 2452717 - RNA, 22 nt, Human
gcucaugugugcaacaggguau

SEQ ID NO: 2452718 - RNA, 17 nt, Human
gcucaugugugcaacag

SEQ ID NO: 2452719 - RNA, 14 nt, Human
gcuccaggagcagc

SEQ ID NO: 2452720 - RNA, 12 nt, Human
gcuccaggagca

SEQ ID NO: 2452721 - RNA, 11 nt, Human
gcuccaggagc

SEQ ID NO: 2452722 - RNA, 14 nt, Human
gcucauuucaggau

SEQ ID NO: 2452723 - RNA, 15 nt, Human
gcucauuuuuucuua

SEQ ID NO: 2452724 - RNA, 15 nt, Human
gcucaucugcugguc

SEQ ID NO: 2452725 - RNA, 14 nt, Human
gcucaucugcuggu

SEQ ID NO: 2452726 - RNA, 16 nt, Human
gcucaucucuguccca

SEQ ID NO: 2452727 - RNA, 21 nt, Human
gcucauccccaccugucuuca

SEQ ID NO: 2452728 - RNA, 13 nt, Human
gcucaucugcugg

SEQ ID NO: 2452729 - RNA, 16 nt, Human
gcucaucauucucugu

SEQ ID NO: 2452730 - RNA, 18 nt, Human
gcucaucauucucugucu

SEQ ID NO: 2452731 - RNA, 19 nt, Human
gcucaucauucucugucuc

SEQ ID NO: 2452732 - RNA, 20 nt, Human
gcucaucauucucugucuca

SEQ ID NO: 2452733 - RNA, 18 nt, Human
gcucauggacuucugcca

SEQ ID NO: 2452734 - RNA, 21 nt, Human
gcucaucugcugguccguggg

SEQ ID NO: 2452735 - RNA, 16 nt, Human
gcucaucugcuggucc

SEQ ID NO: 2452736 - RNA, 23 nt, Human
gcucaucugcugguccgugggac

SEQ ID NO: 2452737 - RNA, 22 nt, Human
gcucaucucugucccacuuggc

SEQ ID NO: 2452738 - RNA, 18 nt, Human
gcucauauuuuguauaua

SEQ ID NO: 2452739 - RNA, 22 nt, Human
gcucauauuccugcagccugga

SEQ ID NO: 2452740 - RNA, 14 nt, Human
gcucauauuuugua

SEQ ID NO: 2452741 - RNA, 13 nt, Human
gcucaggaaaacg

SEQ ID NO: 2452742 - RNA, 20 nt, Human
gcucauauuccugcagccug

SEQ ID NO: 2452743 - RNA, 12 nt, Human
gcucagcuucuc

SEQ ID NO: 2452744 - RNA, 13 nt, Human
gcucagcuucucc

SEQ ID NO: 2452745 - RNA, 11 nt, Human
gcucaggaaaa

SEQ ID NO: 2452746 - RNA, 16 nt, Human
gcucagcuucuccugu

SEQ ID NO: 2452747 - RNA, 21 nt, Human
gcucagcuuuuugucuuuucu

SEQ ID NO: 2452748 - RNA, 16 nt, Human
gcucagcucugggcca

SEQ ID NO: 2452749 - RNA, 17 nt, Human
gcucagcucugggccau

SEQ ID NO: 2452750 - RNA, 20 nt, Human
gcucagcuacugauuuuugu

SEQ ID NO: 2452751 - RNA, 13 nt, Human
gcucagcccugga

SEQ ID NO: 2452752 - RNA, 12 nt, Human
gcucagcccugg

SEQ ID NO: 2452753 - RNA, 23 nt, Human
gcucagcggggacagcuccuucu

SEQ ID NO: 2452754 - RNA, 19 nt, Human
gcucagcggggacagcucc

SEQ ID NO: 2452755 - RNA, 18 nt, Human
gcucagcggggacagcuc

SEQ ID NO: 2452756 - RNA, 17 nt, Human
gcucagcggggacagcu

SEQ ID NO: 2452757 - RNA, 21 nt, Human
gcucagcccucccugccccuc

SEQ ID NO: 2452758 - RNA, 19 nt, Human
gcucagcccucccugcccc

SEQ ID NO: 2452759 - RNA, 18 nt, Human
gcucagcccucccugccc

SEQ ID NO: 2452760 - RNA, 17 nt, Human
gcucagcccucccugcc

SEQ ID NO: 2452761 - RNA, 19 nt, Human
gcucagcccugacuggugc

SEQ ID NO: 2452762 - RNA, 11 nt, Human
gcucagcccug

SEQ ID NO: 2452763 - RNA, 16 nt, Human
gcucagcccugacugg

SEQ ID NO: 2452764 - RNA, 21 nt, Human
gcucagcccugacuggugcua

SEQ ID NO: 2452765 - RNA, 20 nt, Human
gcucagcccugacuggugcu

SEQ ID NO: 2452766 - RNA, 16 nt, Human
gcucagcggggacagc

SEQ ID NO: 2452767 - RNA, 15 nt, Human
gcucaccagccccag

SEQ ID NO: 2452768 - RNA, 16 nt, Human
gcucacaguuccucgc

SEQ ID NO: 2452769 - RNA, 17 nt, Human
gcucacaguuccucgcc

SEQ ID NO: 2452770 - RNA, 19 nt, Human
gcucacaguuccucgcccu

SEQ ID NO: 2452771 - RNA, 21 nt, Human
gcucacaguuccucgcccugg

SEQ ID NO: 2452772 - RNA, 14 nt, Human
gcucaccagcccca

SEQ ID NO: 2452773 - RNA, 13 nt, Human
gcucaccagcccc

SEQ ID NO: 2452774 - RNA, 12 nt, Human
gcucaccagccc

SEQ ID NO: 2452775 - RNA, 16 nt, Human
gcucacauaucuguca

SEQ ID NO: 2452776 - RNA, 22 nt, Human
gcucacacugagaauguaagaa

SEQ ID NO: 2452777 - RNA, 14 nt, Human
gcucacacugagaa

SEQ ID NO: 2452778 - RNA, 21 nt, Human
gcucacacgggguauuuuagg

SEQ ID NO: 2452779 - RNA, 22 nt, Human
gcucacaccccauugguggacu

SEQ ID NO: 2452780 - RNA, 13 nt, Human
gcucacacugaga

SEQ ID NO: 2452781 - RNA, 22 nt, Human
gcucacagaacccuuggagcca

SEQ ID NO: 2452782 - RNA, 13 nt, Human
gcucacaguuccu

SEQ ID NO: 2452783 - RNA, 15 nt, Human
gcucacaguuccucg

SEQ ID NO: 2452784 - RNA, 18 nt, Human
gcucaccucucccuugga

SEQ ID NO: 2452785 - RNA, 17 nt, Human
gcucaccucucccuugg

SEQ ID NO: 2452786 - RNA, 16 nt, Human
gcucaccucucccuug

SEQ ID NO: 2452787 - RNA, 14 nt, Human
gcucaccucucccu

SEQ ID NO: 2452788 - RNA, 12 nt, Human
gcucagcccucc

SEQ ID NO: 2452789 - RNA, 16 nt, Human
gcucagcccucccugc

SEQ ID NO: 2452790 - RNA, 15 nt, Human
gcucagcccucccug

SEQ ID NO: 2452791 - RNA, 15 nt, Human
gcucagccagcacuu

SEQ ID NO: 2452792 - RNA, 22 nt, Human
gcucacaguuccucgcccuggg

SEQ ID NO: 2452793 - RNA, 23 nt, Human
gcucacaguuccucgcccugggu

SEQ ID NO: 2452794 - RNA, 11 nt, Human
gcucagcccac

SEQ ID NO: 2452795 - RNA, 17 nt, Human
gcucagccagccccauc

SEQ ID NO: 2452796 - RNA, 18 nt, Human
gcucagcccaccccccuc

SEQ ID NO: 2452797 - RNA, 14 nt, Human
gcucagcccacccc

SEQ ID NO: 2452798 - RNA, 15 nt, Human
gcucagcccaccccc

SEQ ID NO: 2452799 - RNA, 16 nt, Human
gcucagcccacccccc

SEQ ID NO: 2452800 - RNA, 17 nt, Human
gcucagcccaccccccu

SEQ ID NO: 2452801 - RNA, 13 nt, Human
gcuaucuccccca

SEQ ID NO: 2452802 - RNA, 17 nt, Human
gcuaucguaaaauuaag

SEQ ID NO: 2452803 - RNA, 16 nt, Human
gcuaucguaaaauuaa

SEQ ID NO: 2452804 - RNA, 15 nt, Human
gcuaucguaaaauua

SEQ ID NO: 2452805 - RNA, 13 nt, Human
gcuaucacacagu

SEQ ID NO: 2452806 - RNA, 15 nt, Human
gcuauccuggcucuu

SEQ ID NO: 2452807 - RNA, 15 nt, Human
gcuaucucccccagc

SEQ ID NO: 2452808 - RNA, 14 nt, Human
gcuaucucccccag

SEQ ID NO: 2452809 - RNA, 18 nt, Human
gcucaaguccucuuuucu

SEQ ID NO: 2452810 - RNA, 17 nt, Human
gcucaaggaaaggccug

SEQ ID NO: 2452811 - RNA, 13 nt, Human
gcucaaggaaagg

SEQ ID NO: 2452812 - RNA, 18 nt, Human
gcucaagcgauucuccug

SEQ ID NO: 2452813 - RNA, 22 nt, Human
gcucaagcagucuacccaccuc

SEQ ID NO: 2452814 - RNA, 22 nt, Human
gcucaaguccucuuuucugaga

SEQ ID NO: 2452815 - RNA, 19 nt, Human
gcucaaguccucuuuucug

SEQ ID NO: 2452816 - RNA, 16 nt, Human
gcucaaucaagaaaau

SEQ ID NO: 2452817 - RNA, 19 nt, Human
gcucaauauuccugaauga

SEQ ID NO: 2452818 - RNA, 21 nt, Human
gcucaauauuccugaaugaaa

SEQ ID NO: 2452819 - RNA, 20 nt, Human
gcucaagucuucccugauca

SEQ ID NO: 2452820 - RNA, 19 nt, Human
gcucaaggaaaggccugaa

SEQ ID NO: 2452821 - RNA, 20 nt, Human
gcucaaggaaaggccugaaa

SEQ ID NO: 2452822 - RNA, 17 nt, Human
gcucaaggcgugaggau

SEQ ID NO: 2452823 - RNA, 23 nt, Human
gcucaaggaaagggggucccagu

SEQ ID NO: 2452824 - RNA, 17 nt, Human
gcucaagucuucccuga

SEQ ID NO: 2452825 - RNA, 17 nt, Human
gcucaauggacuggaag

SEQ ID NO: 2452826 - RNA, 14 nt, Human
gcucacaaaccaug

SEQ ID NO: 2452827 - RNA, 20 nt, Human
gcucaauccauguucuauuu

SEQ ID NO: 2452828 - RNA, 22 nt, Human
gcucaauauuccugaaugaaau

SEQ ID NO: 2452829 - RNA, 14 nt, Human
gcucaauccucuaa

SEQ ID NO: 2452830 - RNA, 16 nt, Human
gcucaauccucuaagc

SEQ ID NO: 2452831 - RNA, 23 nt, Human
gcucacaauaaaaauggcucaga

SEQ ID NO: 2452832 - RNA, 13 nt, Human
gcucacacaccug

SEQ ID NO: 2452833 - RNA, 15 nt, Human
gcucacacaugagau

SEQ ID NO: 2452834 - RNA, 14 nt, Human
gcucacaccccauu

SEQ ID NO: 2452835 - RNA, 14 nt, Human
gcucacacaugaga

SEQ ID NO: 2452836 - RNA, 14 nt, Human
gcucacaccuguaa

SEQ ID NO: 2452837 - RNA, 21 nt, Human
gcuauaggugcuacaaaaaca

SEQ ID NO: 2452838 - RNA, 19 nt, Human
gcuauaggugcuacaaaaa

SEQ ID NO: 2452839 - RNA, 21 nt, Human
gcuauacugcauacuuuuuaa

SEQ ID NO: 2452840 - RNA, 17 nt, Human
gcuauaccugugccucg

SEQ ID NO: 2452841 - RNA, 15 nt, Human
gcuauaccugugccu

SEQ ID NO: 2452842 - RNA, 16 nt, Human
gcuauaccugugccuc

SEQ ID NO: 2452843 - RNA, 18 nt, Human
gcuauaacaguagggaug

SEQ ID NO: 2452844 - RNA, 18 nt, Human
gcuauaaauuccucuuug

SEQ ID NO: 2452845 - RNA, 23 nt, Human
gcuauaaauuccucuuugcuuug

SEQ ID NO: 2452846 - RNA, 20 nt, Human
gcuauaacuauguugauaaa

SEQ ID NO: 2452847 - RNA, 23 nt, Human
gcuauaccugggcauacuaauaa

SEQ ID NO: 2452848 - RNA, 14 nt, Human
gcuauauccaugua

SEQ ID NO: 2452849 - RNA, 15 nt, Human
gcuauauccauguac

SEQ ID NO: 2452850 - RNA, 17 nt, Human
gcuauauccauguacug

SEQ ID NO: 2452851 - RNA, 18 nt, Human
gcuauauccauguacugu

SEQ ID NO: 2452852 - RNA, 19 nt, Human
gcuauauccauguacugua

SEQ ID NO: 2452853 - RNA, 19 nt, Human
gcuauaucuauauauaauu

SEQ ID NO: 2452854 - RNA, 15 nt, Human
gcuauaucuauauau

SEQ ID NO: 2452855 - RNA, 21 nt, Human
gcuauauccauguacuguagu

SEQ ID NO: 2452856 - RNA, 23 nt, Human
gcuauauccauguacuguaguuu

SEQ ID NO: 2452857 - RNA, 17 nt, Human
gcuauccauuucucaug

SEQ ID NO: 2452858 - RNA, 20 nt, Human
gcuauccugccaaaaucauu

SEQ ID NO: 2452859 - RNA, 23 nt, Human
gcuauauuuucaugacuuuucca

SEQ ID NO: 2452860 - RNA, 22 nt, Human
gcuauauuuucaugacuuuucc

SEQ ID NO: 2452861 - RNA, 14 nt, Human
gcuauauuuucaug

SEQ ID NO: 2452862 - RNA, 19 nt, Human
gcuauccagcuauuuuuau

SEQ ID NO: 2452863 - RNA, 16 nt, Human
gcuagauguauguacu

SEQ ID NO: 2452864 - RNA, 14 nt, Human
gcuagauguaugua

SEQ ID NO: 2452865 - RNA, 13 nt, Human
gcuauaaauauau

SEQ ID NO: 2452866 - RNA, 15 nt, Human
gcuauaaauauauaa

SEQ ID NO: 2452867 - RNA, 17 nt, Human
gcuauaaacaauuacau

SEQ ID NO: 2452868 - RNA, 21 nt, Human
gcuaguugggcuuccucauag

SEQ ID NO: 2452869 - RNA, 22 nt, Human
gcggugcuaucucccccagccc

SEQ ID NO: 2452870 - RNA, 19 nt, Human
gcggugcuaucucccccag

SEQ ID NO: 2452871 - RNA, 13 nt, Human
gcuagauguaugu

SEQ ID NO: 2452872 - RNA, 20 nt, Human
gcuagaguccucacucccag

SEQ ID NO: 2452873 - RNA, 19 nt, Human
gcuagaugggcauggggug

SEQ ID NO: 2452874 - RNA, 16 nt, Human
gcggugcuguccucag

SEQ ID NO: 2452875 - RNA, 13 nt, Human
ggagggccugggc

SEQ ID NO: 2452876 - RNA, 21 nt, Human
ggagggccguaccccacccuc

SEQ ID NO: 2452877 - RNA, 19 nt, Human
ggagggccacaugggaggc

SEQ ID NO: 2452878 - RNA, 23 nt, Human
ggagggccacaugggaggcucac

SEQ ID NO: 2452879 - RNA, 16 nt, Human
ggagggcccuaccuga

SEQ ID NO: 2452880 - RNA, 20 nt, Human
ggagggccguaccccacccu

SEQ ID NO: 2452881 - RNA, 20 nt, Human
ggagggauagaggggggcug

SEQ ID NO: 2452882 - RNA, 19 nt, Human
ggaggggagcaugggaagu

SEQ ID NO: 2452883 - RNA, 21 nt, Human
ggagggcggcaggggccugga

SEQ ID NO: 2452884 - RNA, 20 nt, Human
ggagggcggcaggggccugg

SEQ ID NO: 2452885 - RNA, 20 nt, Human
ggagggcuagaaccuagaag

SEQ ID NO: 2452886 - RNA, 16 nt, Human
ggagggcuagaaccua

SEQ ID NO: 2452887 - RNA, 15 nt, Human
ggagggcgugggagc

SEQ ID NO: 2452888 - RNA, 17 nt, Human
ggagggcgugacucacc

SEQ ID NO: 2452889 - RNA, 20 nt, Human
ggagggcuagaaccuggaga

SEQ ID NO: 2452890 - RNA, 19 nt, Human
ggagggcuagaaccuggag

SEQ ID NO: 2452891 - RNA, 21 nt, Human
ggagggcuagaaccuggaagg

SEQ ID NO: 2452892 - RNA, 16 nt, Human
ggagggcuagaaccug

SEQ ID NO: 2452893 - RNA, 20 nt, Human
ggagggcuagaaccuggcag

SEQ ID NO: 2452894 - RNA, 22 nt, Human
ggagggcuagaaccuggagagc

SEQ ID NO: 2452895 - RNA, 13 nt, Human
ggaggggaggggg

SEQ ID NO: 2452896 - RNA, 13 nt, Human
ggaggggcaggcu

SEQ ID NO: 2452897 - RNA, 23 nt, Human
ggaggggcccgcuugccucggcu

SEQ ID NO: 2452898 - RNA, 13 nt, Human
ggaggggccuagg

SEQ ID NO: 2452899 - RNA, 15 nt, Human
ggaggggccuaggcc

SEQ ID NO: 2452900 - RNA, 21 nt, Human
ggaggggccuaggccucagcc

SEQ ID NO: 2452901 - RNA, 13 nt, Human
ggaggggccuggc

SEQ ID NO: 2452902 - RNA, 22 nt, Human
ggaggggcccgcuugccucggc

SEQ ID NO: 2452903 - RNA, 18 nt, Human
ggaggggcccgcuugccu

SEQ ID NO: 2452904 - RNA, 13 nt, Human
ggaggggcccgcu

SEQ ID NO: 2452905 - RNA, 21 nt, Human
ggaggggccccugcuucucca

SEQ ID NO: 2452906 - RNA, 14 nt, Human
ggaggggcaggcug

SEQ ID NO: 2452907 - RNA, 13 nt, Human
ggaggggccccug

SEQ ID NO: 2452908 - RNA, 20 nt, Human
ggaggggcauggccagcagc

SEQ ID NO: 2452909 - RNA, 13 nt, Human
ggaguaucuggga

SEQ ID NO: 2452910 - RNA, 18 nt, Human
ggaguaaucuguguacaa

SEQ ID NO: 2452911 - RNA, 15 nt, Human
ggagucaagugugga

SEQ ID NO: 2452912 - RNA, 15 nt, Human
ggaguaugcaaaagu

SEQ ID NO: 2452913 - RNA, 14 nt, Human
ggaguaucugggaa

SEQ ID NO: 2452914 - RNA, 15 nt, Human
ggaguaucugggaac

SEQ ID NO: 2452915 - RNA, 22 nt, Human
ggagucccaccuuggcugcagg

SEQ ID NO: 2452916 - RNA, 14 nt, Human
ggagucagagagaa

SEQ ID NO: 2452917 - RNA, 16 nt, Human
ggaggggcgcuggccc

SEQ ID NO: 2452918 - RNA, 12 nt, Human
ggaggggcgcug

SEQ ID NO: 2452919 - RNA, 22 nt, Human
ggaggggcgcccaccuccccac

SEQ ID NO: 2452920 - RNA, 17 nt, Human
ggaggggcgcccaccuc

SEQ ID NO: 2452921 - RNA, 21 nt, Human
ggaggggccuggcagccgugc

SEQ ID NO: 2452922 - RNA, 18 nt, Human
ggaggggccuggcagccg

SEQ ID NO: 2452923 - RNA, 14 nt, Human
ggaggggccuggca

SEQ ID NO: 2452924 - RNA, 20 nt, Human
ggaggggcgcuggcccagcc

SEQ ID NO: 2452925 - RNA, 19 nt, Human
ggaggggcgcuggcccagc

SEQ ID NO: 2452926 - RNA, 21 nt, Human
ggagguugcagugagcugaga

SEQ ID NO: 2452927 - RNA, 15 nt, Human
ggagguugggugggc

SEQ ID NO: 2452928 - RNA, 20 nt, Human
ggagguuuaggucaagaaga

SEQ ID NO: 2452929 - RNA, 17 nt, Human
ggaguacaggugaagca

SEQ ID NO: 2452930 - RNA, 16 nt, Human
ggagggagggcuccag

SEQ ID NO: 2452931 - RNA, 13 nt, Human
ggagggagggcuc

SEQ ID NO: 2452932 - RNA, 17 nt, Human
ggagggagggcuccaga

SEQ ID NO: 2452933 - RNA, 17 nt, Human
ggagggauucugguucc

SEQ ID NO: 2452934 - RNA, 21 nt, Human
ggagggaugcugccugaguca

SEQ ID NO: 2452935 - RNA, 13 nt, Human
ggaggcagggccu

SEQ ID NO: 2452936 - RNA, 18 nt, Human
ggaggcagggccuugccc

SEQ ID NO: 2452937 - RNA, 19 nt, Human
ggaggcagggccuugccca

SEQ ID NO: 2452938 - RNA, 21 nt, Human
ggaggcagggccuugcccaga

SEQ ID NO: 2452939 - RNA, 17 nt, Human
ggaggcaggaguuucgu

SEQ ID NO: 2452940 - RNA, 22 nt, Human
ggaggcacuuuagggcuguaaa

SEQ ID NO: 2452941 - RNA, 17 nt, Human
ggaggcacacagcugca

SEQ ID NO: 2452942 - RNA, 16 nt, Human
ggaggacgcucucugg

SEQ ID NO: 2452943 - RNA, 21 nt, Human
ggaggauguucugggacacag

SEQ ID NO: 2452944 - RNA, 18 nt, Human
ggaggauguucugggaca

SEQ ID NO: 2452945 - RNA, 12 nt, Human
ggaggaccuuau

SEQ ID NO: 2452946 - RNA, 17 nt, Human
ggaggauucuaugaggc

SEQ ID NO: 2452947 - RNA, 20 nt, Human
ggaggauugcuugagcccag

SEQ ID NO: 2452948 - RNA, 22 nt, Human
ggaggauugcuugagcccagga

SEQ ID NO: 2452949 - RNA, 19 nt, Human
ggaggcaagagggguggag

SEQ ID NO: 2452950 - RNA, 23 nt, Human
ggaggcaagagggguggagacug

SEQ ID NO: 2452951 - RNA, 14 nt, Human
ggaggcaagcccug

SEQ ID NO: 2452952 - RNA, 16 nt, Human
ggaggcacacagcugc

SEQ ID NO: 2452953 - RNA, 20 nt, Human
ggagcccugggaggcucugg

SEQ ID NO: 2452954 - RNA, 15 nt, Human
ggagcacuggagugc

SEQ ID NO: 2452955 - RNA, 13 nt, Human
ggagcacuggagu

SEQ ID NO: 2452956 - RNA, 18 nt, Human
ggagccgggucugccucu

SEQ ID NO: 2452957 - RNA, 16 nt, Human
ggagccuacccacccc

SEQ ID NO: 2452958 - RNA, 18 nt, Human
ggagcacuggagugcagg

SEQ ID NO: 2452959 - RNA, 19 nt, Human
ggagccucauccgaggcag

SEQ ID NO: 2452960 - RNA, 20 nt, Human
ggagccucauccgaggcagg

SEQ ID NO: 2452961 - RNA, 21 nt, Human
ggagccucauccgaggcaggg

SEQ ID NO: 2452962 - RNA, 21 nt, Human
ggagccuagagugagggccug

SEQ ID NO: 2452963 - RNA, 17 nt, Human
ggagccgggucugccuc

SEQ ID NO: 2452964 - RNA, 16 nt, Human
ggagccgguggcggug

SEQ ID NO: 2452965 - RNA, 14 nt, Human
ggagccuccugccc

SEQ ID NO: 2452966 - RNA, 15 nt, Human
ggagccuccugccca

SEQ ID NO: 2452967 - RNA, 13 nt, Human
ggagccuccugcc

SEQ ID NO: 2452968 - RNA, 12 nt, Human
ggagccuccugc

SEQ ID NO: 2452969 - RNA, 11 nt, Human
ggagccuccug

SEQ ID NO: 2452970 - RNA, 19 nt, Human
ggagacaugugacauuuau

SEQ ID NO: 2452971 - RNA, 15 nt, Human
ggagacaugugacau

SEQ ID NO: 2452972 - RNA, 18 nt, Human
ggagaccaugcagagcgc

SEQ ID NO: 2452973 - RNA, 17 nt, Human
ggagaccaaggcgggag

SEQ ID NO: 2452974 - RNA, 14 nt, Human
ggagacaugugaca

SEQ ID NO: 2452975 - RNA, 18 nt, Human
ggagacagugaucuccau

SEQ ID NO: 2452976 - RNA, 12 nt, Human
ggagacaggguu

SEQ ID NO: 2452977 - RNA, 13 nt, Human
ggagacagugauc

SEQ ID NO: 2452978 - RNA, 11 nt, Human
ggagacagggu

SEQ ID NO: 2452979 - RNA, 19 nt, Human
ggagaccaugcagagcgcc

SEQ ID NO: 2452980 - RNA, 20 nt, Human
ggagacauuccugggcacag

SEQ ID NO: 2452981 - RNA, 17 nt, Human
ggagcaaagugagggcc

SEQ ID NO: 2452982 - RNA, 15 nt, Human
ggagcaaagugaggg

SEQ ID NO: 2452983 - RNA, 20 nt, Human
ggagcaaauguuucugcagu

SEQ ID NO: 2452984 - RNA, 18 nt, Human
ggagcaaauguuucugca

SEQ ID NO: 2452985 - RNA, 16 nt, Human
ggagcaaauguuucug

SEQ ID NO: 2452986 - RNA, 15 nt, Human
ggagcaaauguuucu

SEQ ID NO: 2452987 - RNA, 22 nt, Human
ggagcaacuuguucguggguca

SEQ ID NO: 2452988 - RNA, 19 nt, Human
ggagcccugggaggcucug

SEQ ID NO: 2452989 - RNA, 16 nt, Human
ggagcccugggaggcu

SEQ ID NO: 2452990 - RNA, 15 nt, Human
ggagcacaggcagcu

SEQ ID NO: 2452991 - RNA, 17 nt, Human
ggagcaccaggcacgaa

SEQ ID NO: 2452992 - RNA, 14 nt, Human
ggagcacaggcagc

SEQ ID NO: 2452993 - RNA, 13 nt, Human
ggagcacaggcag

SEQ ID NO: 2452994 - RNA, 22 nt, Human
ggagccugcuggucacagccuc

SEQ ID NO: 2452995 - RNA, 13 nt, Human
ggagccugcuggu

SEQ ID NO: 2452996 - RNA, 22 nt, Human
ggagccugcaggguggugcugg

SEQ ID NO: 2452997 - RNA, 12 nt, Human
ggagccuggugc

SEQ ID NO: 2452998 - RNA, 21 nt, Human
ggagccugcaggguggugcug

SEQ ID NO: 2452999 - RNA, 16 nt, Human
ggagccugcagggugg

SEQ ID NO: 2453000 - RNA, 13 nt, Human
ggagccugcaggg

SEQ ID NO: 2453001 - RNA, 11 nt, Human
ggagccugcag

SEQ ID NO: 2453002 - RNA, 17 nt, Human
ggagccugcagagcugc

SEQ ID NO: 2453003 - RNA, 15 nt, Human
ggagccuccugcccu

SEQ ID NO: 2453004 - RNA, 22 nt, Human
ggagccugcaaacucacugcuc

SEQ ID NO: 2453005 - RNA, 18 nt, Human
ggagccuguguaacagcu

SEQ ID NO: 2453006 - RNA, 17 nt, Human
ggagccuguguaacagc

SEQ ID NO: 2453007 - RNA, 16 nt, Human
ggagccuguguaacag

SEQ ID NO: 2453008 - RNA, 15 nt, Human
ggagccuguguaaca

SEQ ID NO: 2453009 - RNA, 22 nt, Human
ggagccuguguaacagcuccuu

SEQ ID NO: 2453010 - RNA, 21 nt, Human
ggagccuguguaacagcuccu

SEQ ID NO: 2453011 - RNA, 20 nt, Human
ggagccuguguaacagcucc

SEQ ID NO: 2453012 - RNA, 19 nt, Human
ggagccuguguaacagcuc

SEQ ID NO: 2453013 - RNA, 20 nt, Human
ggagccuuugguucuggcca

SEQ ID NO: 2453014 - RNA, 15 nt, Human
ggagcgcaccugccc

SEQ ID NO: 2453015 - RNA, 16 nt, Human
ggagcgggaccugugg

SEQ ID NO: 2453016 - RNA, 13 nt, Human
ggagcgggaccug

SEQ ID NO: 2453017 - RNA, 20 nt, Human
ggagcggccggccagccccu

SEQ ID NO: 2453018 - RNA, 16 nt, Human
ggagcggaaagcagcu

SEQ ID NO: 2453019 - RNA, 19 nt, Human
ggagcgcaccugcccccug

SEQ ID NO: 2453020 - RNA, 21 nt, Human
ggagcgcaccugcccccuggu

SEQ ID NO: 2453021 - RNA, 23 nt, Human
ggagcgcaccugcccccuggugg

SEQ ID NO: 2453022 - RNA, 14 nt, Human
ggagcggaaagcag

SEQ ID NO: 2453023 - RNA, 15 nt, Human
ggagcggaaagcagc

SEQ ID NO: 2453024 - RNA, 22 nt, Human
ggagcgguggcccugucccucc

SEQ ID NO: 2453025 - RNA, 14 nt, Human
ggagcgugggaggc

SEQ ID NO: 2453026 - RNA, 15 nt, Human
ggagcgguggcccug

SEQ ID NO: 2453027 - RNA, 17 nt, Human
ggagcgggaccuguggc

SEQ ID NO: 2453028 - RNA, 16 nt, Human
ggagcuaacacuggcc

SEQ ID NO: 2453029 - RNA, 17 nt, Human
ggagcuaacacuggccc

SEQ ID NO: 2453030 - RNA, 18 nt, Human
ggagcuaacacuggcccc

SEQ ID NO: 2453031 - RNA, 19 nt, Human
ggagcuaacacuggccccu

SEQ ID NO: 2453032 - RNA, 22 nt, Human
ggagcuaucaggaacagcuaug

SEQ ID NO: 2453033 - RNA, 15 nt, Human
ggagcuaucaggaac

SEQ ID NO: 2453034 - RNA, 20 nt, Human
ggagcucagagagggcaggc

SEQ ID NO: 2453035 - RNA, 17 nt, Human
ggagcucagagagggca

SEQ ID NO: 2453036 - RNA, 14 nt, Human
ggagcucagagagg

SEQ ID NO: 2453037 - RNA, 20 nt, Human
ggagcucacuguggugucug

SEQ ID NO: 2453038 - RNA, 23 nt, Human
ggagcucacuguggugucugugu

SEQ ID NO: 2453039 - RNA, 17 nt, Human
ggagcuccacucugcuu

SEQ ID NO: 2453040 - RNA, 17 nt, Human
ggaccagccuguuggac

SEQ ID NO: 2453041 - RNA, 13 nt, Human
ggaccagcucagg

SEQ ID NO: 2453042 - RNA, 19 nt, Human
ggaccagagcugccaccug

SEQ ID NO: 2453043 - RNA, 15 nt, Human
ggacauuuuuucagu

SEQ ID NO: 2453044 - RNA, 22 nt, Human
ggacagccuguggcggugccug

SEQ ID NO: 2453045 - RNA, 23 nt, Human
ggacagccuguggcggugccugg

SEQ ID NO: 2453046 - RNA, 20 nt, Human
ggacauuugcucauggaauu

SEQ ID NO: 2453047 - RNA, 14 nt, Human
ggaccagagcugcc

SEQ ID NO: 2453048 - RNA, 17 nt, Human
ggacauuugcucaugga

SEQ ID NO: 2453049 - RNA, 17 nt, Human
ggacagccccacccugg

SEQ ID NO: 2453050 - RNA, 21 nt, Human
ggacagccuguggcggugccu

SEQ ID NO: 2453051 - RNA, 17 nt, Human
ggacagcuccuucuguc

SEQ ID NO: 2453052 - RNA, 16 nt, Human
ggacagcuccuucugu

SEQ ID NO: 2453053 - RNA, 15 nt, Human
ggacagcuccuucug

SEQ ID NO: 2453054 - RNA, 11 nt, Human
ggacagcuccu

SEQ ID NO: 2453055 - RNA, 15 nt, Human
ggacagccccuccuc

SEQ ID NO: 2453056 - RNA, 16 nt, Human
ggacagccccuccucc

SEQ ID NO: 2453057 - RNA, 15 nt, Human
ggacagccccacccu

SEQ ID NO: 2453058 - RNA, 16 nt, Human
ggacagccccacccug

SEQ ID NO: 2453059 - RNA, 14 nt, Human
ggacagccccaccc

SEQ ID NO: 2453060 - RNA, 20 nt, Human
ggacagaggggguggccucc

SEQ ID NO: 2453061 - RNA, 17 nt, Human
ggacagaggccugcccg

SEQ ID NO: 2453062 - RNA, 22 nt, Human
ggacagccacggccaggccaga

SEQ ID NO: 2453063 - RNA, 19 nt, Human
gcuuuuauagaggcuagcu

SEQ ID NO: 2453064 - RNA, 22 nt, Human
gcuuuuauagaggcuagcuucu

SEQ ID NO: 2453065 - RNA, 18 nt, Human
gcuuuuauuaaugcacuu

SEQ ID NO: 2453066 - RNA, 15 nt, Human
gcuuuuauuaaugca

SEQ ID NO: 2453067 - RNA, 21 nt, Human
gcuuuuaugugaaacauguuu

SEQ ID NO: 2453068 - RNA, 20 nt, Human
gcuuuuaugugaaacauguu

SEQ ID NO: 2453069 - RNA, 19 nt, Human
gcuuuuaugugaaacaugu

SEQ ID NO: 2453070 - RNA, 15 nt, Human
gcuuuuauuguauaa

SEQ ID NO: 2453071 - RNA, 22 nt, Human
gcuuuuauuaaugcacuuucua

SEQ ID NO: 2453072 - RNA, 19 nt, Human
gcuuuuauuaaugcacuuu

SEQ ID NO: 2453073 - RNA, 12 nt, Human
gcuuuucacugc

SEQ ID NO: 2453074 - RNA, 18 nt, Human
ggacacuccagugccagc

SEQ ID NO: 2453075 - RNA, 16 nt, Human
ggacacuccagugcca

SEQ ID NO: 2453076 - RNA, 15 nt, Human
ggacacuccagugcc

SEQ ID NO: 2453077 - RNA, 14 nt, Human
ggacacuccagugc

SEQ ID NO: 2453078 - RNA, 14 nt, Human
ggacacucagaccu

SEQ ID NO: 2453079 - RNA, 14 nt, Human
ggacacuccuagag

SEQ ID NO: 2453080 - RNA, 21 nt, Human
ggacacuccagugccagcaau

SEQ ID NO: 2453081 - RNA, 15 nt, Human
ggacacuccuagaga

SEQ ID NO: 2453082 - RNA, 16 nt, Human
ggacacuuaauacuac

SEQ ID NO: 2453083 - RNA, 18 nt, Human
ggacacuuaacagaugca

SEQ ID NO: 2453084 - RNA, 16 nt, Human
ggacagaggccugccc

SEQ ID NO: 2453085 - RNA, 15 nt, Human
ggacagaggccugcc

SEQ ID NO: 2453086 - RNA, 14 nt, Human
ggacagaggccugc

SEQ ID NO: 2453087 - RNA, 14 nt, Human
ggacagagccaugc

SEQ ID NO: 2453088 - RNA, 20 nt, Human
ggacagaggccccagccucc

SEQ ID NO: 2453089 - RNA, 23 nt, Human
ggacagaggccccagccucccug

SEQ ID NO: 2453090 - RNA, 16 nt, Human
ggacagaggggguggc

SEQ ID NO: 2453091 - RNA, 15 nt, Human
ggacagaggccccag

SEQ ID NO: 2453092 - RNA, 16 nt, Human
ggacagaggccccagc

SEQ ID NO: 2453093 - RNA, 17 nt, Human
ggacagaggccccagcc

SEQ ID NO: 2453094 - RNA, 18 nt, Human
ggacagaggccccagccu

SEQ ID NO: 2453095 - RNA, 14 nt, Human
ggacagaggcccca

SEQ ID NO: 2453096 - RNA, 20 nt, Human
ggacagagacaccugcaccu

SEQ ID NO: 2453097 - RNA, 21 nt, Human
ggacagagacaccugcaccuc

SEQ ID NO: 2453098 - RNA, 14 nt, Human
ggacagagacaccu

SEQ ID NO: 2453099 - RNA, 17 nt, Human
ggacagagacaccugca

SEQ ID NO: 2453100 - RNA, 18 nt, Human
ggacagagacaccugcac

SEQ ID NO: 2453101 - RNA, 19 nt, Human
ggacagagacaccugcacc

SEQ ID NO: 2453102 - RNA, 20 nt, Human
ggacacuuugaaauguguuu

SEQ ID NO: 2453103 - RNA, 16 nt, Human
ggacacuuccugccua

SEQ ID NO: 2453104 - RNA, 15 nt, Human
ggacacuuccugccu

SEQ ID NO: 2453105 - RNA, 14 nt, Human
ggacacuuccugcc

SEQ ID NO: 2453106 - RNA, 21 nt, Human
ggacacuucccucuguuucuc

SEQ ID NO: 2453107 - RNA, 18 nt, Human
ggacacuucccucuguuu

SEQ ID NO: 2453108 - RNA, 17 nt, Human
ggacacuucccucuguu

SEQ ID NO: 2453109 - RNA, 14 nt, Human
ggacagaagcagcu

SEQ ID NO: 2453110 - RNA, 23 nt, Human
ggacacuuugaaauguguuucug

SEQ ID NO: 2453111 - RNA, 14 nt, Human
ggacagaagaaggc

SEQ ID NO: 2453112 - RNA, 15 nt, Human
ggacagaagcagcuc

SEQ ID NO: 2453113 - RNA, 16 nt, Human
ggacagaagcagcucu

SEQ ID NO: 2453114 - RNA, 17 nt, Human
ggacagaagcagcucuu

SEQ ID NO: 2453115 - RNA, 23 nt, Human
ggacagacucacaaccugaaccu

SEQ ID NO: 2453116 - RNA, 18 nt, Human
ggacugagaaauuuauaa

SEQ ID NO: 2453117 - RNA, 12 nt, Human
ggacugagcccc

SEQ ID NO: 2453118 - RNA, 18 nt, Human
ggacugagccagucccag

SEQ ID NO: 2453119 - RNA, 17 nt, Human
ggacugagccaguccca

SEQ ID NO: 2453120 - RNA, 12 nt, Human
ggacugagccag

SEQ ID NO: 2453121 - RNA, 21 nt, Human
ggacugagggacucugaagcc

SEQ ID NO: 2453122 - RNA, 14 nt, Human
ggacugaggccuga

SEQ ID NO: 2453123 - RNA, 15 nt, Human
ggacugagccccgca

SEQ ID NO: 2453124 - RNA, 13 nt, Human
ggacugaggccug

SEQ ID NO: 2453125 - RNA, 17 nt, Human
ggacugagggacucuga

SEQ ID NO: 2453126 - RNA, 21 nt, Human
ggagaacuccuaggguggcug

SEQ ID NO: 2453127 - RNA, 13 nt, Human
ggagaacuagaga

SEQ ID NO: 2453128 - RNA, 14 nt, Human
ggagaagaacugaa

SEQ ID NO: 2453129 - RNA, 11 nt, Human
ggagaagaacu

SEQ ID NO: 2453130 - RNA, 15 nt, Human
ggagaagagcuguuc

SEQ ID NO: 2453131 - RNA, 22 nt, Human
ggagaagagaggagaggagaga

SEQ ID NO: 2453132 - RNA, 16 nt, Human
ggagaagagaggagag

SEQ ID NO: 2453133 - RNA, 15 nt, Human
ggagaagagaggaga

SEQ ID NO: 2453134 - RNA, 14 nt, Human
ggagaagagaggag

SEQ ID NO: 2453135 - RNA, 13 nt, Human
ggagaagaaguca

SEQ ID NO: 2453136 - RNA, 13 nt, Human
ggagaagagagga

SEQ ID NO: 2453137 - RNA, 22 nt, Human
ggagaagaauuuucagacccca

SEQ ID NO: 2453138 - RNA, 16 nt, Human
ggagaagcugaugcuu

SEQ ID NO: 2453139 - RNA, 19 nt, Human
ggagaagcuccucucccca

SEQ ID NO: 2453140 - RNA, 19 nt, Human
ggagaagccacaggccuga

SEQ ID NO: 2453141 - RNA, 18 nt, Human
ggagaagcaugaaaaagc

SEQ ID NO: 2453142 - RNA, 17 nt, Human
ggagaaggaaggagacu

SEQ ID NO: 2453143 - RNA, 14 nt, Human
ggagaaggaucuag

SEQ ID NO: 2453144 - RNA, 12 nt, Human
ggagaaggaucu

SEQ ID NO: 2453145 - RNA, 13 nt, Human
ggagaagcugaug

SEQ ID NO: 2453146 - RNA, 22 nt, Human
ggagaaggaaggagacucaccu

SEQ ID NO: 2453147 - RNA, 23 nt, Human
ggagaagagcuguucacagccag

SEQ ID NO: 2453148 - RNA, 18 nt, Human
ggagaagccacaggccug

SEQ ID NO: 2453149 - RNA, 19 nt, Human
ggagaagcagugagccgca

SEQ ID NO: 2453150 - RNA, 13 nt, Human
ggagaagcaugaa

SEQ ID NO: 2453151 - RNA, 15 nt, Human
ggagaagcagugagc

SEQ ID NO: 2453152 - RNA, 16 nt, Human
ggagaagcagugagcc

SEQ ID NO: 2453153 - RNA, 18 nt, Human
ggacucuugcucuuucua

SEQ ID NO: 2453154 - RNA, 22 nt, Human
ggagaagucuuagacuugaaau

SEQ ID NO: 2453155 - RNA, 21 nt, Human
ggagaagggauggaggucaca

SEQ ID NO: 2453156 - RNA, 20 nt, Human
ggagaaggaucuagaaugug

SEQ ID NO: 2453157 - RNA, 14 nt, Human
ggagaagggaugga

SEQ ID NO: 2453158 - RNA, 20 nt, Human
ggagacagccccagagcagg

SEQ ID NO: 2453159 - RNA, 21 nt, Human
ggagacagccccagagcaggg

SEQ ID NO: 2453160 - RNA, 23 nt, Human
ggagacagccccagagcagggug

SEQ ID NO: 2453161 - RNA, 22 nt, Human
ggagacagccccagagcagggu

SEQ ID NO: 2453162 - RNA, 14 nt, Human
ggacugagaaauuu

SEQ ID NO: 2453163 - RNA, 16 nt, Human
ggacugacacccaugu

SEQ ID NO: 2453164 - RNA, 16 nt, Human
ggacugaagccugcag

SEQ ID NO: 2453165 - RNA, 17 nt, Human
ggacugaagccugcagg

SEQ ID NO: 2453166 - RNA, 19 nt, Human
ggacugaagccugcaggag

SEQ ID NO: 2453167 - RNA, 19 nt, Human
ggacugaauuguccccagu

SEQ ID NO: 2453168 - RNA, 19 nt, Human
ggacucuuugguggcuuug

SEQ ID NO: 2453169 - RNA, 14 nt, Human
ggacugaagccugc

SEQ ID NO: 2453170 - RNA, 18 nt, Human
ggacugaaaaccucuccu

SEQ ID NO: 2453171 - RNA, 16 nt, Human
ggacugaaaaccucuc

SEQ ID NO: 2453172 - RNA, 17 nt, Human
ggacugaaaaccucucc

SEQ ID NO: 2453173 - RNA, 15 nt, Human
ggacgcucucuggcc

SEQ ID NO: 2453174 - RNA, 16 nt, Human
ggacgcucucuggccu

SEQ ID NO: 2453175 - RNA, 19 nt, Human
ggacgcucucuggccuucg

SEQ ID NO: 2453176 - RNA, 21 nt, Human
ggacucuugcucuuucuacuc

SEQ ID NO: 2453177 - RNA, 13 nt, Human
ggacgcuucugaa

SEQ ID NO: 2453178 - RNA, 23 nt, Human
ggacgcagcaggaggccaggccg

SEQ ID NO: 2453179 - RNA, 17 nt, Human
ggaccuuucagcuguga

SEQ ID NO: 2453180 - RNA, 15 nt, Human
ggaccuuucagcugu

SEQ ID NO: 2453181 - RNA, 19 nt, Human
ggaccuuuagugguggcca

SEQ ID NO: 2453182 - RNA, 12 nt, Human
ggacccagaccc

SEQ ID NO: 2453183 - RNA, 10 nt, Human
ggacccagac

SEQ ID NO: 2453184 - RNA, 19 nt, Human
ggacccaauguaggagcug

SEQ ID NO: 2453185 - RNA, 18 nt, Human
ggaccuugaacuggguac

SEQ ID NO: 2453186 - RNA, 22 nt, Human
ggaccuuuccaccacagccagc

SEQ ID NO: 2453187 - RNA, 19 nt, Human
ggaccuuuccaccacagcc

SEQ ID NO: 2453188 - RNA, 18 nt, Human
ggaccuuuccaccacagc

SEQ ID NO: 2453189 - RNA, 14 nt, Human
ggacgacucugacc

SEQ ID NO: 2453190 - RNA, 22 nt, Human
ggacgcagcaggaggccaggcc

SEQ ID NO: 2453191 - RNA, 20 nt, Human
ggaccuuuccaccacagcca

SEQ ID NO: 2453192 - RNA, 23 nt, Human
ggaccaggcaaugugacuuugca

SEQ ID NO: 2453193 - RNA, 13 nt, Human
ggaccaggcaaug

SEQ ID NO: 2453194 - RNA, 17 nt, Human
ggaccagggcagggcca

SEQ ID NO: 2453195 - RNA, 19 nt, Human
ggaccagucaaccugggca

SEQ ID NO: 2453196 - RNA, 14 nt, Human
ggaccauccuauuu

SEQ ID NO: 2453197 - RNA, 16 nt, Human
ggacccaaugcacaca

SEQ ID NO: 2453198 - RNA, 17 nt, Human
ggaccaucauccuacug

SEQ ID NO: 2453199 - RNA, 15 nt, Human
ggaguccccucaccu

SEQ ID NO: 2453200 - RNA, 13 nt, Human
ggaguccccucac

SEQ ID NO: 2453201 - RNA, 14 nt, Human
ggagucagugccag

SEQ ID NO: 2453202 - RNA, 15 nt, Human
ggagucagugccagg

SEQ ID NO: 2453203 - RNA, 23 nt, Human
ggagucccaccuuggcugcaggg

SEQ ID NO: 2453204 - RNA, 22 nt, Human
ggaugagaguuuuggaugcagu

SEQ ID NO: 2453205 - RNA, 20 nt, Human
ggaugagaguuuuggaugca

SEQ ID NO: 2453206 - RNA, 21 nt, Human
ggaguccccuccccggcccua

SEQ ID NO: 2453207 - RNA, 13 nt, Human
ggaguccccuccc

SEQ ID NO: 2453208 - RNA, 15 nt, Human
ggagucccgucagga

SEQ ID NO: 2453209 - RNA, 20 nt, Human
ggaugagcauggagcuggcc

SEQ ID NO: 2453210 - RNA, 19 nt, Human
ggaugagcauggagcuggc

SEQ ID NO: 2453211 - RNA, 17 nt, Human
ggaugagcauggagcug

SEQ ID NO: 2453212 - RNA, 23 nt, Human
ggaguccccuccccggcccuacc

SEQ ID NO: 2453213 - RNA, 13 nt, Human
ggaugagcauuua

SEQ ID NO: 2453214 - RNA, 22 nt, Human
ggaugaucuaggaagacuuugg

SEQ ID NO: 2453215 - RNA, 18 nt, Human
ggaugaucuaggaagacu

SEQ ID NO: 2453216 - RNA, 16 nt, Human
ggaugaucuaggaaga

SEQ ID NO: 2453217 - RNA, 21 nt, Human
ggaugaggccgcuagaggccu

SEQ ID NO: 2453218 - RNA, 20 nt, Human
ggaugaggccgcuagaggcc

SEQ ID NO: 2453219 - RNA, 15 nt, Human
ggaugagcuggaagg

SEQ ID NO: 2453220 - RNA, 16 nt, Human
ggaugaggugcuggga

SEQ ID NO: 2453221 - RNA, 18 nt, Human
ggaugaggugcugggagg

SEQ ID NO: 2453222 - RNA, 17 nt, Human
ggaugccugguggcagc

SEQ ID NO: 2453223 - RNA, 13 nt, Human
ggaugccuggugg

SEQ ID NO: 2453224 - RNA, 19 nt, Human
ggaugcccaaagaugcagc

SEQ ID NO: 2453225 - RNA, 17 nt, Human
ggaugccccgucccccu

SEQ ID NO: 2453226 - RNA, 18 nt, Human
ggaugccaucugugggca

SEQ ID NO: 2453227 - RNA, 19 nt, Human
ggaugccaucugugggcac

SEQ ID NO: 2453228 - RNA, 22 nt, Human
ggaugcccagggccacucugcc

SEQ ID NO: 2453229 - RNA, 22 nt, Human
ggaugccaauauuaaaucugcu

SEQ ID NO: 2453230 - RNA, 21 nt, Human
ggaugauucagaaauuggaac

SEQ ID NO: 2453231 - RNA, 20 nt, Human
ggaugauucagaaauuggaa

SEQ ID NO: 2453232 - RNA, 16 nt, Human
ggaugauucagaaauu

SEQ ID NO: 2453233 - RNA, 14 nt, Human
ggaugaugccacac

SEQ ID NO: 2453234 - RNA, 18 nt, Human
ggaugcccaaagaugcag

SEQ ID NO: 2453235 - RNA, 18 nt, Human
ggaugaugacuauggaaa

SEQ ID NO: 2453236 - RNA, 23 nt, Human
ggaugaguacccaaaagcucagc

SEQ ID NO: 2453237 - RNA, 17 nt, Human
ggaugaggugcugggag

SEQ ID NO: 2453238 - RNA, 15 nt, Human
ggaugaugccucaug

SEQ ID NO: 2453239 - RNA, 21 nt, Human
ggaugccugguggcagcugcg

SEQ ID NO: 2453240 - RNA, 20 nt, Human
ggaugccugguggcagcugc

SEQ ID NO: 2453241 - RNA, 19 nt, Human
ggaugccugguggcagcug

SEQ ID NO: 2453242 - RNA, 18 nt, Human
ggaugccugguggcagcu

SEQ ID NO: 2453243 - RNA, 22 nt, Human
ggauuauucauuuaaaaugauu

SEQ ID NO: 2453244 - RNA, 21 nt, Human
ggauuauucauuuaaaaugau

SEQ ID NO: 2453245 - RNA, 19 nt, Human
ggauuauucauuuaaaaug

SEQ ID NO: 2453246 - RNA, 17 nt, Human
ggauuauucauuuaaaa

SEQ ID NO: 2453247 - RNA, 15 nt, Human
ggauuauucauuuaa

SEQ ID NO: 2453248 - RNA, 12 nt, Human
ggauuauauuau

SEQ ID NO: 2453249 - RNA, 18 nt, Human
ggaugcccuggagguggc

SEQ ID NO: 2453250 - RNA, 21 nt, Human
ggaugcccuggagguggcuga

SEQ ID NO: 2453251 - RNA, 13 nt, Human
ggaugcccuggag

SEQ ID NO: 2453252 - RNA, 15 nt, Human
ggaugcccuggaggu

SEQ ID NO: 2453253 - RNA, 12 nt, Human
ggaugcccugga

SEQ ID NO: 2453254 - RNA, 23 nt, Human
ggaugcccagggccacucugccu

SEQ ID NO: 2453255 - RNA, 18 nt, Human
ggauuauuuuuucagacc

SEQ ID NO: 2453256 - RNA, 17 nt, Human
ggauuauuuuuucagac

SEQ ID NO: 2453257 - RNA, 16 nt, Human
ggauuauuuuuucaga

SEQ ID NO: 2453258 - RNA, 14 nt, Human
ggauuauuuuuuca

SEQ ID NO: 2453259 - RNA, 13 nt, Human
ggauuauuuuuuc

SEQ ID NO: 2453260 - RNA, 22 nt, Human
ggauuauuuaauaacauuaccu

SEQ ID NO: 2453261 - RNA, 19 nt, Human
ggauuauuuaauaacauua

SEQ ID NO: 2453262 - RNA, 17 nt, Human
ggauuauuuaauaacau

SEQ ID NO: 2453263 - RNA, 20 nt, Human
ggauuauuuuuucagaccga

SEQ ID NO: 2453264 - RNA, 19 nt, Human
ggauuauuuuuucagaccg

SEQ ID NO: 2453265 - RNA, 17 nt, Human
ggauucauuuccugccc

SEQ ID NO: 2453266 - RNA, 16 nt, Human
ggauucauuuccugcc

SEQ ID NO: 2453267 - RNA, 15 nt, Human
ggauucauuuccugc

SEQ ID NO: 2453268 - RNA, 14 nt, Human
ggauucauuuccug

SEQ ID NO: 2453269 - RNA, 16 nt, Human
ggauucauuacagcuu

SEQ ID NO: 2453270 - RNA, 13 nt, Human
ggauucauuuccu

SEQ ID NO: 2453271 - RNA, 21 nt, Human
ggauucaggaauguguggccu

SEQ ID NO: 2453272 - RNA, 13 nt, Human
ggauucaggcugc

SEQ ID NO: 2453273 - RNA, 14 nt, Human
ggauucaggcugcu

SEQ ID NO: 2453274 - RNA, 15 nt, Human
ggauucaggcugcuu

SEQ ID NO: 2453275 - RNA, 20 nt, Human
ggauucuacuuuaagcacua

SEQ ID NO: 2453276 - RNA, 20 nt, Human
ggauuccugacccaggccgc

SEQ ID NO: 2453277 - RNA, 19 nt, Human
ggauuccugacccaggccg

SEQ ID NO: 2453278 - RNA, 16 nt, Human
ggauucugagagcugu

SEQ ID NO: 2453279 - RNA, 23 nt, Human
ggauucuacuuuaagcacuacau

SEQ ID NO: 2453280 - RNA, 21 nt, Human
ggauucuggccuagucccuuc

SEQ ID NO: 2453281 - RNA, 13 nt, Human
ggauucugggagg

SEQ ID NO: 2453282 - RNA, 22 nt, Human
ggauucccaccaaggucuucag

SEQ ID NO: 2453283 - RNA, 18 nt, Human
ggauucauuuccugcccu

SEQ ID NO: 2453284 - RNA, 16 nt, Human
ggauuccugacccagg

SEQ ID NO: 2453285 - RNA, 15 nt, Human
ggauuccugacccag

SEQ ID NO: 2453286 - RNA, 14 nt, Human
ggauuccugaccca

SEQ ID NO: 2453287 - RNA, 13 nt, Human
ggauuccugaccc

SEQ ID NO: 2453288 - RNA, 23 nt, Human
ggauucccaccaaggucuucagc

SEQ ID NO: 2453289 - RNA, 20 nt, Human
ggauugaucggagccuccuc

SEQ ID NO: 2453290 - RNA, 18 nt, Human
ggcaagaaggaauugacu

SEQ ID NO: 2453291 - RNA, 13 nt, Human
ggauugagucugu

SEQ ID NO: 2453292 - RNA, 16 nt, Human
ggauugaagcccucca

SEQ ID NO: 2453293 - RNA, 14 nt, Human
ggauugaagcccuc

SEQ ID NO: 2453294 - RNA, 17 nt, Human
ggcaagcaccuccugcc

SEQ ID NO: 2453295 - RNA, 14 nt, Human
ggcaagaggggugg

SEQ ID NO: 2453296 - RNA, 12 nt, Human
ggcaagaggggu

SEQ ID NO: 2453297 - RNA, 12 nt, Human
ggcaagauuuuc

SEQ ID NO: 2453298 - RNA, 16 nt, Human
ggcaagagggggugga

SEQ ID NO: 2453299 - RNA, 22 nt, Human
ggcaagagcccccuugacaccg

SEQ ID NO: 2453300 - RNA, 19 nt, Human
ggcaagagcccccuugaca

SEQ ID NO: 2453301 - RNA, 23 nt, Human
ggauucuguacaugcauugagcu

SEQ ID NO: 2453302 - RNA, 13 nt, Human
ggauucuuggccc

SEQ ID NO: 2453303 - RNA, 18 nt, Human
ggauucuuuccauuauga

SEQ ID NO: 2453304 - RNA, 21 nt, Human
ggauucuuccucccucccucu

SEQ ID NO: 2453305 - RNA, 19 nt, Human
ggauucugguuccaggguc

SEQ ID NO: 2453306 - RNA, 18 nt, Human
ggauucugguuccagggu

SEQ ID NO: 2453307 - RNA, 14 nt, Human
ggauucugguucca

SEQ ID NO: 2453308 - RNA, 19 nt, Human
ggauucugggaggaagcag

SEQ ID NO: 2453309 - RNA, 18 nt, Human
ggcaagcuagaaccugga

SEQ ID NO: 2453310 - RNA, 19 nt, Human
ggcaagccccugcccaucu

SEQ ID NO: 2453311 - RNA, 19 nt, Human
ggcaagauuuuccuuuuuu

SEQ ID NO: 2453312 - RNA, 20 nt, Human
ggcaagcuagaaccuggagg

SEQ ID NO: 2453313 - RNA, 22 nt, Human
ggcaagcugugacuucuccagg

SEQ ID NO: 2453314 - RNA, 14 nt, Human
ggcaaggacacaga

SEQ ID NO: 2453315 - RNA, 23 nt, Human
ggcaagcugugacuucuccaggu

SEQ ID NO: 2453316 - RNA, 16 nt, Human
ggcaaggacacagaug

SEQ ID NO: 2453317 - RNA, 22 nt, Human
ggcaagcuuggcuguagaagga

SEQ ID NO: 2453318 - RNA, 19 nt, Human
ggcaagcaccuccugccuc

SEQ ID NO: 2453319 - RNA, 18 nt, Human
ggcaagcaccuccugccu

SEQ ID NO: 2453320 - RNA, 22 nt, Human
ggcaaggcaggugccuccaggu

SEQ ID NO: 2453321 - RNA, 14 nt, Human
ggcaaggcaggugc

SEQ ID NO: 2453322 - RNA, 13 nt, Human
ggcaaggcaggug

SEQ ID NO: 2453323 - RNA, 12 nt, Human
ggcaaggcaggu

SEQ ID NO: 2453324 - RNA, 17 nt, Human
ggcaccagcagccugga

SEQ ID NO: 2453325 - RNA, 17 nt, Human
ggcaccagggguuucuc

SEQ ID NO: 2453326 - RNA, 21 nt, Human
ggcacucacagaccuggagcc

SEQ ID NO: 2453327 - RNA, 17 nt, Human
ggcacucacagaccugg

SEQ ID NO: 2453328 - RNA, 23 nt, Human
ggcacucaaugcagccagaccua

SEQ ID NO: 2453329 - RNA, 18 nt, Human
ggcacucaaugcagccag

SEQ ID NO: 2453330 - RNA, 20 nt, Human
ggcacucagaagacacugau

SEQ ID NO: 2453331 - RNA, 19 nt, Human
ggcacucagaagacacuga

SEQ ID NO: 2453332 - RNA, 18 nt, Human
ggcacucagaagacacug

SEQ ID NO: 2453333 - RNA, 20 nt, Human
ggcacccacaagugccacug

SEQ ID NO: 2453334 - RNA, 20 nt, Human
ggcacccggccccugcuggu

SEQ ID NO: 2453335 - RNA, 19 nt, Human
ggcacccggccccugcugg

SEQ ID NO: 2453336 - RNA, 18 nt, Human
ggcacccggccccugcug

SEQ ID NO: 2453337 - RNA, 20 nt, Human
ggcacccaccaucaugucug

SEQ ID NO: 2453338 - RNA, 21 nt, Human
ggcagagguugcagugagccg

SEQ ID NO: 2453339 - RNA, 18 nt, Human
ggcagagguucauuucaa

SEQ ID NO: 2453340 - RNA, 17 nt, Human
ggcagagcuggcucuga

SEQ ID NO: 2453341 - RNA, 16 nt, Human
ggcagagcuggcucug

SEQ ID NO: 2453342 - RNA, 19 nt, Human
ggcagagcuggcucugagc

SEQ ID NO: 2453343 - RNA, 19 nt, Human
ggcagaggcuggaggcagg

SEQ ID NO: 2453344 - RNA, 21 nt, Human
ggcagaggcuggaggcagggc

SEQ ID NO: 2453345 - RNA, 19 nt, Human
ggcagagggcagaggcugg

SEQ ID NO: 2453346 - RNA, 20 nt, Human
ggcagagggcagaggcugga

SEQ ID NO: 2453347 - RNA, 22 nt, Human
ggcagaggcuggaggcagggcc

SEQ ID NO: 2453348 - RNA, 23 nt, Human
ggcagaggcuggaggcagggccu

SEQ ID NO: 2453349 - RNA, 14 nt, Human
ggcagagggcagag

SEQ ID NO: 2453350 - RNA, 16 nt, Human
ggcagagggcagaggc

SEQ ID NO: 2453351 - RNA, 23 nt, Human
ggcacucacagaccuggagcccc

SEQ ID NO: 2453352 - RNA, 22 nt, Human
ggcacucacagaccuggagccc

SEQ ID NO: 2453353 - RNA, 22 nt, Human
ggcagagcagagaccaucccug

SEQ ID NO: 2453354 - RNA, 12 nt, Human
ggcagagcccaa

SEQ ID NO: 2453355 - RNA, 16 nt, Human
ggcagagcccaaggga

SEQ ID NO: 2453356 - RNA, 16 nt, Human
ggcagagccgggaagc

SEQ ID NO: 2453357 - RNA, 22 nt, Human
ggcagagccuuuggaugaccag

SEQ ID NO: 2453358 - RNA, 16 nt, Human
ggccaggcccucugcc

SEQ ID NO: 2453359 - RNA, 15 nt, Human
ggccaggcccucugc

SEQ ID NO: 2453360 - RNA, 16 nt, Human
ggccaugcugaaggga

SEQ ID NO: 2453361 - RNA, 14 nt, Human
ggccaugccugccc

SEQ ID NO: 2453362 - RNA, 13 nt, Human
ggccaugccugcc

SEQ ID NO: 2453363 - RNA, 17 nt, Human
ggccaggcccucugccc

SEQ ID NO: 2453364 - RNA, 14 nt, Human
ggccaggcccucug

SEQ ID NO: 2453365 - RNA, 13 nt, Human
ggccaggagccuc

SEQ ID NO: 2453366 - RNA, 15 nt, Human
ggccaggacugagcc

SEQ ID NO: 2453367 - RNA, 20 nt, Human
ggccaggacugagccccgca

SEQ ID NO: 2453368 - RNA, 13 nt, Human
ggccaggacugag

SEQ ID NO: 2453369 - RNA, 11 nt, Human
ggccaggagcc

SEQ ID NO: 2453370 - RNA, 12 nt, Human
ggcccaccuggc

SEQ ID NO: 2453371 - RNA, 15 nt, Human
ggcccaccagagcug

SEQ ID NO: 2453372 - RNA, 20 nt, Human
ggcccacagggaacccugcu

SEQ ID NO: 2453373 - RNA, 20 nt, Human
ggcccacagcucccacccca

SEQ ID NO: 2453374 - RNA, 15 nt, Human
ggcccacagcuccca

SEQ ID NO: 2453375 - RNA, 17 nt, Human
ggcccacagcucccacc

SEQ ID NO: 2453376 - RNA, 18 nt, Human
ggcccacagcucccaccc

SEQ ID NO: 2453377 - RNA, 19 nt, Human
ggcccacagcucccacccc

SEQ ID NO: 2453378 - RNA, 22 nt, Human
ggccaugcugaggccugggccg

SEQ ID NO: 2453379 - RNA, 19 nt, Human
ggccaugcugaggccuggg

SEQ ID NO: 2453380 - RNA, 18 nt, Human
ggccaugcugaggccugg

SEQ ID NO: 2453381 - RNA, 15 nt, Human
ggccaugcugaggcc

SEQ ID NO: 2453382 - RNA, 14 nt, Human
ggccaugcugaggc

SEQ ID NO: 2453383 - RNA, 13 nt, Human
ggccaugcugagg

SEQ ID NO: 2453384 - RNA, 17 nt, Human
ggccaugcugaagggac

SEQ ID NO: 2453385 - RNA, 14 nt, Human
ggccauggagagcu

SEQ ID NO: 2453386 - RNA, 17 nt, Human
ggccauggagagcugga

SEQ ID NO: 2453387 - RNA, 16 nt, Human
ggccauggagagcugg

SEQ ID NO: 2453388 - RNA, 23 nt, Human
ggcccacagcaggugcugagcaa

SEQ ID NO: 2453389 - RNA, 19 nt, Human
ggcccacagcaggugcuga

SEQ ID NO: 2453390 - RNA, 13 nt, Human
ggcccacagcucc

SEQ ID NO: 2453391 - RNA, 14 nt, Human
ggcccacagcuccc

SEQ ID NO: 2453392 - RNA, 14 nt, Human
ggcauguuccucug

SEQ ID NO: 2453393 - RNA, 16 nt, Human
ggccacacucagcaca

SEQ ID NO: 2453394 - RNA, 17 nt, Human
ggcauguguauguuccc

SEQ ID NO: 2453395 - RNA, 21 nt, Human
ggccacacucagcacaaggcc

SEQ ID NO: 2453396 - RNA, 22 nt, Human
ggccacagaaaauucuucucca

SEQ ID NO: 2453397 - RNA, 20 nt, Human
ggcauguucucugaggacac

SEQ ID NO: 2453398 - RNA, 20 nt, Human
ggcauguggccuguggccug

SEQ ID NO: 2453399 - RNA, 19 nt, Human
ggcauguggccuguggccu

SEQ ID NO: 2453400 - RNA, 23 nt, Human
ggcauguguuuacuuuauguuac

SEQ ID NO: 2453401 - RNA, 17 nt, Human
ggcauguggccuguggc

SEQ ID NO: 2453402 - RNA, 16 nt, Human
ggcauguggccugugg

SEQ ID NO: 2453403 - RNA, 15 nt, Human
ggcauguggccugug

SEQ ID NO: 2453404 - RNA, 13 nt, Human
ggcauguggccug

SEQ ID NO: 2453405 - RNA, 16 nt, Human
ggccaccuccccagca

SEQ ID NO: 2453406 - RNA, 13 nt, Human
ggccaccucccca

SEQ ID NO: 2453407 - RNA, 17 nt, Human
ggccaccuccccagcau

SEQ ID NO: 2453408 - RNA, 13 nt, Human
ggccaccucucca

SEQ ID NO: 2453409 - RNA, 11 nt, Human
ggccaccucuc

SEQ ID NO: 2453410 - RNA, 16 nt, Human
ggccacaucaaagagg

SEQ ID NO: 2453411 - RNA, 16 nt, Human
ggccacaguuguuuga

SEQ ID NO: 2453412 - RNA, 20 nt, Human
ggccacaguagucuugauga

SEQ ID NO: 2453413 - RNA, 14 nt, Human
ggccacaguuguuu

SEQ ID NO: 2453414 - RNA, 23 nt, Human
ggccacagggcgagacuccgucu

SEQ ID NO: 2453415 - RNA, 20 nt, Human
ggccacagggcgagacuccg

SEQ ID NO: 2453416 - RNA, 22 nt, Human
ggccacagaggacucacuugcc

SEQ ID NO: 2453417 - RNA, 20 nt, Human
ggccaccucuccaagggcuu

SEQ ID NO: 2453418 - RNA, 18 nt, Human
ggccaccucuccaagggc

SEQ ID NO: 2453419 - RNA, 15 nt, Human
ggccaccucuccaag

SEQ ID NO: 2453420 - RNA, 14 nt, Human
ggccaccucuccaa

SEQ ID NO: 2453421 - RNA, 23 nt, Human
ggccaccucugcggaccccagcu

SEQ ID NO: 2453422 - RNA, 12 nt, Human
ggccaccucugc

SEQ ID NO: 2453423 - RNA, 21 nt, Human
ggccaccugaggugggcccag

SEQ ID NO: 2453424 - RNA, 20 nt, Human
ggccaccugaggugggccca

SEQ ID NO: 2453425 - RNA, 19 nt, Human
ggccaccugaggugggccc

SEQ ID NO: 2453426 - RNA, 17 nt, Human
ggccaccugaggugggc

SEQ ID NO: 2453427 - RNA, 16 nt, Human
ggccaccugagguggg

SEQ ID NO: 2453428 - RNA, 20 nt, Human
ggccacugugaagagaacca

SEQ ID NO: 2453429 - RNA, 15 nt, Human
ggccacuucugggug

SEQ ID NO: 2453430 - RNA, 13 nt, Human
ggccaccugcccc

SEQ ID NO: 2453431 - RNA, 23 nt, Human
ggccaccugaggugggcccagga

SEQ ID NO: 2453432 - RNA, 22 nt, Human
ggccaccugaggugggcccagg

SEQ ID NO: 2453433 - RNA, 18 nt, Human
ggccagacacaggcccuc

SEQ ID NO: 2453434 - RNA, 15 nt, Human
ggccagacaugccac

SEQ ID NO: 2453435 - RNA, 15 nt, Human
ggccaggacaggccc

SEQ ID NO: 2453436 - RNA, 16 nt, Human
ggccaggacaggcccg

SEQ ID NO: 2453437 - RNA, 16 nt, Human
ggccagacacaggccc

SEQ ID NO: 2453438 - RNA, 17 nt, Human
ggccagacacaggcccu

SEQ ID NO: 2453439 - RNA, 21 nt, Human
ggccacuucuggguggggcag

SEQ ID NO: 2453440 - RNA, 15 nt, Human
ggccacuuuugacua

SEQ ID NO: 2453441 - RNA, 24 nt, Human
ggcagcugcgguccacccaggagc

SEQ ID NO: 2453442 - RNA, 23 nt, Human
ggcagcugcgguccacccaggag

SEQ ID NO: 2453443 - RNA, 12 nt, Human
ggcaggguccua

SEQ ID NO: 2453444 - RNA, 18 nt, Human
ggcagggucucacucugu

SEQ ID NO: 2453445 - RNA, 17 nt, Human
ggcagggucucacucug

SEQ ID NO: 2453446 - RNA, 17 nt, Human
ggcagguuggugggggc

SEQ ID NO: 2453447 - RNA, 14 nt, Human
ggcaguaauaaaaa

SEQ ID NO: 2453448 - RNA, 15 nt, Human
ggcagggucaggaga

SEQ ID NO: 2453449 - RNA, 17 nt, Human
ggcagggucaggagagg

SEQ ID NO: 2453450 - RNA, 21 nt, Human
ggcagaguugaagacagagcu

SEQ ID NO: 2453451 - RNA, 19 nt, Human
ggcagaguugaagacagag

SEQ ID NO: 2453452 - RNA, 17 nt, Human
ggcagaguugaagacag

SEQ ID NO: 2453453 - RNA, 18 nt, Human
ggcagagguuguggugag

SEQ ID NO: 2453454 - RNA, 21 nt, Human
ggcagcugcgguccacccagg

SEQ ID NO: 2453455 - RNA, 14 nt, Human
ggcagcugccagag

SEQ ID NO: 2453456 - RNA, 15 nt, Human
ggcagcugccagaga

SEQ ID NO: 2453457 - RNA, 16 nt, Human
ggcagcugccagagaa

SEQ ID NO: 2453458 - RNA, 17 nt, Human
ggcagcugccagagaag

SEQ ID NO: 2453459 - RNA, 17 nt, Human
ggcagcugaccauggaa

SEQ ID NO: 2453460 - RNA, 11 nt, Human
ggcagcugcca

SEQ ID NO: 2453461 - RNA, 12 nt, Human
ggcagcugccac

SEQ ID NO: 2453462 - RNA, 21 nt, Human
ggcagaguucuauaauguaaa

SEQ ID NO: 2453463 - RNA, 21 nt, Human
ggcagcugaacuauuggaggg

SEQ ID NO: 2453464 - RNA, 22 nt, Human
ggcaugacacgaauauugcuga

SEQ ID NO: 2453465 - RNA, 20 nt, Human
ggcaguggagucggaagggc

SEQ ID NO: 2453466 - RNA, 19 nt, Human
ggcagucgggggcuggccu

SEQ ID NO: 2453467 - RNA, 18 nt, Human
ggcagucgggggcuggcc

SEQ ID NO: 2453468 - RNA, 15 nt, Human
ggcagucgggggcug

SEQ ID NO: 2453469 - RNA, 14 nt, Human
ggcagucgggggcu

SEQ ID NO: 2453470 - RNA, 23 nt, Human
ggcagucauucagcaccagagca

SEQ ID NO: 2453471 - RNA, 19 nt, Human
ggcagucgauagagcugua

SEQ ID NO: 2453472 - RNA, 22 nt, Human
ggcagucauucagcaccagagc

SEQ ID NO: 2453473 - RNA, 21 nt, Human
ggcaguagaaggucggaggcu

SEQ ID NO: 2453474 - RNA, 20 nt, Human
ggcagucauuggcugucucc

SEQ ID NO: 2453475 - RNA, 19 nt, Human
ggcagucaccugcccagau

SEQ ID NO: 2453476 - RNA, 23 nt, Human
ggcaguagcuguggugagguggg

SEQ ID NO: 2453477 - RNA, 23 nt, Human
ggcaugugaugagaggaaaucac

SEQ ID NO: 2453478 - RNA, 18 nt, Human
ggcaugugaugagaggaa

SEQ ID NO: 2453479 - RNA, 22 nt, Human
ggcaugguggcgcaagccugua

SEQ ID NO: 2453480 - RNA, 20 nt, Human
ggcauggggugggccucugg

SEQ ID NO: 2453481 - RNA, 21 nt, Human
ggcaugguggcgcaagccugu

SEQ ID NO: 2453482 - RNA, 18 nt, Human
ggcauguauuggccugga

SEQ ID NO: 2453483 - RNA, 17 nt, Human
ggcauguauuggccugg

SEQ ID NO: 2453484 - RNA, 16 nt, Human
ggcauguauuggccug

SEQ ID NO: 2453485 - RNA, 15 nt, Human
ggcauguauuggccu

SEQ ID NO: 2453486 - RNA, 20 nt, Human
ggcauguauuggccuggagg

SEQ ID NO: 2453487 - RNA, 19 nt, Human
ggcauguauuggccuggag

SEQ ID NO: 2453488 - RNA, 21 nt, Human
ggcauguauuggccuggaggu

SEQ ID NO: 2453489 - RNA, 21 nt, Human
ggcauggggugggccucuggu

SEQ ID NO: 2453490 - RNA, 19 nt, Human
ggcauggggugggccucug

SEQ ID NO: 2453491 - RNA, 21 nt, Human
ggcaugccccggccaccucug

SEQ ID NO: 2453492 - RNA, 19 nt, Human
ggcaugguggcgcaagccu

SEQ ID NO: 2453493 - RNA, 19 nt, Human
ggcaugguacggagauguu

SEQ ID NO: 2453494 - RNA, 20 nt, Human
ggcaugccccggccaccucu

SEQ ID NO: 2453495 - RNA, 19 nt, Human
ggcaugccccggccaccuc

SEQ ID NO: 2453496 - RNA, 18 nt, Human
ggcaugccccggccaccu

SEQ ID NO: 2453497 - RNA, 15 nt, Human
ggcaugccccggcca

SEQ ID NO: 2453498 - RNA, 22 nt, Human
ggcaugccccggccaccucugc

SEQ ID NO: 2453499 - RNA, 18 nt, Human
ggcauggggugggccucu

SEQ ID NO: 2453500 - RNA, 14 nt, Human
ggcaugagggauca

SEQ ID NO: 2453501 - RNA, 19 nt, Human
ggcaugagggaucacaggg

SEQ ID NO: 2453502 - RNA, 16 nt, Human
ggcccagagcaggaag

SEQ ID NO: 2453503 - RNA, 14 nt, Human
ggcccagagcagga

SEQ ID NO: 2453504 - RNA, 15 nt, Human
ggcccaccuggccac

SEQ ID NO: 2453505 - RNA, 14 nt, Human
ggcccaccuggcca

SEQ ID NO: 2453506 - RNA, 12 nt, Human
ggcccagagccc

SEQ ID NO: 2453507 - RNA, 13 nt, Human
ggcccagagccca

SEQ ID NO: 2453508 - RNA, 14 nt, Human
ggcccagagcccag

SEQ ID NO: 2453509 - RNA, 15 nt, Human
ggcccagagcccagc

SEQ ID NO: 2453510 - RNA, 16 nt, Human
ggcccagagcccagcu

SEQ ID NO: 2453511 - RNA, 17 nt, Human
ggcccagagcccagcuc

SEQ ID NO: 2453512 - RNA, 14 nt, Human
ggcccagagggccu

SEQ ID NO: 2453513 - RNA, 18 nt, Human
ggcccagagcccagcucc

SEQ ID NO: 2453514 - RNA, 19 nt, Human
ggcccagagcccagcucca

SEQ ID NO: 2453515 - RNA, 19 nt, Human
ggcccagagggccugcaag

SEQ ID NO: 2453516 - RNA, 17 nt, Human
ggcccagagggccugca

SEQ ID NO: 2453517 - RNA, 20 nt, Human
ggcccagagggccugcaagg

SEQ ID NO: 2453518 - RNA, 20 nt, Human
ggcccagcauugcugguucu

SEQ ID NO: 2453519 - RNA, 15 nt, Human
ggccggcgagcccug

SEQ ID NO: 2453520 - RNA, 17 nt, Human
ggcccagcauugcuggu

SEQ ID NO: 2453521 - RNA, 15 nt, Human
ggcccagcauugcug

SEQ ID NO: 2453522 - RNA, 22 nt, Human
ggcccagaucuggucccuugca

SEQ ID NO: 2453523 - RNA, 17 nt, Human
ggccuaaaaguaaacau

SEQ ID NO: 2453524 - RNA, 21 nt, Human
ggccguugauguuggcuggga

SEQ ID NO: 2453525 - RNA, 19 nt, Human
ggccguugauguuggcugg

SEQ ID NO: 2453526 - RNA, 17 nt, Human
ggccgugggccuggggu

SEQ ID NO: 2453527 - RNA, 13 nt, Human
ggccguuggccac

SEQ ID NO: 2453528 - RNA, 16 nt, Human
ggccuaaaaguaaaca

SEQ ID NO: 2453529 - RNA, 14 nt, Human
ggccgugggccugg

SEQ ID NO: 2453530 - RNA, 16 nt, Human
ggccguggcugcccac

SEQ ID NO: 2453531 - RNA, 13 nt, Human
ggccguggcugcc

SEQ ID NO: 2453532 - RNA, 22 nt, Human
ggccgggaccccgagccuggcu

SEQ ID NO: 2453533 - RNA, 23 nt, Human
ggccgggaccccgagccuggcuc

SEQ ID NO: 2453534 - RNA, 17 nt, Human
ggccggcgagcccugug

SEQ ID NO: 2453535 - RNA, 18 nt, Human
ggccggcgagcccugugg

SEQ ID NO: 2453536 - RNA, 22 nt, Human
ggccggcuucaugccagcuacu

SEQ ID NO: 2453537 - RNA, 15 nt, Human
ggccgggagccugau

SEQ ID NO: 2453538 - RNA, 22 nt, Human
ggccucaagugauucuccugcc

SEQ ID NO: 2453539 - RNA, 14 nt, Human
ggccucaagugauu

SEQ ID NO: 2453540 - RNA, 21 nt, Human
ggccuccguccaggagccugg

SEQ ID NO: 2453541 - RNA, 12 nt, Human
ggccucaagauc

SEQ ID NO: 2453542 - RNA, 22 nt, Human
ggccucaacccucccucagccc

SEQ ID NO: 2453543 - RNA, 23 nt, Human
ggccucaacccucccucagcccc

SEQ ID NO: 2453544 - RNA, 18 nt, Human
ggccucaagaucaaugaa

SEQ ID NO: 2453545 - RNA, 22 nt, Human
ggccuccucacaacaugguguc

SEQ ID NO: 2453546 - RNA, 15 nt, Human
ggccucaaggacuug

SEQ ID NO: 2453547 - RNA, 18 nt, Human
ggccuccucuguccaggg

SEQ ID NO: 2453548 - RNA, 20 nt, Human
ggccuagcauacguacacau

SEQ ID NO: 2453549 - RNA, 22 nt, Human
ggccuagcauacguacacauuu

SEQ ID NO: 2453550 - RNA, 21 nt, Human
ggccucaacccucccucagcc

SEQ ID NO: 2453551 - RNA, 17 nt, Human
ggccuagauccacacac

SEQ ID NO: 2453552 - RNA, 23 nt, Human
ggccuagauccacacacagagga

SEQ ID NO: 2453553 - RNA, 20 nt, Human
ggccucucuggccucccacc

SEQ ID NO: 2453554 - RNA, 19 nt, Human
ggccucucuggccucccac

SEQ ID NO: 2453555 - RNA, 17 nt, Human
ggccucucuggccuccc

SEQ ID NO: 2453556 - RNA, 16 nt, Human
ggccucucuggccucc

SEQ ID NO: 2453557 - RNA, 15 nt, Human
ggccucucuggccuc

SEQ ID NO: 2453558 - RNA, 13 nt, Human
ggccucucuggcc

SEQ ID NO: 2453559 - RNA, 22 nt, Human
ggccucuaaccccaggccccga

SEQ ID NO: 2453560 - RNA, 20 nt, Human
ggccucuaaccccaggcccc

SEQ ID NO: 2453561 - RNA, 19 nt, Human
ggccucuaaccccaggccc

SEQ ID NO: 2453562 - RNA, 18 nt, Human
ggccucuaaccccaggcc

SEQ ID NO: 2453563 - RNA, 17 nt, Human
ggccucuaaccccaggc

SEQ ID NO: 2453564 - RNA, 16 nt, Human
ggccucuaaccccagg

SEQ ID NO: 2453565 - RNA, 18 nt, Human
ggccucgccuggccugag

SEQ ID NO: 2453566 - RNA, 19 nt, Human
ggccucuccuuguggccug

SEQ ID NO: 2453567 - RNA, 20 nt, Human
ggccucucauuccagaggaa

SEQ ID NO: 2453568 - RNA, 14 nt, Human
ggccuccugugugu

SEQ ID NO: 2453569 - RNA, 17 nt, Human
ggccuccucccuuagcu

SEQ ID NO: 2453570 - RNA, 19 nt, Human
ggccuccucuguccagggc

SEQ ID NO: 2453571 - RNA, 20 nt, Human
ggccucgguguggagaagcg

SEQ ID NO: 2453572 - RNA, 17 nt, Human
ggccucgccuggccuga

SEQ ID NO: 2453573 - RNA, 16 nt, Human
ggccucgccuggccug

SEQ ID NO: 2453574 - RNA, 15 nt, Human
ggccucgccuggccu

SEQ ID NO: 2453575 - RNA, 14 nt, Human
ggccucgccuggcc

SEQ ID NO: 2453576 - RNA, 14 nt, Human
ggccuggccugagc

SEQ ID NO: 2453577 - RNA, 13 nt, Human
ggccuggccugag

SEQ ID NO: 2453578 - RNA, 10 nt, Human
ggccuggccu

SEQ ID NO: 2453579 - RNA, 23 nt, Human
ggccuggccccucagggucccug

SEQ ID NO: 2453580 - RNA, 18 nt, Human
ggccuggccccucagggu

SEQ ID NO: 2453581 - RNA, 17 nt, Human
ggccuggccccucaggg

SEQ ID NO: 2453582 - RNA, 15 nt, Human
ggccuggccccucag

SEQ ID NO: 2453583 - RNA, 14 nt, Human
ggccuggccccuca

SEQ ID NO: 2453584 - RNA, 15 nt, Human
ggccugagccuggcc

SEQ ID NO: 2453585 - RNA, 16 nt, Human
ggccugagccuggcca

SEQ ID NO: 2453586 - RNA, 13 nt, Human
ggccuggccccuc

SEQ ID NO: 2453587 - RNA, 22 nt, Human
ggccugagauuucaucugcucu

SEQ ID NO: 2453588 - RNA, 20 nt, Human
ggccugagauuucaucugcu

SEQ ID NO: 2453589 - RNA, 19 nt, Human
ggccucugcacuccccugc

SEQ ID NO: 2453590 - RNA, 18 nt, Human
ggccucugcacuccccug

SEQ ID NO: 2453591 - RNA, 22 nt, Human
ggccucugcacuccccugcugg

SEQ ID NO: 2453592 - RNA, 16 nt, Human
ggccugacucucagca

SEQ ID NO: 2453593 - RNA, 23 nt, Human
ggccugaaugcuuauagguggcc

SEQ ID NO: 2453594 - RNA, 23 nt, Human
ggccucugccccgucucaugagg

SEQ ID NO: 2453595 - RNA, 18 nt, Human
ggccugagcgcuccugcc

SEQ ID NO: 2453596 - RNA, 16 nt, Human
ggccuggccugagcug

SEQ ID NO: 2453597 - RNA, 15 nt, Human
ggccuggccugagcu

SEQ ID NO: 2453598 - RNA, 23 nt, Human
ggccugggggcugggcagaggaa

SEQ ID NO: 2453599 - RNA, 18 nt, Human
ggccugggguaccaagag

SEQ ID NO: 2453600 - RNA, 11 nt, Human
ggccugggccc

SEQ ID NO: 2453601 - RNA, 15 nt, Human
ggccugggccgcugc

SEQ ID NO: 2453602 - RNA, 14 nt, Human
ggccugggccagag

SEQ ID NO: 2453603 - RNA, 21 nt, Human
ggccuggccggcaaccccagu

SEQ ID NO: 2453604 - RNA, 14 nt, Human
ggccugggucugug

SEQ ID NO: 2453605 - RNA, 21 nt, Human
ggccugggugcuggcugccca

SEQ ID NO: 2453606 - RNA, 19 nt, Human
ggccugguguucuguggga

SEQ ID NO: 2453607 - RNA, 21 nt, Human
ggccugguccaugauggaguc

SEQ ID NO: 2453608 - RNA, 11 nt, Human
ggccuggguuu

SEQ ID NO: 2453609 - RNA, 19 nt, Human
ggccugggucugugucucu

SEQ ID NO: 2453610 - RNA, 17 nt, Human
ggcgcacccuccccucc

SEQ ID NO: 2453611 - RNA, 16 nt, Human
ggcgcacccuccccuc

SEQ ID NO: 2453612 - RNA, 12 nt, Human
ggcgcacuguga

SEQ ID NO: 2453613 - RNA, 18 nt, Human
ggcgcacccuccccuccc

SEQ ID NO: 2453614 - RNA, 24 nt, Human
ggcgcagcauauucaggaagcuca

SEQ ID NO: 2453615 - RNA, 23 nt, Human
ggcgcagcauauucaggaagcuc

SEQ ID NO: 2453616 - RNA, 12 nt, Human
ggcgcccaccuc

SEQ ID NO: 2453617 - RNA, 15 nt, Human
ggcgccaccauccug

SEQ ID NO: 2453618 - RNA, 17 nt, Human
ggcgcagugccucuggu

SEQ ID NO: 2453619 - RNA, 16 nt, Human
ggcgcagugccucugg

SEQ ID NO: 2453620 - RNA, 17 nt, Human
ggcgcagccaaggccga

SEQ ID NO: 2453621 - RNA, 11 nt, Human
ggcgcaggagg

SEQ ID NO: 2453622 - RNA, 15 nt, Human
ggcgcagccaaggcc

SEQ ID NO: 2453623 - RNA, 14 nt, Human
ggcgcagccaaggc

SEQ ID NO: 2453624 - RNA, 22 nt, Human
ggcgcacuuuccuccuggcaga

SEQ ID NO: 2453625 - RNA, 14 nt, Human
ggcuccagaaaugu

SEQ ID NO: 2453626 - RNA, 15 nt, Human
ggcucccauucacuc

SEQ ID NO: 2453627 - RNA, 18 nt, Human
ggcucccauucacucuuc

SEQ ID NO: 2453628 - RNA, 19 nt, Human
ggcucccaugaccauacug

SEQ ID NO: 2453629 - RNA, 16 nt, Human
ggcuccagagggcacu

SEQ ID NO: 2453630 - RNA, 14 nt, Human
ggcuccaggcuccu

SEQ ID NO: 2453631 - RNA, 16 nt, Human
ggcucucaggccagcu

SEQ ID NO: 2453632 - RNA, 15 nt, Human
ggcucucaggccagc

SEQ ID NO: 2453633 - RNA, 22 nt, Human
ggcucccauucacucuuccaga

SEQ ID NO: 2453634 - RNA, 12 nt, Human
ggcuccccucua

SEQ ID NO: 2453635 - RNA, 21 nt, Human
ggcuccccauguguccugguu

SEQ ID NO: 2453636 - RNA, 17 nt, Human
ggcuccccauguguccu

SEQ ID NO: 2453637 - RNA, 22 nt, Human
ggcuccccauguguccugguuc

SEQ ID NO: 2453638 - RNA, 11 nt, Human
ggcuccccucu

SEQ ID NO: 2453639 - RNA, 20 nt, Human
ggcucucaggccagcugcuu

SEQ ID NO: 2453640 - RNA, 19 nt, Human
ggcucucaggccagcugcu

SEQ ID NO: 2453641 - RNA, 18 nt, Human
ggcucucaggccagcugc

SEQ ID NO: 2453642 - RNA, 17 nt, Human
ggcucucaggccagcug

SEQ ID NO: 2453643 - RNA, 18 nt, Human
ggcucuccaagugccaga

SEQ ID NO: 2453644 - RNA, 17 nt, Human
ggcucuccaagugccag

SEQ ID NO: 2453645 - RNA, 12 nt, Human
ggcucuccaagu

SEQ ID NO: 2453646 - RNA, 23 nt, Human
ggcucucauguuuucaacugcca

SEQ ID NO: 2453647 - RNA, 20 nt, Human
ggcucuccaagugccagagg

SEQ ID NO: 2453648 - RNA, 19 nt, Human
ggcucuccaagugccagag

SEQ ID NO: 2453649 - RNA, 23 nt, Human
ggcucuccaagugccagaggugg

SEQ ID NO: 2453650 - RNA, 12 nt, Human
ggcucuccaccu

SEQ ID NO: 2453651 - RNA, 13 nt, Human
ggcucuccaccuc

SEQ ID NO: 2453652 - RNA, 14 nt, Human
ggcucuccaccuca

SEQ ID NO: 2453653 - RNA, 15 nt, Human
ggcucuccaccucag

SEQ ID NO: 2453654 - RNA, 16 nt, Human
ggcucuccaccucagc

SEQ ID NO: 2453655 - RNA, 13 nt, Human
ggcucucuccagg

SEQ ID NO: 2453656 - RNA, 12 nt, Human
ggcucucuccag

SEQ ID NO: 2453657 - RNA, 22 nt, Human
ggcucucuauagcaccagggcu

SEQ ID NO: 2453658 - RNA, 17 nt, Human
ggcucuccaccucagcc

SEQ ID NO: 2453659 - RNA, 18 nt, Human
ggcucuccaccucagccu

SEQ ID NO: 2453660 - RNA, 19 nt, Human
ggcucuccaccucagccuu

SEQ ID NO: 2453661 - RNA, 20 nt, Human
ggcucuccaccucagccuug

SEQ ID NO: 2453662 - RNA, 20 nt, Human
ggcucuccucagaagaaaga

SEQ ID NO: 2453663 - RNA, 13 nt, Human
ggcucuccaguua

SEQ ID NO: 2453664 - RNA, 21 nt, Human
ggcucuccaccucagccuugg

SEQ ID NO: 2453665 - RNA, 22 nt, Human
ggcucuccaccucagccuugga

SEQ ID NO: 2453666 - RNA, 15 nt, Human
ggcucugccucccau

SEQ ID NO: 2453667 - RNA, 13 nt, Human
ggcucugccuccc

SEQ ID NO: 2453668 - RNA, 15 nt, Human
ggcucugcccuuggu

SEQ ID NO: 2453669 - RNA, 14 nt, Human
ggcucugcccuugg

SEQ ID NO: 2453670 - RNA, 16 nt, Human
ggcucugccucccauc

SEQ ID NO: 2453671 - RNA, 16 nt, Human
ggcucuggagcccacu

SEQ ID NO: 2453672 - RNA, 19 nt, Human
ggcucuggagcccacugua

SEQ ID NO: 2453673 - RNA, 17 nt, Human
ggcucuggagcccacug

SEQ ID NO: 2453674 - RNA, 20 nt, Human
ggcucugcaaugggcacugg

SEQ ID NO: 2453675 - RNA, 23 nt, Human
ggcucugaggugccugucccacc

SEQ ID NO: 2453676 - RNA, 20 nt, Human
ggcucugaggugccuguccc

SEQ ID NO: 2453677 - RNA, 19 nt, Human
ggcucugaggugccugucc

SEQ ID NO: 2453678 - RNA, 17 nt, Human
ggcucugaggugccugu

SEQ ID NO: 2453679 - RNA, 15 nt, Human
ggcucugagcgccuc

SEQ ID NO: 2453680 - RNA, 14 nt, Human
ggcucugagcgccu

SEQ ID NO: 2453681 - RNA, 14 nt, Human
ggcucucuccagga

SEQ ID NO: 2453682 - RNA, 17 nt, Human
ggcucucuuuccuucuu

SEQ ID NO: 2453683 - RNA, 23 nt, Human
ggcucucuuuccuucuugccuuc

SEQ ID NO: 2453684 - RNA, 18 nt, Human
ggcucucuuuccuucuug

SEQ ID NO: 2453685 - RNA, 14 nt, Human
ggcucugaaagcca

SEQ ID NO: 2453686 - RNA, 13 nt, Human
ggcucugaccagu

SEQ ID NO: 2453687 - RNA, 12 nt, Human
ggcucugcccuu

SEQ ID NO: 2453688 - RNA, 21 nt, Human
ggcucugccccagaggccucu

SEQ ID NO: 2453689 - RNA, 18 nt, Human
ggcucugccccagaggcc

SEQ ID NO: 2453690 - RNA, 14 nt, Human
ggcucugccccagc

SEQ ID NO: 2453691 - RNA, 20 nt, Human
ggcucugccccagcucuggc

SEQ ID NO: 2453692 - RNA, 21 nt, Human
ggcucugccccagcucuggcu

SEQ ID NO: 2453693 - RNA, 20 nt, Human
ggcucugcaauuccccucug

SEQ ID NO: 2453694 - RNA, 19 nt, Human
ggcucugcaauuccccucu

SEQ ID NO: 2453695 - RNA, 14 nt, Human
ggcucugccacccu

SEQ ID NO: 2453696 - RNA, 12 nt, Human
ggcucugcacag

SEQ ID NO: 2453697 - RNA, 19 nt, Human
ggcucugccacccuaccug

SEQ ID NO: 2453698 - RNA, 17 nt, Human
ggcucugccccagaggc

SEQ ID NO: 2453699 - RNA, 16 nt, Human
ggcucugccccagagg

SEQ ID NO: 2453700 - RNA, 12 nt, Human
ggcucugcccca

SEQ ID NO: 2453701 - RNA, 16 nt, Human
ggcuccacuuggucug

SEQ ID NO: 2453702 - RNA, 9 nt, Human
ggcuccaga

SEQ ID NO: 2453703 - RNA, 17 nt, Human
ggcucacccccuucucc

SEQ ID NO: 2453704 - RNA, 22 nt, Human
ggcucacccccuucuccaucca

SEQ ID NO: 2453705 - RNA, 20 nt, Human
ggcucacgccuaugauccca

SEQ ID NO: 2453706 - RNA, 18 nt, Human
ggcucacgccuguaaucc

SEQ ID NO: 2453707 - RNA, 17 nt, Human
ggcucacgccuguaauc

SEQ ID NO: 2453708 - RNA, 21 nt, Human
ggcucacgccuaugaucccag

SEQ ID NO: 2453709 - RNA, 23 nt, Human
ggcucacgccuaugaucccagca

SEQ ID NO: 2453710 - RNA, 12 nt, Human
ggcuaugcauuu

SEQ ID NO: 2453711 - RNA, 13 nt, Human
ggcuaugcauuug

SEQ ID NO: 2453712 - RNA, 14 nt, Human
ggcucacacugaga

SEQ ID NO: 2453713 - RNA, 15 nt, Human
ggcucacacugagaa

SEQ ID NO: 2453714 - RNA, 14 nt, Human
ggcuaugcauuuga

SEQ ID NO: 2453715 - RNA, 18 nt, Human
ggcucacacugagaaugu

SEQ ID NO: 2453716 - RNA, 17 nt, Human
ggcucacacugagaaug

SEQ ID NO: 2453717 - RNA, 19 nt, Human
ggcucacccaagcaaggcc

SEQ ID NO: 2453718 - RNA, 17 nt, Human
ggcuccaggagcagcca

SEQ ID NO: 2453719 - RNA, 18 nt, Human
ggcuccaggagcagccac

SEQ ID NO: 2453720 - RNA, 13 nt, Human
ggcuccaggcucc

SEQ ID NO: 2453721 - RNA, 12 nt, Human
ggcuccaggcuc

SEQ ID NO: 2453722 - RNA, 16 nt, Human
ggcuccaggagcagcc

SEQ ID NO: 2453723 - RNA, 14 nt, Human
ggcuccaggagcag

SEQ ID NO: 2453724 - RNA, 10 nt, Human
ggcuccagac

SEQ ID NO: 2453725 - RNA, 18 nt, Human
ggcucacuauggugccaa

SEQ ID NO: 2453726 - RNA, 17 nt, Human
ggcucacuauggugcca

SEQ ID NO: 2453727 - RNA, 13 nt, Human
ggcuccagagggc

SEQ ID NO: 2453728 - RNA, 23 nt, Human
ggcucacgccuguaaucccagca

SEQ ID NO: 2453729 - RNA, 22 nt, Human
ggcucacgccuguaaucccagc

SEQ ID NO: 2453730 - RNA, 24 nt, Human
ggcucacgccuguaaucccagcag

SEQ ID NO: 2453731 - RNA, 13 nt, Human
ggcucacgugugu

SEQ ID NO: 2453732 - RNA, 21 nt, Human
ggcgggaguggaguggaagaa

SEQ ID NO: 2453733 - RNA, 19 nt, Human
ggcgggacccaggcaccug

SEQ ID NO: 2453734 - RNA, 16 nt, Human
ggcgggaugggccacc

SEQ ID NO: 2453735 - RNA, 15 nt, Human
ggcgggcagcacagc

SEQ ID NO: 2453736 - RNA, 22 nt, Human
ggcgggcaccuauagucccagc

SEQ ID NO: 2453737 - RNA, 14 nt, Human
ggcgggccccucau

SEQ ID NO: 2453738 - RNA, 17 nt, Human
ggcgggccagccaggcg

SEQ ID NO: 2453739 - RNA, 15 nt, Human
ggcgggccagccagg

SEQ ID NO: 2453740 - RNA, 14 nt, Human
ggcgggccagccag

SEQ ID NO: 2453741 - RNA, 13 nt, Human
ggcgggccagcca

SEQ ID NO: 2453742 - RNA, 12 nt, Human
ggcgggccagcc

SEQ ID NO: 2453743 - RNA, 17 nt, Human
ggcgggccaaggacugc

SEQ ID NO: 2453744 - RNA, 13 nt, Human
ggcuagguacaca

SEQ ID NO: 2453745 - RNA, 12 nt, Human
ggcggguggggg

SEQ ID NO: 2453746 - RNA, 14 nt, Human
ggcgggcggucagg

SEQ ID NO: 2453747 - RNA, 20 nt, Human
ggcuaguaucaaaagaaaga

SEQ ID NO: 2453748 - RNA, 16 nt, Human
ggcgggugggggugga

SEQ ID NO: 2453749 - RNA, 16 nt, Human
ggcuagucaagcuccu

SEQ ID NO: 2453750 - RNA, 17 nt, Human
ggcuagucaagcuccuc

SEQ ID NO: 2453751 - RNA, 19 nt, Human
ggcuagucaagcuccuccu

SEQ ID NO: 2453752 - RNA, 22 nt, Human
ggcuagucaagcuccuccuccc

SEQ ID NO: 2453753 - RNA, 23 nt, Human
ggcuagucaagcuccuccucccu

SEQ ID NO: 2453754 - RNA, 13 nt, Human
ggcuagucagaga

SEQ ID NO: 2453755 - RNA, 23 nt, Human
ggcuauaggugcuacaaaaacac

SEQ ID NO: 2453756 - RNA, 23 nt, Human
ggcuagugacuugugucccauga

SEQ ID NO: 2453757 - RNA, 18 nt, Human
ggcuagucagagagagug

SEQ ID NO: 2453758 - RNA, 20 nt, Human
ggcuauagcuacaggaagca

SEQ ID NO: 2453759 - RNA, 20 nt, Human
ggcuagugacuuguguccca

SEQ ID NO: 2453760 - RNA, 14 nt, Human
ggcuagucagagag

SEQ ID NO: 2453761 - RNA, 15 nt, Human
ggcuagucagagaga

SEQ ID NO: 2453762 - RNA, 15 nt, Human
ggcgcgguggcucac

SEQ ID NO: 2453763 - RNA, 14 nt, Human
ggcgcccuggaagc

SEQ ID NO: 2453764 - RNA, 12 nt, Human
ggcgcccuggaa

SEQ ID NO: 2453765 - RNA, 17 nt, Human
ggcgcccucuguccuga

SEQ ID NO: 2453766 - RNA, 16 nt, Human
ggcgcccucuguccug

SEQ ID NO: 2453767 - RNA, 16 nt, Human
ggcgcccuggaagccg

SEQ ID NO: 2453768 - RNA, 19 nt, Human
ggcgcgguggcucacgccu

SEQ ID NO: 2453769 - RNA, 14 nt, Human
ggcgcccucugucc

SEQ ID NO: 2453770 - RNA, 13 nt, Human
ggcgcccucuguc

SEQ ID NO: 2453771 - RNA, 11 nt, Human
ggcgcccucug

SEQ ID NO: 2453772 - RNA, 22 nt, Human
ggcgccccugccaccucccuga

SEQ ID NO: 2453773 - RNA, 15 nt, Human
ggcgccccugccacc

SEQ ID NO: 2453774 - RNA, 13 nt, Human
ggcgccccugcca

SEQ ID NO: 2453775 - RNA, 24 nt, Human
ggcgcccaccuccccacgcccucc

SEQ ID NO: 2453776 - RNA, 15 nt, Human
ggcgcccaccucccc

SEQ ID NO: 2453777 - RNA, 14 nt, Human
ggcgcccaccuccc

SEQ ID NO: 2453778 - RNA, 13 nt, Human
ggcgcccaccucc

SEQ ID NO: 2453779 - RNA, 17 nt, Human
ggcgcugccccuggcag

SEQ ID NO: 2453780 - RNA, 16 nt, Human
ggcgggacccaggcac

SEQ ID NO: 2453781 - RNA, 16 nt, Human
ggcgggagcaucucuu

SEQ ID NO: 2453782 - RNA, 11 nt, Human
ggcgcugcccc

SEQ ID NO: 2453783 - RNA, 22 nt, Human
ggcuggggccuaucagugugcc

SEQ ID NO: 2453784 - RNA, 21 nt, Human
ggcuggggccuaucagugugc

SEQ ID NO: 2453785 - RNA, 16 nt, Human
ggcuggggcugaccuu

SEQ ID NO: 2453786 - RNA, 14 nt, Human
ggcugggggcagga

SEQ ID NO: 2453787 - RNA, 14 nt, Human
ggcugggggccuca

SEQ ID NO: 2453788 - RNA, 21 nt, Human
ggcuggggaaguccucugggu

SEQ ID NO: 2453789 - RNA, 18 nt, Human
ggcuggggaaguccucug

SEQ ID NO: 2453790 - RNA, 20 nt, Human
ggcuggggccuaucagugug

SEQ ID NO: 2453791 - RNA, 16 nt, Human
ggcugggggaagaagc

SEQ ID NO: 2453792 - RNA, 17 nt, Human
ggcuggggaaguccucu

SEQ ID NO: 2453793 - RNA, 18 nt, Human
ggcugggcuucaguggca

SEQ ID NO: 2453794 - RNA, 22 nt, Human
ggcugggcuucaguggcagcug

SEQ ID NO: 2453795 - RNA, 21 nt, Human
ggcugggcuucaguggcagcu

SEQ ID NO: 2453796 - RNA, 11 nt, Human
ggcugggcuuc

SEQ ID NO: 2453797 - RNA, 21 nt, Human
ggcugggcucccuucccaccu

SEQ ID NO: 2453798 - RNA, 20 nt, Human
ggcugggcucccuucccacc

SEQ ID NO: 2453799 - RNA, 17 nt, Human
ggcugggcaaggaggcc

SEQ ID NO: 2453800 - RNA, 16 nt, Human
ggcugggaugggccug

SEQ ID NO: 2453801 - RNA, 15 nt, Human
ggcugggaguggugg

SEQ ID NO: 2453802 - RNA, 14 nt, Human
ggcugggaguggug

SEQ ID NO: 2453803 - RNA, 23 nt, Human
ggcugggaguaguugucuuuccu

SEQ ID NO: 2453804 - RNA, 13 nt, Human
ggcugggaguggu

SEQ ID NO: 2453805 - RNA, 15 nt, Human
ggcugggagcucugc

SEQ ID NO: 2453806 - RNA, 20 nt, Human
ggcuggaguucaguggugug

SEQ ID NO: 2453807 - RNA, 19 nt, Human
ggcuggagugcaguggcgu

SEQ ID NO: 2453808 - RNA, 20 nt, Human
ggcuggagugcaguggugug

SEQ ID NO: 2453809 - RNA, 19 nt, Human
ggcuggaguggaguggcgu

SEQ ID NO: 2453810 - RNA, 23 nt, Human
ggcucuggagcccacuguacuug

SEQ ID NO: 2453811 - RNA, 23 nt, Human
ggcucugggauagcugacccagc

SEQ ID NO: 2453812 - RNA, 23 nt, Human
ggcucugccccagcucuggcuuc

SEQ ID NO: 2453813 - RNA, 13 nt, Human
ggcucugcccugc

SEQ ID NO: 2453814 - RNA, 17 nt, Human
ggcugaggaaaggccag

SEQ ID NO: 2453815 - RNA, 21 nt, Human
ggcugaggaagcacagcagca

SEQ ID NO: 2453816 - RNA, 22 nt, Human
ggcugaggaaaggccagcuggc

SEQ ID NO: 2453817 - RNA, 20 nt, Human
ggcugagcucucugugggcu

SEQ ID NO: 2453818 - RNA, 19 nt, Human
ggcugaggaggccuccauc

SEQ ID NO: 2453819 - RNA, 16 nt, Human
ggcugaggaggccucc

SEQ ID NO: 2453820 - RNA, 15 nt, Human
ggcugaggaggccuc

SEQ ID NO: 2453821 - RNA, 20 nt, Human
ggcugaggaggccuccaucu

SEQ ID NO: 2453822 - RNA, 21 nt, Human
ggcugaggauuucaagccugc

SEQ ID NO: 2453823 - RNA, 13 nt, Human
ggcugaggcagaa

SEQ ID NO: 2453824 - RNA, 14 nt, Human
ggcugaggcagaag

SEQ ID NO: 2453825 - RNA, 19 nt, Human
ggcugcuucaaggauccug

SEQ ID NO: 2453826 - RNA, 15 nt, Human
ggcugcuucaaggau

SEQ ID NO: 2453827 - RNA, 16 nt, Human
ggcugaggccuggacu

SEQ ID NO: 2453828 - RNA, 14 nt, Human
ggcugaggcuggca

SEQ ID NO: 2453829 - RNA, 17 nt, Human
ggcugaggcuggcacag

SEQ ID NO: 2453830 - RNA, 18 nt, Human
ggcugaggcuggcacagg

SEQ ID NO: 2453831 - RNA, 14 nt, Human
ggcugaggccugga

SEQ ID NO: 2453832 - RNA, 14 nt, Human
ggcugaggcaggag

SEQ ID NO: 2453833 - RNA, 17 nt, Human
ggcugaggcagaagaau

SEQ ID NO: 2453834 - RNA, 20 nt, Human
ggcugcuucaaggauccuga

SEQ ID NO: 2453835 - RNA, 15 nt, Human
ggcugagggagccug

SEQ ID NO: 2453836 - RNA, 21 nt, Human
ggcugcuucaaggauccugag

SEQ ID NO: 2453837 - RNA, 18 nt, Human
ggcuggacugaggccuga

SEQ ID NO: 2453838 - RNA, 17 nt, Human
ggcuggacugaggccug

SEQ ID NO: 2453839 - RNA, 13 nt, Human
ggcuggacuugga

SEQ ID NO: 2453840 - RNA, 16 nt, Human
ggcuggacugaggccu

SEQ ID NO: 2453841 - RNA, 14 nt, Human
ggcuggacugaggc

SEQ ID NO: 2453842 - RNA, 13 nt, Human
ggcuggacugagg

SEQ ID NO: 2453843 - RNA, 13 nt, Human
ggcuggagcuggc

SEQ ID NO: 2453844 - RNA, 18 nt, Human
ggcuggacuuggagguag

SEQ ID NO: 2453845 - RNA, 19 nt, Human
ggcuggagaccaugcagag

SEQ ID NO: 2453846 - RNA, 19 nt, Human
ggcuggagacgggugggcg

SEQ ID NO: 2453847 - RNA, 23 nt, Human
ggcuggagcccagggagcggaaa

SEQ ID NO: 2453848 - RNA, 13 nt, Human
ggcuggaggcagg

SEQ ID NO: 2453849 - RNA, 15 nt, Human
ggcuggaggcagggc

SEQ ID NO: 2453850 - RNA, 23 nt, Human
ggcuggaggcagggccuugccca

SEQ ID NO: 2453851 - RNA, 17 nt, Human
ggcuggaggcagggccu

SEQ ID NO: 2453852 - RNA, 19 nt, Human
ggcuggaggcagggccuug

SEQ ID NO: 2453853 - RNA, 16 nt, Human
ggcuggagugaggaaa

SEQ ID NO: 2453854 - RNA, 14 nt, Human
ggcuggagugagga

SEQ ID NO: 2453855 - RNA, 21 nt, Human
ggcugugggccucaaggacuu

SEQ ID NO: 2453856 - RNA, 15 nt, Human
ggcuguggucacagc

SEQ ID NO: 2453857 - RNA, 24 nt, Human
ggcugugguagggggugucucagg

SEQ ID NO: 2453858 - RNA, 10 nt, Human
ggcugugcua

SEQ ID NO: 2453859 - RNA, 18 nt, Human
ggcugugcagccuguccu

SEQ ID NO: 2453860 - RNA, 11 nt, Human
ggcugugagug

SEQ ID NO: 2453861 - RNA, 20 nt, Human
ggcugugcucccugguucug

SEQ ID NO: 2453862 - RNA, 19 nt, Human
ggcugugcgcugacaacca

SEQ ID NO: 2453863 - RNA, 18 nt, Human
ggcugucuucucaggcuc

SEQ ID NO: 2453864 - RNA, 19 nt, Human
ggcugucuucucaggcucu

SEQ ID NO: 2453865 - RNA, 22 nt, Human
ggcugucuucucaggcucugcc

SEQ ID NO: 2453866 - RNA, 13 nt, Human
ggcugugaggccc

SEQ ID NO: 2453867 - RNA, 23 nt, Human
ggcugucuucucaggcucugccc

SEQ ID NO: 2453868 - RNA, 16 nt, Human
ggcugugccucugccu

SEQ ID NO: 2453869 - RNA, 13 nt, Human
ggcugugccucug

SEQ ID NO: 2453870 - RNA, 22 nt, Human
ggcuguccuguacauuguggga

SEQ ID NO: 2453871 - RNA, 13 nt, Human
ggcuguccuguac

SEQ ID NO: 2453872 - RNA, 23 nt, Human
ggcuguccaguucccagaaggca

SEQ ID NO: 2453873 - RNA, 18 nt, Human
ggcugggggcaggagggc

SEQ ID NO: 2453874 - RNA, 16 nt, Human
ggcugggggcaggagg

SEQ ID NO: 2453875 - RNA, 17 nt, Human
ggcugggggcaggaggg

SEQ ID NO: 2453876 - RNA, 17 nt, Human
ggcuguuggcagugagu

SEQ ID NO: 2453877 - RNA, 15 nt, Human
ggcuguuggcaguga

SEQ ID NO: 2453878 - RNA, 23 nt, Human
ggcuguuggcacucacagaccug

SEQ ID NO: 2453879 - RNA, 17 nt, Human
ggcuguuggcacucaca

SEQ ID NO: 2453880 - RNA, 20 nt, Human
ggcuguuggcugggggccuc

SEQ ID NO: 2453881 - RNA, 16 nt, Human
ggcuguuggcuggggg

SEQ ID NO: 2453882 - RNA, 15 nt, Human
ggcuguuggcugggg

SEQ ID NO: 2453883 - RNA, 14 nt, Human
ggcuguuggcuggg

SEQ ID NO: 2453884 - RNA, 12 nt, Human
ggcuguuggcac

SEQ ID NO: 2453885 - RNA, 13 nt, Human
ggcuguugcaugg

SEQ ID NO: 2453886 - RNA, 14 nt, Human
ggcuguucuggaag

SEQ ID NO: 2453887 - RNA, 16 nt, Human
ggcugugucuaaacug

SEQ ID NO: 2453888 - RNA, 15 nt, Human
ggcugugucuaaacu

SEQ ID NO: 2453889 - RNA, 20 nt, Human
ggcuguguucuggugaggcc

SEQ ID NO: 2453890 - RNA, 14 nt, Human
ggcugugucuaaac

SEQ ID NO: 2453891 - RNA, 22 nt, Human
ggcugugggccucaaggacuug

SEQ ID NO: 2453892 - RNA, 14 nt, Human
ggcuuagucacuga

SEQ ID NO: 2453893 - RNA, 15 nt, Human
ggcuuagucacugag

SEQ ID NO: 2453894 - RNA, 21 nt, Human
ggcuuagacuucgacucagga

SEQ ID NO: 2453895 - RNA, 14 nt, Human
ggcuguuugaggau

SEQ ID NO: 2453896 - RNA, 20 nt, Human
ggcuucacggaagagccuug

SEQ ID NO: 2453897 - RNA, 16 nt, Human
ggcuugccacagcucu

SEQ ID NO: 2453898 - RNA, 13 nt, Human
ggcuugccugcag

SEQ ID NO: 2453899 - RNA, 22 nt, Human
ggcuucacuguauaaauaggag

SEQ ID NO: 2453900 - RNA, 21 nt, Human
ggcuucacuguauaaauagga

SEQ ID NO: 2453901 - RNA, 19 nt, Human
ggcuucacuguauaaauag

SEQ ID NO: 2453902 - RNA, 18 nt, Human
ggcuucacuguauaaaua

SEQ ID NO: 2453903 - RNA, 15 nt, Human
ggcuucacuguauaa

SEQ ID NO: 2453904 - RNA, 21 nt, Human
ggcuucacggaagagccuugc

SEQ ID NO: 2453905 - RNA, 12 nt, Human
ggcuucacagau

SEQ ID NO: 2453906 - RNA, 18 nt, Human
ggcuuagcuuugcucugc

SEQ ID NO: 2453907 - RNA, 17 nt, Human
ggcuuggggaccagagc

SEQ ID NO: 2453908 - RNA, 14 nt, Human
ggcuugggaccgcc

SEQ ID NO: 2453909 - RNA, 15 nt, Human
ggcuuggccugcugu

SEQ ID NO: 2453910 - RNA, 23 nt, Human
ggcuugggcuuccauuugugugu

SEQ ID NO: 2453911 - RNA, 18 nt, Human
ggcuuggggaccagagcu

SEQ ID NO: 2453912 - RNA, 13 nt, Human
ggcuuucuggaga

SEQ ID NO: 2453913 - RNA, 14 nt, Human
ggcuuucuggagag

SEQ ID NO: 2453914 - RNA, 15 nt, Human
ggcuugcugagaggg

SEQ ID NO: 2453915 - RNA, 14 nt, Human
ggcuugcaugccaa

SEQ ID NO: 2453916 - RNA, 16 nt, Human
ggcuuggccugcugug

SEQ ID NO: 2453917 - RNA, 14 nt, Human
ggcuuggccugcug

SEQ ID NO: 2453918 - RNA, 13 nt, Human
ggcuuggccugcu

SEQ ID NO: 2453919 - RNA, 12 nt, Human
ggcuuggccugc

SEQ ID NO: 2453920 - RNA, 13 nt, Human
ggcuugcugagag

SEQ ID NO: 2453921 - RNA, 11 nt, Human
ggcuugcugcc

SEQ ID NO: 2453922 - RNA, 15 nt, Human
ggcuugccugcaggc

SEQ ID NO: 2453923 - RNA, 14 nt, Human
ggcuugccugcagg

SEQ ID NO: 2453924 - RNA, 20 nt, Human
gggacucaauuucuccccag

SEQ ID NO: 2453925 - RNA, 14 nt, Human
gggacguggcucag

SEQ ID NO: 2453926 - RNA, 18 nt, Human
gggacguggcucagccag

SEQ ID NO: 2453927 - RNA, 21 nt, Human
gggacugaggggaggggagca

SEQ ID NO: 2453928 - RNA, 15 nt, Human
gggacugagaaauuu

SEQ ID NO: 2453929 - RNA, 23 nt, Human
gggacucaaugcacugacauugu

SEQ ID NO: 2453930 - RNA, 13 nt, Human
gggacugagccag

SEQ ID NO: 2453931 - RNA, 14 nt, Human
gggacugagccagu

SEQ ID NO: 2453932 - RNA, 19 nt, Human
gggacugagccagucccag

SEQ ID NO: 2453933 - RNA, 17 nt, Human
gggacugagccaguccc

SEQ ID NO: 2453934 - RNA, 19 nt, Human
gggagcccacuguccuggg

SEQ ID NO: 2453935 - RNA, 10 nt, Human
gggagcccac

SEQ ID NO: 2453936 - RNA, 20 nt, Human
gggagcccacuguccugggc

SEQ ID NO: 2453937 - RNA, 21 nt, Human
gggagcccacuguccugggcc

SEQ ID NO: 2453938 - RNA, 12 nt, Human
gggagccccagg

SEQ ID NO: 2453939 - RNA, 13 nt, Human
gggagccccaggg

SEQ ID NO: 2453940 - RNA, 21 nt, Human
gggagccccagggucuucccu

SEQ ID NO: 2453941 - RNA, 14 nt, Human
gggagccccagggu

SEQ ID NO: 2453942 - RNA, 16 nt, Human
gggagccccagggucu

SEQ ID NO: 2453943 - RNA, 19 nt, Human
gggacucaaugcacugaca

SEQ ID NO: 2453944 - RNA, 17 nt, Human
gggacucaaugcacuga

SEQ ID NO: 2453945 - RNA, 17 nt, Human
gggacggugcccaagcc

SEQ ID NO: 2453946 - RNA, 16 nt, Human
gggacgucccugccca

SEQ ID NO: 2453947 - RNA, 23 nt, Human
gggacguccugccaccuggggca

SEQ ID NO: 2453948 - RNA, 21 nt, Human
gggacggggggccccagucag

SEQ ID NO: 2453949 - RNA, 21 nt, Human
gggacgccugggggugccagg

SEQ ID NO: 2453950 - RNA, 22 nt, Human
gggacgccugggggugccagga

SEQ ID NO: 2453951 - RNA, 13 nt, Human
gggacccccgccc

SEQ ID NO: 2453952 - RNA, 19 nt, Human
gggacccccgcccccugcc

SEQ ID NO: 2453953 - RNA, 18 nt, Human
gggacccccgcccccugc

SEQ ID NO: 2453954 - RNA, 17 nt, Human
gggacccccgcccccug

SEQ ID NO: 2453955 - RNA, 14 nt, Human
gggacccccgcccc

SEQ ID NO: 2453956 - RNA, 15 nt, Human
gggaccuuuaguggu

SEQ ID NO: 2453957 - RNA, 21 nt, Human
gggaccugguacccuccuggc

SEQ ID NO: 2453958 - RNA, 19 nt, Human
gggaccugccaggcagggg

SEQ ID NO: 2453959 - RNA, 18 nt, Human
gggaccugccaggcaggg

SEQ ID NO: 2453960 - RNA, 18 nt, Human
gggaccugguacccuccu

SEQ ID NO: 2453961 - RNA, 17 nt, Human
gggaccugccaggcagg

SEQ ID NO: 2453962 - RNA, 24 nt, Human
gggacccccgcccccugcccuccc

SEQ ID NO: 2453963 - RNA, 21 nt, Human
gggacccccgcccccugcccu

SEQ ID NO: 2453964 - RNA, 22 nt, Human
gggacaccagccaggcucugug

SEQ ID NO: 2453965 - RNA, 20 nt, Human
gggacaccagccaggcucug

SEQ ID NO: 2453966 - RNA, 19 nt, Human
gggacaccagccaggcucu

SEQ ID NO: 2453967 - RNA, 18 nt, Human
gggacaccagccaggcuc

SEQ ID NO: 2453968 - RNA, 18 nt, Human
gggacccaggcaccugca

SEQ ID NO: 2453969 - RNA, 21 nt, Human
gggacccaauguaggagcugc

SEQ ID NO: 2453970 - RNA, 14 nt, Human
gggacaccagccag

SEQ ID NO: 2453971 - RNA, 23 nt, Human
gggacacauucaacccuggagag

SEQ ID NO: 2453972 - RNA, 19 nt, Human
gggacaaguggacucaggg

SEQ ID NO: 2453973 - RNA, 20 nt, Human
gggacaccaagccuuggcuc

SEQ ID NO: 2453974 - RNA, 14 nt, Human
gggacacccuguga

SEQ ID NO: 2453975 - RNA, 21 nt, Human
gggaauguuugccucugccuc

SEQ ID NO: 2453976 - RNA, 19 nt, Human
gggaauguuugccucugcc

SEQ ID NO: 2453977 - RNA, 14 nt, Human
gggaauugaggaca

SEQ ID NO: 2453978 - RNA, 22 nt, Human
gggacaaguggacucagggcag

SEQ ID NO: 2453979 - RNA, 22 nt, Human
gggaauguuugggcagaaggga

SEQ ID NO: 2453980 - RNA, 23 nt, Human
gggaauguuugggcagaagggag

SEQ ID NO: 2453981 - RNA, 19 nt, Human
gggaauacuagggagaagg

SEQ ID NO: 2453982 - RNA, 19 nt, Human
gggaauaaauaugccucuc

SEQ ID NO: 2453983 - RNA, 14 nt, Human
gggaauauuugaau

SEQ ID NO: 2453984 - RNA, 13 nt, Human
gggaauauuugaa

SEQ ID NO: 2453985 - RNA, 14 nt, Human
gggaauaaauaugc

SEQ ID NO: 2453986 - RNA, 17 nt, Human
gggaagugaggaagcca

SEQ ID NO: 2453987 - RNA, 23 nt, Human
gggaagugacuuagcagaugcug

SEQ ID NO: 2453988 - RNA, 21 nt, Human
gggaagugacaaggccccaga

SEQ ID NO: 2453989 - RNA, 12 nt, Human
gggaaucaagau

SEQ ID NO: 2453990 - RNA, 14 nt, Human
gggaaucagaacuc

SEQ ID NO: 2453991 - RNA, 18 nt, Human
gggaauauuugaaucuug

SEQ ID NO: 2453992 - RNA, 12 nt, Human
gggaauauuuua

SEQ ID NO: 2453993 - RNA, 23 nt, Human
gggaauagucuagauggcuccuc

SEQ ID NO: 2453994 - RNA, 22 nt, Human
gggaauccccgaaggugcugga

SEQ ID NO: 2453995 - RNA, 19 nt, Human
gggaauccccgaaggugcu

SEQ ID NO: 2453996 - RNA, 11 nt, Human
gggaauguuug

SEQ ID NO: 2453997 - RNA, 12 nt, Human
ggcuuuggauuu

SEQ ID NO: 2453998 - RNA, 13 nt, Human
ggcuuuggcuucu

SEQ ID NO: 2453999 - RNA, 14 nt, Human
ggcuuugccagcuu

SEQ ID NO: 2454000 - RNA, 20 nt, Human
ggcuuuuauuaaugcacuuu

SEQ ID NO: 2454001 - RNA, 23 nt, Human
gggaagugaagacuggaagcuaa

SEQ ID NO: 2454002 - RNA, 18 nt, Human
ggcuuuuacugaagccuu

SEQ ID NO: 2454003 - RNA, 19 nt, Human
ggcuuuuauuaaugcacuu

SEQ ID NO: 2454004 - RNA, 20 nt, Human
ggcuuuuacugaagccuuuc

SEQ ID NO: 2454005 - RNA, 17 nt, Human
gggaggacgcucucugg

SEQ ID NO: 2454006 - RNA, 20 nt, Human
gggaggacgcucucuggccu

SEQ ID NO: 2454007 - RNA, 17 nt, Human
gggaggagggagaggga

SEQ ID NO: 2454008 - RNA, 14 nt, Human
gggaggagggagag

SEQ ID NO: 2454009 - RNA, 13 nt, Human
gggaggagggaga

SEQ ID NO: 2454010 - RNA, 21 nt, Human
gggaggagaggggaagggcca

SEQ ID NO: 2454011 - RNA, 14 nt, Human
gggaggagaaugag

SEQ ID NO: 2454012 - RNA, 17 nt, Human
gggaggaggccaccucu

SEQ ID NO: 2454013 - RNA, 21 nt, Human
gggaggaccagggcagggcca

SEQ ID NO: 2454014 - RNA, 23 nt, Human
gggaggaagcagaauaaagcaau

SEQ ID NO: 2454015 - RNA, 22 nt, Human
gggaggauguucugggacacag

SEQ ID NO: 2454016 - RNA, 21 nt, Human
gggaggauugcuugagcucag

SEQ ID NO: 2454017 - RNA, 23 nt, Human
gggaggaucucuugagccuggga

SEQ ID NO: 2454018 - RNA, 20 nt, Human
gggaggagguggcagcccug

SEQ ID NO: 2454019 - RNA, 17 nt, Human
gggaggaucacuggagc

SEQ ID NO: 2454020 - RNA, 17 nt, Human
gggagugacagaggcag

SEQ ID NO: 2454021 - RNA, 18 nt, Human
gggagguugaucagaucu

SEQ ID NO: 2454022 - RNA, 16 nt, Human
gggaguaugcaaaagu

SEQ ID NO: 2454023 - RNA, 16 nt, Human
gggaguccccuccccg

SEQ ID NO: 2454024 - RNA, 21 nt, Human
gggaguaugcaaaaguucuga

SEQ ID NO: 2454025 - RNA, 21 nt, Human
gggagucaucucaaccauccc

SEQ ID NO: 2454026 - RNA, 21 nt, Human
gggagugaguugauagcacag

SEQ ID NO: 2454027 - RNA, 17 nt, Human
gggaguccccuuuucuu

SEQ ID NO: 2454028 - RNA, 15 nt, Human
gggagucccgucagg

SEQ ID NO: 2454029 - RNA, 17 nt, Human
gggagucugaagcagau

SEQ ID NO: 2454030 - RNA, 23 nt, Human
gggagucugaagcagaugcaaag

SEQ ID NO: 2454031 - RNA, 20 nt, Human
gggaggugggauccuccagg

SEQ ID NO: 2454032 - RNA, 22 nt, Human
gggagguguuuaaagagagguu

SEQ ID NO: 2454033 - RNA, 20 nt, Human
gggagguguuuaaagagagg

SEQ ID NO: 2454034 - RNA, 23 nt, Human
gggaggauugcuugagcucagga

SEQ ID NO: 2454035 - RNA, 19 nt, Human
gggaggaucacuggagccc

SEQ ID NO: 2454036 - RNA, 22 nt, Human
gggaggaucacuggagcccagg

SEQ ID NO: 2454037 - RNA, 18 nt, Human
gggaggcaagaggggugg

SEQ ID NO: 2454038 - RNA, 18 nt, Human
gggaggagggagagggag

SEQ ID NO: 2454039 - RNA, 23 nt, Human
gggaggaucacuggagcccagga

SEQ ID NO: 2454040 - RNA, 15 nt, Human
gggagcugcugcccu

SEQ ID NO: 2454041 - RNA, 19 nt, Human
gggagcugguuagaaaugc

SEQ ID NO: 2454042 - RNA, 16 nt, Human
gggaggaaaagaaaag

SEQ ID NO: 2454043 - RNA, 23 nt, Human
gggaggaagaagcuuaggcaggg

SEQ ID NO: 2454044 - RNA, 24 nt, Human
gggaggaaauuugaauggguccau

SEQ ID NO: 2454045 - RNA, 21 nt, Human
gggaggaagcagaauaaagca

SEQ ID NO: 2454046 - RNA, 20 nt, Human
gggaggaagcagaauaaagc

SEQ ID NO: 2454047 - RNA, 18 nt, Human
gggaggaagcagaauaaa

SEQ ID NO: 2454048 - RNA, 16 nt, Human
gggaggaagcagaaua

SEQ ID NO: 2454049 - RNA, 15 nt, Human
gggaggaagcagaau

SEQ ID NO: 2454050 - RNA, 14 nt, Human
gggaggaagcagaa

SEQ ID NO: 2454051 - RNA, 13 nt, Human
gggaggaagcaga

SEQ ID NO: 2454052 - RNA, 12 nt, Human
gggaggaagcag

SEQ ID NO: 2454053 - RNA, 23 nt, Human
gggaggaagcagguugaggggcu

SEQ ID NO: 2454054 - RNA, 19 nt, Human
gggaggaaucgaggaacca

SEQ ID NO: 2454055 - RNA, 22 nt, Human
gggagcugccuguucagcucca

SEQ ID NO: 2454056 - RNA, 21 nt, Human
gggagcugccuguucagcucc

SEQ ID NO: 2454057 - RNA, 13 nt, Human
gggagcugccugu

SEQ ID NO: 2454058 - RNA, 21 nt, Human
gggagcuccucuccuggagga

SEQ ID NO: 2454059 - RNA, 20 nt, Human
gggagcuccucuccuggagg

SEQ ID NO: 2454060 - RNA, 22 nt, Human
gggagcuccucuccuggaggau

SEQ ID NO: 2454061 - RNA, 12 nt, Human
gggagcugaggc

SEQ ID NO: 2454062 - RNA, 22 nt, Human
gggagccuuugguucuggccag

SEQ ID NO: 2454063 - RNA, 17 nt, Human
gggagcgugggaggcgg

SEQ ID NO: 2454064 - RNA, 18 nt, Human
gggagcuccucuccugga

SEQ ID NO: 2454065 - RNA, 23 nt, Human
gggagcuccacucugcuucucug

SEQ ID NO: 2454066 - RNA, 12 nt, Human
gggagcucugca

SEQ ID NO: 2454067 - RNA, 19 nt, Human
gggagcuccacucugcuuc

SEQ ID NO: 2454068 - RNA, 16 nt, Human
gggagccgcuggcaga

SEQ ID NO: 2454069 - RNA, 23 nt, Human
gggagcccucaggcaccugcacu

SEQ ID NO: 2454070 - RNA, 19 nt, Human
gggagccccuucugcucag

SEQ ID NO: 2454071 - RNA, 16 nt, Human
gggagcccccgccccg

SEQ ID NO: 2454072 - RNA, 22 nt, Human
gggagcccccgccccgccccac

SEQ ID NO: 2454073 - RNA, 12 nt, Human
gggagcccccgc

SEQ ID NO: 2454074 - RNA, 21 nt, Human
gggagccuccugcccaguccc

SEQ ID NO: 2454075 - RNA, 21 nt, Human
gggagccuuugguucuggcca

SEQ ID NO: 2454076 - RNA, 21 nt, Human
gggagccugaucaccugcccu

SEQ ID NO: 2454077 - RNA, 17 nt, Human
gggagccuccugcccag

SEQ ID NO: 2454078 - RNA, 14 nt, Human
gggagccuccugcc

SEQ ID NO: 2454079 - RNA, 13 nt, Human
gggagccuccugc

SEQ ID NO: 2454080 - RNA, 12 nt, Human
gggagccuccug

SEQ ID NO: 2454081 - RNA, 11 nt, Human
gggagccuccu

SEQ ID NO: 2454082 - RNA, 21 nt, Human
ucagccucccaaagugcuggg

SEQ ID NO: 2454083 - RNA, 19 nt, Human
ucagccucccaaagugcug

SEQ ID NO: 2454084 - RNA, 23 nt, Human
ucagcauucucacuccuaccugg

SEQ ID NO: 2454085 - RNA, 14 nt, Human
ucagccucccaaag

SEQ ID NO: 2454086 - RNA, 22 nt, Human
ucagccucccgaauagcuggga

SEQ ID NO: 2454087 - RNA, 21 nt, Human
ucagccucccgaauagcuggg

SEQ ID NO: 2454088 - RNA, 18 nt, Human
ucagccucccgaguagcu

SEQ ID NO: 2454089 - RNA, 20 nt, Human
ucagccucccgaguagcugg

SEQ ID NO: 2454090 - RNA, 16 nt, Human
ucagcaugucuauuca

SEQ ID NO: 2454091 - RNA, 19 nt, Human
ucagcaugucuauucagcu

SEQ ID NO: 2454092 - RNA, 21 nt, Human
ucagcaugucuauucagcuuc

SEQ ID NO: 2454093 - RNA, 20 nt, Human
ucagcauucucacuccuacc

SEQ ID NO: 2454094 - RNA, 17 nt, Human
ucagcauucucacuccu

SEQ ID NO: 2454095 - RNA, 12 nt, Human
ucagcaugucua

SEQ ID NO: 2454096 - RNA, 23 nt, Human
ucagaggugaaagcuauaucaau

SEQ ID NO: 2454097 - RNA, 18 nt, Human
ucagagguagggcugcca

SEQ ID NO: 2454098 - RNA, 17 nt, Human
ucagauauaaaagacug

SEQ ID NO: 2454099 - RNA, 14 nt, Human
ucagauauaaaaga

SEQ ID NO: 2454100 - RNA, 18 nt, Human
ucagauauauuuuucaca

SEQ ID NO: 2454101 - RNA, 23 nt, Human
ucagauauauuuuucacaguuuu

SEQ ID NO: 2454102 - RNA, 15 nt, Human
ucagaguauggagcu

SEQ ID NO: 2454103 - RNA, 18 nt, Human
ucagauauauaucauauu

SEQ ID NO: 2454104 - RNA, 16 nt, Human
ucagauauauuuuuca

SEQ ID NO: 2454105 - RNA, 20 nt, Human
ucagauauaaaagacugacc

SEQ ID NO: 2454106 - RNA, 18 nt, Human
ucagauauaaaagacuga

SEQ ID NO: 2454107 - RNA, 20 nt, Human
ucagcucccccuguccccuc

SEQ ID NO: 2454108 - RNA, 18 nt, Human
ucagcucccccugucccc

SEQ ID NO: 2454109 - RNA, 15 nt, Human
ucagcucccccuguc

SEQ ID NO: 2454110 - RNA, 13 nt, Human
ucagcucccccug

SEQ ID NO: 2454111 - RNA, 19 nt, Human
ucagcucuuggcuccacug

SEQ ID NO: 2454112 - RNA, 18 nt, Human
ucagcuccccucggagaa

SEQ ID NO: 2454113 - RNA, 15 nt, Human
ucagcugaaccuggg

SEQ ID NO: 2454114 - RNA, 16 nt, Human
ucagcugaaccugggu

SEQ ID NO: 2454115 - RNA, 17 nt, Human
ucagcuccccagagucc

SEQ ID NO: 2454116 - RNA, 15 nt, Human
ucagcuccccagagu

SEQ ID NO: 2454117 - RNA, 13 nt, Human
ucagcuccccaga

SEQ ID NO: 2454118 - RNA, 20 nt, Human
ucagcucccauuucuacucu

SEQ ID NO: 2454119 - RNA, 19 nt, Human
ucagcucccauuucuacuc

SEQ ID NO: 2454120 - RNA, 16 nt, Human
ucagcucccauuucua

SEQ ID NO: 2454121 - RNA, 15 nt, Human
ucagcucccauuucu

SEQ ID NO: 2454122 - RNA, 17 nt, Human
ucagcuccccucggaga

SEQ ID NO: 2454123 - RNA, 15 nt, Human
ucagccuggccagac

SEQ ID NO: 2454124 - RNA, 16 nt, Human
ucagccuggccagaca

SEQ ID NO: 2454125 - RNA, 17 nt, Human
ucagccuggccagacac

SEQ ID NO: 2454126 - RNA, 18 nt, Human
ucagccuggccagacaca

SEQ ID NO: 2454127 - RNA, 12 nt, Human
ucagccuggcca

SEQ ID NO: 2454128 - RNA, 14 nt, Human
ucagccuggccaga

SEQ ID NO: 2454129 - RNA, 20 nt, Human
ucagccuccuguguagcugg

SEQ ID NO: 2454130 - RNA, 18 nt, Human
ucagccugcuccagcugu

SEQ ID NO: 2454131 - RNA, 19 nt, Human
ucagccugcuccagcuguu

SEQ ID NO: 2454132 - RNA, 22 nt, Human
ucagccuccugaguagcuggga

SEQ ID NO: 2454133 - RNA, 19 nt, Human
ucagccuccucaucugggg

SEQ ID NO: 2454134 - RNA, 13 nt, Human
ucagccuccugug

SEQ ID NO: 2454135 - RNA, 14 nt, Human
ucagccuccugugu

SEQ ID NO: 2454136 - RNA, 16 nt, Human
ucagccuccuguguag

SEQ ID NO: 2454137 - RNA, 21 nt, Human
ucagccuccugaguagcugga

SEQ ID NO: 2454138 - RNA, 13 nt, Human
ucagccuccugag

SEQ ID NO: 2454139 - RNA, 22 nt, Human
ucagccucccgaguagcuggga

SEQ ID NO: 2454140 - RNA, 21 nt, Human
ucagccucccgaguagcuggg

SEQ ID NO: 2454141 - RNA, 13 nt, Human
ucagccuccucau

SEQ ID NO: 2454142 - RNA, 21 nt, Human
ucagccucccgaguagcugag

SEQ ID NO: 2454143 - RNA, 20 nt, Human
ucagccuccggaguagcugg

SEQ ID NO: 2454144 - RNA, 20 nt, Human
ucagccuccugaguagcugg

SEQ ID NO: 2454145 - RNA, 17 nt, Human
ucaggcuagauguaugu

SEQ ID NO: 2454146 - RNA, 13 nt, Human
ucaggcuagaugu

SEQ ID NO: 2454147 - RNA, 18 nt, Human
ucaggcaaggucuggccu

SEQ ID NO: 2454148 - RNA, 17 nt, Human
ucaggcaaggucuggcc

SEQ ID NO: 2454149 - RNA, 15 nt, Human
ucaggcuccauuagg

SEQ ID NO: 2454150 - RNA, 11 nt, Human
ucaggcuccau

SEQ ID NO: 2454151 - RNA, 22 nt, Human
ucaggcacuagccuuuggcucu

SEQ ID NO: 2454152 - RNA, 21 nt, Human
ucaggcacuagccuuuggcuc

SEQ ID NO: 2454153 - RNA, 16 nt, Human
ucaggcacuagccuuu

SEQ ID NO: 2454154 - RNA, 15 nt, Human
ucaggcacuagccuu

SEQ ID NO: 2454155 - RNA, 20 nt, Human
ucaggcuccauuaggauuug

SEQ ID NO: 2454156 - RNA, 16 nt, Human
ucaggcuccauuagga

SEQ ID NO: 2454157 - RNA, 13 nt, Human
ucaggcucugccc

SEQ ID NO: 2454158 - RNA, 15 nt, Human
ucaggcucugccuca

SEQ ID NO: 2454159 - RNA, 21 nt, Human
ucaggcugcuggcgccucugc

SEQ ID NO: 2454160 - RNA, 14 nt, Human
ucaggcucugcccu

SEQ ID NO: 2454161 - RNA, 19 nt, Human
ucaggcucugcccugcccu

SEQ ID NO: 2454162 - RNA, 14 nt, Human
ucaggcugguggga

SEQ ID NO: 2454163 - RNA, 22 nt, Human
ucaggcugcuggcgccucugca

SEQ ID NO: 2454164 - RNA, 15 nt, Human
ucaggcugcuuggga

SEQ ID NO: 2454165 - RNA, 17 nt, Human
ucaggcuggugggaggg

SEQ ID NO: 2454166 - RNA, 16 nt, Human
ucaggcuggugggagg

SEQ ID NO: 2454167 - RNA, 14 nt, Human
ucaggcuuccuugg

SEQ ID NO: 2454168 - RNA, 15 nt, Human
ucaggcuuccuuggc

SEQ ID NO: 2454169 - RNA, 23 nt, Human
ucaggcuuccuuggcaucacagg

SEQ ID NO: 2454170 - RNA, 18 nt, Human
ucaggagcccugggaggc

SEQ ID NO: 2454171 - RNA, 19 nt, Human
ucaggagcccugggaggcu

SEQ ID NO: 2454172 - RNA, 23 nt, Human
ucagcucccccuguccccucagc

SEQ ID NO: 2454173 - RNA, 22 nt, Human
ucagcucccccuguccccucag

SEQ ID NO: 2454174 - RNA, 16 nt, Human
ucagcugccccacagg

SEQ ID NO: 2454175 - RNA, 23 nt, Human
ucaggagcccugggaggcucugg

SEQ ID NO: 2454176 - RNA, 20 nt, Human
ucaggagcccugggaggcuc

SEQ ID NO: 2454177 - RNA, 20 nt, Human
ucaggaugauacacuaugaa

SEQ ID NO: 2454178 - RNA, 22 nt, Human
ucaggaugcccagggccacucu

SEQ ID NO: 2454179 - RNA, 17 nt, Human
ucaggauucuguuccuu

SEQ ID NO: 2454180 - RNA, 13 nt, Human
ucaggaugcccag

SEQ ID NO: 2454181 - RNA, 14 nt, Human
ucaggaugcccagg

SEQ ID NO: 2454182 - RNA, 15 nt, Human
ucaggaugcccaggg

SEQ ID NO: 2454183 - RNA, 16 nt, Human
ucaggaugcccagggc

SEQ ID NO: 2454184 - RNA, 19 nt, Human
ucagggcccaagucccugu

SEQ ID NO: 2454185 - RNA, 18 nt, Human
ucagggcccaagucccug

SEQ ID NO: 2454186 - RNA, 15 nt, Human
ucagggcccaagucc

SEQ ID NO: 2454187 - RNA, 14 nt, Human
ucagggcccaaguc

SEQ ID NO: 2454188 - RNA, 17 nt, Human
ucagggccaugccugcc

SEQ ID NO: 2454189 - RNA, 23 nt, Human
ucagggccaugcugaggccuggg

SEQ ID NO: 2454190 - RNA, 21 nt, Human
ucagggccaugcugaggccug

SEQ ID NO: 2454191 - RNA, 19 nt, Human
ucagggccaugcugaggcc

SEQ ID NO: 2454192 - RNA, 18 nt, Human
ucagggccaugcugaggc

SEQ ID NO: 2454193 - RNA, 16 nt, Human
ucagggccuggcucag

SEQ ID NO: 2454194 - RNA, 14 nt, Human
ucagggccuggcuc

SEQ ID NO: 2454195 - RNA, 15 nt, Human
ucaggugagaagcag

SEQ ID NO: 2454196 - RNA, 16 nt, Human
ucaggugagaagcaga

SEQ ID NO: 2454197 - RNA, 20 nt, Human
ucagggcuccugccuucugu

SEQ ID NO: 2454198 - RNA, 15 nt, Human
ucagggcuccugccu

SEQ ID NO: 2454199 - RNA, 14 nt, Human
ucagggcuccugcc

SEQ ID NO: 2454200 - RNA, 13 nt, Human
ucagggcuccugc

SEQ ID NO: 2454201 - RNA, 23 nt, Human
ucagggcuaaacgggcauugccu

SEQ ID NO: 2454202 - RNA, 23 nt, Human
ucagggcgcacagcaugagaggc

SEQ ID NO: 2454203 - RNA, 14 nt, Human
ucagggccccagca

SEQ ID NO: 2454204 - RNA, 16 nt, Human
ucagggccccagcacu

SEQ ID NO: 2454205 - RNA, 23 nt, Human
ucagggccccagcacuaaagcag

SEQ ID NO: 2454206 - RNA, 22 nt, Human
ucagggcacugcugcugccuuu

SEQ ID NO: 2454207 - RNA, 21 nt, Human
ucagggauggccguuggccac

SEQ ID NO: 2454208 - RNA, 15 nt, Human
ucagggaucuugcau

SEQ ID NO: 2454209 - RNA, 20 nt, Human
ucagggauuuuuuuuuuaaa

SEQ ID NO: 2454210 - RNA, 23 nt, Human
ucagggauagcacugagcaaagc

SEQ ID NO: 2454211 - RNA, 17 nt, Human
ucagggccaugcugagg

SEQ ID NO: 2454212 - RNA, 14 nt, Human
ucagggccaugcug

SEQ ID NO: 2454213 - RNA, 13 nt, Human
ucagggccaugcu

SEQ ID NO: 2454214 - RNA, 14 nt, Human
ucagggccaugccu

SEQ ID NO: 2454215 - RNA, 15 nt, Human
ucagggcagcgccag

SEQ ID NO: 2454216 - RNA, 19 nt, Human
ucagggcagcgccaggcug

SEQ ID NO: 2454217 - RNA, 16 nt, Human
ucagggcagggcucug

SEQ ID NO: 2454218 - RNA, 22 nt, Human
ucagggaaccguuauuauaauu

SEQ ID NO: 2454219 - RNA, 17 nt, Human
ucagggaccccugcccu

SEQ ID NO: 2454220 - RNA, 16 nt, Human
ucagggaaaggccagu

SEQ ID NO: 2454221 - RNA, 15 nt, Human
ucagggaggucauuu

SEQ ID NO: 2454222 - RNA, 21 nt, Human
ucagggagugggcuaagcacg

SEQ ID NO: 2454223 - RNA, 16 nt, Human
ucaggcuugaaaugca

SEQ ID NO: 2454224 - RNA, 20 nt, Human
ucaggcuuucacuauuuccu

SEQ ID NO: 2454225 - RNA, 21 nt, Human
ucaggcuuucacuauuuccuu

SEQ ID NO: 2454226 - RNA, 18 nt, Human
ucaggcuugaaaugcauu

SEQ ID NO: 2454227 - RNA, 16 nt, Human
ucagggaaaagcagcu

SEQ ID NO: 2454228 - RNA, 18 nt, Human
ucagggaaaagcagcucu

SEQ ID NO: 2454229 - RNA, 19 nt, Human
ucagggaaaagcagcucuc

SEQ ID NO: 2454230 - RNA, 23 nt, Human
ucagggaaaagcagcucuccccu

SEQ ID NO: 2454231 - RNA, 22 nt, Human
ucacugcugcaaggccuuucug

SEQ ID NO: 2454232 - RNA, 18 nt, Human
ucacugcugcaaggccuu

SEQ ID NO: 2454233 - RNA, 17 nt, Human
ucacugcugcaaggccu

SEQ ID NO: 2454234 - RNA, 12 nt, Human
ucacugcugcaa

SEQ ID NO: 2454235 - RNA, 12 nt, Human
ucacugcuggcu

SEQ ID NO: 2454236 - RNA, 24 nt, Human
ucacugcucccugaagccagccuu

SEQ ID NO: 2454237 - RNA, 23 nt, Human
ucacugcucccugaagccagccu

SEQ ID NO: 2454238 - RNA, 21 nt, Human
ucacugcucccugaagccagc

SEQ ID NO: 2454239 - RNA, 20 nt, Human
ucacugcucccugaagccag

SEQ ID NO: 2454240 - RNA, 19 nt, Human
ucacugcucccugaagcca

SEQ ID NO: 2454241 - RNA, 18 nt, Human
ucacugcucccugaagcc

SEQ ID NO: 2454242 - RNA, 14 nt, Human
ucacugcucccuga

SEQ ID NO: 2454243 - RNA, 16 nt, Human
ucacugcuggcugccu

SEQ ID NO: 2454244 - RNA, 15 nt, Human
ucacugcuggcugcc

SEQ ID NO: 2454245 - RNA, 14 nt, Human
ucacugcuggcugc

SEQ ID NO: 2454246 - RNA, 13 nt, Human
ucacugcuggcug

SEQ ID NO: 2454247 - RNA, 16 nt, Human
ucacugcugucaucaa

SEQ ID NO: 2454248 - RNA, 15 nt, Human
ucacugcugucauca

SEQ ID NO: 2454249 - RNA, 14 nt, Human
ucacugcuuaacuu

SEQ ID NO: 2454250 - RNA, 13 nt, Human
ucacugcugucau

SEQ ID NO: 2454251 - RNA, 12 nt, Human
ucacugcuguca

SEQ ID NO: 2454252 - RNA, 11 nt, Human
ucacugcuguc

SEQ ID NO: 2454253 - RNA, 10 nt, Human
ucacugcugu

SEQ ID NO: 2454254 - RNA, 22 nt, Human
ucacugcuggcugccuuagaac

SEQ ID NO: 2454255 - RNA, 18 nt, Human
ucacugcuggcugccuua

SEQ ID NO: 2454256 - RNA, 17 nt, Human
ucacugcuggcugccuu

SEQ ID NO: 2454257 - RNA, 14 nt, Human
ucacuggaacucag

SEQ ID NO: 2454258 - RNA, 23 nt, Human
ucacuggaaaggggagagccugc

SEQ ID NO: 2454259 - RNA, 21 nt, Human
ucacuggaaaggggagagccu

SEQ ID NO: 2454260 - RNA, 18 nt, Human
ucacuggaaaggggagag

SEQ ID NO: 2454261 - RNA, 17 nt, Human
ucacuggaaaggggaga

SEQ ID NO: 2454262 - RNA, 15 nt, Human
ucacuggaaagggga

SEQ ID NO: 2454263 - RNA, 18 nt, Human
ucacuggaccacugggca

SEQ ID NO: 2454264 - RNA, 17 nt, Human
ucacuggagcaccaggc

SEQ ID NO: 2454265 - RNA, 17 nt, Human
ucacuggggccuacagc

SEQ ID NO: 2454266 - RNA, 21 nt, Human
ucacuggcugccuccacuccc

SEQ ID NO: 2454267 - RNA, 14 nt, Human
ucacuggagcccag

SEQ ID NO: 2454268 - RNA, 15 nt, Human
ucacuggagcccagg

SEQ ID NO: 2454269 - RNA, 18 nt, Human
ucacuggagcaccaggca

SEQ ID NO: 2454270 - RNA, 22 nt, Human
ucacuggagcaccaggcacgaa

SEQ ID NO: 2454271 - RNA, 11 nt, Human
ucacuggagcc

SEQ ID NO: 2454272 - RNA, 12 nt, Human
ucacuggagccc

SEQ ID NO: 2454273 - RNA, 13 nt, Human
ucacuggagccca

SEQ ID NO: 2454274 - RNA, 21 nt, Human
ucacuugugccaacacucaag

SEQ ID NO: 2454275 - RNA, 12 nt, Human
ucacuugugggg

SEQ ID NO: 2454276 - RNA, 19 nt, Human
ucacuugugccaacacuca

SEQ ID NO: 2454277 - RNA, 20 nt, Human
ucacuguagaaugauuucau

SEQ ID NO: 2454278 - RNA, 17 nt, Human
ucacuugugcaguguug

SEQ ID NO: 2454279 - RNA, 18 nt, Human
ucacugguagaccaaaau

SEQ ID NO: 2454280 - RNA, 19 nt, Human
ucacugguagaccaaaaua

SEQ ID NO: 2454281 - RNA, 20 nt, Human
ucacugguagaccaaaauaa

SEQ ID NO: 2454282 - RNA, 23 nt, Human
ucacuguaagacucauucccuag

SEQ ID NO: 2454283 - RNA, 18 nt, Human
ucacuggguggggugagg

SEQ ID NO: 2454284 - RNA, 16 nt, Human
ucacugggguccuggg

SEQ ID NO: 2454285 - RNA, 17 nt, Human
ucacugggguccugggg

SEQ ID NO: 2454286 - RNA, 19 nt, Human
ucacugggguccuggggcc

SEQ ID NO: 2454287 - RNA, 20 nt, Human
ucacugggguccuggggccu

SEQ ID NO: 2454288 - RNA, 21 nt, Human
ucacugggguccuggggccuc

SEQ ID NO: 2454289 - RNA, 11 nt, Human
ucacugggugg

SEQ ID NO: 2454290 - RNA, 20 nt, Human
ucacuggguggggugaggac

SEQ ID NO: 2454291 - RNA, 17 nt, Human
ucacucuuauugcccac

SEQ ID NO: 2454292 - RNA, 20 nt, Human
ucaccccucccuuucucccc

SEQ ID NO: 2454293 - RNA, 18 nt, Human
ucaccccucccuuucucc

SEQ ID NO: 2454294 - RNA, 17 nt, Human
ucaccccucccuuucuc

SEQ ID NO: 2454295 - RNA, 14 nt, Human
ucaccccucccuuu

SEQ ID NO: 2454296 - RNA, 18 nt, Human
ucaccccugguucucauc

SEQ ID NO: 2454297 - RNA, 15 nt, Human
ucaccccugguucuc

SEQ ID NO: 2454298 - RNA, 13 nt, Human
ucaccccugcccu

SEQ ID NO: 2454299 - RNA, 14 nt, Human
ucaccccugcccug

SEQ ID NO: 2454300 - RNA, 16 nt, Human
ucaccccugcccuggg

SEQ ID NO: 2454301 - RNA, 17 nt, Human
ucaccccugcccuggga

SEQ ID NO: 2454302 - RNA, 16 nt, Human
ucaccagccccagugc

SEQ ID NO: 2454303 - RNA, 13 nt, Human
ucaccagccccag

SEQ ID NO: 2454304 - RNA, 22 nt, Human
ucaccccggccaccugcggugc

SEQ ID NO: 2454305 - RNA, 14 nt, Human
ucaccccgucuggg

SEQ ID NO: 2454306 - RNA, 14 nt, Human
ucaccccuccagga

SEQ ID NO: 2454307 - RNA, 13 nt, Human
ucaccccuccagg

SEQ ID NO: 2454308 - RNA, 17 nt, Human
ucaccccuccacccuug

SEQ ID NO: 2454309 - RNA, 12 nt, Human
ucaccccuccac

SEQ ID NO: 2454310 - RNA, 19 nt, Human
ucacugccaggccagccuc

SEQ ID NO: 2454311 - RNA, 18 nt, Human
ucacugccaggccagccu

SEQ ID NO: 2454312 - RNA, 16 nt, Human
ucacugccaggccagc

SEQ ID NO: 2454313 - RNA, 15 nt, Human
ucacugccaggccag

SEQ ID NO: 2454314 - RNA, 23 nt, Human
ucacugccaggccagccuccgag

SEQ ID NO: 2454315 - RNA, 20 nt, Human
ucacugccaggccagccucc

SEQ ID NO: 2454316 - RNA, 13 nt, Human
ucacugccauaua

SEQ ID NO: 2454317 - RNA, 18 nt, Human
ucacugccaugccagcuu

SEQ ID NO: 2454318 - RNA, 14 nt, Human
ucacugccuuugcu

SEQ ID NO: 2454319 - RNA, 22 nt, Human
ucacugccugcagaggucugug

SEQ ID NO: 2454320 - RNA, 15 nt, Human
ucacugccugcagag

SEQ ID NO: 2454321 - RNA, 19 nt, Human
ucacugcuaagaauauuug

SEQ ID NO: 2454322 - RNA, 11 nt, Human
ucacugccucu

SEQ ID NO: 2454323 - RNA, 12 nt, Human
ucacugccucuc

SEQ ID NO: 2454324 - RNA, 19 nt, Human
ucacugccucucccuggcc

SEQ ID NO: 2454325 - RNA, 14 nt, Human
ucacugccugcaga

SEQ ID NO: 2454326 - RNA, 21 nt, Human
ucacugccucucccuggcccu

SEQ ID NO: 2454327 - RNA, 14 nt, Human
ucacugccaggcca

SEQ ID NO: 2454328 - RNA, 11 nt, Human
ucacugccagg

SEQ ID NO: 2454329 - RNA, 13 nt, Human
ucacugcauccuc

SEQ ID NO: 2454330 - RNA, 19 nt, Human
ucacugcauccuccgccuc

SEQ ID NO: 2454331 - RNA, 20 nt, Human
ucacucuuauugcccacgcu

SEQ ID NO: 2454332 - RNA, 18 nt, Human
ucacugcauccuccgccu

SEQ ID NO: 2454333 - RNA, 21 nt, Human
ucagaggggaauaaacuguug

SEQ ID NO: 2454334 - RNA, 12 nt, Human
ucagagaauuuc

SEQ ID NO: 2454335 - RNA, 22 nt, Human
ucagaguaauccaagcaaaugu

SEQ ID NO: 2454336 - RNA, 21 nt, Human
ucagaguaauccaagcaaaug

SEQ ID NO: 2454337 - RNA, 16 nt, Human
ucagacuuuggaaaau

SEQ ID NO: 2454338 - RNA, 19 nt, Human
ucagacuuuggaaaaugca

SEQ ID NO: 2454339 - RNA, 21 nt, Human
ucagacuuuggaaaaugcauu

SEQ ID NO: 2454340 - RNA, 20 nt, Human
ucagacuuuggaaaaugcau

SEQ ID NO: 2454341 - RNA, 16 nt, Human
ucagacuuuaaagaau

SEQ ID NO: 2454342 - RNA, 13 nt, Human
ucagacuuugcuu

SEQ ID NO: 2454343 - RNA, 15 nt, Human
ucagacuuuggaaaa

SEQ ID NO: 2454344 - RNA, 17 nt, Human
ucagacuuuaaagaaua

SEQ ID NO: 2454345 - RNA, 23 nt, Human
ucagacuuuaaagaauaauaugc

SEQ ID NO: 2454346 - RNA, 23 nt, Human
ucagaccauaauguuacauuauu

SEQ ID NO: 2454347 - RNA, 15 nt, Human
ucagaccauaauguu

SEQ ID NO: 2454348 - RNA, 14 nt, Human
ucagacagcugccu

SEQ ID NO: 2454349 - RNA, 12 nt, Human
ucagaccccagc

SEQ ID NO: 2454350 - RNA, 13 nt, Human
ucagaccccagcg

SEQ ID NO: 2454351 - RNA, 17 nt, Human
ucagaccccagcggcug

SEQ ID NO: 2454352 - RNA, 12 nt, Human
ucagacccccac

SEQ ID NO: 2454353 - RNA, 14 nt, Human
ucagacccccacuc

SEQ ID NO: 2454354 - RNA, 18 nt, Human
ucagacccccacucucau

SEQ ID NO: 2454355 - RNA, 22 nt, Human
ucagacccccacucucauuccc

SEQ ID NO: 2454356 - RNA, 13 nt, Human
ucagacagcugcc

SEQ ID NO: 2454357 - RNA, 22 nt, Human
ucagacagagaggacuguaggg

SEQ ID NO: 2454358 - RNA, 17 nt, Human
ucagacagagaggacug

SEQ ID NO: 2454359 - RNA, 16 nt, Human
ucagacgccugaggaa

SEQ ID NO: 2454360 - RNA, 23 nt, Human
ucagacugcugggacuggccagg

SEQ ID NO: 2454361 - RNA, 13 nt, Human
ucagacuggcugg

SEQ ID NO: 2454362 - RNA, 14 nt, Human
ucagacuggcuggc

SEQ ID NO: 2454363 - RNA, 15 nt, Human
ucagacuuaccagga

SEQ ID NO: 2454364 - RNA, 20 nt, Human
ucagacuggcuggcugcagu

SEQ ID NO: 2454365 - RNA, 21 nt, Human
ucagacuggcuggcugcagug

SEQ ID NO: 2454366 - RNA, 20 nt, Human
ucagaccuuggaucagauga

SEQ ID NO: 2454367 - RNA, 13 nt, Human
ucagacccuuuag

SEQ ID NO: 2454368 - RNA, 13 nt, Human
ucagacccuaccc

SEQ ID NO: 2454369 - RNA, 14 nt, Human
ucagacccuacccc

SEQ ID NO: 2454370 - RNA, 16 nt, Human
ucagacccuaccccac

SEQ ID NO: 2454371 - RNA, 18 nt, Human
ucagacccuaccccacca

SEQ ID NO: 2454372 - RNA, 17 nt, Human
ucagacgccugaggaac

SEQ ID NO: 2454373 - RNA, 21 nt, Human
ucagaccuuggaucagaugaa

SEQ ID NO: 2454374 - RNA, 11 nt, Human
ucagacaagca

SEQ ID NO: 2454375 - RNA, 16 nt, Human
ucagaauucucuaguu

SEQ ID NO: 2454376 - RNA, 21 nt, Human
ucagaauugaucauuuucccc

SEQ ID NO: 2454377 - RNA, 18 nt, Human
ucagacacucuggcuggu

SEQ ID NO: 2454378 - RNA, 17 nt, Human
ucagacacucuggcugg

SEQ ID NO: 2454379 - RNA, 18 nt, Human
ucagacagaaccccuaca

SEQ ID NO: 2454380 - RNA, 15 nt, Human
ucagacacucuggcu

SEQ ID NO: 2454381 - RNA, 14 nt, Human
ucagacacucuggc

SEQ ID NO: 2454382 - RNA, 23 nt, Human
ucagacacccucaaccucuucug

SEQ ID NO: 2454383 - RNA, 17 nt, Human
ucagacacccucaaccu

SEQ ID NO: 2454384 - RNA, 22 nt, Human
ucagacacccucaaccucuucu

SEQ ID NO: 2454385 - RNA, 15 nt, Human
ucagacacccucaac

SEQ ID NO: 2454386 - RNA, 23 nt, Human
ucagaauucucuaguuugauuaa

SEQ ID NO: 2454387 - RNA, 14 nt, Human
ucagaaauuuaauu

SEQ ID NO: 2454388 - RNA, 21 nt, Human
ucagaaauuuaauucauguuu

SEQ ID NO: 2454389 - RNA, 21 nt, Human
ucagaaauuggaacagaaugu

SEQ ID NO: 2454390 - RNA, 23 nt, Human
ucagaaauuuaauucauguuucu

SEQ ID NO: 2454391 - RNA, 15 nt, Human
ucagaaauguguuau

SEQ ID NO: 2454392 - RNA, 21 nt, Human
ucagaaaugcugccugccugu

SEQ ID NO: 2454393 - RNA, 19 nt, Human
ucagaaaugcugccugccu

SEQ ID NO: 2454394 - RNA, 17 nt, Human
ucagaaaugcugccugc

SEQ ID NO: 2454395 - RNA, 16 nt, Human
ucagaaaugcugccug

SEQ ID NO: 2454396 - RNA, 18 nt, Human
ucagaaauuggaacagaa

SEQ ID NO: 2454397 - RNA, 16 nt, Human
ucagaaauuggaacag

SEQ ID NO: 2454398 - RNA, 18 nt, Human
ucagaaauguacaacuuu

SEQ ID NO: 2454399 - RNA, 16 nt, Human
ucacuuuaauucucau

SEQ ID NO: 2454400 - RNA, 15 nt, Human
ucacuuuaauucuca

SEQ ID NO: 2454401 - RNA, 23 nt, Human
ucacuuguuguuuuacuaaagaa

SEQ ID NO: 2454402 - RNA, 20 nt, Human
ucacuuuaauucucauguga

SEQ ID NO: 2454403 - RNA, 18 nt, Human
ucacuuuaauucucaugu

SEQ ID NO: 2454404 - RNA, 14 nt, Human
ucacuuuagaugcu

SEQ ID NO: 2454405 - RNA, 22 nt, Human
ucacuuguuguuuuacuaaaga

SEQ ID NO: 2454406 - RNA, 21 nt, Human
ucacuuguuguuuuacuaaag

SEQ ID NO: 2454407 - RNA, 20 nt, Human
ucacuuguuguuuuacuaaa

SEQ ID NO: 2454408 - RNA, 15 nt, Human
ucacuuguuguuuua

SEQ ID NO: 2454409 - RNA, 17 nt, Human
ucacuuuagaugcugau

SEQ ID NO: 2454410 - RNA, 16 nt, Human
ucacuuuagaugcuga

SEQ ID NO: 2454411 - RNA, 15 nt, Human
ucacuuuagaugcug

SEQ ID NO: 2454412 - RNA, 22 nt, Human
ucacuuuaauucucaugugauc

SEQ ID NO: 2454413 - RNA, 17 nt, Human
ucacuuucacauagaug

SEQ ID NO: 2454414 - RNA, 18 nt, Human
ucacuuucacauagaugu

SEQ ID NO: 2454415 - RNA, 21 nt, Human
ucagaaacacccucacacugg

SEQ ID NO: 2454416 - RNA, 22 nt, Human
ucagaaacacccucacacuggg

SEQ ID NO: 2454417 - RNA, 19 nt, Human
ucagaaacacccucacacu

SEQ ID NO: 2454418 - RNA, 10 nt, Human
ucagaaaugu

SEQ ID NO: 2454419 - RNA, 15 nt, Human
ucagaaacuugugaa

SEQ ID NO: 2454420 - RNA, 16 nt, Human
ucagaaacuugugaag

SEQ ID NO: 2454421 - RNA, 17 nt, Human
ucagaaacuugugaagu

SEQ ID NO: 2454422 - RNA, 18 nt, Human
ucagaaacuugugaagug

SEQ ID NO: 2454423 - RNA, 12 nt, Human
ucagaaacuguu

SEQ ID NO: 2454424 - RNA, 22 nt, Human
ucagaaaccaguuaugugaaug

SEQ ID NO: 2454425 - RNA, 18 nt, Human
ucagaaaccaaacaguuu

SEQ ID NO: 2454426 - RNA, 21 nt, Human
ucagaaacacuggggcuggca

SEQ ID NO: 2454427 - RNA, 13 nt, Human
ucagaaaccaguu

SEQ ID NO: 2454428 - RNA, 18 nt, Human
ucagaaacaucaguuacu

SEQ ID NO: 2454429 - RNA, 22 nt, Human
ucagaaacaucaguuacucuga

SEQ ID NO: 2454430 - RNA, 18 nt, Human
ucagaaacacuggggcug

SEQ ID NO: 2454431 - RNA, 13 nt, Human
ucauuaucucaaa

SEQ ID NO: 2454432 - RNA, 19 nt, Human
ucauuaucucaaaacugca

SEQ ID NO: 2454433 - RNA, 20 nt, Human
ucauuaucucaaaacugcac

SEQ ID NO: 2454434 - RNA, 20 nt, Human
ucauuauguaaaauguuuua

SEQ ID NO: 2454435 - RNA, 13 nt, Human
ucauuauguaaaa

SEQ ID NO: 2454436 - RNA, 13 nt, Human
ucauuauaaacgu

SEQ ID NO: 2454437 - RNA, 15 nt, Human
ucauuauaaacguga

SEQ ID NO: 2454438 - RNA, 23 nt, Human
ucauuauaaacgugaugaucagc

SEQ ID NO: 2454439 - RNA, 17 nt, Human
ucauuauagauccccca

SEQ ID NO: 2454440 - RNA, 17 nt, Human
ucauuccaacagugagu

SEQ ID NO: 2454441 - RNA, 23 nt, Human
ucauuccaccuucccaugcccug

SEQ ID NO: 2454442 - RNA, 13 nt, Human
ucauucaauaaau

SEQ ID NO: 2454443 - RNA, 16 nt, Human
ucauucaauacaagug

SEQ ID NO: 2454444 - RNA, 14 nt, Human
ucauuccagaggaa

SEQ ID NO: 2454445 - RNA, 21 nt, Human
ucauuccaacuucccaguuca

SEQ ID NO: 2454446 - RNA, 14 nt, Human
ucauuccauucugg

SEQ ID NO: 2454447 - RNA, 15 nt, Human
ucauuccauucugga

SEQ ID NO: 2454448 - RNA, 21 nt, Human
ucauucaacccaccugcgucu

SEQ ID NO: 2454449 - RNA, 22 nt, Human
ucauucaaguguaaaauauuuu

SEQ ID NO: 2454450 - RNA, 22 nt, Human
ucauucaaaaguugaaauuaac

SEQ ID NO: 2454451 - RNA, 16 nt, Human
ucauucaaaaguugaa

SEQ ID NO: 2454452 - RNA, 18 nt, Human
ucauucaaaaguugaaau

SEQ ID NO: 2454453 - RNA, 17 nt, Human
ucauuauuuuuccacuu

SEQ ID NO: 2454454 - RNA, 14 nt, Human
ucauuauuggaggg

SEQ ID NO: 2454455 - RNA, 19 nt, Human
ucauuauuggaauuaaccu

SEQ ID NO: 2454456 - RNA, 21 nt, Human
ucauuauuggaauuaaccugg

SEQ ID NO: 2454457 - RNA, 18 nt, Human
ucauuauagaucccccag

SEQ ID NO: 2454458 - RNA, 14 nt, Human
ucauuauuggaauu

SEQ ID NO: 2454459 - RNA, 17 nt, Human
ucauuauuggaauuaac

SEQ ID NO: 2454460 - RNA, 18 nt, Human
ucauuauuggaauuaacc

SEQ ID NO: 2454461 - RNA, 16 nt, Human
ucauuuccaagcaagu

SEQ ID NO: 2454462 - RNA, 15 nt, Human
ucauuucauuuccua

SEQ ID NO: 2454463 - RNA, 19 nt, Human
ucauuucauuguaugaugu

SEQ ID NO: 2454464 - RNA, 13 nt, Human
ucauuuccaagca

SEQ ID NO: 2454465 - RNA, 14 nt, Human
ucauuucauuguau

SEQ ID NO: 2454466 - RNA, 16 nt, Human
ucauuucauuccuaac

SEQ ID NO: 2454467 - RNA, 15 nt, Human
ucauuucuacuguga

SEQ ID NO: 2454468 - RNA, 23 nt, Human
ucauuuccugcccuuccucaguu

SEQ ID NO: 2454469 - RNA, 21 nt, Human
ucauuuccuucaaggcaucau

SEQ ID NO: 2454470 - RNA, 19 nt, Human
ucauuucuacugugacuga

SEQ ID NO: 2454471 - RNA, 18 nt, Human
ucauuucuacugugacug

SEQ ID NO: 2454472 - RNA, 13 nt, Human
ucauuucuauuuc

SEQ ID NO: 2454473 - RNA, 16 nt, Human
ucauuuccugugucuu

SEQ ID NO: 2454474 - RNA, 13 nt, Human
ucauuuccugugu

SEQ ID NO: 2454475 - RNA, 15 nt, Human
ucauuuccugcccuu

SEQ ID NO: 2454476 - RNA, 14 nt, Human
ucauuuccugcccu

SEQ ID NO: 2454477 - RNA, 13 nt, Human
ucauuuccugccc

SEQ ID NO: 2454478 - RNA, 12 nt, Human
ucauuuccugcc

SEQ ID NO: 2454479 - RNA, 13 nt, Human
ucauuuccucaaa

SEQ ID NO: 2454480 - RNA, 22 nt, Human
ucauuuccuauguaacugcauu

SEQ ID NO: 2454481 - RNA, 18 nt, Human
ucauugugaaauuauuca

SEQ ID NO: 2454482 - RNA, 17 nt, Human
ucauugugaaauuauuc

SEQ ID NO: 2454483 - RNA, 15 nt, Human
ucauugugaaauuau

SEQ ID NO: 2454484 - RNA, 12 nt, Human
ucauugugaaau

SEQ ID NO: 2454485 - RNA, 21 nt, Human
ucauuucaccccucccuuucu

SEQ ID NO: 2454486 - RNA, 16 nt, Human
ucauuucaccccuccc

SEQ ID NO: 2454487 - RNA, 15 nt, Human
ucauuucaccccucc

SEQ ID NO: 2454488 - RNA, 14 nt, Human
ucauuucaccccuc

SEQ ID NO: 2454489 - RNA, 16 nt, Human
ucauuccauucuggaa

SEQ ID NO: 2454490 - RNA, 18 nt, Human
ucauugucuguguagagu

SEQ ID NO: 2454491 - RNA, 23 nt, Human
ucauuucaccccucccuuucucc

SEQ ID NO: 2454492 - RNA, 16 nt, Human
ucauuucaggagcagc

SEQ ID NO: 2454493 - RNA, 15 nt, Human
ucauuucaggagcag

SEQ ID NO: 2454494 - RNA, 12 nt, Human
ucauuucaggau

SEQ ID NO: 2454495 - RNA, 14 nt, Human
ucaucuucucagcu

SEQ ID NO: 2454496 - RNA, 16 nt, Human
ucaucuuacuguaccu

SEQ ID NO: 2454497 - RNA, 13 nt, Human
ucaucuucucagc

SEQ ID NO: 2454498 - RNA, 18 nt, Human
ucaucugcucuccuuccu

SEQ ID NO: 2454499 - RNA, 17 nt, Human
ucaucugcucuccuucc

SEQ ID NO: 2454500 - RNA, 19 nt, Human
ucaucuucaccagaggaau

SEQ ID NO: 2454501 - RNA, 12 nt, Human
ucaucuuacugu

SEQ ID NO: 2454502 - RNA, 16 nt, Human
ucaucugcucuccuuc

SEQ ID NO: 2454503 - RNA, 15 nt, Human
ucaucugcucuccuu

SEQ ID NO: 2454504 - RNA, 14 nt, Human
ucaucugcucuccu

SEQ ID NO: 2454505 - RNA, 12 nt, Human
ucaucugcucuc

SEQ ID NO: 2454506 - RNA, 23 nt, Human
ucaucuuagguuggcaaaaaggc

SEQ ID NO: 2454507 - RNA, 14 nt, Human
ucaugcugaaagcc

SEQ ID NO: 2454508 - RNA, 16 nt, Human
ucaucuucuucaccau

SEQ ID NO: 2454509 - RNA, 19 nt, Human
ucaucuucucagcucccau

SEQ ID NO: 2454510 - RNA, 13 nt, Human
ucaugcugaaagc

SEQ ID NO: 2454511 - RNA, 11 nt, Human
ucaugcugaaa

SEQ ID NO: 2454512 - RNA, 19 nt, Human
ucaucuugaauuguaagga

SEQ ID NO: 2454513 - RNA, 18 nt, Human
ucaucuucucagcuccca

SEQ ID NO: 2454514 - RNA, 15 nt, Human
ucaucuucucagcuc

SEQ ID NO: 2454515 - RNA, 13 nt, Human
ucaucuucucugg

SEQ ID NO: 2454516 - RNA, 17 nt, Human
ucaucugcucagcagcu

SEQ ID NO: 2454517 - RNA, 13 nt, Human
ucaucugccgugc

SEQ ID NO: 2454518 - RNA, 17 nt, Human
ucaucaggggccugcag

SEQ ID NO: 2454519 - RNA, 22 nt, Human
ucaucaggaugaacccaggacg

SEQ ID NO: 2454520 - RNA, 14 nt, Human
ucaucaggaugaac

SEQ ID NO: 2454521 - RNA, 13 nt, Human
ucaucaggaugaa

SEQ ID NO: 2454522 - RNA, 11 nt, Human
ucaucaggaug

SEQ ID NO: 2454523 - RNA, 14 nt, Human
ucaucaguauugaa

SEQ ID NO: 2454524 - RNA, 15 nt, Human
ucaucagaagauaac

SEQ ID NO: 2454525 - RNA, 16 nt, Human
ucaucagccaccaucc

SEQ ID NO: 2454526 - RNA, 21 nt, Human
ucaucagcauaccuuuauugu

SEQ ID NO: 2454527 - RNA, 18 nt, Human
ucaucagccaccauccua

SEQ ID NO: 2454528 - RNA, 14 nt, Human
ucaucagcauaccu

SEQ ID NO: 2454529 - RNA, 22 nt, Human
ucaucacuggaugaagauucuc

SEQ ID NO: 2454530 - RNA, 15 nt, Human
ucaucacuggaugaa

SEQ ID NO: 2454531 - RNA, 17 nt, Human
ucaucacuuuucaguga

SEQ ID NO: 2454532 - RNA, 15 nt, Human
ucaucacuuuucagu

SEQ ID NO: 2454533 - RNA, 16 nt, Human
ucaucacuccccucca

SEQ ID NO: 2454534 - RNA, 15 nt, Human
ucaucacuccccucc

SEQ ID NO: 2454535 - RNA, 14 nt, Human
ucaucacuccccuc

SEQ ID NO: 2454536 - RNA, 18 nt, Human
ucauaccuaucaucuuaa

SEQ ID NO: 2454537 - RNA, 22 nt, Human
ucaggugaccaaaauccccuuc

SEQ ID NO: 2454538 - RNA, 21 nt, Human
ucaggugacaugugaaaccuu

SEQ ID NO: 2454539 - RNA, 15 nt, Human
ucauaccuacaugua

SEQ ID NO: 2454540 - RNA, 16 nt, Human
ucauaccuacauguau

SEQ ID NO: 2454541 - RNA, 23 nt, Human
ucagggcuccugccuucuguccu

SEQ ID NO: 2454542 - RNA, 21 nt, Human
ucagggcuccugccuucuguc

SEQ ID NO: 2454543 - RNA, 17 nt, Human
ucaggugacaugugaaa

SEQ ID NO: 2454544 - RNA, 21 nt, Human
ucauacccacccccacccaag

SEQ ID NO: 2454545 - RNA, 15 nt, Human
ucaggugcugccauc

SEQ ID NO: 2454546 - RNA, 14 nt, Human
ucaggugcugccau

SEQ ID NO: 2454547 - RNA, 13 nt, Human
ucaggugcugcca

SEQ ID NO: 2454548 - RNA, 23 nt, Human
ucaggugccucaagagaaggcaa

SEQ ID NO: 2454549 - RNA, 21 nt, Human
ucaggugagaagcagaggaag

SEQ ID NO: 2454550 - RNA, 22 nt, Human
ucauagcccaguagaccuuguu

SEQ ID NO: 2454551 - RNA, 12 nt, Human
ucauagcuaaga

SEQ ID NO: 2454552 - RNA, 21 nt, Human
ucauagcccucacccuggggc

SEQ ID NO: 2454553 - RNA, 21 nt, Human
ucauagcccagaucagcuccu

SEQ ID NO: 2454554 - RNA, 18 nt, Human
ucauagcccagaucagcu

SEQ ID NO: 2454555 - RNA, 14 nt, Human
ucauagcccaguag

SEQ ID NO: 2454556 - RNA, 19 nt, Human
ucauagcauuaacuaaucu

SEQ ID NO: 2454557 - RNA, 15 nt, Human
ucauacucaccucac

SEQ ID NO: 2454558 - RNA, 15 nt, Human
ucauacguccaccau

SEQ ID NO: 2454559 - RNA, 14 nt, Human
ucauacguccacca

SEQ ID NO: 2454560 - RNA, 20 nt, Human
ucauacuaucuacucuccuc

SEQ ID NO: 2454561 - RNA, 14 nt, Human
ucauagcauuaacu

SEQ ID NO: 2454562 - RNA, 21 nt, Human
ucauagcauuaacuaaucuau

SEQ ID NO: 2454563 - RNA, 21 nt, Human
ucaucaccaacgucugugcca

SEQ ID NO: 2454564 - RNA, 20 nt, Human
ucaucaccaacgucugugcc

SEQ ID NO: 2454565 - RNA, 19 nt, Human
ucaucaccaacgucugugc

SEQ ID NO: 2454566 - RNA, 21 nt, Human
ucauaggaagggaccaaggca

SEQ ID NO: 2454567 - RNA, 20 nt, Human
ucauaggaagggaccaaggc

SEQ ID NO: 2454568 - RNA, 20 nt, Human
ucauaggaaaaguacauuua

SEQ ID NO: 2454569 - RNA, 16 nt, Human
ucauagcuaagaaaua

SEQ ID NO: 2454570 - RNA, 13 nt, Human
ucauagcuaagaa

SEQ ID NO: 2454571 - RNA, 12 nt, Human
ucauagcugaga

SEQ ID NO: 2454572 - RNA, 17 nt, Human
ucauagcugagauuccu

SEQ ID NO: 2454573 - RNA, 15 nt, Human
uccacuuggucugug

SEQ ID NO: 2454574 - RNA, 16 nt, Human
uccacuuggucuguga

SEQ ID NO: 2454575 - RNA, 15 nt, Human
uccaccuucccaugc

SEQ ID NO: 2454576 - RNA, 14 nt, Human
uccacuuggucugu

SEQ ID NO: 2454577 - RNA, 13 nt, Human
uccaccugucuca

SEQ ID NO: 2454578 - RNA, 16 nt, Human
uccaccugucucagcc

SEQ ID NO: 2454579 - RNA, 17 nt, Human
uccaccugucucagccu

SEQ ID NO: 2454580 - RNA, 20 nt, Human
uccaccugucucagccuccc

SEQ ID NO: 2454581 - RNA, 17 nt, Human
uccagccagggcugcua

SEQ ID NO: 2454582 - RNA, 15 nt, Human
uccagccagggcugc

SEQ ID NO: 2454583 - RNA, 14 nt, Human
uccagccagggcug

SEQ ID NO: 2454584 - RNA, 13 nt, Human
uccagccagggcu

SEQ ID NO: 2454585 - RNA, 23 nt, Human
uccagccagcaaugauguccaga

SEQ ID NO: 2454586 - RNA, 23 nt, Human
uccagccaaccccuguggagccc

SEQ ID NO: 2454587 - RNA, 13 nt, Human
uccagccaacccc

SEQ ID NO: 2454588 - RNA, 14 nt, Human
uccagccaaccccu

SEQ ID NO: 2454589 - RNA, 16 nt, Human
uccagccaaccccugu

SEQ ID NO: 2454590 - RNA, 20 nt, Human
uccagccaaccccuguggag

SEQ ID NO: 2454591 - RNA, 17 nt, Human
uccagcuguucagcugg

SEQ ID NO: 2454592 - RNA, 21 nt, Human
uccagcuucugguacucuccu

SEQ ID NO: 2454593 - RNA, 20 nt, Human
uccagcuucugguacucucc

SEQ ID NO: 2454594 - RNA, 19 nt, Human
uccagcuucugguacucuc

SEQ ID NO: 2454595 - RNA, 16 nt, Human
uccaggagcagccaca

SEQ ID NO: 2454596 - RNA, 23 nt, Human
uccagcuucugguacucuccuag

SEQ ID NO: 2454597 - RNA, 15 nt, Human
uccagcuugcucuuc

SEQ ID NO: 2454598 - RNA, 16 nt, Human
uccagcuugcucuuca

SEQ ID NO: 2454599 - RNA, 17 nt, Human
uccagcuuguggagccc

SEQ ID NO: 2454600 - RNA, 16 nt, Human
uccagcuuguggagcc

SEQ ID NO: 2454601 - RNA, 17 nt, Human
uccagcuugcucuucag

SEQ ID NO: 2454602 - RNA, 19 nt, Human
uccagcuugcucuucagug

SEQ ID NO: 2454603 - RNA, 17 nt, Human
uccagcucaccagcccc

SEQ ID NO: 2454604 - RNA, 16 nt, Human
uccagcucaccagccc

SEQ ID NO: 2454605 - RNA, 18 nt, Human
uccagcucaccagcccca

SEQ ID NO: 2454606 - RNA, 13 nt, Human
uccagcuggugag

SEQ ID NO: 2454607 - RNA, 15 nt, Human
uccagcucaccagcc

SEQ ID NO: 2454608 - RNA, 18 nt, Human
uccaggagcagccacauu

SEQ ID NO: 2454609 - RNA, 17 nt, Human
uccaggagcagccacau

SEQ ID NO: 2454610 - RNA, 19 nt, Human
uccagcuuguggagcccca

SEQ ID NO: 2454611 - RNA, 18 nt, Human
uccagcuuguggagcccc

SEQ ID NO: 2454612 - RNA, 23 nt, Human
uccagcuuguggagccccacacu

SEQ ID NO: 2454613 - RNA, 22 nt, Human
uccaggggugggacacccugug

SEQ ID NO: 2454614 - RNA, 22 nt, Human
uccaggagcagccacauuccug

SEQ ID NO: 2454615 - RNA, 18 nt, Human
uccagggucccucugugu

SEQ ID NO: 2454616 - RNA, 17 nt, Human
uccagggucccucugug

SEQ ID NO: 2454617 - RNA, 16 nt, Human
uccagggucccucugu

SEQ ID NO: 2454618 - RNA, 23 nt, Human
uccaggggugggacacccuguga

SEQ ID NO: 2454619 - RNA, 15 nt, Human
uccaggugcacaagc

SEQ ID NO: 2454620 - RNA, 22 nt, Human
uccaggugcacaagcuccaagc

SEQ ID NO: 2454621 - RNA, 21 nt, Human
uccaggugcacaagcuccaag

SEQ ID NO: 2454622 - RNA, 20 nt, Human
uccaggugcacaagcuccaa

SEQ ID NO: 2454623 - RNA, 18 nt, Human
uccaggugcacaagcucc

SEQ ID NO: 2454624 - RNA, 21 nt, Human
uccagguggggugaggcagug

SEQ ID NO: 2454625 - RNA, 16 nt, Human
uccagguggggugagg

SEQ ID NO: 2454626 - RNA, 16 nt, Human
uccagguguuacugua

SEQ ID NO: 2454627 - RNA, 14 nt, Human
uccagguggcauca

SEQ ID NO: 2454628 - RNA, 13 nt, Human
uccaggugcccag

SEQ ID NO: 2454629 - RNA, 11 nt, Human
uccaggguggu

SEQ ID NO: 2454630 - RNA, 16 nt, Human
uccagguucagcuugu

SEQ ID NO: 2454631 - RNA, 15 nt, Human
uccagguucagcuug

SEQ ID NO: 2454632 - RNA, 22 nt, Human
uccacccucccagaccugccuc

SEQ ID NO: 2454633 - RNA, 16 nt, Human
uccacccucccagacc

SEQ ID NO: 2454634 - RNA, 12 nt, Human
uccacccugcuc

SEQ ID NO: 2454635 - RNA, 21 nt, Human
uccacccccucccuggccugu

SEQ ID NO: 2454636 - RNA, 19 nt, Human
uccacccccucccuggccu

SEQ ID NO: 2454637 - RNA, 20 nt, Human
uccacccccucccuggccug

SEQ ID NO: 2454638 - RNA, 23 nt, Human
uccaccccccagaaccuguccuu

SEQ ID NO: 2454639 - RNA, 13 nt, Human
uccacccccuccc

SEQ ID NO: 2454640 - RNA, 15 nt, Human
uccacccccucccug

SEQ ID NO: 2454641 - RNA, 18 nt, Human
uccacccccucccuggcc

SEQ ID NO: 2454642 - RNA, 19 nt, Human
uccacagaagcuccaggua

SEQ ID NO: 2454643 - RNA, 18 nt, Human
uccacagagagucccacu

SEQ ID NO: 2454644 - RNA, 17 nt, Human
uccacagaugccuccac

SEQ ID NO: 2454645 - RNA, 21 nt, Human
uccacagagagucccacugcc

SEQ ID NO: 2454646 - RNA, 17 nt, Human
uccacagcaaccccagg

SEQ ID NO: 2454647 - RNA, 16 nt, Human
uccacccccagcugcu

SEQ ID NO: 2454648 - RNA, 22 nt, Human
uccaccccccagaaccuguccu

SEQ ID NO: 2454649 - RNA, 12 nt, Human
uccacccccucc

SEQ ID NO: 2454650 - RNA, 14 nt, Human
uccacccucugagc

SEQ ID NO: 2454651 - RNA, 12 nt, Human
uccacccucuga

SEQ ID NO: 2454652 - RNA, 16 nt, Human
uccacccucugagcuu

SEQ ID NO: 2454653 - RNA, 15 nt, Human
uccaccugccaggga

SEQ ID NO: 2454654 - RNA, 17 nt, Human
uccaccugccagggaca

SEQ ID NO: 2454655 - RNA, 21 nt, Human
uccaccugccagggacagagg

SEQ ID NO: 2454656 - RNA, 18 nt, Human
uccaccugccagggacag

SEQ ID NO: 2454657 - RNA, 18 nt, Human
uccaccugcucccaggcc

SEQ ID NO: 2454658 - RNA, 17 nt, Human
uccaccugcucccaggc

SEQ ID NO: 2454659 - RNA, 16 nt, Human
uccaccugcucccagg

SEQ ID NO: 2454660 - RNA, 13 nt, Human
uccaccugcuccc

SEQ ID NO: 2454661 - RNA, 23 nt, Human
uccaccugggcauauccaccacc

SEQ ID NO: 2454662 - RNA, 17 nt, Human
uccaccuggccccaugu

SEQ ID NO: 2454663 - RNA, 13 nt, Human
uccaccuggcccc

SEQ ID NO: 2454664 - RNA, 22 nt, Human
uccaaaauguuggucauuuuau

SEQ ID NO: 2454665 - RNA, 19 nt, Human
uccaaaauaauuuuaagaa

SEQ ID NO: 2454666 - RNA, 15 nt, Human
uccaaaauaauuuua

SEQ ID NO: 2454667 - RNA, 17 nt, Human
ucauuucuauuucuccu

SEQ ID NO: 2454668 - RNA, 21 nt, Human
ucauuucuauuucuccuccau

SEQ ID NO: 2454669 - RNA, 20 nt, Human
uccaaaauaaaacuuuuuaa

SEQ ID NO: 2454670 - RNA, 18 nt, Human
uccaaaauaaaacuuuuu

SEQ ID NO: 2454671 - RNA, 14 nt, Human
uccaauuuucugga

SEQ ID NO: 2454672 - RNA, 22 nt, Human
uccaauuguugacaguucugaa

SEQ ID NO: 2454673 - RNA, 21 nt, Human
uccaauuguugacaguucuga

SEQ ID NO: 2454674 - RNA, 16 nt, Human
uccaauuguugacagu

SEQ ID NO: 2454675 - RNA, 22 nt, Human
uccaauuuguaaaaacagcauu

SEQ ID NO: 2454676 - RNA, 17 nt, Human
uccaauuuacauacucu

SEQ ID NO: 2454677 - RNA, 18 nt, Human
uccaauuuacauacucug

SEQ ID NO: 2454678 - RNA, 18 nt, Human
uccacaagagcccaggcc

SEQ ID NO: 2454679 - RNA, 15 nt, Human
uccacaagagcccag

SEQ ID NO: 2454680 - RNA, 23 nt, Human
uccacaagauucccagagacagg

SEQ ID NO: 2454681 - RNA, 17 nt, Human
uccacaagagcccaggc

SEQ ID NO: 2454682 - RNA, 16 nt, Human
uccacaagagcccagg

SEQ ID NO: 2454683 - RNA, 17 nt, Human
uccacaaguuaaauaaa

SEQ ID NO: 2454684 - RNA, 18 nt, Human
uccacaaguuaaauaaau

SEQ ID NO: 2454685 - RNA, 20 nt, Human
uccacagaaacauuuucauu

SEQ ID NO: 2454686 - RNA, 14 nt, Human
uccacacacagagg

SEQ ID NO: 2454687 - RNA, 15 nt, Human
uccacacacagagga

SEQ ID NO: 2454688 - RNA, 19 nt, Human
uccacacacagaggaagag

SEQ ID NO: 2454689 - RNA, 22 nt, Human
uccacacacagaggaagagcag

SEQ ID NO: 2454690 - RNA, 12 nt, Human
uccacacacaga

SEQ ID NO: 2454691 - RNA, 13 nt, Human
uccacacacagag

SEQ ID NO: 2454692 - RNA, 19 nt, Human
uauuuauaaauauauuuaa

SEQ ID NO: 2454693 - RNA, 17 nt, Human
uauuuauaaauauauuu

SEQ ID NO: 2454694 - RNA, 16 nt, Human
uauuuauaaauauauu

SEQ ID NO: 2454695 - RNA, 17 nt, Human
uauuuauaaaacuucuc

SEQ ID NO: 2454696 - RNA, 20 nt, Human
uauuuaguuauaguuucaga

SEQ ID NO: 2454697 - RNA, 14 nt, Human
uauuuauaaaacuu

SEQ ID NO: 2454698 - RNA, 20 nt, Human
uauuuaaagaagaaacgucu

SEQ ID NO: 2454699 - RNA, 24 nt, Human
uauuuauaaaaauaaaaaacacug

SEQ ID NO: 2454700 - RNA, 24 nt, Human
uauuuaaacucuguugcaagugca

SEQ ID NO: 2454701 - RNA, 14 nt, Human
uauuuaaacauggu

SEQ ID NO: 2454702 - RNA, 19 nt, Human
uauuuaaaauuuauugcuu

SEQ ID NO: 2454703 - RNA, 18 nt, Human
uauuuaaaaauauuuuug

SEQ ID NO: 2454704 - RNA, 16 nt, Human
uauuguuuugguuugc

SEQ ID NO: 2454705 - RNA, 16 nt, Human
uauuuaaaagauucau

SEQ ID NO: 2454706 - RNA, 13 nt, Human
uauuuaaaacuug

SEQ ID NO: 2454707 - RNA, 12 nt, Human
uauuuaaaacuu

SEQ ID NO: 2454708 - RNA, 15 nt, Human
uauuuaaaagauuca

SEQ ID NO: 2454709 - RNA, 13 nt, Human
uauuuaaaagauu

SEQ ID NO: 2454710 - RNA, 12 nt, Human
uauuuaaaagau

SEQ ID NO: 2454711 - RNA, 23 nt, Human
uauuuaaaagaaagccucagaga

SEQ ID NO: 2454712 - RNA, 22 nt, Human
uauuguuuucaguguacaugga

SEQ ID NO: 2454713 - RNA, 22 nt, Human
uauuguuuuuccuuguauuuaa

SEQ ID NO: 2454714 - RNA, 18 nt, Human
uauuguuuucaguguaca

SEQ ID NO: 2454715 - RNA, 20 nt, Human
uauuguuuucaguguacaug

SEQ ID NO: 2454716 - RNA, 20 nt, Human
uauuguuucuuuaagaaagu

SEQ ID NO: 2454717 - RNA, 21 nt, Human
uauuguuucuggucacuauau

SEQ ID NO: 2454718 - RNA, 12 nt, Human
uauuguuuucag

SEQ ID NO: 2454719 - RNA, 15 nt, Human
uauuguuacucuggu

SEQ ID NO: 2454720 - RNA, 21 nt, Human
uauuguuaacucuugucuauu

SEQ ID NO: 2454721 - RNA, 17 nt, Human
uauuguuaacucuuguc

SEQ ID NO: 2454722 - RNA, 13 nt, Human
uauuguuccaaga

SEQ ID NO: 2454723 - RNA, 17 nt, Human
uauuguuccaagacauu

SEQ ID NO: 2454724 - RNA, 18 nt, Human
uauuguuccaagacauug

SEQ ID NO: 2454725 - RNA, 19 nt, Human
uauuguuccaagacauugu

SEQ ID NO: 2454726 - RNA, 20 nt, Human
uauuguuccaagacauuguc

SEQ ID NO: 2454727 - RNA, 21 nt, Human
uauuguuccaagacauuguca

SEQ ID NO: 2454728 - RNA, 23 nt, Human
uauuguuccaagacauugucaau

SEQ ID NO: 2454729 - RNA, 20 nt, Human
uauugauguacagucuguca

SEQ ID NO: 2454730 - RNA, 22 nt, Human
uauugauguacagucugucaug

SEQ ID NO: 2454731 - RNA, 23 nt, Human
uauugcaaagguuccaacuguau

SEQ ID NO: 2454732 - RNA, 21 nt, Human
uauugcaaagguuccaacugu

SEQ ID NO: 2454733 - RNA, 20 nt, Human
uauugcaaaauagcauuugu

SEQ ID NO: 2454734 - RNA, 22 nt, Human
uauugcaaagguuccaacugua

SEQ ID NO: 2454735 - RNA, 17 nt, Human
uauucucuccuguaccu

SEQ ID NO: 2454736 - RNA, 16 nt, Human
uauucucacuccacca

SEQ ID NO: 2454737 - RNA, 19 nt, Human
uauucucacuccaccaccc

SEQ ID NO: 2454738 - RNA, 18 nt, Human
uauucucuccaaaaaugc

SEQ ID NO: 2454739 - RNA, 21 nt, Human
uauugauaugcuuauacacuu

SEQ ID NO: 2454740 - RNA, 16 nt, Human
uauuguguuugucauu

SEQ ID NO: 2454741 - RNA, 14 nt, Human
uauuguguuuguca

SEQ ID NO: 2454742 - RNA, 18 nt, Human
uauuguguuugucauuag

SEQ ID NO: 2454743 - RNA, 17 nt, Human
uauuguguuugucauua

SEQ ID NO: 2454744 - RNA, 21 nt, Human
uauuguguuugucauuagccu

SEQ ID NO: 2454745 - RNA, 16 nt, Human
uauuguguuuguguau

SEQ ID NO: 2454746 - RNA, 21 nt, Human
uauuggaggguaaaugaugug

SEQ ID NO: 2454747 - RNA, 21 nt, Human
uauuggaauuaaccuggugcu

SEQ ID NO: 2454748 - RNA, 23 nt, Human
uauuggaauuaaccuggugcugg

SEQ ID NO: 2454749 - RNA, 16 nt, Human
uauugcuuuauaaaua

SEQ ID NO: 2454750 - RNA, 16 nt, Human
uauugcugagagaaau

SEQ ID NO: 2454751 - RNA, 19 nt, Human
uauugcugagagaaauaug

SEQ ID NO: 2454752 - RNA, 15 nt, Human
uauuggaauuaaccu

SEQ ID NO: 2454753 - RNA, 16 nt, Human
uauuggaauuaaccug

SEQ ID NO: 2454754 - RNA, 15 nt, Human
uauugcugagagaaa

SEQ ID NO: 2454755 - RNA, 17 nt, Human
uauugcugauggugcaa

SEQ ID NO: 2454756 - RNA, 22 nt, Human
uauuggaaauuuguuauaauga

SEQ ID NO: 2454757 - RNA, 21 nt, Human
uauugcuugcacaaaccaauu

SEQ ID NO: 2454758 - RNA, 19 nt, Human
uauugcuuguuggauuuuu

SEQ ID NO: 2454759 - RNA, 21 nt, Human
uauuacacuguauuuguaucu

SEQ ID NO: 2454760 - RNA, 14 nt, Human
uauuauuacuguuu

SEQ ID NO: 2454761 - RNA, 19 nt, Human
uauuauuacuuauuuuuga

SEQ ID NO: 2454762 - RNA, 13 nt, Human
uauuauuacuguu

SEQ ID NO: 2454763 - RNA, 16 nt, Human
uauuauucccauucua

SEQ ID NO: 2454764 - RNA, 19 nt, Human
uauuauuaguuuugauuua

SEQ ID NO: 2454765 - RNA, 21 nt, Human
uauuaauuguuuugcacuuuu

SEQ ID NO: 2454766 - RNA, 13 nt, Human
uauuaauugcuuu

SEQ ID NO: 2454767 - RNA, 14 nt, Human
uauuaauugcuuug

SEQ ID NO: 2454768 - RNA, 19 nt, Human
uauuacacuguauuuguau

SEQ ID NO: 2454769 - RNA, 17 nt, Human
uauuacacuguauuugu

SEQ ID NO: 2454770 - RNA, 13 nt, Human
uauuacacuguau

SEQ ID NO: 2454771 - RNA, 21 nt, Human
uauuccagaaugcuguacauc

SEQ ID NO: 2454772 - RNA, 23 nt, Human
uauuccagaaugcuguacaucua

SEQ ID NO: 2454773 - RNA, 14 nt, Human
uauuccauauauua

SEQ ID NO: 2454774 - RNA, 17 nt, Human
uauuccagaaugcugua

SEQ ID NO: 2454775 - RNA, 20 nt, Human
uauuccagaaugcuguacau

SEQ ID NO: 2454776 - RNA, 16 nt, Human
uauuccagaaugcugu

SEQ ID NO: 2454777 - RNA, 19 nt, Human
uauuccaagacaugucugu

SEQ ID NO: 2454778 - RNA, 17 nt, Human
uauuccaagacaugucu

SEQ ID NO: 2454779 - RNA, 13 nt, Human
uauuccacaucua

SEQ ID NO: 2454780 - RNA, 15 nt, Human
uauuauugaaauugu

SEQ ID NO: 2454781 - RNA, 14 nt, Human
uauuauugaaauug

SEQ ID NO: 2454782 - RNA, 13 nt, Human
uauuauucugcag

SEQ ID NO: 2454783 - RNA, 15 nt, Human
uauuauucugcagca

SEQ ID NO: 2454784 - RNA, 18 nt, Human
uauuccauccauauacuu

SEQ ID NO: 2454785 - RNA, 17 nt, Human
uauuccauauuuauuca

SEQ ID NO: 2454786 - RNA, 15 nt, Human
uauuccauauuuauu

SEQ ID NO: 2454787 - RNA, 18 nt, Human
uauuccauauauuagcau

SEQ ID NO: 2454788 - RNA, 23 nt, Human
uauuccaugaauguaucaggaaa

SEQ ID NO: 2454789 - RNA, 19 nt, Human
uauuccauccauauacuuu

SEQ ID NO: 2454790 - RNA, 16 nt, Human
uauuccaugaauguau

SEQ ID NO: 2454791 - RNA, 17 nt, Human
uauuccaugaauguauc

SEQ ID NO: 2454792 - RNA, 22 nt, Human
uauuccaugaauguaucaggaa

SEQ ID NO: 2454793 - RNA, 22 nt, Human
uauucccaagcccaugaguccu

SEQ ID NO: 2454794 - RNA, 20 nt, Human
uauucccaagcccaugaguc

SEQ ID NO: 2454795 - RNA, 12 nt, Human
uauucccaugag

SEQ ID NO: 2454796 - RNA, 23 nt, Human
uauucccaagcucuagugggaag

SEQ ID NO: 2454797 - RNA, 23 nt, Human
uauuccccagcagggucuuuuca

SEQ ID NO: 2454798 - RNA, 17 nt, Human
uauuccccauucuuccu

SEQ ID NO: 2454799 - RNA, 20 nt, Human
uauuccccuaucucuagaau

SEQ ID NO: 2454800 - RNA, 22 nt, Human
uauuccccuaucucuagaauuu

SEQ ID NO: 2454801 - RNA, 19 nt, Human
uauucuagcuaauguaaua

SEQ ID NO: 2454802 - RNA, 22 nt, Human
uauucuauuuucauuuucugca

SEQ ID NO: 2454803 - RNA, 14 nt, Human
uauucuauuuucau

SEQ ID NO: 2454804 - RNA, 22 nt, Human
uauucucaaacacaguuacacu

SEQ ID NO: 2454805 - RNA, 17 nt, Human
uauucucaaacacaguu

SEQ ID NO: 2454806 - RNA, 14 nt, Human
uauucucaccagga

SEQ ID NO: 2454807 - RNA, 15 nt, Human
uauucucaccaggaa

SEQ ID NO: 2454808 - RNA, 13 nt, Human
uauucucacucca

SEQ ID NO: 2454809 - RNA, 14 nt, Human
uauucucacuccac

SEQ ID NO: 2454810 - RNA, 15 nt, Human
uauucucacuccacc

SEQ ID NO: 2454811 - RNA, 22 nt, Human
uauucucacuccaccacccaaa

SEQ ID NO: 2454812 - RNA, 19 nt, Human
uauucuauuaacuuuaauu

SEQ ID NO: 2454813 - RNA, 13 nt, Human
uauucuauuaacu

SEQ ID NO: 2454814 - RNA, 19 nt, Human
uauucuauaugaauuuaaa

SEQ ID NO: 2454815 - RNA, 17 nt, Human
uauucuauaugaauuua

SEQ ID NO: 2454816 - RNA, 12 nt, Human
uauucuauugca

SEQ ID NO: 2454817 - RNA, 15 nt, Human
uauucuauaugaauu

SEQ ID NO: 2454818 - RNA, 14 nt, Human
uauucuauaugaau

SEQ ID NO: 2454819 - RNA, 10 nt, Human
uauucuaguc

SEQ ID NO: 2454820 - RNA, 18 nt, Human
uauuccuccugcucauau

SEQ ID NO: 2454821 - RNA, 13 nt, Human
uauuccuccuggg

SEQ ID NO: 2454822 - RNA, 22 nt, Human
uauuccuauauaguuuauugac

SEQ ID NO: 2454823 - RNA, 21 nt, Human
uauucccuagaaacuuccaaa

SEQ ID NO: 2454824 - RNA, 21 nt, Human
uauucccuguacaauauuuaa

SEQ ID NO: 2454825 - RNA, 20 nt, Human
uauuccuauauaguuuauug

SEQ ID NO: 2454826 - RNA, 21 nt, Human
uauuccuauauaguuuauuga

SEQ ID NO: 2454827 - RNA, 21 nt, Human
uauuccugcauuugugaaaug

SEQ ID NO: 2454828 - RNA, 20 nt, Human
uauuccugcauuugugaaau

SEQ ID NO: 2454829 - RNA, 19 nt, Human
uauuccugcauuugugaaa

SEQ ID NO: 2454830 - RNA, 17 nt, Human
uauuccugcauuuguga

SEQ ID NO: 2454831 - RNA, 16 nt, Human
uauuccuuucuaucau

SEQ ID NO: 2454832 - RNA, 17 nt, Human
uauuccuguauguuguc

SEQ ID NO: 2454833 - RNA, 14 nt, Human
uauuccuguauguu

SEQ ID NO: 2454834 - RNA, 11 nt, Human
uauuccugccu

SEQ ID NO: 2454835 - RNA, 22 nt, Human
uauuccuugauacuaaaaguuc

SEQ ID NO: 2454836 - RNA, 22 nt, Human
uauuccuguggauguaaaguga

SEQ ID NO: 2454837 - RNA, 14 nt, Human
uauuccugaaugaa

SEQ ID NO: 2454838 - RNA, 20 nt, Human
uauuccugaaugaaauauca

SEQ ID NO: 2454839 - RNA, 22 nt, Human
uauucgauacugcgacuuucug

SEQ ID NO: 2454840 - RNA, 20 nt, Human
uauuccuuuuguguacagug

SEQ ID NO: 2454841 - RNA, 19 nt, Human
uauuccuuuuguguacagu

SEQ ID NO: 2454842 - RNA, 21 nt, Human
uauuccuuuuguguacagugu

SEQ ID NO: 2454843 - RNA, 20 nt, Human
uauguaaaguauguaaacag

SEQ ID NO: 2454844 - RNA, 19 nt, Human
uauguaaaguauguaaaca

SEQ ID NO: 2454845 - RNA, 18 nt, Human
uauguaaaguauguaaac

SEQ ID NO: 2454846 - RNA, 17 nt, Human
uauguaaaguauguaaa

SEQ ID NO: 2454847 - RNA, 18 nt, Human
uauguaaacauaauucuu

SEQ ID NO: 2454848 - RNA, 19 nt, Human
uauguaaacugcauuagaa

SEQ ID NO: 2454849 - RNA, 14 nt, Human
uauguaaaguaugu

SEQ ID NO: 2454850 - RNA, 23 nt, Human
uauguaaacugcauuagaaauua

SEQ ID NO: 2454851 - RNA, 17 nt, Human
uauguaaaauguuuuag

SEQ ID NO: 2454852 - RNA, 15 nt, Human
uauguaaaauguuuu

SEQ ID NO: 2454853 - RNA, 15 nt, Human
uauguaaacaggaga

SEQ ID NO: 2454854 - RNA, 14 nt, Human
uauguaaacauaau

SEQ ID NO: 2454855 - RNA, 21 nt, Human
uauguaaaaggccaaaccucu

SEQ ID NO: 2454856 - RNA, 22 nt, Human
uauguaaaaggccaaaccucug

SEQ ID NO: 2454857 - RNA, 23 nt, Human
uauguaaaaggccaaaccucugu

SEQ ID NO: 2454858 - RNA, 12 nt, Human
uauguaaaauaa

SEQ ID NO: 2454859 - RNA, 19 nt, Human
uauguaaaauaaaauuaug

SEQ ID NO: 2454860 - RNA, 10 nt, Human
uauguaaaug

SEQ ID NO: 2454861 - RNA, 14 nt, Human
uauguaaauguaua

SEQ ID NO: 2454862 - RNA, 13 nt, Human
uauguaaauguau

SEQ ID NO: 2454863 - RNA, 21 nt, Human
uauguaacaaaccugcacuua

SEQ ID NO: 2454864 - RNA, 13 nt, Human
uauguaaaugugc

SEQ ID NO: 2454865 - RNA, 19 nt, Human
uaugguguuucucccucuc

SEQ ID NO: 2454866 - RNA, 20 nt, Human
uauggcagaguuguaaauau

SEQ ID NO: 2454867 - RNA, 19 nt, Human
uauggcagaguuguaaaua

SEQ ID NO: 2454868 - RNA, 21 nt, Human
uauggcagaguuguaaauaua

SEQ ID NO: 2454869 - RNA, 21 nt, Human
uaugguugauaguuuaccuga

SEQ ID NO: 2454870 - RNA, 20 nt, Human
uaugguugauaguuuaccug

SEQ ID NO: 2454871 - RNA, 22 nt, Human
uaugguugauaguuuaccugaa

SEQ ID NO: 2454872 - RNA, 18 nt, Human
uauggcagaguuguaaau

SEQ ID NO: 2454873 - RNA, 17 nt, Human
uauggcagaguuguaaa

SEQ ID NO: 2454874 - RNA, 23 nt, Human
uauggcagaagacaccagagcag

SEQ ID NO: 2454875 - RNA, 22 nt, Human
uauggcagaagacaccagagca

SEQ ID NO: 2454876 - RNA, 16 nt, Human
uauggcagaagacacc

SEQ ID NO: 2454877 - RNA, 15 nt, Human
uauggcagaagacac

SEQ ID NO: 2454878 - RNA, 14 nt, Human
uauggcagaagaca

SEQ ID NO: 2454879 - RNA, 13 nt, Human
uauggcagaagac

SEQ ID NO: 2454880 - RNA, 12 nt, Human
uauggcagaaga

SEQ ID NO: 2454881 - RNA, 14 nt, Human
uauggcaaaaaugg

SEQ ID NO: 2454882 - RNA, 21 nt, Human
uauggauuuucuauuguuacu

SEQ ID NO: 2454883 - RNA, 15 nt, Human
gggaguggccacaga

SEQ ID NO: 2454884 - RNA, 13 nt, Human
gggaguggccaca

SEQ ID NO: 2454885 - RNA, 20 nt, Human
uauggaugauucagaaauug

SEQ ID NO: 2454886 - RNA, 11 nt, Human
uauggaugugg

SEQ ID NO: 2454887 - RNA, 19 nt, Human
uauggaugauucagaaauu

SEQ ID NO: 2454888 - RNA, 20 nt, Human
gggagugggacagagucugg

SEQ ID NO: 2454889 - RNA, 15 nt, Human
gggaguggaguggaa

SEQ ID NO: 2454890 - RNA, 21 nt, Human
gggaguggaauaguauccucc

SEQ ID NO: 2454891 - RNA, 17 nt, Human
gggaguggaguggaaga

SEQ ID NO: 2454892 - RNA, 18 nt, Human
gggagugggacagagucu

SEQ ID NO: 2454893 - RNA, 14 nt, Human
uauguagauaacaa

SEQ ID NO: 2454894 - RNA, 16 nt, Human
uauguacuugucaaag

SEQ ID NO: 2454895 - RNA, 19 nt, Human
uauguacuugucaaagaag

SEQ ID NO: 2454896 - RNA, 23 nt, Human
uauguagaaaaaaguaaauguga

SEQ ID NO: 2454897 - RNA, 15 nt, Human
uauguacuugucaaa

SEQ ID NO: 2454898 - RNA, 21 nt, Human
uauguacuccucuuuacacug

SEQ ID NO: 2454899 - RNA, 14 nt, Human
uauguaguaauuga

SEQ ID NO: 2454900 - RNA, 17 nt, Human
uauguaguaauugacau

SEQ ID NO: 2454901 - RNA, 20 nt, Human
uauguaguaauugacaugug

SEQ ID NO: 2454902 - RNA, 19 nt, Human
uauguagcagggaaaauau

SEQ ID NO: 2454903 - RNA, 21 nt, Human
uauguagcaggaaauaaagua

SEQ ID NO: 2454904 - RNA, 17 nt, Human
uauguagaugugcauuu

SEQ ID NO: 2454905 - RNA, 15 nt, Human
uauguagcaaaauac

SEQ ID NO: 2454906 - RNA, 12 nt, Human
uauguagaugug

SEQ ID NO: 2454907 - RNA, 16 nt, Human
uauguagaugugcauu

SEQ ID NO: 2454908 - RNA, 13 nt, Human
uauguauguuuac

SEQ ID NO: 2454909 - RNA, 13 nt, Human
uauguaugugugu

SEQ ID NO: 2454910 - RNA, 14 nt, Human
uauguaugugugua

SEQ ID NO: 2454911 - RNA, 17 nt, Human
uauguauguguguaugg

SEQ ID NO: 2454912 - RNA, 16 nt, Human
uauguaugugaaaguu

SEQ ID NO: 2454913 - RNA, 18 nt, Human
uauguaguccgugcugac

SEQ ID NO: 2454914 - RNA, 15 nt, Human
uauguauaauucaaa

SEQ ID NO: 2454915 - RNA, 19 nt, Human
uauguauauuuaaaagaaa

SEQ ID NO: 2454916 - RNA, 20 nt, Human
uauguauggaauacaguguu

SEQ ID NO: 2454917 - RNA, 17 nt, Human
uauguacuucaugcugu

SEQ ID NO: 2454918 - RNA, 13 nt, Human
uauguacuucaug

SEQ ID NO: 2454919 - RNA, 16 nt, Human
uauguaccauguacau

SEQ ID NO: 2454920 - RNA, 16 nt, Human
uauguacguuuguaug

SEQ ID NO: 2454921 - RNA, 22 nt, Human
uauguacguuuguaugugugua

SEQ ID NO: 2454922 - RNA, 21 nt, Human
uauguacguuuguaugugugu

SEQ ID NO: 2454923 - RNA, 19 nt, Human
uauguacguuuguaugugu

SEQ ID NO: 2454924 - RNA, 18 nt, Human
uauguacguuuguaugug

SEQ ID NO: 2454925 - RNA, 20 nt, Human
uauguacuccucuuuacacu

SEQ ID NO: 2454926 - RNA, 11 nt, Human
uauguaacaug

SEQ ID NO: 2454927 - RNA, 12 nt, Human
uauguaacaugu

SEQ ID NO: 2454928 - RNA, 14 nt, Human
uauguaacugcauu

SEQ ID NO: 2454929 - RNA, 24 nt, Human
uauguaacugcauugagaacugca

SEQ ID NO: 2454930 - RNA, 13 nt, Human
uauguaaucuaug

SEQ ID NO: 2454931 - RNA, 16 nt, Human
uauguaagagcaccuu

SEQ ID NO: 2454932 - RNA, 15 nt, Human
uauguaagagcaccu

SEQ ID NO: 2454933 - RNA, 15 nt, Human
uauguaauaauguga

SEQ ID NO: 2454934 - RNA, 16 nt, Human
uauguaauaaugugaa

SEQ ID NO: 2454935 - RNA, 15 nt, Human
uauguacaugagaag

SEQ ID NO: 2454936 - RNA, 14 nt, Human
uauguacaaguguu

SEQ ID NO: 2454937 - RNA, 18 nt, Human
uauguuuauuuacuaauu

SEQ ID NO: 2454938 - RNA, 18 nt, Human
uauguuuauauaaaugcu

SEQ ID NO: 2454939 - RNA, 18 nt, Human
uauguuuaccuuuuaauu

SEQ ID NO: 2454940 - RNA, 20 nt, Human
uauguugcccaggcaggucu

SEQ ID NO: 2454941 - RNA, 15 nt, Human
uauguugaugaaaaa

SEQ ID NO: 2454942 - RNA, 12 nt, Human
uauguuuacaaa

SEQ ID NO: 2454943 - RNA, 14 nt, Human
uauguuuacauauc

SEQ ID NO: 2454944 - RNA, 19 nt, Human
uauguugcccaggcagguc

SEQ ID NO: 2454945 - RNA, 16 nt, Human
uauguugcccaggcag

SEQ ID NO: 2454946 - RNA, 16 nt, Human
uauguugcauagaaua

SEQ ID NO: 2454947 - RNA, 13 nt, Human
uauguugcccagg

SEQ ID NO: 2454948 - RNA, 17 nt, Human
uauguauguuuacauau

SEQ ID NO: 2454949 - RNA, 16 nt, Human
uauguauguuuacaua

SEQ ID NO: 2454950 - RNA, 19 nt, Human
uauguauuaauauucauug

SEQ ID NO: 2454951 - RNA, 22 nt, Human
uauguauuguaaacauguguuu

SEQ ID NO: 2454952 - RNA, 20 nt, Human
uauguauuguaaacaugugu

SEQ ID NO: 2454953 - RNA, 18 nt, Human
uauguauuguaaacaugu

SEQ ID NO: 2454954 - RNA, 12 nt, Human
uauguauuuaua

SEQ ID NO: 2454955 - RNA, 14 nt, Human
uaugucaaagcagg

SEQ ID NO: 2454956 - RNA, 18 nt, Human
uauguugaauacuuuuua

SEQ ID NO: 2454957 - RNA, 16 nt, Human
uaugucauuucauuuc

SEQ ID NO: 2454958 - RNA, 23 nt, Human
uaugucauuuccuucaaggcauc

SEQ ID NO: 2454959 - RNA, 15 nt, Human
uaugucaucauacau

SEQ ID NO: 2454960 - RNA, 19 nt, Human
uaugucaucauacaugacu

SEQ ID NO: 2454961 - RNA, 12 nt, Human
uauguugcauag

SEQ ID NO: 2454962 - RNA, 14 nt, Human
uauguugauaaaag

SEQ ID NO: 2454963 - RNA, 24 nt, Human
uauuaagaaagacuaucuaaaugu

SEQ ID NO: 2454964 - RNA, 16 nt, Human
uauuaagaaugaaaua

SEQ ID NO: 2454965 - RNA, 22 nt, Human
uauuaagaggcagaaaauugca

SEQ ID NO: 2454966 - RNA, 13 nt, Human
uauuaagaaugaa

SEQ ID NO: 2454967 - RNA, 14 nt, Human
uauuaagagugaaa

SEQ ID NO: 2454968 - RNA, 13 nt, Human
uauuaagauggau

SEQ ID NO: 2454969 - RNA, 15 nt, Human
uauuaagauggauuc

SEQ ID NO: 2454970 - RNA, 12 nt, Human
uauuaaauuaug

SEQ ID NO: 2454971 - RNA, 22 nt, Human
uauguuugccacuuugcaaagg

SEQ ID NO: 2454972 - RNA, 14 nt, Human
uauguuugcacacu

SEQ ID NO: 2454973 - RNA, 19 nt, Human
uauguuugcacacuugugu

SEQ ID NO: 2454974 - RNA, 21 nt, Human
uauuaaauuaaauuuuguguc

SEQ ID NO: 2454975 - RNA, 19 nt, Human
uauuaaauuaaauuuugug

SEQ ID NO: 2454976 - RNA, 12 nt, Human
uauuaaugcacu

SEQ ID NO: 2454977 - RNA, 13 nt, Human
uauuaaugaaaau

SEQ ID NO: 2454978 - RNA, 20 nt, Human
uauuaaugcacuuucuaucc

SEQ ID NO: 2454979 - RNA, 17 nt, Human
uauuaaugcacuuucua

SEQ ID NO: 2454980 - RNA, 14 nt, Human
uauuaaugcacuuu

SEQ ID NO: 2454981 - RNA, 13 nt, Human
uauuaaugcacuu

SEQ ID NO: 2454982 - RNA, 22 nt, Human
uauuaaugccuuuaaaguauga

SEQ ID NO: 2454983 - RNA, 14 nt, Human
uauuaaugccuuua

SEQ ID NO: 2454984 - RNA, 13 nt, Human
uauuaaugccuuu

SEQ ID NO: 2454985 - RNA, 23 nt, Human
uauuaaugccuuuaaaguaugaa

SEQ ID NO: 2454986 - RNA, 15 nt, Human
uauuaauauuuuaau

SEQ ID NO: 2454987 - RNA, 17 nt, Human
uauuaauauucauugua

SEQ ID NO: 2454988 - RNA, 20 nt, Human
uauuaauauucauuguauaa

SEQ ID NO: 2454989 - RNA, 16 nt, Human
uauuaagauggauucu

SEQ ID NO: 2454990 - RNA, 18 nt, Human
uauuaagauggauucuca

SEQ ID NO: 2454991 - RNA, 19 nt, Human
uauuaagauggauucucag

SEQ ID NO: 2454992 - RNA, 20 nt, Human
uauuaagauggauucucaga

SEQ ID NO: 2454993 - RNA, 21 nt, Human
uauuaagauggauucucagau

SEQ ID NO: 2454994 - RNA, 20 nt, Human
uauuaauauauaucugcugu

SEQ ID NO: 2454995 - RNA, 18 nt, Human
uauuaauauauaucugcu

SEQ ID NO: 2454996 - RNA, 17 nt, Human
uauuaauagcugccuua

SEQ ID NO: 2454997 - RNA, 20 nt, Human
ucaacgcuuaaaggugucuu

SEQ ID NO: 2454998 - RNA, 19 nt, Human
ucaacgcuuaaaggugucu

SEQ ID NO: 2454999 - RNA, 18 nt, Human
ucaaccuugagacagcuu

SEQ ID NO: 2455000 - RNA, 18 nt, Human
ucaacgcagcccugcuuu

SEQ ID NO: 2455001 - RNA, 15 nt, Human
ucaacgcagcccugc

SEQ ID NO: 2455002 - RNA, 14 nt, Human
ucaacgcagcccug

SEQ ID NO: 2455003 - RNA, 13 nt, Human
ucaacccuggaga

SEQ ID NO: 2455004 - RNA, 18 nt, Human
ucaacccucucaggugac

SEQ ID NO: 2455005 - RNA, 14 nt, Human
ucaacccuggagag

SEQ ID NO: 2455006 - RNA, 15 nt, Human
ucaaccugugaugag

SEQ ID NO: 2455007 - RNA, 18 nt, Human
ucaaccugggcaaagccu

SEQ ID NO: 2455008 - RNA, 17 nt, Human
ucaaccuugagacagcu

SEQ ID NO: 2455009 - RNA, 16 nt, Human
ucaaccuugagacagc

SEQ ID NO: 2455010 - RNA, 20 nt, Human
ucaaccugugaugaggggag

SEQ ID NO: 2455011 - RNA, 20 nt, Human
ucaagugauucuccugccuc

SEQ ID NO: 2455012 - RNA, 18 nt, Human
ucaagugauucuccugcc

SEQ ID NO: 2455013 - RNA, 21 nt, Human
ucaagugauucuccugccuca

SEQ ID NO: 2455014 - RNA, 17 nt, Human
ucaaguuauuguacagc

SEQ ID NO: 2455015 - RNA, 13 nt, Human
ucaaguuauugua

SEQ ID NO: 2455016 - RNA, 22 nt, Human
ucaacgcuuaaaggugucuucc

SEQ ID NO: 2455017 - RNA, 21 nt, Human
ucaaguuauugacaaacucuc

SEQ ID NO: 2455018 - RNA, 19 nt, Human
ucaagugauucuccugccu

SEQ ID NO: 2455019 - RNA, 16 nt, Human
ucaaguuccuuugggu

SEQ ID NO: 2455020 - RNA, 14 nt, Human
ucaaguuccuuugg

SEQ ID NO: 2455021 - RNA, 21 nt, Human
ucaauaaaauccauacauuug

SEQ ID NO: 2455022 - RNA, 14 nt, Human
ucaaguugugcuug

SEQ ID NO: 2455023 - RNA, 13 nt, Human
ucaaguugugcuu

SEQ ID NO: 2455024 - RNA, 23 nt, Human
ucaauaaacgauuuaauucucuu

SEQ ID NO: 2455025 - RNA, 22 nt, Human
ucaauaaacgauuuaauucucu

SEQ ID NO: 2455026 - RNA, 18 nt, Human
ucaauaaacgauuuaauu

SEQ ID NO: 2455027 - RNA, 17 nt, Human
ucaauaaacgauuuaau

SEQ ID NO: 2455028 - RNA, 12 nt, Human
ucaauaaagcau

SEQ ID NO: 2455029 - RNA, 13 nt, Human
ucaauaaacgauu

SEQ ID NO: 2455030 - RNA, 15 nt, Human
ucaauaaacgauuua

SEQ ID NO: 2455031 - RNA, 23 nt, Human
ucaauaaaaugugauuuuucuga

SEQ ID NO: 2455032 - RNA, 19 nt, Human
ucaauaaaaugugauuuuu

SEQ ID NO: 2455033 - RNA, 22 nt, Human
ucaauaaaaugugauuuuucug

SEQ ID NO: 2455034 - RNA, 14 nt, Human
ucaauaaaauguga

SEQ ID NO: 2455035 - RNA, 15 nt, Human
ucaauaaaaugugau

SEQ ID NO: 2455036 - RNA, 16 nt, Human
ucaauaaaaugugauu

SEQ ID NO: 2455037 - RNA, 18 nt, Human
ucaauaaaaugugauuuu

SEQ ID NO: 2455038 - RNA, 16 nt, Human
ucaaguuuuucagaaa

SEQ ID NO: 2455039 - RNA, 22 nt, Human
ucaaguugugcuuguuuacagc

SEQ ID NO: 2455040 - RNA, 17 nt, Human
ucaaguugugcuuguuu

SEQ ID NO: 2455041 - RNA, 13 nt, Human
ucaauaaaaugug

SEQ ID NO: 2455042 - RNA, 15 nt, Human
ucaauaaaugguaua

SEQ ID NO: 2455043 - RNA, 15 nt, Human
ucaauaaaugucugu

SEQ ID NO: 2455044 - RNA, 22 nt, Human
ucaauaaaguauuuaauuagug

SEQ ID NO: 2455045 - RNA, 20 nt, Human
ucaauaaaguauuuaauuag

SEQ ID NO: 2455046 - RNA, 17 nt, Human
ucaauaaaguaucuaca

SEQ ID NO: 2455047 - RNA, 18 nt, Human
ucaauaaaguauuuaauu

SEQ ID NO: 2455048 - RNA, 17 nt, Human
ucaauaaaguauuuaau

SEQ ID NO: 2455049 - RNA, 16 nt, Human
ucaauaaaguauuuaa

SEQ ID NO: 2455050 - RNA, 15 nt, Human
ucaauaaaguauuua

SEQ ID NO: 2455051 - RNA, 11 nt, Human
ucaauaaagua

SEQ ID NO: 2455052 - RNA, 15 nt, Human
ucaauaaagcauuua

SEQ ID NO: 2455053 - RNA, 19 nt, Human
ucaauaaagcauuuauaaa

SEQ ID NO: 2455054 - RNA, 14 nt, Human
ucaauaaaguauuu

SEQ ID NO: 2455055 - RNA, 12 nt, Human
ucaauaaaguau

SEQ ID NO: 2455056 - RNA, 13 nt, Human
ucaauaaaguauc

SEQ ID NO: 2455057 - RNA, 16 nt, Human
ucaauaaaugucuguu

SEQ ID NO: 2455058 - RNA, 18 nt, Human
ucaauaauauauuuucug

SEQ ID NO: 2455059 - RNA, 15 nt, Human
ucaauaauauauuuu

SEQ ID NO: 2455060 - RNA, 14 nt, Human
ucaauaagccuugu

SEQ ID NO: 2455061 - RNA, 13 nt, Human
ucaaugcagcccc

SEQ ID NO: 2455062 - RNA, 20 nt, Human
ucaauaauauauuuucuguu

SEQ ID NO: 2455063 - RNA, 19 nt, Human
ucaauaauauauuuucugu

SEQ ID NO: 2455064 - RNA, 18 nt, Human
ucaauacacuaguuguuu

SEQ ID NO: 2455065 - RNA, 14 nt, Human
ucaauacacuaguu

SEQ ID NO: 2455066 - RNA, 20 nt, Human
ucaauaagcaucaaacucuu

SEQ ID NO: 2455067 - RNA, 23 nt, Human
ucaauuacaggaaguacuggaga

SEQ ID NO: 2455068 - RNA, 21 nt, Human
ucaauuacaggaaguacugga

SEQ ID NO: 2455069 - RNA, 18 nt, Human
ucaauguggugaugaaau

SEQ ID NO: 2455070 - RNA, 21 nt, Human
ucaaugugauucuaaugucuu

SEQ ID NO: 2455071 - RNA, 18 nt, Human
ucaaugugauucuaaugu

SEQ ID NO: 2455072 - RNA, 17 nt, Human
ucaaugugauucuaaug

SEQ ID NO: 2455073 - RNA, 16 nt, Human
ucaaugugauucuaau

SEQ ID NO: 2455074 - RNA, 13 nt, Human
ucaaugugcagug

SEQ ID NO: 2455075 - RNA, 22 nt, Human
ucaaugugauucuaaugucuuc

SEQ ID NO: 2455076 - RNA, 11 nt, Human
ucaauguucau

SEQ ID NO: 2455077 - RNA, 12 nt, Human
ucaauguucauu

SEQ ID NO: 2455078 - RNA, 13 nt, Human
ucaauguucauug

SEQ ID NO: 2455079 - RNA, 14 nt, Human
ucaauguucauugu

SEQ ID NO: 2455080 - RNA, 19 nt, Human
ucaaugguuugcaaggaag

SEQ ID NO: 2455081 - RNA, 18 nt, Human
ucaaugguuugcaaggaa

SEQ ID NO: 2455082 - RNA, 17 nt, Human
ucaaugguuugcaagga

SEQ ID NO: 2455083 - RNA, 11 nt, Human
ucaaugucacu

SEQ ID NO: 2455084 - RNA, 15 nt, Human
ucaaugucaaguacc

SEQ ID NO: 2455085 - RNA, 15 nt, Human
ucaaugugauucuaa

SEQ ID NO: 2455086 - RNA, 15 nt, Human
ucaaugugaaucaga

SEQ ID NO: 2455087 - RNA, 14 nt, Human
ucaccaaggcugau

SEQ ID NO: 2455088 - RNA, 17 nt, Human
ucaccaaaguauuuuuu

SEQ ID NO: 2455089 - RNA, 13 nt, Human
ucacaguguguuu

SEQ ID NO: 2455090 - RNA, 19 nt, Human
ucaccaaaucagcugcuac

SEQ ID NO: 2455091 - RNA, 20 nt, Human
ucaccaaaucagcugcuacu

SEQ ID NO: 2455092 - RNA, 19 nt, Human
ucaccagaggaaucacucu

SEQ ID NO: 2455093 - RNA, 15 nt, Human
ucaccagauuugcua

SEQ ID NO: 2455094 - RNA, 19 nt, Human
ucaccagcaccaacaccac

SEQ ID NO: 2455095 - RNA, 13 nt, Human
ucaccagcaccaa

SEQ ID NO: 2455096 - RNA, 21 nt, Human
ucaccagauuugcuaauuuau

SEQ ID NO: 2455097 - RNA, 18 nt, Human
ucaccagaggaaucacuc

SEQ ID NO: 2455098 - RNA, 16 nt, Human
ucaccagagagggacu

SEQ ID NO: 2455099 - RNA, 20 nt, Human
ucaccacaugcggagaacaa

SEQ ID NO: 2455100 - RNA, 23 nt, Human
ucaccacaccaaaccucucuuau

SEQ ID NO: 2455101 - RNA, 21 nt, Human
ucaccacaguaaguuccuacu

SEQ ID NO: 2455102 - RNA, 19 nt, Human
ucaccacaguaaguuccua

SEQ ID NO: 2455103 - RNA, 18 nt, Human
ucaccacaguaaguuccu

SEQ ID NO: 2455104 - RNA, 12 nt, Human
ucaccaagcuca

SEQ ID NO: 2455105 - RNA, 16 nt, Human
ucaccaagcucacagu

SEQ ID NO: 2455106 - RNA, 20 nt, Human
ucaccaagcucacaguuccu

SEQ ID NO: 2455107 - RNA, 21 nt, Human
ucaccaagcucacaguuccuc

SEQ ID NO: 2455108 - RNA, 22 nt, Human
ucaccaagcucacaguuccucg

SEQ ID NO: 2455109 - RNA, 13 nt, Human
ucacagugcugag

SEQ ID NO: 2455110 - RNA, 17 nt, Human
ucacauuuauucugcuc

SEQ ID NO: 2455111 - RNA, 13 nt, Human
ucacagucucaca

SEQ ID NO: 2455112 - RNA, 21 nt, Human
ucacagucuaauuuuuauuca

SEQ ID NO: 2455113 - RNA, 16 nt, Human
ucacagucuaauuuuu

SEQ ID NO: 2455114 - RNA, 15 nt, Human
ucacagucuaauuuu

SEQ ID NO: 2455115 - RNA, 20 nt, Human
ucacaccugacucugaaauc

SEQ ID NO: 2455116 - RNA, 19 nt, Human
ucacaccugacucugaaau

SEQ ID NO: 2455117 - RNA, 18 nt, Human
ucacagucucuuuaaucu

SEQ ID NO: 2455118 - RNA, 19 nt, Human
ucacagucucuuuaaucuu

SEQ ID NO: 2455119 - RNA, 21 nt, Human
ucacagucucuuuaaucuuca

SEQ ID NO: 2455120 - RNA, 23 nt, Human
ucacagucucuuuaaucuucagu

SEQ ID NO: 2455121 - RNA, 14 nt, Human
ucacauuuuccuuu

SEQ ID NO: 2455122 - RNA, 16 nt, Human
ucacauuuuccuuuuc

SEQ ID NO: 2455123 - RNA, 17 nt, Human
ucacauuuuccuuuuca

SEQ ID NO: 2455124 - RNA, 18 nt, Human
ucacauuuuccuuuucaa

SEQ ID NO: 2455125 - RNA, 11 nt, Human
ucacauuuucc

SEQ ID NO: 2455126 - RNA, 18 nt, Human
ucacagugggagccaggg

SEQ ID NO: 2455127 - RNA, 17 nt, Human
ucacagugggagccagg

SEQ ID NO: 2455128 - RNA, 19 nt, Human
ucacauuuauucugcucac

SEQ ID NO: 2455129 - RNA, 18 nt, Human
ucacauuuauucugcuca

SEQ ID NO: 2455130 - RNA, 16 nt, Human
ucacagucacauucca

SEQ ID NO: 2455131 - RNA, 19 nt, Human
ucacaguccuuaccagcag

SEQ ID NO: 2455132 - RNA, 23 nt, Human
ucacaguccuuaccagcagagca

SEQ ID NO: 2455133 - RNA, 22 nt, Human
ucacaguccuuaccagcagagc

SEQ ID NO: 2455134 - RNA, 18 nt, Human
ucacaccugacucugaaa

SEQ ID NO: 2455135 - RNA, 17 nt, Human
ucacaccugacucugaa

SEQ ID NO: 2455136 - RNA, 13 nt, Human
ucacaccugacuc

SEQ ID NO: 2455137 - RNA, 18 nt, Human
ucacaggcagguccaggg

SEQ ID NO: 2455138 - RNA, 17 nt, Human
ucacaggcagguccagg

SEQ ID NO: 2455139 - RNA, 16 nt, Human
ucacaggcagguccag

SEQ ID NO: 2455140 - RNA, 17 nt, Human
ucacaagacccaaaagg

SEQ ID NO: 2455141 - RNA, 18 nt, Human
ucacaagacccaaaaggc

SEQ ID NO: 2455142 - RNA, 13 nt, Human
ucacaagacccaa

SEQ ID NO: 2455143 - RNA, 20 nt, Human
ucaauuacaggaaguacugg

SEQ ID NO: 2455144 - RNA, 13 nt, Human
ucaauuacugguc

SEQ ID NO: 2455145 - RNA, 16 nt, Human
ucaauuacugguccaa

SEQ ID NO: 2455146 - RNA, 15 nt, Human
ucacaagaagaccag

SEQ ID NO: 2455147 - RNA, 11 nt, Human
ucacacccacc

SEQ ID NO: 2455148 - RNA, 21 nt, Human
ucacacccaccguccgcccug

SEQ ID NO: 2455149 - RNA, 20 nt, Human
ucacacccaccguccgcccu

SEQ ID NO: 2455150 - RNA, 15 nt, Human
ucacacccaccgucc

SEQ ID NO: 2455151 - RNA, 23 nt, Human
ucacaccaggcuugccugcaggc

SEQ ID NO: 2455152 - RNA, 23 nt, Human
ucacacccaccguccgcccugcu

SEQ ID NO: 2455153 - RNA, 22 nt, Human
ucacacccaccguccgcccugc

SEQ ID NO: 2455154 - RNA, 24 nt, Human
ucacacccaccguccgcccugcuc

SEQ ID NO: 2455155 - RNA, 23 nt, Human
ucacaccccagacgaugucuuca

SEQ ID NO: 2455156 - RNA, 15 nt, Human
ucacaccuagcguca

SEQ ID NO: 2455157 - RNA, 20 nt, Human
ucacaccuagcgucaguauu

SEQ ID NO: 2455158 - RNA, 12 nt, Human
ucacaccugacu

SEQ ID NO: 2455159 - RNA, 14 nt, Human
uauuuuuucccaaa

SEQ ID NO: 2455160 - RNA, 15 nt, Human
uauuuuuucagaccg

SEQ ID NO: 2455161 - RNA, 13 nt, Human
uauuuuuucccaa

SEQ ID NO: 2455162 - RNA, 14 nt, Human
uauuuuuucagacc

SEQ ID NO: 2455163 - RNA, 21 nt, Human
uauuuucugugccugaauauu

SEQ ID NO: 2455164 - RNA, 22 nt, Human
uauuuucugguagauagaaaua

SEQ ID NO: 2455165 - RNA, 22 nt, Human
uauuuuuugaggcuaugaauau

SEQ ID NO: 2455166 - RNA, 19 nt, Human
uauuuuuuuaagcuguaaa

SEQ ID NO: 2455167 - RNA, 15 nt, Human
uauuuuuuuaagcgu

SEQ ID NO: 2455168 - RNA, 15 nt, Human
uauuuucuacagugg

SEQ ID NO: 2455169 - RNA, 14 nt, Human
uauuuuccuguaaa

SEQ ID NO: 2455170 - RNA, 14 nt, Human
uauuuucuacagug

SEQ ID NO: 2455171 - RNA, 20 nt, Human
uauuuucugguagauagaaa

SEQ ID NO: 2455172 - RNA, 15 nt, Human
uauuuuccuccccag

SEQ ID NO: 2455173 - RNA, 16 nt, Human
uauuuuccuccccagc

SEQ ID NO: 2455174 - RNA, 12 nt, Human
uauuuuccuccc

SEQ ID NO: 2455175 - RNA, 22 nt, Human
uauuuucccuauuagagaagag

SEQ ID NO: 2455176 - RNA, 17 nt, Human
uauuuuuuucugauugu

SEQ ID NO: 2455177 - RNA, 15 nt, Human
uauuuuuuucugauu

SEQ ID NO: 2455178 - RNA, 20 nt, Human
uauuuuuuuaagcuguaaaa

SEQ ID NO: 2455179 - RNA, 22 nt, Human
uauuuuuuucugaauuauuuuc

SEQ ID NO: 2455180 - RNA, 14 nt, Human
uauuuuuuuacuaa

SEQ ID NO: 2455181 - RNA, 17 nt, Human
uauuuuuuucuuuucuu

SEQ ID NO: 2455182 - RNA, 17 nt, Human
uauuuuuuuuaaguauu

SEQ ID NO: 2455183 - RNA, 16 nt, Human
uauuuuuuugcaagug

SEQ ID NO: 2455184 - RNA, 13 nt, Human
uauuuuuuugcaa

SEQ ID NO: 2455185 - RNA, 18 nt, Human
uauuuuuuucugauugua

SEQ ID NO: 2455186 - RNA, 20 nt, Human
ucaaaaaaaaaaaaaugcac

SEQ ID NO: 2455187 - RNA, 19 nt, Human
ucaaaaaaaaaaaaaugca

SEQ ID NO: 2455188 - RNA, 19 nt, Human
uauuuuuuuuucuaagaga

SEQ ID NO: 2455189 - RNA, 16 nt, Human
uauuuuuuuuucuaag

SEQ ID NO: 2455190 - RNA, 14 nt, Human
uauuuuuuuucugu

SEQ ID NO: 2455191 - RNA, 19 nt, Human
uauuuuuuugcaagugaag

SEQ ID NO: 2455192 - RNA, 17 nt, Human
uauuuuuuugcaaguga

SEQ ID NO: 2455193 - RNA, 14 nt, Human
ucaaaaaaagaaaa

SEQ ID NO: 2455194 - RNA, 15 nt, Human
ucaaaaaaagaaaaa

SEQ ID NO: 2455195 - RNA, 17 nt, Human
uauuuuauguugcauag

SEQ ID NO: 2455196 - RNA, 16 nt, Human
uauuuauauauguauu

SEQ ID NO: 2455197 - RNA, 14 nt, Human
uauuuauauauauu

SEQ ID NO: 2455198 - RNA, 23 nt, Human
uauuuauauauguauuuauaaau

SEQ ID NO: 2455199 - RNA, 20 nt, Human
uauuuauauauugguaacau

SEQ ID NO: 2455200 - RNA, 21 nt, Human
uauuuuauuacaucuuucaca

SEQ ID NO: 2455201 - RNA, 15 nt, Human
uauuuauaaaacuuc

SEQ ID NO: 2455202 - RNA, 23 nt, Human
uauuuauaacucaucauaaaaua

SEQ ID NO: 2455203 - RNA, 21 nt, Human
uauuuauaacucaucauaaaa

SEQ ID NO: 2455204 - RNA, 22 nt, Human
uauuuauaacucaucauaaaau

SEQ ID NO: 2455205 - RNA, 20 nt, Human
uauuuauaacaaccuaaauu

SEQ ID NO: 2455206 - RNA, 19 nt, Human
uauuuauaacaaccuaaau

SEQ ID NO: 2455207 - RNA, 13 nt, Human
uauuuauaacuca

SEQ ID NO: 2455208 - RNA, 20 nt, Human
uauuuauaacucaucauaaa

SEQ ID NO: 2455209 - RNA, 17 nt, Human
uauuuauaaucacuuuu

SEQ ID NO: 2455210 - RNA, 14 nt, Human
uauuuauaagcaga

SEQ ID NO: 2455211 - RNA, 17 nt, Human
uauuuauaagcagauuu

SEQ ID NO: 2455212 - RNA, 17 nt, Human
uauuuauaauacauuuc

SEQ ID NO: 2455213 - RNA, 18 nt, Human
uauuuauagcaauccaug

SEQ ID NO: 2455214 - RNA, 13 nt, Human
uauuuauauaaau

SEQ ID NO: 2455215 - RNA, 14 nt, Human
uauuuuauuaugca

SEQ ID NO: 2455216 - RNA, 17 nt, Human
uauuuuauuaugcauga

SEQ ID NO: 2455217 - RNA, 17 nt, Human
uauuuuauuuagacaag

SEQ ID NO: 2455218 - RNA, 23 nt, Human
uauuuuauuguaacagacauugu

SEQ ID NO: 2455219 - RNA, 19 nt, Human
uauuuuauuguaacagaca

SEQ ID NO: 2455220 - RNA, 18 nt, Human
uauuuuauuguaacagac

SEQ ID NO: 2455221 - RNA, 20 nt, Human
uauuuuauuuagacaagaga

SEQ ID NO: 2455222 - RNA, 13 nt, Human
uauuuuauucccu

SEQ ID NO: 2455223 - RNA, 17 nt, Human
uauuuuauuguaacaga

SEQ ID NO: 2455224 - RNA, 16 nt, Human
uauuuuauuguaacag

SEQ ID NO: 2455225 - RNA, 19 nt, Human
uauuuuauucccuuucaca

SEQ ID NO: 2455226 - RNA, 16 nt, Human
uauuuucauuguaaaa

SEQ ID NO: 2455227 - RNA, 15 nt, Human
uauuuucauuguaaa

SEQ ID NO: 2455228 - RNA, 13 nt, Human
uauuuucauugua

SEQ ID NO: 2455229 - RNA, 17 nt, Human
uauuuuauuuuuuucua

SEQ ID NO: 2455230 - RNA, 22 nt, Human
uauuuucaaauuguaucuagug

SEQ ID NO: 2455231 - RNA, 19 nt, Human
uauuuuccaagugugcaua

SEQ ID NO: 2455232 - RNA, 15 nt, Human
uauuuuccaagugug

SEQ ID NO: 2455233 - RNA, 14 nt, Human
uauuuuccaagugu

SEQ ID NO: 2455234 - RNA, 22 nt, Human
uauuuuccaaaaguggccucuu

SEQ ID NO: 2455235 - RNA, 16 nt, Human
uauuuuccaugaaaau

SEQ ID NO: 2455236 - RNA, 18 nt, Human
uauuuucccccuuuucug

SEQ ID NO: 2455237 - RNA, 24 nt, Human
uauuuuccaagugugcauauugua

SEQ ID NO: 2455238 - RNA, 22 nt, Human
uauuuuccaagugugcauauug

SEQ ID NO: 2455239 - RNA, 20 nt, Human
uauuuuccaugaaaaugcaa

SEQ ID NO: 2455240 - RNA, 15 nt, Human
ucaaaugacccaaag

SEQ ID NO: 2455241 - RNA, 15 nt, Human
ucaaauccauccaga

SEQ ID NO: 2455242 - RNA, 16 nt, Human
ucaaaugacccaaaga

SEQ ID NO: 2455243 - RNA, 19 nt, Human
ucaaaugacccaaagacca

SEQ ID NO: 2455244 - RNA, 17 nt, Human
ucaaaugacccaaagac

SEQ ID NO: 2455245 - RNA, 21 nt, Human
ucaaaugacccaaagaccaau

SEQ ID NO: 2455246 - RNA, 14 nt, Human
ucaaaugcucagac

SEQ ID NO: 2455247 - RNA, 19 nt, Human
ucaaaugcucagaccagcu

SEQ ID NO: 2455248 - RNA, 22 nt, Human
ucaaauuagaagacauuuauac

SEQ ID NO: 2455249 - RNA, 17 nt, Human
ucaaauuagaagacauu

SEQ ID NO: 2455250 - RNA, 20 nt, Human
ucaaauucauuuuuuucacu

SEQ ID NO: 2455251 - RNA, 14 nt, Human
ucaaauucuucuga

SEQ ID NO: 2455252 - RNA, 15 nt, Human
ucaaauucuucugaa

SEQ ID NO: 2455253 - RNA, 23 nt, Human
ucaaauuaaucuuucuuuaccug

SEQ ID NO: 2455254 - RNA, 16 nt, Human
ucaaauuagaagacau

SEQ ID NO: 2455255 - RNA, 15 nt, Human
ucaaauuagaagaca

SEQ ID NO: 2455256 - RNA, 18 nt, Human
ucaaauggggccagaucc

SEQ ID NO: 2455257 - RNA, 17 nt, Human
ucaaauuaauaaucuua

SEQ ID NO: 2455258 - RNA, 22 nt, Human
ucaaauuaauaaucuuauuagg

SEQ ID NO: 2455259 - RNA, 12 nt, Human
ucaaauuaauaa

SEQ ID NO: 2455260 - RNA, 17 nt, Human
ucaaauggaagacacau

SEQ ID NO: 2455261 - RNA, 23 nt, Human
ucaaauggaaaggagaggaaaga

SEQ ID NO: 2455262 - RNA, 20 nt, Human
ucaaauggaagacacauuga

SEQ ID NO: 2455263 - RNA, 15 nt, Human
ucaaauggaaaggag

SEQ ID NO: 2455264 - RNA, 21 nt, Human
ucaaaugcuuggcuucucaua

SEQ ID NO: 2455265 - RNA, 21 nt, Human
ucaaaugcucagaccagcucu

SEQ ID NO: 2455266 - RNA, 20 nt, Human
ucaaauuguaagcaugcaca

SEQ ID NO: 2455267 - RNA, 17 nt, Human
ucaaauuguaagcaugc

SEQ ID NO: 2455268 - RNA, 14 nt, Human
ucaaauugugugaa

SEQ ID NO: 2455269 - RNA, 16 nt, Human
ucaaauucuucugaac

SEQ ID NO: 2455270 - RNA, 21 nt, Human
ucaaauucuucugaacucaaa

SEQ ID NO: 2455271 - RNA, 16 nt, Human
ucaaauucucaaccua

SEQ ID NO: 2455272 - RNA, 16 nt, Human
ucaaauugagagaaug

SEQ ID NO: 2455273 - RNA, 12 nt, Human
ucaaauuguauc

SEQ ID NO: 2455274 - RNA, 14 nt, Human
ucaaauuguaucua

SEQ ID NO: 2455275 - RNA, 23 nt, Human
ucaaccccuucgcuccugugucu

SEQ ID NO: 2455276 - RNA, 14 nt, Human
ucaacccucccuca

SEQ ID NO: 2455277 - RNA, 15 nt, Human
ucaacccucccucag

SEQ ID NO: 2455278 - RNA, 17 nt, Human
ucaacccucccucagcc

SEQ ID NO: 2455279 - RNA, 18 nt, Human
ucaacccucccucagccc

SEQ ID NO: 2455280 - RNA, 19 nt, Human
ucaacccucccucagcccc

SEQ ID NO: 2455281 - RNA, 20 nt, Human
ucaacccucccucagccccu

SEQ ID NO: 2455282 - RNA, 21 nt, Human
ucaacccucccucagccccuc

SEQ ID NO: 2455283 - RNA, 23 nt, Human
ucaacccucccucagccccucuu

SEQ ID NO: 2455284 - RNA, 13 nt, Human
ucaaauuguaucu

SEQ ID NO: 2455285 - RNA, 18 nt, Human
ucaacccuaaaaagcaga

SEQ ID NO: 2455286 - RNA, 22 nt, Human
ucaacccuaaaaagcagagcuu

SEQ ID NO: 2455287 - RNA, 23 nt, Human
ucaacccuaaaaagcagagcuuu

SEQ ID NO: 2455288 - RNA, 14 nt, Human
ucaaauaugcaaag

SEQ ID NO: 2455289 - RNA, 20 nt, Human
ucaaaucaagaaacuuaagg

SEQ ID NO: 2455290 - RNA, 14 nt, Human
ucaaaucagucagu

SEQ ID NO: 2455291 - RNA, 19 nt, Human
ucaaauauuagaugugauu

SEQ ID NO: 2455292 - RNA, 24 nt, Human
ucaaaucagucagugcaaauguca

SEQ ID NO: 2455293 - RNA, 15 nt, Human
ucaaaucagucagug

SEQ ID NO: 2455294 - RNA, 16 nt, Human
ucaaauauuagaugug

SEQ ID NO: 2455295 - RNA, 15 nt, Human
ucaaauauuagaugu

SEQ ID NO: 2455296 - RNA, 16 nt, Human
ucaaagagaaaacuua

SEQ ID NO: 2455297 - RNA, 14 nt, Human
ucaaauauuagaug

SEQ ID NO: 2455298 - RNA, 23 nt, Human
ucaaauauauucagccuggcuuc

SEQ ID NO: 2455299 - RNA, 22 nt, Human
ucaaauauauucagccuggcuu

SEQ ID NO: 2455300 - RNA, 21 nt, Human
ucaaauauauucagccuggcu

SEQ ID NO: 2455301 - RNA, 21 nt, Human
ucaaagaccuuguguguaugu

SEQ ID NO: 2455302 - RNA, 19 nt, Human
ucaaagaccuuguguguau

SEQ ID NO: 2455303 - RNA, 17 nt, Human
ucaaagaccuugugugu

SEQ ID NO: 2455304 - RNA, 22 nt, Human
ucaaagaaggauggcaccuaaa

SEQ ID NO: 2455305 - RNA, 17 nt, Human
ucaaagacauucugaca

SEQ ID NO: 2455306 - RNA, 23 nt, Human
ucaaagaagguuuguguuuuucu

SEQ ID NO: 2455307 - RNA, 16 nt, Human
ucaaagaaggauggca

SEQ ID NO: 2455308 - RNA, 12 nt, Human
ucaaagaaggaa

SEQ ID NO: 2455309 - RNA, 21 nt, Human
ucaaaacacaucuuuccuguc

SEQ ID NO: 2455310 - RNA, 19 nt, Human
ucaaagaaaugcugaugga

SEQ ID NO: 2455311 - RNA, 16 nt, Human
ucaaagaaaugcugau

SEQ ID NO: 2455312 - RNA, 12 nt, Human
ucaaagaaaugc

SEQ ID NO: 2455313 - RNA, 15 nt, Human
ucaaaacagagaugu

SEQ ID NO: 2455314 - RNA, 14 nt, Human
ucaaaaaacuugua

SEQ ID NO: 2455315 - RNA, 15 nt, Human
ucaaaaaacuuguaa

SEQ ID NO: 2455316 - RNA, 16 nt, Human
ucaaaaauauaacuua

SEQ ID NO: 2455317 - RNA, 15 nt, Human
ucaaaaauauaacuu

SEQ ID NO: 2455318 - RNA, 16 nt, Human
ucaaaaaaacacuagu

SEQ ID NO: 2455319 - RNA, 14 nt, Human
ucaaaaaaacacua

SEQ ID NO: 2455320 - RNA, 14 nt, Human
ucaaaaauauaacu

SEQ ID NO: 2455321 - RNA, 17 nt, Human
ucuuccuggauuauuca

SEQ ID NO: 2455322 - RNA, 22 nt, Human
ucuuccuguaacacaagccaca

SEQ ID NO: 2455323 - RNA, 18 nt, Human
ucuucaucuucaccagag

SEQ ID NO: 2455324 - RNA, 17 nt, Human
ucuucaugcaaugacau

SEQ ID NO: 2455325 - RNA, 14 nt, Human
ucuucaugcaauga

SEQ ID NO: 2455326 - RNA, 13 nt, Human
ucuucaucuucac

SEQ ID NO: 2455327 - RNA, 20 nt, Human
ucuucauccggcagccugga

SEQ ID NO: 2455328 - RNA, 22 nt, Human
ucuucagccucuuucugucccu

SEQ ID NO: 2455329 - RNA, 23 nt, Human
ucuucagccuagccgaccucagc

SEQ ID NO: 2455330 - RNA, 21 nt, Human
ucuucagccuagccgaccuca

SEQ ID NO: 2455331 - RNA, 22 nt, Human
ucuucagccuagccgaccucag

SEQ ID NO: 2455332 - RNA, 16 nt, Human
ucuucagcuucuucau

SEQ ID NO: 2455333 - RNA, 13 nt, Human
ucuucagcuucuu

SEQ ID NO: 2455334 - RNA, 13 nt, Human
ucuucaggccucc

SEQ ID NO: 2455335 - RNA, 14 nt, Human
ucuucaggccuccc

SEQ ID NO: 2455336 - RNA, 15 nt, Human
ucuucaggccucccu

SEQ ID NO: 2455337 - RNA, 18 nt, Human
ucuucauaccuacaugua

SEQ ID NO: 2455338 - RNA, 21 nt, Human
ucuucauaccuacauguauuu

SEQ ID NO: 2455339 - RNA, 15 nt, Human
ucuucauaauucuaa

SEQ ID NO: 2455340 - RNA, 20 nt, Human
ucuucagcuugugcacaauu

SEQ ID NO: 2455341 - RNA, 18 nt, Human
ucuucaggccucccucuc

SEQ ID NO: 2455342 - RNA, 22 nt, Human
ucuucauacuuuuuuucacagu

SEQ ID NO: 2455343 - RNA, 15 nt, Human
ucuucauacuuuuuu

SEQ ID NO: 2455344 - RNA, 13 nt, Human
ucuucauacuuuu

SEQ ID NO: 2455345 - RNA, 18 nt, Human
ucuucauccggcagccug

SEQ ID NO: 2455346 - RNA, 19 nt, Human
ucuucauccggcagccugg

SEQ ID NO: 2455347 - RNA, 17 nt, Human
ucuuaggggagagcuuu

SEQ ID NO: 2455348 - RNA, 19 nt, Human
ucuuaggggagagcuuucu

SEQ ID NO: 2455349 - RNA, 14 nt, Human
ucuuaggagcagag

SEQ ID NO: 2455350 - RNA, 22 nt, Human
ucuuagcuuuuuaauuguuguu

SEQ ID NO: 2455351 - RNA, 19 nt, Human
ucuuaggagcagagcucug

SEQ ID NO: 2455352 - RNA, 16 nt, Human
ucuucagccaccucuc

SEQ ID NO: 2455353 - RNA, 16 nt, Human
ucuucagccaucaaca

SEQ ID NO: 2455354 - RNA, 13 nt, Human
ucuucagccauca

SEQ ID NO: 2455355 - RNA, 19 nt, Human
ucuucagccaccucucuuu

SEQ ID NO: 2455356 - RNA, 11 nt, Human
ucuucagccua

SEQ ID NO: 2455357 - RNA, 12 nt, Human
ucuucagccuag

SEQ ID NO: 2455358 - RNA, 18 nt, Human
ucuucagaucucuaacuu

SEQ ID NO: 2455359 - RNA, 23 nt, Human
ucuucagaucucuaacuucacca

SEQ ID NO: 2455360 - RNA, 21 nt, Human
ucuuagcuuuuuaauuguugu

SEQ ID NO: 2455361 - RNA, 18 nt, Human
ucuuagcuuuuuaauugu

SEQ ID NO: 2455362 - RNA, 17 nt, Human
ucuuagcuuuuuaauug

SEQ ID NO: 2455363 - RNA, 16 nt, Human
ucuuagcuuuuuaauu

SEQ ID NO: 2455364 - RNA, 19 nt, Human
ucuuaggaagagaaaccag

SEQ ID NO: 2455365 - RNA, 15 nt, Human
ucuuaggaagagaaa

SEQ ID NO: 2455366 - RNA, 23 nt, Human
ucuugaaagauucagguauguug

SEQ ID NO: 2455367 - RNA, 20 nt, Human
ucuucuuuuugcuguuguuu

SEQ ID NO: 2455368 - RNA, 18 nt, Human
ucuucuuuuugcuguugu

SEQ ID NO: 2455369 - RNA, 21 nt, Human
ucuugaacacucaugcugaaa

SEQ ID NO: 2455370 - RNA, 20 nt, Human
ucuugaacacucaugcugaa

SEQ ID NO: 2455371 - RNA, 19 nt, Human
ucuugaacacucaugcuga

SEQ ID NO: 2455372 - RNA, 13 nt, Human
ucuugaaaaaugc

SEQ ID NO: 2455373 - RNA, 17 nt, Human
ucuugaacuccugaccu

SEQ ID NO: 2455374 - RNA, 19 nt, Human
ucuugaacuccugaccuca

SEQ ID NO: 2455375 - RNA, 12 nt, Human
ucuugaacuccu

SEQ ID NO: 2455376 - RNA, 16 nt, Human
ucuucuccuaugugua

SEQ ID NO: 2455377 - RNA, 13 nt, Human
ucuucuccuuuca

SEQ ID NO: 2455378 - RNA, 15 nt, Human
ucuucucuagcuggu

SEQ ID NO: 2455379 - RNA, 17 nt, Human
ucuucuccuauguguaa

SEQ ID NO: 2455380 - RNA, 13 nt, Human
ucuucucuagcug

SEQ ID NO: 2455381 - RNA, 14 nt, Human
ucuucuccuuucac

SEQ ID NO: 2455382 - RNA, 18 nt, Human
ucuucuuuuuuugugaug

SEQ ID NO: 2455383 - RNA, 17 nt, Human
ucuucuuuuuuugugau

SEQ ID NO: 2455384 - RNA, 16 nt, Human
ucuucuuuuuuuguga

SEQ ID NO: 2455385 - RNA, 19 nt, Human
ucuucuuuuugcuucaaaa

SEQ ID NO: 2455386 - RNA, 14 nt, Human
ucuucuccccaggu

SEQ ID NO: 2455387 - RNA, 12 nt, Human
ucuucuccaucu

SEQ ID NO: 2455388 - RNA, 12 nt, Human
ucuucuccccag

SEQ ID NO: 2455389 - RNA, 14 nt, Human
ucuucuccaucugg

SEQ ID NO: 2455390 - RNA, 12 nt, Human
ucuucuccacca

SEQ ID NO: 2455391 - RNA, 20 nt, Human
ucuucucauuucaccccucc

SEQ ID NO: 2455392 - RNA, 19 nt, Human
ucuucucauuucaccccuc

SEQ ID NO: 2455393 - RNA, 18 nt, Human
ucuucucauuucaccccu

SEQ ID NO: 2455394 - RNA, 15 nt, Human
ucuucucauuucacc

SEQ ID NO: 2455395 - RNA, 23 nt, Human
ucuucucauuucaccccucccuu

SEQ ID NO: 2455396 - RNA, 22 nt, Human
ucuucucauuucaccccucccu

SEQ ID NO: 2455397 - RNA, 12 nt, Human
ucuucuccacug

SEQ ID NO: 2455398 - RNA, 21 nt, Human
ucuuccuugaagaacugcagg

SEQ ID NO: 2455399 - RNA, 13 nt, Human
ucuuccuucugcc

SEQ ID NO: 2455400 - RNA, 13 nt, Human
ucuuccugugggg

SEQ ID NO: 2455401 - RNA, 12 nt, Human
ucuuccuguggg

SEQ ID NO: 2455402 - RNA, 19 nt, Human
ucuuccugugggggaagag

SEQ ID NO: 2455403 - RNA, 10 nt, Human
ucuucucauu

SEQ ID NO: 2455404 - RNA, 17 nt, Human
ucuucucauagcauuaa

SEQ ID NO: 2455405 - RNA, 18 nt, Human
ucuucucauagcauuaac

SEQ ID NO: 2455406 - RNA, 19 nt, Human
ucuucucauagcauuaacu

SEQ ID NO: 2455407 - RNA, 20 nt, Human
ucuucucauagcauuaacua

SEQ ID NO: 2455408 - RNA, 14 nt, Human
ucuucucaggcucu

SEQ ID NO: 2455409 - RNA, 20 nt, Human
ucuucucaggcucugcccug

SEQ ID NO: 2455410 - RNA, 21 nt, Human
ucuucucaggcucugcccugc

SEQ ID NO: 2455411 - RNA, 16 nt, Human
ucuucucauagcauua

SEQ ID NO: 2455412 - RNA, 22 nt, Human
ucuuccuugaagaacugcaggc

SEQ ID NO: 2455413 - RNA, 22 nt, Human
ucuuaaccagaucauugugaaa

SEQ ID NO: 2455414 - RNA, 23 nt, Human
ucuuaacacauguccuugugugu

SEQ ID NO: 2455415 - RNA, 19 nt, Human
ucuuaacaauuucuguccu

SEQ ID NO: 2455416 - RNA, 15 nt, Human
ucuuaacaauuucug

SEQ ID NO: 2455417 - RNA, 18 nt, Human
ucuuaaauuuugugauau

SEQ ID NO: 2455418 - RNA, 22 nt, Human
ucuuaacguuagaccacaaaua

SEQ ID NO: 2455419 - RNA, 12 nt, Human
ucuuaaccaucu

SEQ ID NO: 2455420 - RNA, 12 nt, Human
ucuuaagaagac

SEQ ID NO: 2455421 - RNA, 15 nt, Human
ucuuagcugucugcu

SEQ ID NO: 2455422 - RNA, 18 nt, Human
ucuuagcugucugcucag

SEQ ID NO: 2455423 - RNA, 14 nt, Human
ucuuagcuuuuuaa

SEQ ID NO: 2455424 - RNA, 12 nt, Human
ucuuagcugagu

SEQ ID NO: 2455425 - RNA, 23 nt, Human
ucuuagcugucugcucagacaga

SEQ ID NO: 2455426 - RNA, 23 nt, Human
ucuuaagccaucuugguaaauuu

SEQ ID NO: 2455427 - RNA, 22 nt, Human
ucuuaagccaucuugguaaauu

SEQ ID NO: 2455428 - RNA, 20 nt, Human
ucuuaagccaucuugguaaa

SEQ ID NO: 2455429 - RNA, 17 nt, Human
ucuuagcuccccuccaa

SEQ ID NO: 2455430 - RNA, 21 nt, Human
ucuuaagccuuuugcucacaa

SEQ ID NO: 2455431 - RNA, 16 nt, Human
ucuuagcuccccucca

SEQ ID NO: 2455432 - RNA, 18 nt, Human
ucuuaagaagacugcauu

SEQ ID NO: 2455433 - RNA, 19 nt, Human
ucuuaagccaucuugguaa

SEQ ID NO: 2455434 - RNA, 17 nt, Human
ucuuaagccaucuuggu

SEQ ID NO: 2455435 - RNA, 16 nt, Human
ucuuaagccaucuugg

SEQ ID NO: 2455436 - RNA, 13 nt, Human
ucuuaagccaucu

SEQ ID NO: 2455437 - RNA, 12 nt, Human
ucuuaagccauc

SEQ ID NO: 2455438 - RNA, 15 nt, Human
ucuuaagacuuuugg

SEQ ID NO: 2455439 - RNA, 17 nt, Human
ucuuaaccagaucauug

SEQ ID NO: 2455440 - RNA, 16 nt, Human
ucuuaaccagaucauu

SEQ ID NO: 2455441 - RNA, 22 nt, Human
ucuuaaauauguggaguucauc

SEQ ID NO: 2455442 - RNA, 19 nt, Human
ucuuaaauaauaaagauca

SEQ ID NO: 2455443 - RNA, 14 nt, Human
ucuuaaauuuugug

SEQ ID NO: 2455444 - RNA, 13 nt, Human
ucuuaaauuuugu

SEQ ID NO: 2455445 - RNA, 11 nt, Human
ucuuaaauuuu

SEQ ID NO: 2455446 - RNA, 15 nt, Human
ucuuaaauaauaaag

SEQ ID NO: 2455447 - RNA, 17 nt, Human
ucugucucugccucccu

SEQ ID NO: 2455448 - RNA, 14 nt, Human
ucugucucugccuc

SEQ ID NO: 2455449 - RNA, 13 nt, Human
ucugucugcccuu

SEQ ID NO: 2455450 - RNA, 22 nt, Human
ucugucugcccuucaccccagu

SEQ ID NO: 2455451 - RNA, 18 nt, Human
ucugucuggagugacaga

SEQ ID NO: 2455452 - RNA, 13 nt, Human
ucugucugguggc

SEQ ID NO: 2455453 - RNA, 17 nt, Human
ucugucugguggccccg

SEQ ID NO: 2455454 - RNA, 16 nt, Human
ucugucugguggcccc

SEQ ID NO: 2455455 - RNA, 17 nt, Human
ucugucuucaagggcuu

SEQ ID NO: 2455456 - RNA, 15 nt, Human
ucugucuucacaaca

SEQ ID NO: 2455457 - RNA, 12 nt, Human
ucugucuucaca

SEQ ID NO: 2455458 - RNA, 14 nt, Human
ucugucuucacagc

SEQ ID NO: 2455459 - RNA, 15 nt, Human
ucugucuucacagcu

SEQ ID NO: 2455460 - RNA, 22 nt, Human
ucugucuucacagcucuguguu

SEQ ID NO: 2455461 - RNA, 19 nt, Human
ucugucuuggcuuucaugu

SEQ ID NO: 2455462 - RNA, 12 nt, Human
ucugucuugaag

SEQ ID NO: 2455463 - RNA, 15 nt, Human
ucugucuucaccuga

SEQ ID NO: 2455464 - RNA, 12 nt, Human
ucuguuuucugu

SEQ ID NO: 2455465 - RNA, 20 nt, Human
ucuguuuuccuuucucaccg

SEQ ID NO: 2455466 - RNA, 23 nt, Human
ucuguuuucuuucuaaugagaua

SEQ ID NO: 2455467 - RNA, 17 nt, Human
ucuguuuugaaggcaaa

SEQ ID NO: 2455468 - RNA, 16 nt, Human
ucuguuuugccugaag

SEQ ID NO: 2455469 - RNA, 19 nt, Human
ucuuaaagaaaacccaccc

SEQ ID NO: 2455470 - RNA, 22 nt, Human
ucuuaaaguauucuucucuucc

SEQ ID NO: 2455471 - RNA, 18 nt, Human
ucuuaaaguauucuucuc

SEQ ID NO: 2455472 - RNA, 23 nt, Human
ucuuaaagcugccuguaguuagg

SEQ ID NO: 2455473 - RNA, 20 nt, Human
ucuuaaagcugccuguaguu

SEQ ID NO: 2455474 - RNA, 21 nt, Human
ucuuaaagcugccuguaguua

SEQ ID NO: 2455475 - RNA, 20 nt, Human
ucuuaaagaaaacccacccc

SEQ ID NO: 2455476 - RNA, 16 nt, Human
ucuuaaagcugccugu

SEQ ID NO: 2455477 - RNA, 19 nt, Human
ucuuaaagcugccuguagu

SEQ ID NO: 2455478 - RNA, 16 nt, Human
ucuguuuuuaaaaauc

SEQ ID NO: 2455479 - RNA, 14 nt, Human
ucuguuuuucuuuu

SEQ ID NO: 2455480 - RNA, 18 nt, Human
ucuuaaaaaauaaaaacu

SEQ ID NO: 2455481 - RNA, 16 nt, Human
ucuuaaaccuucaguu

SEQ ID NO: 2455482 - RNA, 17 nt, Human
ucuuaaacaaauguaug

SEQ ID NO: 2455483 - RNA, 17 nt, Human
ucugcugacagacacag

SEQ ID NO: 2455484 - RNA, 18 nt, Human
ucugcugacagacacagg

SEQ ID NO: 2455485 - RNA, 20 nt, Human
ucugcuccucuccaggcacc

SEQ ID NO: 2455486 - RNA, 18 nt, Human
ucugcuccucuccaggca

SEQ ID NO: 2455487 - RNA, 17 nt, Human
ucugcuccucuccaggc

SEQ ID NO: 2455488 - RNA, 16 nt, Human
ucugcuccucuccagg

SEQ ID NO: 2455489 - RNA, 21 nt, Human
ucugcuccucuccccagcaag

SEQ ID NO: 2455490 - RNA, 18 nt, Human
ucugcuccucuccccagc

SEQ ID NO: 2455491 - RNA, 23 nt, Human
ucugccagugacagacaggcucu

SEQ ID NO: 2455492 - RNA, 16 nt, Human
ucugcuccccagggga

SEQ ID NO: 2455493 - RNA, 15 nt, Human
ucugcuccucuccag

SEQ ID NO: 2455494 - RNA, 14 nt, Human
ucugcuccucucca

SEQ ID NO: 2455495 - RNA, 13 nt, Human
ucugcuccucucc

SEQ ID NO: 2455496 - RNA, 12 nt, Human
ucugcuccucuc

SEQ ID NO: 2455497 - RNA, 16 nt, Human
ucugccugcccaggcc

SEQ ID NO: 2455498 - RNA, 15 nt, Human
ucugccugcccaggc

SEQ ID NO: 2455499 - RNA, 13 nt, Human
ucugccagccaca

SEQ ID NO: 2455500 - RNA, 13 nt, Human
ucugccagccagc

SEQ ID NO: 2455501 - RNA, 15 nt, Human
ucugccagccagcag

SEQ ID NO: 2455502 - RNA, 16 nt, Human
ucugccagccagcagc

SEQ ID NO: 2455503 - RNA, 17 nt, Human
ucugccagccagcagcc

SEQ ID NO: 2455504 - RNA, 14 nt, Human
ucugccaggccccc

SEQ ID NO: 2455505 - RNA, 19 nt, Human
ucugccagccagcagccag

SEQ ID NO: 2455506 - RNA, 23 nt, Human
ucugccaggcccccaagccugca

SEQ ID NO: 2455507 - RNA, 12 nt, Human
ucugccagggag

SEQ ID NO: 2455508 - RNA, 13 nt, Human
ucugccagggagc

SEQ ID NO: 2455509 - RNA, 14 nt, Human
ucugccagggagcu

SEQ ID NO: 2455510 - RNA, 19 nt, Human
ucugccagggagcuugaaa

SEQ ID NO: 2455511 - RNA, 13 nt, Human
ucugccagugaca

SEQ ID NO: 2455512 - RNA, 21 nt, Human
ucugccagugacagacaggcu

SEQ ID NO: 2455513 - RNA, 19 nt, Human
ucugccagugacagacagg

SEQ ID NO: 2455514 - RNA, 13 nt, Human
ucugccugcccag

SEQ ID NO: 2455515 - RNA, 14 nt, Human
ucugccugcccagg

SEQ ID NO: 2455516 - RNA, 16 nt, Human
ucugcuggccuggccg

SEQ ID NO: 2455517 - RNA, 15 nt, Human
ucugcuggccuggcc

SEQ ID NO: 2455518 - RNA, 18 nt, Human
ucugcuggccuggaucuc

SEQ ID NO: 2455519 - RNA, 17 nt, Human
ucugcuggccuggaucu

SEQ ID NO: 2455520 - RNA, 16 nt, Human
ucugcuggccuggauc

SEQ ID NO: 2455521 - RNA, 15 nt, Human
ucugcuggccuggau

SEQ ID NO: 2455522 - RNA, 14 nt, Human
ucugcuggccugga

SEQ ID NO: 2455523 - RNA, 20 nt, Human
ucugcuggcccagccaaacc

SEQ ID NO: 2455524 - RNA, 22 nt, Human
ucugcugauccucccaggcuuc

SEQ ID NO: 2455525 - RNA, 23 nt, Human
ucugcuggaguuucauguacaag

SEQ ID NO: 2455526 - RNA, 16 nt, Human
ucugcuggauaaaaug

SEQ ID NO: 2455527 - RNA, 18 nt, Human
ucugcuggauaaaaugag

SEQ ID NO: 2455528 - RNA, 22 nt, Human
ucugcuggauaaaaugagguuc

SEQ ID NO: 2455529 - RNA, 12 nt, Human
ucugcuggccca

SEQ ID NO: 2455530 - RNA, 14 nt, Human
ucugcuggcccagc

SEQ ID NO: 2455531 - RNA, 22 nt, Human
ucugcugacagacacaggcccg

SEQ ID NO: 2455532 - RNA, 21 nt, Human
ucugcugacagacacaggccc

SEQ ID NO: 2455533 - RNA, 20 nt, Human
ucugcugacagacacaggcc

SEQ ID NO: 2455534 - RNA, 19 nt, Human
ucugcugacagacacaggc

SEQ ID NO: 2455535 - RNA, 17 nt, Human
ucugcugggcuggggcc

SEQ ID NO: 2455536 - RNA, 14 nt, Human
ucugcugggcuggg

SEQ ID NO: 2455537 - RNA, 13 nt, Human
ucugcugggcugg

SEQ ID NO: 2455538 - RNA, 12 nt, Human
ucugcugggcug

SEQ ID NO: 2455539 - RNA, 24 nt, Human
ucugcugggcuggggccugauggg

SEQ ID NO: 2455540 - RNA, 22 nt, Human
ucugcugggcuggggccugaug

SEQ ID NO: 2455541 - RNA, 19 nt, Human
ucuggaauaaggagaauga

SEQ ID NO: 2455542 - RNA, 14 nt, Human
ucuggaauacauga

SEQ ID NO: 2455543 - RNA, 22 nt, Human
ucuggaauacaugaaauauaga

SEQ ID NO: 2455544 - RNA, 15 nt, Human
ucuggaaugcagugg

SEQ ID NO: 2455545 - RNA, 14 nt, Human
ucuggacaggcaug

SEQ ID NO: 2455546 - RNA, 16 nt, Human
ucuggaaugcaguggu

SEQ ID NO: 2455547 - RNA, 21 nt, Human
ucuggacaggcauguucucug

SEQ ID NO: 2455548 - RNA, 22 nt, Human
ucuggaccaacccuguuuccug

SEQ ID NO: 2455549 - RNA, 19 nt, Human
ucuggaaucuggagaccag

SEQ ID NO: 2455550 - RNA, 17 nt, Human
ucuggccuucggccucc

SEQ ID NO: 2455551 - RNA, 14 nt, Human
ucuggaccccaucu

SEQ ID NO: 2455552 - RNA, 17 nt, Human
ucuggaccccaucugug

SEQ ID NO: 2455553 - RNA, 18 nt, Human
ucuggaccccaucuguga

SEQ ID NO: 2455554 - RNA, 19 nt, Human
ucuggaccccaucugugaa

SEQ ID NO: 2455555 - RNA, 18 nt, Human
ucuggccuucggccucca

SEQ ID NO: 2455556 - RNA, 19 nt, Human
ucuggcuaugcauuugaaa

SEQ ID NO: 2455557 - RNA, 22 nt, Human
ucuggcuaugcauuugaaaauu

SEQ ID NO: 2455558 - RNA, 15 nt, Human
ucuggcuccagcugg

SEQ ID NO: 2455559 - RNA, 19 nt, Human
ucuggcuccucaaacagua

SEQ ID NO: 2455560 - RNA, 23 nt, Human
ucuggaccaacccuguuuccuga

SEQ ID NO: 2455561 - RNA, 20 nt, Human
ucuggaccccaucugugaau

SEQ ID NO: 2455562 - RNA, 23 nt, Human
ucuggugacuuuccucuuugguc

SEQ ID NO: 2455563 - RNA, 16 nt, Human
ucugggaccucaguuu

SEQ ID NO: 2455564 - RNA, 13 nt, Human
ucugggaccucag

SEQ ID NO: 2455565 - RNA, 22 nt, Human
ucugggaccugccaggcagggg

SEQ ID NO: 2455566 - RNA, 21 nt, Human
ucugggaccugccaggcaggg

SEQ ID NO: 2455567 - RNA, 20 nt, Human
ucugggaccugccaggcagg

SEQ ID NO: 2455568 - RNA, 19 nt, Human
ucugggacccuuuccuucc

SEQ ID NO: 2455569 - RNA, 14 nt, Human
ucugggacacaguu

SEQ ID NO: 2455570 - RNA, 21 nt, Human
ucuggcugagcugaacccauu

SEQ ID NO: 2455571 - RNA, 15 nt, Human
ucuggcugagcugaa

SEQ ID NO: 2455572 - RNA, 15 nt, Human
ucugggacccuuucc

SEQ ID NO: 2455573 - RNA, 16 nt, Human
ucugggacccuuuccu

SEQ ID NO: 2455574 - RNA, 23 nt, Human
ucuggcucuuccaggcugggaga

SEQ ID NO: 2455575 - RNA, 18 nt, Human
ucuggcucuuccaggcug

SEQ ID NO: 2455576 - RNA, 14 nt, Human
ucuggcugagcuga

SEQ ID NO: 2455577 - RNA, 16 nt, Human
ucuggcugagcccugc

SEQ ID NO: 2455578 - RNA, 15 nt, Human
ucuggcugagcccug

SEQ ID NO: 2455579 - RNA, 20 nt, Human
ucuggcugaacccugugcug

SEQ ID NO: 2455580 - RNA, 21 nt, Human
ucuggcugaacccugugcugg

SEQ ID NO: 2455581 - RNA, 19 nt, Human
ucuggcugaacccugugcu

SEQ ID NO: 2455582 - RNA, 18 nt, Human
ucuggcugaacccugugc

SEQ ID NO: 2455583 - RNA, 17 nt, Human
ucuggcugaacccugug

SEQ ID NO: 2455584 - RNA, 16 nt, Human
ucuggcugaacccugu

SEQ ID NO: 2455585 - RNA, 14 nt, Human
ucuggcugaacccu

SEQ ID NO: 2455586 - RNA, 13 nt, Human
ucuggcugaaccc

SEQ ID NO: 2455587 - RNA, 18 nt, Human
ucuggcugaacacuggca

SEQ ID NO: 2455588 - RNA, 19 nt, Human
ucuguccuacucuguguca

SEQ ID NO: 2455589 - RNA, 15 nt, Human
ucuguccuacucugu

SEQ ID NO: 2455590 - RNA, 17 nt, Human
ucuguccuggugucacu

SEQ ID NO: 2455591 - RNA, 21 nt, Human
ucuguccugggagugagcugg

SEQ ID NO: 2455592 - RNA, 14 nt, Human
ucugucgcccaguc

SEQ ID NO: 2455593 - RNA, 14 nt, Human
ucuguccuucagau

SEQ ID NO: 2455594 - RNA, 14 nt, Human
ucuguccugguguc

SEQ ID NO: 2455595 - RNA, 20 nt, Human
ucuguccuucagauggaaac

SEQ ID NO: 2455596 - RNA, 16 nt, Human
ucugucgcccagucug

SEQ ID NO: 2455597 - RNA, 22 nt, Human
ucugucucuggauuauauuaug

SEQ ID NO: 2455598 - RNA, 12 nt, Human
ucugucucugcc

SEQ ID NO: 2455599 - RNA, 19 nt, Human
ucuguccuuuuggcacuga

SEQ ID NO: 2455600 - RNA, 22 nt, Human
ucugucuccuuaacacugagcu

SEQ ID NO: 2455601 - RNA, 21 nt, Human
ucuguccuuuuggcacugaga

SEQ ID NO: 2455602 - RNA, 18 nt, Human
ucuggugaggccuugcuc

SEQ ID NO: 2455603 - RNA, 17 nt, Human
ucuggugaggccuugcu

SEQ ID NO: 2455604 - RNA, 21 nt, Human
ucugggacuuccuugcucucc

SEQ ID NO: 2455605 - RNA, 17 nt, Human
ucugggacuuccuugcu

SEQ ID NO: 2455606 - RNA, 15 nt, Human
ucugggacuuccuug

SEQ ID NO: 2455607 - RNA, 13 nt, Human
ucugggacuuccu

SEQ ID NO: 2455608 - RNA, 22 nt, Human
ucuggugagcgaggacauucuc

SEQ ID NO: 2455609 - RNA, 13 nt, Human
ucugggagaggau

SEQ ID NO: 2455610 - RNA, 23 nt, Human
ucuggugggguguguuccaacug

SEQ ID NO: 2455611 - RNA, 14 nt, Human
ucugguggccccgu

SEQ ID NO: 2455612 - RNA, 12 nt, Human
ucugguggcccc

SEQ ID NO: 2455613 - RNA, 16 nt, Human
ucugguggucuguugg

SEQ ID NO: 2455614 - RNA, 21 nt, Human
ucugguggccgaucggggcac

SEQ ID NO: 2455615 - RNA, 16 nt, Human
ucugguggucucugcu

SEQ ID NO: 2455616 - RNA, 13 nt, Human
ucuggugucugcu

SEQ ID NO: 2455617 - RNA, 20 nt, Human
ucugguuccuccccuccucc

SEQ ID NO: 2455618 - RNA, 21 nt, Human
ucugguuccuccccuccuccu

SEQ ID NO: 2455619 - RNA, 14 nt, Human
ucuguccuacucug

SEQ ID NO: 2455620 - RNA, 23 nt, Human
ucugguuccagggucccucugug

SEQ ID NO: 2455621 - RNA, 21 nt, Human
ucugguuccagggucccucug

SEQ ID NO: 2455622 - RNA, 13 nt, Human
ucugguuccuccc

SEQ ID NO: 2455623 - RNA, 14 nt, Human
ucugguuccagggu

SEQ ID NO: 2455624 - RNA, 13 nt, Human
ucugguuccaggg

SEQ ID NO: 2455625 - RNA, 12 nt, Human
ucugguuccagg

SEQ ID NO: 2455626 - RNA, 14 nt, Human
ucugaaaauauaac

SEQ ID NO: 2455627 - RNA, 13 nt, Human
ucugaaaauauaa

SEQ ID NO: 2455628 - RNA, 23 nt, Human
ucugaaaaauuccuuuguguuuc

SEQ ID NO: 2455629 - RNA, 17 nt, Human
ucugaaaacggcccucu

SEQ ID NO: 2455630 - RNA, 15 nt, Human
ucugaaaacggcccu

SEQ ID NO: 2455631 - RNA, 14 nt, Human
ucugaaaauugaug

SEQ ID NO: 2455632 - RNA, 13 nt, Human
ucugaaaauguau

SEQ ID NO: 2455633 - RNA, 15 nt, Human
ucugaaaccaguguu

SEQ ID NO: 2455634 - RNA, 20 nt, Human
ucugaaaccaguguuaggga

SEQ ID NO: 2455635 - RNA, 23 nt, Human
ucugaaacccuggaccagugguc

SEQ ID NO: 2455636 - RNA, 22 nt, Human
ucugaaaauugaugggauuugg

SEQ ID NO: 2455637 - RNA, 18 nt, Human
ucugaaaauauaaccagc

SEQ ID NO: 2455638 - RNA, 18 nt, Human
ucucugugugcacaaaua

SEQ ID NO: 2455639 - RNA, 20 nt, Human
ucucuguguuuguuccuaca

SEQ ID NO: 2455640 - RNA, 10 nt, Human
ucucuguguu

SEQ ID NO: 2455641 - RNA, 13 nt, Human
ucucuguucauuu

SEQ ID NO: 2455642 - RNA, 14 nt, Human
ucucuguucauuuc

SEQ ID NO: 2455643 - RNA, 16 nt, Human
ucucuguucauuuccu

SEQ ID NO: 2455644 - RNA, 17 nt, Human
ucucuguucauuuccuc

SEQ ID NO: 2455645 - RNA, 18 nt, Human
ucucuguucauuuccuca

SEQ ID NO: 2455646 - RNA, 21 nt, Human
ucucuguuccauugaaucugu

SEQ ID NO: 2455647 - RNA, 18 nt, Human
ucucuuaauuuaaucuuu

SEQ ID NO: 2455648 - RNA, 22 nt, Human
ucucuuacgcccaacccuuccc

SEQ ID NO: 2455649 - RNA, 19 nt, Human
ucucuuacugcaaauguca

SEQ ID NO: 2455650 - RNA, 15 nt, Human
ucucuuacugcaaau

SEQ ID NO: 2455651 - RNA, 13 nt, Human
ucucuuacugcaa

SEQ ID NO: 2455652 - RNA, 16 nt, Human
ucucuuagcuccccuc

SEQ ID NO: 2455653 - RNA, 18 nt, Human
ucucuuagcuccccucca

SEQ ID NO: 2455654 - RNA, 17 nt, Human
ucucuuagcuccccucc

SEQ ID NO: 2455655 - RNA, 19 nt, Human
ucucuuagcuccccuccaa

SEQ ID NO: 2455656 - RNA, 15 nt, Human
ucucuuauagaauau

SEQ ID NO: 2455657 - RNA, 20 nt, Human
ucucuuuuuggaggugcuua

SEQ ID NO: 2455658 - RNA, 19 nt, Human
ucucuuuuuggaggugcuu

SEQ ID NO: 2455659 - RNA, 17 nt, Human
ucucuuuuuggaggugc

SEQ ID NO: 2455660 - RNA, 21 nt, Human
ucucuuauagaauauuuauua

SEQ ID NO: 2455661 - RNA, 20 nt, Human
ucucuuauagaauauuuauu

SEQ ID NO: 2455662 - RNA, 18 nt, Human
ucucuuauagaauauuua

SEQ ID NO: 2455663 - RNA, 17 nt, Human
ucucuuauagaauauuu

SEQ ID NO: 2455664 - RNA, 15 nt, Human
ucugacauaaguauu

SEQ ID NO: 2455665 - RNA, 12 nt, Human
ucugacaucucu

SEQ ID NO: 2455666 - RNA, 14 nt, Human
ucugacaucucugc

SEQ ID NO: 2455667 - RNA, 17 nt, Human
ucugaccagcagcgccu

SEQ ID NO: 2455668 - RNA, 18 nt, Human
ucugaccagcagcgccuu

SEQ ID NO: 2455669 - RNA, 13 nt, Human
ucugacccacugc

SEQ ID NO: 2455670 - RNA, 22 nt, Human
ucugacaggcaaugcuggcugu

SEQ ID NO: 2455671 - RNA, 21 nt, Human
ucugacaggcaaugcuggcug

SEQ ID NO: 2455672 - RNA, 12 nt, Human
ucugacaggcaa

SEQ ID NO: 2455673 - RNA, 16 nt, Human
ucugacagaaagcaga

SEQ ID NO: 2455674 - RNA, 19 nt, Human
ucugacacacagcucuguc

SEQ ID NO: 2455675 - RNA, 18 nt, Human
ucugacacacagcucugu

SEQ ID NO: 2455676 - RNA, 17 nt, Human
ucugacacacagcucug

SEQ ID NO: 2455677 - RNA, 16 nt, Human
ucugacacacagcucu

SEQ ID NO: 2455678 - RNA, 16 nt, Human
ucugaaccauuaaagu

SEQ ID NO: 2455679 - RNA, 15 nt, Human
ucugaacaauucucu

SEQ ID NO: 2455680 - RNA, 14 nt, Human
ucugcacacagcac

SEQ ID NO: 2455681 - RNA, 22 nt, Human
ucugcaacuuuaagcagcucuu

SEQ ID NO: 2455682 - RNA, 10 nt, Human
ucugcacaga

SEQ ID NO: 2455683 - RNA, 13 nt, Human
ucugcacagaugg

SEQ ID NO: 2455684 - RNA, 23 nt, Human
ucugcacaugaaucccacccaca

SEQ ID NO: 2455685 - RNA, 12 nt, Human
ucugcacaugaa

SEQ ID NO: 2455686 - RNA, 17 nt, Human
ucugcacagcuggccuc

SEQ ID NO: 2455687 - RNA, 15 nt, Human
ucugcacagcuggcc

SEQ ID NO: 2455688 - RNA, 15 nt, Human
ucugcacagauggau

SEQ ID NO: 2455689 - RNA, 20 nt, Human
ucugcaagaauugaagcagg

SEQ ID NO: 2455690 - RNA, 21 nt, Human
ucugcaagaauugaagcagga

SEQ ID NO: 2455691 - RNA, 11 nt, Human
ucugaggcuga

SEQ ID NO: 2455692 - RNA, 23 nt, Human
ucugaggcugaaauucagaauau

SEQ ID NO: 2455693 - RNA, 19 nt, Human
ucugaggcucuuucugggc

SEQ ID NO: 2455694 - RNA, 23 nt, Human
ucugaggccuccucucucaguuu

SEQ ID NO: 2455695 - RNA, 21 nt, Human
ucugcaacuuuaagcagcucu

SEQ ID NO: 2455696 - RNA, 14 nt, Human
ucugcaacuuuaag

SEQ ID NO: 2455697 - RNA, 22 nt, Human
ucugaggcuggauccuagccuu

SEQ ID NO: 2455698 - RNA, 21 nt, Human
ucugaggcuggauccuagccu

SEQ ID NO: 2455699 - RNA, 21 nt, Human
ucugaggcucuuucugggcca

SEQ ID NO: 2455700 - RNA, 12 nt, Human
ucugaggacauu

SEQ ID NO: 2455701 - RNA, 20 nt, Human
ucugaggacauuccaagaca

SEQ ID NO: 2455702 - RNA, 22 nt, Human
ucugaggagaaacaaauaagac

SEQ ID NO: 2455703 - RNA, 18 nt, Human
ucugaccauuucaggggu

SEQ ID NO: 2455704 - RNA, 23 nt, Human
ucugaccaguuuaaccugaugca

SEQ ID NO: 2455705 - RNA, 14 nt, Human
ucugaccauuucag

SEQ ID NO: 2455706 - RNA, 23 nt, Human
ucugaggaauccagacccggcug

SEQ ID NO: 2455707 - RNA, 15 nt, Human
ucugacccacugcuu

SEQ ID NO: 2455708 - RNA, 14 nt, Human
ucugacccacugcu

SEQ ID NO: 2455709 - RNA, 19 nt, Human
ucugcaucagcugcugaaa

SEQ ID NO: 2455710 - RNA, 21 nt, Human
ucugcaucagcugcugaaaca

SEQ ID NO: 2455711 - RNA, 14 nt, Human
ucugcaucagcugc

SEQ ID NO: 2455712 - RNA, 15 nt, Human
ucugcacaugucuug

SEQ ID NO: 2455713 - RNA, 12 nt, Human
ucugcacauguc

SEQ ID NO: 2455714 - RNA, 22 nt, Human
ucugcacaugcagcugcacccu

SEQ ID NO: 2455715 - RNA, 21 nt, Human
ucugcacaugcagcugcaccc

SEQ ID NO: 2455716 - RNA, 20 nt, Human
ucugcacaugcagcugcacc

SEQ ID NO: 2455717 - RNA, 19 nt, Human
ucugcaugcggcccagccc

SEQ ID NO: 2455718 - RNA, 18 nt, Human
ucugcaugcggcccagcc

SEQ ID NO: 2455719 - RNA, 17 nt, Human
ucugcaugcggcccagc

SEQ ID NO: 2455720 - RNA, 16 nt, Human
ucugcaugcggcccag

SEQ ID NO: 2455721 - RNA, 15 nt, Human
ucugcaugcggccca

SEQ ID NO: 2455722 - RNA, 14 nt, Human
ucugcaugcggccc

SEQ ID NO: 2455723 - RNA, 22 nt, Human
ucugcaucuuggggacaucucu

SEQ ID NO: 2455724 - RNA, 17 nt, Human
ucugcaucuuggggaca

SEQ ID NO: 2455725 - RNA, 19 nt, Human
ucugcaucuacucccaagu

SEQ ID NO: 2455726 - RNA, 20 nt, Human
ucugcaucugaccacgugcu

SEQ ID NO: 2455727 - RNA, 15 nt, Human
ucugcaucugaccac

SEQ ID NO: 2455728 - RNA, 13 nt, Human
ucugcaucugacc

SEQ ID NO: 2455729 - RNA, 17 nt, Human
ucugcaucuacucccaa

SEQ ID NO: 2455730 - RNA, 23 nt, Human
ucugcacaugcagcugcacccuc

SEQ ID NO: 2455731 - RNA, 17 nt, Human
ucugcacaugucuugua

SEQ ID NO: 2455732 - RNA, 16 nt, Human
ucugcacaugucuugu

SEQ ID NO: 2455733 - RNA, 19 nt, Human
ucugcacaugucuuguaca

SEQ ID NO: 2455734 - RNA, 15 nt, Human
ucugccaccagagac

SEQ ID NO: 2455735 - RNA, 19 nt, Human
ucugccaccaaaggccagg

SEQ ID NO: 2455736 - RNA, 16 nt, Human
ucugccaccaaaggcc

SEQ ID NO: 2455737 - RNA, 10 nt, Human
ucugccacca

SEQ ID NO: 2455738 - RNA, 17 nt, Human
ucugccaccauccugcu

SEQ ID NO: 2455739 - RNA, 14 nt, Human
ucugccacccuacc

SEQ ID NO: 2455740 - RNA, 19 nt, Human
ucugccaauuuuugccuuc

SEQ ID NO: 2455741 - RNA, 22 nt, Human
ucugcauuuugcuauuguaaau

SEQ ID NO: 2455742 - RNA, 22 nt, Human
ucugccaauuuuugccuucauu

SEQ ID NO: 2455743 - RNA, 23 nt, Human
ucugccagaagauccccucagga

SEQ ID NO: 2455744 - RNA, 22 nt, Human
ucugccagaagauccccucagg

SEQ ID NO: 2455745 - RNA, 21 nt, Human
ucugccagaagauccccucag

SEQ ID NO: 2455746 - RNA, 20 nt, Human
ucugccagaagauccccuca

SEQ ID NO: 2455747 - RNA, 17 nt, Human
ucugccacuucccaggu

SEQ ID NO: 2455748 - RNA, 16 nt, Human
ucugccacuucccagg

SEQ ID NO: 2455749 - RNA, 15 nt, Human
ucugccacuucccag

SEQ ID NO: 2455750 - RNA, 14 nt, Human
ucugccacuggaag

SEQ ID NO: 2455751 - RNA, 18 nt, Human
ucugccacccuaccuguu

SEQ ID NO: 2455752 - RNA, 17 nt, Human
ucugccacccuaccugu

SEQ ID NO: 2455753 - RNA, 21 nt, Human
ucugccacccuaccuguucag

SEQ ID NO: 2455754 - RNA, 14 nt, Human
ucugccaccucccc

SEQ ID NO: 2455755 - RNA, 15 nt, Human
ucugccaccuccccu

SEQ ID NO: 2455756 - RNA, 20 nt, Human
ucugccaccuccccuaucca

SEQ ID NO: 2455757 - RNA, 23 nt, Human
ucugccaccuccccuauccaccc

SEQ ID NO: 2455758 - RNA, 22 nt, Human
ucugcaugcggcccagcccggc

SEQ ID NO: 2455759 - RNA, 21 nt, Human
ucugcaugcggcccagcccgg

SEQ ID NO: 2455760 - RNA, 20 nt, Human
ucugcaugcggcccagcccg

SEQ ID NO: 2455761 - RNA, 17 nt, Human
ucugcauucaggaucaa

SEQ ID NO: 2455762 - RNA, 16 nt, Human
ucugcauucuaguacu

SEQ ID NO: 2455763 - RNA, 15 nt, Human
ucugcauuucggugg

SEQ ID NO: 2455764 - RNA, 18 nt, Human
ucugcauuucgguggcua

SEQ ID NO: 2455765 - RNA, 10 nt, Human
ucugcauuuu

SEQ ID NO: 2455766 - RNA, 15 nt, Human
ucugcauuugucuau

SEQ ID NO: 2455767 - RNA, 14 nt, Human
ucugcauuugucua

SEQ ID NO: 2455768 - RNA, 19 nt, Human
ucugcauuucgguggcuag

SEQ ID NO: 2455769 - RNA, 17 nt, Human
ucugcauuuucacccca

SEQ ID NO: 2455770 - RNA, 21 nt, Human
ucugcauuuucaccccacccu

SEQ ID NO: 2455771 - RNA, 19 nt, Human
ucugccaaaggaugugaua

SEQ ID NO: 2455772 - RNA, 19 nt, Human
ucugcauuuugcuauugua

SEQ ID NO: 2455773 - RNA, 18 nt, Human
ucugcauuuugcuauugu

SEQ ID NO: 2455774 - RNA, 16 nt, Human
ucugcauuuugcuauu

SEQ ID NO: 2455775 - RNA, 23 nt, Human
ucucaauccuaauuucuccuccc

SEQ ID NO: 2455776 - RNA, 13 nt, Human
ucucaaugcucau

SEQ ID NO: 2455777 - RNA, 12 nt, Human
ucuccugccuca

SEQ ID NO: 2455778 - RNA, 22 nt, Human
ucucaauccuaauuucuccucc

SEQ ID NO: 2455779 - RNA, 14 nt, Human
ucucaauaugcuua

SEQ ID NO: 2455780 - RNA, 23 nt, Human
ucucaaaguuuugaaaagcuauu

SEQ ID NO: 2455781 - RNA, 20 nt, Human
ucucaaaguuuugaaaagcu

SEQ ID NO: 2455782 - RNA, 18 nt, Human
ucucaaaguuuugaaaag

SEQ ID NO: 2455783 - RNA, 17 nt, Human
ucucaaaguuuugaaaa

SEQ ID NO: 2455784 - RNA, 17 nt, Human
ucucaaauucucaaccu

SEQ ID NO: 2455785 - RNA, 18 nt, Human
ucucaagagggcacuggu

SEQ ID NO: 2455786 - RNA, 17 nt, Human
ucucaagagggcacugg

SEQ ID NO: 2455787 - RNA, 19 nt, Human
ucucaagagggcacuggug

SEQ ID NO: 2455788 - RNA, 13 nt, Human
ucucaagcccugc

SEQ ID NO: 2455789 - RNA, 23 nt, Human
ucucaagggcuagcaucccugag

SEQ ID NO: 2455790 - RNA, 20 nt, Human
ucucaaggugggccuugcua

SEQ ID NO: 2455791 - RNA, 15 nt, Human
ucuccugccucagcc

SEQ ID NO: 2455792 - RNA, 17 nt, Human
ucuccugccucagccuc

SEQ ID NO: 2455793 - RNA, 17 nt, Human
ucuccuggaggauugca

SEQ ID NO: 2455794 - RNA, 13 nt, Human
ucuccuggaggau

SEQ ID NO: 2455795 - RNA, 12 nt, Human
ucuccuggagga

SEQ ID NO: 2455796 - RNA, 11 nt, Human
ucuccuggagg

SEQ ID NO: 2455797 - RNA, 15 nt, Human
ucuccuguaccucuu

SEQ ID NO: 2455798 - RNA, 21 nt, Human
ucuccuggaagugcuaauuuu

SEQ ID NO: 2455799 - RNA, 21 nt, Human
ucuccuggaaauauuaagaaa

SEQ ID NO: 2455800 - RNA, 21 nt, Human
ucucggcuccccauguguccu

SEQ ID NO: 2455801 - RNA, 14 nt, Human
ucucggugguacca

SEQ ID NO: 2455802 - RNA, 17 nt, Human
ucucgguuccacguccc

SEQ ID NO: 2455803 - RNA, 16 nt, Human
ucuccuguaccucuug

SEQ ID NO: 2455804 - RNA, 17 nt, Human
ucuccuguaccucuuga

SEQ ID NO: 2455805 - RNA, 22 nt, Human
ucucgugauugauaagaaccuu

SEQ ID NO: 2455806 - RNA, 14 nt, Human
ucucgugauugaua

SEQ ID NO: 2455807 - RNA, 19 nt, Human
ucucgugguaggacuguag

SEQ ID NO: 2455808 - RNA, 18 nt, Human
ucucgugggagagccauc

SEQ ID NO: 2455809 - RNA, 21 nt, Human
ucucgugguaggacuguagaa

SEQ ID NO: 2455810 - RNA, 18 nt, Human
ucucuaaguuccacugag

SEQ ID NO: 2455811 - RNA, 11 nt, Human
ucucuaauaug

SEQ ID NO: 2455812 - RNA, 21 nt, Human
ucucuaaguuccacugagcuc

SEQ ID NO: 2455813 - RNA, 19 nt, Human
ucucuaacuucaccauauu

SEQ ID NO: 2455814 - RNA, 16 nt, Human
ucucuaaguuccacug

SEQ ID NO: 2455815 - RNA, 22 nt, Human
ucucuaacucagaaacaucagu

SEQ ID NO: 2455816 - RNA, 22 nt, Human
ucucuaacuucaaggcccauau

SEQ ID NO: 2455817 - RNA, 12 nt, Human
ucucuaacuuca

SEQ ID NO: 2455818 - RNA, 18 nt, Human
ucucuaacucagaaacau

SEQ ID NO: 2455819 - RNA, 20 nt, Human
ucucuaacucagaaacauca

SEQ ID NO: 2455820 - RNA, 21 nt, Human
ucucuaacucagaaacaucag

SEQ ID NO: 2455821 - RNA, 17 nt, Human
ucucuaacagcucagga

SEQ ID NO: 2455822 - RNA, 18 nt, Human
ucucuaacagcucaggau

SEQ ID NO: 2455823 - RNA, 23 nt, Human
ucucuaaaugaggggccucaggu

SEQ ID NO: 2455824 - RNA, 22 nt, Human
ucucuaaagaguuuauuuuaag

SEQ ID NO: 2455825 - RNA, 12 nt, Human
ucucguuuuucu

SEQ ID NO: 2455826 - RNA, 14 nt, Human
ucucguuucaaaaa

SEQ ID NO: 2455827 - RNA, 15 nt, Human
ucucguuucaaaaac

SEQ ID NO: 2455828 - RNA, 21 nt, Human
ucucuaaagaguuuauuuuaa

SEQ ID NO: 2455829 - RNA, 19 nt, Human
ucucuaaagaguuuauuuu

SEQ ID NO: 2455830 - RNA, 17 nt, Human
ucucuggccuuuuccua

SEQ ID NO: 2455831 - RNA, 20 nt, Human
ucucugaugugauauccacu

SEQ ID NO: 2455832 - RNA, 20 nt, Human
ucucugagggcuuccuuugg

SEQ ID NO: 2455833 - RNA, 16 nt, Human
ucucugcaggucccua

SEQ ID NO: 2455834 - RNA, 15 nt, Human
ucucugcaggucccu

SEQ ID NO: 2455835 - RNA, 17 nt, Human
ucucugguaauauugac

SEQ ID NO: 2455836 - RNA, 18 nt, Human
ucucuggggccacacaga

SEQ ID NO: 2455837 - RNA, 21 nt, Human
ucucugggcuuggggcuuccu

SEQ ID NO: 2455838 - RNA, 14 nt, Human
ucucuggcugggga

SEQ ID NO: 2455839 - RNA, 16 nt, Human
ucucuggcgacaguuu

SEQ ID NO: 2455840 - RNA, 17 nt, Human
ucucuggcgacaguuuu

SEQ ID NO: 2455841 - RNA, 22 nt, Human
ucucuggcgacaguuuuccuuc

SEQ ID NO: 2455842 - RNA, 13 nt, Human
ucucuggcugggg

SEQ ID NO: 2455843 - RNA, 12 nt, Human
ucucuggcuggg

SEQ ID NO: 2455844 - RNA, 17 nt, Human
ucucuggugagcgagga

SEQ ID NO: 2455845 - RNA, 20 nt, Human
ucucugguccggacacuccu

SEQ ID NO: 2455846 - RNA, 13 nt, Human
ucucugguccgga

SEQ ID NO: 2455847 - RNA, 12 nt, Human
ucucugucucau

SEQ ID NO: 2455848 - RNA, 14 nt, Human
ucucugucucaucc

SEQ ID NO: 2455849 - RNA, 15 nt, Human
ucucugucucaucca

SEQ ID NO: 2455850 - RNA, 16 nt, Human
ucucugucucauccau

SEQ ID NO: 2455851 - RNA, 19 nt, Human
ucucuguagggaacucugg

SEQ ID NO: 2455852 - RNA, 22 nt, Human
ucucugugcuuugacucaccug

SEQ ID NO: 2455853 - RNA, 21 nt, Human
ucucugugcuuugacucaccu

SEQ ID NO: 2455854 - RNA, 16 nt, Human
ucucugugcuuugacu

SEQ ID NO: 2455855 - RNA, 19 nt, Human
ucucugugcuucaauuaau

SEQ ID NO: 2455856 - RNA, 15 nt, Human
ucucugugcugugga

SEQ ID NO: 2455857 - RNA, 11 nt, Human
ucucugugcuu

SEQ ID NO: 2455858 - RNA, 17 nt, Human
ucucugugccuucgucu

SEQ ID NO: 2455859 - RNA, 12 nt, Human
ucucugugccuu

SEQ ID NO: 2455860 - RNA, 22 nt, Human
ucucugugagacucgagaacuu

SEQ ID NO: 2455861 - RNA, 19 nt, Human
ucucugugagacucgagaa

SEQ ID NO: 2455862 - RNA, 23 nt, Human
ucucugugaacgauuuagaaaga

SEQ ID NO: 2455863 - RNA, 22 nt, Human
ucucugugaacgauuuagaaag

SEQ ID NO: 2455864 - RNA, 14 nt, Human
ucucugugagacuc

SEQ ID NO: 2455865 - RNA, 18 nt, Human
ucucugugaccugccccg

SEQ ID NO: 2455866 - RNA, 21 nt, Human
ucucugucucauccaucauca

SEQ ID NO: 2455867 - RNA, 23 nt, Human
ucucugucucauccaucaucaug

SEQ ID NO: 2455868 - RNA, 16 nt, Human
ucucugucucaugugu

SEQ ID NO: 2455869 - RNA, 18 nt, Human
ucucuguagggaacucug

SEQ ID NO: 2455870 - RNA, 16 nt, Human
ucucugugaacgauuu

SEQ ID NO: 2455871 - RNA, 16 nt, Human
ucucugaagcauguuu

SEQ ID NO: 2455872 - RNA, 14 nt, Human
ucucugaagcaugu

SEQ ID NO: 2455873 - RNA, 13 nt, Human
ucucugaagcaug

SEQ ID NO: 2455874 - RNA, 12 nt, Human
ucucugaagcau

SEQ ID NO: 2455875 - RNA, 21 nt, Human
ucucugaagcauguuucaugu

SEQ ID NO: 2455876 - RNA, 19 nt, Human
ucucugaagcauguuucau

SEQ ID NO: 2455877 - RNA, 22 nt, Human
ucucugaagcauguuucauguu

SEQ ID NO: 2455878 - RNA, 14 nt, Human
ucucugaagggagg

SEQ ID NO: 2455879 - RNA, 13 nt, Human
ucucugaagggag

SEQ ID NO: 2455880 - RNA, 11 nt, Human
ucucugaaggg

SEQ ID NO: 2455881 - RNA, 14 nt, Human
ucucugaggacacu

SEQ ID NO: 2455882 - RNA, 17 nt, Human
ucucugacucucaaauc

SEQ ID NO: 2455883 - RNA, 21 nt, Human
ucucugaccuacucgagggac

SEQ ID NO: 2455884 - RNA, 12 nt, Human
ucucugaccuac

SEQ ID NO: 2455885 - RNA, 16 nt, Human
ucucugaagggaggug

SEQ ID NO: 2455886 - RNA, 16 nt, Human
ucucugaagugaaacu

SEQ ID NO: 2455887 - RNA, 14 nt, Human
ucucugaauccuaa

SEQ ID NO: 2455888 - RNA, 14 nt, Human
ucucugcagguccc

SEQ ID NO: 2455889 - RNA, 13 nt, Human
ucucugcaggucc

SEQ ID NO: 2455890 - RNA, 17 nt, Human
ucucugaggacacuaac

SEQ ID NO: 2455891 - RNA, 15 nt, Human
ucucuaguuugauua

SEQ ID NO: 2455892 - RNA, 15 nt, Human
ucucuaggcugggga

SEQ ID NO: 2455893 - RNA, 14 nt, Human
ucucuaggcugggg

SEQ ID NO: 2455894 - RNA, 14 nt, Human
ucucuagugcugug

SEQ ID NO: 2455895 - RNA, 16 nt, Human
ucucuaguuugauuaa

SEQ ID NO: 2455896 - RNA, 16 nt, Human
ucucuagugcugugaa

SEQ ID NO: 2455897 - RNA, 17 nt, Human
ucucuagugcugugaaa

SEQ ID NO: 2455898 - RNA, 19 nt, Human
ucucuagugcugugaaaaa

SEQ ID NO: 2455899 - RNA, 18 nt, Human
ucucucucccauggagcc

SEQ ID NO: 2455900 - RNA, 23 nt, Human
ucucucucccauggagccccagc

SEQ ID NO: 2455901 - RNA, 11 nt, Human
ucucucuccug

SEQ ID NO: 2455902 - RNA, 22 nt, Human
ucucucuccuguacuuuuucca

SEQ ID NO: 2455903 - RNA, 21 nt, Human
ucucucugacucucaaaucuu

SEQ ID NO: 2455904 - RNA, 12 nt, Human
ucucucugccca

SEQ ID NO: 2455905 - RNA, 20 nt, Human
ucucucugacucucaaaucu

SEQ ID NO: 2455906 - RNA, 14 nt, Human
ucucucugacucuc

SEQ ID NO: 2455907 - RNA, 14 nt, Human
ucucucucucucuc

SEQ ID NO: 2455908 - RNA, 15 nt, Human
ucucucucuuagcau

SEQ ID NO: 2455909 - RNA, 14 nt, Human
ucucucucuacaaa

SEQ ID NO: 2455910 - RNA, 14 nt, Human
ucucucucucuccc

SEQ ID NO: 2455911 - RNA, 12 nt, Human
ucucucuccugu

SEQ ID NO: 2455912 - RNA, 13 nt, Human
ucucucucuacaa

SEQ ID NO: 2455913 - RNA, 13 nt, Human
ucucucuccuguc

SEQ ID NO: 2455914 - RNA, 14 nt, Human
ucucucugcccaac

SEQ ID NO: 2455915 - RNA, 16 nt, Human
ucucucugcccaaccc

SEQ ID NO: 2455916 - RNA, 19 nt, Human
ucucucuggcccucuaccc

SEQ ID NO: 2455917 - RNA, 13 nt, Human
ucucucuggcccu

SEQ ID NO: 2455918 - RNA, 12 nt, Human
ucucucuggccc

SEQ ID NO: 2455919 - RNA, 13 nt, Human
ucucugaagauga

SEQ ID NO: 2455920 - RNA, 21 nt, Human
ucucucuggcccucuaccccu

SEQ ID NO: 2455921 - RNA, 23 nt, Human
ucucugaagaguggguuucacaa

SEQ ID NO: 2455922 - RNA, 22 nt, Human
ucucugaagaguggguuucaca

SEQ ID NO: 2455923 - RNA, 11 nt, Human
ucucugaaccc

SEQ ID NO: 2455924 - RNA, 19 nt, Human
ucgugccagucgcgcugcc

SEQ ID NO: 2455925 - RNA, 15 nt, Human
ucgugauaaacuuug

SEQ ID NO: 2455926 - RNA, 22 nt, Human
ucgugacgcugaauaaaugucu

SEQ ID NO: 2455927 - RNA, 20 nt, Human
ucgugccagucgcgcugccu

SEQ ID NO: 2455928 - RNA, 22 nt, Human
ucgugcauuggaagaccccacc

SEQ ID NO: 2455929 - RNA, 20 nt, Human
ucgugcauuggaagacccca

SEQ ID NO: 2455930 - RNA, 19 nt, Human
ucgugcagcauaugaggau

SEQ ID NO: 2455931 - RNA, 22 nt, Human
ucgugccagucgcgcugccugu

SEQ ID NO: 2455932 - RNA, 21 nt, Human
ucgugccagucgcgcugccug

SEQ ID NO: 2455933 - RNA, 23 nt, Human
ucgugccagucgcgcugccugug

SEQ ID NO: 2455934 - RNA, 20 nt, Human
ucgugccguuacucuccaac

SEQ ID NO: 2455935 - RNA, 21 nt, Human
ucgugccuguguccaugcgcu

SEQ ID NO: 2455936 - RNA, 15 nt, Human
ucgugccugugucca

SEQ ID NO: 2455937 - RNA, 18 nt, Human
ucgugcggaaucagcuuc

SEQ ID NO: 2455938 - RNA, 18 nt, Human
ucgugcuaaauuuucagu

SEQ ID NO: 2455939 - RNA, 14 nt, Human
ucgugccugugucc

SEQ ID NO: 2455940 - RNA, 13 nt, Human
ucgugccuguguc

SEQ ID NO: 2455941 - RNA, 12 nt, Human
ucgugccugugu

SEQ ID NO: 2455942 - RNA, 20 nt, Human
ucgugccuccuuccaccucc

SEQ ID NO: 2455943 - RNA, 23 nt, Human
ucgugccguuacucuccaaccug

SEQ ID NO: 2455944 - RNA, 21 nt, Human
ucguggaacaguuaccucugc

SEQ ID NO: 2455945 - RNA, 22 nt, Human
ucguggcagauaaucagccucu

SEQ ID NO: 2455946 - RNA, 23 nt, Human
ucguggcagauaaucagccucuu

SEQ ID NO: 2455947 - RNA, 23 nt, Human
ucguggaaagggugcugcuuccc

SEQ ID NO: 2455948 - RNA, 23 nt, Human
ucgugccuccuuccaccucccuc

SEQ ID NO: 2455949 - RNA, 24 nt, Human
ucguggaaagggugcugcuucccu

SEQ ID NO: 2455950 - RNA, 22 nt, Human
ucgugggacagucaccucaugg

SEQ ID NO: 2455951 - RNA, 15 nt, Human
ucguggccagcccgg

SEQ ID NO: 2455952 - RNA, 14 nt, Human
ucguggccagcccg

SEQ ID NO: 2455953 - RNA, 13 nt, Human
ucguggccagccc

SEQ ID NO: 2455954 - RNA, 12 nt, Human
ucguggccagcc

SEQ ID NO: 2455955 - RNA, 18 nt, Human
ucguggccagcccggcug

SEQ ID NO: 2455956 - RNA, 17 nt, Human
ucguggccagcccggcu

SEQ ID NO: 2455957 - RNA, 20 nt, Human
ucguggccuuccccagccuc

SEQ ID NO: 2455958 - RNA, 22 nt, Human
ucgugagcucuugugaggaaag

SEQ ID NO: 2455959 - RNA, 16 nt, Human
ucgugagcucuuguga

SEQ ID NO: 2455960 - RNA, 21 nt, Human
ucgugacgcugaauaaauguc

SEQ ID NO: 2455961 - RNA, 15 nt, Human
ucgugagcucuugug

SEQ ID NO: 2455962 - RNA, 16 nt, Human
ucgugauugauaagaa

SEQ ID NO: 2455963 - RNA, 21 nt, Human
ucggccucuaaccccaggccc

SEQ ID NO: 2455964 - RNA, 20 nt, Human
ucggccucuaaccccaggcc

SEQ ID NO: 2455965 - RNA, 19 nt, Human
ucggccucuaaccccaggc

SEQ ID NO: 2455966 - RNA, 18 nt, Human
ucggccucuaaccccagg

SEQ ID NO: 2455967 - RNA, 23 nt, Human
ucggccucuaaccccaggccccg

SEQ ID NO: 2455968 - RNA, 22 nt, Human
ucggccucuaaccccaggcccc

SEQ ID NO: 2455969 - RNA, 21 nt, Human
ucgagguagaguuugaaggag

SEQ ID NO: 2455970 - RNA, 17 nt, Human
ucggccucuaaccccag

SEQ ID NO: 2455971 - RNA, 22 nt, Human
ucggccucccaaagugcuggga

SEQ ID NO: 2455972 - RNA, 20 nt, Human
ucgaggggcucucagcucag

SEQ ID NO: 2455973 - RNA, 18 nt, Human
ucgaggggcucucagcuc

SEQ ID NO: 2455974 - RNA, 16 nt, Human
ucgaggggcucucagc

SEQ ID NO: 2455975 - RNA, 14 nt, Human
ucgaggggcucuca

SEQ ID NO: 2455976 - RNA, 23 nt, Human
ucgagguagguggaucaccugag

SEQ ID NO: 2455977 - RNA, 18 nt, Human
ucggccuccauccugagg

SEQ ID NO: 2455978 - RNA, 17 nt, Human
ucggccuccauccugag

SEQ ID NO: 2455979 - RNA, 21 nt, Human
ucuaaauagccaacacccauc

SEQ ID NO: 2455980 - RNA, 13 nt, Human
ucuaaauagccaa

SEQ ID NO: 2455981 - RNA, 17 nt, Human
ucuaaauaccugcccug

SEQ ID NO: 2455982 - RNA, 13 nt, Human
ucuaaauauuucc

SEQ ID NO: 2455983 - RNA, 21 nt, Human
ucuaaaucuccaaaauaaaac

SEQ ID NO: 2455984 - RNA, 23 nt, Human
ucuaaauauuuccuuaaacugug

SEQ ID NO: 2455985 - RNA, 13 nt, Human
ucguuaauuugua

SEQ ID NO: 2455986 - RNA, 19 nt, Human
ucgugggucuguuuuccuu

SEQ ID NO: 2455987 - RNA, 20 nt, Human
ucgugggaucugccccuccc

SEQ ID NO: 2455988 - RNA, 18 nt, Human
ucguggggugugcuggga

SEQ ID NO: 2455989 - RNA, 15 nt, Human
ucguggggugugcug

SEQ ID NO: 2455990 - RNA, 12 nt, Human
ucguggggaggu

SEQ ID NO: 2455991 - RNA, 23 nt, Human
ucgugggagagagacguguacau

SEQ ID NO: 2455992 - RNA, 19 nt, Human
ucguggccuuccccagccu

SEQ ID NO: 2455993 - RNA, 20 nt, Human
ucuaauauggcaaaaauggc

SEQ ID NO: 2455994 - RNA, 14 nt, Human
ucuaauauggccac

SEQ ID NO: 2455995 - RNA, 14 nt, Human
ucuaauaucagcaa

SEQ ID NO: 2455996 - RNA, 15 nt, Human
ucuaauauauuuuua

SEQ ID NO: 2455997 - RNA, 13 nt, Human
ucuaauagugcuu

SEQ ID NO: 2455998 - RNA, 19 nt, Human
ucuaauagaacucaguuuu

SEQ ID NO: 2455999 - RNA, 17 nt, Human
ucuaaccacaucaauau

SEQ ID NO: 2456000 - RNA, 19 nt, Human
ucuaacagcucaggaucuc

SEQ ID NO: 2456001 - RNA, 22 nt, Human
ucuaauagaacucaguuuuaac

SEQ ID NO: 2456002 - RNA, 21 nt, Human
ucuaauagcggguuacuuuca

SEQ ID NO: 2456003 - RNA, 15 nt, Human
ucuaacagcucagga

SEQ ID NO: 2456004 - RNA, 17 nt, Human
ucuaacagcucaggauc

SEQ ID NO: 2456005 - RNA, 13 nt, Human
ucuaacaaugaca

SEQ ID NO: 2456006 - RNA, 23 nt, Human
ucuaacaagucauagguuaauau

SEQ ID NO: 2456007 - RNA, 12 nt, Human
ucuaacaaguca

SEQ ID NO: 2456008 - RNA, 21 nt, Human
ucuaugccaaagaucacuugu

SEQ ID NO: 2456009 - RNA, 12 nt, Human
ucuaugcucucg

SEQ ID NO: 2456010 - RNA, 15 nt, Human
ucuaugaugcuguug

SEQ ID NO: 2456011 - RNA, 14 nt, Human
ucuaugcauuuucu

SEQ ID NO: 2456012 - RNA, 22 nt, Human
ucuaugauuccagguggcauca

SEQ ID NO: 2456013 - RNA, 15 nt, Human
ucuaugccaaagauc

SEQ ID NO: 2456014 - RNA, 15 nt, Human
ucuaugcauuuucug

SEQ ID NO: 2456015 - RNA, 17 nt, Human
ucuaugccaaagaucac

SEQ ID NO: 2456016 - RNA, 16 nt, Human
ucuaugccaaagauca

SEQ ID NO: 2456017 - RNA, 14 nt, Human
ucuaugccagcuca

SEQ ID NO: 2456018 - RNA, 15 nt, Human
ucucaacuccaaacu

SEQ ID NO: 2456019 - RNA, 17 nt, Human
ucucaaauaacuaaaag

SEQ ID NO: 2456020 - RNA, 16 nt, Human
ucucaaaguuuugaaa

SEQ ID NO: 2456021 - RNA, 17 nt, Human
ucuaugaaauauuaugu

SEQ ID NO: 2456022 - RNA, 14 nt, Human
ucuaugaaauauua

SEQ ID NO: 2456023 - RNA, 13 nt, Human
ucuaugaaauauu

SEQ ID NO: 2456024 - RNA, 21 nt, Human
ucuaucaaguauuauaccuuu

SEQ ID NO: 2456025 - RNA, 22 nt, Human
ucuaucaaguauuauaccuuuu

SEQ ID NO: 2456026 - RNA, 15 nt, Human
ucuaucaaguauuau

SEQ ID NO: 2456027 - RNA, 16 nt, Human
ucuagugcagcugauu

SEQ ID NO: 2456028 - RNA, 22 nt, Human
ucuagugagcagucaggaaaga

SEQ ID NO: 2456029 - RNA, 14 nt, Human
ucuagucucucugg

SEQ ID NO: 2456030 - RNA, 22 nt, Human
ucuagucuccuuugcacugagg

SEQ ID NO: 2456031 - RNA, 19 nt, Human
ucuaggagggagacacugg

SEQ ID NO: 2456032 - RNA, 18 nt, Human
ucuagucucucuggggcc

SEQ ID NO: 2456033 - RNA, 14 nt, Human
ucuagugcagcuga

SEQ ID NO: 2456034 - RNA, 19 nt, Human
ucuagugagcagucaggaa

SEQ ID NO: 2456035 - RNA, 20 nt, Human
ucuagucuccuuugcacuga

SEQ ID NO: 2456036 - RNA, 17 nt, Human
ucuaggagcugggagga

SEQ ID NO: 2456037 - RNA, 18 nt, Human
ucuaggagcugggaggaa

SEQ ID NO: 2456038 - RNA, 20 nt, Human
ucuaggagcugggaggaaaa

SEQ ID NO: 2456039 - RNA, 21 nt, Human
ucuaggagcugggaggaaaag

SEQ ID NO: 2456040 - RNA, 13 nt, Human
ucuagaacacagg

SEQ ID NO: 2456041 - RNA, 15 nt, Human
ucuagaacacaggca

SEQ ID NO: 2456042 - RNA, 16 nt, Human
ucuagaacacaggcaa

SEQ ID NO: 2456043 - RNA, 22 nt, Human
ucuagaaagccuguuccccuca

SEQ ID NO: 2456044 - RNA, 18 nt, Human
ucuaggacgccacccagc

SEQ ID NO: 2456045 - RNA, 16 nt, Human
ucuaggagcugggagg

SEQ ID NO: 2456046 - RNA, 14 nt, Human
ucuaaugugugaau

SEQ ID NO: 2456047 - RNA, 14 nt, Human
ucuaauauguaaca

SEQ ID NO: 2456048 - RNA, 14 nt, Human
ucuacuuuuaaaga

SEQ ID NO: 2456049 - RNA, 16 nt, Human
ucuacuuugaggaaac

SEQ ID NO: 2456050 - RNA, 21 nt, Human
ucuacuuuauuaauuguuuug

SEQ ID NO: 2456051 - RNA, 20 nt, Human
ucuacuuugaagucauacca

SEQ ID NO: 2456052 - RNA, 12 nt, Human
ucuacuuugaag

SEQ ID NO: 2456053 - RNA, 14 nt, Human
ucuacuuuauuaau

SEQ ID NO: 2456054 - RNA, 22 nt, Human
ucuacuuuagaaugagagugug

SEQ ID NO: 2456055 - RNA, 20 nt, Human
ucuaauucuaaggaauauga

SEQ ID NO: 2456056 - RNA, 18 nt, Human
ucuaauucccauuuugca

SEQ ID NO: 2456057 - RNA, 19 nt, Human
ucuaauucccauuuugcaa

SEQ ID NO: 2456058 - RNA, 21 nt, Human
ucuaauucccauuuugcaaaa

SEQ ID NO: 2456059 - RNA, 22 nt, Human
ucuaauucccauuuugcaaaau

SEQ ID NO: 2456060 - RNA, 16 nt, Human
ucuacuuuaagcacua

SEQ ID NO: 2456061 - RNA, 17 nt, Human
uccuggcacugcuucca

SEQ ID NO: 2456062 - RNA, 22 nt, Human
uccuggcacccggccccugcug

SEQ ID NO: 2456063 - RNA, 21 nt, Human
uccuggcacccggccccugcu

SEQ ID NO: 2456064 - RNA, 20 nt, Human
uccuggcacccggccccugc

SEQ ID NO: 2456065 - RNA, 22 nt, Human
uccuggcacugcuuccagugag

SEQ ID NO: 2456066 - RNA, 18 nt, Human
uccuggcacugcuuccag

SEQ ID NO: 2456067 - RNA, 15 nt, Human
uccuggcagaaugcu

SEQ ID NO: 2456068 - RNA, 23 nt, Human
uccuggcaauaguguguucugau

SEQ ID NO: 2456069 - RNA, 21 nt, Human
uccuggcaauaguguguucug

SEQ ID NO: 2456070 - RNA, 22 nt, Human
uccuggcaauaguguguucuga

SEQ ID NO: 2456071 - RNA, 11 nt, Human
uccugccuacu

SEQ ID NO: 2456072 - RNA, 20 nt, Human
uccuggcaauaguguguucu

SEQ ID NO: 2456073 - RNA, 20 nt, Human
uccuguaccucuugagccuu

SEQ ID NO: 2456074 - RNA, 22 nt, Human
uccuguaccucuugagccuuga

SEQ ID NO: 2456075 - RNA, 20 nt, Human
uccuguacauugugggaugu

SEQ ID NO: 2456076 - RNA, 23 nt, Human
uccuguaacacaagccacagaag

SEQ ID NO: 2456077 - RNA, 21 nt, Human
uccuguaacacaagccacaga

SEQ ID NO: 2456078 - RNA, 20 nt, Human
uccuguaacacaagccacag

SEQ ID NO: 2456079 - RNA, 20 nt, Human
uccuguaaaugguguacaua

SEQ ID NO: 2456080 - RNA, 19 nt, Human
uccuguaaaugguguacau

SEQ ID NO: 2456081 - RNA, 21 nt, Human
uccuguaauuccuaccucccu

SEQ ID NO: 2456082 - RNA, 16 nt, Human
uccuguaauuccuacc

SEQ ID NO: 2456083 - RNA, 15 nt, Human
uccuguaauuccuac

SEQ ID NO: 2456084 - RNA, 13 nt, Human
uccuguaauuccu

SEQ ID NO: 2456085 - RNA, 14 nt, Human
uccuguacauugug

SEQ ID NO: 2456086 - RNA, 16 nt, Human
uccuguacacugaaua

SEQ ID NO: 2456087 - RNA, 17 nt, Human
uccuguacacugaauau

SEQ ID NO: 2456088 - RNA, 23 nt, Human
uccuguccuuuacacauucggcu

SEQ ID NO: 2456089 - RNA, 22 nt, Human
uccuguccuucucucaccuccu

SEQ ID NO: 2456090 - RNA, 21 nt, Human
uccuguccucccauccccugg

SEQ ID NO: 2456091 - RNA, 11 nt, Human
uccuguccucc

SEQ ID NO: 2456092 - RNA, 21 nt, Human
uccuguacacugaauauuuau

SEQ ID NO: 2456093 - RNA, 16 nt, Human
uccuguccucagcuuc

SEQ ID NO: 2456094 - RNA, 19 nt, Human
uccuggcacccggccccug

SEQ ID NO: 2456095 - RNA, 16 nt, Human
uccuggcacccggccc

SEQ ID NO: 2456096 - RNA, 14 nt, Human
uccuggcacccggc

SEQ ID NO: 2456097 - RNA, 15 nt, Human
uccugccucagccuc

SEQ ID NO: 2456098 - RNA, 13 nt, Human
uccugccucagcc

SEQ ID NO: 2456099 - RNA, 16 nt, Human
uccugccucagccucc

SEQ ID NO: 2456100 - RNA, 17 nt, Human
uccugccucagccuccc

SEQ ID NO: 2456101 - RNA, 13 nt, Human
uccugagccagau

SEQ ID NO: 2456102 - RNA, 21 nt, Human
uccugagaccccuggccuccg

SEQ ID NO: 2456103 - RNA, 19 nt, Human
uccugagaccccuggccuc

SEQ ID NO: 2456104 - RNA, 18 nt, Human
uccugagaccccuggccu

SEQ ID NO: 2456105 - RNA, 20 nt, Human
uccugagaccccuggccucc

SEQ ID NO: 2456106 - RNA, 13 nt, Human
uccucuucuuuau

SEQ ID NO: 2456107 - RNA, 23 nt, Human
uccucuucugcuuaggagagacc

SEQ ID NO: 2456108 - RNA, 17 nt, Human
uccugagaccccuggcc

SEQ ID NO: 2456109 - RNA, 16 nt, Human
uccugagaccccuggc

SEQ ID NO: 2456110 - RNA, 14 nt, Human
uccugagaccccug

SEQ ID NO: 2456111 - RNA, 20 nt, Human
uccugccuaagugcagcccc

SEQ ID NO: 2456112 - RNA, 14 nt, Human
uccugagccagauu

SEQ ID NO: 2456113 - RNA, 14 nt, Human
uccugccucagccu

SEQ ID NO: 2456114 - RNA, 13 nt, Human
uccuucaccucug

SEQ ID NO: 2456115 - RNA, 19 nt, Human
uccuucaccucacugaaaa

SEQ ID NO: 2456116 - RNA, 17 nt, Human
uccuucaccucacugaa

SEQ ID NO: 2456117 - RNA, 12 nt, Human
uccuucagacac

SEQ ID NO: 2456118 - RNA, 23 nt, Human
uccuugaagaacugcaggcccug

SEQ ID NO: 2456119 - RNA, 21 nt, Human
uccuugaagaacugcaggccc

SEQ ID NO: 2456120 - RNA, 20 nt, Human
uccuugaagaacugcaggcc

SEQ ID NO: 2456121 - RNA, 13 nt, Human
uccuucagacacc

SEQ ID NO: 2456122 - RNA, 22 nt, Human
uccuucaccuuuguccccaccg

SEQ ID NO: 2456123 - RNA, 21 nt, Human
uccuucaccuuuguccccacc

SEQ ID NO: 2456124 - RNA, 13 nt, Human
uccuugcuuggcu

SEQ ID NO: 2456125 - RNA, 22 nt, Human
uccuugcuuaugacaucacuug

SEQ ID NO: 2456126 - RNA, 20 nt, Human
uccuugagagaccaggcaaa

SEQ ID NO: 2456127 - RNA, 16 nt, Human
uccuugagagaccagg

SEQ ID NO: 2456128 - RNA, 17 nt, Human
uccuugagacacggagc

SEQ ID NO: 2456129 - RNA, 21 nt, Human
uccuugagacacggagcccag

SEQ ID NO: 2456130 - RNA, 23 nt, Human
uccuugagacacggagcccagcc

SEQ ID NO: 2456131 - RNA, 12 nt, Human
uccuugaagccg

SEQ ID NO: 2456132 - RNA, 13 nt, Human
uccuugaccagca

SEQ ID NO: 2456133 - RNA, 21 nt, Human
uccuugaccagcagaucccag

SEQ ID NO: 2456134 - RNA, 18 nt, Human
uccuucacagaugggugc

SEQ ID NO: 2456135 - RNA, 18 nt, Human
uccuuaccagcagagcac

SEQ ID NO: 2456136 - RNA, 17 nt, Human
uccuuaccagcagagca

SEQ ID NO: 2456137 - RNA, 16 nt, Human
uccuuaccagcagagc

SEQ ID NO: 2456138 - RNA, 20 nt, Human
uccuucaccuuuguccccac

SEQ ID NO: 2456139 - RNA, 18 nt, Human
uccuucaccuuugucccc

SEQ ID NO: 2456140 - RNA, 19 nt, Human
uccuucacagaugggugcu

SEQ ID NO: 2456141 - RNA, 14 nt, Human
uccuucacauccug

SEQ ID NO: 2456142 - RNA, 20 nt, Human
uccuucacauccuguguuuc

SEQ ID NO: 2456143 - RNA, 16 nt, Human
uccuuggacucauuuu

SEQ ID NO: 2456144 - RNA, 19 nt, Human
uccuuggauaggcuuuuua

SEQ ID NO: 2456145 - RNA, 16 nt, Human
uccuuggaaguuucau

SEQ ID NO: 2456146 - RNA, 12 nt, Human
uccuuggaaauc

SEQ ID NO: 2456147 - RNA, 20 nt, Human
uccuuggcaucacagggcag

SEQ ID NO: 2456148 - RNA, 15 nt, Human
uccuuggcaugccuu

SEQ ID NO: 2456149 - RNA, 17 nt, Human
uccuuggcaugccuucc

SEQ ID NO: 2456150 - RNA, 18 nt, Human
uccuuggcaugccuucca

SEQ ID NO: 2456151 - RNA, 10 nt, Human
uccuuuguuc

SEQ ID NO: 2456152 - RNA, 20 nt, Human
uccuuggcaugccuuccagc

SEQ ID NO: 2456153 - RNA, 16 nt, Human
uccuuuguucuuaccu

SEQ ID NO: 2456154 - RNA, 24 nt, Human
uccuuuguucuuaccuguaugucu

SEQ ID NO: 2456155 - RNA, 15 nt, Human
uccuuuguuuuuaug

SEQ ID NO: 2456156 - RNA, 19 nt, Human
uccuuuuaaaacacuucca

SEQ ID NO: 2456157 - RNA, 23 nt, Human
uccuuuguuuuuuuuuccugucc

SEQ ID NO: 2456158 - RNA, 19 nt, Human
uccuuuguuuuuuuuuccu

SEQ ID NO: 2456159 - RNA, 23 nt, Human
uccuuuucacaguucucuccuuc

SEQ ID NO: 2456160 - RNA, 17 nt, Human
uccuuuuaauuuuccug

SEQ ID NO: 2456161 - RNA, 13 nt, Human
uccuuuuagccua

SEQ ID NO: 2456162 - RNA, 20 nt, Human
uccuuuuaaaucuugauacc

SEQ ID NO: 2456163 - RNA, 15 nt, Human
ucgaaccguuuugaa

SEQ ID NO: 2456164 - RNA, 18 nt, Human
ucgaaccguuuugaagcu

SEQ ID NO: 2456165 - RNA, 15 nt, Human
ucgaacuccugaccu

SEQ ID NO: 2456166 - RNA, 20 nt, Human
ucgaaauaacaauguuaagg

SEQ ID NO: 2456167 - RNA, 19 nt, Human
ucgaaauaacaauguuaag

SEQ ID NO: 2456168 - RNA, 18 nt, Human
ucgaaauaacaauguuaa

SEQ ID NO: 2456169 - RNA, 16 nt, Human
ucgaaauaacaauguu

SEQ ID NO: 2456170 - RNA, 14 nt, Human
ucgaaauaacaaug

SEQ ID NO: 2456171 - RNA, 12 nt, Human
ucgaaauaacaa

SEQ ID NO: 2456172 - RNA, 17 nt, Human
ucgaggcggaucuuugg

SEQ ID NO: 2456173 - RNA, 22 nt, Human
ucgaggcggaucuuuggacaga

SEQ ID NO: 2456174 - RNA, 16 nt, Human
ucgaggcugcagucag

SEQ ID NO: 2456175 - RNA, 20 nt, Human
ucgaggcugcagucagucau

SEQ ID NO: 2456176 - RNA, 15 nt, Human
ucgagggcagggacu

SEQ ID NO: 2456177 - RNA, 18 nt, Human
ucgaaacacagaaaccuu

SEQ ID NO: 2456178 - RNA, 13 nt, Human
ucgaaacacagaa

SEQ ID NO: 2456179 - RNA, 19 nt, Human
ucgaaaccugggauucagg

SEQ ID NO: 2456180 - RNA, 15 nt, Human
uccuuuucccugcuu

SEQ ID NO: 2456181 - RNA, 14 nt, Human
uccuuuucccugcu

SEQ ID NO: 2456182 - RNA, 15 nt, Human
uccuuuuccucucuc

SEQ ID NO: 2456183 - RNA, 13 nt, Human
uccuuuucccugc

SEQ ID NO: 2456184 - RNA, 15 nt, Human
uccuuuuagccuagu

SEQ ID NO: 2456185 - RNA, 12 nt, Human
uccuuuuauguu

SEQ ID NO: 2456186 - RNA, 14 nt, Human
uccuuuuagccuag

SEQ ID NO: 2456187 - RNA, 15 nt, Human
uccuuuuauguuauu

SEQ ID NO: 2456188 - RNA, 14 nt, Human
uccuuuuauguuau

SEQ ID NO: 2456189 - RNA, 14 nt, Human
uccuuuucagaagu

SEQ ID NO: 2456190 - RNA, 17 nt, Human
uccaggugugcacgugg

SEQ ID NO: 2456191 - RNA, 21 nt, Human
uccccuguuuguuucugaaag

SEQ ID NO: 2456192 - RNA, 15 nt, Human
ucccgggacgcagca

SEQ ID NO: 2456193 - RNA, 15 nt, Human
ucccgggcccucccu

SEQ ID NO: 2456194 - RNA, 14 nt, Human
ucccgggcccuccc

SEQ ID NO: 2456195 - RNA, 13 nt, Human
ucccgggcccucc

SEQ ID NO: 2456196 - RNA, 21 nt, Human
ucccgggcccguugaggauga

SEQ ID NO: 2456197 - RNA, 18 nt, Human
uccagguguuacuguaau

SEQ ID NO: 2456198 - RNA, 17 nt, Human
uccagguuuaagcuguu

SEQ ID NO: 2456199 - RNA, 20 nt, Human
uccccuguuuguuucugaaa

SEQ ID NO: 2456200 - RNA, 18 nt, Human
uccccuguuuguuucuga

SEQ ID NO: 2456201 - RNA, 18 nt, Human
uccagguuuaagcuguua

SEQ ID NO: 2456202 - RNA, 20 nt, Human
ucccguggccccagccuggc

SEQ ID NO: 2456203 - RNA, 19 nt, Human
ucccguggccccagccugg

SEQ ID NO: 2456204 - RNA, 18 nt, Human
ucccguggccccagccug

SEQ ID NO: 2456205 - RNA, 17 nt, Human
ucccguggccccagccu

SEQ ID NO: 2456206 - RNA, 16 nt, Human
ucccguggccccagcc

SEQ ID NO: 2456207 - RNA, 15 nt, Human
ucccguggccccagc

SEQ ID NO: 2456208 - RNA, 14 nt, Human
ucccguggccccag

SEQ ID NO: 2456209 - RNA, 13 nt, Human
ucccguggcccca

SEQ ID NO: 2456210 - RNA, 24 nt, Human
ucccguggccccagccuggcccag

SEQ ID NO: 2456211 - RNA, 23 nt, Human
ucccguggccccagccuggccca

SEQ ID NO: 2456212 - RNA, 22 nt, Human
ucccguggccccagccuggccc

SEQ ID NO: 2456213 - RNA, 21 nt, Human
ucccguggccccagccuggcc

SEQ ID NO: 2456214 - RNA, 20 nt, Human
ucccguuucuccaccuagac

SEQ ID NO: 2456215 - RNA, 15 nt, Human
ucccguguucuccuu

SEQ ID NO: 2456216 - RNA, 15 nt, Human
ucccuaauaaagcug

SEQ ID NO: 2456217 - RNA, 23 nt, Human
ucccguuuagaguuauuuaggcu

SEQ ID NO: 2456218 - RNA, 14 nt, Human
ucccuaauaaagcu

SEQ ID NO: 2456219 - RNA, 20 nt, Human
ucccgucccauauccugccu

SEQ ID NO: 2456220 - RNA, 18 nt, Human
ucccgucccauauccugc

SEQ ID NO: 2456221 - RNA, 23 nt, Human
ucccgucagggcccaagucccug

SEQ ID NO: 2456222 - RNA, 20 nt, Human
ucccgucagggcccaagucc

SEQ ID NO: 2456223 - RNA, 16 nt, Human
ucccgguucuuccagu

SEQ ID NO: 2456224 - RNA, 16 nt, Human
ucccgucagggcccaa

SEQ ID NO: 2456225 - RNA, 18 nt, Human
ucccgggcccucccuugg

SEQ ID NO: 2456226 - RNA, 19 nt, Human
ucccgggguccuguggcag

SEQ ID NO: 2456227 - RNA, 14 nt, Human
ucccggggcuccac

SEQ ID NO: 2456228 - RNA, 17 nt, Human
ucccgucuacucauucc

SEQ ID NO: 2456229 - RNA, 21 nt, Human
ucccgucccauauccugccuc

SEQ ID NO: 2456230 - RNA, 12 nt, Human
ucccguggcccc

SEQ ID NO: 2456231 - RNA, 13 nt, Human
ucccgugcagcuu

SEQ ID NO: 2456232 - RNA, 23 nt, Human
ucccguggaacguuuuuccuguu

SEQ ID NO: 2456233 - RNA, 22 nt, Human
ucccguggaacguuuuuccugu

SEQ ID NO: 2456234 - RNA, 16 nt, Human
ucccguggaacguuuu

SEQ ID NO: 2456235 - RNA, 11 nt, Human
ucccuccuggg

SEQ ID NO: 2456236 - RNA, 15 nt, Human
ucccuccucuguccc

SEQ ID NO: 2456237 - RNA, 19 nt, Human
ucccuccugggaaugaagc

SEQ ID NO: 2456238 - RNA, 19 nt, Human
ucccuccugggaucugcuc

SEQ ID NO: 2456239 - RNA, 18 nt, Human
ucccuccugggaucugcu

SEQ ID NO: 2456240 - RNA, 21 nt, Human
ucccuccugccgacuccuggg

SEQ ID NO: 2456241 - RNA, 16 nt, Human
ucccuccugccgacuc

SEQ ID NO: 2456242 - RNA, 18 nt, Human
ucccuauguauuugcagu

SEQ ID NO: 2456243 - RNA, 14 nt, Human
ucccuccugcuacu

SEQ ID NO: 2456244 - RNA, 17 nt, Human
ucccucuacugggagcc

SEQ ID NO: 2456245 - RNA, 21 nt, Human
ucccucuacagagcuucccug

SEQ ID NO: 2456246 - RNA, 22 nt, Human
ucccucuacagagcuucccuga

SEQ ID NO: 2456247 - RNA, 15 nt, Human
ucccucuacugggag

SEQ ID NO: 2456248 - RNA, 16 nt, Human
ucccucuaauuuaucu

SEQ ID NO: 2456249 - RNA, 14 nt, Human
ucccucuaauuuau

SEQ ID NO: 2456250 - RNA, 22 nt, Human
ucccucgcugcacaaauacucc

SEQ ID NO: 2456251 - RNA, 19 nt, Human
ucccucgcugcacaaauac

SEQ ID NO: 2456252 - RNA, 16 nt, Human
ucccuauuagagaaga

SEQ ID NO: 2456253 - RNA, 14 nt, Human
ucccuccucaccuc

SEQ ID NO: 2456254 - RNA, 16 nt, Human
ucccuccucaccucug

SEQ ID NO: 2456255 - RNA, 17 nt, Human
ucccuccucaccucugg

SEQ ID NO: 2456256 - RNA, 18 nt, Human
ucccuccucaccucugga

SEQ ID NO: 2456257 - RNA, 20 nt, Human
ucccuagugacccggaggcc

SEQ ID NO: 2456258 - RNA, 17 nt, Human
ucccuagucuauucauu

SEQ ID NO: 2456259 - RNA, 22 nt, Human
ucccuagucuauucauuauauu

SEQ ID NO: 2456260 - RNA, 18 nt, Human
ucccuagucuucaagcag

SEQ ID NO: 2456261 - RNA, 15 nt, Human
ucccuauguauuugc

SEQ ID NO: 2456262 - RNA, 13 nt, Human
ucccuauguauuu

SEQ ID NO: 2456263 - RNA, 19 nt, Human
ucccuaucuuugccacccu

SEQ ID NO: 2456264 - RNA, 16 nt, Human
ucccuaauaaagcugu

SEQ ID NO: 2456265 - RNA, 20 nt, Human
ucccuaaugcugcagauuug

SEQ ID NO: 2456266 - RNA, 14 nt, Human
ucccuaaugcugca

SEQ ID NO: 2456267 - RNA, 23 nt, Human
ucccuaaucuauggucgggagac

SEQ ID NO: 2456268 - RNA, 16 nt, Human
ucccuaaucuaugguc

SEQ ID NO: 2456269 - RNA, 18 nt, Human
ucccuaaaaacacagaca

SEQ ID NO: 2456270 - RNA, 15 nt, Human
ucccuaggagaccaa

SEQ ID NO: 2456271 - RNA, 13 nt, Human
ucccuacauguau

SEQ ID NO: 2456272 - RNA, 24 nt, Human
ucccuacauguauugcacauugua

SEQ ID NO: 2456273 - RNA, 18 nt, Human
ucccuaggggacacuucc

SEQ ID NO: 2456274 - RNA, 16 nt, Human
ucccuaguaaaaauac

SEQ ID NO: 2456275 - RNA, 13 nt, Human
ucccuucccaccu

SEQ ID NO: 2456276 - RNA, 18 nt, Human
ucccuuccacacccccac

SEQ ID NO: 2456277 - RNA, 16 nt, Human
ucccuuccacaccccc

SEQ ID NO: 2456278 - RNA, 17 nt, Human
ucccuucaugcauggaa

SEQ ID NO: 2456279 - RNA, 18 nt, Human
ucccuucaugcauggaaa

SEQ ID NO: 2456280 - RNA, 21 nt, Human
ucccuucaucuggaaccauca

SEQ ID NO: 2456281 - RNA, 11 nt, Human
ucccuggccuu

SEQ ID NO: 2456282 - RNA, 14 nt, Human
ucccuggccuguuc

SEQ ID NO: 2456283 - RNA, 18 nt, Human
ucccuggccuguucuguu

SEQ ID NO: 2456284 - RNA, 13 nt, Human
ucccuggccuguu

SEQ ID NO: 2456285 - RNA, 22 nt, Human
ucccuggaguguggcugaggag

SEQ ID NO: 2456286 - RNA, 22 nt, Human
ucccuggagccagacucugguc

SEQ ID NO: 2456287 - RNA, 19 nt, Human
ucccuggagccagacucug

SEQ ID NO: 2456288 - RNA, 21 nt, Human
ucccuggaguguggcugagga

SEQ ID NO: 2456289 - RNA, 11 nt, Human
ucccuggagug

SEQ ID NO: 2456290 - RNA, 10 nt, Human
ucccuggagu

SEQ ID NO: 2456291 - RNA, 15 nt, Human
ucccuugaugaagaa

SEQ ID NO: 2456292 - RNA, 22 nt, Human
ucccuucuccaucucucuggcc

SEQ ID NO: 2456293 - RNA, 21 nt, Human
ucccuucuccaucucucuggc

SEQ ID NO: 2456294 - RNA, 16 nt, Human
ucccuucuccaucucu

SEQ ID NO: 2456295 - RNA, 20 nt, Human
ucccuucucuguagggaacu

SEQ ID NO: 2456296 - RNA, 18 nt, Human
ucccuugagaccucagcc

SEQ ID NO: 2456297 - RNA, 22 nt, Human
ucccuucuaggguuauugcauu

SEQ ID NO: 2456298 - RNA, 11 nt, Human
ucccuucucca

SEQ ID NO: 2456299 - RNA, 20 nt, Human
ucccuucuaccugccacuca

SEQ ID NO: 2456300 - RNA, 15 nt, Human
ucccuucuaccugcc

SEQ ID NO: 2456301 - RNA, 20 nt, Human
ucccuuccuuuucccugcuu

SEQ ID NO: 2456302 - RNA, 19 nt, Human
ucccuuccuuuucccugcu

SEQ ID NO: 2456303 - RNA, 18 nt, Human
ucccuuccuuuucccugc

SEQ ID NO: 2456304 - RNA, 17 nt, Human
ucccuuccuuuucccug

SEQ ID NO: 2456305 - RNA, 20 nt, Human
uccgacagcccccucugccg

SEQ ID NO: 2456306 - RNA, 20 nt, Human
uccgaccacuaauugccaag

SEQ ID NO: 2456307 - RNA, 21 nt, Human
uccgacaaccgaugcuccagc

SEQ ID NO: 2456308 - RNA, 22 nt, Human
uccgacaaccgaugcuccagcc

SEQ ID NO: 2456309 - RNA, 17 nt, Human
uccgacagcccccucug

SEQ ID NO: 2456310 - RNA, 23 nt, Human
uccgacaaccgaugcuccagcca

SEQ ID NO: 2456311 - RNA, 19 nt, Human
uccgaaccuccucugugaa

SEQ ID NO: 2456312 - RNA, 20 nt, Human
uccgacaaccgaugcuccag

SEQ ID NO: 2456313 - RNA, 21 nt, Human
uccgaaguaugagggaaaaug

SEQ ID NO: 2456314 - RNA, 22 nt, Human
uccgaaccuccucugugaagca

SEQ ID NO: 2456315 - RNA, 18 nt, Human
uccgaaccuccucuguga

SEQ ID NO: 2456316 - RNA, 19 nt, Human
ucccuugagaccucagcca

SEQ ID NO: 2456317 - RNA, 16 nt, Human
ucccuugaugaagaag

SEQ ID NO: 2456318 - RNA, 14 nt, Human
ucccuugagcccuc

SEQ ID NO: 2456319 - RNA, 23 nt, Human
ucccuugaggaaacaacagcuuu

SEQ ID NO: 2456320 - RNA, 13 nt, Human
ucccugcacuugc

SEQ ID NO: 2456321 - RNA, 19 nt, Human
ucccugccccucccuucaa

SEQ ID NO: 2456322 - RNA, 14 nt, Human
ucccugcacuugca

SEQ ID NO: 2456323 - RNA, 12 nt, Human
ucccucucucug

SEQ ID NO: 2456324 - RNA, 22 nt, Human
ucccucucggaaggcuggcugg

SEQ ID NO: 2456325 - RNA, 23 nt, Human
ucccucucggaaggcuggcuggg

SEQ ID NO: 2456326 - RNA, 12 nt, Human
ucccucucccug

SEQ ID NO: 2456327 - RNA, 13 nt, Human
ucccucuccugcc

SEQ ID NO: 2456328 - RNA, 14 nt, Human
ucccucuccugccu

SEQ ID NO: 2456329 - RNA, 15 nt, Human
ucccucuccugccua

SEQ ID NO: 2456330 - RNA, 12 nt, Human
ucccucucggaa

SEQ ID NO: 2456331 - RNA, 13 nt, Human
ucccucucucuga

SEQ ID NO: 2456332 - RNA, 16 nt, Human
ucccucuccugccuac

SEQ ID NO: 2456333 - RNA, 17 nt, Human
ucccucucucugacucu

SEQ ID NO: 2456334 - RNA, 15 nt, Human
ucccucucucugacu

SEQ ID NO: 2456335 - RNA, 12 nt, Human
ucccucucucuu

SEQ ID NO: 2456336 - RNA, 16 nt, Human
ucccucucucuucugc

SEQ ID NO: 2456337 - RNA, 18 nt, Human
ucccucucucuucugcuc

SEQ ID NO: 2456338 - RNA, 19 nt, Human
ucccucucucuucugcucc

SEQ ID NO: 2456339 - RNA, 22 nt, Human
ucccucucucugacucucaaau

SEQ ID NO: 2456340 - RNA, 15 nt, Human
ucccugccuggucac

SEQ ID NO: 2456341 - RNA, 23 nt, Human
ucccugcuagggguuuuaggucu

SEQ ID NO: 2456342 - RNA, 17 nt, Human
ucccugcuccacgucug

SEQ ID NO: 2456343 - RNA, 16 nt, Human
ucccugcuguguuccc

SEQ ID NO: 2456344 - RNA, 19 nt, Human
ucccugcugucgucuuagc

SEQ ID NO: 2456345 - RNA, 22 nt, Human
ucccugcuguccccucuugccc

SEQ ID NO: 2456346 - RNA, 21 nt, Human
ucccugcuguccccucuugcc

SEQ ID NO: 2456347 - RNA, 17 nt, Human
ucccugcuguccccucu

SEQ ID NO: 2456348 - RNA, 14 nt, Human
ucccugcugucccc

SEQ ID NO: 2456349 - RNA, 13 nt, Human
ucccugcuguccc

SEQ ID NO: 2456350 - RNA, 18 nt, Human
ucccugcuuccaggaaac

SEQ ID NO: 2456351 - RNA, 14 nt, Human
ucccugcuuccagg

SEQ ID NO: 2456352 - RNA, 12 nt, Human
ucccugcuucca

SEQ ID NO: 2456353 - RNA, 13 nt, Human
ucccuggaaggug

SEQ ID NO: 2456354 - RNA, 17 nt, Human
ucccuggagccagacuc

SEQ ID NO: 2456355 - RNA, 17 nt, Human
ucccugccucucaucaa

SEQ ID NO: 2456356 - RNA, 23 nt, Human
ucccugccucucaucaacugaau

SEQ ID NO: 2456357 - RNA, 11 nt, Human
ucccugccugg

SEQ ID NO: 2456358 - RNA, 23 nt, Human
ucccugccugguccucacacuca

SEQ ID NO: 2456359 - RNA, 20 nt, Human
ucccugccccucccuucaac

SEQ ID NO: 2456360 - RNA, 16 nt, Human
ucccugcccucaucuc

SEQ ID NO: 2456361 - RNA, 15 nt, Human
ucccugcccucaucu

SEQ ID NO: 2456362 - RNA, 17 nt, Human
ucccugcccucaucucu

SEQ ID NO: 2456363 - RNA, 14 nt, Human
ucccugccgccuca

SEQ ID NO: 2456364 - RNA, 15 nt, Human
uccucggccuggcuc

SEQ ID NO: 2456365 - RNA, 14 nt, Human
uccucggccuggcu

SEQ ID NO: 2456366 - RNA, 19 nt, Human
uccucggcccccuccaucg

SEQ ID NO: 2456367 - RNA, 15 nt, Human
uccucggcccccucc

SEQ ID NO: 2456368 - RNA, 17 nt, Human
uccucgguacucccaua

SEQ ID NO: 2456369 - RNA, 15 nt, Human
uccucgguacuccca

SEQ ID NO: 2456370 - RNA, 24 nt, Human
uccucgccugacaaccacuggucu

SEQ ID NO: 2456371 - RNA, 15 nt, Human
uccucgccugacaac

SEQ ID NO: 2456372 - RNA, 16 nt, Human
uccucggaucaccgag

SEQ ID NO: 2456373 - RNA, 14 nt, Human
uccucggcccccuc

SEQ ID NO: 2456374 - RNA, 19 nt, Human
uccucggaucaccgagagu

SEQ ID NO: 2456375 - RNA, 19 nt, Human
uccuccuuuucacaguucu

SEQ ID NO: 2456376 - RNA, 24 nt, Human
uccucgcagagaggccaggugcag

SEQ ID NO: 2456377 - RNA, 13 nt, Human
uccucgccugaca

SEQ ID NO: 2456378 - RNA, 13 nt, Human
uccucgcccuggg

SEQ ID NO: 2456379 - RNA, 14 nt, Human
uccucgcccugggu

SEQ ID NO: 2456380 - RNA, 14 nt, Human
uccucuaggagguc

SEQ ID NO: 2456381 - RNA, 19 nt, Human
uccucuacuaacaaucagc

SEQ ID NO: 2456382 - RNA, 21 nt, Human
uccucuaagccacucuuccaa

SEQ ID NO: 2456383 - RNA, 18 nt, Human
uccucuacuuaaugagau

SEQ ID NO: 2456384 - RNA, 17 nt, Human
uccucuagaagccaagg

SEQ ID NO: 2456385 - RNA, 16 nt, Human
uccucuagaagccaag

SEQ ID NO: 2456386 - RNA, 14 nt, Human
uccucuagaagcca

SEQ ID NO: 2456387 - RNA, 19 nt, Human
uccucuacuuaaugagaua

SEQ ID NO: 2456388 - RNA, 17 nt, Human
uccucuacuaacaauca

SEQ ID NO: 2456389 - RNA, 18 nt, Human
uccucuacuaacaaucag

SEQ ID NO: 2456390 - RNA, 20 nt, Human
uccucuaagccacucuucca

SEQ ID NO: 2456391 - RNA, 16 nt, Human
uccucgguacucccau

SEQ ID NO: 2456392 - RNA, 19 nt, Human
uccuccuuggugccuggcc

SEQ ID NO: 2456393 - RNA, 17 nt, Human
uccuccuuggugccugg

SEQ ID NO: 2456394 - RNA, 16 nt, Human
uccuccuuggugccug

SEQ ID NO: 2456395 - RNA, 21 nt, Human
uccuccugguggguccagggg

SEQ ID NO: 2456396 - RNA, 20 nt, Human
uccuccugguggguccaggg

SEQ ID NO: 2456397 - RNA, 16 nt, Human
uccuccuguguacagg

SEQ ID NO: 2456398 - RNA, 22 nt, Human
uccuccugguggguccaggggc

SEQ ID NO: 2456399 - RNA, 13 nt, Human
uccuccuuccaug

SEQ ID NO: 2456400 - RNA, 13 nt, Human
uccuccuucccaa

SEQ ID NO: 2456401 - RNA, 15 nt, Human
uccuccuuccaugga

SEQ ID NO: 2456402 - RNA, 22 nt, Human
uccuccugggcccucucugcuc

SEQ ID NO: 2456403 - RNA, 13 nt, Human
uccuccugguggg

SEQ ID NO: 2456404 - RNA, 20 nt, Human
uccuccugggcccucucugc

SEQ ID NO: 2456405 - RNA, 12 nt, Human
uccuccagcagg

SEQ ID NO: 2456406 - RNA, 14 nt, Human
uccuccagcaggga

SEQ ID NO: 2456407 - RNA, 19 nt, Human
uccuccagaagccucuggc

SEQ ID NO: 2456408 - RNA, 20 nt, Human
uccuccagaagccucuggcu

SEQ ID NO: 2456409 - RNA, 21 nt, Human
uccuccagaagccucuggcua

SEQ ID NO: 2456410 - RNA, 22 nt, Human
uccuccagaagccucuggcuag

SEQ ID NO: 2456411 - RNA, 23 nt, Human
uccuccacucucccccacccccu

SEQ ID NO: 2456412 - RNA, 14 nt, Human
uccuccagaagccu

SEQ ID NO: 2456413 - RNA, 16 nt, Human
uccuccagaagccucu

SEQ ID NO: 2456414 - RNA, 18 nt, Human
uccuccagaagccucugg

SEQ ID NO: 2456415 - RNA, 22 nt, Human
uccuccacguucugcucaucau

SEQ ID NO: 2456416 - RNA, 23 nt, Human
uccuccacguucugcucaucauu

SEQ ID NO: 2456417 - RNA, 19 nt, Human
uccuccacucucccccacc

SEQ ID NO: 2456418 - RNA, 16 nt, Human
uccuccacucuccccc

SEQ ID NO: 2456419 - RNA, 21 nt, Human
uccuccacguucugcucauca

SEQ ID NO: 2456420 - RNA, 17 nt, Human
uccucauguucugcuuu

SEQ ID NO: 2456421 - RNA, 24 nt, Human
uccucuggacggcaggcucacugc

SEQ ID NO: 2456422 - RNA, 15 nt, Human
uccucuguacagagc

SEQ ID NO: 2456423 - RNA, 18 nt, Human
uccucuguacagagccca

SEQ ID NO: 2456424 - RNA, 17 nt, Human
uccucuguacagagccc

SEQ ID NO: 2456425 - RNA, 16 nt, Human
uccucuguacagagcc

SEQ ID NO: 2456426 - RNA, 13 nt, Human
uccucuuccucug

SEQ ID NO: 2456427 - RNA, 12 nt, Human
uccucuuccucu

SEQ ID NO: 2456428 - RNA, 19 nt, Human
uccucuuccccuugcccuu

SEQ ID NO: 2456429 - RNA, 18 nt, Human
uccucuuccccuugcccu

SEQ ID NO: 2456430 - RNA, 16 nt, Human
uccucuuccccuugcc

SEQ ID NO: 2456431 - RNA, 15 nt, Human
uccucuuccccuugc

SEQ ID NO: 2456432 - RNA, 20 nt, Human
uccucuggacggcaggcuca

SEQ ID NO: 2456433 - RNA, 18 nt, Human
uccucuggacggcaggcu

SEQ ID NO: 2456434 - RNA, 22 nt, Human
uccucuggacggcaggcucacu

SEQ ID NO: 2456435 - RNA, 17 nt, Human
uccucuucugcaucuug

SEQ ID NO: 2456436 - RNA, 17 nt, Human
uccucuucugacgugcc

SEQ ID NO: 2456437 - RNA, 15 nt, Human
uccucuucugacgug

SEQ ID NO: 2456438 - RNA, 19 nt, Human
uccucuucuauuuuguaaa

SEQ ID NO: 2456439 - RNA, 16 nt, Human
uccucuuccucugagg

SEQ ID NO: 2456440 - RNA, 15 nt, Human
uccucuuccucugag

SEQ ID NO: 2456441 - RNA, 14 nt, Human
uccucuuccucuga

SEQ ID NO: 2456442 - RNA, 21 nt, Human
uccucuuccugaauuuuauuu

SEQ ID NO: 2456443 - RNA, 16 nt, Human
uccucugcugcuggcu

SEQ ID NO: 2456444 - RNA, 15 nt, Human
uccucugcugcuggc

SEQ ID NO: 2456445 - RNA, 14 nt, Human
uccucugcugcugg

SEQ ID NO: 2456446 - RNA, 12 nt, Human
uccucugcugcu

SEQ ID NO: 2456447 - RNA, 19 nt, Human
uccucuagaagccaaggga

SEQ ID NO: 2456448 - RNA, 18 nt, Human
uccucuagaagccaaggg

SEQ ID NO: 2456449 - RNA, 15 nt, Human
uccucuagcuguggg

SEQ ID NO: 2456450 - RNA, 22 nt, Human
uccucuagaagccaagggaaag

SEQ ID NO: 2456451 - RNA, 21 nt, Human
uccucuagcugugggggugag

SEQ ID NO: 2456452 - RNA, 17 nt, Human
uccucuggacggcaggc

SEQ ID NO: 2456453 - RNA, 15 nt, Human
uccucuggacggcag

SEQ ID NO: 2456454 - RNA, 16 nt, Human
uccuaauuccacagcu

SEQ ID NO: 2456455 - RNA, 17 nt, Human
uccuaauuccacagcug

SEQ ID NO: 2456456 - RNA, 18 nt, Human
uccuaauuccacagcugc

SEQ ID NO: 2456457 - RNA, 15 nt, Human
uccuaauuccacagc

SEQ ID NO: 2456458 - RNA, 14 nt, Human
uccuaaucauccaa

SEQ ID NO: 2456459 - RNA, 15 nt, Human
uccuaaucauccaau

SEQ ID NO: 2456460 - RNA, 22 nt, Human
uccuaaugaaugcauaaaaugu

SEQ ID NO: 2456461 - RNA, 16 nt, Human
uccuaauuucuccucc

SEQ ID NO: 2456462 - RNA, 15 nt, Human
uccuaauuucuccuc

SEQ ID NO: 2456463 - RNA, 16 nt, Human
uccuaauuuugagaaa

SEQ ID NO: 2456464 - RNA, 15 nt, Human
uccuacaagacacag

SEQ ID NO: 2456465 - RNA, 20 nt, Human
uccuaccaauagauucccca

SEQ ID NO: 2456466 - RNA, 15 nt, Human
uccuacaaagauguu

SEQ ID NO: 2456467 - RNA, 19 nt, Human
uccuaauuucuccucccuu

SEQ ID NO: 2456468 - RNA, 14 nt, Human
uccuacaaagaugu

SEQ ID NO: 2456469 - RNA, 18 nt, Human
uccuacaagagcagccug

SEQ ID NO: 2456470 - RNA, 20 nt, Human
uccuacauuaauuaucuagu

SEQ ID NO: 2456471 - RNA, 16 nt, Human
uccuaccaaugcaugc

SEQ ID NO: 2456472 - RNA, 15 nt, Human
uccuaccaaugcaug

SEQ ID NO: 2456473 - RNA, 14 nt, Human
uccuaccaaugcau

SEQ ID NO: 2456474 - RNA, 13 nt, Human
uccuaccaaugca

SEQ ID NO: 2456475 - RNA, 21 nt, Human
uccuaccaaugcaugcagcca

SEQ ID NO: 2456476 - RNA, 17 nt, Human
uccuaccaaugcaugca

SEQ ID NO: 2456477 - RNA, 15 nt, Human
uccuacccaaccacu

SEQ ID NO: 2456478 - RNA, 18 nt, Human
uccuacccacccuccuuu

SEQ ID NO: 2456479 - RNA, 18 nt, Human
uccuaauaaaguucugua

SEQ ID NO: 2456480 - RNA, 20 nt, Human
uccuaauaaucauuggauuc

SEQ ID NO: 2456481 - RNA, 16 nt, Human
uccuaaucuucugaac

SEQ ID NO: 2456482 - RNA, 17 nt, Human
uccgaccagacaccuug

SEQ ID NO: 2456483 - RNA, 13 nt, Human
uccgaccagacac

SEQ ID NO: 2456484 - RNA, 20 nt, Human
uccuaguuuucuccucccag

SEQ ID NO: 2456485 - RNA, 23 nt, Human
uccuaguucuguagaaaugguug

SEQ ID NO: 2456486 - RNA, 13 nt, Human
uccuaguuuucuc

SEQ ID NO: 2456487 - RNA, 20 nt, Human
uccuauaauucccuaucuuu

SEQ ID NO: 2456488 - RNA, 20 nt, Human
uccuauaauauaauaaauau

SEQ ID NO: 2456489 - RNA, 18 nt, Human
uccuauacgcagcgugcu

SEQ ID NO: 2456490 - RNA, 19 nt, Human
uccuauacgcagcgugcuu

SEQ ID NO: 2456491 - RNA, 15 nt, Human
uccuauauaguuuau

SEQ ID NO: 2456492 - RNA, 18 nt, Human
uccuauauuguuuucagu

SEQ ID NO: 2456493 - RNA, 20 nt, Human
uccuacccacaccucugcca

SEQ ID NO: 2456494 - RNA, 16 nt, Human
uccuacccacaccucu

SEQ ID NO: 2456495 - RNA, 15 nt, Human
uccuacccacaccuc

SEQ ID NO: 2456496 - RNA, 16 nt, Human
uccuacccaaccacuc

SEQ ID NO: 2456497 - RNA, 22 nt, Human
uccuacccacaccucugccaga

SEQ ID NO: 2456498 - RNA, 21 nt, Human
uccuacccacaccucugccag

SEQ ID NO: 2456499 - RNA, 14 nt, Human
uccuacccaucccc

SEQ ID NO: 2456500 - RNA, 15 nt, Human
uccuacccauccccg

SEQ ID NO: 2456501 - RNA, 18 nt, Human
uccuaccccaauuccuug

SEQ ID NO: 2456502 - RNA, 16 nt, Human
uccuaccccaauuccu

SEQ ID NO: 2456503 - RNA, 19 nt, Human
uccuaccccaauuccuugu

SEQ ID NO: 2456504 - RNA, 22 nt, Human
uccuaguuccaccaucaagcca

SEQ ID NO: 2456505 - RNA, 17 nt, Human
uccuaguucuguagaaa

SEQ ID NO: 2456506 - RNA, 16 nt, Human
uccuaguucuguagaa

SEQ ID NO: 2456507 - RNA, 19 nt, Human
uccuaguucuguagaaaug

SEQ ID NO: 2456508 - RNA, 18 nt, Human
uccuaguucuguagaaau

SEQ ID NO: 2456509 - RNA, 14 nt, Human
uccuauucucacca

SEQ ID NO: 2456510 - RNA, 14 nt, Human
uccuauucuauugc

SEQ ID NO: 2456511 - RNA, 23 nt, Human
uccuauucaguucccagaaucaa

SEQ ID NO: 2456512 - RNA, 22 nt, Human
uccuauucaguucccagaauca

SEQ ID NO: 2456513 - RNA, 14 nt, Human
uccuauucaguucc

SEQ ID NO: 2456514 - RNA, 19 nt, Human
uccuauguuuuuguucaaa

SEQ ID NO: 2456515 - RNA, 18 nt, Human
uccuauguuuuuguucaa

SEQ ID NO: 2456516 - RNA, 12 nt, Human
uccuauguguaa

SEQ ID NO: 2456517 - RNA, 23 nt, Human
uccuaugugauuuuaacucuguc

SEQ ID NO: 2456518 - RNA, 22 nt, Human
uccuaugugauuuuaacucugu

SEQ ID NO: 2456519 - RNA, 13 nt, Human
uccuauaugcacu

SEQ ID NO: 2456520 - RNA, 21 nt, Human
uccuaugugauuuuaacucug

SEQ ID NO: 2456521 - RNA, 18 nt, Human
uccuauauaguuuauuga

SEQ ID NO: 2456522 - RNA, 21 nt, Human
uccucaucugggggaguggaa

SEQ ID NO: 2456523 - RNA, 20 nt, Human
uccucaucugggggagugga

SEQ ID NO: 2456524 - RNA, 19 nt, Human
uccucaucugggggagugg

SEQ ID NO: 2456525 - RNA, 22 nt, Human
uccucaucucuaacagcucagg

SEQ ID NO: 2456526 - RNA, 23 nt, Human
uccucaucucuaacagcucagga

SEQ ID NO: 2456527 - RNA, 17 nt, Human
uccucauuagcauuuug

SEQ ID NO: 2456528 - RNA, 18 nt, Human
uccucauccagggcucug

SEQ ID NO: 2456529 - RNA, 14 nt, Human
uccucaucccgugu

SEQ ID NO: 2456530 - RNA, 22 nt, Human
uccucaucccguguucuccuuu

SEQ ID NO: 2456531 - RNA, 12 nt, Human
uccucaucucua

SEQ ID NO: 2456532 - RNA, 20 nt, Human
uccucaucucuaacagcuca

SEQ ID NO: 2456533 - RNA, 18 nt, Human
uccuauucucaccaggaa

SEQ ID NO: 2456534 - RNA, 17 nt, Human
uccuauucucaccagga

SEQ ID NO: 2456535 - RNA, 16 nt, Human
uccuauucucaccagg

SEQ ID NO: 2456536 - RNA, 15 nt, Human
uccuauucucaccag

SEQ ID NO: 2456537 - RNA, 16 nt, Human
uccuauucucgggcug

SEQ ID NO: 2456538 - RNA, 20 nt, Human
uccuauucucaccaggaagg

SEQ ID NO: 2456539 - RNA, 14 nt, Human
uccuauugcaaagg

SEQ ID NO: 2456540 - RNA, 20 nt, Human
ugguuguacauauaagugau

SEQ ID NO: 2456541 - RNA, 16 nt, Human
ugguuguauuagaugu

SEQ ID NO: 2456542 - RNA, 14 nt, Human
ugguuguauuagau

SEQ ID NO: 2456543 - RNA, 12 nt, Human
ugguuguauuag

SEQ ID NO: 2456544 - RNA, 17 nt, Human
ugguugucaauauuaaa

SEQ ID NO: 2456545 - RNA, 15 nt, Human
ugguugucaauauua

SEQ ID NO: 2456546 - RNA, 17 nt, Human
ugguuguauucuuugau

SEQ ID NO: 2456547 - RNA, 16 nt, Human
ugguuguauucuuuga

SEQ ID NO: 2456548 - RNA, 15 nt, Human
ugguuguauucuuug

SEQ ID NO: 2456549 - RNA, 11 nt, Human
ugguuguauuc

SEQ ID NO: 2456550 - RNA, 18 nt, Human
ugguuguauuagauguuc

SEQ ID NO: 2456551 - RNA, 16 nt, Human
ugguuuucuguucuuu

SEQ ID NO: 2456552 - RNA, 14 nt, Human
ugguugcuuuaaua

SEQ ID NO: 2456553 - RNA, 13 nt, Human
ugguugcugugug

SEQ ID NO: 2456554 - RNA, 19 nt, Human
ugguugcuguuuuccuccc

SEQ ID NO: 2456555 - RNA, 18 nt, Human
ugguugccuuaaagaaag

SEQ ID NO: 2456556 - RNA, 17 nt, Human
ugguugccuuaaagaaa

SEQ ID NO: 2456557 - RNA, 20 nt, Human
ugguugcacuuaugauuuca

SEQ ID NO: 2456558 - RNA, 13 nt, Human
ugguugcauccua

SEQ ID NO: 2456559 - RNA, 15 nt, Human
ugguugauggguucu

SEQ ID NO: 2456560 - RNA, 22 nt, Human
ugguugaguucagguagcugcc

SEQ ID NO: 2456561 - RNA, 18 nt, Human
ugguugcuuuaauaucau

SEQ ID NO: 2456562 - RNA, 16 nt, Human
ugguuggagagcuaga

SEQ ID NO: 2456563 - RNA, 16 nt, Human
ugguuggagaauuuag

SEQ ID NO: 2456564 - RNA, 16 nt, Human
ugguuggcuggccuuc

SEQ ID NO: 2456565 - RNA, 22 nt, Human
ugguugguaacacaaauuuuca

SEQ ID NO: 2456566 - RNA, 15 nt, Human
ugguuggguccucac

SEQ ID NO: 2456567 - RNA, 19 nt, Human
ugguuuucuuguguguuua

SEQ ID NO: 2456568 - RNA, 22 nt, Human
ugguuguuaguuauagaugucu

SEQ ID NO: 2456569 - RNA, 21 nt, Human
ugguuguuaguuauagauguc

SEQ ID NO: 2456570 - RNA, 23 nt, Human
ugguugucauuuuugcaguagag

SEQ ID NO: 2456571 - RNA, 21 nt, Human
ugguuuuuaaaaaacugcuga

SEQ ID NO: 2456572 - RNA, 19 nt, Human
ugguuuuguaagaugcugg

SEQ ID NO: 2456573 - RNA, 16 nt, Human
ugguuuuguuccccuc

SEQ ID NO: 2456574 - RNA, 18 nt, Human
ugguuuuguaagaugcug

SEQ ID NO: 2456575 - RNA, 20 nt, Human
ugguuuuguuccccuccucc

SEQ ID NO: 2456576 - RNA, 17 nt, Human
ugguuuuguuccccucc

SEQ ID NO: 2456577 - RNA, 23 nt, Human
ugguuuuuaaaaaacugcugacu

SEQ ID NO: 2456578 - RNA, 18 nt, Human
uguaaaaaaaaaugccuu

SEQ ID NO: 2456579 - RNA, 22 nt, Human
uguaaaaaaaaaaaaguuauau

SEQ ID NO: 2456580 - RNA, 20 nt, Human
uguaaaaaaaaaaaaguuau

SEQ ID NO: 2456581 - RNA, 13 nt, Human
uguaaaaaaaaaa

SEQ ID NO: 2456582 - RNA, 15 nt, Human
ugguuuuuuuucuaa

SEQ ID NO: 2456583 - RNA, 22 nt, Human
ugguuuuuguagccuuccucca

SEQ ID NO: 2456584 - RNA, 17 nt, Human
ugguuuuuguagccuuc

SEQ ID NO: 2456585 - RNA, 16 nt, Human
ugguuuuucaguuuuc

SEQ ID NO: 2456586 - RNA, 11 nt, Human
uguaaaauggu

SEQ ID NO: 2456587 - RNA, 23 nt, Human
uguaaaaucuuucuuucuuagaa

SEQ ID NO: 2456588 - RNA, 22 nt, Human
uguaaaaucuuucuuucuuaga

SEQ ID NO: 2456589 - RNA, 14 nt, Human
uguaaaaugaaauu

SEQ ID NO: 2456590 - RNA, 15 nt, Human
uguaaaaugaaauua

SEQ ID NO: 2456591 - RNA, 13 nt, Human
uguaaaaucuuuc

SEQ ID NO: 2456592 - RNA, 21 nt, Human
uguaaaaucuuucuuucuuag

SEQ ID NO: 2456593 - RNA, 14 nt, Human
uguaaaaucuuucu

SEQ ID NO: 2456594 - RNA, 22 nt, Human
uguaaaaucuuggcacagaaac

SEQ ID NO: 2456595 - RNA, 21 nt, Human
uguaaaauauuuugaaucaau

SEQ ID NO: 2456596 - RNA, 21 nt, Human
uguaaaaucuuggcacagaaa

SEQ ID NO: 2456597 - RNA, 12 nt, Human
uguaaaauggug

SEQ ID NO: 2456598 - RNA, 21 nt, Human
uguaaacucaaaacuuaacau

SEQ ID NO: 2456599 - RNA, 16 nt, Human
uguaaacucaaaacuu

SEQ ID NO: 2456600 - RNA, 19 nt, Human
uguaaaccugagucguaca

SEQ ID NO: 2456601 - RNA, 23 nt, Human
uguaaaccacaaggcuguugcau

SEQ ID NO: 2456602 - RNA, 22 nt, Human
uguaaaccacaaggcuguugca

SEQ ID NO: 2456603 - RNA, 15 nt, Human
uguaaacucaaaaua

SEQ ID NO: 2456604 - RNA, 20 nt, Human
uguaaacucaaaauauuugu

SEQ ID NO: 2456605 - RNA, 18 nt, Human
uguaaacugcauuagaaa

SEQ ID NO: 2456606 - RNA, 21 nt, Human
uguaaaauauagcuguacaaa

SEQ ID NO: 2456607 - RNA, 19 nt, Human
uguaaaauauagcuguaca

SEQ ID NO: 2456608 - RNA, 18 nt, Human
uguaaaauauacuuaaau

SEQ ID NO: 2456609 - RNA, 11 nt, Human
uguaaaauaua

SEQ ID NO: 2456610 - RNA, 20 nt, Human
uguaaaauauuuugaaucaa

SEQ ID NO: 2456611 - RNA, 19 nt, Human
uguaaaauauuuugaauca

SEQ ID NO: 2456612 - RNA, 21 nt, Human
uguaaaauagcuuguauagug

SEQ ID NO: 2456613 - RNA, 20 nt, Human
uguaaaauagcuuguauagu

SEQ ID NO: 2456614 - RNA, 17 nt, Human
uguaaaauagcuuguau

SEQ ID NO: 2456615 - RNA, 14 nt, Human
uguaaaauagcuug

SEQ ID NO: 2456616 - RNA, 12 nt, Human
uguaaaauagcu

SEQ ID NO: 2456617 - RNA, 18 nt, Human
uguaaaauaagaaugauu

SEQ ID NO: 2456618 - RNA, 21 nt, Human
uguaaaaggccaaaccucugu

SEQ ID NO: 2456619 - RNA, 22 nt, Human
uguaaaaggccaaaccucuguu

SEQ ID NO: 2456620 - RNA, 23 nt, Human
uguaaaaggccaaaccucuguuc

SEQ ID NO: 2456621 - RNA, 14 nt, Human
uguaaaauaaaauu

SEQ ID NO: 2456622 - RNA, 19 nt, Human
uguaaaagaacaguaaaca

SEQ ID NO: 2456623 - RNA, 15 nt, Human
uguaaaacugaggca

SEQ ID NO: 2456624 - RNA, 16 nt, Human
uguaaaacugaggcac

SEQ ID NO: 2456625 - RNA, 22 nt, Human
uguaaaacgagaauccacccau

SEQ ID NO: 2456626 - RNA, 18 nt, Human
uguaaaaccugucaauga

SEQ ID NO: 2456627 - RNA, 16 nt, Human
uguaaaaccugucaau

SEQ ID NO: 2456628 - RNA, 19 nt, Human
uguaaaaaaaaaugccuuu

SEQ ID NO: 2456629 - RNA, 19 nt, Human
uguaaaaacagcauugcuu

SEQ ID NO: 2456630 - RNA, 20 nt, Human
uguaaaaacagcauugcuuu

SEQ ID NO: 2456631 - RNA, 22 nt, Human
uguaaaaacagcauugcuuucu

SEQ ID NO: 2456632 - RNA, 23 nt, Human
uguaaaaacagcauugcuuucug

SEQ ID NO: 2456633 - RNA, 24 nt, Human
uguaaaaacagcauugcuuucuga

SEQ ID NO: 2456634 - RNA, 14 nt, Human
uguaaaaacugugg

SEQ ID NO: 2456635 - RNA, 22 nt, Human
uguaaaaagagagaaaacuuau

SEQ ID NO: 2456636 - RNA, 20 nt, Human
uguaaaaauuggucacccua

SEQ ID NO: 2456637 - RNA, 23 nt, Human
uguaaaacaaaaauguaaugauc

SEQ ID NO: 2456638 - RNA, 14 nt, Human
uguacagacaacaa

SEQ ID NO: 2456639 - RNA, 18 nt, Human
uguacagaauucugcuac

SEQ ID NO: 2456640 - RNA, 13 nt, Human
uguacacuuuuuu

SEQ ID NO: 2456641 - RNA, 21 nt, Human
uguacagaauucugcuaccuc

SEQ ID NO: 2456642 - RNA, 11 nt, Human
uguacagagcc

SEQ ID NO: 2456643 - RNA, 17 nt, Human
uguacagacguaugcuu

SEQ ID NO: 2456644 - RNA, 18 nt, Human
uguacagacguaugcuua

SEQ ID NO: 2456645 - RNA, 22 nt, Human
uguacagagaacuaacacuauu

SEQ ID NO: 2456646 - RNA, 21 nt, Human
uguacagagaacuaacacuau

SEQ ID NO: 2456647 - RNA, 19 nt, Human
uguacagacguaugcuuau

SEQ ID NO: 2456648 - RNA, 20 nt, Human
uguacagacguaugcuuauu

SEQ ID NO: 2456649 - RNA, 19 nt, Human
uguacaaauaaagucccag

SEQ ID NO: 2456650 - RNA, 17 nt, Human
uguaaugaaacaccuuc

SEQ ID NO: 2456651 - RNA, 16 nt, Human
uguaaugaaacaccuu

SEQ ID NO: 2456652 - RNA, 14 nt, Human
uguacacgggacug

SEQ ID NO: 2456653 - RNA, 13 nt, Human
uguacacgggacu

SEQ ID NO: 2456654 - RNA, 18 nt, Human
uguacaaauauaagaaua

SEQ ID NO: 2456655 - RNA, 15 nt, Human
uguacaaauauaaga

SEQ ID NO: 2456656 - RNA, 21 nt, Human
uguacaaauauaagaauaaaa

SEQ ID NO: 2456657 - RNA, 15 nt, Human
uguacaacuuaaguu

SEQ ID NO: 2456658 - RNA, 20 nt, Human
uguacacgggacugacgcaa

SEQ ID NO: 2456659 - RNA, 15 nt, Human
uguacacgggacuga

SEQ ID NO: 2456660 - RNA, 16 nt, Human
uguacacguguccugu

SEQ ID NO: 2456661 - RNA, 17 nt, Human
uguacacguguccugua

SEQ ID NO: 2456662 - RNA, 12 nt, Human
uguacacugaau

SEQ ID NO: 2456663 - RNA, 14 nt, Human
uguacacugaauau

SEQ ID NO: 2456664 - RNA, 15 nt, Human
uguacacugaauauu

SEQ ID NO: 2456665 - RNA, 16 nt, Human
uguacacugaauauuu

SEQ ID NO: 2456666 - RNA, 17 nt, Human
uguacacugaauauuua

SEQ ID NO: 2456667 - RNA, 19 nt, Human
uguacacugaauauuuaua

SEQ ID NO: 2456668 - RNA, 21 nt, Human
uguacacugaauauuuauauu

SEQ ID NO: 2456669 - RNA, 12 nt, Human
uguacacuuuuu

SEQ ID NO: 2456670 - RNA, 20 nt, Human
uguacacugaauauuuauau

SEQ ID NO: 2456671 - RNA, 17 nt, Human
uguaaugaaaaccacau

SEQ ID NO: 2456672 - RNA, 13 nt, Human
uguaaugaaaacc

SEQ ID NO: 2456673 - RNA, 12 nt, Human
uguaaugaaaac

SEQ ID NO: 2456674 - RNA, 11 nt, Human
uguaaugaaaa

SEQ ID NO: 2456675 - RNA, 15 nt, Human
uguaauaagacauaa

SEQ ID NO: 2456676 - RNA, 13 nt, Human
uguaauaauguga

SEQ ID NO: 2456677 - RNA, 18 nt, Human
uguaauaagacauaacgu

SEQ ID NO: 2456678 - RNA, 14 nt, Human
uguaauaagacaua

SEQ ID NO: 2456679 - RNA, 13 nt, Human
uguaauaagacau

SEQ ID NO: 2456680 - RNA, 12 nt, Human
uguaauaagaca

SEQ ID NO: 2456681 - RNA, 14 nt, Human
uguaauaaauauga

SEQ ID NO: 2456682 - RNA, 22 nt, Human
uguaauaacugugaaguuuaca

SEQ ID NO: 2456683 - RNA, 14 nt, Human
uguaauaacuguga

SEQ ID NO: 2456684 - RNA, 15 nt, Human
uguaauaaauaugag

SEQ ID NO: 2456685 - RNA, 23 nt, Human
uguaaccucagcucugggagagg

SEQ ID NO: 2456686 - RNA, 13 nt, Human
uguaauaaauaug

SEQ ID NO: 2456687 - RNA, 19 nt, Human
uguaaccucagcucuggga

SEQ ID NO: 2456688 - RNA, 18 nt, Human
uguaaccucagcucuggg

SEQ ID NO: 2456689 - RNA, 16 nt, Human
uguaaccucagcucug

SEQ ID NO: 2456690 - RNA, 15 nt, Human
uguaaccucagcucu

SEQ ID NO: 2456691 - RNA, 14 nt, Human
uguaaccucagcuc

SEQ ID NO: 2456692 - RNA, 12 nt, Human
uguaaccucagc

SEQ ID NO: 2456693 - RNA, 22 nt, Human
uguaaccgauucaucucucaga

SEQ ID NO: 2456694 - RNA, 20 nt, Human
uguaaccgauucaucucuca

SEQ ID NO: 2456695 - RNA, 16 nt, Human
uguaacagucugaucg

SEQ ID NO: 2456696 - RNA, 11 nt, Human
uguaacaugua

SEQ ID NO: 2456697 - RNA, 17 nt, Human
uguaacauacuggccug

SEQ ID NO: 2456698 - RNA, 14 nt, Human
uguaacagucugau

SEQ ID NO: 2456699 - RNA, 22 nt, Human
uguaacaggucuccucuuaaaa

SEQ ID NO: 2456700 - RNA, 22 nt, Human
uguaacagcuccuugggaggaa

SEQ ID NO: 2456701 - RNA, 18 nt, Human
uguaacagcuccuuggga

SEQ ID NO: 2456702 - RNA, 11 nt, Human
uguaacagcug

SEQ ID NO: 2456703 - RNA, 14 nt, Human
uguaacagcugagg

SEQ ID NO: 2456704 - RNA, 15 nt, Human
uguaacagcugaggu

SEQ ID NO: 2456705 - RNA, 18 nt, Human
uguaacaggucuccucuu

SEQ ID NO: 2456706 - RNA, 20 nt, Human
uguaacaggucuccucuuaa

SEQ ID NO: 2456707 - RNA, 21 nt, Human
uguaacaggucuccucuuaaa

SEQ ID NO: 2456708 - RNA, 17 nt, Human
uguaacagcuccuuggg

SEQ ID NO: 2456709 - RNA, 16 nt, Human
uguaacagcuccuugg

SEQ ID NO: 2456710 - RNA, 14 nt, Human
uguaacagcuccuu

SEQ ID NO: 2456711 - RNA, 13 nt, Human
uguaacagcuccu

SEQ ID NO: 2456712 - RNA, 12 nt, Human
uguaacagcucc

SEQ ID NO: 2456713 - RNA, 18 nt, Human
uguaacagccaggagugu

SEQ ID NO: 2456714 - RNA, 16 nt, Human
uguaacagacauuguu

SEQ ID NO: 2456715 - RNA, 15 nt, Human
uguaacagacauugu

SEQ ID NO: 2456716 - RNA, 13 nt, Human
uguaacagacauu

SEQ ID NO: 2456717 - RNA, 23 nt, Human
uguaacagaaagggcaacaauaa

SEQ ID NO: 2456718 - RNA, 22 nt, Human
uguaacagaaagggcaacaaua

SEQ ID NO: 2456719 - RNA, 17 nt, Human
uguaacagaaagggcaa

SEQ ID NO: 2456720 - RNA, 13 nt, Human
uguaacagaaagg

SEQ ID NO: 2456721 - RNA, 20 nt, Human
uguaacacuuuacaauguuc

SEQ ID NO: 2456722 - RNA, 18 nt, Human
uguaacacuuuacaaugu

SEQ ID NO: 2456723 - RNA, 16 nt, Human
uguaacacuuuacaau

SEQ ID NO: 2456724 - RNA, 20 nt, Human
uguaaauuuuguaugaaaaa

SEQ ID NO: 2456725 - RNA, 17 nt, Human
uguaacaagccacccca

SEQ ID NO: 2456726 - RNA, 15 nt, Human
uguaacacaagccac

SEQ ID NO: 2456727 - RNA, 24 nt, Human
uguaacacaagccacagaagccag

SEQ ID NO: 2456728 - RNA, 21 nt, Human
uguaacacaagccacagaagc

SEQ ID NO: 2456729 - RNA, 20 nt, Human
uguaacacaagccacagaag

SEQ ID NO: 2456730 - RNA, 16 nt, Human
uguaacacaagccaca

SEQ ID NO: 2456731 - RNA, 21 nt, Human
uguaacacagcugagagacuu

SEQ ID NO: 2456732 - RNA, 20 nt, Human
uguaacacagcugagagacu

SEQ ID NO: 2456733 - RNA, 23 nt, Human
uguaacacagcugagagacuuuu

SEQ ID NO: 2456734 - RNA, 13 nt, Human
uguaaacugugua

SEQ ID NO: 2456735 - RNA, 14 nt, Human
uguaaacuguguau

SEQ ID NO: 2456736 - RNA, 22 nt, Human
uguaaacucaaaacuuaacaua

SEQ ID NO: 2456737 - RNA, 18 nt, Human
uguaaacuguguauucca

SEQ ID NO: 2456738 - RNA, 14 nt, Human
uguaaacugugcac

SEQ ID NO: 2456739 - RNA, 15 nt, Human
uguaaacugugcacc

SEQ ID NO: 2456740 - RNA, 23 nt, Human
uguaaacucaaaauauuuguaca

SEQ ID NO: 2456741 - RNA, 14 nt, Human
uguaacaagccacc

SEQ ID NO: 2456742 - RNA, 17 nt, Human
uguaaauuuaugugaug

SEQ ID NO: 2456743 - RNA, 17 nt, Human
ugguguaauaagacaua

SEQ ID NO: 2456744 - RNA, 16 nt, Human
ugguguaauaagacau

SEQ ID NO: 2456745 - RNA, 15 nt, Human
ugguguaauaagaca

SEQ ID NO: 2456746 - RNA, 14 nt, Human
ugguguaauaagac

SEQ ID NO: 2456747 - RNA, 19 nt, Human
ugguguaauaagacauaac

SEQ ID NO: 2456748 - RNA, 23 nt, Human
ugguguauccccccccuguauag

SEQ ID NO: 2456749 - RNA, 19 nt, Human
ugguguaguugaacugaua

SEQ ID NO: 2456750 - RNA, 16 nt, Human
uggugucaccugaaga

SEQ ID NO: 2456751 - RNA, 20 nt, Human
uggugucacuuacuguuucu

SEQ ID NO: 2456752 - RNA, 18 nt, Human
uggugucacuuacuguuu

SEQ ID NO: 2456753 - RNA, 17 nt, Human
uggugucacuuacuguu

SEQ ID NO: 2456754 - RNA, 16 nt, Human
uggugucacuuacugu

SEQ ID NO: 2456755 - RNA, 18 nt, Human
ugguguccaccuggcccc

SEQ ID NO: 2456756 - RNA, 14 nt, Human
ugguguccugacca

SEQ ID NO: 2456757 - RNA, 13 nt, Human
ugguguccaccug

SEQ ID NO: 2456758 - RNA, 14 nt, Human
ugguguccaccugg

SEQ ID NO: 2456759 - RNA, 15 nt, Human
ugguguccaccuggc

SEQ ID NO: 2456760 - RNA, 17 nt, Human
ugguguccaccuggccc

SEQ ID NO: 2456761 - RNA, 15 nt, Human
uggugucgggcauga

SEQ ID NO: 2456762 - RNA, 20 nt, Human
ugguguccugaccacccucc

SEQ ID NO: 2456763 - RNA, 19 nt, Human
ugguguccugaccacccuc

SEQ ID NO: 2456764 - RNA, 17 nt, Human
ugguguccugaccaccc

SEQ ID NO: 2456765 - RNA, 15 nt, Human
ugguguccugaccac

SEQ ID NO: 2456766 - RNA, 21 nt, Human
uggugucgcgccuucuccccc

SEQ ID NO: 2456767 - RNA, 18 nt, Human
uggugucgcgccuucucc

SEQ ID NO: 2456768 - RNA, 21 nt, Human
ugguguccugaccacccuccc

SEQ ID NO: 2456769 - RNA, 19 nt, Human
ugguguccuuucccuccac

SEQ ID NO: 2456770 - RNA, 22 nt, Human
ugguuccagggucccucugugu

SEQ ID NO: 2456771 - RNA, 21 nt, Human
ugguuccagggucccucugug

SEQ ID NO: 2456772 - RNA, 17 nt, Human
ugguuccaagcccugga

SEQ ID NO: 2456773 - RNA, 16 nt, Human
ugguuccaagcccugg

SEQ ID NO: 2456774 - RNA, 12 nt, Human
ugguuccagggu

SEQ ID NO: 2456775 - RNA, 23 nt, Human
ugguuccauuguuuggagacauu

SEQ ID NO: 2456776 - RNA, 21 nt, Human
ugguuccauuguuuggagaca

SEQ ID NO: 2456777 - RNA, 22 nt, Human
ugguuccaugccugagggugga

SEQ ID NO: 2456778 - RNA, 19 nt, Human
ugguuccaugccugagggu

SEQ ID NO: 2456779 - RNA, 17 nt, Human
ugguuccaugccugagg

SEQ ID NO: 2456780 - RNA, 15 nt, Human
ugguuccaugccuga

SEQ ID NO: 2456781 - RNA, 13 nt, Human
ugguuccaugccu

SEQ ID NO: 2456782 - RNA, 20 nt, Human
ugguuccccuguucacucua

SEQ ID NO: 2456783 - RNA, 19 nt, Human
ugguuccccuguucacucu

SEQ ID NO: 2456784 - RNA, 18 nt, Human
ugguuccccuguucacuc

SEQ ID NO: 2456785 - RNA, 11 nt, Human
ugguuccccug

SEQ ID NO: 2456786 - RNA, 19 nt, Human
uggugucgggcaugacacg

SEQ ID NO: 2456787 - RNA, 18 nt, Human
uggugucgggcaugacac

SEQ ID NO: 2456788 - RNA, 15 nt, Human
ugguuccagccugcc

SEQ ID NO: 2456789 - RNA, 16 nt, Human
ugguuccagccugcca

SEQ ID NO: 2456790 - RNA, 16 nt, Human
ugguucauuaauucua

SEQ ID NO: 2456791 - RNA, 13 nt, Human
ugguuccaagccc

SEQ ID NO: 2456792 - RNA, 15 nt, Human
ugguucauaaaugaa

SEQ ID NO: 2456793 - RNA, 13 nt, Human
ugguucauaaaug

SEQ ID NO: 2456794 - RNA, 16 nt, Human
ugguucauaaaugaau

SEQ ID NO: 2456795 - RNA, 16 nt, Human
ugguugaaaauaaaaa

SEQ ID NO: 2456796 - RNA, 12 nt, Human
ugguugaauaaa

SEQ ID NO: 2456797 - RNA, 18 nt, Human
ugguugaauaaacuagau

SEQ ID NO: 2456798 - RNA, 14 nt, Human
ugguucuuguauua

SEQ ID NO: 2456799 - RNA, 18 nt, Human
ugguucuuguauuaagaa

SEQ ID NO: 2456800 - RNA, 19 nt, Human
ugguucuuguauuaagaau

SEQ ID NO: 2456801 - RNA, 22 nt, Human
ugguugagguggaagcccuccu

SEQ ID NO: 2456802 - RNA, 17 nt, Human
ugguugagaaaugaaua

SEQ ID NO: 2456803 - RNA, 15 nt, Human
ugguugagguggaag

SEQ ID NO: 2456804 - RNA, 12 nt, Human
ugguugaggaaa

SEQ ID NO: 2456805 - RNA, 15 nt, Human
ugguugacuggguuu

SEQ ID NO: 2456806 - RNA, 18 nt, Human
ugguugaugaucuuugca

SEQ ID NO: 2456807 - RNA, 15 nt, Human
ugguucucaucuuuc

SEQ ID NO: 2456808 - RNA, 14 nt, Human
ugguucucaucuuu

SEQ ID NO: 2456809 - RNA, 17 nt, Human
ugguucucaucuuucuu

SEQ ID NO: 2456810 - RNA, 13 nt, Human
ugguucucaucuu

SEQ ID NO: 2456811 - RNA, 11 nt, Human
ugguucucauc

SEQ ID NO: 2456812 - RNA, 20 nt, Human
ugguucugaugaugugccug

SEQ ID NO: 2456813 - RNA, 12 nt, Human
ugguucuggcca

SEQ ID NO: 2456814 - RNA, 13 nt, Human
ugguucugugcca

SEQ ID NO: 2456815 - RNA, 12 nt, Human
ugguucuggggc

SEQ ID NO: 2456816 - RNA, 21 nt, Human
ugguucuugguagagauucau

SEQ ID NO: 2456817 - RNA, 19 nt, Human
ugguucuuaguucucacug

SEQ ID NO: 2456818 - RNA, 18 nt, Human
ugguucugugucuguguu

SEQ ID NO: 2456819 - RNA, 20 nt, Human
ugguucccuugaugaagaag

SEQ ID NO: 2456820 - RNA, 17 nt, Human
ugguucccuugaugaag

SEQ ID NO: 2456821 - RNA, 16 nt, Human
ugguucccuugaugaa

SEQ ID NO: 2456822 - RNA, 20 nt, Human
ugguucccguuucuccaccu

SEQ ID NO: 2456823 - RNA, 18 nt, Human
ugguucccguuucuccac

SEQ ID NO: 2456824 - RNA, 23 nt, Human
ugguuccccuguucacucuacuu

SEQ ID NO: 2456825 - RNA, 17 nt, Human
ugguuccuuucucagcc

SEQ ID NO: 2456826 - RNA, 15 nt, Human
ugguucuaauagaac

SEQ ID NO: 2456827 - RNA, 16 nt, Human
ugguucuauuuaaugg

SEQ ID NO: 2456828 - RNA, 14 nt, Human
ugguucuauuuaau

SEQ ID NO: 2456829 - RNA, 18 nt, Human
ugguuccuccccuccucc

SEQ ID NO: 2456830 - RNA, 23 nt, Human
ugguuccuccccuccuccuggac

SEQ ID NO: 2456831 - RNA, 12 nt, Human
ugguuccucccc

SEQ ID NO: 2456832 - RNA, 20 nt, Human
ugguuccggaauccuguccu

SEQ ID NO: 2456833 - RNA, 23 nt, Human
uggguacuuguggacacagcucu

SEQ ID NO: 2456834 - RNA, 20 nt, Human
uggguacuuguggacacagc

SEQ ID NO: 2456835 - RNA, 14 nt, Human
uggguagacacaca

SEQ ID NO: 2456836 - RNA, 18 nt, Human
ugggguuggcugggccca

SEQ ID NO: 2456837 - RNA, 14 nt, Human
uggugagaggcauc

SEQ ID NO: 2456838 - RNA, 22 nt, Human
uggugagaacuacucagggaau

SEQ ID NO: 2456839 - RNA, 23 nt, Human
uggugagaacuacucagggaaug

SEQ ID NO: 2456840 - RNA, 18 nt, Human
ugguggcagugggagcug

SEQ ID NO: 2456841 - RNA, 13 nt, Human
ugguggcaguggg

SEQ ID NO: 2456842 - RNA, 19 nt, Human
ugguggcccgacagccugg

SEQ ID NO: 2456843 - RNA, 20 nt, Human
ugguggcagugggagcugcc

SEQ ID NO: 2456844 - RNA, 20 nt, Human
uggugcaaugaccuuucaau

SEQ ID NO: 2456845 - RNA, 19 nt, Human
uggugcaaugaccuuucaa

SEQ ID NO: 2456846 - RNA, 14 nt, Human
uggugcaaugaccu

SEQ ID NO: 2456847 - RNA, 14 nt, Human
uggugcaaauccua

SEQ ID NO: 2456848 - RNA, 17 nt, Human
uggugguuucagaaaug

SEQ ID NO: 2456849 - RNA, 18 nt, Human
uggugguuucagaaaugu

SEQ ID NO: 2456850 - RNA, 19 nt, Human
uggugguuuucuguucuuu

SEQ ID NO: 2456851 - RNA, 14 nt, Human
uggugguugcuguu

SEQ ID NO: 2456852 - RNA, 17 nt, Human
uggugguuucacggugc

SEQ ID NO: 2456853 - RNA, 13 nt, Human
ugguguaauaaga

SEQ ID NO: 2456854 - RNA, 17 nt, Human
ugguggguccaugggca

SEQ ID NO: 2456855 - RNA, 18 nt, Human
ugguggguccaugggcag

SEQ ID NO: 2456856 - RNA, 16 nt, Human
ugguggguccaugggc

SEQ ID NO: 2456857 - RNA, 23 nt, Human
uggugggguguguuccaacugcc

SEQ ID NO: 2456858 - RNA, 18 nt, Human
ugguggggguagagcuga

SEQ ID NO: 2456859 - RNA, 17 nt, Human
ugguggggguagagcug

SEQ ID NO: 2456860 - RNA, 21 nt, Human
ugguggggguagagcugaucc

SEQ ID NO: 2456861 - RNA, 16 nt, Human
uggugguaacccuggu

SEQ ID NO: 2456862 - RNA, 19 nt, Human
ugguggguucaggggacuc

SEQ ID NO: 2456863 - RNA, 21 nt, Human
ugguggguucaggggacucag

SEQ ID NO: 2456864 - RNA, 15 nt, Human
ugguggucuguuggc

SEQ ID NO: 2456865 - RNA, 17 nt, Human
uggugguaacccuggug

SEQ ID NO: 2456866 - RNA, 15 nt, Human
uggugguaucugagu

SEQ ID NO: 2456867 - RNA, 21 nt, Human
ugguggcccgacagccuggca

SEQ ID NO: 2456868 - RNA, 21 nt, Human
ugguggccucugccccgucuc

SEQ ID NO: 2456869 - RNA, 16 nt, Human
ugguggcgcaagccug

SEQ ID NO: 2456870 - RNA, 13 nt, Human
ugguggcuggguu

SEQ ID NO: 2456871 - RNA, 17 nt, Human
ugguggcgcaagccugu

SEQ ID NO: 2456872 - RNA, 13 nt, Human
ugguggcuuugca

SEQ ID NO: 2456873 - RNA, 21 nt, Human
ugguggcucccggagggcccu

SEQ ID NO: 2456874 - RNA, 12 nt, Human
uggugggagggg

SEQ ID NO: 2456875 - RNA, 21 nt, Human
uggugggaagcgucuguccgu

SEQ ID NO: 2456876 - RNA, 16 nt, Human
uggugggggccucggu

SEQ ID NO: 2456877 - RNA, 18 nt, Human
uggugggggccucggugu

SEQ ID NO: 2456878 - RNA, 23 nt, Human
ugguggggaggggcgcuggccca

SEQ ID NO: 2456879 - RNA, 22 nt, Human
ugguggggaggggcgcuggccc

SEQ ID NO: 2456880 - RNA, 21 nt, Human
ugguggggaggggcgcuggcc

SEQ ID NO: 2456881 - RNA, 20 nt, Human
ugguggggaggggcgcuggc

SEQ ID NO: 2456882 - RNA, 15 nt, Human
ugguggggaggggcg

SEQ ID NO: 2456883 - RNA, 13 nt, Human
ugguggggagggg

SEQ ID NO: 2456884 - RNA, 20 nt, Human
uggugggccaacaaagaaca

SEQ ID NO: 2456885 - RNA, 23 nt, Human
uggugggccaacaaagaacacua

SEQ ID NO: 2456886 - RNA, 22 nt, Human
uggugggaggggcgcccaccuc

SEQ ID NO: 2456887 - RNA, 21 nt, Human
uggugggaggggcgcccaccu

SEQ ID NO: 2456888 - RNA, 23 nt, Human
uggugggaggggcgcccaccucc

SEQ ID NO: 2456889 - RNA, 18 nt, Human
ugucucaagagggcacug

SEQ ID NO: 2456890 - RNA, 17 nt, Human
ugucucaagagggcacu

SEQ ID NO: 2456891 - RNA, 21 nt, Human
ugucucaaaaaaagaaaaaga

SEQ ID NO: 2456892 - RNA, 19 nt, Human
ugucuauucaaaauaucaa

SEQ ID NO: 2456893 - RNA, 18 nt, Human
ugucuauuaccuguuagu

SEQ ID NO: 2456894 - RNA, 13 nt, Human
ugucuauucagcu

SEQ ID NO: 2456895 - RNA, 14 nt, Human
ugucuauucagcuu

SEQ ID NO: 2456896 - RNA, 14 nt, Human
ugucuauuucugcu

SEQ ID NO: 2456897 - RNA, 13 nt, Human
ugucuauuucugc

SEQ ID NO: 2456898 - RNA, 14 nt, Human
ugucuauucuccag

SEQ ID NO: 2456899 - RNA, 18 nt, Human
ugucuauuucugcugaau

SEQ ID NO: 2456900 - RNA, 15 nt, Human
ugucuauuucugcug

SEQ ID NO: 2456901 - RNA, 17 nt, Human
ugucucacugaaacauu

SEQ ID NO: 2456902 - RNA, 13 nt, Human
ugucucagccucc

SEQ ID NO: 2456903 - RNA, 16 nt, Human
ugucucagccuccuga

SEQ ID NO: 2456904 - RNA, 14 nt, Human
ugucucagccuccc

SEQ ID NO: 2456905 - RNA, 15 nt, Human
ugucucagccuccca

SEQ ID NO: 2456906 - RNA, 16 nt, Human
ugucuaugggacucaa

SEQ ID NO: 2456907 - RNA, 15 nt, Human
ugucuaugggacuca

SEQ ID NO: 2456908 - RNA, 14 nt, Human
ugucuaugggacuc

SEQ ID NO: 2456909 - RNA, 22 nt, Human
ugucuauaaucccagcacuuug

SEQ ID NO: 2456910 - RNA, 23 nt, Human
ugucuaguuguuugauucagaca

SEQ ID NO: 2456911 - RNA, 15 nt, Human
ugucuaguuguuuga

SEQ ID NO: 2456912 - RNA, 14 nt, Human
ugucuagaguagcu

SEQ ID NO: 2456913 - RNA, 14 nt, Human
ugucuagagaggga

SEQ ID NO: 2456914 - RNA, 19 nt, Human
ugucuaggcaggaccugug

SEQ ID NO: 2456915 - RNA, 17 nt, Human
ugucuaggcaggaccug

SEQ ID NO: 2456916 - RNA, 16 nt, Human
ugucuguuuguucucu

SEQ ID NO: 2456917 - RNA, 23 nt, Human
ugucuguuaccaugucacugugg

SEQ ID NO: 2456918 - RNA, 15 nt, Human
ugucuguucuacaua

SEQ ID NO: 2456919 - RNA, 21 nt, Human
ugucuguucuacauagaugcu

SEQ ID NO: 2456920 - RNA, 22 nt, Human
ugucuuaaugaaguuugaaugu

SEQ ID NO: 2456921 - RNA, 21 nt, Human
ugucuuaaugaaguuugaaug

SEQ ID NO: 2456922 - RNA, 20 nt, Human
ugucuuaaugaaguuugaau

SEQ ID NO: 2456923 - RNA, 19 nt, Human
ugucuuaaugaaguuugaa

SEQ ID NO: 2456924 - RNA, 18 nt, Human
ugucuuaaugaaguuuga

SEQ ID NO: 2456925 - RNA, 15 nt, Human
ugucuuaaugaaguu

SEQ ID NO: 2456926 - RNA, 14 nt, Human
ugucuuaaugaagu

SEQ ID NO: 2456927 - RNA, 16 nt, Human
ugucuuuucuugcaug

SEQ ID NO: 2456928 - RNA, 19 nt, Human
ugucuuuguuggaaaagaa

SEQ ID NO: 2456929 - RNA, 23 nt, Human
ugucuuuggacccugaggcccag

SEQ ID NO: 2456930 - RNA, 12 nt, Human
ugucuuaauuaa

SEQ ID NO: 2456931 - RNA, 15 nt, Human
ugucugcacccaggg

SEQ ID NO: 2456932 - RNA, 19 nt, Human
ugucugucucuccaucugu

SEQ ID NO: 2456933 - RNA, 14 nt, Human
ugucugcacccagg

SEQ ID NO: 2456934 - RNA, 17 nt, Human
ugucuguuacacuggag

SEQ ID NO: 2456935 - RNA, 12 nt, Human
ugucuguuacac

SEQ ID NO: 2456936 - RNA, 11 nt, Human
ugucuguuaca

SEQ ID NO: 2456937 - RNA, 22 nt, Human
ugucuguuaccaugucacugug

SEQ ID NO: 2456938 - RNA, 19 nt, Human
ugucuguuaccaugucacu

SEQ ID NO: 2456939 - RNA, 13 nt, Human
ugucuguucuaca

SEQ ID NO: 2456940 - RNA, 21 nt, Human
ugucugugcuagggaaacuuc

SEQ ID NO: 2456941 - RNA, 11 nt, Human
ugucugugcua

SEQ ID NO: 2456942 - RNA, 21 nt, Human
ugucugugugcaagugugugc

SEQ ID NO: 2456943 - RNA, 12 nt, Human
ugucugugugca

SEQ ID NO: 2456944 - RNA, 17 nt, Human
ugucugagcccucaaag

SEQ ID NO: 2456945 - RNA, 16 nt, Human
ugucugagaugcuggu

SEQ ID NO: 2456946 - RNA, 18 nt, Human
ugucugagaguuuaguug

SEQ ID NO: 2456947 - RNA, 20 nt, Human
ugucugagcccucaaaguga

SEQ ID NO: 2456948 - RNA, 18 nt, Human
ugucugagcccucaaagu

SEQ ID NO: 2456949 - RNA, 14 nt, Human
ugucugagugaacc

SEQ ID NO: 2456950 - RNA, 15 nt, Human
ugucugagugaaccu

SEQ ID NO: 2456951 - RNA, 20 nt, Human
ugucugaagucacugcacag

SEQ ID NO: 2456952 - RNA, 16 nt, Human
ugucugcacccagggg

SEQ ID NO: 2456953 - RNA, 19 nt, Human
ugucugauuggcucaccca

SEQ ID NO: 2456954 - RNA, 23 nt, Human
ugucugaucugugcuuuccagcu

SEQ ID NO: 2456955 - RNA, 20 nt, Human
ugucugaucugugcuuucca

SEQ ID NO: 2456956 - RNA, 15 nt, Human
ugucugaucugugcu

SEQ ID NO: 2456957 - RNA, 16 nt, Human
ugucugaucugugcuu

SEQ ID NO: 2456958 - RNA, 17 nt, Human
ugucugagugaaccugu

SEQ ID NO: 2456959 - RNA, 20 nt, Human
ugucugagugaaccuguaua

SEQ ID NO: 2456960 - RNA, 21 nt, Human
ugucugagugaaccuguauaa

SEQ ID NO: 2456961 - RNA, 18 nt, Human
uguccugauggucagcuc

SEQ ID NO: 2456962 - RNA, 21 nt, Human
uguccugauggucagcucccu

SEQ ID NO: 2456963 - RNA, 20 nt, Human
uguccugauggucagcuccc

SEQ ID NO: 2456964 - RNA, 19 nt, Human
uguccugauggucagcucc

SEQ ID NO: 2456965 - RNA, 19 nt, Human
uguccugccugucugaagc

SEQ ID NO: 2456966 - RNA, 22 nt, Human
uguccugccuaaggcugaacuu

SEQ ID NO: 2456967 - RNA, 20 nt, Human
uguccugggagugagcuggu

SEQ ID NO: 2456968 - RNA, 19 nt, Human
uguccugggagugagcugg

SEQ ID NO: 2456969 - RNA, 12 nt, Human
uguccugcuggu

SEQ ID NO: 2456970 - RNA, 18 nt, Human
uguccugcuccacagugu

SEQ ID NO: 2456971 - RNA, 17 nt, Human
uguccugcuccacagug

SEQ ID NO: 2456972 - RNA, 16 nt, Human
uguccugcuccacagu

SEQ ID NO: 2456973 - RNA, 15 nt, Human
uguccugcuccacag

SEQ ID NO: 2456974 - RNA, 14 nt, Human
uguccugcuccaca

SEQ ID NO: 2456975 - RNA, 12 nt, Human
uguccugggagu

SEQ ID NO: 2456976 - RNA, 19 nt, Human
uguccuggugcucucugcc

SEQ ID NO: 2456977 - RNA, 16 nt, Human
uguccuggugcucucu

SEQ ID NO: 2456978 - RNA, 13 nt, Human
uguccuggugcuc

SEQ ID NO: 2456979 - RNA, 17 nt, Human
uguccugggcugguggc

SEQ ID NO: 2456980 - RNA, 13 nt, Human
uguccugggcugg

SEQ ID NO: 2456981 - RNA, 18 nt, Human
uguccugggcgcccugga

SEQ ID NO: 2456982 - RNA, 17 nt, Human
uguccugggcgcccugg

SEQ ID NO: 2456983 - RNA, 16 nt, Human
uguccugggcgcccug

SEQ ID NO: 2456984 - RNA, 14 nt, Human
uguccugggccugc

SEQ ID NO: 2456985 - RNA, 15 nt, Human
uguccugggccugca

SEQ ID NO: 2456986 - RNA, 11 nt, Human
uguccugggcg

SEQ ID NO: 2456987 - RNA, 10 nt, Human
uguccugggc

SEQ ID NO: 2456988 - RNA, 17 nt, Human
uguccugggccugcaga

SEQ ID NO: 2456989 - RNA, 18 nt, Human
ugucuaauguauuuuauu

SEQ ID NO: 2456990 - RNA, 17 nt, Human
ugucuaauguauuuuau

SEQ ID NO: 2456991 - RNA, 13 nt, Human
ugucuaauguauu

SEQ ID NO: 2456992 - RNA, 22 nt, Human
ugucuaaggucacacaguauua

SEQ ID NO: 2456993 - RNA, 20 nt, Human
uguccuggugcucucugcca

SEQ ID NO: 2456994 - RNA, 14 nt, Human
ugucuaaugaaacc

SEQ ID NO: 2456995 - RNA, 17 nt, Human
ugucuacacuaagagag

SEQ ID NO: 2456996 - RNA, 19 nt, Human
ugucuaauguauuuuauug

SEQ ID NO: 2456997 - RNA, 22 nt, Human
ugucuacacuaagagagaauga

SEQ ID NO: 2456998 - RNA, 19 nt, Human
ugucuacagagaaccugga

SEQ ID NO: 2456999 - RNA, 12 nt, Human
ugucuacagaga

SEQ ID NO: 2457000 - RNA, 22 nt, Human
uguccuaugggagucaagugug

SEQ ID NO: 2457001 - RNA, 14 nt, Human
uguccccucagcuc

SEQ ID NO: 2457002 - RNA, 13 nt, Human
uguccccucagcu

SEQ ID NO: 2457003 - RNA, 18 nt, Human
uguccccuccacugucac

SEQ ID NO: 2457004 - RNA, 20 nt, Human
uguccuaggaguauccucau

SEQ ID NO: 2457005 - RNA, 15 nt, Human
ugucaucucagugcu

SEQ ID NO: 2457006 - RNA, 13 nt, Human
uguccccuauccu

SEQ ID NO: 2457007 - RNA, 16 nt, Human
uguccccggccucagc

SEQ ID NO: 2457008 - RNA, 23 nt, Human
uguccccuauggggaugguccac

SEQ ID NO: 2457009 - RNA, 19 nt, Human
uguccccgcacugggcuug

SEQ ID NO: 2457010 - RNA, 17 nt, Human
uguccccgcacugggcu

SEQ ID NO: 2457011 - RNA, 13 nt, Human
ugucaucucagcu

SEQ ID NO: 2457012 - RNA, 23 nt, Human
uguccugaccacccuccccucuc

SEQ ID NO: 2457013 - RNA, 22 nt, Human
uguccugaccacccuccccucu

SEQ ID NO: 2457014 - RNA, 21 nt, Human
uguccugaccacccuccccuc

SEQ ID NO: 2457015 - RNA, 20 nt, Human
uguccugaccacccuccccu

SEQ ID NO: 2457016 - RNA, 19 nt, Human
uguccugaccacccucccc

SEQ ID NO: 2457017 - RNA, 17 nt, Human
uguccugaccacccucc

SEQ ID NO: 2457018 - RNA, 16 nt, Human
uguccugaccacccuc

SEQ ID NO: 2457019 - RNA, 22 nt, Human
uguccugacuucaggggcugcc

SEQ ID NO: 2457020 - RNA, 21 nt, Human
uguccugacuucaggggcugc

SEQ ID NO: 2457021 - RNA, 17 nt, Human
uguccugaccugucuca

SEQ ID NO: 2457022 - RNA, 22 nt, Human
uguccucccauccccuggacug

SEQ ID NO: 2457023 - RNA, 19 nt, Human
uguccucccauccccugga

SEQ ID NO: 2457024 - RNA, 18 nt, Human
uguccucccauccccugg

SEQ ID NO: 2457025 - RNA, 17 nt, Human
uguccucccauccccug

SEQ ID NO: 2457026 - RNA, 23 nt, Human
uguccucccauccccuggacugg

SEQ ID NO: 2457027 - RNA, 14 nt, Human
uguccuccccuugg

SEQ ID NO: 2457028 - RNA, 22 nt, Human
uguccuccagaagccucuggcu

SEQ ID NO: 2457029 - RNA, 23 nt, Human
uguccuccagaagccucuggcua

SEQ ID NO: 2457030 - RNA, 13 nt, Human
uguccucccaucc

SEQ ID NO: 2457031 - RNA, 22 nt, Human
uguccucacugcucccugaagc

SEQ ID NO: 2457032 - RNA, 19 nt, Human
uguccucacugcucccuga

SEQ ID NO: 2457033 - RNA, 14 nt, Human
uguccucagcagcu

SEQ ID NO: 2457034 - RNA, 15 nt, Human
uguccucacugcucc

SEQ ID NO: 2457035 - RNA, 14 nt, Human
uguccucacugcuc

SEQ ID NO: 2457036 - RNA, 22 nt, Human
uguccucacggugccuuuuuuc

SEQ ID NO: 2457037 - RNA, 20 nt, Human
uguccucacggugccuuuuu

SEQ ID NO: 2457038 - RNA, 14 nt, Human
uguccucaccacau

SEQ ID NO: 2457039 - RNA, 18 nt, Human
uguccuccagaagccucu

SEQ ID NO: 2457040 - RNA, 19 nt, Human
uguccuccagaagccucug

SEQ ID NO: 2457041 - RNA, 20 nt, Human
uguccuccagaagccucugg

SEQ ID NO: 2457042 - RNA, 21 nt, Human
uguccuccagaagccucuggc

SEQ ID NO: 2457043 - RNA, 16 nt, Human
uguccuccagaagccu

SEQ ID NO: 2457044 - RNA, 17 nt, Human
uguccuccagaagccuc

SEQ ID NO: 2457045 - RNA, 23 nt, Human
uguccuccaacaccaagcacagc

SEQ ID NO: 2457046 - RNA, 17 nt, Human
uguccuccaagccagcg

SEQ ID NO: 2457047 - RNA, 13 nt, Human
uguauaaaauaau

SEQ ID NO: 2457048 - RNA, 14 nt, Human
uguauaaaauaauu

SEQ ID NO: 2457049 - RNA, 16 nt, Human
uguauaaaaucagcca

SEQ ID NO: 2457050 - RNA, 14 nt, Human
uguauaaaaucagc

SEQ ID NO: 2457051 - RNA, 21 nt, Human
uguaguguuggagaagaacug

SEQ ID NO: 2457052 - RNA, 20 nt, Human
uguaguguuggagaagaacu

SEQ ID NO: 2457053 - RNA, 19 nt, Human
uguaguguuggagaagaac

SEQ ID NO: 2457054 - RNA, 23 nt, Human
uguaggaagaguagcauuucauu

SEQ ID NO: 2457055 - RNA, 21 nt, Human
uguaggaagaguagcauuuca

SEQ ID NO: 2457056 - RNA, 19 nt, Human
uguaggaagaguagcauuu

SEQ ID NO: 2457057 - RNA, 12 nt, Human
uguacagagccc

SEQ ID NO: 2457058 - RNA, 21 nt, Human
uguacagagcccacgccccca

SEQ ID NO: 2457059 - RNA, 22 nt, Human
uguacagcaaggagauuuacaa

SEQ ID NO: 2457060 - RNA, 12 nt, Human
uguagcuuugcu

SEQ ID NO: 2457061 - RNA, 13 nt, Human
uguagcuuugcuc

SEQ ID NO: 2457062 - RNA, 15 nt, Human
uguagcuuugcucuu

SEQ ID NO: 2457063 - RNA, 23 nt, Human
uguacagcaaggagauuuacaac

SEQ ID NO: 2457064 - RNA, 19 nt, Human
uguacagaugaaugauaaa

SEQ ID NO: 2457065 - RNA, 22 nt, Human
uguauaagauuagaaugaaaau

SEQ ID NO: 2457066 - RNA, 21 nt, Human
uguauaacuucuuaaaaguug

SEQ ID NO: 2457067 - RNA, 18 nt, Human
uguauaacuucuuaaaag

SEQ ID NO: 2457068 - RNA, 21 nt, Human
uguauaacagguuauuuuagu

SEQ ID NO: 2457069 - RNA, 17 nt, Human
uguauaacagguuauuu

SEQ ID NO: 2457070 - RNA, 15 nt, Human
uguauaacagguuau

SEQ ID NO: 2457071 - RNA, 14 nt, Human
uguauaacagguua

SEQ ID NO: 2457072 - RNA, 14 nt, Human
uguauaaauuuauu

SEQ ID NO: 2457073 - RNA, 23 nt, Human
uguauaaagcaacuguuaugaaa

SEQ ID NO: 2457074 - RNA, 19 nt, Human
uguauaaagcaacuguuau

SEQ ID NO: 2457075 - RNA, 14 nt, Human
uguauaaauaggag

SEQ ID NO: 2457076 - RNA, 13 nt, Human
uguauaaagaaca

SEQ ID NO: 2457077 - RNA, 21 nt, Human
uguauaaaucuuucuuuugau

SEQ ID NO: 2457078 - RNA, 18 nt, Human
uguauaaauaggagagga

SEQ ID NO: 2457079 - RNA, 18 nt, Human
uguauagaugcaagauau

SEQ ID NO: 2457080 - RNA, 16 nt, Human
uguauagguagauguu

SEQ ID NO: 2457081 - RNA, 15 nt, Human
uguauaguacuggca

SEQ ID NO: 2457082 - RNA, 23 nt, Human
uguauaguaaagugauaauuucu

SEQ ID NO: 2457083 - RNA, 20 nt, Human
uguauagaugcaagauauuu

SEQ ID NO: 2457084 - RNA, 19 nt, Human
uguauagaugcaagauauu

SEQ ID NO: 2457085 - RNA, 22 nt, Human
uguaucuugggggacagggcug

SEQ ID NO: 2457086 - RNA, 14 nt, Human
uguaugacuaaaga

SEQ ID NO: 2457087 - RNA, 15 nt, Human
uguaugacuaaagag

SEQ ID NO: 2457088 - RNA, 16 nt, Human
uguaugacugcacaug

SEQ ID NO: 2457089 - RNA, 16 nt, Human
uguaugacuaaagaga

SEQ ID NO: 2457090 - RNA, 20 nt, Human
uguaugacuaaagagagaau

SEQ ID NO: 2457091 - RNA, 17 nt, Human
uguaugacugcacauga

SEQ ID NO: 2457092 - RNA, 21 nt, Human
uguaugacuaaagagagaaug

SEQ ID NO: 2457093 - RNA, 22 nt, Human
uguaugaaagauggcugugccu

SEQ ID NO: 2457094 - RNA, 22 nt, Human
uguaucugcaggcagacacgga

SEQ ID NO: 2457095 - RNA, 21 nt, Human
uguaucugcaggcagacacgg

SEQ ID NO: 2457096 - RNA, 21 nt, Human
uguaucuugggggacagggcu

SEQ ID NO: 2457097 - RNA, 20 nt, Human
uguaucugauagcucuuugg

SEQ ID NO: 2457098 - RNA, 22 nt, Human
uguaucugaaggagauuuuccu

SEQ ID NO: 2457099 - RNA, 23 nt, Human
uguaucucugaagcauguuucau

SEQ ID NO: 2457100 - RNA, 18 nt, Human
uguaucugaaggagauuu

SEQ ID NO: 2457101 - RNA, 20 nt, Human
uguaucugcaggcagacacg

SEQ ID NO: 2457102 - RNA, 19 nt, Human
uguaucugcaggcagacac

SEQ ID NO: 2457103 - RNA, 18 nt, Human
uguaucugcaggcagaca

SEQ ID NO: 2457104 - RNA, 17 nt, Human
uguaucugcaggcagac

SEQ ID NO: 2457105 - RNA, 13 nt, Human
uguaucugagcag

SEQ ID NO: 2457106 - RNA, 22 nt, Human
uguaucucugaagcauguuuca

SEQ ID NO: 2457107 - RNA, 21 nt, Human
uguaucucugaagcauguuuc

SEQ ID NO: 2457108 - RNA, 19 nt, Human
uguaucucugaagcauguu

SEQ ID NO: 2457109 - RNA, 18 nt, Human
uguaucucugaagcaugu

SEQ ID NO: 2457110 - RNA, 17 nt, Human
uguaucucugaagcaug

SEQ ID NO: 2457111 - RNA, 19 nt, Human
uguaucuaugcauuuucug

SEQ ID NO: 2457112 - RNA, 21 nt, Human
uguauaguacuggcaugguac

SEQ ID NO: 2457113 - RNA, 19 nt, Human
uguauuuuaaaagaaugau

SEQ ID NO: 2457114 - RNA, 18 nt, Human
uguauuuuaaaagaauga

SEQ ID NO: 2457115 - RNA, 19 nt, Human
uguauuuuacuaauaaaau

SEQ ID NO: 2457116 - RNA, 15 nt, Human
uguauuuuaacucau

SEQ ID NO: 2457117 - RNA, 14 nt, Human
uguauuuuaacuca

SEQ ID NO: 2457118 - RNA, 15 nt, Human
uguauuuguuugcau

SEQ ID NO: 2457119 - RNA, 14 nt, Human
uguauuuguuugca

SEQ ID NO: 2457120 - RNA, 16 nt, Human
ugucaauuucuguguu

SEQ ID NO: 2457121 - RNA, 15 nt, Human
ugucaauuucugugu

SEQ ID NO: 2457122 - RNA, 23 nt, Human
ugucaauuucccugacuccucua

SEQ ID NO: 2457123 - RNA, 19 nt, Human
ugucaauuucccugacucc

SEQ ID NO: 2457124 - RNA, 21 nt, Human
ugucaauuacaggaaguacug

SEQ ID NO: 2457125 - RNA, 14 nt, Human
ugucacaggcaggu

SEQ ID NO: 2457126 - RNA, 13 nt, Human
ugucacacacuuu

SEQ ID NO: 2457127 - RNA, 14 nt, Human
ugucacaauccuaa

SEQ ID NO: 2457128 - RNA, 19 nt, Human
ugucacaauccuaacacau

SEQ ID NO: 2457129 - RNA, 21 nt, Human
ugucacaauccuaacacauua

SEQ ID NO: 2457130 - RNA, 13 nt, Human
uguaugcuucaua

SEQ ID NO: 2457131 - RNA, 14 nt, Human
uguaugcuucauac

SEQ ID NO: 2457132 - RNA, 16 nt, Human
uguaugcuucauacag

SEQ ID NO: 2457133 - RNA, 19 nt, Human
uguaugcuucauacaggga

SEQ ID NO: 2457134 - RNA, 23 nt, Human
uguaugccuuuaaaucugugaug

SEQ ID NO: 2457135 - RNA, 22 nt, Human
uguaugccuuuaaaucugugau

SEQ ID NO: 2457136 - RNA, 13 nt, Human
uguaugcgugugu

SEQ ID NO: 2457137 - RNA, 16 nt, Human
uguaugccaagugaga

SEQ ID NO: 2457138 - RNA, 18 nt, Human
uguaugccaagugagaag

SEQ ID NO: 2457139 - RNA, 21 nt, Human
uguaugccuuuaaaucuguga

SEQ ID NO: 2457140 - RNA, 12 nt, Human
uguaugccuuua

SEQ ID NO: 2457141 - RNA, 20 nt, Human
uguaugccaagugagaagau

SEQ ID NO: 2457142 - RNA, 15 nt, Human
uguaugggcaaaaaa

SEQ ID NO: 2457143 - RNA, 15 nt, Human
uguaugguucugugc

SEQ ID NO: 2457144 - RNA, 23 nt, Human
uguauggguguguguuuguguga

SEQ ID NO: 2457145 - RNA, 10 nt, Human
uguauguaaa

SEQ ID NO: 2457146 - RNA, 22 nt, Human
uguauguaaaugugcauucuuu

SEQ ID NO: 2457147 - RNA, 15 nt, Human
uguauguaaaugugc

SEQ ID NO: 2457148 - RNA, 14 nt, Human
uguauguaaaugug

SEQ ID NO: 2457149 - RNA, 21 nt, Human
uguauggauaguaaaauucua

SEQ ID NO: 2457150 - RNA, 16 nt, Human
uguauggauaguaaaa

SEQ ID NO: 2457151 - RNA, 14 nt, Human
uguaugggcaaaaa

SEQ ID NO: 2457152 - RNA, 17 nt, Human
uguauggagagaaaaca

SEQ ID NO: 2457153 - RNA, 18 nt, Human
uguauggaauacaguguu

SEQ ID NO: 2457154 - RNA, 19 nt, Human
uguauggaauacaguguua

SEQ ID NO: 2457155 - RNA, 23 nt, Human
uguauggaaauaaauguaucaua

SEQ ID NO: 2457156 - RNA, 16 nt, Human
uguauggaauacagug

SEQ ID NO: 2457157 - RNA, 17 nt, Human
uguauggaauacagugu

SEQ ID NO: 2457158 - RNA, 18 nt, Human
uguauggaaauaaaugua

SEQ ID NO: 2457159 - RNA, 12 nt, Human
uguaugcuggac

SEQ ID NO: 2457160 - RNA, 22 nt, Human
ugucaucauuguauauaugugu

SEQ ID NO: 2457161 - RNA, 19 nt, Human
ugucaucauuguauauaug

SEQ ID NO: 2457162 - RNA, 18 nt, Human
ugucaucauuguauauau

SEQ ID NO: 2457163 - RNA, 17 nt, Human
ugucacuuugcucuggg

SEQ ID NO: 2457164 - RNA, 16 nt, Human
ugucacuuugcucugg

SEQ ID NO: 2457165 - RNA, 19 nt, Human
ugucaucagaagauaacuu

SEQ ID NO: 2457166 - RNA, 18 nt, Human
ugucaucagccaccaucc

SEQ ID NO: 2457167 - RNA, 15 nt, Human
ugucaucagccacca

SEQ ID NO: 2457168 - RNA, 21 nt, Human
ugucaucagccaccauccuau

SEQ ID NO: 2457169 - RNA, 19 nt, Human
ugucagugugacugaucuc

SEQ ID NO: 2457170 - RNA, 16 nt, Human
ugucagugugacugau

SEQ ID NO: 2457171 - RNA, 14 nt, Human
ugucagugugacug

SEQ ID NO: 2457172 - RNA, 15 nt, Human
ugucagugugacuga

SEQ ID NO: 2457173 - RNA, 15 nt, Human
ugucacuuugcucug

SEQ ID NO: 2457174 - RNA, 14 nt, Human
ugucacuuugcucu

SEQ ID NO: 2457175 - RNA, 22 nt, Human
ugucacuucgcgugcccucgcu

SEQ ID NO: 2457176 - RNA, 13 nt, Human
ugucacuguuucu

SEQ ID NO: 2457177 - RNA, 17 nt, Human
ugucacuguuucucugc

SEQ ID NO: 2457178 - RNA, 21 nt, Human
ugucacuuacuguuucuguca

SEQ ID NO: 2457179 - RNA, 14 nt, Human
ugucacuuacuguu

SEQ ID NO: 2457180 - RNA, 18 nt, Human
ugucacuguuucucugcu

SEQ ID NO: 2457181 - RNA, 21 nt, Human
ugucacaggcagguccagggu

SEQ ID NO: 2457182 - RNA, 17 nt, Human
ugucacaggcaggucca

SEQ ID NO: 2457183 - RNA, 16 nt, Human
ugucacaggcaggucc

SEQ ID NO: 2457184 - RNA, 15 nt, Human
ugucacaggcagguc

SEQ ID NO: 2457185 - RNA, 22 nt, Human
ugucacuggcugccuccacucc

SEQ ID NO: 2457186 - RNA, 21 nt, Human
ugucacuggcugccuccacuc

SEQ ID NO: 2457187 - RNA, 19 nt, Human
ugucacuggcugccuccac

SEQ ID NO: 2457188 - RNA, 18 nt, Human
ugucacuggcugccucca

SEQ ID NO: 2457189 - RNA, 17 nt, Human
ugucacuggcugccucc

SEQ ID NO: 2457190 - RNA, 16 nt, Human
ugucacuggcugccuc

SEQ ID NO: 2457191 - RNA, 14 nt, Human
ugucacuggcugcc

SEQ ID NO: 2457192 - RNA, 13 nt, Human
ugucacuggcugc

SEQ ID NO: 2457193 - RNA, 23 nt, Human
ugucacugguagaccaaaauaaa

SEQ ID NO: 2457194 - RNA, 15 nt, Human
ugucacugugguccu

SEQ ID NO: 2457195 - RNA, 12 nt, Human
ugucacuguggu

SEQ ID NO: 2457196 - RNA, 21 nt, Human
ugucacugguagaccaaaaua

SEQ ID NO: 2457197 - RNA, 14 nt, Human
ugucacagggccaa

SEQ ID NO: 2457198 - RNA, 13 nt, Human
ugucacagggcca

SEQ ID NO: 2457199 - RNA, 12 nt, Human
ugucacagggcc

SEQ ID NO: 2457200 - RNA, 11 nt, Human
ugucacagggc

SEQ ID NO: 2457201 - RNA, 20 nt, Human
ugucacaugaaacauuugca

SEQ ID NO: 2457202 - RNA, 13 nt, Human
ugucacaggcagg

SEQ ID NO: 2457203 - RNA, 17 nt, Human
ugucacagggacugaaa

SEQ ID NO: 2457204 - RNA, 20 nt, Human
ugggauauaagaggcagcgu

SEQ ID NO: 2457205 - RNA, 19 nt, Human
ugggaucugccccucccug

SEQ ID NO: 2457206 - RNA, 23 nt, Human
ugggaucugccccucccugcuuc

SEQ ID NO: 2457207 - RNA, 19 nt, Human
ugggaugagaguuuuggau

SEQ ID NO: 2457208 - RNA, 13 nt, Human
ugggauaggaaaa

SEQ ID NO: 2457209 - RNA, 21 nt, Human
ugggauaggaaaaaugaguaa

SEQ ID NO: 2457210 - RNA, 16 nt, Human
ugggauacugcagggc

SEQ ID NO: 2457211 - RNA, 18 nt, Human
ugggaugauuggaggggg

SEQ ID NO: 2457212 - RNA, 16 nt, Human
ugggaugagccgcugu

SEQ ID NO: 2457213 - RNA, 14 nt, Human
ugggaugcuugccu

SEQ ID NO: 2457214 - RNA, 19 nt, Human
ugggaugcuugccuagggc

SEQ ID NO: 2457215 - RNA, 19 nt, Human
ugggaggagggagagggag

SEQ ID NO: 2457216 - RNA, 22 nt, Human
ugggaguugaucgccuuuccca

SEQ ID NO: 2457217 - RNA, 18 nt, Human
ugggaggagggagaggga

SEQ ID NO: 2457218 - RNA, 15 nt, Human
ugggaggagggagag

SEQ ID NO: 2457219 - RNA, 20 nt, Human
ugggaguuuuguauucaucu

SEQ ID NO: 2457220 - RNA, 23 nt, Human
ugggauaaagaugcaaggaccag

SEQ ID NO: 2457221 - RNA, 15 nt, Human
ugggacacccuguga

SEQ ID NO: 2457222 - RNA, 14 nt, Human
ugggacacccugug

SEQ ID NO: 2457223 - RNA, 21 nt, Human
ugggaaugaaugucaguguga

SEQ ID NO: 2457224 - RNA, 16 nt, Human
ugggaaugaaugucag

SEQ ID NO: 2457225 - RNA, 14 nt, Human
ugggacagggagga

SEQ ID NO: 2457226 - RNA, 20 nt, Human
ugggaaugaagcuuguguau

SEQ ID NO: 2457227 - RNA, 19 nt, Human
ugggaaugaagcuugugua

SEQ ID NO: 2457228 - RNA, 18 nt, Human
ugggaaugaagcuugugu

SEQ ID NO: 2457229 - RNA, 15 nt, Human
ugggaaugaagcuug

SEQ ID NO: 2457230 - RNA, 21 nt, Human
ugggaaugaagcuuguguauc

SEQ ID NO: 2457231 - RNA, 16 nt, Human
ugggaggaucucuuga

SEQ ID NO: 2457232 - RNA, 17 nt, Human
ugggcagagcagagacc

SEQ ID NO: 2457233 - RNA, 15 nt, Human
ugggcagagcagaga

SEQ ID NO: 2457234 - RNA, 14 nt, Human
ugggcagagcagag

SEQ ID NO: 2457235 - RNA, 16 nt, Human
ugggaugguggagggc

SEQ ID NO: 2457236 - RNA, 17 nt, Human
ugggaugguggagggcc

SEQ ID NO: 2457237 - RNA, 20 nt, Human
ugggaugcuugccuagggcc

SEQ ID NO: 2457238 - RNA, 13 nt, Human
ugggauggaggag

SEQ ID NO: 2457239 - RNA, 16 nt, Human
ugggauggaggagaag

SEQ ID NO: 2457240 - RNA, 14 nt, Human
ugggauggaggaga

SEQ ID NO: 2457241 - RNA, 13 nt, Human
ugggcagagcaga

SEQ ID NO: 2457242 - RNA, 16 nt, Human
ugggcagcauagcaag

SEQ ID NO: 2457243 - RNA, 18 nt, Human
ugggcagcauagcaagac

SEQ ID NO: 2457244 - RNA, 14 nt, Human
ugggcagccaggcu

SEQ ID NO: 2457245 - RNA, 15 nt, Human
ugggcagccaggcug

SEQ ID NO: 2457246 - RNA, 17 nt, Human
ugggcagcgcccuuccu

SEQ ID NO: 2457247 - RNA, 13 nt, Human
ugggcagcgcccu

SEQ ID NO: 2457248 - RNA, 16 nt, Human
ugggcagccaggcugc

SEQ ID NO: 2457249 - RNA, 22 nt, Human
ugggcaggacucagcuccccag

SEQ ID NO: 2457250 - RNA, 17 nt, Human
ugggcccugggcuggaa

SEQ ID NO: 2457251 - RNA, 16 nt, Human
ugggcccugggcugga

SEQ ID NO: 2457252 - RNA, 14 nt, Human
ugggcccugggcug

SEQ ID NO: 2457253 - RNA, 13 nt, Human
ugggccgcugcca

SEQ ID NO: 2457254 - RNA, 13 nt, Human
ugggcccuuugag

SEQ ID NO: 2457255 - RNA, 21 nt, Human
ugggccggcuucaugccagcu

SEQ ID NO: 2457256 - RNA, 14 nt, Human
ugggccgcugccac

SEQ ID NO: 2457257 - RNA, 16 nt, Human
ugggccucaaggacuu

SEQ ID NO: 2457258 - RNA, 22 nt, Human
ugggcagcuaccauuucccuuu

SEQ ID NO: 2457259 - RNA, 21 nt, Human
ugggcagcgcccuuccucucc

SEQ ID NO: 2457260 - RNA, 20 nt, Human
ugggcagcgcccuuccucuc

SEQ ID NO: 2457261 - RNA, 19 nt, Human
ugggcagcgcccuuccucu

SEQ ID NO: 2457262 - RNA, 19 nt, Human
ugggcagcucaucucuguc

SEQ ID NO: 2457263 - RNA, 10 nt, Human
ugggcagcuc

SEQ ID NO: 2457264 - RNA, 13 nt, Human
ugggcaggaaaag

SEQ ID NO: 2457265 - RNA, 23 nt, Human
ugggcaggaagugaagagauccu

SEQ ID NO: 2457266 - RNA, 13 nt, Human
ugggcaggaccuc

SEQ ID NO: 2457267 - RNA, 21 nt, Human
ugggcaggacucagcucccca

SEQ ID NO: 2457268 - RNA, 18 nt, Human
ugggcaggacucagcucc

SEQ ID NO: 2457269 - RNA, 17 nt, Human
ugggcaggacucagcuc

SEQ ID NO: 2457270 - RNA, 16 nt, Human
ugggcaggaccucaga

SEQ ID NO: 2457271 - RNA, 19 nt, Human
ugggguggguauaaaagau

SEQ ID NO: 2457272 - RNA, 15 nt, Human
ugggguggguauaaa

SEQ ID NO: 2457273 - RNA, 21 nt, Human
uggggggccaacaccagggau

SEQ ID NO: 2457274 - RNA, 15 nt, Human
uggggugugcuggga

SEQ ID NO: 2457275 - RNA, 13 nt, Human
uggggugugcugg

SEQ ID NO: 2457276 - RNA, 18 nt, Human
ugggguuaucucuguguu

SEQ ID NO: 2457277 - RNA, 15 nt, Human
uggggugugggaggc

SEQ ID NO: 2457278 - RNA, 19 nt, Human
ugggguuaucucuguguua

SEQ ID NO: 2457279 - RNA, 21 nt, Human
ugggguguguuccaacugccc

SEQ ID NO: 2457280 - RNA, 14 nt, Human
ugggguucagcccc

SEQ ID NO: 2457281 - RNA, 15 nt, Human
ugggguucagccccu

SEQ ID NO: 2457282 - RNA, 17 nt, Human
ugggguucagccccucc

SEQ ID NO: 2457283 - RNA, 19 nt, Human
ugggguucagccccuccuc

SEQ ID NO: 2457284 - RNA, 21 nt, Human
ugggguucagccccuccucug

SEQ ID NO: 2457285 - RNA, 22 nt, Human
ugggguucagccccuccucugc

SEQ ID NO: 2457286 - RNA, 14 nt, Human
ugggguucguggaa

SEQ ID NO: 2457287 - RNA, 16 nt, Human
ugggguugcaaccacu

SEQ ID NO: 2457288 - RNA, 20 nt, Human
ugggguucguggaaagggug

SEQ ID NO: 2457289 - RNA, 15 nt, Human
ugggggcuggugcca

SEQ ID NO: 2457290 - RNA, 13 nt, Human
ugggggcuggugc

SEQ ID NO: 2457291 - RNA, 16 nt, Human
ugggggcuggugccag

SEQ ID NO: 2457292 - RNA, 19 nt, Human
uggggggcugaggugggag

SEQ ID NO: 2457293 - RNA, 17 nt, Human
uggggggcuucauacac

SEQ ID NO: 2457294 - RNA, 15 nt, Human
uggggggccaacacc

SEQ ID NO: 2457295 - RNA, 17 nt, Human
uggggggccaacaccag

SEQ ID NO: 2457296 - RNA, 14 nt, Human
ugggggccuggauu

SEQ ID NO: 2457297 - RNA, 16 nt, Human
ugggggccucagugcc

SEQ ID NO: 2457298 - RNA, 13 nt, Human
ugggggccaugag

SEQ ID NO: 2457299 - RNA, 16 nt, Human
ugggggccaugagcuc

SEQ ID NO: 2457300 - RNA, 21 nt, Human
uggggccagauccagccuggg

SEQ ID NO: 2457301 - RNA, 18 nt, Human
ugggggcagagggcagag

SEQ ID NO: 2457302 - RNA, 17 nt, Human
ugggggcagggcaugac

SEQ ID NO: 2457303 - RNA, 22 nt, Human
ugggggcaggagggcccuaccu

SEQ ID NO: 2457304 - RNA, 17 nt, Human
ugggggcagagggcaga

SEQ ID NO: 2457305 - RNA, 19 nt, Human
uggggccagauccagccug

SEQ ID NO: 2457306 - RNA, 20 nt, Human
uggggccagauccagccugg

SEQ ID NO: 2457307 - RNA, 17 nt, Human
uggggccaggcuggguc

SEQ ID NO: 2457308 - RNA, 14 nt, Human
uggggccagaucca

SEQ ID NO: 2457309 - RNA, 15 nt, Human
uggggccagauccag

SEQ ID NO: 2457310 - RNA, 16 nt, Human
uggggccagauccagc

SEQ ID NO: 2457311 - RNA, 18 nt, Human
uggggccagauccagccu

SEQ ID NO: 2457312 - RNA, 17 nt, Human
uggggccacacagaaac

SEQ ID NO: 2457313 - RNA, 13 nt, Human
uggggccagaucc

SEQ ID NO: 2457314 - RNA, 14 nt, Human
uggggccacacaga

SEQ ID NO: 2457315 - RNA, 15 nt, Human
ugggcuucauccucc

SEQ ID NO: 2457316 - RNA, 15 nt, Human
ugggccugcuuccug

SEQ ID NO: 2457317 - RNA, 14 nt, Human
ugggccugcuuccu

SEQ ID NO: 2457318 - RNA, 13 nt, Human
ugggccugcuucc

SEQ ID NO: 2457319 - RNA, 22 nt, Human
ugggcuucauccuccucagauc

SEQ ID NO: 2457320 - RNA, 21 nt, Human
ugggcuucaguggcagcugcu

SEQ ID NO: 2457321 - RNA, 22 nt, Human
ugggcuucaguggcagcugcuu

SEQ ID NO: 2457322 - RNA, 16 nt, Human
ugggccugcuccagac

SEQ ID NO: 2457323 - RNA, 18 nt, Human
ugggccugcuccagaccu

SEQ ID NO: 2457324 - RNA, 19 nt, Human
ugggccugcuccagaccug

SEQ ID NO: 2457325 - RNA, 20 nt, Human
ugggccugcuccagaccuga

SEQ ID NO: 2457326 - RNA, 14 nt, Human
ugggccugcuccag

SEQ ID NO: 2457327 - RNA, 15 nt, Human
ugggccugcuccaga

SEQ ID NO: 2457328 - RNA, 13 nt, Human
ugggccugcagaa

SEQ ID NO: 2457329 - RNA, 21 nt, Human
ugggccucuuggaaaaaguga

SEQ ID NO: 2457330 - RNA, 21 nt, Human
ugggccucugguuuggggcga

SEQ ID NO: 2457331 - RNA, 16 nt, Human
ugggccucugguuugg

SEQ ID NO: 2457332 - RNA, 13 nt, Human
ugggccuccucac

SEQ ID NO: 2457333 - RNA, 20 nt, Human
ugggccuccucacaacaugg

SEQ ID NO: 2457334 - RNA, 23 nt, Human
ugggccucaaggacuugaaagca

SEQ ID NO: 2457335 - RNA, 23 nt, Human
ugggcuuggggaccagagcugcc

SEQ ID NO: 2457336 - RNA, 17 nt, Human
ugggcuugucuguagau

SEQ ID NO: 2457337 - RNA, 21 nt, Human
ugggcuugucuguagauuuua

SEQ ID NO: 2457338 - RNA, 22 nt, Human
ugggcuuggggaccagagcugc

SEQ ID NO: 2457339 - RNA, 17 nt, Human
ugggccugcuuccuguc

SEQ ID NO: 2457340 - RNA, 15 nt, Human
uggggauuucuccca

SEQ ID NO: 2457341 - RNA, 17 nt, Human
uggggauuucucccagc

SEQ ID NO: 2457342 - RNA, 13 nt, Human
uggggcagcuuga

SEQ ID NO: 2457343 - RNA, 18 nt, Human
uggggcagcacagagagg

SEQ ID NO: 2457344 - RNA, 16 nt, Human
uggggcagcacagaga

SEQ ID NO: 2457345 - RNA, 22 nt, Human
uggggcagcacagagagggggc

SEQ ID NO: 2457346 - RNA, 12 nt, Human
uggggcaaggcu

SEQ ID NO: 2457347 - RNA, 18 nt, Human
uggggcaagauuuuccuu

SEQ ID NO: 2457348 - RNA, 19 nt, Human
uggggcaagucccugacuc

SEQ ID NO: 2457349 - RNA, 14 nt, Human
uggggcagcacaga

SEQ ID NO: 2457350 - RNA, 13 nt, Human
uggggcagcacag

SEQ ID NO: 2457351 - RNA, 16 nt, Human
uggcugcugaaggcuc

SEQ ID NO: 2457352 - RNA, 14 nt, Human
uggcugcugaaggc

SEQ ID NO: 2457353 - RNA, 13 nt, Human
uggcugcugaagg

SEQ ID NO: 2457354 - RNA, 21 nt, Human
uggcugcugaagcugccugcu

SEQ ID NO: 2457355 - RNA, 15 nt, Human
uggcugcugaagcug

SEQ ID NO: 2457356 - RNA, 12 nt, Human
uggcugcugaag

SEQ ID NO: 2457357 - RNA, 18 nt, Human
uggcuccuaucuguguuu

SEQ ID NO: 2457358 - RNA, 11 nt, Human
uggcugcugaa

SEQ ID NO: 2457359 - RNA, 20 nt, Human
uggcucccggagggcccuga

SEQ ID NO: 2457360 - RNA, 21 nt, Human
uggcuccccucuauuuagcau

SEQ ID NO: 2457361 - RNA, 19 nt, Human
uggcuccgaacacccucga

SEQ ID NO: 2457362 - RNA, 16 nt, Human
uggcuccuaucugugu

SEQ ID NO: 2457363 - RNA, 14 nt, Human
uggcucccucuugg

SEQ ID NO: 2457364 - RNA, 13 nt, Human
uggcuccccucua

SEQ ID NO: 2457365 - RNA, 14 nt, Human
uggcuccccucuau

SEQ ID NO: 2457366 - RNA, 18 nt, Human
uggcucccauucacucuu

SEQ ID NO: 2457367 - RNA, 17 nt, Human
uggcucccauucacucu

SEQ ID NO: 2457368 - RNA, 23 nt, Human
uggcucccaugaccauacugagg

SEQ ID NO: 2457369 - RNA, 23 nt, Human
uggcuccccucuauuuagcauga

SEQ ID NO: 2457370 - RNA, 20 nt, Human
uggcuccagaugcagggcag

SEQ ID NO: 2457371 - RNA, 21 nt, Human
uggcuccagaugcagggcagu

SEQ ID NO: 2457372 - RNA, 20 nt, Human
uggcuccagaaaugucuaaa

SEQ ID NO: 2457373 - RNA, 15 nt, Human
uggcuccagaaaugu

SEQ ID NO: 2457374 - RNA, 21 nt, Human
uggcuccagcaccauccgcca

SEQ ID NO: 2457375 - RNA, 13 nt, Human
uggcuccagcacc

SEQ ID NO: 2457376 - RNA, 23 nt, Human
uggcuccagaugcagggcaguca

SEQ ID NO: 2457377 - RNA, 17 nt, Human
uggcuccagcuggccgg

SEQ ID NO: 2457378 - RNA, 20 nt, Human
uggcucccaugaccauacug

SEQ ID NO: 2457379 - RNA, 19 nt, Human
uggcuccagucugcugccc

SEQ ID NO: 2457380 - RNA, 20 nt, Human
uggcuccagucugcugcccu

SEQ ID NO: 2457381 - RNA, 23 nt, Human
uggcuccagucugcugcccucca

SEQ ID NO: 2457382 - RNA, 15 nt, Human
uggcuccaggccagg

SEQ ID NO: 2457383 - RNA, 15 nt, Human
uggcuccagucugcu

SEQ ID NO: 2457384 - RNA, 22 nt, Human
uggccuucggccuccauccuga

SEQ ID NO: 2457385 - RNA, 20 nt, Human
uggccuucggccuccauccu

SEQ ID NO: 2457386 - RNA, 23 nt, Human
uggccuucggccuccauccugag

SEQ ID NO: 2457387 - RNA, 13 nt, Human
uggccucugcacu

SEQ ID NO: 2457388 - RNA, 18 nt, Human
uggccucugcaaaggaaa

SEQ ID NO: 2457389 - RNA, 18 nt, Human
uggccuugaaaccaccuu

SEQ ID NO: 2457390 - RNA, 21 nt, Human
uggcuucccgcucagcccucc

SEQ ID NO: 2457391 - RNA, 20 nt, Human
uggcuucccgcucagcccuc

SEQ ID NO: 2457392 - RNA, 19 nt, Human
uggcuucccgcucagcccu

SEQ ID NO: 2457393 - RNA, 18 nt, Human
uggcuucccgcucagccc

SEQ ID NO: 2457394 - RNA, 15 nt, Human
uggcugggcccagaa

SEQ ID NO: 2457395 - RNA, 17 nt, Human
uggcuugccacagcucu

SEQ ID NO: 2457396 - RNA, 22 nt, Human
uggcuucccgcucagcccuccc

SEQ ID NO: 2457397 - RNA, 22 nt, Human
uggcuuccuaaaauucagugga

SEQ ID NO: 2457398 - RNA, 17 nt, Human
uggcugggaacugcaga

SEQ ID NO: 2457399 - RNA, 23 nt, Human
uggcugggaacucaccuggggcu

SEQ ID NO: 2457400 - RNA, 15 nt, Human
uggcugggaacucac

SEQ ID NO: 2457401 - RNA, 15 nt, Human
uggcugggacguggc

SEQ ID NO: 2457402 - RNA, 19 nt, Human
uggcugggacguggcucag

SEQ ID NO: 2457403 - RNA, 23 nt, Human
uggcugggacguggcucagccag

SEQ ID NO: 2457404 - RNA, 21 nt, Human
uggcugggaacugcagaccug

SEQ ID NO: 2457405 - RNA, 12 nt, Human
uggcugggccca

SEQ ID NO: 2457406 - RNA, 12 nt, Human
uggcugggcaug

SEQ ID NO: 2457407 - RNA, 21 nt, Human
uggcuggccuuccacuuggcu

SEQ ID NO: 2457408 - RNA, 22 nt, Human
uggcuggcuaacuggaagcaug

SEQ ID NO: 2457409 - RNA, 22 nt, Human
uggcugcugaagcugccugcuu

SEQ ID NO: 2457410 - RNA, 22 nt, Human
uggcuggaugaaauuuucuaga

SEQ ID NO: 2457411 - RNA, 15 nt, Human
uggcuggccacugca

SEQ ID NO: 2457412 - RNA, 17 nt, Human
uggcuggcccgucaugu

SEQ ID NO: 2457413 - RNA, 13 nt, Human
uggcuggcugcag

SEQ ID NO: 2457414 - RNA, 14 nt, Human
uggcuggcugcagu

SEQ ID NO: 2457415 - RNA, 17 nt, Human
uggcuuguaacuccacc

SEQ ID NO: 2457416 - RNA, 19 nt, Human
uggcuuguguguuucacuu

SEQ ID NO: 2457417 - RNA, 20 nt, Human
uggcuuguguguuucacuuu

SEQ ID NO: 2457418 - RNA, 16 nt, Human
uggcuuuucacugcug

SEQ ID NO: 2457419 - RNA, 24 nt, Human
uggcuuguaucaacacuguuacuu

SEQ ID NO: 2457420 - RNA, 18 nt, Human
uggcuuguguguuucacu

SEQ ID NO: 2457421 - RNA, 16 nt, Human
uggcuuguguguuuca

SEQ ID NO: 2457422 - RNA, 14 nt, Human
uggcuuguguguuu

SEQ ID NO: 2457423 - RNA, 22 nt, Human
uggcuuuucacugcuggcugcc

SEQ ID NO: 2457424 - RNA, 21 nt, Human
uggcuuuucacugcuggcugc

SEQ ID NO: 2457425 - RNA, 19 nt, Human
uggcuuuucacugcuggcu

SEQ ID NO: 2457426 - RNA, 18 nt, Human
uggcuuuucacugcuggc

SEQ ID NO: 2457427 - RNA, 14 nt, Human
ugggaaugaagcaa

SEQ ID NO: 2457428 - RNA, 14 nt, Human
ugggaaugaagcuu

SEQ ID NO: 2457429 - RNA, 13 nt, Human
ugggaaugaagcu

SEQ ID NO: 2457430 - RNA, 12 nt, Human
ugggaaugaagc

SEQ ID NO: 2457431 - RNA, 14 nt, Human
ugggaaucaagauu

SEQ ID NO: 2457432 - RNA, 15 nt, Human
uggcuuuucacugcu

SEQ ID NO: 2457433 - RNA, 18 nt, Human
uggccuccucccuuagcu

SEQ ID NO: 2457434 - RNA, 21 nt, Human
uggccuccggcgucagccucc

SEQ ID NO: 2457435 - RNA, 20 nt, Human
uggccuccggcgucagccuc

SEQ ID NO: 2457436 - RNA, 19 nt, Human
uggccuccggcgucagccu

SEQ ID NO: 2457437 - RNA, 19 nt, Human
uggccuccucccuuagcuc

SEQ ID NO: 2457438 - RNA, 20 nt, Human
uggccucccaaaugagccau

SEQ ID NO: 2457439 - RNA, 16 nt, Human
uggccuccccugcuga

SEQ ID NO: 2457440 - RNA, 18 nt, Human
uggccuccggccuccccu

SEQ ID NO: 2457441 - RNA, 15 nt, Human
uggccuccggccucc

SEQ ID NO: 2457442 - RNA, 12 nt, Human
uggccuccggcc

SEQ ID NO: 2457443 - RNA, 23 nt, Human
uggccucgggacaccugcccugc

SEQ ID NO: 2457444 - RNA, 17 nt, Human
uggccucgccuggccug

SEQ ID NO: 2457445 - RNA, 16 nt, Human
uggccucgccuggccu

SEQ ID NO: 2457446 - RNA, 15 nt, Human
uggccucgccuggcc

SEQ ID NO: 2457447 - RNA, 14 nt, Human
uggccucgccuggc

SEQ ID NO: 2457448 - RNA, 21 nt, Human
uggccucuccuuguggccugg

SEQ ID NO: 2457449 - RNA, 19 nt, Human
uggccucgggacaccugcc

SEQ ID NO: 2457450 - RNA, 22 nt, Human
uggccucccaacucaccccagc

SEQ ID NO: 2457451 - RNA, 21 nt, Human
uggccucccaacucaccccag

SEQ ID NO: 2457452 - RNA, 20 nt, Human
uggccucccaacucacccca

SEQ ID NO: 2457453 - RNA, 19 nt, Human
uggccucccaacucacccc

SEQ ID NO: 2457454 - RNA, 23 nt, Human
uggccuagcauacguacacauuu

SEQ ID NO: 2457455 - RNA, 13 nt, Human
uggccucaagauc

SEQ ID NO: 2457456 - RNA, 21 nt, Human
uggccucaacccucccucagc

SEQ ID NO: 2457457 - RNA, 22 nt, Human
uggccucaacccucccucagcc

SEQ ID NO: 2457458 - RNA, 23 nt, Human
uggccucaagugauucuccugcc

SEQ ID NO: 2457459 - RNA, 18 nt, Human
uggccucaagugauucuc

SEQ ID NO: 2457460 - RNA, 14 nt, Human
uggccucccaacuc

SEQ ID NO: 2457461 - RNA, 11 nt, Human
uggccucccaa

SEQ ID NO: 2457462 - RNA, 22 nt, Human
uggccucaagaucaaugaaaug

SEQ ID NO: 2457463 - RNA, 21 nt, Human
uggccucaagaucaaugaaau

SEQ ID NO: 2457464 - RNA, 23 nt, Human
uggccucaacccucccucagccc

SEQ ID NO: 2457465 - RNA, 17 nt, Human
uggccucagaauucaca

SEQ ID NO: 2457466 - RNA, 21 nt, Human
uggccuccacaguucgaccug

SEQ ID NO: 2457467 - RNA, 18 nt, Human
uggccccucugaccugca

SEQ ID NO: 2457468 - RNA, 16 nt, Human
uggccccucugaccug

SEQ ID NO: 2457469 - RNA, 14 nt, Human
uggccccugaacaa

SEQ ID NO: 2457470 - RNA, 20 nt, Human
uggccccugaacaagaauug

SEQ ID NO: 2457471 - RNA, 14 nt, Human
uggccccugagauc

SEQ ID NO: 2457472 - RNA, 20 nt, Human
uggccuagcauacguacaca

SEQ ID NO: 2457473 - RNA, 22 nt, Human
uggccccucagggucccuggug

SEQ ID NO: 2457474 - RNA, 21 nt, Human
uggccccucagggucccuggu

SEQ ID NO: 2457475 - RNA, 14 nt, Human
uggccccucugacc

SEQ ID NO: 2457476 - RNA, 13 nt, Human
uggccccucugac

SEQ ID NO: 2457477 - RNA, 12 nt, Human
uggccccucuga

SEQ ID NO: 2457478 - RNA, 10 nt, Human
uggccccucu

SEQ ID NO: 2457479 - RNA, 13 nt, Human
uggccccucaccu

SEQ ID NO: 2457480 - RNA, 23 nt, Human
uggccccaugucucucagaauuc

SEQ ID NO: 2457481 - RNA, 19 nt, Human
uggccccaugucucucaga

SEQ ID NO: 2457482 - RNA, 21 nt, Human
uggccccaugucucucagaau

SEQ ID NO: 2457483 - RNA, 19 nt, Human
uggccccucccccugccag

SEQ ID NO: 2457484 - RNA, 16 nt, Human
uggccccucaccuggg

SEQ ID NO: 2457485 - RNA, 21 nt, Human
uggccccucaccugggcaccu

SEQ ID NO: 2457486 - RNA, 20 nt, Human
uggccccagccuggcccagc

SEQ ID NO: 2457487 - RNA, 19 nt, Human
uggccccagccuggcccag

SEQ ID NO: 2457488 - RNA, 18 nt, Human
uggccccagccuggccca

SEQ ID NO: 2457489 - RNA, 17 nt, Human
uggccccagccuggccc

SEQ ID NO: 2457490 - RNA, 16 nt, Human
uggccccagccuggcc

SEQ ID NO: 2457491 - RNA, 13 nt, Human
uggccccagccug

SEQ ID NO: 2457492 - RNA, 12 nt, Human
uggccccagccu

SEQ ID NO: 2457493 - RNA, 17 nt, Human
uggcagcucuccaguca

SEQ ID NO: 2457494 - RNA, 22 nt, Human
uggccccagccuggcccagcuc

SEQ ID NO: 2457495 - RNA, 21 nt, Human
uggccccagccuggcccagcu

SEQ ID NO: 2457496 - RNA, 12 nt, Human
uggccccaggac

SEQ ID NO: 2457497 - RNA, 15 nt, Human
uggccccaggaccug

SEQ ID NO: 2457498 - RNA, 20 nt, Human
uggccccaggaccuggcugc

SEQ ID NO: 2457499 - RNA, 20 nt, Human
uggccccucagggucccugg

SEQ ID NO: 2457500 - RNA, 13 nt, Human
uggccccucaggg

SEQ ID NO: 2457501 - RNA, 19 nt, Human
uggccccagcacagcuuga

SEQ ID NO: 2457502 - RNA, 18 nt, Human
uggccccagcacagcuug

SEQ ID NO: 2457503 - RNA, 17 nt, Human
uggccccagcacagcuu

SEQ ID NO: 2457504 - RNA, 14 nt, Human
uggccccagcacag

SEQ ID NO: 2457505 - RNA, 13 nt, Human
uggccccagcaca

SEQ ID NO: 2457506 - RNA, 19 nt, Human
uggcagcugcgguccaccc

SEQ ID NO: 2457507 - RNA, 17 nt, Human
uggcagcugcgguccac

SEQ ID NO: 2457508 - RNA, 11 nt, Human
uggcagcucug

SEQ ID NO: 2457509 - RNA, 21 nt, Human
uggcagcucuggacagcccca

SEQ ID NO: 2457510 - RNA, 22 nt, Human
uggcagcucuggacagccccac

SEQ ID NO: 2457511 - RNA, 16 nt, Human
uggcagcugccacgcc

SEQ ID NO: 2457512 - RNA, 18 nt, Human
uggaacuucuaauauauu

SEQ ID NO: 2457513 - RNA, 16 nt, Human
uggaacuucuaauaua

SEQ ID NO: 2457514 - RNA, 15 nt, Human
uggaacuucuaauau

SEQ ID NO: 2457515 - RNA, 14 nt, Human
uggaacuucuaaua

SEQ ID NO: 2457516 - RNA, 15 nt, Human
uggaaccuccuuucu

SEQ ID NO: 2457517 - RNA, 13 nt, Human
uggaaccuccuuu

SEQ ID NO: 2457518 - RNA, 13 nt, Human
uggaacuucuaau

SEQ ID NO: 2457519 - RNA, 21 nt, Human
uggaacuucuaauauauuuuu

SEQ ID NO: 2457520 - RNA, 17 nt, Human
uggaaccucagccuggc

SEQ ID NO: 2457521 - RNA, 18 nt, Human
uggaaccucagccuggcc

SEQ ID NO: 2457522 - RNA, 19 nt, Human
uggaaccucagccuggcca

SEQ ID NO: 2457523 - RNA, 21 nt, Human
uggaaccuccuuucucuucuc

SEQ ID NO: 2457524 - RNA, 23 nt, Human
uggaaccucagccuggccagaca

SEQ ID NO: 2457525 - RNA, 12 nt, Human
uggaaccuccuu

SEQ ID NO: 2457526 - RNA, 20 nt, Human
uggaacagauucacacuguc

SEQ ID NO: 2457527 - RNA, 19 nt, Human
uggaacagauucacacugu

SEQ ID NO: 2457528 - RNA, 21 nt, Human
uggaacagaauguuuuacugu

SEQ ID NO: 2457529 - RNA, 16 nt, Human
uggaaacugaaugcuc

SEQ ID NO: 2457530 - RNA, 23 nt, Human
uggaacagauucacacugucugg

SEQ ID NO: 2457531 - RNA, 15 nt, Human
uggaaacugaaugcu

SEQ ID NO: 2457532 - RNA, 14 nt, Human
uggaaacugaaugc

SEQ ID NO: 2457533 - RNA, 16 nt, Human
uggaacagaauguuuu

SEQ ID NO: 2457534 - RNA, 17 nt, Human
uggaacacucugagacu

SEQ ID NO: 2457535 - RNA, 15 nt, Human
uggaacacucugaga

SEQ ID NO: 2457536 - RNA, 24 nt, Human
uggaaaccugcccugccugagggc

SEQ ID NO: 2457537 - RNA, 22 nt, Human
uggaaaccugcccugccugagg

SEQ ID NO: 2457538 - RNA, 12 nt, Human
uggaaacugaau

SEQ ID NO: 2457539 - RNA, 19 nt, Human
uggaaacucuuuaacuucu

SEQ ID NO: 2457540 - RNA, 18 nt, Human
uggaaacucuuuaacuuc

SEQ ID NO: 2457541 - RNA, 22 nt, Human
uggaaaaguauguuagugcaaa

SEQ ID NO: 2457542 - RNA, 19 nt, Human
uggaaaagggucuugggaa

SEQ ID NO: 2457543 - RNA, 20 nt, Human
uggaaaaggaagacuagagg

SEQ ID NO: 2457544 - RNA, 22 nt, Human
uggaaaaggaagacuagaggcu

SEQ ID NO: 2457545 - RNA, 16 nt, Human
uggaaaagaggaguuu

SEQ ID NO: 2457546 - RNA, 15 nt, Human
uggaaaaggaagacu

SEQ ID NO: 2457547 - RNA, 16 nt, Human
uggaaaaggaagacua

SEQ ID NO: 2457548 - RNA, 18 nt, Human
uggaaaaggaagacuaga

SEQ ID NO: 2457549 - RNA, 21 nt, Human
uggaaaccugcccugccugag

SEQ ID NO: 2457550 - RNA, 20 nt, Human
uggaaaccugcccugccuga

SEQ ID NO: 2457551 - RNA, 19 nt, Human
uggaaaccugcccugccug

SEQ ID NO: 2457552 - RNA, 17 nt, Human
uggaaaccugcccugcc

SEQ ID NO: 2457553 - RNA, 16 nt, Human
uggaaaccugcccugc

SEQ ID NO: 2457554 - RNA, 15 nt, Human
uggaaaccugcccug

SEQ ID NO: 2457555 - RNA, 14 nt, Human
uggaaaccugcccu

SEQ ID NO: 2457556 - RNA, 17 nt, Human
uggaaaccugaaaaaaa

SEQ ID NO: 2457557 - RNA, 12 nt, Human
uggaaaccacag

SEQ ID NO: 2457558 - RNA, 22 nt, Human
uggaaaagggucuugggaaaua

SEQ ID NO: 2457559 - RNA, 21 nt, Human
uggaaaagggucuugggaaau

SEQ ID NO: 2457560 - RNA, 21 nt, Human
uggaaacccuuaggacagggu

SEQ ID NO: 2457561 - RNA, 15 nt, Human
uggaaaccugaaaaa

SEQ ID NO: 2457562 - RNA, 12 nt, Human
ugcuuguguuau

SEQ ID NO: 2457563 - RNA, 16 nt, Human
ugcuuguuaacugagu

SEQ ID NO: 2457564 - RNA, 15 nt, Human
ugcuuguguuaagua

SEQ ID NO: 2457565 - RNA, 14 nt, Human
ugcuuguuaacuga

SEQ ID NO: 2457566 - RNA, 20 nt, Human
ugcuuucgucuccagccccu

SEQ ID NO: 2457567 - RNA, 20 nt, Human
ugcuuuccguggcacugcau

SEQ ID NO: 2457568 - RNA, 21 nt, Human
ugcuuuccguggcacugcaua

SEQ ID NO: 2457569 - RNA, 15 nt, Human
ugcuuuccccugugg

SEQ ID NO: 2457570 - RNA, 14 nt, Human
ugcuuuccccugug

SEQ ID NO: 2457571 - RNA, 13 nt, Human
ugcuuuccccugu

SEQ ID NO: 2457572 - RNA, 16 nt, Human
ugcuuucccugaacug

SEQ ID NO: 2457573 - RNA, 20 nt, Human
ugcuuuccccuguggggauc

SEQ ID NO: 2457574 - RNA, 17 nt, Human
ugcuuuccguggcacug

SEQ ID NO: 2457575 - RNA, 22 nt, Human
ugcuucuguuuuauaauuuugu

SEQ ID NO: 2457576 - RNA, 13 nt, Human
ugcuucuucagag

SEQ ID NO: 2457577 - RNA, 18 nt, Human
ugcuugugaaaggaaaga

SEQ ID NO: 2457578 - RNA, 12 nt, Human
ugcuuguguuaa

SEQ ID NO: 2457579 - RNA, 19 nt, Human
ugcuucuuaaccccaguaa

SEQ ID NO: 2457580 - RNA, 17 nt, Human
ugcuucuuaaccccagu

SEQ ID NO: 2457581 - RNA, 17 nt, Human
ugcuuuggaaaacccag

SEQ ID NO: 2457582 - RNA, 14 nt, Human
ugcuuugcccagca

SEQ ID NO: 2457583 - RNA, 13 nt, Human
ugcuuugcuuucu

SEQ ID NO: 2457584 - RNA, 16 nt, Human
uggaaaagccaagagg

SEQ ID NO: 2457585 - RNA, 19 nt, Human
uggaaaagccaagaggcug

SEQ ID NO: 2457586 - RNA, 19 nt, Human
ugcuuugcuuucugcucag

SEQ ID NO: 2457587 - RNA, 14 nt, Human
ugcuuugcuuucug

SEQ ID NO: 2457588 - RNA, 14 nt, Human
uggaaaagaauaca

SEQ ID NO: 2457589 - RNA, 19 nt, Human
uggaaaagaauacagaaag

SEQ ID NO: 2457590 - RNA, 20 nt, Human
ugcuuugacugagcagacug

SEQ ID NO: 2457591 - RNA, 22 nt, Human
ugcuuugacugagcagacuggu

SEQ ID NO: 2457592 - RNA, 22 nt, Human
ugcuuugacucaccuguuacuu

SEQ ID NO: 2457593 - RNA, 13 nt, Human
ugcuuugcccagc

SEQ ID NO: 2457594 - RNA, 15 nt, Human
ugcuuugccccugag

SEQ ID NO: 2457595 - RNA, 18 nt, Human
ugcuuucuccauuguaaa

SEQ ID NO: 2457596 - RNA, 18 nt, Human
ugcuuucuauuguacaga

SEQ ID NO: 2457597 - RNA, 13 nt, Human
ugcuuucuauugu

SEQ ID NO: 2457598 - RNA, 12 nt, Human
ugcuuucuauug

SEQ ID NO: 2457599 - RNA, 18 nt, Human
ugcuuucgaacugcuagu

SEQ ID NO: 2457600 - RNA, 12 nt, Human
ugcuuucugaaa

SEQ ID NO: 2457601 - RNA, 13 nt, Human
ugcuuucugaaau

SEQ ID NO: 2457602 - RNA, 16 nt, Human
ugcuguuuuguucugu

SEQ ID NO: 2457603 - RNA, 15 nt, Human
ugcuguuuuguucug

SEQ ID NO: 2457604 - RNA, 18 nt, Human
ugcuuaaaaaucauugau

SEQ ID NO: 2457605 - RNA, 18 nt, Human
ugcuguuuuguucugugg

SEQ ID NO: 2457606 - RNA, 17 nt, Human
ugcuuaaaaaucauuga

SEQ ID NO: 2457607 - RNA, 19 nt, Human
ugcuuaaaaaucauugauu

SEQ ID NO: 2457608 - RNA, 16 nt, Human
ugcuguuuuccucccu

SEQ ID NO: 2457609 - RNA, 17 nt, Human
ugcuguuuuccucccuu

SEQ ID NO: 2457610 - RNA, 19 nt, Human
ugcuguuuuccucccuucu

SEQ ID NO: 2457611 - RNA, 21 nt, Human
ugcuguuuuccucccuucugc

SEQ ID NO: 2457612 - RNA, 18 nt, Human
ugcuguuuugauuuguac

SEQ ID NO: 2457613 - RNA, 22 nt, Human
ugcuguuuuccucccuucugcu

SEQ ID NO: 2457614 - RNA, 14 nt, Human
ugcuguuuuccucc

SEQ ID NO: 2457615 - RNA, 15 nt, Human
ugcuguuuuccuccc

SEQ ID NO: 2457616 - RNA, 19 nt, Human
ugcuguuuguuugacaaag

SEQ ID NO: 2457617 - RNA, 14 nt, Human
ugccugucccucuc

SEQ ID NO: 2457618 - RNA, 11 nt, Human
ugccugucccu

SEQ ID NO: 2457619 - RNA, 19 nt, Human
ugccugucccacccccacc

SEQ ID NO: 2457620 - RNA, 16 nt, Human
ugccugucccaccccc

SEQ ID NO: 2457621 - RNA, 19 nt, Human
ugccuguccagccugggca

SEQ ID NO: 2457622 - RNA, 20 nt, Human
ugccuguccagccugggcag

SEQ ID NO: 2457623 - RNA, 23 nt, Human
ugccuguaguuaggaaauaaaac

SEQ ID NO: 2457624 - RNA, 15 nt, Human
ugccuguccagccug

SEQ ID NO: 2457625 - RNA, 16 nt, Human
ugccuguccagccugg

SEQ ID NO: 2457626 - RNA, 18 nt, Human
ugccuguccagccugggc

SEQ ID NO: 2457627 - RNA, 13 nt, Human
ugcuuaacuucac

SEQ ID NO: 2457628 - RNA, 14 nt, Human
ugcuuaacuucaca

SEQ ID NO: 2457629 - RNA, 17 nt, Human
ugcuuaacuucacauau

SEQ ID NO: 2457630 - RNA, 18 nt, Human
ugcuuaacuucacauauu

SEQ ID NO: 2457631 - RNA, 16 nt, Human
ugcuuaagcagaagca

SEQ ID NO: 2457632 - RNA, 19 nt, Human
ugcuuaacuucacauauug

SEQ ID NO: 2457633 - RNA, 12 nt, Human
ugcuuaaugaaa

SEQ ID NO: 2457634 - RNA, 14 nt, Human
ugcuuaaugaaaag

SEQ ID NO: 2457635 - RNA, 15 nt, Human
ugcuuccuccuggaa

SEQ ID NO: 2457636 - RNA, 14 nt, Human
ugcuuccuccugga

SEQ ID NO: 2457637 - RNA, 13 nt, Human
ugcuucgggcccu

SEQ ID NO: 2457638 - RNA, 12 nt, Human
ugcuucucacug

SEQ ID NO: 2457639 - RNA, 13 nt, Human
ugcuuccuccugg

SEQ ID NO: 2457640 - RNA, 12 nt, Human
ugcuuccuccug

SEQ ID NO: 2457641 - RNA, 22 nt, Human
ugcuuccuagaaguuacugaau

SEQ ID NO: 2457642 - RNA, 21 nt, Human
ugcuuccuagaaguuacugaa

SEQ ID NO: 2457643 - RNA, 20 nt, Human
ugcuuccuagaaguuacuga

SEQ ID NO: 2457644 - RNA, 12 nt, Human
ugcuuccuagaa

SEQ ID NO: 2457645 - RNA, 21 nt, Human
ugcuucccucugccugucccu

SEQ ID NO: 2457646 - RNA, 15 nt, Human
ugcuucuccagccug

SEQ ID NO: 2457647 - RNA, 13 nt, Human
ugcuucuccagcc

SEQ ID NO: 2457648 - RNA, 17 nt, Human
ugcuucuccaugagaca

SEQ ID NO: 2457649 - RNA, 17 nt, Human
ugcuucuguuuuauaau

SEQ ID NO: 2457650 - RNA, 13 nt, Human
ugcuucucugacu

SEQ ID NO: 2457651 - RNA, 12 nt, Human
ugcuucucugac

SEQ ID NO: 2457652 - RNA, 14 nt, Human
ugcuucucuacaga

SEQ ID NO: 2457653 - RNA, 16 nt, Human
ugcuucucuacagacu

SEQ ID NO: 2457654 - RNA, 14 nt, Human
ugcuuacauuuuua

SEQ ID NO: 2457655 - RNA, 12 nt, Human
ugcuuacauuuu

SEQ ID NO: 2457656 - RNA, 20 nt, Human
ugcuuacacaucucagaccc

SEQ ID NO: 2457657 - RNA, 17 nt, Human
ugcuuacacaucucaga

SEQ ID NO: 2457658 - RNA, 16 nt, Human
ugcuuacacaucucag

SEQ ID NO: 2457659 - RNA, 15 nt, Human
ugcuuacacaucuca

SEQ ID NO: 2457660 - RNA, 23 nt, Human
ugcuuacaauuuuuuuaauuuug

SEQ ID NO: 2457661 - RNA, 22 nt, Human
ugcuuacaauuuuuuuaauuuu

SEQ ID NO: 2457662 - RNA, 14 nt, Human
ugcuuacaauuuuu

SEQ ID NO: 2457663 - RNA, 13 nt, Human
ugcuuacaauuuu

SEQ ID NO: 2457664 - RNA, 22 nt, Human
ugcuuacaauucccugcugucg

SEQ ID NO: 2457665 - RNA, 21 nt, Human
ugcuuacaauucccugcuguc

SEQ ID NO: 2457666 - RNA, 20 nt, Human
ugcuuacaauucccugcugu

SEQ ID NO: 2457667 - RNA, 18 nt, Human
ugcuuacaauucccugcu

SEQ ID NO: 2457668 - RNA, 20 nt, Human
ugcuuacauuuuuacaauaa

SEQ ID NO: 2457669 - RNA, 17 nt, Human
ugcuuacauuuuuacaa

SEQ ID NO: 2457670 - RNA, 15 nt, Human
ugcuuacauuuuuac

SEQ ID NO: 2457671 - RNA, 18 nt, Human
ugcuuacauuuuuacaau

SEQ ID NO: 2457672 - RNA, 22 nt, Human
ugcuuccagugaggcucugccc

SEQ ID NO: 2457673 - RNA, 23 nt, Human
ugcuucccauuguggcuccuauc

SEQ ID NO: 2457674 - RNA, 15 nt, Human
ugcuucccuaaucua

SEQ ID NO: 2457675 - RNA, 20 nt, Human
ugcuucccauuguggcuccu

SEQ ID NO: 2457676 - RNA, 13 nt, Human
ugcuucccucugc

SEQ ID NO: 2457677 - RNA, 15 nt, Human
ugcuucccucugccu

SEQ ID NO: 2457678 - RNA, 20 nt, Human
ugcuucccucugccuguccc

SEQ ID NO: 2457679 - RNA, 17 nt, Human
ugcuucccauuguggcu

SEQ ID NO: 2457680 - RNA, 23 nt, Human
ugcuucccauccuacccucgggc

SEQ ID NO: 2457681 - RNA, 18 nt, Human
ugcuucccauccuacccu

SEQ ID NO: 2457682 - RNA, 16 nt, Human
ugcuucccauccuacc

SEQ ID NO: 2457683 - RNA, 15 nt, Human
ugcuucccauccuac

SEQ ID NO: 2457684 - RNA, 14 nt, Human
ugcuucccauccua

SEQ ID NO: 2457685 - RNA, 23 nt, Human
ugcuuccagugaggcucugcccu

SEQ ID NO: 2457686 - RNA, 22 nt, Human
uggagacauuccugggcacagu

SEQ ID NO: 2457687 - RNA, 21 nt, Human
uggagacauuccugggcacag

SEQ ID NO: 2457688 - RNA, 20 nt, Human
uggagacauuccugggcaca

SEQ ID NO: 2457689 - RNA, 15 nt, Human
uggagacauuccugg

SEQ ID NO: 2457690 - RNA, 22 nt, Human
uggagacagccccagagcaggg

SEQ ID NO: 2457691 - RNA, 21 nt, Human
uggagacagccccagagcagg

SEQ ID NO: 2457692 - RNA, 20 nt, Human
uggagacagccccagagcag

SEQ ID NO: 2457693 - RNA, 19 nt, Human
uggagacagccccagagca

SEQ ID NO: 2457694 - RNA, 17 nt, Human
uggagacagccccagag

SEQ ID NO: 2457695 - RNA, 13 nt, Human
uggagacagcccc

SEQ ID NO: 2457696 - RNA, 12 nt, Human
uggagacagccc

SEQ ID NO: 2457697 - RNA, 17 nt, Human
uggagacacaacuauuu

SEQ ID NO: 2457698 - RNA, 18 nt, Human
uggagagcuagaaccugg

SEQ ID NO: 2457699 - RNA, 20 nt, Human
uggagaccaugcagagcgcc

SEQ ID NO: 2457700 - RNA, 19 nt, Human
uggagaccaugcagagcgc

SEQ ID NO: 2457701 - RNA, 18 nt, Human
uggagaccaugcagagcg

SEQ ID NO: 2457702 - RNA, 18 nt, Human
uggagaccagggagccuu

SEQ ID NO: 2457703 - RNA, 19 nt, Human
uggagaccagggagccuuu

SEQ ID NO: 2457704 - RNA, 15 nt, Human
uggagaguuuccuga

SEQ ID NO: 2457705 - RNA, 16 nt, Human
uggagaguuuccugaa

SEQ ID NO: 2457706 - RNA, 20 nt, Human
uggagagcuggagccuggug

SEQ ID NO: 2457707 - RNA, 18 nt, Human
uggagagcuggagccugg

SEQ ID NO: 2457708 - RNA, 14 nt, Human
uggagagcuggugc

SEQ ID NO: 2457709 - RNA, 16 nt, Human
uggagagcuggugccc

SEQ ID NO: 2457710 - RNA, 19 nt, Human
uggagagcuggugcccgga

SEQ ID NO: 2457711 - RNA, 23 nt, Human
uggagagcuagaaccuggagagc

SEQ ID NO: 2457712 - RNA, 22 nt, Human
uggagagcuagaaccuggagag

SEQ ID NO: 2457713 - RNA, 21 nt, Human
uggagagcuagaaccuggagg

SEQ ID NO: 2457714 - RNA, 21 nt, Human
uggagagcuagaaccuggaga

SEQ ID NO: 2457715 - RNA, 20 nt, Human
uggagagcuagaaccuggag

SEQ ID NO: 2457716 - RNA, 19 nt, Human
uggagagcuagaaccugga

SEQ ID NO: 2457717 - RNA, 17 nt, Human
uggagagcuggagccug

SEQ ID NO: 2457718 - RNA, 15 nt, Human
uggagagcuggagcc

SEQ ID NO: 2457719 - RNA, 13 nt, Human
uggagagcuggag

SEQ ID NO: 2457720 - RNA, 11 nt, Human
uggagagcugg

SEQ ID NO: 2457721 - RNA, 22 nt, Human
uggacucugcacaugucuugua

SEQ ID NO: 2457722 - RNA, 18 nt, Human
uggacucugcacaugucu

SEQ ID NO: 2457723 - RNA, 17 nt, Human
uggacucugcacauguc

SEQ ID NO: 2457724 - RNA, 17 nt, Human
uggacucugcacaugaa

SEQ ID NO: 2457725 - RNA, 16 nt, Human
uggacucugcacauga

SEQ ID NO: 2457726 - RNA, 20 nt, Human
uggacggugcuccaggcagg

SEQ ID NO: 2457727 - RNA, 14 nt, Human
uggacucugcacau

SEQ ID NO: 2457728 - RNA, 15 nt, Human
uggacucugcacaug

SEQ ID NO: 2457729 - RNA, 19 nt, Human
uggacucugcacaugucuu

SEQ ID NO: 2457730 - RNA, 14 nt, Human
uggacucuugcucu

SEQ ID NO: 2457731 - RNA, 12 nt, Human
uggacucuugcu

SEQ ID NO: 2457732 - RNA, 18 nt, Human
uggacucuugcucuuucu

SEQ ID NO: 2457733 - RNA, 15 nt, Human
uggacucuugcucuu

SEQ ID NO: 2457734 - RNA, 19 nt, Human
uggacucuuugguggcuuu

SEQ ID NO: 2457735 - RNA, 15 nt, Human
uggacugaagccugc

SEQ ID NO: 2457736 - RNA, 21 nt, Human
uggacugucauagaaauuaca

SEQ ID NO: 2457737 - RNA, 15 nt, Human
uggacugugaugcca

SEQ ID NO: 2457738 - RNA, 15 nt, Human
uggacugucauagaa

SEQ ID NO: 2457739 - RNA, 21 nt, Human
uggacugugaugccacacaga

SEQ ID NO: 2457740 - RNA, 20 nt, Human
uggacugugaugccacacag

SEQ ID NO: 2457741 - RNA, 16 nt, Human
uggacuggccccuggg

SEQ ID NO: 2457742 - RNA, 15 nt, Human
uggacuggccccugg

SEQ ID NO: 2457743 - RNA, 14 nt, Human
uggacuggccccug

SEQ ID NO: 2457744 - RNA, 17 nt, Human
uggacuggaguggagca

SEQ ID NO: 2457745 - RNA, 20 nt, Human
uggacuggccccugggucag

SEQ ID NO: 2457746 - RNA, 17 nt, Human
uggacuggccccugggu

SEQ ID NO: 2457747 - RNA, 13 nt, Human
uggacuggcuaga

SEQ ID NO: 2457748 - RNA, 19 nt, Human
uggacuggcuagaguccuc

SEQ ID NO: 2457749 - RNA, 20 nt, Human
uggacuggcuagaguccuca

SEQ ID NO: 2457750 - RNA, 22 nt, Human
uggacuggcuagaguccucacu

SEQ ID NO: 2457751 - RNA, 13 nt, Human
uggacugggaggu

SEQ ID NO: 2457752 - RNA, 20 nt, Human
uggacuaacuugucuuugga

SEQ ID NO: 2457753 - RNA, 19 nt, Human
uggacuaacuugucuuugg

SEQ ID NO: 2457754 - RNA, 23 nt, Human
uggacuaaaagauauaagugcug

SEQ ID NO: 2457755 - RNA, 22 nt, Human
uggacuaaaagauauaagugcu

SEQ ID NO: 2457756 - RNA, 21 nt, Human
uggacuaaaagauauaagugc

SEQ ID NO: 2457757 - RNA, 15 nt, Human
uggacuaaaagauau

SEQ ID NO: 2457758 - RNA, 14 nt, Human
uggacuaaaagaua

SEQ ID NO: 2457759 - RNA, 13 nt, Human
uggacuaaaagau

SEQ ID NO: 2457760 - RNA, 17 nt, Human
uggacguucggggcaug

SEQ ID NO: 2457761 - RNA, 23 nt, Human
uggacguguuaugacuccagaau

SEQ ID NO: 2457762 - RNA, 19 nt, Human
uggacguguuaugacucca

SEQ ID NO: 2457763 - RNA, 22 nt, Human
uggacggugcuccaggcaggcu

SEQ ID NO: 2457764 - RNA, 19 nt, Human
uggacggugcuccaggcag

SEQ ID NO: 2457765 - RNA, 18 nt, Human
uggacggugcuccaggca

SEQ ID NO: 2457766 - RNA, 17 nt, Human
uggacggugcuccaggc

SEQ ID NO: 2457767 - RNA, 16 nt, Human
uggacggugcuccagg

SEQ ID NO: 2457768 - RNA, 14 nt, Human
uggacggugcucca

SEQ ID NO: 2457769 - RNA, 16 nt, Human
uggacggggacugggg

SEQ ID NO: 2457770 - RNA, 21 nt, Human
uggacggcaggcucacugcca

SEQ ID NO: 2457771 - RNA, 17 nt, Human
uggacauuuuuucaguc

SEQ ID NO: 2457772 - RNA, 23 nt, Human
uggacggcaggcucacugccagg

SEQ ID NO: 2457773 - RNA, 22 nt, Human
uggacggcaggcucacugccag

SEQ ID NO: 2457774 - RNA, 15 nt, Human
uggacggcugggcac

SEQ ID NO: 2457775 - RNA, 19 nt, Human
uggaagaagggagaagaaa

SEQ ID NO: 2457776 - RNA, 17 nt, Human
uggaagaagggagaaga

SEQ ID NO: 2457777 - RNA, 15 nt, Human
uggaagaagggagaa

SEQ ID NO: 2457778 - RNA, 13 nt, Human
uggaagaagggag

SEQ ID NO: 2457779 - RNA, 15 nt, Human
uggaagacacauuga

SEQ ID NO: 2457780 - RNA, 11 nt, Human
uggaagacaca

SEQ ID NO: 2457781 - RNA, 21 nt, Human
uggaagaagggagaagaaagg

SEQ ID NO: 2457782 - RNA, 12 nt, Human
uggaagaaggga

SEQ ID NO: 2457783 - RNA, 15 nt, Human
uggaagaagagggag

SEQ ID NO: 2457784 - RNA, 20 nt, Human
uggaagaaauuccuguagca

SEQ ID NO: 2457785 - RNA, 17 nt, Human
uggaagaaauuccugua

SEQ ID NO: 2457786 - RNA, 22 nt, Human
uggacaggcauguucucugagg

SEQ ID NO: 2457787 - RNA, 18 nt, Human
uggacaggcauguucucu

SEQ ID NO: 2457788 - RNA, 22 nt, Human
uggacauuugccuugcuggacg

SEQ ID NO: 2457789 - RNA, 19 nt, Human
uggacauuugccuugcugg

SEQ ID NO: 2457790 - RNA, 18 nt, Human
uggacauuugccuugcug

SEQ ID NO: 2457791 - RNA, 17 nt, Human
uggacauuugccuugcu

SEQ ID NO: 2457792 - RNA, 23 nt, Human
uggacaggcauguucucugagga

SEQ ID NO: 2457793 - RNA, 17 nt, Human
uggacaggcauguucuc

SEQ ID NO: 2457794 - RNA, 17 nt, Human
uggacauggccccugug

SEQ ID NO: 2457795 - RNA, 12 nt, Human
uggacauggccc

SEQ ID NO: 2457796 - RNA, 15 nt, Human
uggacauugucugcg

SEQ ID NO: 2457797 - RNA, 22 nt, Human
uggacauuguuggcagcauaaa

SEQ ID NO: 2457798 - RNA, 21 nt, Human
uggaugcagccucacaguccu

SEQ ID NO: 2457799 - RNA, 13 nt, Human
uggaugcagccuc

SEQ ID NO: 2457800 - RNA, 22 nt, Human
uggaugcagccucacaguccuu

SEQ ID NO: 2457801 - RNA, 14 nt, Human
uggaugauguuucg

SEQ ID NO: 2457802 - RNA, 17 nt, Human
uggaugauguuucguga

SEQ ID NO: 2457803 - RNA, 17 nt, Human
uggauauaguuuuacuu

SEQ ID NO: 2457804 - RNA, 16 nt, Human
uggauauaguuuuacu

SEQ ID NO: 2457805 - RNA, 18 nt, Human
uggauauauguuuuugaa

SEQ ID NO: 2457806 - RNA, 13 nt, Human
uggauauuuucaa

SEQ ID NO: 2457807 - RNA, 19 nt, Human
uggaucaaauccagccugc

SEQ ID NO: 2457808 - RNA, 23 nt, Human
uggaucacagaggcuucuucaga

SEQ ID NO: 2457809 - RNA, 18 nt, Human
uggauauuuucaaauugu

SEQ ID NO: 2457810 - RNA, 22 nt, Human
uggauauuuucaaauuguaucu

SEQ ID NO: 2457811 - RNA, 23 nt, Human
uggauauuuucaaauuguaucua

SEQ ID NO: 2457812 - RNA, 12 nt, Human
uggagggcugga

SEQ ID NO: 2457813 - RNA, 23 nt, Human
uggagggcuagaaucuggagagc

SEQ ID NO: 2457814 - RNA, 22 nt, Human
uggagggcuagaaucuggagag

SEQ ID NO: 2457815 - RNA, 21 nt, Human
uggagggcuagaaucuggaga

SEQ ID NO: 2457816 - RNA, 22 nt, Human
uggagggcuggaaucuggagag

SEQ ID NO: 2457817 - RNA, 21 nt, Human
uggagggcuggaaucuggaga

SEQ ID NO: 2457818 - RNA, 23 nt, Human
uggaggggggaggugggauccuc

SEQ ID NO: 2457819 - RNA, 20 nt, Human
uggaggggcauggccagcag

SEQ ID NO: 2457820 - RNA, 14 nt, Human
uggaggggccccug

SEQ ID NO: 2457821 - RNA, 21 nt, Human
uggagauccuccugcagacca

SEQ ID NO: 2457822 - RNA, 20 nt, Human
uggagauccuccugcagacc

SEQ ID NO: 2457823 - RNA, 21 nt, Human
uggagggcuagaacuggagag

SEQ ID NO: 2457824 - RNA, 20 nt, Human
uggagggcuagaacuggaga

SEQ ID NO: 2457825 - RNA, 21 nt, Human
uggagggcuagaaccuggagg

SEQ ID NO: 2457826 - RNA, 16 nt, Human
uggagauagggaaaga

SEQ ID NO: 2457827 - RNA, 19 nt, Human
uggagauauuuaugggggg

SEQ ID NO: 2457828 - RNA, 23 nt, Human
uggagauauuuauggggggagaa

SEQ ID NO: 2457829 - RNA, 17 nt, Human
uggagaguuuccugaaa

SEQ ID NO: 2457830 - RNA, 20 nt, Human
uggagauaaagauuucuuga

SEQ ID NO: 2457831 - RNA, 18 nt, Human
uggagauccuccugcaga

SEQ ID NO: 2457832 - RNA, 16 nt, Human
uggagauccuccugca

SEQ ID NO: 2457833 - RNA, 14 nt, Human
uggagauccuccug

SEQ ID NO: 2457834 - RNA, 19 nt, Human
uggcacugcuuccagugag

SEQ ID NO: 2457835 - RNA, 19 nt, Human
uggcacucacagaccugga

SEQ ID NO: 2457836 - RNA, 18 nt, Human
uggcacucacagaccugg

SEQ ID NO: 2457837 - RNA, 17 nt, Human
uggcacucacagaccug

SEQ ID NO: 2457838 - RNA, 19 nt, Human
uggcacugacugggcauag

SEQ ID NO: 2457839 - RNA, 13 nt, Human
uggcacugagccc

SEQ ID NO: 2457840 - RNA, 22 nt, Human
uggcacugagauauuuauuguu

SEQ ID NO: 2457841 - RNA, 22 nt, Human
uggcacucacagaccuggagcc

SEQ ID NO: 2457842 - RNA, 15 nt, Human
uggcacucaacauga

SEQ ID NO: 2457843 - RNA, 16 nt, Human
uggcaaggcugugcuc

SEQ ID NO: 2457844 - RNA, 15 nt, Human
uggcaaggcugugcu

SEQ ID NO: 2457845 - RNA, 14 nt, Human
uggcaaggcugugc

SEQ ID NO: 2457846 - RNA, 22 nt, Human
uggcacuauaauguaagcucua

SEQ ID NO: 2457847 - RNA, 22 nt, Human
uggcacugcuuccagugaggcu

SEQ ID NO: 2457848 - RNA, 15 nt, Human
uggcacugagccccc

SEQ ID NO: 2457849 - RNA, 14 nt, Human
uggcacugagcccc

SEQ ID NO: 2457850 - RNA, 13 nt, Human
uggcacuggaugc

SEQ ID NO: 2457851 - RNA, 15 nt, Human
uggcacuggaugcag

SEQ ID NO: 2457852 - RNA, 15 nt, Human
uggcagcucuccagu

SEQ ID NO: 2457853 - RNA, 14 nt, Human
uggcagcucuccag

SEQ ID NO: 2457854 - RNA, 13 nt, Human
uggcagcucucca

SEQ ID NO: 2457855 - RNA, 12 nt, Human
uggcagcucucc

SEQ ID NO: 2457856 - RNA, 20 nt, Human
uggcacuggggcacuuggca

SEQ ID NO: 2457857 - RNA, 17 nt, Human
uggcacuggggcacuug

SEQ ID NO: 2457858 - RNA, 20 nt, Human
uggcacuggcauugucccug

SEQ ID NO: 2457859 - RNA, 18 nt, Human
uggcacuggaugcagaaa

SEQ ID NO: 2457860 - RNA, 12 nt, Human
uggcaaggcugu

SEQ ID NO: 2457861 - RNA, 20 nt, Human
uggcaaggcagcccugucug

SEQ ID NO: 2457862 - RNA, 19 nt, Human
uggcaaggacacagaugaa

SEQ ID NO: 2457863 - RNA, 21 nt, Human
uggcacuauaauguaagcucu

SEQ ID NO: 2457864 - RNA, 21 nt, Human
uggcaagcuagaaccuggagg

SEQ ID NO: 2457865 - RNA, 21 nt, Human
uggcaagccccugcccaucug

SEQ ID NO: 2457866 - RNA, 16 nt, Human
uggcaagccccugccc

SEQ ID NO: 2457867 - RNA, 15 nt, Human
uggcaagccccugcc

SEQ ID NO: 2457868 - RNA, 13 nt, Human
uggcaagcuguga

SEQ ID NO: 2457869 - RNA, 16 nt, Human
uggcaaggaaaaacag

SEQ ID NO: 2457870 - RNA, 13 nt, Human
uggcaagagcccc

SEQ ID NO: 2457871 - RNA, 19 nt, Human
uggcaagaaagcugguaaa

SEQ ID NO: 2457872 - RNA, 22 nt, Human
uggcaaccuugucucuaugcca

SEQ ID NO: 2457873 - RNA, 15 nt, Human
uggcaagaaagcugg

SEQ ID NO: 2457874 - RNA, 15 nt, Human
uggauuuaacagaaa

SEQ ID NO: 2457875 - RNA, 14 nt, Human
uggaugcagugcuc

SEQ ID NO: 2457876 - RNA, 17 nt, Human
uggauuuaacagaaaug

SEQ ID NO: 2457877 - RNA, 22 nt, Human
ugaucagagccgugguccuuug

SEQ ID NO: 2457878 - RNA, 23 nt, Human
ugaucagagccgugguccuuugg

SEQ ID NO: 2457879 - RNA, 15 nt, Human
ugaucagaucugaca

SEQ ID NO: 2457880 - RNA, 16 nt, Human
ugaucagaucugacau

SEQ ID NO: 2457881 - RNA, 17 nt, Human
ugaucagaucugacaug

SEQ ID NO: 2457882 - RNA, 23 nt, Human
ugaucagaucugacaugauuccu

SEQ ID NO: 2457883 - RNA, 21 nt, Human
ugaucagagccgugguccuuu

SEQ ID NO: 2457884 - RNA, 18 nt, Human
ugaucagaccauaauguu

SEQ ID NO: 2457885 - RNA, 18 nt, Human
ugaucacuggcaaugaaa

SEQ ID NO: 2457886 - RNA, 16 nt, Human
ugauauggcagaagac

SEQ ID NO: 2457887 - RNA, 20 nt, Human
ugauauggagcccuguaauu

SEQ ID NO: 2457888 - RNA, 17 nt, Human
ugauauggagcccugua

SEQ ID NO: 2457889 - RNA, 15 nt, Human
ugauauggcagaaga

SEQ ID NO: 2457890 - RNA, 22 nt, Human
ugaucacggcucacugcagccu

SEQ ID NO: 2457891 - RNA, 19 nt, Human
ugauaugaaaaauaugaua

SEQ ID NO: 2457892 - RNA, 19 nt, Human
ugauaugauuuaaaacaug

SEQ ID NO: 2457893 - RNA, 15 nt, Human
ugauaugauuuaaaa

SEQ ID NO: 2457894 - RNA, 12 nt, Human
ugauaugaaaaa

SEQ ID NO: 2457895 - RNA, 15 nt, Human
ugauaugaaaaauau

SEQ ID NO: 2457896 - RNA, 19 nt, Human
ugauaugcaguuuuccuua

SEQ ID NO: 2457897 - RNA, 15 nt, Human
ugauauauuuuacaa

SEQ ID NO: 2457898 - RNA, 17 nt, Human
ugauaucacagucuaau

SEQ ID NO: 2457899 - RNA, 19 nt, Human
ugauauauuuaaaaauauu

SEQ ID NO: 2457900 - RNA, 19 nt, Human
ugauaucacagucuaauuu

SEQ ID NO: 2457901 - RNA, 19 nt, Human
ugauauccauucuuucuga

SEQ ID NO: 2457902 - RNA, 21 nt, Human
ugauaucaugccccuguacuc

SEQ ID NO: 2457903 - RNA, 16 nt, Human
ugauaucccccagccu

SEQ ID NO: 2457904 - RNA, 21 nt, Human
ugauauccauucuuucugaua

SEQ ID NO: 2457905 - RNA, 11 nt, Human
ugauaugaaaa

SEQ ID NO: 2457906 - RNA, 22 nt, Human
ugauauauaaguguacauaugu

SEQ ID NO: 2457907 - RNA, 16 nt, Human
ugauauauggauaaug

SEQ ID NO: 2457908 - RNA, 13 nt, Human
ugauauauguguu

SEQ ID NO: 2457909 - RNA, 13 nt, Human
ugauauauuuuac

SEQ ID NO: 2457910 - RNA, 14 nt, Human
ugauauauuuuaca

SEQ ID NO: 2457911 - RNA, 14 nt, Human
ugauauauuuaaaa

SEQ ID NO: 2457912 - RNA, 21 nt, Human
ugauauauguguuuuucacau

SEQ ID NO: 2457913 - RNA, 19 nt, Human
ugauauauaaguguacaua

SEQ ID NO: 2457914 - RNA, 18 nt, Human
ugauauauaaguguacau

SEQ ID NO: 2457915 - RNA, 22 nt, Human
ugauauagaacagugcuugcca

SEQ ID NO: 2457916 - RNA, 16 nt, Human
ugauauaaaugcaaua

SEQ ID NO: 2457917 - RNA, 13 nt, Human
ugauauaaaugca

SEQ ID NO: 2457918 - RNA, 22 nt, Human
ugauauacuuuuuucuuauuua

SEQ ID NO: 2457919 - RNA, 23 nt, Human
ugauauaaguguguguuuuucau

SEQ ID NO: 2457920 - RNA, 17 nt, Human
ugauauaaguguguguu

SEQ ID NO: 2457921 - RNA, 24 nt, Human
ugauaguuguaccgcaaugugacu

SEQ ID NO: 2457922 - RNA, 20 nt, Human
ugauaguuacuguugugacc

SEQ ID NO: 2457923 - RNA, 19 nt, Human
ugauauaaaucagauucuu

SEQ ID NO: 2457924 - RNA, 14 nt, Human
ugauauaaauaaaa

SEQ ID NO: 2457925 - RNA, 20 nt, Human
ugauccacccaccucagccu

SEQ ID NO: 2457926 - RNA, 15 nt, Human
ugauccacccaccuc

SEQ ID NO: 2457927 - RNA, 21 nt, Human
ugauccaagcuggucccacuc

SEQ ID NO: 2457928 - RNA, 19 nt, Human
ugaucauagguauuucaaa

SEQ ID NO: 2457929 - RNA, 15 nt, Human
ugaucauaagucuaa

SEQ ID NO: 2457930 - RNA, 21 nt, Human
ugaucauaagucuaaauaaau

SEQ ID NO: 2457931 - RNA, 17 nt, Human
ugauccaagcugguccc

SEQ ID NO: 2457932 - RNA, 24 nt, Human
ugaucauccacugugccaugugcc

SEQ ID NO: 2457933 - RNA, 13 nt, Human
ugaucauccacug

SEQ ID NO: 2457934 - RNA, 21 nt, Human
ugaucuaggaagacuuuggaa

SEQ ID NO: 2457935 - RNA, 19 nt, Human
ugaucuaggaagacuuugg

SEQ ID NO: 2457936 - RNA, 22 nt, Human
ugauccacccaccucagccucc

SEQ ID NO: 2457937 - RNA, 21 nt, Human
ugauccacccaccucagccuc

SEQ ID NO: 2457938 - RNA, 21 nt, Human
ugaucuagguuuaacucagau

SEQ ID NO: 2457939 - RNA, 20 nt, Human
ugaucuagguuuaacucaga

SEQ ID NO: 2457940 - RNA, 19 nt, Human
ugaucuagguuuaacucag

SEQ ID NO: 2457941 - RNA, 18 nt, Human
ugaucuagguuuaacuca

SEQ ID NO: 2457942 - RNA, 17 nt, Human
ugaucuagguuuaacuc

SEQ ID NO: 2457943 - RNA, 16 nt, Human
ugaucuagguuuaacu

SEQ ID NO: 2457944 - RNA, 15 nt, Human
ugaucuagguuuaac

SEQ ID NO: 2457945 - RNA, 14 nt, Human
ugaucuagguuuaa

SEQ ID NO: 2457946 - RNA, 20 nt, Human
ugaucauagguauuucaaaa

SEQ ID NO: 2457947 - RNA, 13 nt, Human
ugaucuagguuua

SEQ ID NO: 2457948 - RNA, 22 nt, Human
ugaucuagguuuaacucagauc

SEQ ID NO: 2457949 - RNA, 20 nt, Human
ugaucugaugcaagcaagaa

SEQ ID NO: 2457950 - RNA, 17 nt, Human
ugaucugagucccagga

SEQ ID NO: 2457951 - RNA, 23 nt, Human
ugaucucuucuuuuggcuuccau

SEQ ID NO: 2457952 - RNA, 17 nt, Human
ugaucugacauccccac

SEQ ID NO: 2457953 - RNA, 20 nt, Human
ugaugaugaaaugaggucag

SEQ ID NO: 2457954 - RNA, 23 nt, Human
ugaugaucuuugcagacaggcaa

SEQ ID NO: 2457955 - RNA, 14 nt, Human
ugaugaaaauauuu

SEQ ID NO: 2457956 - RNA, 22 nt, Human
ugaugaucuuugcagacaggca

SEQ ID NO: 2457957 - RNA, 14 nt, Human
ugaugccaugagga

SEQ ID NO: 2457958 - RNA, 22 nt, Human
ugaugccacaccaagcugugcc

SEQ ID NO: 2457959 - RNA, 20 nt, Human
ugaugccacaccaagcugug

SEQ ID NO: 2457960 - RNA, 18 nt, Human
ugaugccacaccaagcug

SEQ ID NO: 2457961 - RNA, 17 nt, Human
ugaugccacaccaagcu

SEQ ID NO: 2457962 - RNA, 19 nt, Human
ugaugccaaguuguuugag

SEQ ID NO: 2457963 - RNA, 15 nt, Human
ugaugccacaccaag

SEQ ID NO: 2457964 - RNA, 18 nt, Human
ugaugccacacagagugg

SEQ ID NO: 2457965 - RNA, 15 nt, Human
ugaugccaaccucug

SEQ ID NO: 2457966 - RNA, 15 nt, Human
ugaugccaaguuguu

SEQ ID NO: 2457967 - RNA, 21 nt, Human
ugaugccaaguuguuugagaa

SEQ ID NO: 2457968 - RNA, 21 nt, Human
ugaugaugggaauugugugau

SEQ ID NO: 2457969 - RNA, 18 nt, Human
ugaugaugggaauugugu

SEQ ID NO: 2457970 - RNA, 20 nt, Human
ugaucuuugcagacaggcaa

SEQ ID NO: 2457971 - RNA, 19 nt, Human
ugaucuuugcagacaggca

SEQ ID NO: 2457972 - RNA, 19 nt, Human
ugaucugcucagcccugga

SEQ ID NO: 2457973 - RNA, 18 nt, Human
ugaucugcucagcccugg

SEQ ID NO: 2457974 - RNA, 17 nt, Human
ugaucugcucagcccug

SEQ ID NO: 2457975 - RNA, 16 nt, Human
ugaucugcucagcccu

SEQ ID NO: 2457976 - RNA, 21 nt, Human
ugaucugcucagcccuggagg

SEQ ID NO: 2457977 - RNA, 20 nt, Human
ugaucugcucagcccuggag

SEQ ID NO: 2457978 - RNA, 13 nt, Human
ugaucuggaaccc

SEQ ID NO: 2457979 - RNA, 15 nt, Human
ugaucugcucagccc

SEQ ID NO: 2457980 - RNA, 14 nt, Human
ugaucugcucagcc

SEQ ID NO: 2457981 - RNA, 21 nt, Human
ugaucugaugcaagcaagaaa

SEQ ID NO: 2457982 - RNA, 23 nt, Human
ugaucuuugcagacaggcaagca

SEQ ID NO: 2457983 - RNA, 21 nt, Human
ugaucuuugcagacaggcaag

SEQ ID NO: 2457984 - RNA, 18 nt, Human
ugaucuuugcagacaggc

SEQ ID NO: 2457985 - RNA, 15 nt, Human
ugaugaaaaauagca

SEQ ID NO: 2457986 - RNA, 13 nt, Human
ugauguauucuag

SEQ ID NO: 2457987 - RNA, 20 nt, Human
ugauguaggguaaggugccu

SEQ ID NO: 2457988 - RNA, 19 nt, Human
ugauguacagucugucaug

SEQ ID NO: 2457989 - RNA, 18 nt, Human
ugauguacagucugucau

SEQ ID NO: 2457990 - RNA, 17 nt, Human
ugauguacagucuguca

SEQ ID NO: 2457991 - RNA, 16 nt, Human
ugauguacagucuguc

SEQ ID NO: 2457992 - RNA, 20 nt, Human
ugauguaccaugaaacaaag

SEQ ID NO: 2457993 - RNA, 18 nt, Human
ugauguaccaugaaacaa

SEQ ID NO: 2457994 - RNA, 20 nt, Human
ugauguauucuagcuaaugu

SEQ ID NO: 2457995 - RNA, 14 nt, Human
ugauguauucuagc

SEQ ID NO: 2457996 - RNA, 21 nt, Human
ugauguauucuagcuaaugua

SEQ ID NO: 2457997 - RNA, 18 nt, Human
ugauguagugccucuuuc

SEQ ID NO: 2457998 - RNA, 17 nt, Human
ugauguagugccucuuu

SEQ ID NO: 2457999 - RNA, 12 nt, Human
ugauguauauuu

SEQ ID NO: 2458000 - RNA, 15 nt, Human
ugaugucccuaugga

SEQ ID NO: 2458001 - RNA, 13 nt, Human
ugauguacaugua

SEQ ID NO: 2458002 - RNA, 22 nt, Human
ugauguaaucuugaauuguaac

SEQ ID NO: 2458003 - RNA, 19 nt, Human
ugauguaaguuuaccuaug

SEQ ID NO: 2458004 - RNA, 21 nt, Human
ugaugguuguacauauaagug

SEQ ID NO: 2458005 - RNA, 17 nt, Human
ugaugcuggagagguua

SEQ ID NO: 2458006 - RNA, 16 nt, Human
ugaugcuggagagguu

SEQ ID NO: 2458007 - RNA, 15 nt, Human
ugaugcuggaugcuc

SEQ ID NO: 2458008 - RNA, 21 nt, Human
ugauguaaccgauucaucucu

SEQ ID NO: 2458009 - RNA, 22 nt, Human
ugaugcuucuucagagacuccu

SEQ ID NO: 2458010 - RNA, 21 nt, Human
ugaugcuucuucagagacucc

SEQ ID NO: 2458011 - RNA, 19 nt, Human
ugaugcuucuucagagacu

SEQ ID NO: 2458012 - RNA, 15 nt, Human
ugaugcuggagaggu

SEQ ID NO: 2458013 - RNA, 14 nt, Human
ugaugcuggagagg

SEQ ID NO: 2458014 - RNA, 20 nt, Human
ugaugcuggaugcuccuucc

SEQ ID NO: 2458015 - RNA, 15 nt, Human
ugaugcugccccuca

SEQ ID NO: 2458016 - RNA, 23 nt, Human
ugaugcucccuccccugcccugg

SEQ ID NO: 2458017 - RNA, 17 nt, Human
ugaugcucccuccccug

SEQ ID NO: 2458018 - RNA, 20 nt, Human
ugaugcucccuccccugccc

SEQ ID NO: 2458019 - RNA, 21 nt, Human
ugaugcucccuccccugcccu

SEQ ID NO: 2458020 - RNA, 22 nt, Human
ugaugcucccuccccugcccug

SEQ ID NO: 2458021 - RNA, 15 nt, Human
ugaugcucccucccc

SEQ ID NO: 2458022 - RNA, 16 nt, Human
ugaugcucccuccccu

SEQ ID NO: 2458023 - RNA, 14 nt, Human
ugaugcucccuccc

SEQ ID NO: 2458024 - RNA, 15 nt, Human
ugaugcucaggcuug

SEQ ID NO: 2458025 - RNA, 14 nt, Human
ugaugccaggacac

SEQ ID NO: 2458026 - RNA, 23 nt, Human
ugaugccacaccaagcugugcca

SEQ ID NO: 2458027 - RNA, 19 nt, Human
ugaugccagguucuauuug

SEQ ID NO: 2458028 - RNA, 14 nt, Human
ugaugcucaggcuu

SEQ ID NO: 2458029 - RNA, 21 nt, Human
ugauagcacagacccugcccu

SEQ ID NO: 2458030 - RNA, 20 nt, Human
ugauagcacagacccugccc

SEQ ID NO: 2458031 - RNA, 18 nt, Human
ugauagcacagacccugc

SEQ ID NO: 2458032 - RNA, 17 nt, Human
ugauagcacagacccug

SEQ ID NO: 2458033 - RNA, 16 nt, Human
ugauagcacagacccu

SEQ ID NO: 2458034 - RNA, 15 nt, Human
ugauagcacagaccc

SEQ ID NO: 2458035 - RNA, 21 nt, Human
ugauaaaguuucucagauccu

SEQ ID NO: 2458036 - RNA, 18 nt, Human
ugauaaaguuucucagau

SEQ ID NO: 2458037 - RNA, 22 nt, Human
ugauaaaguuucucagauccuu

SEQ ID NO: 2458038 - RNA, 19 nt, Human
ugauaaauuccacuggacu

SEQ ID NO: 2458039 - RNA, 23 nt, Human
ugauagcacagacccugcccugu

SEQ ID NO: 2458040 - RNA, 22 nt, Human
ugauagcacagacccugcccug

SEQ ID NO: 2458041 - RNA, 15 nt, Human
ugauagcacuuucua

SEQ ID NO: 2458042 - RNA, 21 nt, Human
ugauagcacuuucuacaaugu

SEQ ID NO: 2458043 - RNA, 13 nt, Human
ugauagcacuuuc

SEQ ID NO: 2458044 - RNA, 14 nt, Human
ugauagcacuuucu

SEQ ID NO: 2458045 - RNA, 12 nt, Human
ugauagcacuuu

SEQ ID NO: 2458046 - RNA, 22 nt, Human
ugauagcucuuuggcagucuau

SEQ ID NO: 2458047 - RNA, 21 nt, Human
ugauagcuaacauuuuaaaua

SEQ ID NO: 2458048 - RNA, 18 nt, Human
ugauagcuaacauuuuaa

SEQ ID NO: 2458049 - RNA, 16 nt, Human
ugauagcuaacauuuu

SEQ ID NO: 2458050 - RNA, 17 nt, Human
ugauagggauacaugcu

SEQ ID NO: 2458051 - RNA, 21 nt, Human
ugauaggaaugugaaagcacg

SEQ ID NO: 2458052 - RNA, 18 nt, Human
ugauagguauaaguggug

SEQ ID NO: 2458053 - RNA, 11 nt, Human
ugauagcuuua

SEQ ID NO: 2458054 - RNA, 13 nt, Human
ugauagcuuuauu

SEQ ID NO: 2458055 - RNA, 14 nt, Human
ugauagcuuuauuu

SEQ ID NO: 2458056 - RNA, 23 nt, Human
ugauagcuuuauuuuuuaaguau

SEQ ID NO: 2458057 - RNA, 17 nt, Human
ugauagucuuuugcuuu

SEQ ID NO: 2458058 - RNA, 16 nt, Human
ugauagucuuuugcuu

SEQ ID NO: 2458059 - RNA, 20 nt, Human
ugauagggauacaugcucuu

SEQ ID NO: 2458060 - RNA, 21 nt, Human
ugauaguuacuguugugaccu

SEQ ID NO: 2458061 - RNA, 17 nt, Human
ugauaguuacuguugug

SEQ ID NO: 2458062 - RNA, 16 nt, Human
ugauaguuacuguugu

SEQ ID NO: 2458063 - RNA, 14 nt, Human
ugauaguuacuguu

SEQ ID NO: 2458064 - RNA, 13 nt, Human
ugauaguuacugu

SEQ ID NO: 2458065 - RNA, 12 nt, Human
ugauaguuacug

SEQ ID NO: 2458066 - RNA, 14 nt, Human
ugaguuggcuggga

SEQ ID NO: 2458067 - RNA, 16 nt, Human
ugaguuggcugggaau

SEQ ID NO: 2458068 - RNA, 18 nt, Human
ugaguccuugaaaauauu

SEQ ID NO: 2458069 - RNA, 16 nt, Human
ugaguccuugaaaaua

SEQ ID NO: 2458070 - RNA, 18 nt, Human
ugagucgaggacagggag

SEQ ID NO: 2458071 - RNA, 16 nt, Human
ugaguugauucagcuc

SEQ ID NO: 2458072 - RNA, 19 nt, Human
ugaguugauucagcucugc

SEQ ID NO: 2458073 - RNA, 23 nt, Human
ugaguugauagcacagacccugc

SEQ ID NO: 2458074 - RNA, 21 nt, Human
ugaguugauagcacagacccu

SEQ ID NO: 2458075 - RNA, 16 nt, Human
ugagucgaggacaggg

SEQ ID NO: 2458076 - RNA, 15 nt, Human
ugagucgaggacagg

SEQ ID NO: 2458077 - RNA, 16 nt, Human
ugauaaaguuucucag

SEQ ID NO: 2458078 - RNA, 13 nt, Human
ugauaaaguuucu

SEQ ID NO: 2458079 - RNA, 19 nt, Human
ugauaaaguaguaaaaauu

SEQ ID NO: 2458080 - RNA, 14 nt, Human
ugauaaacuuugcu

SEQ ID NO: 2458081 - RNA, 14 nt, Human
ugauaaacauuuaa

SEQ ID NO: 2458082 - RNA, 19 nt, Human
ugaguuucauucuccugcc

SEQ ID NO: 2458083 - RNA, 18 nt, Human
ugaguuucauucuccugc

SEQ ID NO: 2458084 - RNA, 15 nt, Human
ugaguuucauagcua

SEQ ID NO: 2458085 - RNA, 14 nt, Human
ugaguuucauagcu

SEQ ID NO: 2458086 - RNA, 19 nt, Human
ugaguuuaguaaggcugug

SEQ ID NO: 2458087 - RNA, 17 nt, Human
ugaguuuauaucucuca

SEQ ID NO: 2458088 - RNA, 21 nt, Human
ugaguuuagugaucugaacag

SEQ ID NO: 2458089 - RNA, 16 nt, Human
ugauaaaaccauguag

SEQ ID NO: 2458090 - RNA, 22 nt, Human
ugaguuuccucaggcugcugga

SEQ ID NO: 2458091 - RNA, 16 nt, Human
ugaguuuccucaggcu

SEQ ID NO: 2458092 - RNA, 17 nt, Human
ugaguuuccucaggcug

SEQ ID NO: 2458093 - RNA, 19 nt, Human
ugaguuuccucaggcugcu

SEQ ID NO: 2458094 - RNA, 23 nt, Human
ugaguuuaccuuguauacuguag

SEQ ID NO: 2458095 - RNA, 16 nt, Human
ugaguuuaccuuguau

SEQ ID NO: 2458096 - RNA, 23 nt, Human
ugaguuguuuucagacucagacu

SEQ ID NO: 2458097 - RNA, 14 nt, Human
ugaguuuaaagcaa

SEQ ID NO: 2458098 - RNA, 17 nt, Human
ugaguuggcugggaaua

SEQ ID NO: 2458099 - RNA, 17 nt, Human
ugaguuggggucuggca

SEQ ID NO: 2458100 - RNA, 19 nt, Human
ugaguuggggucuggcagc

SEQ ID NO: 2458101 - RNA, 21 nt, Human
ugaguuggggucuggcagccu

SEQ ID NO: 2458102 - RNA, 18 nt, Human
ugaguuguugcccugggu

SEQ ID NO: 2458103 - RNA, 20 nt, Human
ugaguugguguugacaugug

SEQ ID NO: 2458104 - RNA, 16 nt, Human
ugaggacuauggaaau

SEQ ID NO: 2458105 - RNA, 16 nt, Human
ugaggagcagcuucag

SEQ ID NO: 2458106 - RNA, 20 nt, Human
ugaggacauuccaagacagu

SEQ ID NO: 2458107 - RNA, 21 nt, Human
ugaggacauguuuuuguuuuc

SEQ ID NO: 2458108 - RNA, 23 nt, Human
ugagcucuugugaggaaagucau

SEQ ID NO: 2458109 - RNA, 23 nt, Human
ugaggacuuaaaauauuccugca

SEQ ID NO: 2458110 - RNA, 15 nt, Human
ugaggagccaggccg

SEQ ID NO: 2458111 - RNA, 20 nt, Human
ugaggagcagcuucaguugu

SEQ ID NO: 2458112 - RNA, 14 nt, Human
ugaggagccccagc

SEQ ID NO: 2458113 - RNA, 11 nt, Human
ugaggagcccc

SEQ ID NO: 2458114 - RNA, 16 nt, Human
ugaggagccccagcua

SEQ ID NO: 2458115 - RNA, 11 nt, Human
ugaggagcugc

SEQ ID NO: 2458116 - RNA, 12 nt, Human
ugaggagcugcu

SEQ ID NO: 2458117 - RNA, 13 nt, Human
ugaggcugcagcg

SEQ ID NO: 2458118 - RNA, 11 nt, Human
ugaggcugggc

SEQ ID NO: 2458119 - RNA, 14 nt, Human
ugaggcuggcacag

SEQ ID NO: 2458120 - RNA, 15 nt, Human
ugaggcuggcacagg

SEQ ID NO: 2458121 - RNA, 17 nt, Human
ugaggcuggcacaggac

SEQ ID NO: 2458122 - RNA, 12 nt, Human
ugaggcugggaa

SEQ ID NO: 2458123 - RNA, 16 nt, Human
ugaggcugcuuuccaa

SEQ ID NO: 2458124 - RNA, 20 nt, Human
ugaggcugcuuuccaaagcc

SEQ ID NO: 2458125 - RNA, 23 nt, Human
ugaggcugcuuuccaaagccaau

SEQ ID NO: 2458126 - RNA, 11 nt, Human
ugaggcuggca

SEQ ID NO: 2458127 - RNA, 14 nt, Human
ugaggucuguucuu

SEQ ID NO: 2458128 - RNA, 15 nt, Human
ugaggucuguucuuu

SEQ ID NO: 2458129 - RNA, 20 nt, Human
ugaggucuguucuuuccaaa

SEQ ID NO: 2458130 - RNA, 16 nt, Human
ugagggaacagacagg

SEQ ID NO: 2458131 - RNA, 15 nt, Human
ugaggucuggcugcu

SEQ ID NO: 2458132 - RNA, 17 nt, Human
ugaggucuuuugacaug

SEQ ID NO: 2458133 - RNA, 19 nt, Human
ugaggucuuuugacaugug

SEQ ID NO: 2458134 - RNA, 23 nt, Human
ugaggcuuuggauuugacauugc

SEQ ID NO: 2458135 - RNA, 21 nt, Human
ugaggcuugcugagaggggcu

SEQ ID NO: 2458136 - RNA, 20 nt, Human
ugaggcuugcugagaggggc

SEQ ID NO: 2458137 - RNA, 18 nt, Human
ugaggcuuucagguuuua

SEQ ID NO: 2458138 - RNA, 13 nt, Human
ugaggcuuuggau

SEQ ID NO: 2458139 - RNA, 18 nt, Human
ugaggcuuuggauuugac

SEQ ID NO: 2458140 - RNA, 17 nt, Human
ugaggcuugcugagagg

SEQ ID NO: 2458141 - RNA, 16 nt, Human
ugaggcuugcugagag

SEQ ID NO: 2458142 - RNA, 15 nt, Human
ugaggcuugcugaga

SEQ ID NO: 2458143 - RNA, 14 nt, Human
ugaggcuugcugag

SEQ ID NO: 2458144 - RNA, 13 nt, Human
ugaggcuugcuga

SEQ ID NO: 2458145 - RNA, 16 nt, Human
ugaggcuuccagagag

SEQ ID NO: 2458146 - RNA, 15 nt, Human
ugaggcuuccagaga

SEQ ID NO: 2458147 - RNA, 23 nt, Human
ugaggcuuagcuuugcucugcca

SEQ ID NO: 2458148 - RNA, 11 nt, Human
ugaggcugugg

SEQ ID NO: 2458149 - RNA, 18 nt, Human
ugaggcuguccuguacau

SEQ ID NO: 2458150 - RNA, 21 nt, Human
ugaggcuguggucacagcgga

SEQ ID NO: 2458151 - RNA, 21 nt, Human
ugaguccccuguuuguuucug

SEQ ID NO: 2458152 - RNA, 19 nt, Human
ugagguuucaaaccucccu

SEQ ID NO: 2458153 - RNA, 15 nt, Human
ugagguugcuuacua

SEQ ID NO: 2458154 - RNA, 16 nt, Human
ugagguugcuagagaa

SEQ ID NO: 2458155 - RNA, 21 nt, Human
ugagguuccucugccugcccc

SEQ ID NO: 2458156 - RNA, 20 nt, Human
ugagguuccucugccugccc

SEQ ID NO: 2458157 - RNA, 19 nt, Human
ugagguuccucugccugcc

SEQ ID NO: 2458158 - RNA, 18 nt, Human
ugagguuccucugccugc

SEQ ID NO: 2458159 - RNA, 17 nt, Human
ugagguuccucugccug

SEQ ID NO: 2458160 - RNA, 16 nt, Human
ugagguuccucugccu

SEQ ID NO: 2458161 - RNA, 23 nt, Human
ugaggugugggggcugcagcaug

SEQ ID NO: 2458162 - RNA, 21 nt, Human
ugaggugugggggcugcagca

SEQ ID NO: 2458163 - RNA, 15 nt, Human
ugagguuccucugcc

SEQ ID NO: 2458164 - RNA, 14 nt, Human
ugagguuccucugc

SEQ ID NO: 2458165 - RNA, 12 nt, Human
ugagguuaggag

SEQ ID NO: 2458166 - RNA, 16 nt, Human
ugaggugcuauguucu

SEQ ID NO: 2458167 - RNA, 15 nt, Human
ugaggugcuauguuc

SEQ ID NO: 2458168 - RNA, 19 nt, Human
ugagguggaagagggcugc

SEQ ID NO: 2458169 - RNA, 20 nt, Human
ugaggucuuuugacaugugg

SEQ ID NO: 2458170 - RNA, 15 nt, Human
ugaggugcugggagg

SEQ ID NO: 2458171 - RNA, 16 nt, Human
ugaggugcugggaggg

SEQ ID NO: 2458172 - RNA, 17 nt, Human
ugaggugcugggaggga

SEQ ID NO: 2458173 - RNA, 15 nt, Human
ugagguggaagcccu

SEQ ID NO: 2458174 - RNA, 16 nt, Human
ugagguggaagcccuc

SEQ ID NO: 2458175 - RNA, 17 nt, Human
ugagguggaagcccucc

SEQ ID NO: 2458176 - RNA, 20 nt, Human
ugagguggaagcccuccuuc

SEQ ID NO: 2458177 - RNA, 18 nt, Human
ugaggugugggggcugca

SEQ ID NO: 2458178 - RNA, 14 nt, Human
ugagguggcacuuu

SEQ ID NO: 2458179 - RNA, 21 nt, Human
ugagguggaagcccuccuucc

SEQ ID NO: 2458180 - RNA, 22 nt, Human
ugagguggaagcccuccuucca

SEQ ID NO: 2458181 - RNA, 22 nt, Human
ugaguccuggcaugggaaugaa

SEQ ID NO: 2458182 - RNA, 19 nt, Human
ugaguccuggcaugggaau

SEQ ID NO: 2458183 - RNA, 15 nt, Human
ugaguccuugaaaau

SEQ ID NO: 2458184 - RNA, 18 nt, Human
ugaguccuuaaacagggc

SEQ ID NO: 2458185 - RNA, 14 nt, Human
ugaguccuuaaaca

SEQ ID NO: 2458186 - RNA, 14 nt, Human
ugagucgaggacag

SEQ ID NO: 2458187 - RNA, 18 nt, Human
ugaguccuggcaugggaa

SEQ ID NO: 2458188 - RNA, 11 nt, Human
ugaguccuggc

SEQ ID NO: 2458189 - RNA, 21 nt, Human
ugagguuuccuucagacagau

SEQ ID NO: 2458190 - RNA, 14 nt, Human
ugacugaauuucuu

SEQ ID NO: 2458191 - RNA, 15 nt, Human
ugacugaauuucuuu

SEQ ID NO: 2458192 - RNA, 15 nt, Human
ugacugagcuucccu

SEQ ID NO: 2458193 - RNA, 11 nt, Human
ugacugagcuu

SEQ ID NO: 2458194 - RNA, 20 nt, Human
ugacugaugcuuucagauua

SEQ ID NO: 2458195 - RNA, 19 nt, Human
ugacugagcagacugguga

SEQ ID NO: 2458196 - RNA, 15 nt, Human
ugacugagcagacug

SEQ ID NO: 2458197 - RNA, 23 nt, Human
ugacugguguuaucaccgugggc

SEQ ID NO: 2458198 - RNA, 17 nt, Human
ugacucuggcaaagcuu

SEQ ID NO: 2458199 - RNA, 19 nt, Human
ugacucugcccccugcugg

SEQ ID NO: 2458200 - RNA, 18 nt, Human
ugacucugcccccugcug

SEQ ID NO: 2458201 - RNA, 15 nt, Human
ugacucugcccccug

SEQ ID NO: 2458202 - RNA, 14 nt, Human
ugacucugcccccu

SEQ ID NO: 2458203 - RNA, 22 nt, Human
ugacucuggcaaagcuuuuaga

SEQ ID NO: 2458204 - RNA, 12 nt, Human
ugacucuuaaga

SEQ ID NO: 2458205 - RNA, 13 nt, Human
ugacugaauuucu

SEQ ID NO: 2458206 - RNA, 18 nt, Human
ugacggugcagucugggu

SEQ ID NO: 2458207 - RNA, 17 nt, Human
ugacgugaccggacuuu

SEQ ID NO: 2458208 - RNA, 19 nt, Human
ugacgucaagucuccuucc

SEQ ID NO: 2458209 - RNA, 13 nt, Human
ugacucugccccc

SEQ ID NO: 2458210 - RNA, 22 nt, Human
ugacucugaaaucugaagaccu

SEQ ID NO: 2458211 - RNA, 19 nt, Human
ugacgugccuuuugcaccc

SEQ ID NO: 2458212 - RNA, 18 nt, Human
ugacgugccuuuugcacc

SEQ ID NO: 2458213 - RNA, 16 nt, Human
ugacgugccuuuugca

SEQ ID NO: 2458214 - RNA, 23 nt, Human
ugacgugcaccuguacucaggag

SEQ ID NO: 2458215 - RNA, 24 nt, Human
ugacgugaccggacuuuucugcaa

SEQ ID NO: 2458216 - RNA, 22 nt, Human
ugacgugaccggacuuuucugc

SEQ ID NO: 2458217 - RNA, 18 nt, Human
ugacgugcaccuguacuc

SEQ ID NO: 2458218 - RNA, 19 nt, Human
ugacgugcaccuguacuca

SEQ ID NO: 2458219 - RNA, 20 nt, Human
ugacgccaucccagccccaa

SEQ ID NO: 2458220 - RNA, 19 nt, Human
ugacgccaucccagcccca

SEQ ID NO: 2458221 - RNA, 18 nt, Human
ugacgccaucccagcccc

SEQ ID NO: 2458222 - RNA, 17 nt, Human
ugacgccaucccagccc

SEQ ID NO: 2458223 - RNA, 19 nt, Human
ugacggccagggagaagcu

SEQ ID NO: 2458224 - RNA, 20 nt, Human
ugacggaagccaacuuggcu

SEQ ID NO: 2458225 - RNA, 18 nt, Human
ugacggaagaacauagaa

SEQ ID NO: 2458226 - RNA, 19 nt, Human
ugacggaugauuggauuau

SEQ ID NO: 2458227 - RNA, 17 nt, Human
ugacggugcagucuggg

SEQ ID NO: 2458228 - RNA, 23 nt, Human
ugacggucccacacuggugacug

SEQ ID NO: 2458229 - RNA, 21 nt, Human
ugacggucccacacuggugac

SEQ ID NO: 2458230 - RNA, 19 nt, Human
ugacggucccacacuggug

SEQ ID NO: 2458231 - RNA, 19 nt, Human
ugacgguauuaugcuucuu

SEQ ID NO: 2458232 - RNA, 18 nt, Human
ugacgguauuaugcuucu

SEQ ID NO: 2458233 - RNA, 14 nt, Human
ugacgcugaauaaa

SEQ ID NO: 2458234 - RNA, 19 nt, Human
ugacgccugcccuccccag

SEQ ID NO: 2458235 - RNA, 19 nt, Human
ugacgcaacccacguguaa

SEQ ID NO: 2458236 - RNA, 20 nt, Human
ugacgacaagugcugaacag

SEQ ID NO: 2458237 - RNA, 20 nt, Human
ugacgcugaauaaaugucuu

SEQ ID NO: 2458238 - RNA, 18 nt, Human
ugacgcugaauaaauguc

SEQ ID NO: 2458239 - RNA, 17 nt, Human
ugacgcugaauaaaugu

SEQ ID NO: 2458240 - RNA, 15 nt, Human
ugacgcugaauaaau

SEQ ID NO: 2458241 - RNA, 22 nt, Human
ugacgcugaauaaaugucuuuu

SEQ ID NO: 2458242 - RNA, 14 nt, Human
ugacggaagaacau

SEQ ID NO: 2458243 - RNA, 16 nt, Human
ugacgccaucccagcc

SEQ ID NO: 2458244 - RNA, 15 nt, Human
ugacgccaucccagc

SEQ ID NO: 2458245 - RNA, 14 nt, Human
ugacgccaucccag

SEQ ID NO: 2458246 - RNA, 13 nt, Human
ugacgccauccca

SEQ ID NO: 2458247 - RNA, 22 nt, Human
ugaccuuucaauaggaaaaacu

SEQ ID NO: 2458248 - RNA, 18 nt, Human
ugaccuuucaauaggaaa

SEQ ID NO: 2458249 - RNA, 17 nt, Human
ugaccuuuuauguagua

SEQ ID NO: 2458250 - RNA, 18 nt, Human
ugaccuuuuauguaguaa

SEQ ID NO: 2458251 - RNA, 23 nt, Human
ugaccuuuuauguaguaauugac

SEQ ID NO: 2458252 - RNA, 19 nt, Human
ugacgaacuuccauggccc

SEQ ID NO: 2458253 - RNA, 20 nt, Human
ugaccuuuugacuuaaagca

SEQ ID NO: 2458254 - RNA, 15 nt, Human
ugacgacaagugcug

SEQ ID NO: 2458255 - RNA, 14 nt, Human
ugacgaagucucuu

SEQ ID NO: 2458256 - RNA, 18 nt, Human
ugaccucugcagcaauaa

SEQ ID NO: 2458257 - RNA, 21 nt, Human
ugaccucugcagcaauaaagc

SEQ ID NO: 2458258 - RNA, 23 nt, Human
ugaccucugcagcaauaaagcag

SEQ ID NO: 2458259 - RNA, 12 nt, Human
ugaccucugccu

SEQ ID NO: 2458260 - RNA, 16 nt, Human
ugaccuuucaauagga

SEQ ID NO: 2458261 - RNA, 15 nt, Human
ugaccuuucaauagg

SEQ ID NO: 2458262 - RNA, 14 nt, Human
ugaccuuucaauag

SEQ ID NO: 2458263 - RNA, 13 nt, Human
ugaccucaugcau

SEQ ID NO: 2458264 - RNA, 22 nt, Human
ugaccucaggugauccacccac

SEQ ID NO: 2458265 - RNA, 16 nt, Human
ugaccucccagcccua

SEQ ID NO: 2458266 - RNA, 15 nt, Human
ugaccucccagcccu

SEQ ID NO: 2458267 - RNA, 14 nt, Human
ugaccucccagccc

SEQ ID NO: 2458268 - RNA, 12 nt, Human
ugaccucccagc

SEQ ID NO: 2458269 - RNA, 11 nt, Human
ugaccucccag

SEQ ID NO: 2458270 - RNA, 22 nt, Human
ugaccuccaugacugcacagua

SEQ ID NO: 2458271 - RNA, 22 nt, Human
ugaccucaugcaucuccaccug

SEQ ID NO: 2458272 - RNA, 19 nt, Human
ugaccucaugcaucuccac

SEQ ID NO: 2458273 - RNA, 16 nt, Human
ugaccucaugcaucuc

SEQ ID NO: 2458274 - RNA, 17 nt, Human
ugaccuccacagcuucc

SEQ ID NO: 2458275 - RNA, 14 nt, Human
ugaccuccacagcu

SEQ ID NO: 2458276 - RNA, 15 nt, Human
ugaccuccacagcuu

SEQ ID NO: 2458277 - RNA, 13 nt, Human
ugaccucugcagc

SEQ ID NO: 2458278 - RNA, 16 nt, Human
ugaccucugcagcaau

SEQ ID NO: 2458279 - RNA, 14 nt, Human
ugaccucccucuaa

SEQ ID NO: 2458280 - RNA, 13 nt, Human
ugaccucccucua

SEQ ID NO: 2458281 - RNA, 23 nt, Human
ugaccucccagcccuauggaugu

SEQ ID NO: 2458282 - RNA, 22 nt, Human
ugaccucccagcccuauggaug

SEQ ID NO: 2458283 - RNA, 18 nt, Human
ugaccucgugauccaccc

SEQ ID NO: 2458284 - RNA, 22 nt, Human
ugaccucccucuaauuuaucuu

SEQ ID NO: 2458285 - RNA, 16 nt, Human
ugaccuaucacuucca

SEQ ID NO: 2458286 - RNA, 18 nt, Human
ugaccuacucgagggacu

SEQ ID NO: 2458287 - RNA, 17 nt, Human
ugaccuaguuuuccaug

SEQ ID NO: 2458288 - RNA, 22 nt, Human
ugaccuaguuuuccaugcgugu

SEQ ID NO: 2458289 - RNA, 17 nt, Human
ugaccucaaccugugau

SEQ ID NO: 2458290 - RNA, 18 nt, Human
ugaccucaaccugugaug

SEQ ID NO: 2458291 - RNA, 21 nt, Human
ugaccucaagauguccuccuu

SEQ ID NO: 2458292 - RNA, 17 nt, Human
ugaccuacucgagggac

SEQ ID NO: 2458293 - RNA, 16 nt, Human
ugaccuacaaaucaau

SEQ ID NO: 2458294 - RNA, 13 nt, Human
ugaccuacucuca

SEQ ID NO: 2458295 - RNA, 20 nt, Human
ugacccugcgaaggggcccu

SEQ ID NO: 2458296 - RNA, 23 nt, Human
ugaccgugggcggggccuugcgg

SEQ ID NO: 2458297 - RNA, 20 nt, Human
ugaccgugggcggggccuug

SEQ ID NO: 2458298 - RNA, 15 nt, Human
ugacccugaagugag

SEQ ID NO: 2458299 - RNA, 16 nt, Human
ugacccugaucagucu

SEQ ID NO: 2458300 - RNA, 22 nt, Human
ugacccuccuguugcacccagc

SEQ ID NO: 2458301 - RNA, 21 nt, Human
ugacccuccuguugcacccag

SEQ ID NO: 2458302 - RNA, 16 nt, Human
ugacccuccuguugca

SEQ ID NO: 2458303 - RNA, 23 nt, Human
ugacccucugaaugguccagggu

SEQ ID NO: 2458304 - RNA, 22 nt, Human
ugacccucugaaugguccaggg

SEQ ID NO: 2458305 - RNA, 15 nt, Human
ugacccucuccaccc

SEQ ID NO: 2458306 - RNA, 18 nt, Human
ugacccucuccaccccau

SEQ ID NO: 2458307 - RNA, 14 nt, Human
ucuugaaugucuuu

SEQ ID NO: 2458308 - RNA, 13 nt, Human
ugacccuccuguu

SEQ ID NO: 2458309 - RNA, 22 nt, Human
ugaccauucuccaccugccagg

SEQ ID NO: 2458310 - RNA, 21 nt, Human
ugaccauucuccaccugccag

SEQ ID NO: 2458311 - RNA, 20 nt, Human
ugaccauucuccaccugcca

SEQ ID NO: 2458312 - RNA, 17 nt, Human
ucuugaauuguaaggaa

SEQ ID NO: 2458313 - RNA, 13 nt, Human
ucuugaaggugcu

SEQ ID NO: 2458314 - RNA, 15 nt, Human
ucuugaacuccuggc

SEQ ID NO: 2458315 - RNA, 16 nt, Human
ucuugaauaauguaag

SEQ ID NO: 2458316 - RNA, 16 nt, Human
ucuugaaugucuuuug

SEQ ID NO: 2458317 - RNA, 13 nt, Human
ucuugaaucccau

SEQ ID NO: 2458318 - RNA, 16 nt, Human
ugagaaagacuauuca

SEQ ID NO: 2458319 - RNA, 17 nt, Human
ugagaaagacuauucaa

SEQ ID NO: 2458320 - RNA, 22 nt, Human
ugacuguacuccucccaggcgc

SEQ ID NO: 2458321 - RNA, 18 nt, Human
ugacuguacuccucccag

SEQ ID NO: 2458322 - RNA, 17 nt, Human
ugacuguacuccuccca

SEQ ID NO: 2458323 - RNA, 16 nt, Human
ugacuguacuccuccc

SEQ ID NO: 2458324 - RNA, 17 nt, Human
ugagaaaucuaaaaaac

SEQ ID NO: 2458325 - RNA, 13 nt, Human
ugagaaaucuaaa

SEQ ID NO: 2458326 - RNA, 21 nt, Human
ugacuggguuucucuguauag

SEQ ID NO: 2458327 - RNA, 18 nt, Human
ugagaaagacuauucaaa

SEQ ID NO: 2458328 - RNA, 20 nt, Human
ugagaaagacuauucaaaca

SEQ ID NO: 2458329 - RNA, 14 nt, Human
ugacuguauauaaa

SEQ ID NO: 2458330 - RNA, 23 nt, Human
ugacuggguuucucuguauagua

SEQ ID NO: 2458331 - RNA, 12 nt, Human
ugagacccuguc

SEQ ID NO: 2458332 - RNA, 18 nt, Human
ugagaccccuggccuccg

SEQ ID NO: 2458333 - RNA, 16 nt, Human
ugagaccccuggccuc

SEQ ID NO: 2458334 - RNA, 22 nt, Human
ugagaccccuggccuccggcgu

SEQ ID NO: 2458335 - RNA, 14 nt, Human
ugagacccugucuc

SEQ ID NO: 2458336 - RNA, 15 nt, Human
ugagacccugucucu

SEQ ID NO: 2458337 - RNA, 18 nt, Human
ugagacaguccagccugg

SEQ ID NO: 2458338 - RNA, 16 nt, Human
ugagacaguccagccu

SEQ ID NO: 2458339 - RNA, 15 nt, Human
ugagacaggagaauc

SEQ ID NO: 2458340 - RNA, 15 nt, Human
ugagaccccuggccu

SEQ ID NO: 2458341 - RNA, 14 nt, Human
ugagaccccuggcc

SEQ ID NO: 2458342 - RNA, 13 nt, Human
ugagaccccuggc

SEQ ID NO: 2458343 - RNA, 17 nt, Human
ugagacccccacaccuc

SEQ ID NO: 2458344 - RNA, 19 nt, Human
ugagacaguccagccugga

SEQ ID NO: 2458345 - RNA, 22 nt, Human
ugagacccccacaccucaguuc

SEQ ID NO: 2458346 - RNA, 14 nt, Human
ugagacagcucugc

SEQ ID NO: 2458347 - RNA, 16 nt, Human
ugagacagcucugcau

SEQ ID NO: 2458348 - RNA, 13 nt, Human
ugagaaaugcaua

SEQ ID NO: 2458349 - RNA, 13 nt, Human
ugagaaauuaagu

SEQ ID NO: 2458350 - RNA, 15 nt, Human
ugagaaaugaauaau

SEQ ID NO: 2458351 - RNA, 20 nt, Human
ugagaaaugaauaauuuccc

SEQ ID NO: 2458352 - RNA, 11 nt, Human
ugagaaaugca

SEQ ID NO: 2458353 - RNA, 22 nt, Human
ugagaaaugaauaauuucccaa

SEQ ID NO: 2458354 - RNA, 14 nt, Human
ugagaaauuaagua

SEQ ID NO: 2458355 - RNA, 12 nt, Human
ugagaaaugcau

SEQ ID NO: 2458356 - RNA, 14 nt, Human
ugagacucugucuc

SEQ ID NO: 2458357 - RNA, 13 nt, Human
ugagacucugucu

SEQ ID NO: 2458358 - RNA, 12 nt, Human
ugagaccucagc

SEQ ID NO: 2458359 - RNA, 13 nt, Human
ugagaccucagcc

SEQ ID NO: 2458360 - RNA, 12 nt, Human
ugagacucuguc

SEQ ID NO: 2458361 - RNA, 22 nt, Human
ugagaggcauccaguaucuuga

SEQ ID NO: 2458362 - RNA, 14 nt, Human
ugagaccucagcca

SEQ ID NO: 2458363 - RNA, 23 nt, Human
ugagacucucuuaggagcagagc

SEQ ID NO: 2458364 - RNA, 19 nt, Human
ugagacucucuuaggagca

SEQ ID NO: 2458365 - RNA, 18 nt, Human
ugagaggcagacuucccu

SEQ ID NO: 2458366 - RNA, 23 nt, Human
ugagaggcauccaguaucuugaa

SEQ ID NO: 2458367 - RNA, 14 nt, Human
ugagaggcaggcau

SEQ ID NO: 2458368 - RNA, 13 nt, Human
ugagaggcaggca

SEQ ID NO: 2458369 - RNA, 12 nt, Human
ugagaggcaggc

SEQ ID NO: 2458370 - RNA, 16 nt, Human
ugagaggcaggcauag

SEQ ID NO: 2458371 - RNA, 18 nt, Human
ugagaggggcuguccagu

SEQ ID NO: 2458372 - RNA, 14 nt, Human
ugagagguuugacu

SEQ ID NO: 2458373 - RNA, 17 nt, Human
ugagaguagagucacug

SEQ ID NO: 2458374 - RNA, 19 nt, Human
ugagaggggaacagacugg

SEQ ID NO: 2458375 - RNA, 14 nt, Human
ugagaucaggcucu

SEQ ID NO: 2458376 - RNA, 20 nt, Human
ugagaugauacauccaaagc

SEQ ID NO: 2458377 - RNA, 23 nt, Human
ugagaucuaagccuuuccauaag

SEQ ID NO: 2458378 - RNA, 16 nt, Human
ugagaucuaagccuuu

SEQ ID NO: 2458379 - RNA, 20 nt, Human
ugagaucuaagccuuuccau

SEQ ID NO: 2458380 - RNA, 21 nt, Human
ugagaucuaagccuuuccaua

SEQ ID NO: 2458381 - RNA, 22 nt, Human
ugagaucuaagccuuuccauaa

SEQ ID NO: 2458382 - RNA, 19 nt, Human
ugagaguauauuauguauu

SEQ ID NO: 2458383 - RNA, 18 nt, Human
ugagaguaacuuaaguua

SEQ ID NO: 2458384 - RNA, 22 nt, Human
ugagagguuugacuagaugaug

SEQ ID NO: 2458385 - RNA, 19 nt, Human
ugagaguaucaggucuccc

SEQ ID NO: 2458386 - RNA, 17 nt, Human
ugagaguaucaggucuc

SEQ ID NO: 2458387 - RNA, 13 nt, Human
ugagaucaggcuc

SEQ ID NO: 2458388 - RNA, 23 nt, Human
ugagaguauuuaggcagauugaa

SEQ ID NO: 2458389 - RNA, 18 nt, Human
ugagauccuuccuuuuga

SEQ ID NO: 2458390 - RNA, 15 nt, Human
ugagcagucaggaaa

SEQ ID NO: 2458391 - RNA, 17 nt, Human
ugagcagucaggaaaga

SEQ ID NO: 2458392 - RNA, 20 nt, Human
ugagcagucaggaaagagaa

SEQ ID NO: 2458393 - RNA, 13 nt, Human
ugagcaucaggcc

SEQ ID NO: 2458394 - RNA, 18 nt, Human
ugagaugcagcuggaaaa

SEQ ID NO: 2458395 - RNA, 16 nt, Human
ugagaugcagcuggaa

SEQ ID NO: 2458396 - RNA, 15 nt, Human
ugagaugcagcugga

SEQ ID NO: 2458397 - RNA, 14 nt, Human
ugagaugcagcugg

SEQ ID NO: 2458398 - RNA, 19 nt, Human
ugagaugauucagaagggg

SEQ ID NO: 2458399 - RNA, 18 nt, Human
ugagaugauucagaaggg

SEQ ID NO: 2458400 - RNA, 14 nt, Human
ugagaugcuagaac

SEQ ID NO: 2458401 - RNA, 16 nt, Human
ugagaugcuagaacuc

SEQ ID NO: 2458402 - RNA, 20 nt, Human
ugagaugcuagaacucccuu

SEQ ID NO: 2458403 - RNA, 23 nt, Human
ugagcccacugcccacccccuca

SEQ ID NO: 2458404 - RNA, 22 nt, Human
ugagcccacugcccacccccuc

SEQ ID NO: 2458405 - RNA, 21 nt, Human
ugagcccacugcccacccccu

SEQ ID NO: 2458406 - RNA, 20 nt, Human
ugagcccacugcccaccccc

SEQ ID NO: 2458407 - RNA, 19 nt, Human
ugagcccacugcccacccc

SEQ ID NO: 2458408 - RNA, 17 nt, Human
ugagcccacaaagccuu

SEQ ID NO: 2458409 - RNA, 17 nt, Human
ugagcaucacaguuuug

SEQ ID NO: 2458410 - RNA, 16 nt, Human
ugagcaucacaguuuu

SEQ ID NO: 2458411 - RNA, 16 nt, Human
ugagcccacaaagccu

SEQ ID NO: 2458412 - RNA, 15 nt, Human
ugagcaucaggccag

SEQ ID NO: 2458413 - RNA, 14 nt, Human
ugagcaucaggcca

SEQ ID NO: 2458414 - RNA, 13 nt, Human
ugagccccaaaag

SEQ ID NO: 2458415 - RNA, 15 nt, Human
ugagccccuggaggc

SEQ ID NO: 2458416 - RNA, 17 nt, Human
ugagcccauggcccucc

SEQ ID NO: 2458417 - RNA, 17 nt, Human
ugagcccagcuggguca

SEQ ID NO: 2458418 - RNA, 21 nt, Human
ugagcccagcugggucaggca

SEQ ID NO: 2458419 - RNA, 12 nt, Human
ugagcccaggag

SEQ ID NO: 2458420 - RNA, 13 nt, Human
ugagcccaggagu

SEQ ID NO: 2458421 - RNA, 19 nt, Human
ugagccgggccccugggcu

SEQ ID NO: 2458422 - RNA, 20 nt, Human
ugagccgggccccugggcuu

SEQ ID NO: 2458423 - RNA, 17 nt, Human
ugagccgggccccuggg

SEQ ID NO: 2458424 - RNA, 16 nt, Human
ugagccgggccccugg

SEQ ID NO: 2458425 - RNA, 15 nt, Human
ugagccgggccccug

SEQ ID NO: 2458426 - RNA, 21 nt, Human
ugagccgcugugagccccugg

SEQ ID NO: 2458427 - RNA, 16 nt, Human
ugagccuacgcugaag

SEQ ID NO: 2458428 - RNA, 15 nt, Human
ugagccucagcaucc

SEQ ID NO: 2458429 - RNA, 13 nt, Human
ugagccucagcau

SEQ ID NO: 2458430 - RNA, 21 nt, Human
ugagcccgggcugccugggcu

SEQ ID NO: 2458431 - RNA, 22 nt, Human
ugagcccgggcugccugggcug

SEQ ID NO: 2458432 - RNA, 20 nt, Human
ugagcccgggcugccugggc

SEQ ID NO: 2458433 - RNA, 19 nt, Human
ugagcccgggcugccuggg

SEQ ID NO: 2458434 - RNA, 18 nt, Human
ugagcccgggcugccugg

SEQ ID NO: 2458435 - RNA, 17 nt, Human
ugagcccgggcugccug

SEQ ID NO: 2458436 - RNA, 16 nt, Human
ugagcccucaaaguga

SEQ ID NO: 2458437 - RNA, 12 nt, Human
ugagcccucaga

SEQ ID NO: 2458438 - RNA, 14 nt, Human
ugagcccucagaac

SEQ ID NO: 2458439 - RNA, 17 nt, Human
ugagcccucagaacccu

SEQ ID NO: 2458440 - RNA, 17 nt, Human
ugagccccugucuagag

SEQ ID NO: 2458441 - RNA, 21 nt, Human
ugagccccugucuagagaggg

SEQ ID NO: 2458442 - RNA, 12 nt, Human
ugagccccuucc

SEQ ID NO: 2458443 - RNA, 22 nt, Human
ugagccccugucuagagaggga

SEQ ID NO: 2458444 - RNA, 13 nt, Human
ugagccccuggga

SEQ ID NO: 2458445 - RNA, 14 nt, Human
ugagccccugggac

SEQ ID NO: 2458446 - RNA, 15 nt, Human
ugagccccugguccu

SEQ ID NO: 2458447 - RNA, 15 nt, Human
ugagccccugggacu

SEQ ID NO: 2458448 - RNA, 16 nt, Human
ugagcccgggcugccu

SEQ ID NO: 2458449 - RNA, 15 nt, Human
ugagcccgggcugcc

SEQ ID NO: 2458450 - RNA, 14 nt, Human
ugagcccgggcugc

SEQ ID NO: 2458451 - RNA, 13 nt, Human
ugagcccgggcug

SEQ ID NO: 2458452 - RNA, 14 nt, Human
ugagccccuuccuu

SEQ ID NO: 2458453 - RNA, 13 nt, Human
ugagccccuuccu

SEQ ID NO: 2458454 - RNA, 17 nt, Human
ugagcccggaugcuucu

SEQ ID NO: 2458455 - RNA, 21 nt, Human
ugagcucugcagcccagggac

SEQ ID NO: 2458456 - RNA, 18 nt, Human
ugagcucugcagcccagg

SEQ ID NO: 2458457 - RNA, 12 nt, Human
ugagcucucugu

SEQ ID NO: 2458458 - RNA, 23 nt, Human
ugagcucugcauuugucuauucu

SEQ ID NO: 2458459 - RNA, 22 nt, Human
ugagcucugcauuugucuauuc

SEQ ID NO: 2458460 - RNA, 12 nt, Human
ugagcucuucau

SEQ ID NO: 2458461 - RNA, 15 nt, Human
ugagcucuucauguu

SEQ ID NO: 2458462 - RNA, 16 nt, Human
ugagcucuucauguuu

SEQ ID NO: 2458463 - RNA, 18 nt, Human
ugagcucuucauguuuca

SEQ ID NO: 2458464 - RNA, 13 nt, Human
ugagcucuuguga

SEQ ID NO: 2458465 - RNA, 22 nt, Human
ugagcucuugugaggaaaguca

SEQ ID NO: 2458466 - RNA, 18 nt, Human
ugagcucuugugaggaaa

SEQ ID NO: 2458467 - RNA, 20 nt, Human
ugagcucucggaacugcaug

SEQ ID NO: 2458468 - RNA, 21 nt, Human
ugagcucucggaacugcaugc

SEQ ID NO: 2458469 - RNA, 16 nt, Human
ugagcuccucugggca

SEQ ID NO: 2458470 - RNA, 18 nt, Human
ugagcuccucugggcagg

SEQ ID NO: 2458471 - RNA, 23 nt, Human
ugagcuccccaccaccccagcug

SEQ ID NO: 2458472 - RNA, 13 nt, Human
ugagcuccucugg

SEQ ID NO: 2458473 - RNA, 14 nt, Human
ugagcuccucuggg

SEQ ID NO: 2458474 - RNA, 15 nt, Human
ugagcuccucugggc

SEQ ID NO: 2458475 - RNA, 21 nt, Human
ugagcuccccaaaaaccucac

SEQ ID NO: 2458476 - RNA, 15 nt, Human
ugagcuccccaccac

SEQ ID NO: 2458477 - RNA, 20 nt, Human
ugagcuccccaccaccccag

SEQ ID NO: 2458478 - RNA, 22 nt, Human
ugagcuccccaccaccccagcu

SEQ ID NO: 2458479 - RNA, 15 nt, Human
ugagcuccccaaaaa

SEQ ID NO: 2458480 - RNA, 16 nt, Human
ugagcuccccaaaaac

SEQ ID NO: 2458481 - RNA, 16 nt, Human
ugagcuccaugugccc

SEQ ID NO: 2458482 - RNA, 21 nt, Human
ugagcuccagacccccagcaa

SEQ ID NO: 2458483 - RNA, 18 nt, Human
ugagcuccagacccccag

SEQ ID NO: 2458484 - RNA, 19 nt, Human
ugagcuccagacccccagc

SEQ ID NO: 2458485 - RNA, 20 nt, Human
ugagcuccagacccccagca

SEQ ID NO: 2458486 - RNA, 16 nt, Human
ugcacaaacagaggcc

SEQ ID NO: 2458487 - RNA, 15 nt, Human
ugcacaaacagaggc

SEQ ID NO: 2458488 - RNA, 20 nt, Human
ugcaauuucauaugcuguau

SEQ ID NO: 2458489 - RNA, 14 nt, Human
ugcaauuucauaug

SEQ ID NO: 2458490 - RNA, 19 nt, Human
ugcaauuuguuugugcuuc

SEQ ID NO: 2458491 - RNA, 17 nt, Human
ugcaauuuguuugugcu

SEQ ID NO: 2458492 - RNA, 19 nt, Human
ugcaauuugggagauauau

SEQ ID NO: 2458493 - RNA, 21 nt, Human
ugcaauuuguuugugcuucua

SEQ ID NO: 2458494 - RNA, 20 nt, Human
ugcaauuuguuugugcuucu

SEQ ID NO: 2458495 - RNA, 20 nt, Human
ugcaauuuuaauugauuauu

SEQ ID NO: 2458496 - RNA, 18 nt, Human
ugcaauuccccucugcug

SEQ ID NO: 2458497 - RNA, 14 nt, Human
ugcaauuccccucu

SEQ ID NO: 2458498 - RNA, 13 nt, Human
ugcaauuccccuc

SEQ ID NO: 2458499 - RNA, 16 nt, Human
ugcaauuaaagugaua

SEQ ID NO: 2458500 - RNA, 15 nt, Human
ugcaauuaaagugau

SEQ ID NO: 2458501 - RNA, 22 nt, Human
ugcaauuuauuaaaaugauugu

SEQ ID NO: 2458502 - RNA, 18 nt, Human
ugcaauuuauuaaaauga

SEQ ID NO: 2458503 - RNA, 15 nt, Human
ugcaauugcuuagga

SEQ ID NO: 2458504 - RNA, 21 nt, Human
ugcaauuguaggggugugugu

SEQ ID NO: 2458505 - RNA, 15 nt, Human
ugcaauuuauuaaaa

SEQ ID NO: 2458506 - RNA, 14 nt, Human
ugcaauuuauuaaa

SEQ ID NO: 2458507 - RNA, 22 nt, Human
ugcaauuguaggggugugugug

SEQ ID NO: 2458508 - RNA, 19 nt, Human
ugcacaaacagaggccgcc

SEQ ID NO: 2458509 - RNA, 17 nt, Human
ugcacaaacagaggccg

SEQ ID NO: 2458510 - RNA, 15 nt, Human
ugcacaaacucacca

SEQ ID NO: 2458511 - RNA, 21 nt, Human
ugcacaaaauucgaccugauu

SEQ ID NO: 2458512 - RNA, 19 nt, Human
ugcacaaaacccagaccug

SEQ ID NO: 2458513 - RNA, 18 nt, Human
ugcacaaaacccagaccu

SEQ ID NO: 2458514 - RNA, 20 nt, Human
ugcacaaacagaggccgcca

SEQ ID NO: 2458515 - RNA, 18 nt, Human
ugcacagaguuguuacau

SEQ ID NO: 2458516 - RNA, 19 nt, Human
ugcacagaguuguuacauu

SEQ ID NO: 2458517 - RNA, 17 nt, Human
ugcacagaguuguuaca

SEQ ID NO: 2458518 - RNA, 17 nt, Human
ugcacaaagcccuucca

SEQ ID NO: 2458519 - RNA, 15 nt, Human
ugcacaaagcccuuc

SEQ ID NO: 2458520 - RNA, 23 nt, Human
ugcaaugaccuuucaauaggaaa

SEQ ID NO: 2458521 - RNA, 22 nt, Human
ugcaaugaccuuucaauaggaa

SEQ ID NO: 2458522 - RNA, 19 nt, Human
ugcaaugaccuuucaauag

SEQ ID NO: 2458523 - RNA, 17 nt, Human
ugcaaugaccuuucaau

SEQ ID NO: 2458524 - RNA, 16 nt, Human
ugcaaugaccuuucaa

SEQ ID NO: 2458525 - RNA, 13 nt, Human
ugcaaugaccuuu

SEQ ID NO: 2458526 - RNA, 18 nt, Human
ugcaagagacucuggccu

SEQ ID NO: 2458527 - RNA, 11 nt, Human
ugcaaugaaca

SEQ ID NO: 2458528 - RNA, 15 nt, Human
ugcaaugaagucucu

SEQ ID NO: 2458529 - RNA, 17 nt, Human
ugcaagagacucuggcc

SEQ ID NO: 2458530 - RNA, 20 nt, Human
ugcaagaaaaugauguguac

SEQ ID NO: 2458531 - RNA, 18 nt, Human
ugcaaugaagucucugaa

SEQ ID NO: 2458532 - RNA, 22 nt, Human
ugcaaugaagucucugaaguga

SEQ ID NO: 2458533 - RNA, 21 nt, Human
ugcaaugacacagucuuggcu

SEQ ID NO: 2458534 - RNA, 16 nt, Human
ugcaauggcagccuug

SEQ ID NO: 2458535 - RNA, 15 nt, Human
ugcaauggcagccuu

SEQ ID NO: 2458536 - RNA, 14 nt, Human
ugcaauggcagccu

SEQ ID NO: 2458537 - RNA, 13 nt, Human
ugcaauggcagcc

SEQ ID NO: 2458538 - RNA, 15 nt, Human
ugcaauguuuuccuu

SEQ ID NO: 2458539 - RNA, 22 nt, Human
ugcaaugucugagugaaccugu

SEQ ID NO: 2458540 - RNA, 19 nt, Human
ugcaaugucugagugaacc

SEQ ID NO: 2458541 - RNA, 16 nt, Human
ugcaaugugcuacuga

SEQ ID NO: 2458542 - RNA, 22 nt, Human
ugcaauguagaggggaaaagag

SEQ ID NO: 2458543 - RNA, 17 nt, Human
ugcaaugguuaacaucu

SEQ ID NO: 2458544 - RNA, 15 nt, Human
ugcaaugggcacugg

SEQ ID NO: 2458545 - RNA, 20 nt, Human
ugcaauggcgugaucucggc

SEQ ID NO: 2458546 - RNA, 18 nt, Human
ugcaauggcuauauggca

SEQ ID NO: 2458547 - RNA, 16 nt, Human
ugcaaugacaucuuca

SEQ ID NO: 2458548 - RNA, 17 nt, Human
ugcaaugacaucuucaa

SEQ ID NO: 2458549 - RNA, 16 nt, Human
ugcaaugacucaggac

SEQ ID NO: 2458550 - RNA, 17 nt, Human
ugcagaggucugugcug

SEQ ID NO: 2458551 - RNA, 16 nt, Human
ugcagaggucugugcu

SEQ ID NO: 2458552 - RNA, 15 nt, Human
ugcagaggucugugc

SEQ ID NO: 2458553 - RNA, 14 nt, Human
ugcagaggucugug

SEQ ID NO: 2458554 - RNA, 19 nt, Human
ugcagagguccacaacaca

SEQ ID NO: 2458555 - RNA, 21 nt, Human
ugcagaggggcuuucuggaga

SEQ ID NO: 2458556 - RNA, 22 nt, Human
ugcagaggggcuuucuggagag

SEQ ID NO: 2458557 - RNA, 20 nt, Human
ugcagagguaaaagugugag

SEQ ID NO: 2458558 - RNA, 19 nt, Human
ugcagaggguacuuuaaga

SEQ ID NO: 2458559 - RNA, 15 nt, Human
ugcagaggggcaggc

SEQ ID NO: 2458560 - RNA, 14 nt, Human
ugcacuucuuacaa

SEQ ID NO: 2458561 - RNA, 20 nt, Human
ugcagaggggcaggcccugc

SEQ ID NO: 2458562 - RNA, 18 nt, Human
ugcagaggggcaggcccu

SEQ ID NO: 2458563 - RNA, 17 nt, Human
ugcagaggggcaggccc

SEQ ID NO: 2458564 - RNA, 22 nt, Human
ugcagaggggcaggcccugcac

SEQ ID NO: 2458565 - RNA, 21 nt, Human
ugcagaggggcaggcccugca

SEQ ID NO: 2458566 - RNA, 20 nt, Human
ugcagaggggcuuucuggag

SEQ ID NO: 2458567 - RNA, 20 nt, Human
ugcacuguucccccugugca

SEQ ID NO: 2458568 - RNA, 21 nt, Human
ugcacuguucccccugugcag

SEQ ID NO: 2458569 - RNA, 23 nt, Human
ugcacuguucccccugugcagcc

SEQ ID NO: 2458570 - RNA, 14 nt, Human
ugcacuguuccccc

SEQ ID NO: 2458571 - RNA, 19 nt, Human
ugcacuguucccccugugc

SEQ ID NO: 2458572 - RNA, 13 nt, Human
ugcacuguucccc

SEQ ID NO: 2458573 - RNA, 18 nt, Human
ugcacugugaaggacccu

SEQ ID NO: 2458574 - RNA, 18 nt, Human
ugcacuuacuugcuuauu

SEQ ID NO: 2458575 - RNA, 16 nt, Human
ugcacuuacuugcuua

SEQ ID NO: 2458576 - RNA, 18 nt, Human
ugcacuuaugauuucaug

SEQ ID NO: 2458577 - RNA, 19 nt, Human
ugcacuuaugauuucaugu

SEQ ID NO: 2458578 - RNA, 20 nt, Human
ugcacuuaugauuucaugug

SEQ ID NO: 2458579 - RNA, 21 nt, Human
ugcacuuaaggcacucuguua

SEQ ID NO: 2458580 - RNA, 15 nt, Human
ugcacuuacuugcuu

SEQ ID NO: 2458581 - RNA, 16 nt, Human
ugcacuuaaggcacuc

SEQ ID NO: 2458582 - RNA, 23 nt, Human
ugcacuuaacaagcucccaggcc

SEQ ID NO: 2458583 - RNA, 18 nt, Human
ugcacuuaacaagcuccc

SEQ ID NO: 2458584 - RNA, 17 nt, Human
ugcacuguccugcucca

SEQ ID NO: 2458585 - RNA, 16 nt, Human
ugcacuguccugcucc

SEQ ID NO: 2458586 - RNA, 15 nt, Human
ugcacuguccugcuc

SEQ ID NO: 2458587 - RNA, 14 nt, Human
ugcacuguccugcu

SEQ ID NO: 2458588 - RNA, 13 nt, Human
ugcacuguccugc

SEQ ID NO: 2458589 - RNA, 12 nt, Human
ugcacuguccug

SEQ ID NO: 2458590 - RNA, 23 nt, Human
ugcacugucacuuugcucugggu

SEQ ID NO: 2458591 - RNA, 22 nt, Human
ugcacugucacuuugcucuggg

SEQ ID NO: 2458592 - RNA, 22 nt, Human
ugcacuguccugcuccacagug

SEQ ID NO: 2458593 - RNA, 21 nt, Human
ugcacuguccugcuccacagu

SEQ ID NO: 2458594 - RNA, 20 nt, Human
ugcacuguccugcuccacag

SEQ ID NO: 2458595 - RNA, 18 nt, Human
ugcacuguccugcuccac

SEQ ID NO: 2458596 - RNA, 19 nt, Human
ugcacugucgauaaucaga

SEQ ID NO: 2458597 - RNA, 23 nt, Human
ugcacuguccugcuccacagugu

SEQ ID NO: 2458598 - RNA, 15 nt, Human
ugcacugugaaggac

SEQ ID NO: 2458599 - RNA, 16 nt, Human
ugcacugucaagauga

SEQ ID NO: 2458600 - RNA, 21 nt, Human
ugcacugucacuuugcucugg

SEQ ID NO: 2458601 - RNA, 19 nt, Human
ugcacugucacuuugcucu

SEQ ID NO: 2458602 - RNA, 15 nt, Human
ugcacugucacuuug

SEQ ID NO: 2458603 - RNA, 21 nt, Human
ugcacugacauuguuggccaa

SEQ ID NO: 2458604 - RNA, 18 nt, Human
ugcacugacauuguuggc

SEQ ID NO: 2458605 - RNA, 13 nt, Human
ugcacucugugcc

SEQ ID NO: 2458606 - RNA, 12 nt, Human
ugcacucugugc

SEQ ID NO: 2458607 - RNA, 16 nt, Human
ugcacucugugcccau

SEQ ID NO: 2458608 - RNA, 15 nt, Human
ugcacucugugccca

SEQ ID NO: 2458609 - RNA, 21 nt, Human
ugcacucugugcccaugggca

SEQ ID NO: 2458610 - RNA, 21 nt, Human
ugcaccggcuggccuggcccc

SEQ ID NO: 2458611 - RNA, 17 nt, Human
ugcaccuggaauauaua

SEQ ID NO: 2458612 - RNA, 20 nt, Human
ugcaccuggaauauauaacc

SEQ ID NO: 2458613 - RNA, 22 nt, Human
ugcaccuggaauauauaaccag

SEQ ID NO: 2458614 - RNA, 19 nt, Human
ugcacagugauuuuuuucu

SEQ ID NO: 2458615 - RNA, 16 nt, Human
ugcaccuguacucagg

SEQ ID NO: 2458616 - RNA, 17 nt, Human
ugcaccuguacucagga

SEQ ID NO: 2458617 - RNA, 19 nt, Human
ugcaccuuaccaacuuucu

SEQ ID NO: 2458618 - RNA, 18 nt, Human
ugcaccuuaccaacuuuc

SEQ ID NO: 2458619 - RNA, 13 nt, Human
ugcaccuuaccaa

SEQ ID NO: 2458620 - RNA, 12 nt, Human
ugcaccugugca

SEQ ID NO: 2458621 - RNA, 20 nt, Human
ugcaccuguacucaggaggc

SEQ ID NO: 2458622 - RNA, 16 nt, Human
ugcaccuugugucugu

SEQ ID NO: 2458623 - RNA, 15 nt, Human
ugcaccuugugucug

SEQ ID NO: 2458624 - RNA, 21 nt, Human
ugcaccuuaccaacuuucugu

SEQ ID NO: 2458625 - RNA, 20 nt, Human
ugcaccuuaccaacuuucug

SEQ ID NO: 2458626 - RNA, 14 nt, Human
ugcaccuugugucu

SEQ ID NO: 2458627 - RNA, 15 nt, Human
ugcacgaccuuggga

SEQ ID NO: 2458628 - RNA, 20 nt, Human
ugcaccggcuggccuggccc

SEQ ID NO: 2458629 - RNA, 19 nt, Human
ugcaccggcuggccuggcc

SEQ ID NO: 2458630 - RNA, 18 nt, Human
ugcaccggcuggccuggc

SEQ ID NO: 2458631 - RNA, 17 nt, Human
ugcacagugcaucucag

SEQ ID NO: 2458632 - RNA, 16 nt, Human
ugcacagugcaucuca

SEQ ID NO: 2458633 - RNA, 13 nt, Human
ugcacagugauuu

SEQ ID NO: 2458634 - RNA, 15 nt, Human
ugcacagugcaucuc

SEQ ID NO: 2458635 - RNA, 19 nt, Human
ugcacagggcagcugggcc

SEQ ID NO: 2458636 - RNA, 21 nt, Human
ugcacagagcucuccagcucc

SEQ ID NO: 2458637 - RNA, 21 nt, Human
ugcacaaauauuuauuuucuu

SEQ ID NO: 2458638 - RNA, 20 nt, Human
ugcacagggcagcugggccc

SEQ ID NO: 2458639 - RNA, 20 nt, Human
ugcacagaguuguuacauuu

SEQ ID NO: 2458640 - RNA, 23 nt, Human
ugauuuuuuuuuccuucagugcc

SEQ ID NO: 2458641 - RNA, 22 nt, Human
ugauuuuuuuuuccuucagugc

SEQ ID NO: 2458642 - RNA, 18 nt, Human
ugauuuuuuuuucauaca

SEQ ID NO: 2458643 - RNA, 22 nt, Human
ugauuuuuuuuucauacacuua

SEQ ID NO: 2458644 - RNA, 16 nt, Human
ugauuuuuuuuuuuca

SEQ ID NO: 2458645 - RNA, 14 nt, Human
ugcaaaaaggguca

SEQ ID NO: 2458646 - RNA, 18 nt, Human
ugcaaaaauauuuauaaa

SEQ ID NO: 2458647 - RNA, 12 nt, Human
ugcaaaaaauag

SEQ ID NO: 2458648 - RNA, 22 nt, Human
ugcaaaaauauuuauaaaacuu

SEQ ID NO: 2458649 - RNA, 23 nt, Human
ugcaaaaauauuuauaaaacuuc

SEQ ID NO: 2458650 - RNA, 19 nt, Human
ugcaaaacagcguuuaaga

SEQ ID NO: 2458651 - RNA, 23 nt, Human
ugcaaaagacuaauuuaaaaaau

SEQ ID NO: 2458652 - RNA, 19 nt, Human
ugcaaaaggacucucagga

SEQ ID NO: 2458653 - RNA, 23 nt, Human
ugcaaaacagcguuuaagacugu

SEQ ID NO: 2458654 - RNA, 20 nt, Human
ugauuuuuuuuuccuucagu

SEQ ID NO: 2458655 - RNA, 19 nt, Human
ugauuuuuuuuuccuucag

SEQ ID NO: 2458656 - RNA, 17 nt, Human
ugauuuuuuuuuccuuc

SEQ ID NO: 2458657 - RNA, 16 nt, Human
ugauuuuuuuuuccuu

SEQ ID NO: 2458658 - RNA, 21 nt, Human
ugauuuuugccucuuccaguc

SEQ ID NO: 2458659 - RNA, 19 nt, Human
ugauuuuucuggagguuga

SEQ ID NO: 2458660 - RNA, 13 nt, Human
ugauuuuucugga

SEQ ID NO: 2458661 - RNA, 20 nt, Human
ugauuuuuagaugagauugu

SEQ ID NO: 2458662 - RNA, 22 nt, Human
ugauuuuugccucuuccagucu

SEQ ID NO: 2458663 - RNA, 13 nt, Human
ugauuuuuugcau

SEQ ID NO: 2458664 - RNA, 16 nt, Human
ugauuuuuuuuccuuu

SEQ ID NO: 2458665 - RNA, 18 nt, Human
ugauuuuuguaagacaau

SEQ ID NO: 2458666 - RNA, 13 nt, Human
ugauuuuuuucca

SEQ ID NO: 2458667 - RNA, 12 nt, Human
ugauuuuaacaa

SEQ ID NO: 2458668 - RNA, 17 nt, Human
ugauguggaguggggca

SEQ ID NO: 2458669 - RNA, 18 nt, Human
ugauguggaguggggcag

SEQ ID NO: 2458670 - RNA, 22 nt, Human
ugauuuuaaaccauaaaaagcu

SEQ ID NO: 2458671 - RNA, 14 nt, Human
ugauuuuaacucug

SEQ ID NO: 2458672 - RNA, 22 nt, Human
ugauuuuaacaauaacuacugu

SEQ ID NO: 2458673 - RNA, 18 nt, Human
ugauuuuaacaauaacua

SEQ ID NO: 2458674 - RNA, 19 nt, Human
ugauuuuaacaauaacuac

SEQ ID NO: 2458675 - RNA, 13 nt, Human
ugauuuuaacaau

SEQ ID NO: 2458676 - RNA, 14 nt, Human
ugauuuuaacaaua

SEQ ID NO: 2458677 - RNA, 16 nt, Human
ugauuuuaacaauaac

SEQ ID NO: 2458678 - RNA, 17 nt, Human
ugauuuuaacaauaacu

SEQ ID NO: 2458679 - RNA, 16 nt, Human
ugauuuuaauaauaua

SEQ ID NO: 2458680 - RNA, 15 nt, Human
ugauuuuaacucugu

SEQ ID NO: 2458681 - RNA, 17 nt, Human
ugauuuuaacucugucu

SEQ ID NO: 2458682 - RNA, 19 nt, Human
ugauuuuagccuucucugu

SEQ ID NO: 2458683 - RNA, 18 nt, Human
ugauuuuagcugcagaac

SEQ ID NO: 2458684 - RNA, 15 nt, Human
ugauuuuagccuucu

SEQ ID NO: 2458685 - RNA, 19 nt, Human
ugauuuuacaauugaaaug

SEQ ID NO: 2458686 - RNA, 13 nt, Human
ugaugugccuggg

SEQ ID NO: 2458687 - RNA, 21 nt, Human
ugaugugccauuuuaaaaaaa

SEQ ID NO: 2458688 - RNA, 22 nt, Human
ugaugugaagccaauucagaca

SEQ ID NO: 2458689 - RNA, 14 nt, Human
ugaugugaagccaa

SEQ ID NO: 2458690 - RNA, 16 nt, Human
ugaugucccuauggaa

SEQ ID NO: 2458691 - RNA, 20 nt, Human
ugauuuucaaagcuuuuucc

SEQ ID NO: 2458692 - RNA, 15 nt, Human
ugauuuucauugcug

SEQ ID NO: 2458693 - RNA, 16 nt, Human
ugauuuuaucugugaa

SEQ ID NO: 2458694 - RNA, 15 nt, Human
ugauuuuaucuguga

SEQ ID NO: 2458695 - RNA, 13 nt, Human
ugauuuucauugc

SEQ ID NO: 2458696 - RNA, 12 nt, Human
ugauuuucuguu

SEQ ID NO: 2458697 - RNA, 15 nt, Human
ugauuuugaaaccau

SEQ ID NO: 2458698 - RNA, 13 nt, Human
ugauuuucuguug

SEQ ID NO: 2458699 - RNA, 15 nt, Human
ugauuuugaaaucau

SEQ ID NO: 2458700 - RNA, 16 nt, Human
ugauuuugcuguagaa

SEQ ID NO: 2458701 - RNA, 14 nt, Human
ugauuuugcuguag

SEQ ID NO: 2458702 - RNA, 19 nt, Human
ugauuuugcuguagaagau

SEQ ID NO: 2458703 - RNA, 17 nt, Human
ugauuuugcuguagaag

SEQ ID NO: 2458704 - RNA, 22 nt, Human
ugauuuuuaccguuucuucccu

SEQ ID NO: 2458705 - RNA, 13 nt, Human
ugauuuugcaaau

SEQ ID NO: 2458706 - RNA, 21 nt, Human
ugauuuuuaccguuucuuccc

SEQ ID NO: 2458707 - RNA, 21 nt, Human
ugcaaccuccgccucccgggu

SEQ ID NO: 2458708 - RNA, 14 nt, Human
ugcaaccucgcugg

SEQ ID NO: 2458709 - RNA, 19 nt, Human
ugcaaccucgcuggacucu

SEQ ID NO: 2458710 - RNA, 20 nt, Human
ugcaaccucgcuggacucuc

SEQ ID NO: 2458711 - RNA, 22 nt, Human
ugcaaccucgcuggacucucag

SEQ ID NO: 2458712 - RNA, 18 nt, Human
ugcaaccucuuggccuga

SEQ ID NO: 2458713 - RNA, 20 nt, Human
ugcaaccugauugugucucu

SEQ ID NO: 2458714 - RNA, 19 nt, Human
ugcaaccugauugugucuc

SEQ ID NO: 2458715 - RNA, 21 nt, Human
ugcaaccuccgccucuugggu

SEQ ID NO: 2458716 - RNA, 20 nt, Human
ugcaaccuccgccucuuggg

SEQ ID NO: 2458717 - RNA, 20 nt, Human
ugcaaccuccgccucccggg

SEQ ID NO: 2458718 - RNA, 21 nt, Human
ugcaacccaaggacugaggga

SEQ ID NO: 2458719 - RNA, 18 nt, Human
ugcaaccuccgccucuug

SEQ ID NO: 2458720 - RNA, 22 nt, Human
ugcaaccugauugugucucuug

SEQ ID NO: 2458721 - RNA, 18 nt, Human
ugcaaccuucgccaccug

SEQ ID NO: 2458722 - RNA, 21 nt, Human
ugcaaccuucgccaccugggu

SEQ ID NO: 2458723 - RNA, 22 nt, Human
ugcaacuucaugucaacuucug

SEQ ID NO: 2458724 - RNA, 15 nt, Human
ugcaacuucauguca

SEQ ID NO: 2458725 - RNA, 17 nt, Human
ugcaacucaaggacuuu

SEQ ID NO: 2458726 - RNA, 16 nt, Human
ugcaacucaaggacuu

SEQ ID NO: 2458727 - RNA, 16 nt, Human
ugcaacggcuuagacu

SEQ ID NO: 2458728 - RNA, 14 nt, Human
ugcaaccuguugau

SEQ ID NO: 2458729 - RNA, 18 nt, Human
ugcaacuuuguauaaaag

SEQ ID NO: 2458730 - RNA, 23 nt, Human
ugcaacuuuaagcagcucuugcu

SEQ ID NO: 2458731 - RNA, 20 nt, Human
ugcaacuuuaagcagcucuu

SEQ ID NO: 2458732 - RNA, 19 nt, Human
ugcaacuuuaagcagcucu

SEQ ID NO: 2458733 - RNA, 14 nt, Human
ugcaacuuggacuu

SEQ ID NO: 2458734 - RNA, 18 nt, Human
ugcaacuuguaaaugugg

SEQ ID NO: 2458735 - RNA, 16 nt, Human
ugcaacuuguaaaugu

SEQ ID NO: 2458736 - RNA, 17 nt, Human
ugcaacuucuuuuuauu

SEQ ID NO: 2458737 - RNA, 21 nt, Human
ugcaacuucuuuuuauuuucu

SEQ ID NO: 2458738 - RNA, 14 nt, Human
ugcaacuucugccu

SEQ ID NO: 2458739 - RNA, 13 nt, Human
ugcaacuucugcc

SEQ ID NO: 2458740 - RNA, 22 nt, Human
ugcaaacaugggguuggcuggg

SEQ ID NO: 2458741 - RNA, 23 nt, Human
ugcaaacacacaaagguauaauu

SEQ ID NO: 2458742 - RNA, 14 nt, Human
ugcaaaauuuccag

SEQ ID NO: 2458743 - RNA, 15 nt, Human
ugcaaaauuuccagu

SEQ ID NO: 2458744 - RNA, 16 nt, Human
ugcaaaauuuccagua

SEQ ID NO: 2458745 - RNA, 22 nt, Human
ugcaaaauuugaugccaggaca

SEQ ID NO: 2458746 - RNA, 21 nt, Human
ugcaaaauuugaugccaggac

SEQ ID NO: 2458747 - RNA, 21 nt, Human
ugcaaaauuuccaguaccuuu

SEQ ID NO: 2458748 - RNA, 20 nt, Human
ugcaaaagacuaauuuaaaa

SEQ ID NO: 2458749 - RNA, 21 nt, Human
ugcaaaaugaggaauguauau

SEQ ID NO: 2458750 - RNA, 18 nt, Human
ugcaaaaugaggaaugua

SEQ ID NO: 2458751 - RNA, 17 nt, Human
ugcaaaaugagacccuc

SEQ ID NO: 2458752 - RNA, 20 nt, Human
ugcaaaaguucugacuugac

SEQ ID NO: 2458753 - RNA, 23 nt, Human
ugcaaaagguucacuaaagcagu

SEQ ID NO: 2458754 - RNA, 22 nt, Human
ugcaaaaggacucucaggacca

SEQ ID NO: 2458755 - RNA, 22 nt, Human
ugcaaaagguucacuaaagcag

SEQ ID NO: 2458756 - RNA, 17 nt, Human
ugcaacaggcugggcuu

SEQ ID NO: 2458757 - RNA, 16 nt, Human
ugcaacaggcugggcu

SEQ ID NO: 2458758 - RNA, 15 nt, Human
ugcaacaggcugggc

SEQ ID NO: 2458759 - RNA, 14 nt, Human
ugcaacaggcuggg

SEQ ID NO: 2458760 - RNA, 15 nt, Human
ugcaaccacugcaac

SEQ ID NO: 2458761 - RNA, 13 nt, Human
ugcaaccacugca

SEQ ID NO: 2458762 - RNA, 17 nt, Human
ugcaaccaacuacaacc

SEQ ID NO: 2458763 - RNA, 11 nt, Human
ugcaaccacug

SEQ ID NO: 2458764 - RNA, 24 nt, Human
ugcaacaggguauggacuaucugu

SEQ ID NO: 2458765 - RNA, 14 nt, Human
ugcaacaggcuugu

SEQ ID NO: 2458766 - RNA, 13 nt, Human
ugcaacaguagca

SEQ ID NO: 2458767 - RNA, 14 nt, Human
ugcaacaguagcau

SEQ ID NO: 2458768 - RNA, 20 nt, Human
ugcaacaggcugggcuucag

SEQ ID NO: 2458769 - RNA, 19 nt, Human
ugcaacaggcugggcuuca

SEQ ID NO: 2458770 - RNA, 14 nt, Human
ugcaaccuccgccu

SEQ ID NO: 2458771 - RNA, 13 nt, Human
ugcaaccuccgcc

SEQ ID NO: 2458772 - RNA, 16 nt, Human
ugcaaccgucuguuau

SEQ ID NO: 2458773 - RNA, 15 nt, Human
ugcaacccuuacccc

SEQ ID NO: 2458774 - RNA, 17 nt, Human
ugcaacccuuaccccuu

SEQ ID NO: 2458775 - RNA, 20 nt, Human
ugcaacccaaggacugaggg

SEQ ID NO: 2458776 - RNA, 16 nt, Human
ugcaacccaaggacug

SEQ ID NO: 2458777 - RNA, 19 nt, Human
ugccaggaagccagcaggc

SEQ ID NO: 2458778 - RNA, 18 nt, Human
ugccaggaagccagcagg

SEQ ID NO: 2458779 - RNA, 16 nt, Human
ugccaggaagccagca

SEQ ID NO: 2458780 - RNA, 12 nt, Human
ugccaggaagcc

SEQ ID NO: 2458781 - RNA, 18 nt, Human
ugccacucacuaggcccc

SEQ ID NO: 2458782 - RNA, 17 nt, Human
ugccacucacuaggccc

SEQ ID NO: 2458783 - RNA, 15 nt, Human
ugccacucacuaggc

SEQ ID NO: 2458784 - RNA, 14 nt, Human
ugccacucacuagg

SEQ ID NO: 2458785 - RNA, 22 nt, Human
ugccacucacacagccaggugc

SEQ ID NO: 2458786 - RNA, 14 nt, Human
ugccaccagagacc

SEQ ID NO: 2458787 - RNA, 13 nt, Human
ugccacucacuag

SEQ ID NO: 2458788 - RNA, 13 nt, Human
ugccaccagagac

SEQ ID NO: 2458789 - RNA, 22 nt, Human
ugccacucacuaggcccccacu

SEQ ID NO: 2458790 - RNA, 21 nt, Human
ugccacucacuaggcccccac

SEQ ID NO: 2458791 - RNA, 20 nt, Human
ugccacucacuaggccccca

SEQ ID NO: 2458792 - RNA, 19 nt, Human
ugccacucacuaggccccc

SEQ ID NO: 2458793 - RNA, 18 nt, Human
ugccacucauuccuguag

SEQ ID NO: 2458794 - RNA, 17 nt, Human
ugccacucauuccugua

SEQ ID NO: 2458795 - RNA, 23 nt, Human
ugccacucacacagccaggugcc

SEQ ID NO: 2458796 - RNA, 17 nt, Human
ugccacugcccgagcug

SEQ ID NO: 2458797 - RNA, 19 nt, Human
ugccagguuuucugggugu

SEQ ID NO: 2458798 - RNA, 18 nt, Human
ugccagguuuucugggug

SEQ ID NO: 2458799 - RNA, 14 nt, Human
ugccagguuuucug

SEQ ID NO: 2458800 - RNA, 20 nt, Human
ugccagguucuauuuggaau

SEQ ID NO: 2458801 - RNA, 22 nt, Human
ugccaucauguuuacagaggac

SEQ ID NO: 2458802 - RNA, 12 nt, Human
ugccauccaggu

SEQ ID NO: 2458803 - RNA, 14 nt, Human
ugccaucuucccag

SEQ ID NO: 2458804 - RNA, 15 nt, Human
ugccauccagguuca

SEQ ID NO: 2458805 - RNA, 19 nt, Human
ugccagguucuauuuggaa

SEQ ID NO: 2458806 - RNA, 20 nt, Human
ugccagguccuugcccuuug

SEQ ID NO: 2458807 - RNA, 16 nt, Human
ugccagguccuugccc

SEQ ID NO: 2458808 - RNA, 17 nt, Human
ugccagguuuuuggucu

SEQ ID NO: 2458809 - RNA, 23 nt, Human
ugccaggguuucgagaagcugcu

SEQ ID NO: 2458810 - RNA, 20 nt, Human
ugccaggguuucgagaagcu

SEQ ID NO: 2458811 - RNA, 21 nt, Human
ugccacucacacagccaggug

SEQ ID NO: 2458812 - RNA, 12 nt, Human
ugccagggcagg

SEQ ID NO: 2458813 - RNA, 16 nt, Human
ugccagggcagggccc

SEQ ID NO: 2458814 - RNA, 15 nt, Human
ugccagggcagggcc

SEQ ID NO: 2458815 - RNA, 18 nt, Human
ugccacugcccgagcugg

SEQ ID NO: 2458816 - RNA, 20 nt, Human
ugcccaccuggccucugcac

SEQ ID NO: 2458817 - RNA, 16 nt, Human
ugccauguuggccagg

SEQ ID NO: 2458818 - RNA, 15 nt, Human
ugccauguuggccag

SEQ ID NO: 2458819 - RNA, 12 nt, Human
ugccauguuggc

SEQ ID NO: 2458820 - RNA, 18 nt, Human
ugcccacgcuggagugca

SEQ ID NO: 2458821 - RNA, 19 nt, Human
ugcccaccuggccucugca

SEQ ID NO: 2458822 - RNA, 19 nt, Human
ugcccacggagucgugggg

SEQ ID NO: 2458823 - RNA, 11 nt, Human
ugcccaccugu

SEQ ID NO: 2458824 - RNA, 13 nt, Human
ugcccacucccug

SEQ ID NO: 2458825 - RNA, 21 nt, Human
ugcccacucccugcaaccuga

SEQ ID NO: 2458826 - RNA, 17 nt, Human
ugcccacugucucuccu

SEQ ID NO: 2458827 - RNA, 21 nt, Human
ugcccagaacuggacucagga

SEQ ID NO: 2458828 - RNA, 17 nt, Human
ugccaugugugcugaac

SEQ ID NO: 2458829 - RNA, 15 nt, Human
ugccaugugaagagg

SEQ ID NO: 2458830 - RNA, 16 nt, Human
ugccaugugaagaggg

SEQ ID NO: 2458831 - RNA, 15 nt, Human
ugccaugugccaggu

SEQ ID NO: 2458832 - RNA, 20 nt, Human
ugccauguaggguucccuua

SEQ ID NO: 2458833 - RNA, 14 nt, Human
ugccaugugccagg

SEQ ID NO: 2458834 - RNA, 23 nt, Human
ugccaugaggaacaaggcaaggc

SEQ ID NO: 2458835 - RNA, 20 nt, Human
ugccaugaggaacaaggcaa

SEQ ID NO: 2458836 - RNA, 16 nt, Human
ugccaucuucccagca

SEQ ID NO: 2458837 - RNA, 15 nt, Human
ugccaucuucccagc

SEQ ID NO: 2458838 - RNA, 14 nt, Human
ugcauuauauuuau

SEQ ID NO: 2458839 - RNA, 12 nt, Human
ugcauuaucuag

SEQ ID NO: 2458840 - RNA, 17 nt, Human
ugcauuaucuagauacu

SEQ ID NO: 2458841 - RNA, 21 nt, Human
ugcauuauauuuguaaauuua

SEQ ID NO: 2458842 - RNA, 16 nt, Human
ugcauuugucuauucu

SEQ ID NO: 2458843 - RNA, 21 nt, Human
ugcauguuuuccagcuccuca

SEQ ID NO: 2458844 - RNA, 14 nt, Human
ugcauuaaaagaaa

SEQ ID NO: 2458845 - RNA, 15 nt, Human
ugcauuaaaagaaaa

SEQ ID NO: 2458846 - RNA, 16 nt, Human
ugcauuaaaagaaaau

SEQ ID NO: 2458847 - RNA, 17 nt, Human
ugcauuaaaagaaaaua

SEQ ID NO: 2458848 - RNA, 22 nt, Human
ugcauuacagagaggagaaaca

SEQ ID NO: 2458849 - RNA, 23 nt, Human
ugcauuaccgcguuguaaaauau

SEQ ID NO: 2458850 - RNA, 22 nt, Human
ugcauuaccgcguuguaaaaua

SEQ ID NO: 2458851 - RNA, 23 nt, Human
ugcauuacagagaggagaaacac

SEQ ID NO: 2458852 - RNA, 19 nt, Human
ugcauuaccgcguuguaaa

SEQ ID NO: 2458853 - RNA, 15 nt, Human
ugcauuacugcaugc

SEQ ID NO: 2458854 - RNA, 17 nt, Human
ugcauuacugcaugcac

SEQ ID NO: 2458855 - RNA, 18 nt, Human
ugcauuacugcaugcacu

SEQ ID NO: 2458856 - RNA, 19 nt, Human
ugcauuagaaauagacagu

SEQ ID NO: 2458857 - RNA, 20 nt, Human
ugcauuagaaauagacagua

SEQ ID NO: 2458858 - RNA, 21 nt, Human
ugcauuagagcccauuucaau

SEQ ID NO: 2458859 - RNA, 22 nt, Human
ugcauuagaaauagacaguaua

SEQ ID NO: 2458860 - RNA, 13 nt, Human
ugcauuagaaauu

SEQ ID NO: 2458861 - RNA, 14 nt, Human
ugcauuagaaauua

SEQ ID NO: 2458862 - RNA, 23 nt, Human
ugcauuagaaauuagcuguguga

SEQ ID NO: 2458863 - RNA, 20 nt, Human
ugcauuugucuauucuccag

SEQ ID NO: 2458864 - RNA, 19 nt, Human
ugcauuugucuauucucca

SEQ ID NO: 2458865 - RNA, 16 nt, Human
ugcauuuuaaaaauga

SEQ ID NO: 2458866 - RNA, 21 nt, Human
ugcauuuuaaaaaugaaauuu

SEQ ID NO: 2458867 - RNA, 20 nt, Human
ugcauuuugcuauuguaaau

SEQ ID NO: 2458868 - RNA, 19 nt, Human
ugcauuuugcuauuguaaa

SEQ ID NO: 2458869 - RNA, 18 nt, Human
ugcauuuugcuauuguaa

SEQ ID NO: 2458870 - RNA, 17 nt, Human
ugcauuuugcuauugua

SEQ ID NO: 2458871 - RNA, 16 nt, Human
ugcauuuugcuauugu

SEQ ID NO: 2458872 - RNA, 15 nt, Human
ugcauuuugcuauug

SEQ ID NO: 2458873 - RNA, 13 nt, Human
ugcauuuugcuau

SEQ ID NO: 2458874 - RNA, 21 nt, Human
ugcauuuuaauuuuaaccaaa

SEQ ID NO: 2458875 - RNA, 19 nt, Human
ugcauuuuaauuuuaacca

SEQ ID NO: 2458876 - RNA, 17 nt, Human
ugcauuuuaauuuuaac

SEQ ID NO: 2458877 - RNA, 17 nt, Human
ugcauuuucaccccacc

SEQ ID NO: 2458878 - RNA, 18 nt, Human
ugcauuuugcagcaguga

SEQ ID NO: 2458879 - RNA, 22 nt, Human
ugccacaggccucccuguuuga

SEQ ID NO: 2458880 - RNA, 18 nt, Human
ugccacaggccucccugu

SEQ ID NO: 2458881 - RNA, 17 nt, Human
ugccacaggccucccug

SEQ ID NO: 2458882 - RNA, 22 nt, Human
ugcauuuugcuauuguaaauau

SEQ ID NO: 2458883 - RNA, 15 nt, Human
ugccacaggccuccc

SEQ ID NO: 2458884 - RNA, 18 nt, Human
ugcauuuuguuugguauu

SEQ ID NO: 2458885 - RNA, 23 nt, Human
ugcauuuuggagaguuuccugaa

SEQ ID NO: 2458886 - RNA, 15 nt, Human
ugccaccacgcccgg

SEQ ID NO: 2458887 - RNA, 18 nt, Human
ugccaccaaaggccaggg

SEQ ID NO: 2458888 - RNA, 22 nt, Human
ugccacauuuauuuuuauaucu

SEQ ID NO: 2458889 - RNA, 23 nt, Human
ugccacaggccucccuguuugaa

SEQ ID NO: 2458890 - RNA, 21 nt, Human
ugccacaucuugaucugcuca

SEQ ID NO: 2458891 - RNA, 19 nt, Human
ugcagauaaacaguaguga

SEQ ID NO: 2458892 - RNA, 22 nt, Human
ugcagaggucugugcugaggcc

SEQ ID NO: 2458893 - RNA, 19 nt, Human
ugcagaggucugugcugag

SEQ ID NO: 2458894 - RNA, 18 nt, Human
ugcagaggucugugcuga

SEQ ID NO: 2458895 - RNA, 21 nt, Human
ugcagaggucugugcugaggc

SEQ ID NO: 2458896 - RNA, 18 nt, Human
ugcagauggggcucccgc

SEQ ID NO: 2458897 - RNA, 15 nt, Human
ugcagaugacaaaaa

SEQ ID NO: 2458898 - RNA, 14 nt, Human
ugcagaugacaaaa

SEQ ID NO: 2458899 - RNA, 21 nt, Human
ugcauccauuccucagggaca

SEQ ID NO: 2458900 - RNA, 19 nt, Human
ugcauccauuccucaggga

SEQ ID NO: 2458901 - RNA, 20 nt, Human
ugcauccauuccucagggac

SEQ ID NO: 2458902 - RNA, 17 nt, Human
ugcagauuugggcugga

SEQ ID NO: 2458903 - RNA, 16 nt, Human
ugcagauuugggcugg

SEQ ID NO: 2458904 - RNA, 22 nt, Human
ugcagauggggcucccgcccgu

SEQ ID NO: 2458905 - RNA, 13 nt, Human
ugcagauucauuu

SEQ ID NO: 2458906 - RNA, 14 nt, Human
ugcauccuccgccu

SEQ ID NO: 2458907 - RNA, 19 nt, Human
ugcauccguaguucccuga

SEQ ID NO: 2458908 - RNA, 20 nt, Human
ugcauccguaguucccugaa

SEQ ID NO: 2458909 - RNA, 14 nt, Human
ugcauccuccaaga

SEQ ID NO: 2458910 - RNA, 16 nt, Human
ugcauccccuuggcug

SEQ ID NO: 2458911 - RNA, 19 nt, Human
ugcauccgggggcagcucu

SEQ ID NO: 2458912 - RNA, 17 nt, Human
ugcaucccccccaccuc

SEQ ID NO: 2458913 - RNA, 15 nt, Human
ugcaucccccccacc

SEQ ID NO: 2458914 - RNA, 17 nt, Human
ugcaugguuuagaaagc

SEQ ID NO: 2458915 - RNA, 22 nt, Human
ugcauccuccaagaaucuaucu

SEQ ID NO: 2458916 - RNA, 15 nt, Human
ugcauccuccaagaa

SEQ ID NO: 2458917 - RNA, 20 nt, Human
ugcauguaaacacgccugca

SEQ ID NO: 2458918 - RNA, 15 nt, Human
ugcauguaugucuug

SEQ ID NO: 2458919 - RNA, 14 nt, Human
ugcauguaugucuu

SEQ ID NO: 2458920 - RNA, 13 nt, Human
ugcauguaugucu

SEQ ID NO: 2458921 - RNA, 14 nt, Human
ugcauguuccacua

SEQ ID NO: 2458922 - RNA, 22 nt, Human
ugcauguuaggaaaauuucaca

SEQ ID NO: 2458923 - RNA, 15 nt, Human
ugcauguuugugauu

SEQ ID NO: 2458924 - RNA, 17 nt, Human
ugcauguuccacuaacc

SEQ ID NO: 2458925 - RNA, 16 nt, Human
ugcauguuccacuaac

SEQ ID NO: 2458926 - RNA, 18 nt, Human
ugcauguuccacuaaccc

SEQ ID NO: 2458927 - RNA, 19 nt, Human
ugcauguuuuccagcuccu

SEQ ID NO: 2458928 - RNA, 23 nt, Human
ugcccugcugccgccucccagcc

SEQ ID NO: 2458929 - RNA, 21 nt, Human
ugcccugcugccgccucccag

SEQ ID NO: 2458930 - RNA, 19 nt, Human
ugcccugcggccccgucug

SEQ ID NO: 2458931 - RNA, 17 nt, Human
ugcccugccugagggcc

SEQ ID NO: 2458932 - RNA, 11 nt, Human
ugcccugcugc

SEQ ID NO: 2458933 - RNA, 18 nt, Human
ugcccuggauccaucagg

SEQ ID NO: 2458934 - RNA, 15 nt, Human
ugcccugguggagaa

SEQ ID NO: 2458935 - RNA, 14 nt, Human
ugcccugguggaga

SEQ ID NO: 2458936 - RNA, 13 nt, Human
ugcccugguggag

SEQ ID NO: 2458937 - RNA, 16 nt, Human
ugcccuggcccugagg

SEQ ID NO: 2458938 - RNA, 21 nt, Human
ugcccuggugcugccacacuu

SEQ ID NO: 2458939 - RNA, 23 nt, Human
ugcccugguggagaaagcacuga

SEQ ID NO: 2458940 - RNA, 22 nt, Human
ugcccugguggagaaagcacug

SEQ ID NO: 2458941 - RNA, 15 nt, Human
ugcccugguuucacu

SEQ ID NO: 2458942 - RNA, 17 nt, Human
ugcccugguuucacugg

SEQ ID NO: 2458943 - RNA, 14 nt, Human
ugcccuggcccuga

SEQ ID NO: 2458944 - RNA, 13 nt, Human
ugcccuggcccug

SEQ ID NO: 2458945 - RNA, 12 nt, Human
ugcccuggcccu

SEQ ID NO: 2458946 - RNA, 16 nt, Human
ugcccuggagguggcu

SEQ ID NO: 2458947 - RNA, 18 nt, Human
ugcccuggugcugccaca

SEQ ID NO: 2458948 - RNA, 20 nt, Human
ugcccuggugcugccacacu

SEQ ID NO: 2458949 - RNA, 19 nt, Human
ugccgucuaccugaggggc

SEQ ID NO: 2458950 - RNA, 17 nt, Human
ugccgucuaccugaggg

SEQ ID NO: 2458951 - RNA, 23 nt, Human
ugccguggggccgccgccucuuu

SEQ ID NO: 2458952 - RNA, 22 nt, Human
ugccguggauugcacguggccu

SEQ ID NO: 2458953 - RNA, 20 nt, Human
ugccguggauugcacguggc

SEQ ID NO: 2458954 - RNA, 16 nt, Human
ugccggugagaauaag

SEQ ID NO: 2458955 - RNA, 16 nt, Human
ugccgucuaccugagg

SEQ ID NO: 2458956 - RNA, 15 nt, Human
ugccgucuaccugag

SEQ ID NO: 2458957 - RNA, 15 nt, Human
ugcccugguuuccug

SEQ ID NO: 2458958 - RNA, 22 nt, Human
ugcccugguuucacuggcccaa

SEQ ID NO: 2458959 - RNA, 14 nt, Human
ugccggguuuuaua

SEQ ID NO: 2458960 - RNA, 20 nt, Human
ugccgguaaacacgccugca

SEQ ID NO: 2458961 - RNA, 18 nt, Human
ugccggguuuuauauuuu

SEQ ID NO: 2458962 - RNA, 23 nt, Human
ugcccugcccaccuggccucugc

SEQ ID NO: 2458963 - RNA, 22 nt, Human
ugcccugcccaccuggccucug

SEQ ID NO: 2458964 - RNA, 17 nt, Human
ugcccuaaaguguauuu

SEQ ID NO: 2458965 - RNA, 19 nt, Human
ugcccuaaaguguauuuuu

SEQ ID NO: 2458966 - RNA, 19 nt, Human
ugcccugcgggucacagga

SEQ ID NO: 2458967 - RNA, 18 nt, Human
ugcccugcugagucccag

SEQ ID NO: 2458968 - RNA, 22 nt, Human
ugcccugcugagucccaggcug

SEQ ID NO: 2458969 - RNA, 23 nt, Human
ugcccugcugagucccaggcuga

SEQ ID NO: 2458970 - RNA, 21 nt, Human
ugcccugcccaccuggccucu

SEQ ID NO: 2458971 - RNA, 16 nt, Human
ugcccugcccccacga

SEQ ID NO: 2458972 - RNA, 11 nt, Human
ugcccugcccc

SEQ ID NO: 2458973 - RNA, 12 nt, Human
ugcccugccuga

SEQ ID NO: 2458974 - RNA, 14 nt, Human
ugcccugccugagg

SEQ ID NO: 2458975 - RNA, 16 nt, Human
ugcccugcccuagcuc

SEQ ID NO: 2458976 - RNA, 17 nt, Human
ugcccagaaugaggcug

SEQ ID NO: 2458977 - RNA, 18 nt, Human
ugcccagaaugaggcugc

SEQ ID NO: 2458978 - RNA, 19 nt, Human
ugcccagaauaaguuauug

SEQ ID NO: 2458979 - RNA, 17 nt, Human
ugcccagaauaaguuau

SEQ ID NO: 2458980 - RNA, 21 nt, Human
ugcccagaauaaguuauugca

SEQ ID NO: 2458981 - RNA, 18 nt, Human
ugcccggggaaaggcaag

SEQ ID NO: 2458982 - RNA, 21 nt, Human
ugcccggggaaaggcaagguc

SEQ ID NO: 2458983 - RNA, 20 nt, Human
ugcccgggcgcggccagccc

SEQ ID NO: 2458984 - RNA, 19 nt, Human
ugcccgggcgcggccagcc

SEQ ID NO: 2458985 - RNA, 22 nt, Human
ugcccgggcgcggccagccccg

SEQ ID NO: 2458986 - RNA, 18 nt, Human
ugcccggggcagcugcca

SEQ ID NO: 2458987 - RNA, 23 nt, Human
ugcccguaaacacgccugcaaac

SEQ ID NO: 2458988 - RNA, 17 nt, Human
ugcccgucucucuccca

SEQ ID NO: 2458989 - RNA, 20 nt, Human
ugcccggggcagcugccaga

SEQ ID NO: 2458990 - RNA, 20 nt, Human
ugcccguaaacacgccugca

SEQ ID NO: 2458991 - RNA, 23 nt, Human
ugcccggggcagcugccagagaa

SEQ ID NO: 2458992 - RNA, 21 nt, Human
ugcccgucucucucccaugga

SEQ ID NO: 2458993 - RNA, 20 nt, Human
ugcccgucucucucccaugg

SEQ ID NO: 2458994 - RNA, 19 nt, Human
ugcccgucucucucccaug

SEQ ID NO: 2458995 - RNA, 18 nt, Human
ugcccgucucucucccau

SEQ ID NO: 2458996 - RNA, 13 nt, Human
ugcccgucuucag

SEQ ID NO: 2458997 - RNA, 16 nt, Human
ugcccgucuucagccu

SEQ ID NO: 2458998 - RNA, 17 nt, Human
ugcccgucuucagccua

SEQ ID NO: 2458999 - RNA, 18 nt, Human
ugcccgucuucagccuag

SEQ ID NO: 2459000 - RNA, 23 nt, Human
ugcccgucucucucccauggagc

SEQ ID NO: 2459001 - RNA, 19 nt, Human
ugcccgucuucagccuagc

SEQ ID NO: 2459002 - RNA, 14 nt, Human
ugccugguuuugau

SEQ ID NO: 2459003 - RNA, 22 nt, Human
ugccuggucacagggcaugccc

SEQ ID NO: 2459004 - RNA, 17 nt, Human
ugccuggucacagggca

SEQ ID NO: 2459005 - RNA, 16 nt, Human
ugccuggucacagggc

SEQ ID NO: 2459006 - RNA, 17 nt, Human
ugccugguccucacacu

SEQ ID NO: 2459007 - RNA, 19 nt, Human
ugccugguggcagcugcgg

SEQ ID NO: 2459008 - RNA, 15 nt, Human
ugccuguaguuagga

SEQ ID NO: 2459009 - RNA, 16 nt, Human
ugccuguaguuaggaa

SEQ ID NO: 2459010 - RNA, 17 nt, Human
ugccuguaguuaggaaa

SEQ ID NO: 2459011 - RNA, 18 nt, Human
ugccuguaguuaggaaau

SEQ ID NO: 2459012 - RNA, 19 nt, Human
ugccuguaguuaggaaaua

SEQ ID NO: 2459013 - RNA, 20 nt, Human
ugccuguaguuaggaaauaa

SEQ ID NO: 2459014 - RNA, 21 nt, Human
ugccuguaguuaggaaauaaa

SEQ ID NO: 2459015 - RNA, 22 nt, Human
ugccuguaguuaggaaauaaaa

SEQ ID NO: 2459016 - RNA, 18 nt, Human
ugccugguggcagcugcg

SEQ ID NO: 2459017 - RNA, 17 nt, Human
ugccugguggcagcugc

SEQ ID NO: 2459018 - RNA, 20 nt, Human
ugccugguauauccaaaagc

SEQ ID NO: 2459019 - RNA, 23 nt, Human
ugccugguauauccaaaagcuuu

SEQ ID NO: 2459020 - RNA, 22 nt, Human
ugccuggguuuaaggggagagg

SEQ ID NO: 2459021 - RNA, 16 nt, Human
ugccuggguggggcug

SEQ ID NO: 2459022 - RNA, 17 nt, Human
ugccuggguggggcugc

SEQ ID NO: 2459023 - RNA, 19 nt, Human
ugccuggguggggcugcuc

SEQ ID NO: 2459024 - RNA, 21 nt, Human
ugccuggguggggcugcuccu

SEQ ID NO: 2459025 - RNA, 22 nt, Human
ugccuggguggggcugcuccuc

SEQ ID NO: 2459026 - RNA, 23 nt, Human
ugccuggguggggcugcuccucc

SEQ ID NO: 2459027 - RNA, 24 nt, Human
ugccuggguggggcugcuccucca

SEQ ID NO: 2459028 - RNA, 16 nt, Human
ugccugccagcugcac

SEQ ID NO: 2459029 - RNA, 13 nt, Human
ugccugcccaccc

SEQ ID NO: 2459030 - RNA, 14 nt, Human
ugccugcccacccg

SEQ ID NO: 2459031 - RNA, 22 nt, Human
ugccugggcucccuugugcgug

SEQ ID NO: 2459032 - RNA, 21 nt, Human
ugccuggguggacauggcccc

SEQ ID NO: 2459033 - RNA, 17 nt, Human
ugccugggcuguuggca

SEQ ID NO: 2459034 - RNA, 16 nt, Human
ugccugggcuguuggc

SEQ ID NO: 2459035 - RNA, 12 nt, Human
ugccugggcugu

SEQ ID NO: 2459036 - RNA, 15 nt, Human
ugccugcccacccgu

SEQ ID NO: 2459037 - RNA, 16 nt, Human
ugccugcccacccgug

SEQ ID NO: 2459038 - RNA, 19 nt, Human
ugccugccagcugcacuga

SEQ ID NO: 2459039 - RNA, 15 nt, Human
ugccugccagcugca

SEQ ID NO: 2459040 - RNA, 21 nt, Human
ugccugcagaggucugugcug

SEQ ID NO: 2459041 - RNA, 13 nt, Human
ugccugcauucug

SEQ ID NO: 2459042 - RNA, 15 nt, Human
ugccugcauguauuu

SEQ ID NO: 2459043 - RNA, 15 nt, Human
ugccugcagccccgc

SEQ ID NO: 2459044 - RNA, 22 nt, Human
ugccugcagccccgcgccuccu

SEQ ID NO: 2459045 - RNA, 21 nt, Human
ugccucuuccagucuuccuga

SEQ ID NO: 2459046 - RNA, 23 nt, Human
ugccucuuccagucuuccugaca

SEQ ID NO: 2459047 - RNA, 15 nt, Human
ugccucuuagacuuc

SEQ ID NO: 2459048 - RNA, 23 nt, Human
ugccucuguuugacaaaccucua

SEQ ID NO: 2459049 - RNA, 16 nt, Human
ugccucuguuugacaa

SEQ ID NO: 2459050 - RNA, 23 nt, Human
ugccucuucccccugcuuccacc

SEQ ID NO: 2459051 - RNA, 13 nt, Human
ugccucuuccucc

SEQ ID NO: 2459052 - RNA, 21 nt, Human
ugccucuucucuacucuaggg

SEQ ID NO: 2459053 - RNA, 17 nt, Human
ugccucuuccuugaaga

SEQ ID NO: 2459054 - RNA, 18 nt, Human
ugccugcagagagaagcc

SEQ ID NO: 2459055 - RNA, 20 nt, Human
ugccugcagaggucugugcu

SEQ ID NO: 2459056 - RNA, 19 nt, Human
ugccugcagaggucugugc

SEQ ID NO: 2459057 - RNA, 11 nt, Human
ugccugcagcc

SEQ ID NO: 2459058 - RNA, 20 nt, Human
ugccuccuuugugaggaagc

SEQ ID NO: 2459059 - RNA, 21 nt, Human
ugccuccuuugugaggaagcc

SEQ ID NO: 2459060 - RNA, 19 nt, Human
ugccuccucacccccagcu

SEQ ID NO: 2459061 - RNA, 24 nt, Human
ugccuccucacccccagcuuugcu

SEQ ID NO: 2459062 - RNA, 13 nt, Human
ugccucgaaacac

SEQ ID NO: 2459063 - RNA, 17 nt, Human
ugccucgaaacacagaa

SEQ ID NO: 2459064 - RNA, 22 nt, Human
ugccuccuuugugaggaagccg

SEQ ID NO: 2459065 - RNA, 14 nt, Human
ugccucugccuguc

SEQ ID NO: 2459066 - RNA, 13 nt, Human
ugccucugccugu

SEQ ID NO: 2459067 - RNA, 18 nt, Human
ugccucugccugucuccc

SEQ ID NO: 2459068 - RNA, 21 nt, Human
ugccucgaaacacagaaaccu

SEQ ID NO: 2459069 - RNA, 16 nt, Human
ugccucugccugcauu

SEQ ID NO: 2459070 - RNA, 17 nt, Human
ugccucugugcugugug

SEQ ID NO: 2459071 - RNA, 21 nt, Human
ugccucugugcugugugugac

SEQ ID NO: 2459072 - RNA, 13 nt, Human
ugccucugggacu

SEQ ID NO: 2459073 - RNA, 13 nt, Human
ugccuaagcccuc

SEQ ID NO: 2459074 - RNA, 20 nt, Human
ugccgugugcccucgggcga

SEQ ID NO: 2459075 - RNA, 16 nt, Human
ugccguuacucuccaa

SEQ ID NO: 2459076 - RNA, 19 nt, Human
ugccguuacucuccaaccu

SEQ ID NO: 2459077 - RNA, 22 nt, Human
ugccguuacucuccaaccugga

SEQ ID NO: 2459078 - RNA, 16 nt, Human
ugccucccucacccug

SEQ ID NO: 2459079 - RNA, 13 nt, Human
ugccuccccugug

SEQ ID NO: 2459080 - RNA, 21 nt, Human
ugccucccucacccugagccc

SEQ ID NO: 2459081 - RNA, 17 nt, Human
ugccucccucacccuga

SEQ ID NO: 2459082 - RNA, 22 nt, Human
ugccucccucacccugagcccc

SEQ ID NO: 2459083 - RNA, 16 nt, Human
ugccucccuucaugca

SEQ ID NO: 2459084 - RNA, 12 nt, Human
ugccuccucacc

SEQ ID NO: 2459085 - RNA, 19 nt, Human
ugccuccgccucaguaaga

SEQ ID NO: 2459086 - RNA, 22 nt, Human
ugccuccgcgugaucaaagcca

SEQ ID NO: 2459087 - RNA, 13 nt, Human
uuuuuuuugacaa

SEQ ID NO: 2459088 - RNA, 13 nt, Human
uuuuuuuuaaugu

SEQ ID NO: 2459089 - RNA, 14 nt, Human
uuuuuuuuaaacua

SEQ ID NO: 2459090 - RNA, 11 nt, Human
uuuuuuuucau

SEQ ID NO: 2459091 - RNA, 14 nt, Human
uuuucaaaauggag

SEQ ID NO: 2459092 - RNA, 21 nt, Human
uuuucaaaauuguuacaaauu

SEQ ID NO: 2459093 - RNA, 14 nt, Human
uuuucaaauuguau

SEQ ID NO: 2459094 - RNA, 19 nt, Human
uuuucaaauuguaucuagu

SEQ ID NO: 2459095 - RNA, 14 nt, Human
uuuucacaugaaca

SEQ ID NO: 2459096 - RNA, 13 nt, Human
uuuucacaugaac

SEQ ID NO: 2459097 - RNA, 18 nt, Human
uuuucacauucuuauaaa

SEQ ID NO: 2459098 - RNA, 22 nt, Human
uuuucacauucuuauaaauaug

SEQ ID NO: 2459099 - RNA, 23 nt, Human
uuuucacaugaacauacuggcug

SEQ ID NO: 2459100 - RNA, 12 nt, Human
uuuucacauuuu

SEQ ID NO: 2459101 - RNA, 19 nt, Human
uuuucaccagauuugcuaa

SEQ ID NO: 2459102 - RNA, 23 nt, Human
uuuucacauucuuauaaauauga

SEQ ID NO: 2459103 - RNA, 22 nt, Human
uuuucagaaaauauuauguguu

SEQ ID NO: 2459104 - RNA, 18 nt, Human
uuuucacggaaguuuuca

SEQ ID NO: 2459105 - RNA, 17 nt, Human
uuuucacggaaguuuuc

SEQ ID NO: 2459106 - RNA, 15 nt, Human
uuuucacggaaguuu

SEQ ID NO: 2459107 - RNA, 23 nt, Human
uuuucaccuguuuuuaagcuguu

SEQ ID NO: 2459108 - RNA, 13 nt, Human
uuuucaccccacc

SEQ ID NO: 2459109 - RNA, 20 nt, Human
uuuucaccccacccuucccc

SEQ ID NO: 2459110 - RNA, 23 nt, Human
uuuucagaaaauauuauguguuu

SEQ ID NO: 2459111 - RNA, 17 nt, Human
uuuucagaaccucuucc

SEQ ID NO: 2459112 - RNA, 18 nt, Human
uuuucagaaccucuuccc

SEQ ID NO: 2459113 - RNA, 11 nt, Human
uuuucagaccc

SEQ ID NO: 2459114 - RNA, 22 nt, Human
uuuucagaaccucuuccccaga

SEQ ID NO: 2459115 - RNA, 11 nt, Human
uuuucagaccg

SEQ ID NO: 2459116 - RNA, 15 nt, Human
uuuucagaaauaugu

SEQ ID NO: 2459117 - RNA, 13 nt, Human
uuuucagaccgaa

SEQ ID NO: 2459118 - RNA, 14 nt, Human
uuuucagacucaga

SEQ ID NO: 2459119 - RNA, 15 nt, Human
uuuucagauauaaaa

SEQ ID NO: 2459120 - RNA, 13 nt, Human
uuuucccacugca

SEQ ID NO: 2459121 - RNA, 20 nt, Human
uuuucccacugcacccccuc

SEQ ID NO: 2459122 - RNA, 16 nt, Human
uuuucagacucagacu

SEQ ID NO: 2459123 - RNA, 22 nt, Human
uuuucccacugcacccccuccu

SEQ ID NO: 2459124 - RNA, 20 nt, Human
uuuucccagauacuucccau

SEQ ID NO: 2459125 - RNA, 18 nt, Human
uuuucccagcuacaccuu

SEQ ID NO: 2459126 - RNA, 18 nt, Human
uuuucccuauuagagaag

SEQ ID NO: 2459127 - RNA, 22 nt, Human
uuuucccuauuagagaagagau

SEQ ID NO: 2459128 - RNA, 19 nt, Human
uuuucccccuuuucugcau

SEQ ID NO: 2459129 - RNA, 19 nt, Human
uuuuccccccacucucccc

SEQ ID NO: 2459130 - RNA, 16 nt, Human
uuuuccccccuagaaa

SEQ ID NO: 2459131 - RNA, 19 nt, Human
uuuuccccggucccuugag

SEQ ID NO: 2459132 - RNA, 23 nt, Human
uuuuccccggucccuugagaccu

SEQ ID NO: 2459133 - RNA, 18 nt, Human
uuuuccccccacucuccc

SEQ ID NO: 2459134 - RNA, 19 nt, Human
uuuucccagcuacaccuuu

SEQ ID NO: 2459135 - RNA, 13 nt, Human
uuuucuuauuuca

SEQ ID NO: 2459136 - RNA, 21 nt, Human
uuuucuuaaccagaucauugu

SEQ ID NO: 2459137 - RNA, 23 nt, Human
uuuucuacucgaguuacagacaa

SEQ ID NO: 2459138 - RNA, 22 nt, Human
uuuucuacucgaguuacagaca

SEQ ID NO: 2459139 - RNA, 20 nt, Human
uuuucuacucgaguuacaga

SEQ ID NO: 2459140 - RNA, 16 nt, Human
uuuuccccuguccuga

SEQ ID NO: 2459141 - RNA, 12 nt, Human
uuuuccccuccc

SEQ ID NO: 2459142 - RNA, 22 nt, Human
uuuucccucuuuggcuccccug

SEQ ID NO: 2459143 - RNA, 23 nt, Human
uuuucccgagcaaagucuaaagu

SEQ ID NO: 2459144 - RNA, 15 nt, Human
uuuucccuguacagu

SEQ ID NO: 2459145 - RNA, 13 nt, Human
uuuucuacucgag

SEQ ID NO: 2459146 - RNA, 20 nt, Human
uuuuccuaagugauuguaug

SEQ ID NO: 2459147 - RNA, 20 nt, Human
uuuuccuaauaaaguucugu

SEQ ID NO: 2459148 - RNA, 13 nt, Human
uuuuccuaaguga

SEQ ID NO: 2459149 - RNA, 14 nt, Human
uuuuccuaaaugca

SEQ ID NO: 2459150 - RNA, 16 nt, Human
uuuucuuucagccaag

SEQ ID NO: 2459151 - RNA, 16 nt, Human
uuuucuuuaaaagaau

SEQ ID NO: 2459152 - RNA, 15 nt, Human
uuuucuuuaaaagaa

SEQ ID NO: 2459153 - RNA, 16 nt, Human
uuuucuuuaaugcuuu

SEQ ID NO: 2459154 - RNA, 17 nt, Human
uuuugaaauuaaccucu

SEQ ID NO: 2459155 - RNA, 20 nt, Human
uuuugaacuaauaaaagcau

SEQ ID NO: 2459156 - RNA, 21 nt, Human
uuuugaacuaauaaaagcaua

SEQ ID NO: 2459157 - RNA, 22 nt, Human
uuuucuuguguguuuauuguca

SEQ ID NO: 2459158 - RNA, 16 nt, Human
uuuucuucaugcaaug

SEQ ID NO: 2459159 - RNA, 12 nt, Human
uuuucuuuaaaa

SEQ ID NO: 2459160 - RNA, 13 nt, Human
uuuucuucucccu

SEQ ID NO: 2459161 - RNA, 13 nt, Human
uuuucuuacauaa

SEQ ID NO: 2459162 - RNA, 17 nt, Human
uuuucuuaaccaucuuu

SEQ ID NO: 2459163 - RNA, 21 nt, Human
uuuucuucaacaucaauguuc

SEQ ID NO: 2459164 - RNA, 22 nt, Human
uuuucuucaacaucaauguuca

SEQ ID NO: 2459165 - RNA, 15 nt, Human
uuuucuucacugucc

SEQ ID NO: 2459166 - RNA, 20 nt, Human
uuuuaugacuucauuaauaa

SEQ ID NO: 2459167 - RNA, 21 nt, Human
uuuuaugacuucauuaauaau

SEQ ID NO: 2459168 - RNA, 19 nt, Human
uuuuaucuuucgugauaaa

SEQ ID NO: 2459169 - RNA, 23 nt, Human
uuuuaugaagaaaaaauacauuu

SEQ ID NO: 2459170 - RNA, 19 nt, Human
uuuuaucgucacugcuuaa

SEQ ID NO: 2459171 - RNA, 23 nt, Human
uuuuaucuccccuucacaugcau

SEQ ID NO: 2459172 - RNA, 20 nt, Human
uuuuauuuuguaauuauugu

SEQ ID NO: 2459173 - RNA, 16 nt, Human
uuuuauuuuguaauua

SEQ ID NO: 2459174 - RNA, 15 nt, Human
uuuuauuuuguaauu

SEQ ID NO: 2459175 - RNA, 21 nt, Human
uuuuauuuuucucaugaugag

SEQ ID NO: 2459176 - RNA, 18 nt, Human
uuuuauuuuuagacagag

SEQ ID NO: 2459177 - RNA, 18 nt, Human
uuuuauuuuucuaaaaaa

SEQ ID NO: 2459178 - RNA, 11 nt, Human
uuuuauauuua

SEQ ID NO: 2459179 - RNA, 13 nt, Human
uuuuauuuuucua

SEQ ID NO: 2459180 - RNA, 17 nt, Human
uuuuauuuuuuucuacc

SEQ ID NO: 2459181 - RNA, 17 nt, Human
uuuucaaaauaaaaaug

SEQ ID NO: 2459182 - RNA, 18 nt, Human
uuuuauauuugaaauauu

SEQ ID NO: 2459183 - RNA, 13 nt, Human
uuuuauauuugaa

SEQ ID NO: 2459184 - RNA, 23 nt, Human
uuuuauauuuaguuauaguuuca

SEQ ID NO: 2459185 - RNA, 13 nt, Human
uuuuauauuuagu

SEQ ID NO: 2459186 - RNA, 13 nt, Human
uuuuauacauaaa

SEQ ID NO: 2459187 - RNA, 21 nt, Human
uuuuauacauaaacaagacca

SEQ ID NO: 2459188 - RNA, 13 nt, Human
uuuuauacucuuu

SEQ ID NO: 2459189 - RNA, 18 nt, Human
uuuuauacucuuucugua

SEQ ID NO: 2459190 - RNA, 19 nt, Human
uuuuauacacauaauuaaa

SEQ ID NO: 2459191 - RNA, 16 nt, Human
uuuuauagauuugacc

SEQ ID NO: 2459192 - RNA, 19 nt, Human
uuuuauacucuuucuguau

SEQ ID NO: 2459193 - RNA, 12 nt, Human
uuuuauacugua

SEQ ID NO: 2459194 - RNA, 15 nt, Human
uuuuauacuguacuu

SEQ ID NO: 2459195 - RNA, 12 nt, Human
uuuuacaauaaa

SEQ ID NO: 2459196 - RNA, 17 nt, Human
uuuuacaauaaaaucuu

SEQ ID NO: 2459197 - RNA, 18 nt, Human
uuuuacaauaaauaaucu

SEQ ID NO: 2459198 - RNA, 14 nt, Human
uuuuacaauugaaa

SEQ ID NO: 2459199 - RNA, 17 nt, Human
uuuuaaauaaaagcagc

SEQ ID NO: 2459200 - RNA, 19 nt, Human
uuuuacaaaaaagaaaaga

SEQ ID NO: 2459201 - RNA, 19 nt, Human
uuuuaaagugauuaaacgu

SEQ ID NO: 2459202 - RNA, 15 nt, Human
uuuuaaauaaaagca

SEQ ID NO: 2459203 - RNA, 17 nt, Human
uuuuaaauaaaagugau

SEQ ID NO: 2459204 - RNA, 21 nt, Human
uuuuaaaguaacccuacaaaa

SEQ ID NO: 2459205 - RNA, 13 nt, Human
uuuuaaacugugu

SEQ ID NO: 2459206 - RNA, 20 nt, Human
uuuuaaacuguguacauaac

SEQ ID NO: 2459207 - RNA, 23 nt, Human
uuuuaaacuguguacauaacuga

SEQ ID NO: 2459208 - RNA, 16 nt, Human
uuuuaaaguauauauu

SEQ ID NO: 2459209 - RNA, 22 nt, Human
uuuuaaaguauguuauugcaua

SEQ ID NO: 2459210 - RNA, 14 nt, Human
uuuuaaagugauua

SEQ ID NO: 2459211 - RNA, 21 nt, Human
uuuuauaauuuugugaagcaa

SEQ ID NO: 2459212 - RNA, 15 nt, Human
uuuuacuaauagaca

SEQ ID NO: 2459213 - RNA, 23 nt, Human
uuuuauaauuuugugaagcaaaa

SEQ ID NO: 2459214 - RNA, 14 nt, Human
uuuuacuacugugg

SEQ ID NO: 2459215 - RNA, 15 nt, Human
uuuuauacacauaau

SEQ ID NO: 2459216 - RNA, 13 nt, Human
uuuuauacacaua

SEQ ID NO: 2459217 - RNA, 17 nt, Human
uuuuaccguuucuuccc

SEQ ID NO: 2459218 - RNA, 18 nt, Human
uuuuaccguuucuucccu

SEQ ID NO: 2459219 - RNA, 18 nt, Human
uuuuaccuaccacagugu

SEQ ID NO: 2459220 - RNA, 19 nt, Human
uuuuaccuaccacaguguc

SEQ ID NO: 2459221 - RNA, 20 nt, Human
uuuuaccuaccacagugucu

SEQ ID NO: 2459222 - RNA, 16 nt, Human
uuuuacaauugaaaug

SEQ ID NO: 2459223 - RNA, 19 nt, Human
uuuuacguccaucucuugu

SEQ ID NO: 2459224 - RNA, 21 nt, Human
uuuuaccuaccacagugucug

SEQ ID NO: 2459225 - RNA, 22 nt, Human
uuuuacuaaagaaagauuacuu

SEQ ID NO: 2459226 - RNA, 13 nt, Human
uuuuacuaaagaa

SEQ ID NO: 2459227 - RNA, 20 nt, Human
uuuguuauuuucaguauuuu

SEQ ID NO: 2459228 - RNA, 18 nt, Human
uuuguuauuuguacaguu

SEQ ID NO: 2459229 - RNA, 17 nt, Human
uuuguuauuuguacagu

SEQ ID NO: 2459230 - RNA, 19 nt, Human
uuuguuauuuguacaguuc

SEQ ID NO: 2459231 - RNA, 14 nt, Human
uuuguugcuguuuu

SEQ ID NO: 2459232 - RNA, 23 nt, Human
uuuguuggaagguuuggugugug

SEQ ID NO: 2459233 - RNA, 15 nt, Human
uuuguugucagcuga

SEQ ID NO: 2459234 - RNA, 17 nt, Human
uuuguguguugucuuga

SEQ ID NO: 2459235 - RNA, 15 nt, Human
uuuguguguugucuu

SEQ ID NO: 2459236 - RNA, 18 nt, Human
uuuguguguugucuugaa

SEQ ID NO: 2459237 - RNA, 17 nt, Human
uuuguguguugucucuu

SEQ ID NO: 2459238 - RNA, 22 nt, Human
uuuguuaguaugaggcauuugu

SEQ ID NO: 2459239 - RNA, 13 nt, Human
uuuguuaccuuua

SEQ ID NO: 2459240 - RNA, 12 nt, Human
uuuguuauuugu

SEQ ID NO: 2459241 - RNA, 23 nt, Human
uuuuaaaauccacuuuaucuuga

SEQ ID NO: 2459242 - RNA, 13 nt, Human
uuuuaaacaguga

SEQ ID NO: 2459243 - RNA, 23 nt, Human
uuuuaaacaaaauagaagcugua

SEQ ID NO: 2459244 - RNA, 21 nt, Human
uuuuaaaccauaaaaagcuga

SEQ ID NO: 2459245 - RNA, 19 nt, Human
uuuuaaacagugagccuga

SEQ ID NO: 2459246 - RNA, 20 nt, Human
uuuuaaacccuauugguaaa

SEQ ID NO: 2459247 - RNA, 22 nt, Human
uuuuaaaaguuucaaugugauu

SEQ ID NO: 2459248 - RNA, 21 nt, Human
uuuuaaaaguuucaaugugau

SEQ ID NO: 2459249 - RNA, 19 nt, Human
uuuuaaaaguuucaaugug

SEQ ID NO: 2459250 - RNA, 12 nt, Human
uuuguuguaaaa

SEQ ID NO: 2459251 - RNA, 18 nt, Human
uuuuaaaaguuucaaugu

SEQ ID NO: 2459252 - RNA, 14 nt, Human
uuuuaaaauccacu

SEQ ID NO: 2459253 - RNA, 14 nt, Human
uuuuaaaauaucuu

SEQ ID NO: 2459254 - RNA, 20 nt, Human
uuuuaaaauaucuuuugacc

SEQ ID NO: 2459255 - RNA, 14 nt, Human
uuuguauucucuga

SEQ ID NO: 2459256 - RNA, 16 nt, Human
uuuguauucucugagc

SEQ ID NO: 2459257 - RNA, 15 nt, Human
uuuguauucucuccu

SEQ ID NO: 2459258 - RNA, 21 nt, Human
uuuguauuguuucaauugcau

SEQ ID NO: 2459259 - RNA, 23 nt, Human
uuuguauuuuccaagugugcaua

SEQ ID NO: 2459260 - RNA, 17 nt, Human
uuuguauuuuguuuaaa

SEQ ID NO: 2459261 - RNA, 15 nt, Human
uuuguauuuuccaag

SEQ ID NO: 2459262 - RNA, 10 nt, Human
uuuguauuuu

SEQ ID NO: 2459263 - RNA, 14 nt, Human
uuugugugauugaa

SEQ ID NO: 2459264 - RNA, 22 nt, Human
uuugugucaaugggcaaugaca

SEQ ID NO: 2459265 - RNA, 12 nt, Human
uuugugugagag

SEQ ID NO: 2459266 - RNA, 13 nt, Human
uuugugugauuga

SEQ ID NO: 2459267 - RNA, 14 nt, Human
uuugugugagagac

SEQ ID NO: 2459268 - RNA, 14 nt, Human
uuuguguguagucu

SEQ ID NO: 2459269 - RNA, 13 nt, Human
uuugugugucuua

SEQ ID NO: 2459270 - RNA, 21 nt, Human
uuugugucauguuuaagaaau

SEQ ID NO: 2459271 - RNA, 20 nt, Human
uuuguguauuuaacagggag

SEQ ID NO: 2459272 - RNA, 14 nt, Human
uuuguauuuuuagu

SEQ ID NO: 2459273 - RNA, 17 nt, Human
uuuguauuuuuuugcaa

SEQ ID NO: 2459274 - RNA, 14 nt, Human
uuuguauuuuuaau

SEQ ID NO: 2459275 - RNA, 13 nt, Human
uuuguguauuuaa

SEQ ID NO: 2459276 - RNA, 19 nt, Human
uuuguauaaaauaauuuuu

SEQ ID NO: 2459277 - RNA, 18 nt, Human
uuuguauaaaauaauuuu

SEQ ID NO: 2459278 - RNA, 17 nt, Human
uuuguauaaaauaauuu

SEQ ID NO: 2459279 - RNA, 17 nt, Human
uuuggucuacacugugc

SEQ ID NO: 2459280 - RNA, 15 nt, Human
uuuggucaacacuaa

SEQ ID NO: 2459281 - RNA, 13 nt, Human
uuuggucccuggg

SEQ ID NO: 2459282 - RNA, 23 nt, Human
uuuggucccgugcagcuucuguc

SEQ ID NO: 2459283 - RNA, 14 nt, Human
uuugguauuguauu

SEQ ID NO: 2459284 - RNA, 22 nt, Human
uuugguauuacacuguauuugu

SEQ ID NO: 2459285 - RNA, 17 nt, Human
uuuggaccccagcuggg

SEQ ID NO: 2459286 - RNA, 13 nt, Human
uuugguauuguau

SEQ ID NO: 2459287 - RNA, 16 nt, Human
uuuggaccccagcugg

SEQ ID NO: 2459288 - RNA, 19 nt, Human
uuugguaucuguucuuuaa

SEQ ID NO: 2459289 - RNA, 15 nt, Human
uuuggaaaaugcauu

SEQ ID NO: 2459290 - RNA, 23 nt, Human
uuugcauuuaaaacagacacugg

SEQ ID NO: 2459291 - RNA, 12 nt, Human
uuuggaaaauaa

SEQ ID NO: 2459292 - RNA, 13 nt, Human
uuuggacccugag

SEQ ID NO: 2459293 - RNA, 18 nt, Human
uuugcauaacguauaaaa

SEQ ID NO: 2459294 - RNA, 17 nt, Human
uuugcauaacaauuccu

SEQ ID NO: 2459295 - RNA, 18 nt, Human
uuugcauaacaauuccuc

SEQ ID NO: 2459296 - RNA, 16 nt, Human
uuugcauaacaauucc

SEQ ID NO: 2459297 - RNA, 21 nt, Human
uuugcaguagagucaucucca

SEQ ID NO: 2459298 - RNA, 14 nt, Human
uuugcagguugcuu

SEQ ID NO: 2459299 - RNA, 20 nt, Human
uuugcacuggaguucuaugc

SEQ ID NO: 2459300 - RNA, 16 nt, Human
uuugcaggcaugcaug

SEQ ID NO: 2459301 - RNA, 22 nt, Human
uuugcacugagggccacacuau

SEQ ID NO: 2459302 - RNA, 12 nt, Human
uuugcaggcuca

SEQ ID NO: 2459303 - RNA, 20 nt, Human
uuugcauaacaauuccucua

SEQ ID NO: 2459304 - RNA, 22 nt, Human
uuugcauaacaauuccucuacu

SEQ ID NO: 2459305 - RNA, 17 nt, Human
uuugcauuaaauucaca

SEQ ID NO: 2459306 - RNA, 18 nt, Human
uuugcauuaaauucacaa

SEQ ID NO: 2459307 - RNA, 14 nt, Human
uuugcauucaaauu

SEQ ID NO: 2459308 - RNA, 13 nt, Human
uuugcauucaaau

SEQ ID NO: 2459309 - RNA, 12 nt, Human
uuugcauucaaa

SEQ ID NO: 2459310 - RNA, 21 nt, Human
uuugcauuaaauucacaaacu

SEQ ID NO: 2459311 - RNA, 22 nt, Human
uuugcauuaaauucacaaacuu

SEQ ID NO: 2459312 - RNA, 16 nt, Human
uuugcauuuaaaacag

SEQ ID NO: 2459313 - RNA, 17 nt, Human
uuugcauuuaaaacaga

SEQ ID NO: 2459314 - RNA, 19 nt, Human
uuugcauuuaaaacagaca

SEQ ID NO: 2459315 - RNA, 21 nt, Human
uuugcauuuaaaacagacacu

SEQ ID NO: 2459316 - RNA, 19 nt, Human
uuugcauugaacacaaacu

SEQ ID NO: 2459317 - RNA, 17 nt, Human
uuugcauucaaauuaag

SEQ ID NO: 2459318 - RNA, 15 nt, Human
uuugcauucaaauua

SEQ ID NO: 2459319 - RNA, 14 nt, Human
uuugcauuccuaca

SEQ ID NO: 2459320 - RNA, 15 nt, Human
uuuccacagaagcuc

SEQ ID NO: 2459321 - RNA, 16 nt, Human
uuuccaagugugcaua

SEQ ID NO: 2459322 - RNA, 19 nt, Human
uuuccaccacagccagcac

SEQ ID NO: 2459323 - RNA, 23 nt, Human
uuuccacauaaggaaacuggguu

SEQ ID NO: 2459324 - RNA, 20 nt, Human
uuuccacauaaggaaacugg

SEQ ID NO: 2459325 - RNA, 17 nt, Human
uuuccacaccuggcacu

SEQ ID NO: 2459326 - RNA, 22 nt, Human
uuuccacaagauucccagagac

SEQ ID NO: 2459327 - RNA, 19 nt, Human
uuuccacaaaaucugucca

SEQ ID NO: 2459328 - RNA, 15 nt, Human
uuuccacaaaucagu

SEQ ID NO: 2459329 - RNA, 20 nt, Human
uuuccacaagauucccagag

SEQ ID NO: 2459330 - RNA, 17 nt, Human
uuuccguuaaaauacca

SEQ ID NO: 2459331 - RNA, 13 nt, Human
uuugagugccuua

SEQ ID NO: 2459332 - RNA, 15 nt, Human
uuuccguuaaaauac

SEQ ID NO: 2459333 - RNA, 21 nt, Human
uuugagugccuuacacaaugg

SEQ ID NO: 2459334 - RNA, 13 nt, Human
uuugagugcucug

SEQ ID NO: 2459335 - RNA, 16 nt, Human
uuuccguggcacugca

SEQ ID NO: 2459336 - RNA, 12 nt, Human
uuugaguucuac

SEQ ID NO: 2459337 - RNA, 14 nt, Human
uuugaguguuuuaa

SEQ ID NO: 2459338 - RNA, 21 nt, Human
uuugaguggaugauguuucgu

SEQ ID NO: 2459339 - RNA, 14 nt, Human
uuugagugcucuga

SEQ ID NO: 2459340 - RNA, 16 nt, Human
uuugaguggaugaugu

SEQ ID NO: 2459341 - RNA, 20 nt, Human
uuugaguggaugauguuucg

SEQ ID NO: 2459342 - RNA, 16 nt, Human
uuugcaccugcucucu

SEQ ID NO: 2459343 - RNA, 16 nt, Human
uuugcaccccucccau

SEQ ID NO: 2459344 - RNA, 15 nt, Human
uuugcaccccuccca

SEQ ID NO: 2459345 - RNA, 13 nt, Human
uuugcaccccucc

SEQ ID NO: 2459346 - RNA, 12 nt, Human
uuugcaccccuc

SEQ ID NO: 2459347 - RNA, 20 nt, Human
uuugcaccccaugcuguuga

SEQ ID NO: 2459348 - RNA, 18 nt, Human
uuugcaccccaugcuguu

SEQ ID NO: 2459349 - RNA, 17 nt, Human
uuugcaccccaugcugu

SEQ ID NO: 2459350 - RNA, 19 nt, Human
uuugaguuauuuuaauuau

SEQ ID NO: 2459351 - RNA, 17 nt, Human
uuugcacugagggccac

SEQ ID NO: 2459352 - RNA, 16 nt, Human
uuugcacugagggcca

SEQ ID NO: 2459353 - RNA, 18 nt, Human
uuugcacugauauaucau

SEQ ID NO: 2459354 - RNA, 14 nt, Human
uuugcacugagggc

SEQ ID NO: 2459355 - RNA, 12 nt, Human
uuugcacugagg

SEQ ID NO: 2459356 - RNA, 18 nt, Human
uuuuucaugauuuugaaa

SEQ ID NO: 2459357 - RNA, 11 nt, Human
uuuuucaugau

SEQ ID NO: 2459358 - RNA, 10 nt, Human
uuuuucaugu

SEQ ID NO: 2459359 - RNA, 11 nt, Human
uuuuucauguu

SEQ ID NO: 2459360 - RNA, 18 nt, Human
uuuuucauguuuuaacaa

SEQ ID NO: 2459361 - RNA, 13 nt, Human
uuuuucauauugu

SEQ ID NO: 2459362 - RNA, 14 nt, Human
uuuuucagaccgaa

SEQ ID NO: 2459363 - RNA, 15 nt, Human
uuuuucaguuuucag

SEQ ID NO: 2459364 - RNA, 12 nt, Human
uuuuucaguuuu

SEQ ID NO: 2459365 - RNA, 16 nt, Human
uuuuuccaaaaaaaua

SEQ ID NO: 2459366 - RNA, 13 nt, Human
uuuuuccaaaaaa

SEQ ID NO: 2459367 - RNA, 19 nt, Human
uuuuuccaaaaaaauacug

SEQ ID NO: 2459368 - RNA, 14 nt, Human
uuuuuccaacugug

SEQ ID NO: 2459369 - RNA, 21 nt, Human
uuuuuccacauaaggaaacug

SEQ ID NO: 2459370 - RNA, 20 nt, Human
uuuuuccacuuuguucuuua

SEQ ID NO: 2459371 - RNA, 14 nt, Human
uuuuuccacuuugu

SEQ ID NO: 2459372 - RNA, 12 nt, Human
uuuuuccaggcu

SEQ ID NO: 2459373 - RNA, 20 nt, Human
uuuuucauguuuuaacaaaa

SEQ ID NO: 2459374 - RNA, 21 nt, Human
uuuuucauugauaugaaaaau

SEQ ID NO: 2459375 - RNA, 13 nt, Human
uuuuuaaucuuua

SEQ ID NO: 2459376 - RNA, 17 nt, Human
uuuuuaaucaugaaauu

SEQ ID NO: 2459377 - RNA, 13 nt, Human
uuuuuaaucauga

SEQ ID NO: 2459378 - RNA, 20 nt, Human
uuuuuaauaaagacaggguu

SEQ ID NO: 2459379 - RNA, 17 nt, Human
uuuuuaauaaagacagg

SEQ ID NO: 2459380 - RNA, 18 nt, Human
uuuuuaauaaaaaggcac

SEQ ID NO: 2459381 - RNA, 18 nt, Human
uuuuuaaguuacacauuu

SEQ ID NO: 2459382 - RNA, 20 nt, Human
uuuuucaauuaaacggauua

SEQ ID NO: 2459383 - RNA, 19 nt, Human
uuuuucaauuaaacggauu

SEQ ID NO: 2459384 - RNA, 18 nt, Human
uuuuucaauuaaacggau

SEQ ID NO: 2459385 - RNA, 17 nt, Human
uuuuucaauuaaacgga

SEQ ID NO: 2459386 - RNA, 16 nt, Human
uuuuucacggaaguuu

SEQ ID NO: 2459387 - RNA, 21 nt, Human
uuuuucaauuaaacggauuau

SEQ ID NO: 2459388 - RNA, 13 nt, Human
uuuuucacauuuu

SEQ ID NO: 2459389 - RNA, 22 nt, Human
uuuuucacggaaguuuucaaug

SEQ ID NO: 2459390 - RNA, 19 nt, Human
uuuuucacggaaguuuuca

SEQ ID NO: 2459391 - RNA, 10 nt, Human
uuuuucagac

SEQ ID NO: 2459392 - RNA, 14 nt, Human
uuuuucagaaauau

SEQ ID NO: 2459393 - RNA, 12 nt, Human
uuuuucagaccg

SEQ ID NO: 2459394 - RNA, 11 nt, Human
uuuuucagacc

SEQ ID NO: 2459395 - RNA, 21 nt, Human
uuuuucagcagacuaugaaua

SEQ ID NO: 2459396 - RNA, 15 nt, Human
uuuuucaauuaaacg

SEQ ID NO: 2459397 - RNA, 14 nt, Human
uuuuucaauuaaac

SEQ ID NO: 2459398 - RNA, 13 nt, Human
uuuuucaauuaaa

SEQ ID NO: 2459399 - RNA, 19 nt, Human
uuuuuaaugugcuguguaa

SEQ ID NO: 2459400 - RNA, 12 nt, Human
uuuuuaaugugc

SEQ ID NO: 2459401 - RNA, 17 nt, Human
uuuuuaaugugcugugu

SEQ ID NO: 2459402 - RNA, 15 nt, Human
uuuuuaaucaugaaa

SEQ ID NO: 2459403 - RNA, 19 nt, Human
uuuugacaguguugaaaau

SEQ ID NO: 2459404 - RNA, 23 nt, Human
uuuugacaguguugaaaauguuc

SEQ ID NO: 2459405 - RNA, 15 nt, Human
uuuugaauaaaaacu

SEQ ID NO: 2459406 - RNA, 10 nt, Human
uuuugaagug

SEQ ID NO: 2459407 - RNA, 19 nt, Human
uuuugaaguaguuuguaua

SEQ ID NO: 2459408 - RNA, 22 nt, Human
uuuugaaguguaggcagacaca

SEQ ID NO: 2459409 - RNA, 13 nt, Human
uuuugaaggcaaa

SEQ ID NO: 2459410 - RNA, 14 nt, Human
uuuugaaggcaaaa

SEQ ID NO: 2459411 - RNA, 24 nt, Human
uuuugacaguguugaaaauguuca

SEQ ID NO: 2459412 - RNA, 18 nt, Human
uuuugaccuguggugcaa

SEQ ID NO: 2459413 - RNA, 11 nt, Human
uuuugaagugu

SEQ ID NO: 2459414 - RNA, 17 nt, Human
uuuugacuuaaagcaga

SEQ ID NO: 2459415 - RNA, 20 nt, Human
uuuugacggaugauuggauu

SEQ ID NO: 2459416 - RNA, 15 nt, Human
uuuugacggaugauu

SEQ ID NO: 2459417 - RNA, 22 nt, Human
uuuugacuagggauucaggcug

SEQ ID NO: 2459418 - RNA, 20 nt, Human
uuuuuaaauuuuauuuccug

SEQ ID NO: 2459419 - RNA, 12 nt, Human
uuuuuaaccaaa

SEQ ID NO: 2459420 - RNA, 20 nt, Human
uuuuuaaauguaaagauauu

SEQ ID NO: 2459421 - RNA, 21 nt, Human
uuuugacucuggcaaagcuuu

SEQ ID NO: 2459422 - RNA, 18 nt, Human
uuuuuaagugcugcauuu

SEQ ID NO: 2459423 - RNA, 19 nt, Human
uuuuuaagugcugcauuua

SEQ ID NO: 2459424 - RNA, 22 nt, Human
uuuuuaagugcugcauuuaaaa

SEQ ID NO: 2459425 - RNA, 23 nt, Human
uuuuuaagugcugcauuuaaaag

SEQ ID NO: 2459426 - RNA, 16 nt, Human
uuuuuaagugcugcau

SEQ ID NO: 2459427 - RNA, 17 nt, Human
uuuuuaagugcugcauu

SEQ ID NO: 2459428 - RNA, 12 nt, Human
uuuuuaagaaaa

SEQ ID NO: 2459429 - RNA, 23 nt, Human
uuuuuaagaaaaaggaugcacag

SEQ ID NO: 2459430 - RNA, 22 nt, Human
uuuuuaacucaauauuuuccau

SEQ ID NO: 2459431 - RNA, 12 nt, Human
uuuuuuucuuua

SEQ ID NO: 2459432 - RNA, 12 nt, Human
uuuuuuugagau

SEQ ID NO: 2459433 - RNA, 14 nt, Human
uuuuuuucuaagag

SEQ ID NO: 2459434 - RNA, 10 nt, Human
uuuuuuucca

SEQ ID NO: 2459435 - RNA, 12 nt, Human
uuuuuuuuaaga

SEQ ID NO: 2459436 - RNA, 11 nt, Human
uuuuuuuacua

SEQ ID NO: 2459437 - RNA, 13 nt, Human
uuuuuuuaaugug

SEQ ID NO: 2459438 - RNA, 13 nt, Human
uuuuuuccaucuu

SEQ ID NO: 2459439 - RNA, 22 nt, Human
uuuuuuccaucuuuacaaaacu

SEQ ID NO: 2459440 - RNA, 13 nt, Human
uuuuuuccacuua

SEQ ID NO: 2459441 - RNA, 15 nt, Human
uuuuuuaaugugcug

SEQ ID NO: 2459442 - RNA, 12 nt, Human
uuuuuuaauuuu

SEQ ID NO: 2459443 - RNA, 16 nt, Human
uuuuuuaaugugcugu

SEQ ID NO: 2459444 - RNA, 16 nt, Human
uuuuuuauuguuuaaa

SEQ ID NO: 2459445 - RNA, 12 nt, Human
uuuuuucagacc

SEQ ID NO: 2459446 - RNA, 11 nt, Human
uuuuuucagac

SEQ ID NO: 2459447 - RNA, 18 nt, Human
uuuuuucaauauuuauua

SEQ ID NO: 2459448 - RNA, 20 nt, Human
uuuuuucauguuuuaacaaa

SEQ ID NO: 2459449 - RNA, 14 nt, Human
uuuuuucagaccga

SEQ ID NO: 2459450 - RNA, 12 nt, Human
uuuuuucaucuu

SEQ ID NO: 2459451 - RNA, 12 nt, Human
uuuuuuaagauu

SEQ ID NO: 2459452 - RNA, 17 nt, Human
uuuuuuaaguauuuaua

SEQ ID NO: 2459453 - RNA, 11 nt, Human
uuuuuuaagau

SEQ ID NO: 2459454 - RNA, 19 nt, Human
uuuuuuaaccaaaggugaa

SEQ ID NO: 2459455 - RNA, 16 nt, Human
uuuuuccccaaagucu

SEQ ID NO: 2459456 - RNA, 15 nt, Human
uuuuuccccaaaguc

SEQ ID NO: 2459457 - RNA, 14 nt, Human
uuuuuccccaaagu

SEQ ID NO: 2459458 - RNA, 13 nt, Human
uuuuuccaucuuu

SEQ ID NO: 2459459 - RNA, 19 nt, Human
uuuuucccagcuacaccuu

SEQ ID NO: 2459460 - RNA, 20 nt, Human
uuguacauuuaugauuuaau

SEQ ID NO: 2459461 - RNA, 17 nt, Human
uuguacauuuaugauuu

SEQ ID NO: 2459462 - RNA, 21 nt, Human
uuguacauauuuguggaauaa

SEQ ID NO: 2459463 - RNA, 16 nt, Human
uuguacauaguuauuu

SEQ ID NO: 2459464 - RNA, 21 nt, Human
uuguacauguguagccugugc

SEQ ID NO: 2459465 - RNA, 20 nt, Human
uuguacauguguagccugug

SEQ ID NO: 2459466 - RNA, 15 nt, Human
uuguacauauuugug

SEQ ID NO: 2459467 - RNA, 18 nt, Human
uuguacauauguaaaaua

SEQ ID NO: 2459468 - RNA, 22 nt, Human
uuguaugccuuuaaaucuguga

SEQ ID NO: 2459469 - RNA, 21 nt, Human
uuguaugccuuuaaaucugug

SEQ ID NO: 2459470 - RNA, 14 nt, Human
uuguacuguaaaga

SEQ ID NO: 2459471 - RNA, 12 nt, Human
uuguacuguaaa

SEQ ID NO: 2459472 - RNA, 16 nt, Human
uuguauguaaaugugc

SEQ ID NO: 2459473 - RNA, 13 nt, Human
uuguauguaaaug

SEQ ID NO: 2459474 - RNA, 23 nt, Human
uuguaugccuuuaaaucugugau

SEQ ID NO: 2459475 - RNA, 19 nt, Human
uuguauguuaaguuacuuc

SEQ ID NO: 2459476 - RNA, 17 nt, Human
uuguauguguguagaca

SEQ ID NO: 2459477 - RNA, 18 nt, Human
uuguauguaaaugugcau

SEQ ID NO: 2459478 - RNA, 13 nt, Human
uuguauuaaacuc

SEQ ID NO: 2459479 - RNA, 15 nt, Human
uuguauuaaacucuu

SEQ ID NO: 2459480 - RNA, 14 nt, Human
uuguauuaaagaca

SEQ ID NO: 2459481 - RNA, 22 nt, Human
uugucguugacuuuagggacuc

SEQ ID NO: 2459482 - RNA, 17 nt, Human
uugucuaaaacaauaaa

SEQ ID NO: 2459483 - RNA, 18 nt, Human
uugucuaaaacaauaaaa

SEQ ID NO: 2459484 - RNA, 16 nt, Human
uuguauuaaacucuuc

SEQ ID NO: 2459485 - RNA, 19 nt, Human
uuguauucucuccuguacc

SEQ ID NO: 2459486 - RNA, 22 nt, Human
uugucuaaaaugccucagugua

SEQ ID NO: 2459487 - RNA, 11 nt, Human
uugucuaaaau

SEQ ID NO: 2459488 - RNA, 15 nt, Human
uuguauucucuccug

SEQ ID NO: 2459489 - RNA, 16 nt, Human
uuguauucucuccugu

SEQ ID NO: 2459490 - RNA, 21 nt, Human
uuguauucagaguugaugguu

SEQ ID NO: 2459491 - RNA, 13 nt, Human
uuguauuaagaau

SEQ ID NO: 2459492 - RNA, 18 nt, Human
uuguauuaagaaugaaau

SEQ ID NO: 2459493 - RNA, 12 nt, Human
uuguauuaagaa

SEQ ID NO: 2459494 - RNA, 16 nt, Human
uuguauuaaagacaga

SEQ ID NO: 2459495 - RNA, 12 nt, Human
uugucucccugg

SEQ ID NO: 2459496 - RNA, 17 nt, Human
uugucucccuggcccuc

SEQ ID NO: 2459497 - RNA, 16 nt, Human
uugucucccuggcccu

SEQ ID NO: 2459498 - RNA, 15 nt, Human
uugucucccuggccc

SEQ ID NO: 2459499 - RNA, 14 nt, Human
uugucucccuggcc

SEQ ID NO: 2459500 - RNA, 20 nt, Human
uugucugaagucacugcaca

SEQ ID NO: 2459501 - RNA, 21 nt, Human
uugucugaagucacugcacag

SEQ ID NO: 2459502 - RNA, 15 nt, Human
uugucuuaaaaagug

SEQ ID NO: 2459503 - RNA, 15 nt, Human
uugucuagugaaacu

SEQ ID NO: 2459504 - RNA, 17 nt, Human
uugucucaaugcucaua

SEQ ID NO: 2459505 - RNA, 16 nt, Human
uugucucaaugcucau

SEQ ID NO: 2459506 - RNA, 18 nt, Human
uugucucaaugcucauaa

SEQ ID NO: 2459507 - RNA, 16 nt, Human
uugugauuuuuguaau

SEQ ID NO: 2459508 - RNA, 17 nt, Human
uugugauuuuuguaauu

SEQ ID NO: 2459509 - RNA, 12 nt, Human
uugugauuuuug

SEQ ID NO: 2459510 - RNA, 14 nt, Human
uugugaaaugaugg

SEQ ID NO: 2459511 - RNA, 23 nt, Human
uugugauuucccguggccccagc

SEQ ID NO: 2459512 - RNA, 20 nt, Human
uugugaaaggaaagaggcuc

SEQ ID NO: 2459513 - RNA, 21 nt, Human
uugugaaauaaaacuggcuuu

SEQ ID NO: 2459514 - RNA, 17 nt, Human
uugugaaaugaaaacau

SEQ ID NO: 2459515 - RNA, 19 nt, Human
uugucugugcauccggggg

SEQ ID NO: 2459516 - RNA, 16 nt, Human
uuggguucaucugagc

SEQ ID NO: 2459517 - RNA, 22 nt, Human
uuggguucaagcgauucuucug

SEQ ID NO: 2459518 - RNA, 15 nt, Human
uugcacggcugcuga

SEQ ID NO: 2459519 - RNA, 14 nt, Human
uugcacggcugcug

SEQ ID NO: 2459520 - RNA, 15 nt, Human
uugcacguggccucu

SEQ ID NO: 2459521 - RNA, 17 nt, Human
uugcacgcccaugugug

SEQ ID NO: 2459522 - RNA, 18 nt, Human
uugcacgcccauguguga

SEQ ID NO: 2459523 - RNA, 20 nt, Human
uugcacgcccaugugugagu

SEQ ID NO: 2459524 - RNA, 14 nt, Human
uugcacuccagccu

SEQ ID NO: 2459525 - RNA, 21 nt, Human
uuggguguaacaggucuccuc

SEQ ID NO: 2459526 - RNA, 23 nt, Human
uuggguguaacaggucuccucuu

SEQ ID NO: 2459527 - RNA, 19 nt, Human
uugcacuaaaguauguaaa

SEQ ID NO: 2459528 - RNA, 15 nt, Human
uugcacuaaaguaug

SEQ ID NO: 2459529 - RNA, 21 nt, Human
uugguauuguauuuauucaau

SEQ ID NO: 2459530 - RNA, 14 nt, Human
uugguauuguauuu

SEQ ID NO: 2459531 - RNA, 13 nt, Human
uugguauuguauu

SEQ ID NO: 2459532 - RNA, 18 nt, Human
uugguaucuguucuuuaa

SEQ ID NO: 2459533 - RNA, 12 nt, Human
uugguauuguau

SEQ ID NO: 2459534 - RNA, 17 nt, Human
uugguaucaagaaaguc

SEQ ID NO: 2459535 - RNA, 16 nt, Human
uugguaucaagaaagu

SEQ ID NO: 2459536 - RNA, 13 nt, Human
uugguagagauuc

SEQ ID NO: 2459537 - RNA, 15 nt, Human
uugguagagauucau

SEQ ID NO: 2459538 - RNA, 22 nt, Human
uugguacuacuagaugucuuua

SEQ ID NO: 2459539 - RNA, 16 nt, Human
uuggucugugagaugc

SEQ ID NO: 2459540 - RNA, 13 nt, Human
uuggucuguguga

SEQ ID NO: 2459541 - RNA, 15 nt, Human
uugguccaggaaaug

SEQ ID NO: 2459542 - RNA, 15 nt, Human
uuggucuuauuuauu

SEQ ID NO: 2459543 - RNA, 19 nt, Human
uuggucuuauuuauuauug

SEQ ID NO: 2459544 - RNA, 22 nt, Human
uuguaaaaauuaaaaguuaugg

SEQ ID NO: 2459545 - RNA, 15 nt, Human
uuguaaauuaacuuu

SEQ ID NO: 2459546 - RNA, 16 nt, Human
uuguaaauuaacuuuu

SEQ ID NO: 2459547 - RNA, 18 nt, Human
uuguaaauuaacuuuuau

SEQ ID NO: 2459548 - RNA, 23 nt, Human
uuguaaauuaacuuuuauaaacu

SEQ ID NO: 2459549 - RNA, 18 nt, Human
uuguacauaaugcgugca

SEQ ID NO: 2459550 - RNA, 14 nt, Human
uuguacauaaugcg

SEQ ID NO: 2459551 - RNA, 16 nt, Human
uuguaaauuaaucuuu

SEQ ID NO: 2459552 - RNA, 14 nt, Human
uuguaaauuaaucu

SEQ ID NO: 2459553 - RNA, 18 nt, Human
uuguaaauauauaaauau

SEQ ID NO: 2459554 - RNA, 15 nt, Human
uuguaaauuaaucuu

SEQ ID NO: 2459555 - RNA, 21 nt, Human
uuguaaauauauaaauauaua

SEQ ID NO: 2459556 - RNA, 17 nt, Human
uuguaaauauauaaaua

SEQ ID NO: 2459557 - RNA, 15 nt, Human
uuguaaauauauaaa

SEQ ID NO: 2459558 - RNA, 13 nt, Human
uuguaaauauaua

SEQ ID NO: 2459559 - RNA, 12 nt, Human
uuguaaauauau

SEQ ID NO: 2459560 - RNA, 21 nt, Human
uuguaaaugugguaaagaguu

SEQ ID NO: 2459561 - RNA, 16 nt, Human
uuguaaaugugguaaa

SEQ ID NO: 2459562 - RNA, 17 nt, Human
uuguaaauaguauuuga

SEQ ID NO: 2459563 - RNA, 17 nt, Human
uuguaaauagcucaggu

SEQ ID NO: 2459564 - RNA, 15 nt, Human
uuguaaaauagcuug

SEQ ID NO: 2459565 - RNA, 21 nt, Human
uuguaaaagaacaguaaacau

SEQ ID NO: 2459566 - RNA, 21 nt, Human
uuguaaaauagcuuguauagu

SEQ ID NO: 2459567 - RNA, 11 nt, Human
uuguaaauaca

SEQ ID NO: 2459568 - RNA, 12 nt, Human
uuguaaauacac

SEQ ID NO: 2459569 - RNA, 14 nt, Human
uuguaaauacacca

SEQ ID NO: 2459570 - RNA, 13 nt, Human
uuguaaauacacc

SEQ ID NO: 2459571 - RNA, 14 nt, Human
uuguaaauacacau

SEQ ID NO: 2459572 - RNA, 20 nt, Human
uuguaaaagaacaguaaaca

SEQ ID NO: 2459573 - RNA, 14 nt, Human
uuguaaaacuacac

SEQ ID NO: 2459574 - RNA, 23 nt, Human
uuguaaaagaacaguaaacauug

SEQ ID NO: 2459575 - RNA, 20 nt, Human
uuguaaaaccugucaaugau

SEQ ID NO: 2459576 - RNA, 23 nt, Human
uuguaaaaccugucaaugauaca

SEQ ID NO: 2459577 - RNA, 21 nt, Human
uuguaaaaccugucaaugaua

SEQ ID NO: 2459578 - RNA, 20 nt, Human
uuguguuugucauuagccug

SEQ ID NO: 2459579 - RNA, 15 nt, Human
uuguguuugucauua

SEQ ID NO: 2459580 - RNA, 17 nt, Human
uuguguuuguguauuua

SEQ ID NO: 2459581 - RNA, 17 nt, Human
uuguguuuuuaauuuau

SEQ ID NO: 2459582 - RNA, 21 nt, Human
uuguguuuuuaauuuauuuau

SEQ ID NO: 2459583 - RNA, 16 nt, Human
uuguuaaaauaacuag

SEQ ID NO: 2459584 - RNA, 18 nt, Human
uuguguuuugcaagccag

SEQ ID NO: 2459585 - RNA, 14 nt, Human
uuguguuugucauu

SEQ ID NO: 2459586 - RNA, 19 nt, Human
uuguguuucuuuaguuuuu

SEQ ID NO: 2459587 - RNA, 18 nt, Human
uuguuaacucuugucuau

SEQ ID NO: 2459588 - RNA, 18 nt, Human
uuguguuuuuaauuuauu

SEQ ID NO: 2459589 - RNA, 22 nt, Human
uuguuaacucuugucuauuuuu

SEQ ID NO: 2459590 - RNA, 14 nt, Human
uuguuaaauauuua

SEQ ID NO: 2459591 - RNA, 17 nt, Human
uuguuaagauaugaugu

SEQ ID NO: 2459592 - RNA, 19 nt, Human
uuguuaauaaaaguacaug

SEQ ID NO: 2459593 - RNA, 14 nt, Human
uuguuaauaaaagu

SEQ ID NO: 2459594 - RNA, 22 nt, Human
uuguuaagucuaaauauuuccu

SEQ ID NO: 2459595 - RNA, 21 nt, Human
uuguuaauaaaaguacauguu

SEQ ID NO: 2459596 - RNA, 17 nt, Human
uuguuaaugaaaauguc

SEQ ID NO: 2459597 - RNA, 18 nt, Human
uuguuaaugaaaauguca

SEQ ID NO: 2459598 - RNA, 19 nt, Human
uuguuaguaugaggcauuu

SEQ ID NO: 2459599 - RNA, 21 nt, Human
uuguuaguaugaggcauuugu

SEQ ID NO: 2459600 - RNA, 14 nt, Human
uuguuacuucugag

SEQ ID NO: 2459601 - RNA, 17 nt, Human
uuguuacucugguucuu

SEQ ID NO: 2459602 - RNA, 18 nt, Human
uuguuacuaacuaaacuc

SEQ ID NO: 2459603 - RNA, 17 nt, Human
uuguuacuaacuaaacu

SEQ ID NO: 2459604 - RNA, 22 nt, Human
uuguuacucugguucuuuguuu

SEQ ID NO: 2459605 - RNA, 22 nt, Human
uuguuaauuuuuccuauauugc

SEQ ID NO: 2459606 - RNA, 21 nt, Human
uuguuacaggcaccgagaaug

SEQ ID NO: 2459607 - RNA, 12 nt, Human
uuguuaccuuua

SEQ ID NO: 2459608 - RNA, 14 nt, Human
uuguuacauuuuua

SEQ ID NO: 2459609 - RNA, 19 nt, Human
uuguuaaugaaaaugucag

SEQ ID NO: 2459610 - RNA, 17 nt, Human
uuguuaauggugcaaau

SEQ ID NO: 2459611 - RNA, 19 nt, Human
uuguuaaugguuugaauau

SEQ ID NO: 2459612 - RNA, 15 nt, Human
uuguuuccuuucacu

SEQ ID NO: 2459613 - RNA, 9 nt, Human
uuguuuaaa

SEQ ID NO: 2459614 - RNA, 16 nt, Human
uuguuucaauugcauc

SEQ ID NO: 2459615 - RNA, 20 nt, Human
uuguuucauugacuaucaaa

SEQ ID NO: 2459616 - RNA, 14 nt, Human
uuguuuaaaaucau

SEQ ID NO: 2459617 - RNA, 16 nt, Human
uuguuguuuuuaagau

SEQ ID NO: 2459618 - RNA, 23 nt, Human
uuguuguuugccauacuuugucu

SEQ ID NO: 2459619 - RNA, 20 nt, Human
uuguuuauuuaucagugaca

SEQ ID NO: 2459620 - RNA, 18 nt, Human
uuguuucaaacacaaaug

SEQ ID NO: 2459621 - RNA, 21 nt, Human
uuguuugagaaauuaaguauc

SEQ ID NO: 2459622 - RNA, 23 nt, Human
uuguuugaugcauuaaaagaaaa

SEQ ID NO: 2459623 - RNA, 15 nt, Human
uuguuugagaaauua

SEQ ID NO: 2459624 - RNA, 21 nt, Human
uuguuugaaacaaagaagguu

SEQ ID NO: 2459625 - RNA, 12 nt, Human
uuguuugcuauc

SEQ ID NO: 2459626 - RNA, 16 nt, Human
uuguuugccauacuuu

SEQ ID NO: 2459627 - RNA, 15 nt, Human
uuguuugccauacuu

SEQ ID NO: 2459628 - RNA, 19 nt, Human
uuguuugcucaccuggggu

SEQ ID NO: 2459629 - RNA, 16 nt, Human
uuguuugcuaucuuaa

SEQ ID NO: 2459630 - RNA, 13 nt, Human
uuguuugcuuauu

SEQ ID NO: 2459631 - RNA, 16 nt, Human
uuguuucguggggagg

SEQ ID NO: 2459632 - RNA, 16 nt, Human
uuguuucuaccuccca

SEQ ID NO: 2459633 - RNA, 14 nt, Human
uuguuucuaccucc

SEQ ID NO: 2459634 - RNA, 17 nt, Human
uuguuucuaccucccag

SEQ ID NO: 2459635 - RNA, 16 nt, Human
uuguuucucccccugg

SEQ ID NO: 2459636 - RNA, 21 nt, Human
uuguuguuugccauacuuugu

SEQ ID NO: 2459637 - RNA, 15 nt, Human
uuguuguuuguaugu

SEQ ID NO: 2459638 - RNA, 14 nt, Human
uuguuguuugccau

SEQ ID NO: 2459639 - RNA, 20 nt, Human
uuguuguuauuuuuugagaa

SEQ ID NO: 2459640 - RNA, 21 nt, Human
uuguuguuaaugaaaauguca

SEQ ID NO: 2459641 - RNA, 18 nt, Human
uuguuauguagauaacaa

SEQ ID NO: 2459642 - RNA, 19 nt, Human
uuguuauggcuuaaugaca

SEQ ID NO: 2459643 - RNA, 14 nt, Human
uuguuauggcuuaa

SEQ ID NO: 2459644 - RNA, 20 nt, Human
uuguuagugugucuuagugu

SEQ ID NO: 2459645 - RNA, 22 nt, Human
uuguuaguaugaggcauuuguu

SEQ ID NO: 2459646 - RNA, 16 nt, Human
uuguuaucagucaaua

SEQ ID NO: 2459647 - RNA, 22 nt, Human
uuguuaucagucaauauuuuua

SEQ ID NO: 2459648 - RNA, 13 nt, Human
uuguuaucaguaa

SEQ ID NO: 2459649 - RNA, 21 nt, Human
uuguggaaaaugaaaauuagg

SEQ ID NO: 2459650 - RNA, 16 nt, Human
uugugcuuuuccuauu

SEQ ID NO: 2459651 - RNA, 18 nt, Human
uuguggaaagccucugcu

SEQ ID NO: 2459652 - RNA, 16 nt, Human
uuguggacacagcucu

SEQ ID NO: 2459653 - RNA, 16 nt, Human
uuguggacauuuaaga

SEQ ID NO: 2459654 - RNA, 21 nt, Human
uuguggaauugggagcuuggg

SEQ ID NO: 2459655 - RNA, 22 nt, Human
uuguggaagcaaaaaucugaaa

SEQ ID NO: 2459656 - RNA, 22 nt, Human
uuguggaauggagauucaguuu

SEQ ID NO: 2459657 - RNA, 17 nt, Human
uuguggacacagcucuu

SEQ ID NO: 2459658 - RNA, 20 nt, Human
uuguggauuuaacagaaaug

SEQ ID NO: 2459659 - RNA, 21 nt, Human
uuguggauuuaacagaaaugu

SEQ ID NO: 2459660 - RNA, 22 nt, Human
uuguggacuaaaagauauaagu

SEQ ID NO: 2459661 - RNA, 18 nt, Human
uuguggacuaaaagauau

SEQ ID NO: 2459662 - RNA, 16 nt, Human
uuguggacuaaaagau

SEQ ID NO: 2459663 - RNA, 13 nt, Human
uuguggacuaaaa

SEQ ID NO: 2459664 - RNA, 18 nt, Human
uuguggauguuuuaauuc

SEQ ID NO: 2459665 - RNA, 14 nt, Human
uuguggaugucuuc

SEQ ID NO: 2459666 - RNA, 14 nt, Human
uuguggagccccac

SEQ ID NO: 2459667 - RNA, 15 nt, Human
uuguggacauuuaag

SEQ ID NO: 2459668 - RNA, 22 nt, Human
uuguggaggagcucaggacacu

SEQ ID NO: 2459669 - RNA, 22 nt, Human
uuguggauuuaacagaaaugua

SEQ ID NO: 2459670 - RNA, 23 nt, Human
uuguggauuuaacagaaauguac

SEQ ID NO: 2459671 - RNA, 14 nt, Human
uuguggcacauucu

SEQ ID NO: 2459672 - RNA, 20 nt, Human
uuguguucccauuucagcug

SEQ ID NO: 2459673 - RNA, 13 nt, Human
uuguguucuaaua

SEQ ID NO: 2459674 - RNA, 23 nt, Human
uuguggauguuuuaauuccauga

SEQ ID NO: 2459675 - RNA, 21 nt, Human
uuguggauguuuuaauuccau

SEQ ID NO: 2459676 - RNA, 13 nt, Human
uuguguucaccuu

SEQ ID NO: 2459677 - RNA, 21 nt, Human
uuguguuuauauauaagccaa

SEQ ID NO: 2459678 - RNA, 11 nt, Human
uuguguuguca

SEQ ID NO: 2459679 - RNA, 13 nt, Human
uuguguugugaau

SEQ ID NO: 2459680 - RNA, 19 nt, Human
uugugcagaaaacauuguu

SEQ ID NO: 2459681 - RNA, 18 nt, Human
uugugcagaaaacauugu

SEQ ID NO: 2459682 - RNA, 16 nt, Human
uugugcagaaaacauu

SEQ ID NO: 2459683 - RNA, 15 nt, Human
uugugcagaaaacau

SEQ ID NO: 2459684 - RNA, 21 nt, Human
uugugcacccucuaucccaau

SEQ ID NO: 2459685 - RNA, 19 nt, Human
uugugcacccucuauccca

SEQ ID NO: 2459686 - RNA, 17 nt, Human
uugugcauuaucuagau

SEQ ID NO: 2459687 - RNA, 22 nt, Human
uugugauuugacuguuuuuacc

SEQ ID NO: 2459688 - RNA, 17 nt, Human
uugugauuugacuguuu

SEQ ID NO: 2459689 - RNA, 16 nt, Human
uugugauuugacuguu

SEQ ID NO: 2459690 - RNA, 15 nt, Human
uugugauuugacugu

SEQ ID NO: 2459691 - RNA, 11 nt, Human
uugugauuuga

SEQ ID NO: 2459692 - RNA, 23 nt, Human
uugugaaaugaaaacauguaaua

SEQ ID NO: 2459693 - RNA, 22 nt, Human
uugugcauuaucuagauacugu

SEQ ID NO: 2459694 - RNA, 23 nt, Human
uugugcauuaucuagauacugua

SEQ ID NO: 2459695 - RNA, 12 nt, Human
uugugcauuugg

SEQ ID NO: 2459696 - RNA, 16 nt, Human
uugugccaauauguau

SEQ ID NO: 2459697 - RNA, 16 nt, Human
uugugccuuuuauagc

SEQ ID NO: 2459698 - RNA, 11 nt, Human
uugugcuucua

SEQ ID NO: 2459699 - RNA, 14 nt, Human
uugugcuuguuuac

SEQ ID NO: 2459700 - RNA, 23 nt, Human
uugugcuucuuucuuugggaaua

SEQ ID NO: 2459701 - RNA, 18 nt, Human
uugugcuggauggagccc

SEQ ID NO: 2459702 - RNA, 22 nt, Human
uugugcugaucgugcuaaauuu

SEQ ID NO: 2459703 - RNA, 22 nt, Human
uugugccaauauguauuguaaa

SEQ ID NO: 2459704 - RNA, 17 nt, Human
uugugccaauauguauu

SEQ ID NO: 2459705 - RNA, 22 nt, Human
uugugccauagucacauggccu

SEQ ID NO: 2459706 - RNA, 16 nt, Human
uugugccagaaugcuu

SEQ ID NO: 2459707 - RNA, 21 nt, Human
uugugccagaaugcuuuagga

SEQ ID NO: 2459708 - RNA, 12 nt, Human
uugugccccugc

SEQ ID NO: 2459709 - RNA, 17 nt, Human
uugugcccacugucucu

SEQ ID NO: 2459710 - RNA, 15 nt, Human
uugugccuggcucag

SEQ ID NO: 2459711 - RNA, 15 nt, Human
uuuaagacacuuuuu

SEQ ID NO: 2459712 - RNA, 19 nt, Human
uuuaagacauuuuuggaag

SEQ ID NO: 2459713 - RNA, 22 nt, Human
uuuaagacagucccaucaaaac

SEQ ID NO: 2459714 - RNA, 22 nt, Human
uuuaagaaaaaggaugcacaga

SEQ ID NO: 2459715 - RNA, 19 nt, Human
uuuaacuugaggguaauaa

SEQ ID NO: 2459716 - RNA, 12 nt, Human
uuuaacuugagc

SEQ ID NO: 2459717 - RNA, 13 nt, Human
uuuaacuucugcc

SEQ ID NO: 2459718 - RNA, 18 nt, Human
uuuaacuuuaaguuucag

SEQ ID NO: 2459719 - RNA, 14 nt, Human
uuuaacuuuaaguu

SEQ ID NO: 2459720 - RNA, 21 nt, Human
uuuaacuuaaucaauuaauuu

SEQ ID NO: 2459721 - RNA, 18 nt, Human
uuuaagaaaaaggaugca

SEQ ID NO: 2459722 - RNA, 22 nt, Human
uuuaagaaaaaauaacacacau

SEQ ID NO: 2459723 - RNA, 18 nt, Human
uuuaagaaaaaauaacac

SEQ ID NO: 2459724 - RNA, 19 nt, Human
uuuaacuuuaucacauuau

SEQ ID NO: 2459725 - RNA, 13 nt, Human
uuuaauaauguuu

SEQ ID NO: 2459726 - RNA, 22 nt, Human
uuuaauaacauuaccuuacugu

SEQ ID NO: 2459727 - RNA, 20 nt, Human
uuuaauaacauuaccuuacu

SEQ ID NO: 2459728 - RNA, 18 nt, Human
uuuaauaacauuaccuua

SEQ ID NO: 2459729 - RNA, 15 nt, Human
uuuaauaacauuacc

SEQ ID NO: 2459730 - RNA, 23 nt, Human
uuuaauaacauuaccuuacugug

SEQ ID NO: 2459731 - RNA, 15 nt, Human
uuuaauaauauacuu

SEQ ID NO: 2459732 - RNA, 17 nt, Human
uuuaauaaaauaauucu

SEQ ID NO: 2459733 - RNA, 16 nt, Human
uuuaauaaaauaauuc

SEQ ID NO: 2459734 - RNA, 20 nt, Human
uuuaauaaaaaggcaccuau

SEQ ID NO: 2459735 - RNA, 13 nt, Human
uuuaauaaacuuu

SEQ ID NO: 2459736 - RNA, 20 nt, Human
uuuaauaaaauaauucuaaa

SEQ ID NO: 2459737 - RNA, 14 nt, Human
uuuaauaacaauug

SEQ ID NO: 2459738 - RNA, 12 nt, Human
uuuaauaacauu

SEQ ID NO: 2459739 - RNA, 22 nt, Human
uuuaaguguaacuggcaguuuu

SEQ ID NO: 2459740 - RNA, 18 nt, Human
uuuaagacagucuuuggg

SEQ ID NO: 2459741 - RNA, 18 nt, Human
uuuaagugcuuuguaaug

SEQ ID NO: 2459742 - RNA, 14 nt, Human
uuuaaguguaacug

SEQ ID NO: 2459743 - RNA, 15 nt, Human
uuuaaguuguuugca

SEQ ID NO: 2459744 - RNA, 21 nt, Human
uuuaaguuguuugcaugugaa

SEQ ID NO: 2459745 - RNA, 14 nt, Human
uuuaaguuguuugc

SEQ ID NO: 2459746 - RNA, 23 nt, Human
uuuaaguucuggaugcauuucuc

SEQ ID NO: 2459747 - RNA, 18 nt, Human
uuuaaguuacacauuuuu

SEQ ID NO: 2459748 - RNA, 18 nt, Human
uuguuuggagacagaguc

SEQ ID NO: 2459749 - RNA, 18 nt, Human
uuuaaauuuuuuuccuua

SEQ ID NO: 2459750 - RNA, 15 nt, Human
uuguuugcuuauugu

SEQ ID NO: 2459751 - RNA, 18 nt, Human
uuuaaauuuuacccuuua

SEQ ID NO: 2459752 - RNA, 22 nt, Human
uuuaaauuuuacccuuuagacu

SEQ ID NO: 2459753 - RNA, 15 nt, Human
uuuaacaaaaaccaa

SEQ ID NO: 2459754 - RNA, 15 nt, Human
uuuaacaaaagcaag

SEQ ID NO: 2459755 - RNA, 16 nt, Human
uuuaacaaaagcaaga

SEQ ID NO: 2459756 - RNA, 23 nt, Human
uuuaacaacuaugauuuggaaaa

SEQ ID NO: 2459757 - RNA, 18 nt, Human
uuuaacagaaauguacag

SEQ ID NO: 2459758 - RNA, 18 nt, Human
uuuaacaauaacuacugu

SEQ ID NO: 2459759 - RNA, 20 nt, Human
uuuaacaauaacuacugugu

SEQ ID NO: 2459760 - RNA, 21 nt, Human
uuuaacaauaacuacuguguu

SEQ ID NO: 2459761 - RNA, 22 nt, Human
uuuaacaauaacuacuguguuc

SEQ ID NO: 2459762 - RNA, 23 nt, Human
uuuaacaauaacuacuguguucc

SEQ ID NO: 2459763 - RNA, 17 nt, Human
uuuaacagcugaauuau

SEQ ID NO: 2459764 - RNA, 18 nt, Human
uuuaacaggaagaucuua

SEQ ID NO: 2459765 - RNA, 20 nt, Human
uuuaacagcugaauuaucua

SEQ ID NO: 2459766 - RNA, 14 nt, Human
uuuaacagggucuc

SEQ ID NO: 2459767 - RNA, 23 nt, Human
uuuaacagggucucuagugcugu

SEQ ID NO: 2459768 - RNA, 16 nt, Human
uuuaacagucauuuaa

SEQ ID NO: 2459769 - RNA, 15 nt, Human
uuuaacagucauuua

SEQ ID NO: 2459770 - RNA, 17 nt, Human
uuuaacagucauuuaaa

SEQ ID NO: 2459771 - RNA, 19 nt, Human
uuuaacucuauaauguguu

SEQ ID NO: 2459772 - RNA, 21 nt, Human
uuuaacauauaauuucuuuaa

SEQ ID NO: 2459773 - RNA, 15 nt, Human
uuuaacuagaauuua

SEQ ID NO: 2459774 - RNA, 22 nt, Human
uuuaacgaaugaagaugucuaa

SEQ ID NO: 2459775 - RNA, 14 nt, Human
uuuaacugccuugu

SEQ ID NO: 2459776 - RNA, 13 nt, Human
uuuaacucugucu

SEQ ID NO: 2459777 - RNA, 14 nt, Human
uuuaacucugucuu

SEQ ID NO: 2459778 - RNA, 17 nt, Human
uuuaacucugucuucac

SEQ ID NO: 2459779 - RNA, 23 nt, Human
uuuaacucagaucacuacugcag

SEQ ID NO: 2459780 - RNA, 22 nt, Human
uuuaacucauaccuuuaaagga

SEQ ID NO: 2459781 - RNA, 12 nt, Human
uuuaacucuguc

SEQ ID NO: 2459782 - RNA, 23 nt, Human
uuuaacucgagaccuuuucaacu

SEQ ID NO: 2459783 - RNA, 21 nt, Human
uuuaacucagaucacuacugc

SEQ ID NO: 2459784 - RNA, 18 nt, Human
uuuaacucagaucacuac

SEQ ID NO: 2459785 - RNA, 15 nt, Human
uuuaacucagaucac

SEQ ID NO: 2459786 - RNA, 12 nt, Human
uuuaacucagau

SEQ ID NO: 2459787 - RNA, 17 nt, Human
uuuaacuagaauuuauu

SEQ ID NO: 2459788 - RNA, 24 nt, Human
uuuaacucaauauuuuccaugaaa

SEQ ID NO: 2459789 - RNA, 22 nt, Human
uuuagaaagcauuugaaugcau

SEQ ID NO: 2459790 - RNA, 19 nt, Human
uuuagaaauacugcaagaa

SEQ ID NO: 2459791 - RNA, 20 nt, Human
uuuagaaauacugcaagaaa

SEQ ID NO: 2459792 - RNA, 22 nt, Human
uuuagaaauacugcaagaaaau

SEQ ID NO: 2459793 - RNA, 14 nt, Human
uuuagaaauauaau

SEQ ID NO: 2459794 - RNA, 19 nt, Human
uuuagaaagcauuugaaug

SEQ ID NO: 2459795 - RNA, 18 nt, Human
uuuagaaagcauuugaau

SEQ ID NO: 2459796 - RNA, 16 nt, Human
uuuagaaagcauuuga

SEQ ID NO: 2459797 - RNA, 14 nt, Human
uuuagaaagcauuu

SEQ ID NO: 2459798 - RNA, 15 nt, Human
uuuagaaagaauauu

SEQ ID NO: 2459799 - RNA, 23 nt, Human
uuuagaaagaagcccaauauuau

SEQ ID NO: 2459800 - RNA, 13 nt, Human
uuuagaaagcauu

SEQ ID NO: 2459801 - RNA, 19 nt, Human
uuuacuucuuauacauuug

SEQ ID NO: 2459802 - RNA, 22 nt, Human
uuuacuucuuauacauuugaua

SEQ ID NO: 2459803 - RNA, 18 nt, Human
uuuacuugccauuacuca

SEQ ID NO: 2459804 - RNA, 18 nt, Human
uuuaccacccccacaccu

SEQ ID NO: 2459805 - RNA, 18 nt, Human
uuuacuugcauugaauau

SEQ ID NO: 2459806 - RNA, 21 nt, Human
uuuacuugcauugaauauauu

SEQ ID NO: 2459807 - RNA, 22 nt, Human
uuuagacaaauacucaugugua

SEQ ID NO: 2459808 - RNA, 21 nt, Human
uuuagacaaauacucaugugu

SEQ ID NO: 2459809 - RNA, 20 nt, Human
uuuagacaaauacucaugug

SEQ ID NO: 2459810 - RNA, 19 nt, Human
uuuagacaaauacucaugu

SEQ ID NO: 2459811 - RNA, 18 nt, Human
uuuagacaaauacucaug

SEQ ID NO: 2459812 - RNA, 16 nt, Human
uuuagacaaauacuca

SEQ ID NO: 2459813 - RNA, 12 nt, Human
uuuagacagagu

SEQ ID NO: 2459814 - RNA, 22 nt, Human
uuuaguuucuguucuguggaaa

SEQ ID NO: 2459815 - RNA, 14 nt, Human
uuuaguuuacucaa

SEQ ID NO: 2459816 - RNA, 14 nt, Human
uuuagacacuggcu

SEQ ID NO: 2459817 - RNA, 23 nt, Human
uuuagacaaauacucauguguau

SEQ ID NO: 2459818 - RNA, 22 nt, Human
uuuagacaagagaugggaauga

SEQ ID NO: 2459819 - RNA, 23 nt, Human
uuuauaaaaauaaaaaacacugg

SEQ ID NO: 2459820 - RNA, 21 nt, Human
uuuauaaaaauaaaaaacacu

SEQ ID NO: 2459821 - RNA, 15 nt, Human
uuuaguuuuuguucu

SEQ ID NO: 2459822 - RNA, 11 nt, Human
uuuaguuuuug

SEQ ID NO: 2459823 - RNA, 17 nt, Human
uuuauaaaaaauggugc

SEQ ID NO: 2459824 - RNA, 14 nt, Human
uuuaauacagcagu

SEQ ID NO: 2459825 - RNA, 17 nt, Human
uuuaauaauauacuugu

SEQ ID NO: 2459826 - RNA, 14 nt, Human
uuuaauacagggua

SEQ ID NO: 2459827 - RNA, 19 nt, Human
uuuaauagaauauaauuau

SEQ ID NO: 2459828 - RNA, 21 nt, Human
uuuaauagaauauaauuaucg

SEQ ID NO: 2459829 - RNA, 21 nt, Human
uuuacacacgugcaauuuguu

SEQ ID NO: 2459830 - RNA, 16 nt, Human
uuuacacucuuuguaa

SEQ ID NO: 2459831 - RNA, 22 nt, Human
uuuacacucaggcuuucacuau

SEQ ID NO: 2459832 - RNA, 14 nt, Human
uuuacacucaggcu

SEQ ID NO: 2459833 - RNA, 21 nt, Human
uuuacacauucggcucccugg

SEQ ID NO: 2459834 - RNA, 21 nt, Human
uuuacaccaguuccuuucaau

SEQ ID NO: 2459835 - RNA, 16 nt, Human
uuuacagcugccugca

SEQ ID NO: 2459836 - RNA, 15 nt, Human
uuuacagcugccugc

SEQ ID NO: 2459837 - RNA, 20 nt, Human
uuuacaguaaauaaauuguu

SEQ ID NO: 2459838 - RNA, 19 nt, Human
uuuacaguaaauaaauugu

SEQ ID NO: 2459839 - RNA, 15 nt, Human
uuuacaguaaauaaa

SEQ ID NO: 2459840 - RNA, 23 nt, Human
uuuacagggagccuccugcccag

SEQ ID NO: 2459841 - RNA, 22 nt, Human
uuuacagggagccuccugccca

SEQ ID NO: 2459842 - RNA, 20 nt, Human
uuuacagggagccuccugcc

SEQ ID NO: 2459843 - RNA, 18 nt, Human
uuuacagggagccuccug

SEQ ID NO: 2459844 - RNA, 20 nt, Human
uuuacagcuuucaugauuag

SEQ ID NO: 2459845 - RNA, 23 nt, Human
uuuacagcuuucaugauuagcaa

SEQ ID NO: 2459846 - RNA, 13 nt, Human
uuuaccacuugug

SEQ ID NO: 2459847 - RNA, 15 nt, Human
uuuaccacccccaca

SEQ ID NO: 2459848 - RNA, 13 nt, Human
uuuaccaccccca

SEQ ID NO: 2459849 - RNA, 12 nt, Human
uuuaccaaguuu

SEQ ID NO: 2459850 - RNA, 23 nt, Human
uuuacagugaaaauguaagcugu

SEQ ID NO: 2459851 - RNA, 19 nt, Human
uuuacagugaaaauguaag

SEQ ID NO: 2459852 - RNA, 16 nt, Human
uuuacauuguugagcu

SEQ ID NO: 2459853 - RNA, 13 nt, Human
uuuauuaugcaug

SEQ ID NO: 2459854 - RNA, 13 nt, Human
uuuauuauggcac

SEQ ID NO: 2459855 - RNA, 22 nt, Human
uuuauggccucagcugccucac

SEQ ID NO: 2459856 - RNA, 14 nt, Human
uuuauggcuuuugu

SEQ ID NO: 2459857 - RNA, 16 nt, Human
uuuauggcuuuugugc

SEQ ID NO: 2459858 - RNA, 17 nt, Human
uuuauggcacuaguauu

SEQ ID NO: 2459859 - RNA, 17 nt, Human
uuuauacaaauuagaaa

SEQ ID NO: 2459860 - RNA, 12 nt, Human
uuuauggccuca

SEQ ID NO: 2459861 - RNA, 13 nt, Human
uuuauggccucag

SEQ ID NO: 2459862 - RNA, 13 nt, Human
uuuauaagguuuu

SEQ ID NO: 2459863 - RNA, 22 nt, Human
uuuauaauuuugugaagcaaaa

SEQ ID NO: 2459864 - RNA, 17 nt, Human
uuuauacaaaugucuua

SEQ ID NO: 2459865 - RNA, 13 nt, Human
uuuauacaaauua

SEQ ID NO: 2459866 - RNA, 15 nt, Human
uuuauacaaauuaga

SEQ ID NO: 2459867 - RNA, 21 nt, Human
uuuauaacucaucauaaaaua

SEQ ID NO: 2459868 - RNA, 20 nt, Human
uuuauaagcagauuuaacaa

SEQ ID NO: 2459869 - RNA, 16 nt, Human
uuuaguuuuuguucuu

SEQ ID NO: 2459870 - RNA, 19 nt, Human
uuuauaacuaguccuuuac

SEQ ID NO: 2459871 - RNA, 16 nt, Human
uuuauaacucaucaua

SEQ ID NO: 2459872 - RNA, 18 nt, Human
uuuauaacucaucauaaa

SEQ ID NO: 2459873 - RNA, 19 nt, Human
uuuauaacucaucauaaaa

SEQ ID NO: 2459874 - RNA, 20 nt, Human
uuuauaacucaucauaaaau

SEQ ID NO: 2459875 - RNA, 22 nt, Human
uuuauaacucaucauaaaauaa

SEQ ID NO: 2459876 - RNA, 17 nt, Human
uuucaaggcccucagca

SEQ ID NO: 2459877 - RNA, 22 nt, Human
uuucaagccugccuaggaauuc

SEQ ID NO: 2459878 - RNA, 23 nt, Human
uuucaagaauaaucacgcuuucc

SEQ ID NO: 2459879 - RNA, 20 nt, Human
uuucaagacauuaaaucuau

SEQ ID NO: 2459880 - RNA, 17 nt, Human
uuucaagaaacugagga

SEQ ID NO: 2459881 - RNA, 22 nt, Human
uuucaacuuggcuuccuuucuu

SEQ ID NO: 2459882 - RNA, 23 nt, Human
uuucaagcagucgugccuguguc

SEQ ID NO: 2459883 - RNA, 22 nt, Human
uuucaagcagucgugccugugu

SEQ ID NO: 2459884 - RNA, 20 nt, Human
uuucaacgcagcccugcuuu

SEQ ID NO: 2459885 - RNA, 16 nt, Human
uuucaacgcagcccug

SEQ ID NO: 2459886 - RNA, 11 nt, Human
uuuauuuacua

SEQ ID NO: 2459887 - RNA, 15 nt, Human
uuucaacgcagcccu

SEQ ID NO: 2459888 - RNA, 19 nt, Human
uuucaagaaacugaggaau

SEQ ID NO: 2459889 - RNA, 16 nt, Human
uuucaacugccaaaau

SEQ ID NO: 2459890 - RNA, 21 nt, Human
uuucaacgcagcccugcuuug

SEQ ID NO: 2459891 - RNA, 17 nt, Human
uuuauuuaaaagauuca

SEQ ID NO: 2459892 - RNA, 15 nt, Human
uuuauuuaaaagauu

SEQ ID NO: 2459893 - RNA, 14 nt, Human
uuuauuuaaaagau

SEQ ID NO: 2459894 - RNA, 23 nt, Human
uuuauuguuuaaagcaacugucu

SEQ ID NO: 2459895 - RNA, 22 nt, Human
uuuauuguuuaaaaucauuucu

SEQ ID NO: 2459896 - RNA, 20 nt, Human
uuuauuuacagaugaaugua

SEQ ID NO: 2459897 - RNA, 16 nt, Human
uuuauuuacugcuagu

SEQ ID NO: 2459898 - RNA, 21 nt, Human
uuuauuuaaaugucuaaugua

SEQ ID NO: 2459899 - RNA, 15 nt, Human
uuuauuuaaaugucu

SEQ ID NO: 2459900 - RNA, 22 nt, Human
uuuauuuaaaagauucauuuuu

SEQ ID NO: 2459901 - RNA, 17 nt, Human
uuuauuuaauguuaugu

SEQ ID NO: 2459902 - RNA, 16 nt, Human
uuuauuccuguauguu

SEQ ID NO: 2459903 - RNA, 14 nt, Human
uuuauuccuuguga

SEQ ID NO: 2459904 - RNA, 16 nt, Human
uuuauuauuuauuuau

SEQ ID NO: 2459905 - RNA, 19 nt, Human
uuuauuccauauucaugua

SEQ ID NO: 2459906 - RNA, 22 nt, Human
uuuauuccuauauaguuuauug

SEQ ID NO: 2459907 - RNA, 16 nt, Human
uuuauuauuacuguuu

SEQ ID NO: 2459908 - RNA, 14 nt, Human
uuuauugacacaga

SEQ ID NO: 2459909 - RNA, 15 nt, Human
uuuauugacacagaa

SEQ ID NO: 2459910 - RNA, 14 nt, Human
uuuauugagaaaga

SEQ ID NO: 2459911 - RNA, 16 nt, Human
uuuauugagaaagagc

SEQ ID NO: 2459912 - RNA, 14 nt, Human
uuuauugagaauuu

SEQ ID NO: 2459913 - RNA, 12 nt, Human
uuuauugacaca

SEQ ID NO: 2459914 - RNA, 13 nt, Human
uuuauugacacag

SEQ ID NO: 2459915 - RNA, 12 nt, Human
uuuauugacaau

SEQ ID NO: 2459916 - RNA, 16 nt, Human
uuuauucuuuuuaaag

SEQ ID NO: 2459917 - RNA, 12 nt, Human
uuucagaugcuu

SEQ ID NO: 2459918 - RNA, 14 nt, Human
uuucagaugcuucu

SEQ ID NO: 2459919 - RNA, 16 nt, Human
uuucagaugcuucugg

SEQ ID NO: 2459920 - RNA, 12 nt, Human
uuucagaugucu

SEQ ID NO: 2459921 - RNA, 20 nt, Human
uuucagaugcuucugggaga

SEQ ID NO: 2459922 - RNA, 16 nt, Human
uuucagauauauauca

SEQ ID NO: 2459923 - RNA, 15 nt, Human
uuucagauauauauc

SEQ ID NO: 2459924 - RNA, 13 nt, Human
uuucacaacagau

SEQ ID NO: 2459925 - RNA, 18 nt, Human
uuucagauauaaaagacu

SEQ ID NO: 2459926 - RNA, 16 nt, Human
uuucagauauaaaaga

SEQ ID NO: 2459927 - RNA, 14 nt, Human
uuucagauauaaaa

SEQ ID NO: 2459928 - RNA, 14 nt, Human
uuucacaaauuugu

SEQ ID NO: 2459929 - RNA, 16 nt, Human
uuucacaaccuucugu

SEQ ID NO: 2459930 - RNA, 22 nt, Human
uuucacaaccuucuguggcuca

SEQ ID NO: 2459931 - RNA, 13 nt, Human
uuucacaaauaaa

SEQ ID NO: 2459932 - RNA, 12 nt, Human
uuucacaaauaa

SEQ ID NO: 2459933 - RNA, 17 nt, Human
uuucaauuuugcaugcu

SEQ ID NO: 2459934 - RNA, 22 nt, Human
uuucaaguuccaaguugcuaau

SEQ ID NO: 2459935 - RNA, 23 nt, Human
uuucaagucaaauuaauaaucuu

SEQ ID NO: 2459936 - RNA, 19 nt, Human
uuucaauaaagcauuuaua

SEQ ID NO: 2459937 - RNA, 20 nt, Human
uuucaauaaagcauuuauaa

SEQ ID NO: 2459938 - RNA, 20 nt, Human
uuucaagguaauuucuugug

SEQ ID NO: 2459939 - RNA, 18 nt, Human
uuucaaggcccucagcau

SEQ ID NO: 2459940 - RNA, 18 nt, Human
uuucaagucaaauuaaua

SEQ ID NO: 2459941 - RNA, 20 nt, Human
uuucaagucaaauuaauaau

SEQ ID NO: 2459942 - RNA, 21 nt, Human
uuucaagugaaucuaaaagcu

SEQ ID NO: 2459943 - RNA, 14 nt, Human
uuucaauaggaaaa

SEQ ID NO: 2459944 - RNA, 12 nt, Human
uuucaauaggaa

SEQ ID NO: 2459945 - RNA, 17 nt, Human
uuucaauaggaaaaacu

SEQ ID NO: 2459946 - RNA, 19 nt, Human
uuucaauaggaaaaacuga

SEQ ID NO: 2459947 - RNA, 14 nt, Human
uuucaauuuccaag

SEQ ID NO: 2459948 - RNA, 19 nt, Human
uuucaauuuccaagagcug

SEQ ID NO: 2459949 - RNA, 22 nt, Human
uuucagugucaaauaaacacug

SEQ ID NO: 2459950 - RNA, 21 nt, Human
uuucagugucaaauaaacacu

SEQ ID NO: 2459951 - RNA, 22 nt, Human
uuucaguggcacgucaucuagu

SEQ ID NO: 2459952 - RNA, 21 nt, Human
uuucaguggggcagucauuau

SEQ ID NO: 2459953 - RNA, 23 nt, Human
uuucagugucaaauaaacacugu

SEQ ID NO: 2459954 - RNA, 13 nt, Human
uuucaguguacau

SEQ ID NO: 2459955 - RNA, 14 nt, Human
uuucaguguacaug

SEQ ID NO: 2459956 - RNA, 20 nt, Human
uuucagaugucuucugccug

SEQ ID NO: 2459957 - RNA, 19 nt, Human
uuucagaugucuucugccu

SEQ ID NO: 2459958 - RNA, 17 nt, Human
uuucagaugucuucugc

SEQ ID NO: 2459959 - RNA, 15 nt, Human
uuucagaugucuucu

SEQ ID NO: 2459960 - RNA, 22 nt, Human
uuucagaugucuucugccuguu

SEQ ID NO: 2459961 - RNA, 21 nt, Human
uuucagaugucuucugccugu

SEQ ID NO: 2459962 - RNA, 20 nt, Human
uuucagauucccagagcaaa

SEQ ID NO: 2459963 - RNA, 23 nt, Human
uuucagcaccuacaguguacagu

SEQ ID NO: 2459964 - RNA, 14 nt, Human
uuucagcagacuau

SEQ ID NO: 2459965 - RNA, 21 nt, Human
uuucagcagacuaugaauauu

SEQ ID NO: 2459966 - RNA, 17 nt, Human
uuucagugaaagcauca

SEQ ID NO: 2459967 - RNA, 23 nt, Human
uuucauuguaugauguguuguga

SEQ ID NO: 2459968 - RNA, 20 nt, Human
uuucauuguaugauguguug

SEQ ID NO: 2459969 - RNA, 18 nt, Human
uuucauuguaugaugugu

SEQ ID NO: 2459970 - RNA, 14 nt, Human
uuucauuuagguga

SEQ ID NO: 2459971 - RNA, 19 nt, Human
uuucauuuagucaugugac

SEQ ID NO: 2459972 - RNA, 17 nt, Human
uuucauuuacuguggcu

SEQ ID NO: 2459973 - RNA, 14 nt, Human
uuucauuuacugug

SEQ ID NO: 2459974 - RNA, 18 nt, Human
uuucauuuaggugaggaa

SEQ ID NO: 2459975 - RNA, 23 nt, Human
uuuccaacaccacagacacacac

SEQ ID NO: 2459976 - RNA, 22 nt, Human
uuuccaacaccacagacacaca

SEQ ID NO: 2459977 - RNA, 21 nt, Human
uuuccaacaccacagacacac

SEQ ID NO: 2459978 - RNA, 20 nt, Human
uuuccaacaccacagacaca

SEQ ID NO: 2459979 - RNA, 18 nt, Human
uuuccaacaccacagaca

SEQ ID NO: 2459980 - RNA, 15 nt, Human
uuuccaacaccacag

SEQ ID NO: 2459981 - RNA, 23 nt, Human
uuuccaaauucacaaguuguguu

SEQ ID NO: 2459982 - RNA, 16 nt, Human
uuuccaagagcugagg

SEQ ID NO: 2459983 - RNA, 14 nt, Human
uuuccaagagcuga

SEQ ID NO: 2459984 - RNA, 13 nt, Human
uuuccaagagcug

SEQ ID NO: 2459985 - RNA, 22 nt, Human
uucugauuguaacguugcugug

SEQ ID NO: 2459986 - RNA, 21 nt, Human
uucugauuguaacguugcugu

SEQ ID NO: 2459987 - RNA, 11 nt, Human
uucugauugua

SEQ ID NO: 2459988 - RNA, 12 nt, Human
uucugauuccac

SEQ ID NO: 2459989 - RNA, 23 nt, Human
uucugauuguaacguugcugugg

SEQ ID NO: 2459990 - RNA, 19 nt, Human
uucugcaaaaauauuuaua

SEQ ID NO: 2459991 - RNA, 16 nt, Human
uucugccuucucauga

SEQ ID NO: 2459992 - RNA, 11 nt, Human
uucugccuucc

SEQ ID NO: 2459993 - RNA, 24 nt, Human
uucugccuguuauaacucugcacu

SEQ ID NO: 2459994 - RNA, 21 nt, Human
uucugccuguuauaacucugc

SEQ ID NO: 2459995 - RNA, 14 nt, Human
uucugccuucucau

SEQ ID NO: 2459996 - RNA, 21 nt, Human
uucugcaagcacaucugcauu

SEQ ID NO: 2459997 - RNA, 20 nt, Human
uucugccuguuauaacucug

SEQ ID NO: 2459998 - RNA, 15 nt, Human
uucugccuguuauaa

SEQ ID NO: 2459999 - RNA, 17 nt, Human
uucugauuagaaaugac

SEQ ID NO: 2460000 - RNA, 17 nt, Human
uucugauuacacaaaac

SEQ ID NO: 2460001 - RNA, 18 nt, Human
uucugaugaugugccugg

SEQ ID NO: 2460002 - RNA, 14 nt, Human
uucugauuagaaau

SEQ ID NO: 2460003 - RNA, 15 nt, Human
uucugauuagaaaug

SEQ ID NO: 2460004 - RNA, 19 nt, Human
uucugauccuaguuccacc

SEQ ID NO: 2460005 - RNA, 22 nt, Human
uucugauaugcaguuuuccuua

SEQ ID NO: 2460006 - RNA, 22 nt, Human
uucugccuuuggggacuuuucu

SEQ ID NO: 2460007 - RNA, 15 nt, Human
uucugccuuuuuuau

SEQ ID NO: 2460008 - RNA, 15 nt, Human
uucugcuaccucacu

SEQ ID NO: 2460009 - RNA, 19 nt, Human
uucugcucacauaucuguc

SEQ ID NO: 2460010 - RNA, 13 nt, Human
uucugcucaucau

SEQ ID NO: 2460011 - RNA, 14 nt, Human
uucugcucaucauu

SEQ ID NO: 2460012 - RNA, 15 nt, Human
uucugcucagcucug

SEQ ID NO: 2460013 - RNA, 20 nt, Human
uucugcucagcucugggcca

SEQ ID NO: 2460014 - RNA, 19 nt, Human
uucugcuacuggcaaaagg

SEQ ID NO: 2460015 - RNA, 14 nt, Human
uucugcucagcucu

SEQ ID NO: 2460016 - RNA, 16 nt, Human
uucugcuaccucacug

SEQ ID NO: 2460017 - RNA, 21 nt, Human
uucugcuaccucacugggguc

SEQ ID NO: 2460018 - RNA, 9 nt, Human
uucugcucc

SEQ ID NO: 2460019 - RNA, 13 nt, Human
uucugcuccaccc

SEQ ID NO: 2460020 - RNA, 15 nt, Human
uucugcuccacccuu

SEQ ID NO: 2460021 - RNA, 16 nt, Human
uucugcuccacccuug

SEQ ID NO: 2460022 - RNA, 19 nt, Human
uucugcucaucauucucug

SEQ ID NO: 2460023 - RNA, 20 nt, Human
uucugcucaucauucucugu

SEQ ID NO: 2460024 - RNA, 21 nt, Human
uucugcucaucauucucuguc

SEQ ID NO: 2460025 - RNA, 12 nt, Human
uucugcucagcu

SEQ ID NO: 2460026 - RNA, 18 nt, Human
uucugcuccucuccaggc

SEQ ID NO: 2460027 - RNA, 17 nt, Human
uucugcuccucuccagg

SEQ ID NO: 2460028 - RNA, 16 nt, Human
uucugcuccucuccag

SEQ ID NO: 2460029 - RNA, 15 nt, Human
uucugcuccucucca

SEQ ID NO: 2460030 - RNA, 14 nt, Human
uucugcuccucucc

SEQ ID NO: 2460031 - RNA, 13 nt, Human
uucugcuccucuc

SEQ ID NO: 2460032 - RNA, 11 nt, Human
uucugcuccuc

SEQ ID NO: 2460033 - RNA, 17 nt, Human
uucugcuccacccuugg

SEQ ID NO: 2460034 - RNA, 18 nt, Human
uucugcuccacccuuggc

SEQ ID NO: 2460035 - RNA, 20 nt, Human
uucugcuccacccuuggccu

SEQ ID NO: 2460036 - RNA, 22 nt, Human
uucugacccaugcugcccugug

SEQ ID NO: 2460037 - RNA, 23 nt, Human
uucugacccaugcugcccuguga

SEQ ID NO: 2460038 - RNA, 17 nt, Human
uucucugcccuccaaga

SEQ ID NO: 2460039 - RNA, 16 nt, Human
uucucugcccuccaag

SEQ ID NO: 2460040 - RNA, 16 nt, Human
uucugagaaagacuau

SEQ ID NO: 2460041 - RNA, 21 nt, Human
uucugagaaagacuauucaaa

SEQ ID NO: 2460042 - RNA, 18 nt, Human
uucugacccugcuucaaa

SEQ ID NO: 2460043 - RNA, 21 nt, Human
uucugacccugcuucaaauau

SEQ ID NO: 2460044 - RNA, 22 nt, Human
uucugauaacuagauggugcug

SEQ ID NO: 2460045 - RNA, 16 nt, Human
uucugauaaugaaaau

SEQ ID NO: 2460046 - RNA, 23 nt, Human
uucugauaacuagauggugcuga

SEQ ID NO: 2460047 - RNA, 23 nt, Human
uucugaguuucauucuccugccu

SEQ ID NO: 2460048 - RNA, 20 nt, Human
uucugaguuucauucuccug

SEQ ID NO: 2460049 - RNA, 19 nt, Human
uucugaguuucauucuccu

SEQ ID NO: 2460050 - RNA, 16 nt, Human
uucugaguuucauucu

SEQ ID NO: 2460051 - RNA, 20 nt, Human
uucugaguguuuuuacuaca

SEQ ID NO: 2460052 - RNA, 20 nt, Human
uucugaggguccacuacuca

SEQ ID NO: 2460053 - RNA, 21 nt, Human
uucugaggacauuccaagaca

SEQ ID NO: 2460054 - RNA, 19 nt, Human
uucugaggacauuccaaga

SEQ ID NO: 2460055 - RNA, 12 nt, Human
uucugaguuccu

SEQ ID NO: 2460056 - RNA, 15 nt, Human
uucugaguuccugca

SEQ ID NO: 2460057 - RNA, 14 nt, Human
uucugaguguuuuu

SEQ ID NO: 2460058 - RNA, 13 nt, Human
uucugagagcugu

SEQ ID NO: 2460059 - RNA, 19 nt, Human
uucugagagcugugcauca

SEQ ID NO: 2460060 - RNA, 18 nt, Human
uucugagaagguccuuaa

SEQ ID NO: 2460061 - RNA, 16 nt, Human
uucucuccagccccug

SEQ ID NO: 2460062 - RNA, 15 nt, Human
uucucuccagccccu

SEQ ID NO: 2460063 - RNA, 14 nt, Human
uucucuccuguacc

SEQ ID NO: 2460064 - RNA, 18 nt, Human
uucucuccuguaccucuu

SEQ ID NO: 2460065 - RNA, 14 nt, Human
uucucuccagcccc

SEQ ID NO: 2460066 - RNA, 13 nt, Human
uucucuccagccc

SEQ ID NO: 2460067 - RNA, 15 nt, Human
uucuccagcugggcu

SEQ ID NO: 2460068 - RNA, 14 nt, Human
uucuccagcugggc

SEQ ID NO: 2460069 - RNA, 23 nt, Human
uucuccagccuggacccccagcu

SEQ ID NO: 2460070 - RNA, 12 nt, Human
uucuccagcugg

SEQ ID NO: 2460071 - RNA, 22 nt, Human
uucuccagccuggacccccagc

SEQ ID NO: 2460072 - RNA, 14 nt, Human
uucuccagccagca

SEQ ID NO: 2460073 - RNA, 17 nt, Human
uucuccagccuggaccc

SEQ ID NO: 2460074 - RNA, 13 nt, Human
uucuccagccagc

SEQ ID NO: 2460075 - RNA, 17 nt, Human
uucuccacucaguugca

SEQ ID NO: 2460076 - RNA, 19 nt, Human
uucuccagacccaccacac

SEQ ID NO: 2460077 - RNA, 12 nt, Human
uucucugcccuc

SEQ ID NO: 2460078 - RNA, 11 nt, Human
uucucugcccu

SEQ ID NO: 2460079 - RNA, 20 nt, Human
uucucugaggacacuaacca

SEQ ID NO: 2460080 - RNA, 14 nt, Human
uucucugaggacac

SEQ ID NO: 2460081 - RNA, 20 nt, Human
uucuccagcugggcucugca

SEQ ID NO: 2460082 - RNA, 19 nt, Human
uucucuccuguaccucuug

SEQ ID NO: 2460083 - RNA, 16 nt, Human
uucucugagcugugca

SEQ ID NO: 2460084 - RNA, 17 nt, Human
uucucugagcugugcag

SEQ ID NO: 2460085 - RNA, 18 nt, Human
uucucugagcugugcagg

SEQ ID NO: 2460086 - RNA, 18 nt, Human
uucuccaccugccaggga

SEQ ID NO: 2460087 - RNA, 16 nt, Human
uucuccaccugccagg

SEQ ID NO: 2460088 - RNA, 20 nt, Human
uucuccaccugccagggaca

SEQ ID NO: 2460089 - RNA, 14 nt, Human
uucuccacucaguu

SEQ ID NO: 2460090 - RNA, 12 nt, Human
uucuccacugga

SEQ ID NO: 2460091 - RNA, 15 nt, Human
uucuccaccugccag

SEQ ID NO: 2460092 - RNA, 14 nt, Human
uucuccaccugcca

SEQ ID NO: 2460093 - RNA, 12 nt, Human
uucuccaccugc

SEQ ID NO: 2460094 - RNA, 21 nt, Human
uucuccaccucccacaaagga

SEQ ID NO: 2460095 - RNA, 21 nt, Human
uucuaugaaauauuauguuaa

SEQ ID NO: 2460096 - RNA, 18 nt, Human
uucucaugugauccuuuu

SEQ ID NO: 2460097 - RNA, 17 nt, Human
uucucaugugauccuuu

SEQ ID NO: 2460098 - RNA, 21 nt, Human
uucucaugccucagccuccug

SEQ ID NO: 2460099 - RNA, 14 nt, Human
uucuaugaaauauu

SEQ ID NO: 2460100 - RNA, 15 nt, Human
uucuauccucuguaa

SEQ ID NO: 2460101 - RNA, 14 nt, Human
uucuauccucugua

SEQ ID NO: 2460102 - RNA, 20 nt, Human
uucuaucauuuuuguacagu

SEQ ID NO: 2460103 - RNA, 23 nt, Human
uucuauccuacaacaagaguuua

SEQ ID NO: 2460104 - RNA, 21 nt, Human
uucuccaccuagacuguaaac

SEQ ID NO: 2460105 - RNA, 19 nt, Human
uucucauuucaccccuccc

SEQ ID NO: 2460106 - RNA, 16 nt, Human
uucuccacccugcucu

SEQ ID NO: 2460107 - RNA, 16 nt, Human
uucucauuucaccccu

SEQ ID NO: 2460108 - RNA, 15 nt, Human
uucucauuucacccc

SEQ ID NO: 2460109 - RNA, 20 nt, Human
uucucauuugccaauaauaa

SEQ ID NO: 2460110 - RNA, 18 nt, Human
uucucauuccaacaguga

SEQ ID NO: 2460111 - RNA, 20 nt, Human
uucucauuccaacagugagu

SEQ ID NO: 2460112 - RNA, 19 nt, Human
uucuacccagcgagcccug

SEQ ID NO: 2460113 - RNA, 12 nt, Human
uucuacccagcg

SEQ ID NO: 2460114 - RNA, 22 nt, Human
uucuacauaaguaauucaagaa

SEQ ID NO: 2460115 - RNA, 15 nt, Human
uucuacauagaugcu

SEQ ID NO: 2460116 - RNA, 16 nt, Human
uucuacauuucuuaga

SEQ ID NO: 2460117 - RNA, 17 nt, Human
uucuacauuucuuagac

SEQ ID NO: 2460118 - RNA, 14 nt, Human
uucuaccauuucag

SEQ ID NO: 2460119 - RNA, 21 nt, Human
uucuaccacacagcagcaguu

SEQ ID NO: 2460120 - RNA, 15 nt, Human
uucuacaaugugaac

SEQ ID NO: 2460121 - RNA, 16 nt, Human
uucuacaaugugaacu

SEQ ID NO: 2460122 - RNA, 18 nt, Human
uucuacaaugugaacuuu

SEQ ID NO: 2460123 - RNA, 15 nt, Human
uucuacacagagcag

SEQ ID NO: 2460124 - RNA, 19 nt, Human
uucuacaaugugaacuuua

SEQ ID NO: 2460125 - RNA, 21 nt, Human
uucuaauuucaaaaauauaac

SEQ ID NO: 2460126 - RNA, 17 nt, Human
uucuaauuuuggaugga

SEQ ID NO: 2460127 - RNA, 18 nt, Human
uucuacaaaauccugaug

SEQ ID NO: 2460128 - RNA, 15 nt, Human
uucuacauacuaugg

SEQ ID NO: 2460129 - RNA, 17 nt, Human
uucuacaguauuaugua

SEQ ID NO: 2460130 - RNA, 21 nt, Human
uucuacagugguuuuauacug

SEQ ID NO: 2460131 - RNA, 15 nt, Human
uucuacagugguuuu

SEQ ID NO: 2460132 - RNA, 20 nt, Human
uucuaauuaauaaauuauuu

SEQ ID NO: 2460133 - RNA, 17 nt, Human
uucuaaugucuucauuu

SEQ ID NO: 2460134 - RNA, 16 nt, Human
uucuaaugucuucauu

SEQ ID NO: 2460135 - RNA, 17 nt, Human
uucuaauuggcaugaag

SEQ ID NO: 2460136 - RNA, 20 nt, Human
uucgugcggaaucagcuucu

SEQ ID NO: 2460137 - RNA, 13 nt, Human
uucguggggaggu

SEQ ID NO: 2460138 - RNA, 17 nt, Human
uucguggugaucaauua

SEQ ID NO: 2460139 - RNA, 22 nt, Human
uucguggugaucaauuaaaugu

SEQ ID NO: 2460140 - RNA, 23 nt, Human
uucuaaugugugaaucagagcac

SEQ ID NO: 2460141 - RNA, 14 nt, Human
uucuaaugucuuca

SEQ ID NO: 2460142 - RNA, 15 nt, Human
uucguacaguucuuc

SEQ ID NO: 2460143 - RNA, 14 nt, Human
uucguacaguucuu

SEQ ID NO: 2460144 - RNA, 20 nt, Human
uucgguuucuaacuuggagc

SEQ ID NO: 2460145 - RNA, 13 nt, Human
uucggugugcacc

SEQ ID NO: 2460146 - RNA, 14 nt, Human
uucgguuucuaacu

SEQ ID NO: 2460147 - RNA, 22 nt, Human
uucgguggcuagucaagcuccu

SEQ ID NO: 2460148 - RNA, 19 nt, Human
uucguagcuuucccaaaua

SEQ ID NO: 2460149 - RNA, 22 nt, Human
uucguacaguucuucgggaaga

SEQ ID NO: 2460150 - RNA, 20 nt, Human
uucguacaguucuucgggaa

SEQ ID NO: 2460151 - RNA, 23 nt, Human
uucguacaguucuucgggaagag

SEQ ID NO: 2460152 - RNA, 16 nt, Human
uucgucuucuaauuuc

SEQ ID NO: 2460153 - RNA, 13 nt, Human
uucgucuucuaau

SEQ ID NO: 2460154 - RNA, 19 nt, Human
uucgucuguuuauaaacau

SEQ ID NO: 2460155 - RNA, 14 nt, Human
uucgucuucuaauu

SEQ ID NO: 2460156 - RNA, 21 nt, Human
uucgugaaguauacuguauuu

SEQ ID NO: 2460157 - RNA, 17 nt, Human
uucgugaaguauacugu

SEQ ID NO: 2460158 - RNA, 18 nt, Human
uucgugaaguauacugua

SEQ ID NO: 2460159 - RNA, 15 nt, Human
uucuacccuagccau

SEQ ID NO: 2460160 - RNA, 14 nt, Human
uucuacccuagcca

SEQ ID NO: 2460161 - RNA, 22 nt, Human
uucuaccaugaacagaaaacau

SEQ ID NO: 2460162 - RNA, 15 nt, Human
uucuaccauuucaga

SEQ ID NO: 2460163 - RNA, 18 nt, Human
uucuaccauuucagagag

SEQ ID NO: 2460164 - RNA, 14 nt, Human
uucuacccaggugc

SEQ ID NO: 2460165 - RNA, 21 nt, Human
uucuacccagcgagcccuggu

SEQ ID NO: 2460166 - RNA, 20 nt, Human
uucuacccagcgagcccugg

SEQ ID NO: 2460167 - RNA, 13 nt, Human
uucuacuauuuau

SEQ ID NO: 2460168 - RNA, 15 nt, Human
uucuacucauauaua

SEQ ID NO: 2460169 - RNA, 11 nt, Human
uucuaccugcc

SEQ ID NO: 2460170 - RNA, 14 nt, Human
uucuaccucccaga

SEQ ID NO: 2460171 - RNA, 12 nt, Human
uucuaccugcca

SEQ ID NO: 2460172 - RNA, 18 nt, Human
uucuaccuugaggucuuu

SEQ ID NO: 2460173 - RNA, 19 nt, Human
uucuaccuugaggucuuuu

SEQ ID NO: 2460174 - RNA, 21 nt, Human
uucuacccuagccauuccugg

SEQ ID NO: 2460175 - RNA, 20 nt, Human
uucuacccuagccauuccug

SEQ ID NO: 2460176 - RNA, 18 nt, Human
uucuacccuagccauucc

SEQ ID NO: 2460177 - RNA, 13 nt, Human
uucuaccucccag

SEQ ID NO: 2460178 - RNA, 12 nt, Human
uucuaccuccca

SEQ ID NO: 2460179 - RNA, 13 nt, Human
uucuacgccaggg

SEQ ID NO: 2460180 - RNA, 14 nt, Human
uucuauagcuuuuc

SEQ ID NO: 2460181 - RNA, 23 nt, Human
uucuauagcagauuguguaacaa

SEQ ID NO: 2460182 - RNA, 19 nt, Human
uucuaucauuuuuguacag

SEQ ID NO: 2460183 - RNA, 20 nt, Human
uucuauaugaauuuaaauau

SEQ ID NO: 2460184 - RNA, 18 nt, Human
uucuaucauuuuuguaca

SEQ ID NO: 2460185 - RNA, 12 nt, Human
uucuauaugaau

SEQ ID NO: 2460186 - RNA, 20 nt, Human
uucuauaggaacauaugaaa

SEQ ID NO: 2460187 - RNA, 22 nt, Human
uucuacucgaguuacagacaaa

SEQ ID NO: 2460188 - RNA, 12 nt, Human
uucuacuguaug

SEQ ID NO: 2460189 - RNA, 17 nt, Human
uucuacucuuaaguuuc

SEQ ID NO: 2460190 - RNA, 19 nt, Human
uucuacucucccauggcuu

SEQ ID NO: 2460191 - RNA, 14 nt, Human
uucuacucucccau

SEQ ID NO: 2460192 - RNA, 18 nt, Human
uucuacucauauauaucu

SEQ ID NO: 2460193 - RNA, 13 nt, Human
uucuacugugacu

SEQ ID NO: 2460194 - RNA, 21 nt, Human
uucuacucuuaaguuucucag

SEQ ID NO: 2460195 - RNA, 18 nt, Human
uucuacuuuaagcacuac

SEQ ID NO: 2460196 - RNA, 15 nt, Human
uucuacuuuuaaaga

SEQ ID NO: 2460197 - RNA, 19 nt, Human
uuccugcaacucaaggacu

SEQ ID NO: 2460198 - RNA, 22 nt, Human
uuccugaugguacaggaaagcu

SEQ ID NO: 2460199 - RNA, 19 nt, Human
uuccugaugguacaggaaa

SEQ ID NO: 2460200 - RNA, 21 nt, Human
uuccugauggcaggauggccu

SEQ ID NO: 2460201 - RNA, 17 nt, Human
uuccugauaauaauuga

SEQ ID NO: 2460202 - RNA, 19 nt, Human
uuccugauaauaauugauc

SEQ ID NO: 2460203 - RNA, 23 nt, Human
uuccugaugcuucuucagagacu

SEQ ID NO: 2460204 - RNA, 20 nt, Human
uuccugcaacucaaggacuu

SEQ ID NO: 2460205 - RNA, 13 nt, Human
uuccugcaaugaa

SEQ ID NO: 2460206 - RNA, 21 nt, Human
uuccugcaaugaagucucuga

SEQ ID NO: 2460207 - RNA, 15 nt, Human
uuccugcagccugga

SEQ ID NO: 2460208 - RNA, 14 nt, Human
uuccugcagccugg

SEQ ID NO: 2460209 - RNA, 21 nt, Human
uuccugcaggccaggccagcu

SEQ ID NO: 2460210 - RNA, 15 nt, Human
uuccugaggcugggc

SEQ ID NO: 2460211 - RNA, 11 nt, Human
uuccugagcuu

SEQ ID NO: 2460212 - RNA, 13 nt, Human
uuccugagcuugg

SEQ ID NO: 2460213 - RNA, 20 nt, Human
uuccugagcuuggccagaag

SEQ ID NO: 2460214 - RNA, 20 nt, Human
uuccugaggcugggcucccu

SEQ ID NO: 2460215 - RNA, 21 nt, Human
uuccugaggaagagggacugu

SEQ ID NO: 2460216 - RNA, 16 nt, Human
uuccugagcuuggcca

SEQ ID NO: 2460217 - RNA, 13 nt, Human
uuccugaauccaa

SEQ ID NO: 2460218 - RNA, 11 nt, Human
uuccugaagcu

SEQ ID NO: 2460219 - RNA, 18 nt, Human
uuccugaauccaaacuaa

SEQ ID NO: 2460220 - RNA, 14 nt, Human
uuccugaagcugag

SEQ ID NO: 2460221 - RNA, 14 nt, Human
uuccugaaugaaau

SEQ ID NO: 2460222 - RNA, 23 nt, Human
uuccugacccaggccgcagcucu

SEQ ID NO: 2460223 - RNA, 22 nt, Human
uuccugacccaggccgcagcuc

SEQ ID NO: 2460224 - RNA, 16 nt, Human
uuccugacccaggccg

SEQ ID NO: 2460225 - RNA, 15 nt, Human
uuccugacccaggcc

SEQ ID NO: 2460226 - RNA, 14 nt, Human
uuccugacccaggc

SEQ ID NO: 2460227 - RNA, 13 nt, Human
uuccugacccagg

SEQ ID NO: 2460228 - RNA, 22 nt, Human
uuccugaauucuauuugcuggg

SEQ ID NO: 2460229 - RNA, 22 nt, Human
uuccugacacuuuaauuaccaa

SEQ ID NO: 2460230 - RNA, 13 nt, Human
uuccugacacuuu

SEQ ID NO: 2460231 - RNA, 20 nt, Human
uuccugaauucuauuugcug

SEQ ID NO: 2460232 - RNA, 16 nt, Human
uuccugaaugaaauau

SEQ ID NO: 2460233 - RNA, 12 nt, Human
uuccauggccuc

SEQ ID NO: 2460234 - RNA, 16 nt, Human
uuccauggcccucauu

SEQ ID NO: 2460235 - RNA, 15 nt, Human
uuccauggcccucau

SEQ ID NO: 2460236 - RNA, 23 nt, Human
uuccaugccugaggguggagacu

SEQ ID NO: 2460237 - RNA, 14 nt, Human
uuccauggauuuug

SEQ ID NO: 2460238 - RNA, 16 nt, Human
uuccauggccucuuca

SEQ ID NO: 2460239 - RNA, 12 nt, Human
uuccauggggua

SEQ ID NO: 2460240 - RNA, 21 nt, Human
uuccauggugugaucgucuga

SEQ ID NO: 2460241 - RNA, 17 nt, Human
uuccauggcccucauua

SEQ ID NO: 2460242 - RNA, 17 nt, Human
uuccugcguccuccuca

SEQ ID NO: 2460243 - RNA, 16 nt, Human
uuccugcguccuccuc

SEQ ID NO: 2460244 - RNA, 19 nt, Human
uuccugcguccuccucacc

SEQ ID NO: 2460245 - RNA, 15 nt, Human
uuccugccugucucc

SEQ ID NO: 2460246 - RNA, 18 nt, Human
uuccugcagccuggaggc

SEQ ID NO: 2460247 - RNA, 18 nt, Human
uuccugcauucacccaga

SEQ ID NO: 2460248 - RNA, 16 nt, Human
uuccugccugucuccu

SEQ ID NO: 2460249 - RNA, 18 nt, Human
uuccugccugucuccuuu

SEQ ID NO: 2460250 - RNA, 19 nt, Human
uuccugcggagugaagagg

SEQ ID NO: 2460251 - RNA, 17 nt, Human
uuccugcggagugaaga

SEQ ID NO: 2460252 - RNA, 23 nt, Human
uuccugccuucuucuuuuugcug

SEQ ID NO: 2460253 - RNA, 23 nt, Human
uuccugcggagugaagaggggca

SEQ ID NO: 2460254 - RNA, 20 nt, Human
uuccugcggagugaagaggg

SEQ ID NO: 2460255 - RNA, 15 nt, Human
uuccugcguccuccu

SEQ ID NO: 2460256 - RNA, 21 nt, Human
uuccugcgggcuuuuccccgg

SEQ ID NO: 2460257 - RNA, 16 nt, Human
uuccuugcucugcacc

SEQ ID NO: 2460258 - RNA, 14 nt, Human
uuccuugcucuccc

SEQ ID NO: 2460259 - RNA, 13 nt, Human
uuccuugcucucc

SEQ ID NO: 2460260 - RNA, 11 nt, Human
uuccuugcucu

SEQ ID NO: 2460261 - RNA, 15 nt, Human
uuccuugcucaacca

SEQ ID NO: 2460262 - RNA, 13 nt, Human
uuccuugcucaac

SEQ ID NO: 2460263 - RNA, 13 nt, Human
uuccuugcuaaug

SEQ ID NO: 2460264 - RNA, 19 nt, Human
uuccuugccugcacaaacu

SEQ ID NO: 2460265 - RNA, 13 nt, Human
uuccuugccugca

SEQ ID NO: 2460266 - RNA, 15 nt, Human
uuccuggacacucag

SEQ ID NO: 2460267 - RNA, 21 nt, Human
uuccuugaguugauucagcuc

SEQ ID NO: 2460268 - RNA, 16 nt, Human
uuccuuuaaaaaaauu

SEQ ID NO: 2460269 - RNA, 20 nt, Human
uuccuuguccccacacuccu

SEQ ID NO: 2460270 - RNA, 17 nt, Human
uuccuuguccccacacu

SEQ ID NO: 2460271 - RNA, 16 nt, Human
uuccuuguccccacac

SEQ ID NO: 2460272 - RNA, 21 nt, Human
uuccuuguccccacacuccua

SEQ ID NO: 2460273 - RNA, 23 nt, Human
uuccuuuaaaaaaauuuaagugc

SEQ ID NO: 2460274 - RNA, 17 nt, Human
uuccuuuaaaaaaauuu

SEQ ID NO: 2460275 - RNA, 16 nt, Human
uuccuugucacuggua

SEQ ID NO: 2460276 - RNA, 13 nt, Human
uuccuugucccca

SEQ ID NO: 2460277 - RNA, 15 nt, Human
uuccuuguauuuaaa

SEQ ID NO: 2460278 - RNA, 18 nt, Human
uuccuuguauuuaaauau

SEQ ID NO: 2460279 - RNA, 18 nt, Human
uuccuugcuguccuaggc

SEQ ID NO: 2460280 - RNA, 20 nt, Human
uuccuugcuguccuaggcca

SEQ ID NO: 2460281 - RNA, 18 nt, Human
uuccuugcucugcacccc

SEQ ID NO: 2460282 - RNA, 18 nt, Human
uucggugagcuacaaaug

SEQ ID NO: 2460283 - RNA, 13 nt, Human
uuccuuuauaaug

SEQ ID NO: 2460284 - RNA, 14 nt, Human
uuccuuuauauuua

SEQ ID NO: 2460285 - RNA, 16 nt, Human
uuccuuucauuuacug

SEQ ID NO: 2460286 - RNA, 17 nt, Human
uucgggugugcaauguc

SEQ ID NO: 2460287 - RNA, 21 nt, Human
uucgggugugcaaugucugag

SEQ ID NO: 2460288 - RNA, 17 nt, Human
uucggggaacuccugga

SEQ ID NO: 2460289 - RNA, 15 nt, Human
uucugucccucacag

SEQ ID NO: 2460290 - RNA, 14 nt, Human
uucugucccuucug

SEQ ID NO: 2460291 - RNA, 19 nt, Human
uucuguccuacucuguguc

SEQ ID NO: 2460292 - RNA, 14 nt, Human
uucugucaagaaga

SEQ ID NO: 2460293 - RNA, 19 nt, Human
uucugucucugccucccuc

SEQ ID NO: 2460294 - RNA, 14 nt, Human
uucugucucugccu

SEQ ID NO: 2460295 - RNA, 13 nt, Human
uucugucucugcc

SEQ ID NO: 2460296 - RNA, 21 nt, Human
uucugucgccuuagcauguuu

SEQ ID NO: 2460297 - RNA, 16 nt, Human
uucugucucauaugau

SEQ ID NO: 2460298 - RNA, 18 nt, Human
uucuguccuggugucacu

SEQ ID NO: 2460299 - RNA, 13 nt, Human
uucuguccugcug

SEQ ID NO: 2460300 - RNA, 17 nt, Human
uucugucccuuggagcu

SEQ ID NO: 2460301 - RNA, 14 nt, Human
uucuguccuucaga

SEQ ID NO: 2460302 - RNA, 22 nt, Human
uucuguccuuuuggcacugaga

SEQ ID NO: 2460303 - RNA, 18 nt, Human
uucugucgccuuagcaug

SEQ ID NO: 2460304 - RNA, 23 nt, Human
uucuguccuuuuggcacugagau

SEQ ID NO: 2460305 - RNA, 19 nt, Human
uucuggauaaagccacuga

SEQ ID NO: 2460306 - RNA, 18 nt, Human
uucuggauaaagccacug

SEQ ID NO: 2460307 - RNA, 13 nt, Human
uucuggauaaagc

SEQ ID NO: 2460308 - RNA, 20 nt, Human
uucuggaugcauuucucugg

SEQ ID NO: 2460309 - RNA, 15 nt, Human
uucuggaugcauuuc

SEQ ID NO: 2460310 - RNA, 15 nt, Human
uucuggauucuuggc

SEQ ID NO: 2460311 - RNA, 20 nt, Human
uucuggauuuugucaagcag

SEQ ID NO: 2460312 - RNA, 11 nt, Human
uucuguauuuu

SEQ ID NO: 2460313 - RNA, 22 nt, Human
uucuguauuuuuuuuucuaaga

SEQ ID NO: 2460314 - RNA, 20 nt, Human
uucuguauuuuuuuuucuaa

SEQ ID NO: 2460315 - RNA, 18 nt, Human
uucuguauuuuguuuuug

SEQ ID NO: 2460316 - RNA, 17 nt, Human
uucugucuucacaacag

SEQ ID NO: 2460317 - RNA, 21 nt, Human
uucugucucugccucccucac

SEQ ID NO: 2460318 - RNA, 23 nt, Human
uucugugguuuuccccucccugg

SEQ ID NO: 2460319 - RNA, 20 nt, Human
uucugugguuuuccccuccc

SEQ ID NO: 2460320 - RNA, 18 nt, Human
uucugugguuuuccccuc

SEQ ID NO: 2460321 - RNA, 22 nt, Human
uucugugucuuucacagcuccu

SEQ ID NO: 2460322 - RNA, 12 nt, Human
uucugugucuuu

SEQ ID NO: 2460323 - RNA, 23 nt, Human
uucugugucuuucacagcuccuc

SEQ ID NO: 2460324 - RNA, 13 nt, Human
uucugugugaaga

SEQ ID NO: 2460325 - RNA, 19 nt, Human
uucuuaguucucacuguuc

SEQ ID NO: 2460326 - RNA, 18 nt, Human
uucuuaguucucacuguu

SEQ ID NO: 2460327 - RNA, 22 nt, Human
uucugugguuuuccccucccug

SEQ ID NO: 2460328 - RNA, 23 nt, Human
uucugugugcaccuuaccaacuu

SEQ ID NO: 2460329 - RNA, 22 nt, Human
uucugugugugaugugcauggg

SEQ ID NO: 2460330 - RNA, 20 nt, Human
uucuguguguuuucauaaua

SEQ ID NO: 2460331 - RNA, 17 nt, Human
uucuuauaaauaugaag

SEQ ID NO: 2460332 - RNA, 15 nt, Human
uucuuauaaauauga

SEQ ID NO: 2460333 - RNA, 14 nt, Human
uucuuauaaauaug

SEQ ID NO: 2460334 - RNA, 13 nt, Human
uucuuauaaauau

SEQ ID NO: 2460335 - RNA, 23 nt, Human
uucuuaguugcuguaugucucgu

SEQ ID NO: 2460336 - RNA, 15 nt, Human
uucuuaguugcugua

SEQ ID NO: 2460337 - RNA, 14 nt, Human
uucuuaguugcugu

SEQ ID NO: 2460338 - RNA, 19 nt, Human
uucugcuuuucugcccugg

SEQ ID NO: 2460339 - RNA, 18 nt, Human
uucugcuuuucugcccug

SEQ ID NO: 2460340 - RNA, 17 nt, Human
uucugcuuuucugcccu

SEQ ID NO: 2460341 - RNA, 13 nt, Human
uucugcuuuucug

SEQ ID NO: 2460342 - RNA, 18 nt, Human
uucuggaaaagaggaguu

SEQ ID NO: 2460343 - RNA, 19 nt, Human
uucugcuuuugaaaucugu

SEQ ID NO: 2460344 - RNA, 17 nt, Human
uucuggaauacaugaaa

SEQ ID NO: 2460345 - RNA, 21 nt, Human
uucugcuuuuaccaugccccu

SEQ ID NO: 2460346 - RNA, 14 nt, Human
uucugcuuugcucu

SEQ ID NO: 2460347 - RNA, 18 nt, Human
uucugcuuuccucuuccu

SEQ ID NO: 2460348 - RNA, 16 nt, Human
uucugcuuaggagaga

SEQ ID NO: 2460349 - RNA, 15 nt, Human
uucugcuuucaucuu

SEQ ID NO: 2460350 - RNA, 20 nt, Human
uucuggaauguaaucaaugu

SEQ ID NO: 2460351 - RNA, 16 nt, Human
uucuggaauguaauca

SEQ ID NO: 2460352 - RNA, 19 nt, Human
uucuggaauacaugaaaua

SEQ ID NO: 2460353 - RNA, 15 nt, Human
uucuggaauguaauc

SEQ ID NO: 2460354 - RNA, 22 nt, Human
uucuggaauguaaucaauguuu

SEQ ID NO: 2460355 - RNA, 19 nt, Human
uucuggacccguucaacuu

SEQ ID NO: 2460356 - RNA, 21 nt, Human
uucuggaccuuguuguuguua

SEQ ID NO: 2460357 - RNA, 10 nt, Human
uucuggagcc

SEQ ID NO: 2460358 - RNA, 10 nt, Human
uucuggaguu

SEQ ID NO: 2460359 - RNA, 17 nt, Human
uucuggagucuccagug

SEQ ID NO: 2460360 - RNA, 15 nt, Human
uucuggagucuccag

SEQ ID NO: 2460361 - RNA, 20 nt, Human
uucuggagguugauaacuuu

SEQ ID NO: 2460362 - RNA, 13 nt, Human
uucuggagcccuu

SEQ ID NO: 2460363 - RNA, 15 nt, Human
uucuggagcccuugg

SEQ ID NO: 2460364 - RNA, 15 nt, Human
uucugcugggcuggg

SEQ ID NO: 2460365 - RNA, 13 nt, Human
uucugcugggcug

SEQ ID NO: 2460366 - RNA, 19 nt, Human
uucugcuggccuggaucuc

SEQ ID NO: 2460367 - RNA, 18 nt, Human
uucugcuggccuggaucu

SEQ ID NO: 2460368 - RNA, 15 nt, Human
uucugcuggccugga

SEQ ID NO: 2460369 - RNA, 14 nt, Human
uucugcuggccugg

SEQ ID NO: 2460370 - RNA, 13 nt, Human
uucugcuggccug

SEQ ID NO: 2460371 - RNA, 14 nt, Human
uucugcuucagccu

SEQ ID NO: 2460372 - RNA, 20 nt, Human
uucugcugaauuuucacaug

SEQ ID NO: 2460373 - RNA, 18 nt, Human
uucugcugaauuuucaca

SEQ ID NO: 2460374 - RNA, 14 nt, Human
uucugcugaauuuu

SEQ ID NO: 2460375 - RNA, 12 nt, Human
uucugcuggccu

SEQ ID NO: 2460376 - RNA, 13 nt, Human
uucugcuggauaa

SEQ ID NO: 2460377 - RNA, 21 nt, Human
uucugcuggauaaaaugaggu

SEQ ID NO: 2460378 - RNA, 18 nt, Human
uucugcuggaaacagacu

SEQ ID NO: 2460379 - RNA, 16 nt, Human
uucugcuucagccucc

SEQ ID NO: 2460380 - RNA, 15 nt, Human
uucugcuucagccuc

SEQ ID NO: 2460381 - RNA, 19 nt, Human
uucugcuucagccucccga

SEQ ID NO: 2460382 - RNA, 18 nt, Human
uucugcuuguguuaagua

SEQ ID NO: 2460383 - RNA, 20 nt, Human
uucugcugggcuggggccug

SEQ ID NO: 2460384 - RNA, 14 nt, Human
uucugcuuaggaga

SEQ ID NO: 2460385 - RNA, 16 nt, Human
uugaaaaggugaccuu

SEQ ID NO: 2460386 - RNA, 14 nt, Human
uugaaaagcuauua

SEQ ID NO: 2460387 - RNA, 22 nt, Human
uugaaaagcuauuagccaggau

SEQ ID NO: 2460388 - RNA, 13 nt, Human
uugaaaagcuauu

SEQ ID NO: 2460389 - RNA, 20 nt, Human
uugaacucagaucugucuga

SEQ ID NO: 2460390 - RNA, 15 nt, Human
uugaacucagaucug

SEQ ID NO: 2460391 - RNA, 15 nt, Human
uugaaaagucaaacu

SEQ ID NO: 2460392 - RNA, 16 nt, Human
uugaacuccuggccuc

SEQ ID NO: 2460393 - RNA, 15 nt, Human
uugaacuccuggccu

SEQ ID NO: 2460394 - RNA, 16 nt, Human
uugaaaacuuuucuca

SEQ ID NO: 2460395 - RNA, 14 nt, Human
uugaaaacuuuucu

SEQ ID NO: 2460396 - RNA, 13 nt, Human
uugaaaacuuuuc

SEQ ID NO: 2460397 - RNA, 13 nt, Human
uugaaaagaggug

SEQ ID NO: 2460398 - RNA, 17 nt, Human
uugaaaacuuuucucag

SEQ ID NO: 2460399 - RNA, 13 nt, Human
uugaaaagacauc

SEQ ID NO: 2460400 - RNA, 14 nt, Human
uugaaaagaggugu

SEQ ID NO: 2460401 - RNA, 21 nt, Human
uugaaaagaggugugcaagag

SEQ ID NO: 2460402 - RNA, 12 nt, Human
uugaaaagcuau

SEQ ID NO: 2460403 - RNA, 20 nt, Human
uugaaaaaccauuuugcugu

SEQ ID NO: 2460404 - RNA, 20 nt, Human
uugaaaaaauagagccugag

SEQ ID NO: 2460405 - RNA, 21 nt, Human
uucuuuccaaaguacacuguu

SEQ ID NO: 2460406 - RNA, 14 nt, Human
uucuuucauuuucu

SEQ ID NO: 2460407 - RNA, 18 nt, Human
uucuuuuuuuucauuaua

SEQ ID NO: 2460408 - RNA, 23 nt, Human
uugaaaacacuguucucugcccu

SEQ ID NO: 2460409 - RNA, 18 nt, Human
uugaaaacauaaucugca

SEQ ID NO: 2460410 - RNA, 16 nt, Human
uugaaaaccugacaaa

SEQ ID NO: 2460411 - RNA, 22 nt, Human
uugaaaaaauagagccugaggg

SEQ ID NO: 2460412 - RNA, 21 nt, Human
uucuuguguguuuauugucaa

SEQ ID NO: 2460413 - RNA, 13 nt, Human
uucuuccucccuc

SEQ ID NO: 2460414 - RNA, 14 nt, Human
uucuuguguguuua

SEQ ID NO: 2460415 - RNA, 19 nt, Human
uucuuuaaaagaaugggca

SEQ ID NO: 2460416 - RNA, 16 nt, Human
uucuuuaaaagaaugg

SEQ ID NO: 2460417 - RNA, 13 nt, Human
uucuuuaaaagaa

SEQ ID NO: 2460418 - RNA, 23 nt, Human
uucuuuaaaaaacaacuauggau

SEQ ID NO: 2460419 - RNA, 12 nt, Human
uucuuucagcca

SEQ ID NO: 2460420 - RNA, 14 nt, Human
uucuuuccaaagua

SEQ ID NO: 2460421 - RNA, 21 nt, Human
uucuuccacaagagcccaggc

SEQ ID NO: 2460422 - RNA, 19 nt, Human
uucuuccaggugcccagcu

SEQ ID NO: 2460423 - RNA, 20 nt, Human
uucuuccaggugcccagcua

SEQ ID NO: 2460424 - RNA, 21 nt, Human
uucuucauucaauacaagugu

SEQ ID NO: 2460425 - RNA, 13 nt, Human
uucuuaguucuca

SEQ ID NO: 2460426 - RNA, 22 nt, Human
uucuuauaaauaugaagcucac

SEQ ID NO: 2460427 - RNA, 17 nt, Human
uucuuccaaaaagauuu

SEQ ID NO: 2460428 - RNA, 21 nt, Human
uucuuauacauuugauaaagu

SEQ ID NO: 2460429 - RNA, 14 nt, Human
uucuuccaucugau

SEQ ID NO: 2460430 - RNA, 17 nt, Human
uucuuccaucccaggac

SEQ ID NO: 2460431 - RNA, 16 nt, Human
uucuuccaucccagga

SEQ ID NO: 2460432 - RNA, 14 nt, Human
uucuuccaucccag

SEQ ID NO: 2460433 - RNA, 13 nt, Human
uucuuccaucuga

SEQ ID NO: 2460434 - RNA, 13 nt, Human
uucuuccauccca

SEQ ID NO: 2460435 - RNA, 21 nt, Human
uucuuccuauuugccaugggc

SEQ ID NO: 2460436 - RNA, 22 nt, Human
uucuucccuuuuacauacugcu

SEQ ID NO: 2460437 - RNA, 20 nt, Human
uucuucccuuuuacauacug

SEQ ID NO: 2460438 - RNA, 21 nt, Human
uucuucccuuuuacauacugc

SEQ ID NO: 2460439 - RNA, 19 nt, Human
uucuucccaucacuggagc

SEQ ID NO: 2460440 - RNA, 19 nt, Human
uugaugcauuaaaagaaaa

SEQ ID NO: 2460441 - RNA, 20 nt, Human
uugaugcauuaaaagaaaau

SEQ ID NO: 2460442 - RNA, 17 nt, Human
uugaugacccccaacca

SEQ ID NO: 2460443 - RNA, 14 nt, Human
uugaugaggccucu

SEQ ID NO: 2460444 - RNA, 19 nt, Human
uugauaucacagucuaauu

SEQ ID NO: 2460445 - RNA, 16 nt, Human
uugaugaucuuugcag

SEQ ID NO: 2460446 - RNA, 20 nt, Human
uugauugcuaaauguaacag

SEQ ID NO: 2460447 - RNA, 15 nt, Human
uugauugcuaaaugu

SEQ ID NO: 2460448 - RNA, 13 nt, Human
uugauugcuaaau

SEQ ID NO: 2460449 - RNA, 12 nt, Human
uugauugcuaaa

SEQ ID NO: 2460450 - RNA, 13 nt, Human
uugauugauuuga

SEQ ID NO: 2460451 - RNA, 14 nt, Human
uugauugauuugaa

SEQ ID NO: 2460452 - RNA, 12 nt, Human
uugauucugcag

SEQ ID NO: 2460453 - RNA, 20 nt, Human
uugauucugcaguaaaucuu

SEQ ID NO: 2460454 - RNA, 12 nt, Human
uugauucuuccu

SEQ ID NO: 2460455 - RNA, 21 nt, Human
uugauugagaguaacuuaagu

SEQ ID NO: 2460456 - RNA, 13 nt, Human
uugauuugaagaa

SEQ ID NO: 2460457 - RNA, 14 nt, Human
uugauuugaagaac

SEQ ID NO: 2460458 - RNA, 23 nt, Human
uugauugcuaaauguaacagucu

SEQ ID NO: 2460459 - RNA, 12 nt, Human
uugcaaaucuug

SEQ ID NO: 2460460 - RNA, 15 nt, Human
uugcaaaucuugaaa

SEQ ID NO: 2460461 - RNA, 16 nt, Human
uugcaaaucuugaaau

SEQ ID NO: 2460462 - RNA, 23 nt, Human
uugcaaaugcccuuacacuuacu

SEQ ID NO: 2460463 - RNA, 17 nt, Human
uugcaaaucuugaaauu

SEQ ID NO: 2460464 - RNA, 21 nt, Human
uugcaaaguaucccuacugua

SEQ ID NO: 2460465 - RNA, 22 nt, Human
uugcaaaggagcucacuguggu

SEQ ID NO: 2460466 - RNA, 12 nt, Human
uugcaaauaguc

SEQ ID NO: 2460467 - RNA, 15 nt, Human
uugauuugcauugaa

SEQ ID NO: 2460468 - RNA, 17 nt, Human
uugauuugcauugaaca

SEQ ID NO: 2460469 - RNA, 19 nt, Human
uugauuugcauugaacaca

SEQ ID NO: 2460470 - RNA, 13 nt, Human
uugauuugcauug

SEQ ID NO: 2460471 - RNA, 14 nt, Human
uugauuugcauuga

SEQ ID NO: 2460472 - RNA, 18 nt, Human
uugauuugaagaacaugu

SEQ ID NO: 2460473 - RNA, 17 nt, Human
uugauuucuuuccagag

SEQ ID NO: 2460474 - RNA, 20 nt, Human
uugauuuuagccuucucugu

SEQ ID NO: 2460475 - RNA, 13 nt, Human
uugauuuuacaau

SEQ ID NO: 2460476 - RNA, 23 nt, Human
uugauuuuacaauugaaaugacu

SEQ ID NO: 2460477 - RNA, 18 nt, Human
uugagccagcagacauug

SEQ ID NO: 2460478 - RNA, 12 nt, Human
uugacuguuuuu

SEQ ID NO: 2460479 - RNA, 17 nt, Human
uugacuggguuucucug

SEQ ID NO: 2460480 - RNA, 23 nt, Human
uugacuggguuucucuguauagu

SEQ ID NO: 2460481 - RNA, 20 nt, Human
uugagccagcagacauuguc

SEQ ID NO: 2460482 - RNA, 19 nt, Human
uugagccagcagacauugu

SEQ ID NO: 2460483 - RNA, 13 nt, Human
uugagccaggccu

SEQ ID NO: 2460484 - RNA, 17 nt, Human
uugagccaggccugggu

SEQ ID NO: 2460485 - RNA, 19 nt, Human
uugagcccacaaagccuua

SEQ ID NO: 2460486 - RNA, 22 nt, Human
uugagccaggccugggucugug

SEQ ID NO: 2460487 - RNA, 13 nt, Human
uugagcccaggag

SEQ ID NO: 2460488 - RNA, 23 nt, Human
uugagccccaaguccugaagagg

SEQ ID NO: 2460489 - RNA, 18 nt, Human
uugagccccaaguccuga

SEQ ID NO: 2460490 - RNA, 14 nt, Human
uugagccccaaguc

SEQ ID NO: 2460491 - RNA, 19 nt, Human
uugagccccaaguccugaa

SEQ ID NO: 2460492 - RNA, 19 nt, Human
uugagccgggccccugggc

SEQ ID NO: 2460493 - RNA, 11 nt, Human
uugagccuggg

SEQ ID NO: 2460494 - RNA, 20 nt, Human
uugagccgggccccugggcu

SEQ ID NO: 2460495 - RNA, 13 nt, Human
uugaggguugggc

SEQ ID NO: 2460496 - RNA, 16 nt, Human
uugaggguugggcugg

SEQ ID NO: 2460497 - RNA, 21 nt, Human
uugagguccagcccuggcuga

SEQ ID NO: 2460498 - RNA, 16 nt, Human
uugaggucaaguaaga

SEQ ID NO: 2460499 - RNA, 22 nt, Human
uugaggucaaguaagaagacau

SEQ ID NO: 2460500 - RNA, 19 nt, Human
uugagguacucugcacaua

SEQ ID NO: 2460501 - RNA, 21 nt, Human
uugagguaggagaauugcuug

SEQ ID NO: 2460502 - RNA, 14 nt, Human
uugaugaagaaguu

SEQ ID NO: 2460503 - RNA, 13 nt, Human
uugaugaagaagu

SEQ ID NO: 2460504 - RNA, 23 nt, Human
uugaugaagaaguugauaugccu

SEQ ID NO: 2460505 - RNA, 15 nt, Human
uugauaucacagucu

SEQ ID NO: 2460506 - RNA, 20 nt, Human
uugaugaccaaaguccuuuu

SEQ ID NO: 2460507 - RNA, 23 nt, Human
uugauagcacagacccugcccug

SEQ ID NO: 2460508 - RNA, 19 nt, Human
uugauagcuuuauuuuuua

SEQ ID NO: 2460509 - RNA, 14 nt, Human
uugauagcuuuauu

SEQ ID NO: 2460510 - RNA, 17 nt, Human
uugaggucugcucggcc

SEQ ID NO: 2460511 - RNA, 23 nt, Human
uugauauccucuuugagugaagc

SEQ ID NO: 2460512 - RNA, 22 nt, Human
uugauauagaacagugcuugcc

SEQ ID NO: 2460513 - RNA, 17 nt, Human
uugauauagaacagugc

SEQ ID NO: 2460514 - RNA, 21 nt, Human
uugauauacuuuuuucuuauu

SEQ ID NO: 2460515 - RNA, 20 nt, Human
uugauauacuuuuuucuuau

SEQ ID NO: 2460516 - RNA, 18 nt, Human
uugauauaaauaaaacau

SEQ ID NO: 2460517 - RNA, 19 nt, Human
uugacgccaucccagcccc

SEQ ID NO: 2460518 - RNA, 18 nt, Human
uugacgccaucccagccc

SEQ ID NO: 2460519 - RNA, 17 nt, Human
uugacgccaucccagcc

SEQ ID NO: 2460520 - RNA, 16 nt, Human
uugaccucugcagcaa

SEQ ID NO: 2460521 - RNA, 19 nt, Human
uugacucaccuguuacuug

SEQ ID NO: 2460522 - RNA, 14 nt, Human
uugacucaccuguu

SEQ ID NO: 2460523 - RNA, 20 nt, Human
uugacugaagaugcagcuca

SEQ ID NO: 2460524 - RNA, 21 nt, Human
uugacucuuuugccauuaaac

SEQ ID NO: 2460525 - RNA, 15 nt, Human
uugacucuuuugcca

SEQ ID NO: 2460526 - RNA, 13 nt, Human
uugacucugggga

SEQ ID NO: 2460527 - RNA, 19 nt, Human
uugacucuggcaaagcuuu

SEQ ID NO: 2460528 - RNA, 23 nt, Human
uugacuccuugugguuuauguca

SEQ ID NO: 2460529 - RNA, 17 nt, Human
uugacccacaagaaaug

SEQ ID NO: 2460530 - RNA, 17 nt, Human
uugaccgugaggccaga

SEQ ID NO: 2460531 - RNA, 14 nt, Human
uugacccacaagaa

SEQ ID NO: 2460532 - RNA, 22 nt, Human
uugacaagucauuuuaacuuua

SEQ ID NO: 2460533 - RNA, 14 nt, Human
uugaccucugcagc

SEQ ID NO: 2460534 - RNA, 15 nt, Human
uugaccucugcagca

SEQ ID NO: 2460535 - RNA, 21 nt, Human
uugaccucaggugauccaccc

SEQ ID NO: 2460536 - RNA, 20 nt, Human
uugaccgcgacuaauuucaa

SEQ ID NO: 2460537 - RNA, 16 nt, Human
uugacaaaauuuguug

SEQ ID NO: 2460538 - RNA, 19 nt, Human
uugacaaagucaagccaca

SEQ ID NO: 2460539 - RNA, 18 nt, Human
uugacaaaggcaagcacu

SEQ ID NO: 2460540 - RNA, 20 nt, Human
uugacaaagucaagccacau

SEQ ID NO: 2460541 - RNA, 16 nt, Human
uugacaaccaugagac

SEQ ID NO: 2460542 - RNA, 12 nt, Human
uugacaacaucu

SEQ ID NO: 2460543 - RNA, 13 nt, Human
uugacaacaucug

SEQ ID NO: 2460544 - RNA, 13 nt, Human
uugacaaacucuc

SEQ ID NO: 2460545 - RNA, 14 nt, Human
uugacaacaaauua

SEQ ID NO: 2460546 - RNA, 14 nt, Human
uugaauuuucugug

SEQ ID NO: 2460547 - RNA, 18 nt, Human
uugaauuuucccacugca

SEQ ID NO: 2460548 - RNA, 18 nt, Human
uugaauuuugaugaacaa

SEQ ID NO: 2460549 - RNA, 17 nt, Human
uugaauuuucccacugc

SEQ ID NO: 2460550 - RNA, 16 nt, Human
uugaauuuucccacug

SEQ ID NO: 2460551 - RNA, 18 nt, Human
uugaacuuccugcaggua

SEQ ID NO: 2460552 - RNA, 18 nt, Human
uugaacuuaaauaaaugu

SEQ ID NO: 2460553 - RNA, 14 nt, Human
uugaauuguaagga

SEQ ID NO: 2460554 - RNA, 22 nt, Human
uugaacuuaaauaaaugucauu

SEQ ID NO: 2460555 - RNA, 17 nt, Human
uugaacuccugaccuca

SEQ ID NO: 2460556 - RNA, 19 nt, Human
uugaacugauaguuacugu

SEQ ID NO: 2460557 - RNA, 15 nt, Human
uugaacuccugggcu

SEQ ID NO: 2460558 - RNA, 18 nt, Human
uugaacuggguacuugug

SEQ ID NO: 2460559 - RNA, 13 nt, Human
uugaacuuugacc

SEQ ID NO: 2460560 - RNA, 21 nt, Human
uugaacugauaguuacuguug

SEQ ID NO: 2460561 - RNA, 20 nt, Human
uugaacugauaguuacuguu

SEQ ID NO: 2460562 - RNA, 22 nt, Human
uugaacugauaguuacuguugu

SEQ ID NO: 2460563 - RNA, 13 nt, Human
uucacggaagagc

SEQ ID NO: 2460564 - RNA, 21 nt, Human
uucacgccuguaaucccagca

SEQ ID NO: 2460565 - RNA, 23 nt, Human
uucacgccuguaaucccagcacu

SEQ ID NO: 2460566 - RNA, 22 nt, Human
uucaccuuuguccccaccgcag

SEQ ID NO: 2460567 - RNA, 22 nt, Human
uucaccucacugaaaacaucug

SEQ ID NO: 2460568 - RNA, 15 nt, Human
uucacgagagcccgg

SEQ ID NO: 2460569 - RNA, 20 nt, Human
uucacgaaguguugcaugga

SEQ ID NO: 2460570 - RNA, 17 nt, Human
uucacgaaguguugcau

SEQ ID NO: 2460571 - RNA, 19 nt, Human
uucaccucacugaaaacau

SEQ ID NO: 2460572 - RNA, 16 nt, Human
uucagacagcugccug

SEQ ID NO: 2460573 - RNA, 15 nt, Human
uucagacagcugccu

SEQ ID NO: 2460574 - RNA, 14 nt, Human
uucagacagcugcc

SEQ ID NO: 2460575 - RNA, 17 nt, Human
uucacggaagagccuug

SEQ ID NO: 2460576 - RNA, 17 nt, Human
uucagacagcugccugg

SEQ ID NO: 2460577 - RNA, 17 nt, Human
uucagauacaaacugca

SEQ ID NO: 2460578 - RNA, 12 nt, Human
uucagauacaug

SEQ ID NO: 2460579 - RNA, 12 nt, Human
uucagauauaaa

SEQ ID NO: 2460580 - RNA, 15 nt, Human
uucagauauaaaaga

SEQ ID NO: 2460581 - RNA, 14 nt, Human
uucagauauaaaag

SEQ ID NO: 2460582 - RNA, 14 nt, Human
uucagcucacugca

SEQ ID NO: 2460583 - RNA, 20 nt, Human
uucaccuuuguccccaccgc

SEQ ID NO: 2460584 - RNA, 19 nt, Human
uucaccuuuguccccaccg

SEQ ID NO: 2460585 - RNA, 14 nt, Human
uucaccuuuguccc

SEQ ID NO: 2460586 - RNA, 14 nt, Human
uucaccgaggacau

SEQ ID NO: 2460587 - RNA, 22 nt, Human
uucacccuguccaaacugccua

SEQ ID NO: 2460588 - RNA, 22 nt, Human
uucaccccucccuuucuccccu

SEQ ID NO: 2460589 - RNA, 20 nt, Human
uucaccccucccuuucuccc

SEQ ID NO: 2460590 - RNA, 18 nt, Human
uucaccccucccuuucuc

SEQ ID NO: 2460591 - RNA, 17 nt, Human
uucaccccucccuuucu

SEQ ID NO: 2460592 - RNA, 13 nt, Human
uucacccuuuucu

SEQ ID NO: 2460593 - RNA, 22 nt, Human
uucacaagacccaaaaggcaga

SEQ ID NO: 2460594 - RNA, 16 nt, Human
uucaccccucccuuuc

SEQ ID NO: 2460595 - RNA, 15 nt, Human
uucaccccucccuuu

SEQ ID NO: 2460596 - RNA, 21 nt, Human
uucacaaccuucuguggcuca

SEQ ID NO: 2460597 - RNA, 22 nt, Human
uucaauaggaaaaacugauuuu

SEQ ID NO: 2460598 - RNA, 21 nt, Human
uucaauaggaaaaacugauuu

SEQ ID NO: 2460599 - RNA, 20 nt, Human
uucaauaagcaucaaacucu

SEQ ID NO: 2460600 - RNA, 22 nt, Human
uucacaaacuuuuauacucuuu

SEQ ID NO: 2460601 - RNA, 15 nt, Human
uucacaaagcccaag

SEQ ID NO: 2460602 - RNA, 11 nt, Human
uucacaaauaa

SEQ ID NO: 2460603 - RNA, 16 nt, Human
uucacaaacuuuuaua

SEQ ID NO: 2460604 - RNA, 17 nt, Human
uucacaaacuuuuauac

SEQ ID NO: 2460605 - RNA, 11 nt, Human
uucaauauuua

SEQ ID NO: 2460606 - RNA, 15 nt, Human
uucaauauccuuugc

SEQ ID NO: 2460607 - RNA, 16 nt, Human
uuauuuuaaacaaaau

SEQ ID NO: 2460608 - RNA, 14 nt, Human
uuauuuuaaacaaa

SEQ ID NO: 2460609 - RNA, 15 nt, Human
uuauuuguuuucccg

SEQ ID NO: 2460610 - RNA, 19 nt, Human
uuauuuuaauaauguuuca

SEQ ID NO: 2460611 - RNA, 18 nt, Human
uuauuuguuauuuucagu

SEQ ID NO: 2460612 - RNA, 21 nt, Human
uuauuuguguaauagaaaacu

SEQ ID NO: 2460613 - RNA, 13 nt, Human
uuauuuuaaaaga

SEQ ID NO: 2460614 - RNA, 16 nt, Human
uuauuuguguaauaga

SEQ ID NO: 2460615 - RNA, 13 nt, Human
uuauuuguguaau

SEQ ID NO: 2460616 - RNA, 22 nt, Human
uuauuuguguuuuaauuuaaac

SEQ ID NO: 2460617 - RNA, 15 nt, Human
uuauuuguacaguuc

SEQ ID NO: 2460618 - RNA, 14 nt, Human
uuauuuguacaguu

SEQ ID NO: 2460619 - RNA, 20 nt, Human
uuauuuuaauaauguuucaa

SEQ ID NO: 2460620 - RNA, 18 nt, Human
uuauuuuauuaugcauga

SEQ ID NO: 2460621 - RNA, 11 nt, Human
uuauuugcaua

SEQ ID NO: 2460622 - RNA, 13 nt, Human
uuauuuguacagu

SEQ ID NO: 2460623 - RNA, 13 nt, Human
uuauuugcaugug

SEQ ID NO: 2460624 - RNA, 15 nt, Human
uuauuugcagagaca

SEQ ID NO: 2460625 - RNA, 18 nt, Human
uuauuugcagagacagga

SEQ ID NO: 2460626 - RNA, 21 nt, Human
uuauuagagauuaccuccuga

SEQ ID NO: 2460627 - RNA, 17 nt, Human
uuauuagagugucuuuc

SEQ ID NO: 2460628 - RNA, 17 nt, Human
uuauuagggagaaaauu

SEQ ID NO: 2460629 - RNA, 18 nt, Human
uuauuagggagaaaauuc

SEQ ID NO: 2460630 - RNA, 16 nt, Human
uuauuagggagaaaau

SEQ ID NO: 2460631 - RNA, 22 nt, Human
uuauuagccagguaaugugaau

SEQ ID NO: 2460632 - RNA, 14 nt, Human
uuauuugacaaaau

SEQ ID NO: 2460633 - RNA, 22 nt, Human
uuauuugaaaacauauaaagca

SEQ ID NO: 2460634 - RNA, 23 nt, Human
uuauuagggagaaaauucaauug

SEQ ID NO: 2460635 - RNA, 19 nt, Human
uuauuagggagaaaauuca

SEQ ID NO: 2460636 - RNA, 20 nt, Human
uuauuagggagaaaauucaa

SEQ ID NO: 2460637 - RNA, 20 nt, Human
uuauuaguaaaugcuuauca

SEQ ID NO: 2460638 - RNA, 19 nt, Human
uuauuucuuaaacaaaugu

SEQ ID NO: 2460639 - RNA, 23 nt, Human
uuauuuugccauggaugagaguc

SEQ ID NO: 2460640 - RNA, 12 nt, Human
uuauuuugcaac

SEQ ID NO: 2460641 - RNA, 13 nt, Human
uuauuuugguacu

SEQ ID NO: 2460642 - RNA, 22 nt, Human
uuauuuuggaaaauaaauuauu

SEQ ID NO: 2460643 - RNA, 17 nt, Human
uuauuuuaaacaaaaua

SEQ ID NO: 2460644 - RNA, 18 nt, Human
uuauuuucaagaaacuga

SEQ ID NO: 2460645 - RNA, 13 nt, Human
uuauuuucaagaa

SEQ ID NO: 2460646 - RNA, 15 nt, Human
uuauuuuguaauuau

SEQ ID NO: 2460647 - RNA, 14 nt, Human
uuauuuuguaauua

SEQ ID NO: 2460648 - RNA, 13 nt, Human
uuauuuuguaauu

SEQ ID NO: 2460649 - RNA, 18 nt, Human
uuauuuugguacuuuuau

SEQ ID NO: 2460650 - RNA, 21 nt, Human
uuauuuuguaauuauugugau

SEQ ID NO: 2460651 - RNA, 18 nt, Human
uuauuuuguaauuauugu

SEQ ID NO: 2460652 - RNA, 18 nt, Human
uucaaaugcuguaacuuu

SEQ ID NO: 2460653 - RNA, 22 nt, Human
uucaaaugauuuuuacaaguuu

SEQ ID NO: 2460654 - RNA, 14 nt, Human
uucaaaugugcugu

SEQ ID NO: 2460655 - RNA, 19 nt, Human
uucaaauuagaagacauuu

SEQ ID NO: 2460656 - RNA, 21 nt, Human
uucaacagguuuuccugaaga

SEQ ID NO: 2460657 - RNA, 14 nt, Human
uucaacaucaaugu

SEQ ID NO: 2460658 - RNA, 15 nt, Human
uucaacaucaauguu

SEQ ID NO: 2460659 - RNA, 16 nt, Human
uucaacaucaauguuc

SEQ ID NO: 2460660 - RNA, 19 nt, Human
uucaacaucaauguucauu

SEQ ID NO: 2460661 - RNA, 22 nt, Human
uucaacaucaauguucauugua

SEQ ID NO: 2460662 - RNA, 16 nt, Human
uucaaauucuucugaa

SEQ ID NO: 2460663 - RNA, 19 nt, Human
uucaaauucuucugaacuc

SEQ ID NO: 2460664 - RNA, 18 nt, Human
uucaaauugagagaaugg

SEQ ID NO: 2460665 - RNA, 16 nt, Human
uucaauaauaaauauu

SEQ ID NO: 2460666 - RNA, 19 nt, Human
uucaauaaaugucuguuga

SEQ ID NO: 2460667 - RNA, 18 nt, Human
uucaauaaaugucuguug

SEQ ID NO: 2460668 - RNA, 15 nt, Human
uucaaccauucccca

SEQ ID NO: 2460669 - RNA, 19 nt, Human
uucaaccacuguaaaauga

SEQ ID NO: 2460670 - RNA, 21 nt, Human
uucaacaucaauguucauugu

SEQ ID NO: 2460671 - RNA, 17 nt, Human
uuccaucauguccccaa

SEQ ID NO: 2460672 - RNA, 22 nt, Human
uuccaugccugaggguggagac

SEQ ID NO: 2460673 - RNA, 18 nt, Human
uuccaugccugagggugg

SEQ ID NO: 2460674 - RNA, 16 nt, Human
uuccaugccugagggu

SEQ ID NO: 2460675 - RNA, 13 nt, Human
uuccaucccagag

SEQ ID NO: 2460676 - RNA, 15 nt, Human
uuccaugccugaggg

SEQ ID NO: 2460677 - RNA, 18 nt, Human
uuccaugcguguuucuga

SEQ ID NO: 2460678 - RNA, 21 nt, Human
uuccaugcguguuucugacuc

SEQ ID NO: 2460679 - RNA, 15 nt, Human
uuccauggacuuugu

SEQ ID NO: 2460680 - RNA, 14 nt, Human
uuccauggacuuug

SEQ ID NO: 2460681 - RNA, 15 nt, Human
uuccauauggauuuu

SEQ ID NO: 2460682 - RNA, 20 nt, Human
uuccauauggauuuucuauu

SEQ ID NO: 2460683 - RNA, 14 nt, Human
uuccauauucaugu

SEQ ID NO: 2460684 - RNA, 15 nt, Human
uuccauauucaugua

SEQ ID NO: 2460685 - RNA, 16 nt, Human
uuccaucaugucccca

SEQ ID NO: 2460686 - RNA, 14 nt, Human
uuccaucauguccc

SEQ ID NO: 2460687 - RNA, 19 nt, Human
uuccaucagguuccauccc

SEQ ID NO: 2460688 - RNA, 12 nt, Human
uuccaucauguc

SEQ ID NO: 2460689 - RNA, 23 nt, Human
uuccagauaaccagcuguaacac

SEQ ID NO: 2460690 - RNA, 20 nt, Human
uuccauaugaccucaugcau

SEQ ID NO: 2460691 - RNA, 15 nt, Human
uuccauaugaccuca

SEQ ID NO: 2460692 - RNA, 18 nt, Human
uuccauauauuagcauuu

SEQ ID NO: 2460693 - RNA, 18 nt, Human
uuccagauccuggaaauc

SEQ ID NO: 2460694 - RNA, 18 nt, Human
uuccagauaaccagcugu

SEQ ID NO: 2460695 - RNA, 16 nt, Human
uuccagagggguugag

SEQ ID NO: 2460696 - RNA, 20 nt, Human
uuccagaggcuauuauuuuc

SEQ ID NO: 2460697 - RNA, 19 nt, Human
uuccagaggcuauuauuuu

SEQ ID NO: 2460698 - RNA, 16 nt, Human
uuccagaccugaagaa

SEQ ID NO: 2460699 - RNA, 17 nt, Human
uuccagaccugaagaau

SEQ ID NO: 2460700 - RNA, 23 nt, Human
uuccagacugcuuccaauuuucu

SEQ ID NO: 2460701 - RNA, 20 nt, Human
uuccagacuuccuugagaca

SEQ ID NO: 2460702 - RNA, 19 nt, Human
uuccaacccucaucaccaa

SEQ ID NO: 2460703 - RNA, 19 nt, Human
uuccagaauaucugggauu

SEQ ID NO: 2460704 - RNA, 21 nt, Human
uuccagaagugugauugggaa

SEQ ID NO: 2460705 - RNA, 15 nt, Human
uuccagaagugugau

SEQ ID NO: 2460706 - RNA, 15 nt, Human
uuccaaccccaacuc

SEQ ID NO: 2460707 - RNA, 14 nt, Human
uuccagaccugaag

SEQ ID NO: 2460708 - RNA, 19 nt, Human
uuccagaaugcuguacauc

SEQ ID NO: 2460709 - RNA, 16 nt, Human
uuccagaaugcuguac

SEQ ID NO: 2460710 - RNA, 18 nt, Human
uuccagaaugcuguacau

SEQ ID NO: 2460711 - RNA, 14 nt, Human
uuccagaaugcugu

SEQ ID NO: 2460712 - RNA, 15 nt, Human
uuccagaaugcugua

SEQ ID NO: 2460713 - RNA, 16 nt, Human
uuccagaaucccaaga

SEQ ID NO: 2460714 - RNA, 15 nt, Human
uuccagaaucccaag

SEQ ID NO: 2460715 - RNA, 13 nt, Human
uucaucuguaacu

SEQ ID NO: 2460716 - RNA, 18 nt, Human
uucaucugggaaagacau

SEQ ID NO: 2460717 - RNA, 14 nt, Human
uucaucugggaaag

SEQ ID NO: 2460718 - RNA, 13 nt, Human
uucaucugggaaa

SEQ ID NO: 2460719 - RNA, 19 nt, Human
uucaucuggcaacaucuuu

SEQ ID NO: 2460720 - RNA, 17 nt, Human
uucaucuggaaccauca

SEQ ID NO: 2460721 - RNA, 23 nt, Human
uucaucuggaaccaucagaaaca

SEQ ID NO: 2460722 - RNA, 12 nt, Human
uucaucuggaac

SEQ ID NO: 2460723 - RNA, 21 nt, Human
uucaucugcucuccuuccugg

SEQ ID NO: 2460724 - RNA, 23 nt, Human
uucaucuguaacucuaaaagauc

SEQ ID NO: 2460725 - RNA, 21 nt, Human
uucaucuguaacucuaaaaga

SEQ ID NO: 2460726 - RNA, 19 nt, Human
uucaucuguaacucuaaaa

SEQ ID NO: 2460727 - RNA, 18 nt, Human
uucaucuguaacucuaaa

SEQ ID NO: 2460728 - RNA, 18 nt, Human
uucaucuguuguuuuguu

SEQ ID NO: 2460729 - RNA, 14 nt, Human
uucaugcauggaaa

SEQ ID NO: 2460730 - RNA, 15 nt, Human
uucaugcauggaaau

SEQ ID NO: 2460731 - RNA, 16 nt, Human
uucaugcauggaaauu

SEQ ID NO: 2460732 - RNA, 21 nt, Human
uucaugccaauuagcaauuga

SEQ ID NO: 2460733 - RNA, 19 nt, Human
uucaugccaccauggccag

SEQ ID NO: 2460734 - RNA, 17 nt, Human
uucaugcucagcccuga

SEQ ID NO: 2460735 - RNA, 14 nt, Human
uucaugcucagccc

SEQ ID NO: 2460736 - RNA, 16 nt, Human
uucaugccuggcuucg

SEQ ID NO: 2460737 - RNA, 17 nt, Human
uucaugcuaucucugug

SEQ ID NO: 2460738 - RNA, 18 nt, Human
uucaugcuaucucugugu

SEQ ID NO: 2460739 - RNA, 21 nt, Human
uucaugccagcuacuuccucc

SEQ ID NO: 2460740 - RNA, 22 nt, Human
uucaugccaccauggccagcca

SEQ ID NO: 2460741 - RNA, 22 nt, Human
uucaugccagcuacuuccuccu

SEQ ID NO: 2460742 - RNA, 18 nt, Human
uucauuuuuaaucaugaa

SEQ ID NO: 2460743 - RNA, 17 nt, Human
uucauuuuuaaucauga

SEQ ID NO: 2460744 - RNA, 13 nt, Human
uucauuuuuccua

SEQ ID NO: 2460745 - RNA, 17 nt, Human
uucauuuuuuuccaggc

SEQ ID NO: 2460746 - RNA, 14 nt, Human
uucauuuuuuucca

SEQ ID NO: 2460747 - RNA, 15 nt, Human
uucauuuuuccuaac

SEQ ID NO: 2460748 - RNA, 23 nt, Human
uucauuuuuuucacuggaguuac

SEQ ID NO: 2460749 - RNA, 16 nt, Human
uuccaaaaguggccuc

SEQ ID NO: 2460750 - RNA, 17 nt, Human
uuccaaaaguggccucu

SEQ ID NO: 2460751 - RNA, 18 nt, Human
uuccaaaaguggccucuu

SEQ ID NO: 2460752 - RNA, 21 nt, Human
uuccaaaaguggccucuuugu

SEQ ID NO: 2460753 - RNA, 21 nt, Human
uuccaaaaagauuuucagaaa

SEQ ID NO: 2460754 - RNA, 15 nt, Human
uuccaaaaaaauacu

SEQ ID NO: 2460755 - RNA, 13 nt, Human
uuccaaaaaaaua

SEQ ID NO: 2460756 - RNA, 18 nt, Human
uucauuuuuuuccaggcu

SEQ ID NO: 2460757 - RNA, 13 nt, Human
uuccaaaguacac

SEQ ID NO: 2460758 - RNA, 20 nt, Human
uuccaaagcacauugaaaga

SEQ ID NO: 2460759 - RNA, 22 nt, Human
uuccaaagaguagaauugcauu

SEQ ID NO: 2460760 - RNA, 19 nt, Human
uuccaaagcacauugaaag

SEQ ID NO: 2460761 - RNA, 23 nt, Human
uuccaaaggccauggagagcugg

SEQ ID NO: 2460762 - RNA, 15 nt, Human
uuccaaauaaaauga

SEQ ID NO: 2460763 - RNA, 14 nt, Human
uuccaaaguuaaca

SEQ ID NO: 2460764 - RNA, 23 nt, Human
uuccaacaaaggguuuuaaugua

SEQ ID NO: 2460765 - RNA, 16 nt, Human
uuccaaaguacacugu

SEQ ID NO: 2460766 - RNA, 22 nt, Human
uuccaacaccacagacacacac

SEQ ID NO: 2460767 - RNA, 21 nt, Human
uuccaacaccacagacacaca

SEQ ID NO: 2460768 - RNA, 20 nt, Human
uuccaacaccacagacacac

SEQ ID NO: 2460769 - RNA, 19 nt, Human
uuccaacaccacagacaca

SEQ ID NO: 2460770 - RNA, 18 nt, Human
uuccaacaccacagacac

SEQ ID NO: 2460771 - RNA, 17 nt, Human
uuccaacaccacagaca

SEQ ID NO: 2460772 - RNA, 12 nt, Human
uuccaacaccac

SEQ ID NO: 2460773 - RNA, 14 nt, Human
uuccaacagugagu

SEQ ID NO: 2460774 - RNA, 23 nt, Human
uuccaacagcucaagucuucccu

SEQ ID NO: 2460775 - RNA, 23 nt, Human
uuccaacaccacagacacacaca

SEQ ID NO: 2460776 - RNA, 16 nt, Human
uucaguggcagcugcu

SEQ ID NO: 2460777 - RNA, 15 nt, Human
uucaguggcagcugc

SEQ ID NO: 2460778 - RNA, 17 nt, Human
uucaguggcagcugcuu

SEQ ID NO: 2460779 - RNA, 17 nt, Human
uucaguggcagggcuca

SEQ ID NO: 2460780 - RNA, 16 nt, Human
uucaguggcagggcuc

SEQ ID NO: 2460781 - RNA, 22 nt, Human
uucagcuucugcugggcugggg

SEQ ID NO: 2460782 - RNA, 20 nt, Human
uucagcuucugcugggcugg

SEQ ID NO: 2460783 - RNA, 14 nt, Human
uucaguggggcagu

SEQ ID NO: 2460784 - RNA, 20 nt, Human
uucaguggcagggcucagga

SEQ ID NO: 2460785 - RNA, 14 nt, Human
uucagugggagaaa

SEQ ID NO: 2460786 - RNA, 20 nt, Human
uucaguguaauuucuuugcc

SEQ ID NO: 2460787 - RNA, 19 nt, Human
uucaguguaauuucuuugc

SEQ ID NO: 2460788 - RNA, 17 nt, Human
uucaguguaauuucuuu

SEQ ID NO: 2460789 - RNA, 16 nt, Human
uucaguguaauuucuu

SEQ ID NO: 2460790 - RNA, 13 nt, Human
uucaguguaauuu

SEQ ID NO: 2460791 - RNA, 12 nt, Human
uucaguguaauu

SEQ ID NO: 2460792 - RNA, 13 nt, Human
uucaguguaaaua

SEQ ID NO: 2460793 - RNA, 12 nt, Human
uucaguguacau

SEQ ID NO: 2460794 - RNA, 13 nt, Human
uucagugucccgg

SEQ ID NO: 2460795 - RNA, 23 nt, Human
uucagugucaaauaaacacugug

SEQ ID NO: 2460796 - RNA, 22 nt, Human
uucagugucaaauaaacacugu

SEQ ID NO: 2460797 - RNA, 21 nt, Human
uucaguguaauuucuuugccu

SEQ ID NO: 2460798 - RNA, 20 nt, Human
uucaguguauggaaauaaau

SEQ ID NO: 2460799 - RNA, 13 nt, Human
uucaguguacaug

SEQ ID NO: 2460800 - RNA, 15 nt, Human
uucagcuccagcuca

SEQ ID NO: 2460801 - RNA, 12 nt, Human
uucagcuccagc

SEQ ID NO: 2460802 - RNA, 20 nt, Human
uucagcugugaacauggacu

SEQ ID NO: 2460803 - RNA, 13 nt, Human
uucagcucacugu

SEQ ID NO: 2460804 - RNA, 21 nt, Human
uucagcugguugagguuucaa

SEQ ID NO: 2460805 - RNA, 22 nt, Human
uucagcuccagcucaccagccc

SEQ ID NO: 2460806 - RNA, 13 nt, Human
uucagcuugggga

SEQ ID NO: 2460807 - RNA, 14 nt, Human
uucaguggcagcug

SEQ ID NO: 2460808 - RNA, 18 nt, Human
uucagcuucugcugggcu

SEQ ID NO: 2460809 - RNA, 17 nt, Human
uucagcuucugcugggc

SEQ ID NO: 2460810 - RNA, 16 nt, Human
uucagcuucugcuggg

SEQ ID NO: 2460811 - RNA, 15 nt, Human
uucagcuucugcugg

SEQ ID NO: 2460812 - RNA, 14 nt, Human
uucagcuucauuug

SEQ ID NO: 2460813 - RNA, 23 nt, Human
uucagcugugaacauggacucuu

SEQ ID NO: 2460814 - RNA, 22 nt, Human
uucagcuucguuuauuuucaag

SEQ ID NO: 2460815 - RNA, 22 nt, Human
uucagcuuguaaauagcucagg

SEQ ID NO: 2460816 - RNA, 23 nt, Human
uucaguuauuauauuuacaaaug

SEQ ID NO: 2460817 - RNA, 12 nt, Human
uucaguguuaaa

SEQ ID NO: 2460818 - RNA, 18 nt, Human
uucaguguuaaaugugau

SEQ ID NO: 2460819 - RNA, 22 nt, Human
uucaguguuaaaugugaugaau

SEQ ID NO: 2460820 - RNA, 18 nt, Human
uucagugucccgggcccg

SEQ ID NO: 2460821 - RNA, 13 nt, Human
uucaguuacagaa

SEQ ID NO: 2460822 - RNA, 11 nt, Human
uucaguuacag

SEQ ID NO: 2460823 - RNA, 19 nt, Human
uucaguucccagaaucaaa

SEQ ID NO: 2460824 - RNA, 17 nt, Human
uucaguucccagaauca

SEQ ID NO: 2460825 - RNA, 15 nt, Human
uucaguucccagaau

SEQ ID NO: 2460826 - RNA, 22 nt, Human
uucaguuccucuuugcauggaa

SEQ ID NO: 2460827 - RNA, 17 nt, Human
uucaguuccucuuugca

SEQ ID NO: 2460828 - RNA, 23 nt, Human
uucaguuccucuuugcauggaau

SEQ ID NO: 2460829 - RNA, 17 nt, Human
uucaguuacagaaagug

SEQ ID NO: 2460830 - RNA, 16 nt, Human
uucaguuacagaaagu

SEQ ID NO: 2460831 - RNA, 15 nt, Human
uucaguuacagaaag

SEQ ID NO: 2460832 - RNA, 14 nt, Human
uucaguuacagaaa

SEQ ID NO: 2460833 - RNA, 20 nt, Human
uucauaaauaaaguuuguug

SEQ ID NO: 2460834 - RNA, 19 nt, Human
uucauaaacaacuuaaugu

SEQ ID NO: 2460835 - RNA, 16 nt, Human
uucaguugaucacugg

SEQ ID NO: 2460836 - RNA, 18 nt, Human
uucaguugaucacuggca

SEQ ID NO: 2460837 - RNA, 19 nt, Human
uucaucugcucuccuuccu

SEQ ID NO: 2460838 - RNA, 16 nt, Human
uucaucugcucuccuu

SEQ ID NO: 2460839 - RNA, 15 nt, Human
uucaucugcucuccu

SEQ ID NO: 2460840 - RNA, 13 nt, Human
uucaucugcucuc

SEQ ID NO: 2460841 - RNA, 20 nt, Human
uucaucgaaucuacuaauuc

SEQ ID NO: 2460842 - RNA, 14 nt, Human
uucauaacuuucau

SEQ ID NO: 2460843 - RNA, 18 nt, Human
uucauccugacucugccc

SEQ ID NO: 2460844 - RNA, 18 nt, Human
uucauccggcagccugga

SEQ ID NO: 2460845 - RNA, 18 nt, Human
uucaucgaaucuacuaau

SEQ ID NO: 2460846 - RNA, 19 nt, Human
uucauccuccucagaucuu

SEQ ID NO: 2460847 - RNA, 15 nt, Human
uucauccuccucaga

SEQ ID NO: 2460848 - RNA, 15 nt, Human
uucauaaccuagccu

SEQ ID NO: 2460849 - RNA, 16 nt, Human
uucauaaaugaauuuu

SEQ ID NO: 2460850 - RNA, 15 nt, Human
uucauaaaugaauuu

SEQ ID NO: 2460851 - RNA, 12 nt, Human
uucauaaaugaa

SEQ ID NO: 2460852 - RNA, 15 nt, Human
uuauaauuuugugaa

SEQ ID NO: 2460853 - RNA, 14 nt, Human
uuauaauuuuguga

SEQ ID NO: 2460854 - RNA, 21 nt, Human
uuauaauuuuaaauguuuuuu

SEQ ID NO: 2460855 - RNA, 17 nt, Human
uuauaauuuuaaauguu

SEQ ID NO: 2460856 - RNA, 12 nt, Human
uuauaauuuuaa

SEQ ID NO: 2460857 - RNA, 22 nt, Human
uuauaauuguaucagaggccua

SEQ ID NO: 2460858 - RNA, 14 nt, Human
uuauaauuguauca

SEQ ID NO: 2460859 - RNA, 12 nt, Human
uuauaauuuaaa

SEQ ID NO: 2460860 - RNA, 13 nt, Human
uuauaauauacua

SEQ ID NO: 2460861 - RNA, 18 nt, Human
uuauaauaauguuaacau

SEQ ID NO: 2460862 - RNA, 22 nt, Human
uuauaauaaaaggaaaagcaaa

SEQ ID NO: 2460863 - RNA, 21 nt, Human
uuauaauaaaaggaaaagcaa

SEQ ID NO: 2460864 - RNA, 17 nt, Human
uuauaauaaaaggaaaa

SEQ ID NO: 2460865 - RNA, 15 nt, Human
uuauaauaauguuaa

SEQ ID NO: 2460866 - RNA, 13 nt, Human
uuauaauggguaa

SEQ ID NO: 2460867 - RNA, 19 nt, Human
uuauaaugaggaugauuau

SEQ ID NO: 2460868 - RNA, 13 nt, Human
uuauaaucacuuu

SEQ ID NO: 2460869 - RNA, 20 nt, Human
uuauaaucuuccauacuucu

SEQ ID NO: 2460870 - RNA, 11 nt, Human
uuauaaucuuu

SEQ ID NO: 2460871 - RNA, 15 nt, Human
uuauaaugaaugaaa

SEQ ID NO: 2460872 - RNA, 14 nt, Human
uuauaagcagauuu

SEQ ID NO: 2460873 - RNA, 16 nt, Human
uuauaagcagauuuaa

SEQ ID NO: 2460874 - RNA, 18 nt, Human
uuauaaguaucuucaugu

SEQ ID NO: 2460875 - RNA, 18 nt, Human
uuauaaguagcaggccaa

SEQ ID NO: 2460876 - RNA, 20 nt, Human
uuagugcuaagugugaacug

SEQ ID NO: 2460877 - RNA, 19 nt, Human
uuagugcuaagugugaacu

SEQ ID NO: 2460878 - RNA, 17 nt, Human
uuagugcuaagugugaa

SEQ ID NO: 2460879 - RNA, 16 nt, Human
uuagugcuaaguguga

SEQ ID NO: 2460880 - RNA, 21 nt, Human
uuagugcuaagugugaacugg

SEQ ID NO: 2460881 - RNA, 16 nt, Human
uuaguggcucaacauu

SEQ ID NO: 2460882 - RNA, 20 nt, Human
uuaguggcucaacauugugu

SEQ ID NO: 2460883 - RNA, 23 nt, Human
uuaguggcucaacauuguguucc

SEQ ID NO: 2460884 - RNA, 12 nt, Human
uuaguggcuuuu

SEQ ID NO: 2460885 - RNA, 12 nt, Human
uuaguggcuuca

SEQ ID NO: 2460886 - RNA, 16 nt, Human
uuaguguaugcuuuga

SEQ ID NO: 2460887 - RNA, 14 nt, Human
uuagugucacuuac

SEQ ID NO: 2460888 - RNA, 18 nt, Human
uuagugaugucaucuguc

SEQ ID NO: 2460889 - RNA, 15 nt, Human
uuagugcuaagugug

SEQ ID NO: 2460890 - RNA, 12 nt, Human
uuagugcuaagu

SEQ ID NO: 2460891 - RNA, 14 nt, Human
uuagugccugugug

SEQ ID NO: 2460892 - RNA, 17 nt, Human
uuagugcggacaaguuu

SEQ ID NO: 2460893 - RNA, 19 nt, Human
uuagugcggacaaguuuua

SEQ ID NO: 2460894 - RNA, 18 nt, Human
uuagucuucucauagcau

SEQ ID NO: 2460895 - RNA, 19 nt, Human
uuagugaccucagcuuuga

SEQ ID NO: 2460896 - RNA, 17 nt, Human
uuagucugcaaaaugag

SEQ ID NO: 2460897 - RNA, 15 nt, Human
uuagucugcaaaaug

SEQ ID NO: 2460898 - RNA, 13 nt, Human
uuagucuucucau

SEQ ID NO: 2460899 - RNA, 14 nt, Human
uuagucuucucaua

SEQ ID NO: 2460900 - RNA, 21 nt, Human
ugugaaaagaaaaaugagccu

SEQ ID NO: 2460901 - RNA, 17 nt, Human
ugugaaaagaaaaauga

SEQ ID NO: 2460902 - RNA, 13 nt, Human
ugugaaaagaaaa

SEQ ID NO: 2460903 - RNA, 15 nt, Human
ugugaaaagaaaaau

SEQ ID NO: 2460904 - RNA, 20 nt, Human
uuauauuaaaauauggcuau

SEQ ID NO: 2460905 - RNA, 16 nt, Human
uuauauuaugaagcuu

SEQ ID NO: 2460906 - RNA, 14 nt, Human
uuauauuccauaua

SEQ ID NO: 2460907 - RNA, 16 nt, Human
uuauauuccauauauu

SEQ ID NO: 2460908 - RNA, 21 nt, Human
uuauauuccauauauuagcau

SEQ ID NO: 2460909 - RNA, 22 nt, Human
uuauauggaugauucagaaauu

SEQ ID NO: 2460910 - RNA, 20 nt, Human
uuauauggaugauucagaaa

SEQ ID NO: 2460911 - RNA, 16 nt, Human
uuauauguacaugaga

SEQ ID NO: 2460912 - RNA, 19 nt, Human
uuauauguacaugagaagg

SEQ ID NO: 2460913 - RNA, 15 nt, Human
uuauauuaaaauaug

SEQ ID NO: 2460914 - RNA, 16 nt, Human
uuauaugucaaagcag

SEQ ID NO: 2460915 - RNA, 19 nt, Human
uuauaugcuuacugauaua

SEQ ID NO: 2460916 - RNA, 13 nt, Human
uuauaugcuuacu

SEQ ID NO: 2460917 - RNA, 16 nt, Human
uuauaugaagauaagu

SEQ ID NO: 2460918 - RNA, 15 nt, Human
uuauaugaagaaaau

SEQ ID NO: 2460919 - RNA, 19 nt, Human
uuauaugaagaaaaucacu

SEQ ID NO: 2460920 - RNA, 13 nt, Human
uuauauaugugaa

SEQ ID NO: 2460921 - RNA, 13 nt, Human
uuauacauaaaca

SEQ ID NO: 2460922 - RNA, 22 nt, Human
uuauauauugguaacauccuuu

SEQ ID NO: 2460923 - RNA, 23 nt, Human
uuauauaugugaacauuuaucaa

SEQ ID NO: 2460924 - RNA, 11 nt, Human
uuauacauaaa

SEQ ID NO: 2460925 - RNA, 15 nt, Human
uuauaucagccugag

SEQ ID NO: 2460926 - RNA, 23 nt, Human
uuauauauuuauaacucaucaua

SEQ ID NO: 2460927 - RNA, 13 nt, Human
uuauauauuuaua

SEQ ID NO: 2460928 - RNA, 14 nt, Human
uuauauauuuauaa

SEQ ID NO: 2460929 - RNA, 15 nt, Human
uuauauauuuauaac

SEQ ID NO: 2460930 - RNA, 20 nt, Human
uuauauauuuauaacucauc

SEQ ID NO: 2460931 - RNA, 21 nt, Human
uuauaucaucagcauaccuuu

SEQ ID NO: 2460932 - RNA, 16 nt, Human
uuauaucagccugagu

SEQ ID NO: 2460933 - RNA, 19 nt, Human
uuauaucaguccucuuuca

SEQ ID NO: 2460934 - RNA, 21 nt, Human
uuauacacauaauuaaagugu

SEQ ID NO: 2460935 - RNA, 18 nt, Human
uuauacacauaauuaaag

SEQ ID NO: 2460936 - RNA, 15 nt, Human
uuauacacuguaaug

SEQ ID NO: 2460937 - RNA, 22 nt, Human
uuauacagaauugugucugcag

SEQ ID NO: 2460938 - RNA, 22 nt, Human
uuauacagaccgaacuguugua

SEQ ID NO: 2460939 - RNA, 23 nt, Human
uuauacagaauugugucugcagg

SEQ ID NO: 2460940 - RNA, 18 nt, Human
uuauacagcucagcuuuu

SEQ ID NO: 2460941 - RNA, 15 nt, Human
uuauacaaaugucuu

SEQ ID NO: 2460942 - RNA, 17 nt, Human
uuauacaacagugcuaa

SEQ ID NO: 2460943 - RNA, 16 nt, Human
uuauacaacagugcua

SEQ ID NO: 2460944 - RNA, 12 nt, Human
uuauacaacagu

SEQ ID NO: 2460945 - RNA, 19 nt, Human
uuauacaaauuagaaaaug

SEQ ID NO: 2460946 - RNA, 14 nt, Human
uuauacacauaauu

SEQ ID NO: 2460947 - RNA, 13 nt, Human
uuauacacauaau

SEQ ID NO: 2460948 - RNA, 12 nt, Human
uuauacacauaa

SEQ ID NO: 2460949 - RNA, 21 nt, Human
uuauacaacagugcuaaaaau

SEQ ID NO: 2460950 - RNA, 23 nt, Human
uuauacaacagugcuaaaaaugg

SEQ ID NO: 2460951 - RNA, 15 nt, Human
uuauacaauaucauc

SEQ ID NO: 2460952 - RNA, 17 nt, Human
uuauaauuuugugaagc

SEQ ID NO: 2460953 - RNA, 16 nt, Human
uuauaauuuugugaag

SEQ ID NO: 2460954 - RNA, 18 nt, Human
uuauaauuuugugaagca

SEQ ID NO: 2460955 - RNA, 14 nt, Human
uuauaauuuuccua

SEQ ID NO: 2460956 - RNA, 16 nt, Human
uuauaauuuuccuaau

SEQ ID NO: 2460957 - RNA, 16 nt, Human
uuauaauuuuuuucaa

SEQ ID NO: 2460958 - RNA, 21 nt, Human
uuauaauuuuuuuauuacuga

SEQ ID NO: 2460959 - RNA, 18 nt, Human
uuauggcuauaggugcua

SEQ ID NO: 2460960 - RNA, 16 nt, Human
uuauggcuuuugugca

SEQ ID NO: 2460961 - RNA, 20 nt, Human
uuauggaauugauuugcauu

SEQ ID NO: 2460962 - RNA, 21 nt, Human
uuauggaauugauuugcauug

SEQ ID NO: 2460963 - RNA, 23 nt, Human
uuauggaauugauuugcauugaa

SEQ ID NO: 2460964 - RNA, 14 nt, Human
uuauggcacaucag

SEQ ID NO: 2460965 - RNA, 18 nt, Human
uuauggcuuuugugcauu

SEQ ID NO: 2460966 - RNA, 21 nt, Human
uuauggcucacuaugaaucua

SEQ ID NO: 2460967 - RNA, 17 nt, Human
uuauggcuuuugugcau

SEQ ID NO: 2460968 - RNA, 17 nt, Human
uuauguugcauagaaua

SEQ ID NO: 2460969 - RNA, 19 nt, Human
uuauguuuauauaaaugcu

SEQ ID NO: 2460970 - RNA, 20 nt, Human
uuauggaacacucugagacu

SEQ ID NO: 2460971 - RNA, 18 nt, Human
uuauggaacacucugaga

SEQ ID NO: 2460972 - RNA, 21 nt, Human
uuauggacaaugacccagugg

SEQ ID NO: 2460973 - RNA, 14 nt, Human
uuauggaauugauu

SEQ ID NO: 2460974 - RNA, 19 nt, Human
uuauggaauugauuugcau

SEQ ID NO: 2460975 - RNA, 19 nt, Human
uuauggaagauuuuaaauu

SEQ ID NO: 2460976 - RNA, 22 nt, Human
uuauggaaucuaccaacuguuu

SEQ ID NO: 2460977 - RNA, 22 nt, Human
uuauggaagauuuuaaauucac

SEQ ID NO: 2460978 - RNA, 17 nt, Human
uuaugauuuaauaaaau

SEQ ID NO: 2460979 - RNA, 18 nt, Human
uuaugauuuuuuuuucau

SEQ ID NO: 2460980 - RNA, 19 nt, Human
uuaugauuuuuuuuucaua

SEQ ID NO: 2460981 - RNA, 17 nt, Human
uuauggaacacucugag

SEQ ID NO: 2460982 - RNA, 20 nt, Human
uuaugauuuaauaaaauaau

SEQ ID NO: 2460983 - RNA, 15 nt, Human
uuaugauuuaauaaa

SEQ ID NO: 2460984 - RNA, 13 nt, Human
uuaugauuuaaua

SEQ ID NO: 2460985 - RNA, 15 nt, Human
uuauuaauaaacauu

SEQ ID NO: 2460986 - RNA, 14 nt, Human
uuauuaauaaacau

SEQ ID NO: 2460987 - RNA, 23 nt, Human
uuauuaagauggauucucagaua

SEQ ID NO: 2460988 - RNA, 17 nt, Human
uuauuaagauggauucu

SEQ ID NO: 2460989 - RNA, 19 nt, Human
uuauuaagauggauucuca

SEQ ID NO: 2460990 - RNA, 20 nt, Human
uuauuaagauggauucucag

SEQ ID NO: 2460991 - RNA, 21 nt, Human
uuauuaagauggauucucaga

SEQ ID NO: 2460992 - RNA, 13 nt, Human
uuauuaaucacua

SEQ ID NO: 2460993 - RNA, 12 nt, Human
uuauuacaucuu

SEQ ID NO: 2460994 - RNA, 18 nt, Human
uuauuacaucuuucacau

SEQ ID NO: 2460995 - RNA, 18 nt, Human
uuauuacccagaguuuuu

SEQ ID NO: 2460996 - RNA, 19 nt, Human
uuauuacccccuccuucag

SEQ ID NO: 2460997 - RNA, 20 nt, Human
uuauuacccccuccuucaga

SEQ ID NO: 2460998 - RNA, 22 nt, Human
uuauuacccccuccuucagaca

SEQ ID NO: 2460999 - RNA, 13 nt, Human
uuauuaccucuga

SEQ ID NO: 2461000 - RNA, 12 nt, Human
uuauuaccucug

SEQ ID NO: 2461001 - RNA, 15 nt, Human
uuauuaccucugaua

SEQ ID NO: 2461002 - RNA, 19 nt, Human
uuauuacugcuaaguauuu

SEQ ID NO: 2461003 - RNA, 14 nt, Human
uuauuacugcuaag

SEQ ID NO: 2461004 - RNA, 21 nt, Human
uuauuaaaugcccagccccuu

SEQ ID NO: 2461005 - RNA, 19 nt, Human
uuauuaaaugcccagcccc

SEQ ID NO: 2461006 - RNA, 23 nt, Human
uuauuaaaaaucucaaauuucua

SEQ ID NO: 2461007 - RNA, 11 nt, Human
uuauguuugcc

SEQ ID NO: 2461008 - RNA, 20 nt, Human
uuauguuugccacuuugcaa

SEQ ID NO: 2461009 - RNA, 21 nt, Human
uuauuaacuaauaugggcauu

SEQ ID NO: 2461010 - RNA, 18 nt, Human
uuauuaacauaggugaaa

SEQ ID NO: 2461011 - RNA, 19 nt, Human
uuauuaacaaauuauguua

SEQ ID NO: 2461012 - RNA, 20 nt, Human
uuauuaaauacaaaacuucc

SEQ ID NO: 2461013 - RNA, 18 nt, Human
uuauuaaauacaaaacuu

SEQ ID NO: 2461014 - RNA, 22 nt, Human
uuauguuuuuuaaaauauuuau

SEQ ID NO: 2461015 - RNA, 11 nt, Human
uuaucucaaaa

SEQ ID NO: 2461016 - RNA, 16 nt, Human
uuaucucacuugugcc

SEQ ID NO: 2461017 - RNA, 20 nt, Human
uuaucucagucaugcauaaa

SEQ ID NO: 2461018 - RNA, 19 nt, Human
uuaucucagucaugcauaa

SEQ ID NO: 2461019 - RNA, 17 nt, Human
uuaucucagucaugcau

SEQ ID NO: 2461020 - RNA, 15 nt, Human
uuaucucuauuuaau

SEQ ID NO: 2461021 - RNA, 14 nt, Human
uuaucucuauuuaa

SEQ ID NO: 2461022 - RNA, 18 nt, Human
uuaucuguguuuuugaaa

SEQ ID NO: 2461023 - RNA, 22 nt, Human
uuaucucagucaugcauaaaua

SEQ ID NO: 2461024 - RNA, 21 nt, Human
uuaucucagucaugcauaaau

SEQ ID NO: 2461025 - RNA, 21 nt, Human
uuaucuccccuucacaugcau

SEQ ID NO: 2461026 - RNA, 16 nt, Human
uuaucuugaauaaugu

SEQ ID NO: 2461027 - RNA, 14 nt, Human
uuaucuugaauaau

SEQ ID NO: 2461028 - RNA, 17 nt, Human
uuaucuuaugccacggg

SEQ ID NO: 2461029 - RNA, 21 nt, Human
uuaucgaaauaacaauguuaa

SEQ ID NO: 2461030 - RNA, 19 nt, Human
uuaucgaaauaacaauguu

SEQ ID NO: 2461031 - RNA, 22 nt, Human
uuaucgaaauaacaauguuaag

SEQ ID NO: 2461032 - RNA, 15 nt, Human
uuaucggaagcagug

SEQ ID NO: 2461033 - RNA, 14 nt, Human
uuaucggaagcagu

SEQ ID NO: 2461034 - RNA, 16 nt, Human
uuaucggaagcagugc

SEQ ID NO: 2461035 - RNA, 14 nt, Human
uuaucgggaacagu

SEQ ID NO: 2461036 - RNA, 16 nt, Human
uuaucgggaacagugu

SEQ ID NO: 2461037 - RNA, 17 nt, Human
uuaucgggaacaguguu

SEQ ID NO: 2461038 - RNA, 23 nt, Human
uuaucgggaacaguguuucccau

SEQ ID NO: 2461039 - RNA, 16 nt, Human
uuaucgggagcagugu

SEQ ID NO: 2461040 - RNA, 18 nt, Human
uuaucgggagcagugucu

SEQ ID NO: 2461041 - RNA, 19 nt, Human
uuaucgggagcagugucuu

SEQ ID NO: 2461042 - RNA, 19 nt, Human
uuaucuaauaccucugugu

SEQ ID NO: 2461043 - RNA, 21 nt, Human
uuaucuaaaagaaaugucuau

SEQ ID NO: 2461044 - RNA, 15 nt, Human
uuaucuaaaagaaau

SEQ ID NO: 2461045 - RNA, 21 nt, Human
uuaucgggagcagugucuucc

SEQ ID NO: 2461046 - RNA, 23 nt, Human
uuaucgggagcagugucuuccau

SEQ ID NO: 2461047 - RNA, 19 nt, Human
uuaucuauacauaucuuua

SEQ ID NO: 2461048 - RNA, 14 nt, Human
uuaucuagauacug

SEQ ID NO: 2461049 - RNA, 17 nt, Human
uuaucuauacauaucuu

SEQ ID NO: 2461050 - RNA, 20 nt, Human
uuaucuaauaccucugugug

SEQ ID NO: 2461051 - RNA, 20 nt, Human
uuauauuuauuacuguaaga

SEQ ID NO: 2461052 - RNA, 18 nt, Human
uuauauuuaguuauaguu

SEQ ID NO: 2461053 - RNA, 17 nt, Human
uuauauuuaguuauagu

SEQ ID NO: 2461054 - RNA, 22 nt, Human
uuauauuuaguuauaguuucag

SEQ ID NO: 2461055 - RNA, 19 nt, Human
uuauauuuaguuauaguuu

SEQ ID NO: 2461056 - RNA, 12 nt, Human
uuauauuugaaa

SEQ ID NO: 2461057 - RNA, 16 nt, Human
uuauauuuacaaaugg

SEQ ID NO: 2461058 - RNA, 24 nt, Human
uuauauuguaagaaauacuguaca

SEQ ID NO: 2461059 - RNA, 16 nt, Human
uuauauuguaagaaau

SEQ ID NO: 2461060 - RNA, 22 nt, Human
uuauauuguaagaaauacugua

SEQ ID NO: 2461061 - RNA, 14 nt, Human
uuauauuguaagaa

SEQ ID NO: 2461062 - RNA, 15 nt, Human
uuauauugauaacag

SEQ ID NO: 2461063 - RNA, 15 nt, Human
uuauauuugaaauau

SEQ ID NO: 2461064 - RNA, 13 nt, Human
uuauauuugaaau

SEQ ID NO: 2461065 - RNA, 19 nt, Human
uuauccuaaaacaaauagu

SEQ ID NO: 2461066 - RNA, 23 nt, Human
uuaucccuuccuuuuagccuagu

SEQ ID NO: 2461067 - RNA, 13 nt, Human
uuaucccucucca

SEQ ID NO: 2461068 - RNA, 21 nt, Human
uuauccucugaucuccauggc

SEQ ID NO: 2461069 - RNA, 20 nt, Human
uuauccucugaucuccaugg

SEQ ID NO: 2461070 - RNA, 19 nt, Human
uuauccucugaucuccaug

SEQ ID NO: 2461071 - RNA, 16 nt, Human
uuauccucugaucucc

SEQ ID NO: 2461072 - RNA, 15 nt, Human
uuauccucugaucuc

SEQ ID NO: 2461073 - RNA, 14 nt, Human
uuauccucugaucu

SEQ ID NO: 2461074 - RNA, 17 nt, Human
uuauccucuuuagaguu

SEQ ID NO: 2461075 - RNA, 15 nt, Human
uuauccucuuuagag

SEQ ID NO: 2461076 - RNA, 16 nt, Human
uuauccucugguuuaa

SEQ ID NO: 2461077 - RNA, 14 nt, Human
uuauccucuuuaga

SEQ ID NO: 2461078 - RNA, 17 nt, Human
uuauccugaaauuucag

SEQ ID NO: 2461079 - RNA, 20 nt, Human
uuauccucuuuagaguuaga

SEQ ID NO: 2461080 - RNA, 18 nt, Human
uuauccucuuuagaguua

SEQ ID NO: 2461081 - RNA, 15 nt, Human
uuaucgaaauaacaa

SEQ ID NO: 2461082 - RNA, 14 nt, Human
uuaucgaaauaaca

SEQ ID NO: 2461083 - RNA, 13 nt, Human
uuaucgaaauaac

SEQ ID NO: 2461084 - RNA, 16 nt, Human
uuauccugaaauuuca

SEQ ID NO: 2461085 - RNA, 15 nt, Human
aaaaaauauuuuccu

SEQ ID NO: 2461086 - RNA, 20 nt, Human
aaaaaaugcugaacauugca

SEQ ID NO: 2461087 - RNA, 22 nt, Human
aaaaaaugcugaacauugcaua

SEQ ID NO: 2461088 - RNA, 16 nt, Human
aaaaaauguauaugca

SEQ ID NO: 2461089 - RNA, 11 nt, Human
aaaaaaugucc

SEQ ID NO: 2461090 - RNA, 13 nt, Human
aaaaaaucugcag

SEQ ID NO: 2461091 - RNA, 15 nt, Human
aaaaaaucugcagaa

SEQ ID NO: 2461092 - RNA, 12 nt, Human
aaaaacacuagu

SEQ ID NO: 2461093 - RNA, 18 nt, Human
aaaaacaccuagcuuuau

SEQ ID NO: 2461094 - RNA, 17 nt, Human
aaaaacaccuagcuuua

SEQ ID NO: 2461095 - RNA, 15 nt, Human
aaaaacaccuagcuu

SEQ ID NO: 2461096 - RNA, 18 nt, Human
aaaaacacagcaagggug

SEQ ID NO: 2461097 - RNA, 13 nt, Human
aaaaacacagcaa

SEQ ID NO: 2461098 - RNA, 22 nt, Human
aaaaaauuagaaauuggcugga

SEQ ID NO: 2461099 - RNA, 22 nt, Human
aaaaaccuuguauaucuuguuu

SEQ ID NO: 2461100 - RNA, 20 nt, Human
aaaaacuaaaucucuaauau

SEQ ID NO: 2461101 - RNA, 14 nt, Human
aaaaacuaaauugu

SEQ ID NO: 2461102 - RNA, 13 nt, Human
aaaaacuacacau

SEQ ID NO: 2461103 - RNA, 14 nt, Human
aaaaacagaggcca

SEQ ID NO: 2461104 - RNA, 15 nt, Human
aaaaacagcauugcu

SEQ ID NO: 2461105 - RNA, 17 nt, Human
aaaaacagcauugcuuu

SEQ ID NO: 2461106 - RNA, 13 nt, Human
acuagaugaugga

SEQ ID NO: 2461107 - RNA, 15 nt, Human
acuagauggcgagca

SEQ ID NO: 2461108 - RNA, 15 nt, Human
acuagauggugcuga

SEQ ID NO: 2461109 - RNA, 16 nt, Human
acuagauggugcugag

SEQ ID NO: 2461110 - RNA, 18 nt, Human
acuagauggugcugagaa

SEQ ID NO: 2461111 - RNA, 13 nt, Human
acuagcauaucug

SEQ ID NO: 2461112 - RNA, 13 nt, Human
acuagauuacauu

SEQ ID NO: 2461113 - RNA, 18 nt, Human
acuagauuacauucaguu

SEQ ID NO: 2461114 - RNA, 20 nt, Human
acuaguauuucuaugaaaua

SEQ ID NO: 2461115 - RNA, 19 nt, Human
acuagcauaucugccuuua

SEQ ID NO: 2461116 - RNA, 17 nt, Human
acuagcauaucugccuu

SEQ ID NO: 2461117 - RNA, 15 nt, Human
acuagcauaucugcc

SEQ ID NO: 2461118 - RNA, 13 nt, Human
acuagugcaaauc

SEQ ID NO: 2461119 - RNA, 16 nt, Human
acuagugaggaaagau

SEQ ID NO: 2461120 - RNA, 16 nt, Human
acuagugcaaaucaua

SEQ ID NO: 2461121 - RNA, 23 nt, Human
acuagugacaagcuccuggucuu

SEQ ID NO: 2461122 - RNA, 21 nt, Human
acuauucaaacagucucagga

SEQ ID NO: 2461123 - RNA, 13 nt, Human
acuaguuacacau

SEQ ID NO: 2461124 - RNA, 21 nt, Human
acuauuccccagcagggucuu

SEQ ID NO: 2461125 - RNA, 22 nt, Human
acuauucaggagaguagaacag

SEQ ID NO: 2461126 - RNA, 13 nt, Human
acuauucaaguau

SEQ ID NO: 2461127 - RNA, 15 nt, Human
acuaguguugcuugg

SEQ ID NO: 2461128 - RNA, 22 nt, Human
acuauucugauuacacaaaaca

SEQ ID NO: 2461129 - RNA, 21 nt, Human
acuauucugauuacacaaaac

SEQ ID NO: 2461130 - RNA, 15 nt, Human
acuauucugauuaca

SEQ ID NO: 2461131 - RNA, 20 nt, Human
acuauuccccagcagggucu

SEQ ID NO: 2461132 - RNA, 11 nt, Human
acuauuuaaag

SEQ ID NO: 2461133 - RNA, 20 nt, Human
acuauuuaaagccuccucau

SEQ ID NO: 2461134 - RNA, 23 nt, Human
acuauucugauuacacaaaacaa

SEQ ID NO: 2461135 - RNA, 18 nt, Human
acuauuuaacuugagggu

SEQ ID NO: 2461136 - RNA, 22 nt, Human
acuauuuaacuugagcuuuaaa

SEQ ID NO: 2461137 - RNA, 15 nt, Human
acuauuuaacuugag

SEQ ID NO: 2461138 - RNA, 14 nt, Human
acuauuuaacuuga

SEQ ID NO: 2461139 - RNA, 20 nt, Human
acuauuuaguuuuuguaauu

SEQ ID NO: 2461140 - RNA, 21 nt, Human
acuauuuaguuuuuguaauuu

SEQ ID NO: 2461141 - RNA, 23 nt, Human
acuauuuaguuuuuguaauuuau

SEQ ID NO: 2461142 - RNA, 12 nt, Human
acuauuuaucug

SEQ ID NO: 2461143 - RNA, 13 nt, Human
acucaaaagcugg

SEQ ID NO: 2461144 - RNA, 18 nt, Human
acuauuuuucagaaucuc

SEQ ID NO: 2461145 - RNA, 15 nt, Human
acuauuuaucugugu

SEQ ID NO: 2461146 - RNA, 14 nt, Human
acuauuuuucagaa

SEQ ID NO: 2461147 - RNA, 19 nt, Human
acucauaaugugaaguguu

SEQ ID NO: 2461148 - RNA, 16 nt, Human
acucauaaugugaagu

SEQ ID NO: 2461149 - RNA, 15 nt, Human
acucauaaugugaag

SEQ ID NO: 2461150 - RNA, 14 nt, Human
acucauaaugugaa

SEQ ID NO: 2461151 - RNA, 19 nt, Human
acucaguccauagcagaga

SEQ ID NO: 2461152 - RNA, 16 nt, Human
acucagggcuccuggg

SEQ ID NO: 2461153 - RNA, 18 nt, Human
acucagggccccagcacu

SEQ ID NO: 2461154 - RNA, 22 nt, Human
acucagggccccagcacuaaag

SEQ ID NO: 2461155 - RNA, 17 nt, Human
acucaggaugcccaggg

SEQ ID NO: 2461156 - RNA, 20 nt, Human
acucagguuguaguaaagaa

SEQ ID NO: 2461157 - RNA, 21 nt, Human
acucagguuguaguaaagaaa

SEQ ID NO: 2461158 - RNA, 22 nt, Human
acucagguuguaguaaagaaau

SEQ ID NO: 2461159 - RNA, 23 nt, Human
acucagguuguaguaaagaaauu

SEQ ID NO: 2461160 - RNA, 16 nt, Human
acucaggcccaaagcc

SEQ ID NO: 2461161 - RNA, 15 nt, Human
acucagggccccagc

SEQ ID NO: 2461162 - RNA, 15 nt, Human
acucaggaugcccag

SEQ ID NO: 2461163 - RNA, 16 nt, Human
acucaggaugcccagg

SEQ ID NO: 2461164 - RNA, 18 nt, Human
acucaggaugcccagggc

SEQ ID NO: 2461165 - RNA, 17 nt, Human
acucagcuuccuaccca

SEQ ID NO: 2461166 - RNA, 20 nt, Human
acucaggaggcugaggcaga

SEQ ID NO: 2461167 - RNA, 17 nt, Human
acucaggaggcugaggg

SEQ ID NO: 2461168 - RNA, 18 nt, Human
acucaggaggcugagggg

SEQ ID NO: 2461169 - RNA, 18 nt, Human
acucaggauccagucccu

SEQ ID NO: 2461170 - RNA, 14 nt, Human
acucaggaugccca

SEQ ID NO: 2461171 - RNA, 13 nt, Human
acucaggaagaac

SEQ ID NO: 2461172 - RNA, 13 nt, Human
acucaggaggcug

SEQ ID NO: 2461173 - RNA, 14 nt, Human
acucaggaggcuga

SEQ ID NO: 2461174 - RNA, 16 nt, Human
acucaggaggcugagg

SEQ ID NO: 2461175 - RNA, 17 nt, Human
acucaggaggcugaggc

SEQ ID NO: 2461176 - RNA, 18 nt, Human
acucaggaggcugaggca

SEQ ID NO: 2461177 - RNA, 19 nt, Human
acucaggaggcugaggcag

SEQ ID NO: 2461178 - RNA, 23 nt, Human
acucagccaagcacagugguggc

SEQ ID NO: 2461179 - RNA, 22 nt, Human
acucagccaagcacaguggugg

SEQ ID NO: 2461180 - RNA, 17 nt, Human
acucagcccucauuggc

SEQ ID NO: 2461181 - RNA, 21 nt, Human
acucagcccucauuggcucuu

SEQ ID NO: 2461182 - RNA, 11 nt, Human
acucagcccug

SEQ ID NO: 2461183 - RNA, 14 nt, Human
acucagcccugagg

SEQ ID NO: 2461184 - RNA, 18 nt, Human
acucagccaagcacagug

SEQ ID NO: 2461185 - RNA, 17 nt, Human
acucagccaagcacagu

SEQ ID NO: 2461186 - RNA, 16 nt, Human
acucagccaagcacag

SEQ ID NO: 2461187 - RNA, 15 nt, Human
acucagccaagcaca

SEQ ID NO: 2461188 - RNA, 14 nt, Human
acucagccaagcac

SEQ ID NO: 2461189 - RNA, 22 nt, Human
acucagcagcccuccucacccc

SEQ ID NO: 2461190 - RNA, 23 nt, Human
acucagcagcccuccucaccccg

SEQ ID NO: 2461191 - RNA, 18 nt, Human
acucagcagcccuccuca

SEQ ID NO: 2461192 - RNA, 19 nt, Human
acucagcagcccuccucac

SEQ ID NO: 2461193 - RNA, 20 nt, Human
acucagcagcccuccucacc

SEQ ID NO: 2461194 - RNA, 21 nt, Human
acucagcagcccuccucaccc

SEQ ID NO: 2461195 - RNA, 17 nt, Human
acucagcagcccuccuc

SEQ ID NO: 2461196 - RNA, 20 nt, Human
acucaaaacccaucugggcu

SEQ ID NO: 2461197 - RNA, 15 nt, Human
acucaaaacuuaaca

SEQ ID NO: 2461198 - RNA, 18 nt, Human
acucaaaugcucagacca

SEQ ID NO: 2461199 - RNA, 21 nt, Human
acucaaaugcucagaccagcu

SEQ ID NO: 2461200 - RNA, 20 nt, Human
acucaaauggggccagaucc

SEQ ID NO: 2461201 - RNA, 21 nt, Human
acucaaauggggccagaucca

SEQ ID NO: 2461202 - RNA, 22 nt, Human
acucaaauggggccagauccag

SEQ ID NO: 2461203 - RNA, 23 nt, Human
acucaaauggggccagauccagc

SEQ ID NO: 2461204 - RNA, 22 nt, Human
acucaaaugcuuggcuucucau

SEQ ID NO: 2461205 - RNA, 19 nt, Human
acucaaaugcuuggcuucu

SEQ ID NO: 2461206 - RNA, 17 nt, Human
acucaaauggggccaga

SEQ ID NO: 2461207 - RNA, 12 nt, Human
acucaaaugcuu

SEQ ID NO: 2461208 - RNA, 23 nt, Human
acucaaaugcucagaccagcucu

SEQ ID NO: 2461209 - RNA, 15 nt, Human
acucugguucuuugu

SEQ ID NO: 2461210 - RNA, 18 nt, Human
acucuggucuucuuuggg

SEQ ID NO: 2461211 - RNA, 19 nt, Human
acucugucgcccagucugg

SEQ ID NO: 2461212 - RNA, 23 nt, Human
acucugucaauuucccugacucc

SEQ ID NO: 2461213 - RNA, 14 nt, Human
acucugucagaugg

SEQ ID NO: 2461214 - RNA, 16 nt, Human
acucugucagauggga

SEQ ID NO: 2461215 - RNA, 21 nt, Human
acucuaucaaguauuauaccu

SEQ ID NO: 2461216 - RNA, 17 nt, Human
acucuauguucuaagaa

SEQ ID NO: 2461217 - RNA, 23 nt, Human
acucuaucaaguauuauaccuuu

SEQ ID NO: 2461218 - RNA, 13 nt, Human
acucuagggcagu

SEQ ID NO: 2461219 - RNA, 23 nt, Human
acucuagauuuuguuuugcuuuu

SEQ ID NO: 2461220 - RNA, 20 nt, Human
acucuagcugggggugggcc

SEQ ID NO: 2461221 - RNA, 21 nt, Human
acucuaggggucaggcuccau

SEQ ID NO: 2461222 - RNA, 17 nt, Human
acucuaggugcccuugg

SEQ ID NO: 2461223 - RNA, 21 nt, Human
acucuagauuuuguuuugcuu

SEQ ID NO: 2461224 - RNA, 20 nt, Human
acucuagauuuuguuuugcu

SEQ ID NO: 2461225 - RNA, 19 nt, Human
acucuagauuuuguuuugc

SEQ ID NO: 2461226 - RNA, 14 nt, Human
acucuagauuuugu

SEQ ID NO: 2461227 - RNA, 15 nt, Human
acucuagggaaaaac

SEQ ID NO: 2461228 - RNA, 17 nt, Human
acucuagggaaaaacca

SEQ ID NO: 2461229 - RNA, 20 nt, Human
acucauacugugcuggagcc

SEQ ID NO: 2461230 - RNA, 19 nt, Human
acucauacugugcuggagc

SEQ ID NO: 2461231 - RNA, 17 nt, Human
acucauacugugcugga

SEQ ID NO: 2461232 - RNA, 15 nt, Human
acucauacugugcug

SEQ ID NO: 2461233 - RNA, 17 nt, Human
acucauaccuuuaaagg

SEQ ID NO: 2461234 - RNA, 15 nt, Human
acucauacaucuggc

SEQ ID NO: 2461235 - RNA, 14 nt, Human
acucauacaucugg

SEQ ID NO: 2461236 - RNA, 23 nt, Human
acucauacugugcuggagccacu

SEQ ID NO: 2461237 - RNA, 21 nt, Human
acucauacugugcuggagcca

SEQ ID NO: 2461238 - RNA, 22 nt, Human
acucauauccccuauuuaacag

SEQ ID NO: 2461239 - RNA, 21 nt, Human
accucugcagcaauaaagcag

SEQ ID NO: 2461240 - RNA, 19 nt, Human
accucugcggaccccagcu

SEQ ID NO: 2461241 - RNA, 18 nt, Human
accucugcggaccccagc

SEQ ID NO: 2461242 - RNA, 17 nt, Human
accucugcggaccccag

SEQ ID NO: 2461243 - RNA, 14 nt, Human
accucugcggaccc

SEQ ID NO: 2461244 - RNA, 18 nt, Human
accucugcagcaauaaag

SEQ ID NO: 2461245 - RNA, 20 nt, Human
accucugcagcaauaaagca

SEQ ID NO: 2461246 - RNA, 15 nt, Human
accucugcagcaaua

SEQ ID NO: 2461247 - RNA, 20 nt, Human
accugcccugcugaguccca

SEQ ID NO: 2461248 - RNA, 17 nt, Human
accugcccugccugagg

SEQ ID NO: 2461249 - RNA, 18 nt, Human
accugcccugccugaggg

SEQ ID NO: 2461250 - RNA, 23 nt, Human
accucugcucugaggcuuccaga

SEQ ID NO: 2461251 - RNA, 23 nt, Human
accucuggacuggcuagaguccu

SEQ ID NO: 2461252 - RNA, 22 nt, Human
accucugcucugaggcuuccag

SEQ ID NO: 2461253 - RNA, 14 nt, Human
accucugcucugag

SEQ ID NO: 2461254 - RNA, 12 nt, Human
accucugcucug

SEQ ID NO: 2461255 - RNA, 20 nt, Human
accucugcggaccccagcug

SEQ ID NO: 2461256 - RNA, 14 nt, Human
accucuggacuggc

SEQ ID NO: 2461257 - RNA, 15 nt, Human
accucuggacuggcu

SEQ ID NO: 2461258 - RNA, 16 nt, Human
accucuggacuggcua

SEQ ID NO: 2461259 - RNA, 19 nt, Human
accucuggacuggcuagag

SEQ ID NO: 2461260 - RNA, 19 nt, Human
accugucaugccccccuca

SEQ ID NO: 2461261 - RNA, 18 nt, Human
accugucaugccccccuc

SEQ ID NO: 2461262 - RNA, 17 nt, Human
accugucaugccccccu

SEQ ID NO: 2461263 - RNA, 15 nt, Human
accugucaugccccc

SEQ ID NO: 2461264 - RNA, 17 nt, Human
accugccucacagcugg

SEQ ID NO: 2461265 - RNA, 18 nt, Human
accugucaccgugagcag

SEQ ID NO: 2461266 - RNA, 23 nt, Human
accugucacgauugucaucagga

SEQ ID NO: 2461267 - RNA, 19 nt, Human
accugucaccgugagcagc

SEQ ID NO: 2461268 - RNA, 20 nt, Human
accugcccugccugagggcc

SEQ ID NO: 2461269 - RNA, 19 nt, Human
accugcccugccugagggc

SEQ ID NO: 2461270 - RNA, 12 nt, Human
accugccgaccu

SEQ ID NO: 2461271 - RNA, 13 nt, Human
accugccgaccuc

SEQ ID NO: 2461272 - RNA, 17 nt, Human
accugccgaccucgucc

SEQ ID NO: 2461273 - RNA, 18 nt, Human
accugccgaccucguccu

SEQ ID NO: 2461274 - RNA, 20 nt, Human
accugccgaccucguccucc

SEQ ID NO: 2461275 - RNA, 15 nt, Human
accugucccccugac

SEQ ID NO: 2461276 - RNA, 12 nt, Human
accugucccccu

SEQ ID NO: 2461277 - RNA, 16 nt, Human
accugucccccugaca

SEQ ID NO: 2461278 - RNA, 15 nt, Human
accuguccuccuggu

SEQ ID NO: 2461279 - RNA, 14 nt, Human
accuguccuccugg

SEQ ID NO: 2461280 - RNA, 20 nt, Human
accugucaugccccccucaa

SEQ ID NO: 2461281 - RNA, 13 nt, Human
accugucucacca

SEQ ID NO: 2461282 - RNA, 18 nt, Human
accuguccuccugguggg

SEQ ID NO: 2461283 - RNA, 14 nt, Human
accuguccuugcac

SEQ ID NO: 2461284 - RNA, 14 nt, Human
accugucucagccu

SEQ ID NO: 2461285 - RNA, 17 nt, Human
accugucuccuuucuca

SEQ ID NO: 2461286 - RNA, 22 nt, Human
accugucuccuuucaccccagg

SEQ ID NO: 2461287 - RNA, 12 nt, Human
accugucuccuu

SEQ ID NO: 2461288 - RNA, 19 nt, Human
accuuguuggagccugcag

SEQ ID NO: 2461289 - RNA, 18 nt, Human
accuuguuggagccugca

SEQ ID NO: 2461290 - RNA, 17 nt, Human
accuuguuggagccugc

SEQ ID NO: 2461291 - RNA, 16 nt, Human
accuuguuggagccug

SEQ ID NO: 2461292 - RNA, 15 nt, Human
accuuguuggagccu

SEQ ID NO: 2461293 - RNA, 22 nt, Human
accuuguugcaugauguauuuu

SEQ ID NO: 2461294 - RNA, 23 nt, Human
accuugguguaguugaacugaua

SEQ ID NO: 2461295 - RNA, 17 nt, Human
accuuggggcuugacuu

SEQ ID NO: 2461296 - RNA, 16 nt, Human
accuguuuaaauauuu

SEQ ID NO: 2461297 - RNA, 14 nt, Human
accuguuuaaauau

SEQ ID NO: 2461298 - RNA, 16 nt, Human
accuguugguuccaag

SEQ ID NO: 2461299 - RNA, 18 nt, Human
accuuggcugcagggagu

SEQ ID NO: 2461300 - RNA, 20 nt, Human
accuguucagugucccgggc

SEQ ID NO: 2461301 - RNA, 19 nt, Human
accuguucagugucccggg

SEQ ID NO: 2461302 - RNA, 22 nt, Human
accuguucagugucccgggccc

SEQ ID NO: 2461303 - RNA, 17 nt, Human
accuguuaccuacuuug

SEQ ID NO: 2461304 - RNA, 18 nt, Human
accuguuaccuacuuuga

SEQ ID NO: 2461305 - RNA, 18 nt, Human
accuguucagugucccgg

SEQ ID NO: 2461306 - RNA, 17 nt, Human
accuguucagugucccg

SEQ ID NO: 2461307 - RNA, 17 nt, Human
accuguuagcagacagg

SEQ ID NO: 2461308 - RNA, 14 nt, Human
accuguugguucca

SEQ ID NO: 2461309 - RNA, 21 nt, Human
accuguugcuuacaauuuuuu

SEQ ID NO: 2461310 - RNA, 20 nt, Human
accuguugcuuacaauuuuu

SEQ ID NO: 2461311 - RNA, 19 nt, Human
accuguugcuuacaauuuu

SEQ ID NO: 2461312 - RNA, 18 nt, Human
accuguugcuuacaauuu

SEQ ID NO: 2461313 - RNA, 16 nt, Human
accuguugcuuacaau

SEQ ID NO: 2461314 - RNA, 15 nt, Human
accuguugcuuacaa

SEQ ID NO: 2461315 - RNA, 17 nt, Human
accuuggcugcagggag

SEQ ID NO: 2461316 - RNA, 13 nt, Human
accuuucccaucu

SEQ ID NO: 2461317 - RNA, 18 nt, Human
accuuucccaucuuccaa

SEQ ID NO: 2461318 - RNA, 18 nt, Human
accuuuccaccacagcca

SEQ ID NO: 2461319 - RNA, 23 nt, Human
accuuuccaaaguuaacagauuu

SEQ ID NO: 2461320 - RNA, 15 nt, Human
accuuuaagagaaau

SEQ ID NO: 2461321 - RNA, 15 nt, Human
accuuuagggcagcu

SEQ ID NO: 2461322 - RNA, 14 nt, Human
accuuuagggcagc

SEQ ID NO: 2461323 - RNA, 18 nt, Human
accuuguuguuguuaaau

SEQ ID NO: 2461324 - RNA, 21 nt, Human
accuuuagggcagcuugcccc

SEQ ID NO: 2461325 - RNA, 20 nt, Human
accuuuagugguggccauuu

SEQ ID NO: 2461326 - RNA, 15 nt, Human
accuuuaugguuucu

SEQ ID NO: 2461327 - RNA, 14 nt, Human
accuuuauuaaaau

SEQ ID NO: 2461328 - RNA, 15 nt, Human
accuuuauuaaaauc

SEQ ID NO: 2461329 - RNA, 16 nt, Human
accuuuauuaaaaucu

SEQ ID NO: 2461330 - RNA, 17 nt, Human
accuuuauuaaaaucuu

SEQ ID NO: 2461331 - RNA, 18 nt, Human
accuuuauuaaaaucuua

SEQ ID NO: 2461332 - RNA, 18 nt, Human
accuuucauaaucuuugc

SEQ ID NO: 2461333 - RNA, 19 nt, Human
accuuucauaaucuuugcu

SEQ ID NO: 2461334 - RNA, 21 nt, Human
accuuucauaaucuuugcuuu

SEQ ID NO: 2461335 - RNA, 20 nt, Human
accuuucauaaucuuugcuu

SEQ ID NO: 2461336 - RNA, 16 nt, Human
acgugacagugccugg

SEQ ID NO: 2461337 - RNA, 19 nt, Human
acgugacagugccugggaa

SEQ ID NO: 2461338 - RNA, 21 nt, Human
acgugaccggacuuuucugca

SEQ ID NO: 2461339 - RNA, 17 nt, Human
acgugacagugccuggg

SEQ ID NO: 2461340 - RNA, 14 nt, Human
acgugacugcccca

SEQ ID NO: 2461341 - RNA, 18 nt, Human
acgugacugccccaacuc

SEQ ID NO: 2461342 - RNA, 20 nt, Human
acgugacugccccaacuccu

SEQ ID NO: 2461343 - RNA, 21 nt, Human
acgugacuguggcacacgccu

SEQ ID NO: 2461344 - RNA, 14 nt, Human
acgugagagugucu

SEQ ID NO: 2461345 - RNA, 11 nt, Human
acgugaguccu

SEQ ID NO: 2461346 - RNA, 18 nt, Human
acgugauggucugagacu

SEQ ID NO: 2461347 - RNA, 23 nt, Human
acgugagccagguaaugagggac

SEQ ID NO: 2461348 - RNA, 22 nt, Human
acgugagccagguaaugaggga

SEQ ID NO: 2461349 - RNA, 15 nt, Human
acgugagccagguaa

SEQ ID NO: 2461350 - RNA, 14 nt, Human
acgugagccaggua

SEQ ID NO: 2461351 - RNA, 16 nt, Human
acgugagaucauucac

SEQ ID NO: 2461352 - RNA, 15 nt, Human
acgugagagugucuu

SEQ ID NO: 2461353 - RNA, 23 nt, Human
acgugagagugucuucacggcag

SEQ ID NO: 2461354 - RNA, 13 nt, Human
acuaagagagaau

SEQ ID NO: 2461355 - RNA, 22 nt, Human
acuaagcagaggaggggccgcu

SEQ ID NO: 2461356 - RNA, 15 nt, Human
acuaagcagaggagg

SEQ ID NO: 2461357 - RNA, 14 nt, Human
acuaagaaaagaua

SEQ ID NO: 2461358 - RNA, 16 nt, Human
acuaagaauucaaacu

SEQ ID NO: 2461359 - RNA, 18 nt, Human
acuaagaauucaaacugg

SEQ ID NO: 2461360 - RNA, 14 nt, Human
acuaagaagaaaau

SEQ ID NO: 2461361 - RNA, 13 nt, Human
acuaagaagaaaa

SEQ ID NO: 2461362 - RNA, 17 nt, Human
acuaacuugacuuuuaa

SEQ ID NO: 2461363 - RNA, 18 nt, Human
acuaagcccugucgagac

SEQ ID NO: 2461364 - RNA, 16 nt, Human
acuaagcccugucgag

SEQ ID NO: 2461365 - RNA, 13 nt, Human
acuaagcccuguc

SEQ ID NO: 2461366 - RNA, 18 nt, Human
acuaagccacaagaaauu

SEQ ID NO: 2461367 - RNA, 16 nt, Human
acuaagccacaagaaa

SEQ ID NO: 2461368 - RNA, 15 nt, Human
acuaagccacaagaa

SEQ ID NO: 2461369 - RNA, 19 nt, Human
acuaagcagaggaggggcc

SEQ ID NO: 2461370 - RNA, 19 nt, Human
acuaagccuaccugcucuc

SEQ ID NO: 2461371 - RNA, 18 nt, Human
acuaagccuaccugcucu

SEQ ID NO: 2461372 - RNA, 14 nt, Human
acuaagccuaccug

SEQ ID NO: 2461373 - RNA, 22 nt, Human
acuaagcccugucgagacacuu

SEQ ID NO: 2461374 - RNA, 21 nt, Human
acuaagcuuugccagcugcug

SEQ ID NO: 2461375 - RNA, 20 nt, Human
acuaagcuuugccagcugcu

SEQ ID NO: 2461376 - RNA, 20 nt, Human
acuaaggaguaaucugugua

SEQ ID NO: 2461377 - RNA, 12 nt, Human
acuaaggggccc

SEQ ID NO: 2461378 - RNA, 13 nt, Human
acuaauuccacac

SEQ ID NO: 2461379 - RNA, 15 nt, Human
acuaauuccacaccu

SEQ ID NO: 2461380 - RNA, 18 nt, Human
acuaaguuauaguauauc

SEQ ID NO: 2461381 - RNA, 17 nt, Human
acuaaguuauaguauau

SEQ ID NO: 2461382 - RNA, 22 nt, Human
acuaaggggcccggccagccau

SEQ ID NO: 2461383 - RNA, 21 nt, Human
acuaaggggcccggccagcca

SEQ ID NO: 2461384 - RNA, 15 nt, Human
acuaauuuaaaaaau

SEQ ID NO: 2461385 - RNA, 20 nt, Human
acuaauuucaaaaugcuuuu

SEQ ID NO: 2461386 - RNA, 16 nt, Human
acuaauuucaaaaugc

SEQ ID NO: 2461387 - RNA, 19 nt, Human
acuaauuucaaaaugcuuu

SEQ ID NO: 2461388 - RNA, 19 nt, Human
acuaauuguauaacagguu

SEQ ID NO: 2461389 - RNA, 18 nt, Human
acuaauuguauaacaggu

SEQ ID NO: 2461390 - RNA, 17 nt, Human
acuaauuguauaacagg

SEQ ID NO: 2461391 - RNA, 16 nt, Human
acuaauuguauaacag

SEQ ID NO: 2461392 - RNA, 22 nt, Human
acuaauuguauaacagguuauu

SEQ ID NO: 2461393 - RNA, 20 nt, Human
acuaauuguauaacagguua

SEQ ID NO: 2461394 - RNA, 14 nt, Human
acuaauuucaaaau

SEQ ID NO: 2461395 - RNA, 15 nt, Human
acuaauuguauaaca

SEQ ID NO: 2461396 - RNA, 14 nt, Human
acuaauuguauaac

SEQ ID NO: 2461397 - RNA, 20 nt, Human
acuaauuggccucuuuaaga

SEQ ID NO: 2461398 - RNA, 23 nt, Human
acuaauuccacaccuuuuauuga

SEQ ID NO: 2461399 - RNA, 14 nt, Human
acgcugugcugccc

SEQ ID NO: 2461400 - RNA, 12 nt, Human
acgcugugcugc

SEQ ID NO: 2461401 - RNA, 11 nt, Human
acgcugugcug

SEQ ID NO: 2461402 - RNA, 12 nt, Human
acgccacccagc

SEQ ID NO: 2461403 - RNA, 18 nt, Human
acgccaccauuccuggaa

SEQ ID NO: 2461404 - RNA, 13 nt, Human
acgccaccauucc

SEQ ID NO: 2461405 - RNA, 19 nt, Human
acgcaggcccccaggugcc

SEQ ID NO: 2461406 - RNA, 22 nt, Human
acgcaggcccccaggugccagu

SEQ ID NO: 2461407 - RNA, 17 nt, Human
acgcagggguugcagug

SEQ ID NO: 2461408 - RNA, 14 nt, Human
acgcaguggccuuc

SEQ ID NO: 2461409 - RNA, 22 nt, Human
acgcauggaguguguauuguuc

SEQ ID NO: 2461410 - RNA, 21 nt, Human
acguccugucagugccgccgc

SEQ ID NO: 2461411 - RNA, 19 nt, Human
acgucgucuucuguauacu

SEQ ID NO: 2461412 - RNA, 14 nt, Human
acgucugacaggca

SEQ ID NO: 2461413 - RNA, 13 nt, Human
acgucugacaggc

SEQ ID NO: 2461414 - RNA, 18 nt, Human
acguccugucagugccgc

SEQ ID NO: 2461415 - RNA, 15 nt, Human
acguccugucagugc

SEQ ID NO: 2461416 - RNA, 20 nt, Human
acguccugccaccuggggca

SEQ ID NO: 2461417 - RNA, 12 nt, Human
acgcuuugauuc

SEQ ID NO: 2461418 - RNA, 13 nt, Human
acgcuuugauuca

SEQ ID NO: 2461419 - RNA, 14 nt, Human
acgcuuugauucau

SEQ ID NO: 2461420 - RNA, 16 nt, Human
acgcuuugauucauag

SEQ ID NO: 2461421 - RNA, 19 nt, Human
acgcugucuccagaccccc

SEQ ID NO: 2461422 - RNA, 20 nt, Human
acgcugucuccagaccccca

SEQ ID NO: 2461423 - RNA, 21 nt, Human
acgcugucuccagacccccac

SEQ ID NO: 2461424 - RNA, 22 nt, Human
acgcugucuccagacccccacc

SEQ ID NO: 2461425 - RNA, 11 nt, Human
acgcuuugauu

SEQ ID NO: 2461426 - RNA, 17 nt, Human
acgcuuucuagcuguug

SEQ ID NO: 2461427 - RNA, 18 nt, Human
acgcuuuccugaauccaa

SEQ ID NO: 2461428 - RNA, 23 nt, Human
acgcugucuccagacccccaccc

SEQ ID NO: 2461429 - RNA, 20 nt, Human
acugugcugagucugaaggc

SEQ ID NO: 2461430 - RNA, 14 nt, Human
acugugcucagggc

SEQ ID NO: 2461431 - RNA, 21 nt, Human
acugugcuaauaacagugcau

SEQ ID NO: 2461432 - RNA, 18 nt, Human
acugugcuaauaacagug

SEQ ID NO: 2461433 - RNA, 12 nt, Human
acugugcuaaua

SEQ ID NO: 2461434 - RNA, 22 nt, Human
acugugcugagucugaaggcug

SEQ ID NO: 2461435 - RNA, 22 nt, Human
acuucugucuucacaacagauu

SEQ ID NO: 2461436 - RNA, 16 nt, Human
acuucuuauggaauug

SEQ ID NO: 2461437 - RNA, 17 nt, Human
acuucuuauggaauuga

SEQ ID NO: 2461438 - RNA, 20 nt, Human
acuucuuauggaauugauuu

SEQ ID NO: 2461439 - RNA, 21 nt, Human
acuucuucagagcugacacag

SEQ ID NO: 2461440 - RNA, 16 nt, Human
acuucuucagagcuga

SEQ ID NO: 2461441 - RNA, 13 nt, Human
acuucuucagagc

SEQ ID NO: 2461442 - RNA, 21 nt, Human
acuucuuauggaauugauuug

SEQ ID NO: 2461443 - RNA, 23 nt, Human
acuucuuauggaauugauuugca

SEQ ID NO: 2461444 - RNA, 20 nt, Human
acuucuucagagcugacaca

SEQ ID NO: 2461445 - RNA, 12 nt, Human
acuucuugaagg

SEQ ID NO: 2461446 - RNA, 17 nt, Human
acuugggccauagcucc

SEQ ID NO: 2461447 - RNA, 20 nt, Human
acuuggggagauggaguucu

SEQ ID NO: 2461448 - RNA, 21 nt, Human
acuuggggaguuaagaccugg

SEQ ID NO: 2461449 - RNA, 15 nt, Human
acuugggccacugug

SEQ ID NO: 2461450 - RNA, 13 nt, Human
acuucuugaaggu

SEQ ID NO: 2461451 - RNA, 16 nt, Human
acuucuugaaggugcu

SEQ ID NO: 2461452 - RNA, 14 nt, Human
acuugggccacugu

SEQ ID NO: 2461453 - RNA, 16 nt, Human
acuugguuuuuaaaaa

SEQ ID NO: 2461454 - RNA, 18 nt, Human
acuugggccauagcuccu

SEQ ID NO: 2461455 - RNA, 23 nt, Human
acuuggggaguuaagaccuggca

SEQ ID NO: 2461456 - RNA, 21 nt, Human
acuugguguccuuucccucca

SEQ ID NO: 2461457 - RNA, 22 nt, Human
acuugguguccuuucccuccac

SEQ ID NO: 2461458 - RNA, 21 nt, Human
acuuggucugugagaugcuag

SEQ ID NO: 2461459 - RNA, 18 nt, Human
acuugguuggguccucac

SEQ ID NO: 2461460 - RNA, 14 nt, Human
acuguuucugucag

SEQ ID NO: 2461461 - RNA, 16 nt, Human
acuguuucugucagga

SEQ ID NO: 2461462 - RNA, 15 nt, Human
acuguuucugucagg

SEQ ID NO: 2461463 - RNA, 18 nt, Human
acuguuugagguuuuuaa

SEQ ID NO: 2461464 - RNA, 15 nt, Human
acuguuucucugcug

SEQ ID NO: 2461465 - RNA, 13 nt, Human
acuguuucucugc

SEQ ID NO: 2461466 - RNA, 14 nt, Human
acuguuucucugcu

SEQ ID NO: 2461467 - RNA, 18 nt, Human
acuuauuuuuuucugauu

SEQ ID NO: 2461468 - RNA, 17 nt, Human
acuuauuuuuuucugau

SEQ ID NO: 2461469 - RNA, 16 nt, Human
acuuauuuuuuucuga

SEQ ID NO: 2461470 - RNA, 15 nt, Human
acuuauuuuuuucug

SEQ ID NO: 2461471 - RNA, 19 nt, Human
acuuauuuuugacaguguu

SEQ ID NO: 2461472 - RNA, 22 nt, Human
acuuauuuuugacaguguugaa

SEQ ID NO: 2461473 - RNA, 14 nt, Human
acuuauuuuugaca

SEQ ID NO: 2461474 - RNA, 16 nt, Human
acuuauuuuugacagu

SEQ ID NO: 2461475 - RNA, 22 nt, Human
acuuauuugagugauuauuugu

SEQ ID NO: 2461476 - RNA, 12 nt, Human
acuuauuugagu

SEQ ID NO: 2461477 - RNA, 15 nt, Human
acuuauuuucucugu

SEQ ID NO: 2461478 - RNA, 23 nt, Human
acuguuugagguuuuuaagccuu

SEQ ID NO: 2461479 - RNA, 22 nt, Human
acuguuugccuucuacuuuuaa

SEQ ID NO: 2461480 - RNA, 21 nt, Human
acuguuugccuucuacuuuua

SEQ ID NO: 2461481 - RNA, 11 nt, Human
acuuauuugag

SEQ ID NO: 2461482 - RNA, 15 nt, Human
acuuauuuauauaaa

SEQ ID NO: 2461483 - RNA, 21 nt, Human
acuucugucuucacaacagau

SEQ ID NO: 2461484 - RNA, 16 nt, Human
acuucuggcuccucaa

SEQ ID NO: 2461485 - RNA, 17 nt, Human
acuucuggguggggcag

SEQ ID NO: 2461486 - RNA, 16 nt, Human
acuucuggguggggca

SEQ ID NO: 2461487 - RNA, 15 nt, Human
acuucuggcuccuca

SEQ ID NO: 2461488 - RNA, 13 nt, Human
acuucuggcuccu

SEQ ID NO: 2461489 - RNA, 17 nt, Human
acuucugggcuucaucu

SEQ ID NO: 2461490 - RNA, 19 nt, Human
acuucugggcuucaucugg

SEQ ID NO: 2461491 - RNA, 22 nt, Human
acuucugggcuucaucuggcaa

SEQ ID NO: 2461492 - RNA, 12 nt, Human
acuucagacaua

SEQ ID NO: 2461493 - RNA, 21 nt, Human
acuucaaaaguauuuuccugu

SEQ ID NO: 2461494 - RNA, 19 nt, Human
acuucaaaaguauuuuccu

SEQ ID NO: 2461495 - RNA, 23 nt, Human
acuucacauauugauuuccguua

SEQ ID NO: 2461496 - RNA, 18 nt, Human
acuucaaaaguauuuucc

SEQ ID NO: 2461497 - RNA, 17 nt, Human
acuucaaaaguauuuuc

SEQ ID NO: 2461498 - RNA, 16 nt, Human
acuucaaaaguauuuu

SEQ ID NO: 2461499 - RNA, 15 nt, Human
acuucaaaaguauuu

SEQ ID NO: 2461500 - RNA, 21 nt, Human
acuuauuuuuuucugauugua

SEQ ID NO: 2461501 - RNA, 19 nt, Human
acuuauuuuuuucugauug

SEQ ID NO: 2461502 - RNA, 17 nt, Human
acuucacuuuaauucuc

SEQ ID NO: 2461503 - RNA, 23 nt, Human
acuucacugucaggaagaaauca

SEQ ID NO: 2461504 - RNA, 21 nt, Human
acuucacugucaggaagaaau

SEQ ID NO: 2461505 - RNA, 19 nt, Human
acuucacugucaggaagaa

SEQ ID NO: 2461506 - RNA, 22 nt, Human
acugugaaguuuacauuguaaa

SEQ ID NO: 2461507 - RNA, 13 nt, Human
acugugacaggca

SEQ ID NO: 2461508 - RNA, 16 nt, Human
acugugaaggacccuu

SEQ ID NO: 2461509 - RNA, 17 nt, Human
acugugacaggcagcag

SEQ ID NO: 2461510 - RNA, 16 nt, Human
acugugacaggcagca

SEQ ID NO: 2461511 - RNA, 15 nt, Human
acugugacaggcagc

SEQ ID NO: 2461512 - RNA, 14 nt, Human
acugugacaggcag

SEQ ID NO: 2461513 - RNA, 19 nt, Human
acugugacaggcagcagag

SEQ ID NO: 2461514 - RNA, 18 nt, Human
acugugacaggcagcaga

SEQ ID NO: 2461515 - RNA, 23 nt, Human
acugugccuuugaguuuccucag

SEQ ID NO: 2461516 - RNA, 11 nt, Human
acugugccuuu

SEQ ID NO: 2461517 - RNA, 19 nt, Human
acugugacccccagcuccg

SEQ ID NO: 2461518 - RNA, 21 nt, Human
acugugacccccagcuccggc

SEQ ID NO: 2461519 - RNA, 11 nt, Human
acugugacuga

SEQ ID NO: 2461520 - RNA, 23 nt, Human
acugugacucuuuuuagggccag

SEQ ID NO: 2461521 - RNA, 12 nt, Human
acugugaccugu

SEQ ID NO: 2461522 - RNA, 15 nt, Human
acugucucucaugaa

SEQ ID NO: 2461523 - RNA, 17 nt, Human
acugucucucaugaacc

SEQ ID NO: 2461524 - RNA, 21 nt, Human
acugucucgaugcaaugaaca

SEQ ID NO: 2461525 - RNA, 22 nt, Human
acugucuccauggcccugcaaa

SEQ ID NO: 2461526 - RNA, 18 nt, Human
acugucucucaugaaccu

SEQ ID NO: 2461527 - RNA, 15 nt, Human
acugugaaggacccu

SEQ ID NO: 2461528 - RNA, 23 nt, Human
acugucucaagagggcacuggug

SEQ ID NO: 2461529 - RNA, 22 nt, Human
acugguuuauccacccacaaca

SEQ ID NO: 2461530 - RNA, 12 nt, Human
acugucucacug

SEQ ID NO: 2461531 - RNA, 18 nt, Human
acugucucaguuucacuu

SEQ ID NO: 2461532 - RNA, 21 nt, Human
acugucucaagagggcacugg

SEQ ID NO: 2461533 - RNA, 20 nt, Human
acugucucaagagggcacug

SEQ ID NO: 2461534 - RNA, 13 nt, Human
acuguaagaaaau

SEQ ID NO: 2461535 - RNA, 19 nt, Human
acuguaagaaaauaucacu

SEQ ID NO: 2461536 - RNA, 22 nt, Human
acuguaagaaaauaucacuugu

SEQ ID NO: 2461537 - RNA, 19 nt, Human
acugucucaagagggcacu

SEQ ID NO: 2461538 - RNA, 22 nt, Human
acugguuuguugcagccaaaga

SEQ ID NO: 2461539 - RNA, 18 nt, Human
acugguuccauggccucu

SEQ ID NO: 2461540 - RNA, 20 nt, Human
acugguuuauccacccacaa

SEQ ID NO: 2461541 - RNA, 20 nt, Human
acugguuguugccaaacagc

SEQ ID NO: 2461542 - RNA, 16 nt, Human
acugcccccucugccc

SEQ ID NO: 2461543 - RNA, 17 nt, Human
acugcccccucugcccu

SEQ ID NO: 2461544 - RNA, 17 nt, Human
acuggaagcacagcuuc

SEQ ID NO: 2461545 - RNA, 19 nt, Human
acuggaagcacagcuucau

SEQ ID NO: 2461546 - RNA, 16 nt, Human
acuggaagcuaauuug

SEQ ID NO: 2461547 - RNA, 19 nt, Human
acuggaagcauguaggaga

SEQ ID NO: 2461548 - RNA, 20 nt, Human
acuggaagcauguaggagaa

SEQ ID NO: 2461549 - RNA, 16 nt, Human
acugccaggccagccu

SEQ ID NO: 2461550 - RNA, 15 nt, Human
acugccaggccagcc

SEQ ID NO: 2461551 - RNA, 17 nt, Human
acugccaggccagccuc

SEQ ID NO: 2461552 - RNA, 16 nt, Human
acugcccauggacagg

SEQ ID NO: 2461553 - RNA, 19 nt, Human
acugcccauggacaggcug

SEQ ID NO: 2461554 - RNA, 14 nt, Human
acugcccccucugc

SEQ ID NO: 2461555 - RNA, 15 nt, Human
acugcccccucugcc

SEQ ID NO: 2461556 - RNA, 18 nt, Human
acugccccaacuccugga

SEQ ID NO: 2461557 - RNA, 21 nt, Human
acugccccaacuccuggaagc

SEQ ID NO: 2461558 - RNA, 21 nt, Human
acugcccauggacaggcuggc

SEQ ID NO: 2461559 - RNA, 15 nt, Human
acugccccaacuccu

SEQ ID NO: 2461560 - RNA, 17 nt, Human
acugccccaacuccugg

SEQ ID NO: 2461561 - RNA, 15 nt, Human
acuggagaaaaugga

SEQ ID NO: 2461562 - RNA, 19 nt, Human
acuggaagcuaauuugcau

SEQ ID NO: 2461563 - RNA, 21 nt, Human
acuggaagcauguaggagaau

SEQ ID NO: 2461564 - RNA, 17 nt, Human
acuggagaagucuuaga

SEQ ID NO: 2461565 - RNA, 17 nt, Human
acuggagaggcuagaac

SEQ ID NO: 2461566 - RNA, 13 nt, Human
acuggagcaccag

SEQ ID NO: 2461567 - RNA, 13 nt, Human
acuggagcaucug

SEQ ID NO: 2461568 - RNA, 15 nt, Human
acuggagcaccaggc

SEQ ID NO: 2461569 - RNA, 16 nt, Human
acuggagcaccaggca

SEQ ID NO: 2461570 - RNA, 17 nt, Human
acuggagcaucugacuc

SEQ ID NO: 2461571 - RNA, 16 nt, Human
acuggagcaucugacu

SEQ ID NO: 2461572 - RNA, 14 nt, Human
acuggagcaucuga

SEQ ID NO: 2461573 - RNA, 19 nt, Human
acuggagcaccaggcacga

SEQ ID NO: 2461574 - RNA, 12 nt, Human
acuggagcccag

SEQ ID NO: 2461575 - RNA, 18 nt, Human
acuggagcaucugacuca

SEQ ID NO: 2461576 - RNA, 21 nt, Human
acugguccaaaagauugcuga

SEQ ID NO: 2461577 - RNA, 22 nt, Human
acugguccaaaagauugcugaa

SEQ ID NO: 2461578 - RNA, 18 nt, Human
acugguauuccugccucc

SEQ ID NO: 2461579 - RNA, 14 nt, Human
acugguauuuuauc

SEQ ID NO: 2461580 - RNA, 15 nt, Human
acuggucuguaggga

SEQ ID NO: 2461581 - RNA, 20 nt, Human
acugguccugugugcaguga

SEQ ID NO: 2461582 - RNA, 15 nt, Human
acugguccugugugc

SEQ ID NO: 2461583 - RNA, 14 nt, Human
acugguccugugug

SEQ ID NO: 2461584 - RNA, 18 nt, Human
acugguaggaaacuaggu

SEQ ID NO: 2461585 - RNA, 13 nt, Human
acuggagcccagg

SEQ ID NO: 2461586 - RNA, 14 nt, Human
acuggagcccagga

SEQ ID NO: 2461587 - RNA, 15 nt, Human
acugguaggaccaag

SEQ ID NO: 2461588 - RNA, 23 nt, Human
acugccagaugcugauguucagu

SEQ ID NO: 2461589 - RNA, 22 nt, Human
acugccagaugcugauguucag

SEQ ID NO: 2461590 - RNA, 19 nt, Human
acugccagaugcugauguu

SEQ ID NO: 2461591 - RNA, 17 nt, Human
acugccagaugcugaug

SEQ ID NO: 2461592 - RNA, 15 nt, Human
acugccagaugcuga

SEQ ID NO: 2461593 - RNA, 13 nt, Human
acugccagcaacg

SEQ ID NO: 2461594 - RNA, 16 nt, Human
acucugucuucaccug

SEQ ID NO: 2461595 - RNA, 17 nt, Human
acucugucuucaccuga

SEQ ID NO: 2461596 - RNA, 18 nt, Human
acucugucuucaccugau

SEQ ID NO: 2461597 - RNA, 15 nt, Human
acucugucuuguguu

SEQ ID NO: 2461598 - RNA, 22 nt, Human
acucugucuucaccugauucaa

SEQ ID NO: 2461599 - RNA, 20 nt, Human
acucugucucaguccaugaa

SEQ ID NO: 2461600 - RNA, 18 nt, Human
acucugucucaguccaug

SEQ ID NO: 2461601 - RNA, 21 nt, Human
agaaauaagugguuauuucuc

SEQ ID NO: 2461602 - RNA, 17 nt, Human
agaaauaagugguuauu

SEQ ID NO: 2461603 - RNA, 22 nt, Human
agaaauaagugguuauuucuca

SEQ ID NO: 2461604 - RNA, 14 nt, Human
agaaauaauaugca

SEQ ID NO: 2461605 - RNA, 16 nt, Human
agaaauaauaugcauu

SEQ ID NO: 2461606 - RNA, 15 nt, Human
agaaauaauaugcau

SEQ ID NO: 2461607 - RNA, 19 nt, Human
agaaauaaauagcuauauc

SEQ ID NO: 2461608 - RNA, 22 nt, Human
agaaauaaauagcuauauccau

SEQ ID NO: 2461609 - RNA, 21 nt, Human
agaaauaaaguuugcuuagaa

SEQ ID NO: 2461610 - RNA, 15 nt, Human
agaaauaaauagcua

SEQ ID NO: 2461611 - RNA, 18 nt, Human
agaaauaaauagcuauau

SEQ ID NO: 2461612 - RNA, 17 nt, Human
agaaauaaaaggaagcc

SEQ ID NO: 2461613 - RNA, 14 nt, Human
agaaauaaaacugu

SEQ ID NO: 2461614 - RNA, 15 nt, Human
agaaauaaaacuguu

SEQ ID NO: 2461615 - RNA, 21 nt, Human
agaaaguugcacggcugcuga

SEQ ID NO: 2461616 - RNA, 20 nt, Human
agaaaguugcacggcugcug

SEQ ID NO: 2461617 - RNA, 19 nt, Human
agaaaguugcacggcugcu

SEQ ID NO: 2461618 - RNA, 17 nt, Human
agaaaguugcacggcug

SEQ ID NO: 2461619 - RNA, 23 nt, Human
agaaagugugcuuuaugcugaaa

SEQ ID NO: 2461620 - RNA, 21 nt, Human
agaaaguggugcucaguugua

SEQ ID NO: 2461621 - RNA, 15 nt, Human
agaaagugugcuuua

SEQ ID NO: 2461622 - RNA, 16 nt, Human
agaaagugugcuuuau

SEQ ID NO: 2461623 - RNA, 22 nt, Human
agaaagugugcuuuaugcugaa

SEQ ID NO: 2461624 - RNA, 17 nt, Human
agaaagugugagcaaac

SEQ ID NO: 2461625 - RNA, 23 nt, Human
agaaagugugagcaaacuaacuu

SEQ ID NO: 2461626 - RNA, 17 nt, Human
agaaaguggugcucagu

SEQ ID NO: 2461627 - RNA, 14 nt, Human
agaaaguggugcuc

SEQ ID NO: 2461628 - RNA, 21 nt, Human
agaaagugggugagaugcugg

SEQ ID NO: 2461629 - RNA, 20 nt, Human
agaaagugggugagaugcug

SEQ ID NO: 2461630 - RNA, 16 nt, Human
agaaagugugagcaaa

SEQ ID NO: 2461631 - RNA, 19 nt, Human
agaaaguggaaaacaagga

SEQ ID NO: 2461632 - RNA, 20 nt, Human
agaaaguggaaaacaaggaa

SEQ ID NO: 2461633 - RNA, 23 nt, Human
agaaaguggaaaacaaggaaguc

SEQ ID NO: 2461634 - RNA, 21 nt, Human
agaaaguggccaugccacccu

SEQ ID NO: 2461635 - RNA, 15 nt, Human
agaaagugauuucua

SEQ ID NO: 2461636 - RNA, 23 nt, Human
agaaagugaagcaaaucagaaac

SEQ ID NO: 2461637 - RNA, 21 nt, Human
agaaagucgaauuaauagcuu

SEQ ID NO: 2461638 - RNA, 19 nt, Human
agaaagucuuauuuauuca

SEQ ID NO: 2461639 - RNA, 22 nt, Human
agaaagucuuauuuauucauau

SEQ ID NO: 2461640 - RNA, 15 nt, Human
agaaagugaagcaaa

SEQ ID NO: 2461641 - RNA, 23 nt, Human
agaaaguacuucuccacccugcu

SEQ ID NO: 2461642 - RNA, 16 nt, Human
agaaagguucugcccg

SEQ ID NO: 2461643 - RNA, 20 nt, Human
agaaagguggacuggaaggg

SEQ ID NO: 2461644 - RNA, 20 nt, Human
agaaagucgaauuaauagcu

SEQ ID NO: 2461645 - RNA, 22 nt, Human
agaaaguacuucuccacccugc

SEQ ID NO: 2461646 - RNA, 23 nt, Human
agaaaggugaguuugagcugccu

SEQ ID NO: 2461647 - RNA, 22 nt, Human
agaaaggugaguuugagcugcc

SEQ ID NO: 2461648 - RNA, 17 nt, Human
agaaaggguguuuuucu

SEQ ID NO: 2461649 - RNA, 14 nt, Human
agaaaggguguuuu

SEQ ID NO: 2461650 - RNA, 20 nt, Human
agaaagggcaacaauaaaau

SEQ ID NO: 2461651 - RNA, 14 nt, Human
agaaaggggagccc

SEQ ID NO: 2461652 - RNA, 15 nt, Human
agaaaggggagccca

SEQ ID NO: 2461653 - RNA, 16 nt, Human
agaaaggggagcccac

SEQ ID NO: 2461654 - RNA, 17 nt, Human
agaaaggggagcccacu

SEQ ID NO: 2461655 - RNA, 19 nt, Human
agaaaggccuuuaaaauuu

SEQ ID NO: 2461656 - RNA, 17 nt, Human
agaaaggccuuuaaaau

SEQ ID NO: 2461657 - RNA, 16 nt, Human
agaaaggccuuuaaaa

SEQ ID NO: 2461658 - RNA, 15 nt, Human
agaaaggccuuuaaa

SEQ ID NO: 2461659 - RNA, 14 nt, Human
agaaaggccuuuaa

SEQ ID NO: 2461660 - RNA, 16 nt, Human
agaaaggauaaaguug

SEQ ID NO: 2461661 - RNA, 22 nt, Human
agaaaauauuuugucuaaaaug

SEQ ID NO: 2461662 - RNA, 21 nt, Human
agaaaauauuuugucuaaaau

SEQ ID NO: 2461663 - RNA, 20 nt, Human
agaaaauauuuugucuaaaa

SEQ ID NO: 2461664 - RNA, 19 nt, Human
agaaaauauuuugucuaaa

SEQ ID NO: 2461665 - RNA, 13 nt, Human
agaaaaucacuua

SEQ ID NO: 2461666 - RNA, 19 nt, Human
agaaaaucauauugcuucu

SEQ ID NO: 2461667 - RNA, 13 nt, Human
acuuuaucacauu

SEQ ID NO: 2461668 - RNA, 14 nt, Human
acuuuaucacauua

SEQ ID NO: 2461669 - RNA, 21 nt, Human
acuuuaucacauuauuugcau

SEQ ID NO: 2461670 - RNA, 15 nt, Human
agaaaauaccaagga

SEQ ID NO: 2461671 - RNA, 19 nt, Human
agaaaauaguggugugauu

SEQ ID NO: 2461672 - RNA, 16 nt, Human
agaaaaucaggcuggc

SEQ ID NO: 2461673 - RNA, 18 nt, Human
agaaaauauuuugucuaa

SEQ ID NO: 2461674 - RNA, 16 nt, Human
agaaaauauuuugucu

SEQ ID NO: 2461675 - RNA, 10 nt, Human
agaaaauaua

SEQ ID NO: 2461676 - RNA, 14 nt, Human
acuuuucuuugugg

SEQ ID NO: 2461677 - RNA, 15 nt, Human
acuuuugcccuuuga

SEQ ID NO: 2461678 - RNA, 12 nt, Human
acuuuugacaaa

SEQ ID NO: 2461679 - RNA, 14 nt, Human
agaaaauaacaaua

SEQ ID NO: 2461680 - RNA, 17 nt, Human
agaaaauaaucauucuu

SEQ ID NO: 2461681 - RNA, 23 nt, Human
acuuuuaugauacuugaaaauua

SEQ ID NO: 2461682 - RNA, 23 nt, Human
acuuuuauuuccagugaaaucag

SEQ ID NO: 2461683 - RNA, 20 nt, Human
acuuuuaugauguauauuua

SEQ ID NO: 2461684 - RNA, 19 nt, Human
acuuuuaugauguauauuu

SEQ ID NO: 2461685 - RNA, 20 nt, Human
acuuuucauaaccuagccuu

SEQ ID NO: 2461686 - RNA, 22 nt, Human
acuuuuccauguaucuaccuca

SEQ ID NO: 2461687 - RNA, 21 nt, Human
acuuuuccauguaucuaccuc

SEQ ID NO: 2461688 - RNA, 17 nt, Human
acuuuuccauucccaau

SEQ ID NO: 2461689 - RNA, 17 nt, Human
acuuuuccccuguccug

SEQ ID NO: 2461690 - RNA, 20 nt, Human
acuuuuccguuucagcggaa

SEQ ID NO: 2461691 - RNA, 16 nt, Human
acuuuucuuucagcca

SEQ ID NO: 2461692 - RNA, 17 nt, Human
acuuuuccauguaucua

SEQ ID NO: 2461693 - RNA, 12 nt, Human
acuuuucaguga

SEQ ID NO: 2461694 - RNA, 20 nt, Human
acuuuuaaacuguguacaua

SEQ ID NO: 2461695 - RNA, 14 nt, Human
acuuuuaaggcagu

SEQ ID NO: 2461696 - RNA, 17 nt, Human
acuuuuaauaaacuuuu

SEQ ID NO: 2461697 - RNA, 24 nt, Human
acuuuauuuucugguagauagaaa

SEQ ID NO: 2461698 - RNA, 19 nt, Human
acuuuguucuggcucuucc

SEQ ID NO: 2461699 - RNA, 20 nt, Human
acuuuguucuggcucuucca

SEQ ID NO: 2461700 - RNA, 13 nt, Human
acuuuauuuucug

SEQ ID NO: 2461701 - RNA, 16 nt, Human
acuuuuaugauacuug

SEQ ID NO: 2461702 - RNA, 12 nt, Human
acuuuuaugaua

SEQ ID NO: 2461703 - RNA, 13 nt, Human
acuuuuauaaacu

SEQ ID NO: 2461704 - RNA, 17 nt, Human
acuuuguucuggcucuu

SEQ ID NO: 2461705 - RNA, 16 nt, Human
acuuuguucuggcucu

SEQ ID NO: 2461706 - RNA, 22 nt, Human
acuuuauuuucuauaauuuaaa

SEQ ID NO: 2461707 - RNA, 23 nt, Human
acuuuaucuaauaccucugugug

SEQ ID NO: 2461708 - RNA, 22 nt, Human
acuuuaucuugaauaauguaag

SEQ ID NO: 2461709 - RNA, 13 nt, Human
acuuuauugcauc

SEQ ID NO: 2461710 - RNA, 20 nt, Human
acuuuauuaaauacaaaacu

SEQ ID NO: 2461711 - RNA, 20 nt, Human
acuuuaugccggaugugcuu

SEQ ID NO: 2461712 - RNA, 15 nt, Human
acuuuaugccggaug

SEQ ID NO: 2461713 - RNA, 20 nt, Human
acuuuauuuauacacugucu

SEQ ID NO: 2461714 - RNA, 17 nt, Human
acaauucuuuauacaac

SEQ ID NO: 2461715 - RNA, 16 nt, Human
acaauucuuuauacaa

SEQ ID NO: 2461716 - RNA, 15 nt, Human
acaauucuuuauaca

SEQ ID NO: 2461717 - RNA, 14 nt, Human
acaauucuuuauac

SEQ ID NO: 2461718 - RNA, 13 nt, Human
acaauucuuuaua

SEQ ID NO: 2461719 - RNA, 22 nt, Human
acaauucuguuuuagguuaaaa

SEQ ID NO: 2461720 - RNA, 14 nt, Human
acacgcuccuuccu

SEQ ID NO: 2461721 - RNA, 14 nt, Human
acacgcuccucccu

SEQ ID NO: 2461722 - RNA, 14 nt, Human
acacgagcaggcua

SEQ ID NO: 2461723 - RNA, 19 nt, Human
acacgagcaggcuacuguc

SEQ ID NO: 2461724 - RNA, 21 nt, Human
acacauuuuguauaauuguau

SEQ ID NO: 2461725 - RNA, 14 nt, Human
acaccaaauaaaua

SEQ ID NO: 2461726 - RNA, 17 nt, Human
acacgcgugcacacacc

SEQ ID NO: 2461727 - RNA, 15 nt, Human
acacgcgugcacaca

SEQ ID NO: 2461728 - RNA, 21 nt, Human
acacgagcaggcuacugucag

SEQ ID NO: 2461729 - RNA, 22 nt, Human
acacgagguaugaggucuagga

SEQ ID NO: 2461730 - RNA, 13 nt, Human
acacgcacacaca

SEQ ID NO: 2461731 - RNA, 14 nt, Human
acacgcacacacac

SEQ ID NO: 2461732 - RNA, 20 nt, Human
acacgcacacacacacacag

SEQ ID NO: 2461733 - RNA, 23 nt, Human
acacgcacacacacacacaggag

SEQ ID NO: 2461734 - RNA, 13 nt, Human
acacagcucuucu

SEQ ID NO: 2461735 - RNA, 11 nt, Human
acacagcucuu

SEQ ID NO: 2461736 - RNA, 22 nt, Human
acacauuuuauuuuauuaugca

SEQ ID NO: 2461737 - RNA, 21 nt, Human
acacauuuuauuuuauuaugc

SEQ ID NO: 2461738 - RNA, 12 nt, Human
acacauuuugua

SEQ ID NO: 2461739 - RNA, 16 nt, Human
acacagaugaaacaca

SEQ ID NO: 2461740 - RNA, 14 nt, Human
acacagcagcaguu

SEQ ID NO: 2461741 - RNA, 20 nt, Human
acacauuuuuuaaaugcacc

SEQ ID NO: 2461742 - RNA, 22 nt, Human
acacauuuuuuaaaugcaccug

SEQ ID NO: 2461743 - RNA, 12 nt, Human
acacauuuuucu

SEQ ID NO: 2461744 - RNA, 16 nt, Human
acacauuuuguauaau

SEQ ID NO: 2461745 - RNA, 15 nt, Human
acacauuuuguauaa

SEQ ID NO: 2461746 - RNA, 14 nt, Human
acacauuuuguaua

SEQ ID NO: 2461747 - RNA, 13 nt, Human
acacauuuuguau

SEQ ID NO: 2461748 - RNA, 14 nt, Human
acacauuuuucaga

SEQ ID NO: 2461749 - RNA, 19 nt, Human
acacagaggcugccucucc

SEQ ID NO: 2461750 - RNA, 21 nt, Human
acacagaugaaacacaaacaa

SEQ ID NO: 2461751 - RNA, 14 nt, Human
acacagaugaaaca

SEQ ID NO: 2461752 - RNA, 19 nt, Human
acacagaguggucuuucug

SEQ ID NO: 2461753 - RNA, 21 nt, Human
acacagaguggucuuucugga

SEQ ID NO: 2461754 - RNA, 23 nt, Human
acacagaguggucuuucuggaga

SEQ ID NO: 2461755 - RNA, 17 nt, Human
acacagauuugagcuca

SEQ ID NO: 2461756 - RNA, 14 nt, Human
acacagcucugucc

SEQ ID NO: 2461757 - RNA, 20 nt, Human
acacagcucuguccugggag

SEQ ID NO: 2461758 - RNA, 19 nt, Human
acaauugaacuuaaauaaa

SEQ ID NO: 2461759 - RNA, 21 nt, Human
acaauucuuuauacaacagug

SEQ ID NO: 2461760 - RNA, 17 nt, Human
acaauugaacuuaaaua

SEQ ID NO: 2461761 - RNA, 19 nt, Human
acaauucuuuauacaacag

SEQ ID NO: 2461762 - RNA, 18 nt, Human
acaauucuuuauacaaca

SEQ ID NO: 2461763 - RNA, 12 nt, Human
acaauugaaaug

SEQ ID NO: 2461764 - RNA, 12 nt, Human
acaauuguaaua

SEQ ID NO: 2461765 - RNA, 20 nt, Human
acaauuguaaaacugaggca

SEQ ID NO: 2461766 - RNA, 13 nt, Human
acacagaggaaga

SEQ ID NO: 2461767 - RNA, 17 nt, Human
acacagaggaagagcag

SEQ ID NO: 2461768 - RNA, 21 nt, Human
acacagaggaagagcaggcac

SEQ ID NO: 2461769 - RNA, 12 nt, Human
acacagaggaag

SEQ ID NO: 2461770 - RNA, 19 nt, Human
aauuuuccuaauaaaguuc

SEQ ID NO: 2461771 - RNA, 15 nt, Human
aauuuuccuugaagc

SEQ ID NO: 2461772 - RNA, 14 nt, Human
aauuuuccuugaag

SEQ ID NO: 2461773 - RNA, 17 nt, Human
aauuuuccuugaagccg

SEQ ID NO: 2461774 - RNA, 16 nt, Human
aauuuuccuugaagcc

SEQ ID NO: 2461775 - RNA, 20 nt, Human
aauuuucuagacuuucuguu

SEQ ID NO: 2461776 - RNA, 17 nt, Human
aauuuucuagacuuucu

SEQ ID NO: 2461777 - RNA, 15 nt, Human
aauuuucuagacuuu

SEQ ID NO: 2461778 - RNA, 12 nt, Human
aauuuucuagac

SEQ ID NO: 2461779 - RNA, 18 nt, Human
aauuuucucccaggaagc

SEQ ID NO: 2461780 - RNA, 18 nt, Human
aauuuucuagacuuucug

SEQ ID NO: 2461781 - RNA, 22 nt, Human
aauuuucuggaauacaugaaau

SEQ ID NO: 2461782 - RNA, 13 nt, Human
aauuuucuucaug

SEQ ID NO: 2461783 - RNA, 21 nt, Human
aauuuucuguguucugaaguc

SEQ ID NO: 2461784 - RNA, 14 nt, Human
aauuuucuucaugc

SEQ ID NO: 2461785 - RNA, 13 nt, Human
aauuuugugaagc

SEQ ID NO: 2461786 - RNA, 20 nt, Human
aauuuuguucuaguuuucag

SEQ ID NO: 2461787 - RNA, 19 nt, Human
aauuuuguucuaguuuuca

SEQ ID NO: 2461788 - RNA, 13 nt, Human
aauuuuguugcug

SEQ ID NO: 2461789 - RNA, 17 nt, Human
aauuuuguauuuuccaa

SEQ ID NO: 2461790 - RNA, 16 nt, Human
aauuuuguauuuucca

SEQ ID NO: 2461791 - RNA, 15 nt, Human
aauuuuguauuuucc

SEQ ID NO: 2461792 - RNA, 14 nt, Human
aauuuuguauuuuc

SEQ ID NO: 2461793 - RNA, 23 nt, Human
aauuuuguauuuuccaagugugc

SEQ ID NO: 2461794 - RNA, 21 nt, Human
aauuuuguauuuuccaagugu

SEQ ID NO: 2461795 - RNA, 13 nt, Human
aauuuuguauuuu

SEQ ID NO: 2461796 - RNA, 12 nt, Human
aauuuuguauuu

SEQ ID NO: 2461797 - RNA, 16 nt, Human
aauuuuguaugaaaaa

SEQ ID NO: 2461798 - RNA, 14 nt, Human
aauuuuguacaaau

SEQ ID NO: 2461799 - RNA, 15 nt, Human
aauuuuguaacgaag

SEQ ID NO: 2461800 - RNA, 13 nt, Human
aauuuuguacaaa

SEQ ID NO: 2461801 - RNA, 23 nt, Human
aauuuugguuguauucuuugaug

SEQ ID NO: 2461802 - RNA, 22 nt, Human
aauuuugguuguauucuuugau

SEQ ID NO: 2461803 - RNA, 20 nt, Human
aauuuugguuguauucuuug

SEQ ID NO: 2461804 - RNA, 19 nt, Human
aauuuugguuguauucuuu

SEQ ID NO: 2461805 - RNA, 19 nt, Human
aauuuucuucaugcaauga

SEQ ID NO: 2461806 - RNA, 22 nt, Human
aauuuucuucaugcaaugacau

SEQ ID NO: 2461807 - RNA, 15 nt, Human
acaaggcuguugcau

SEQ ID NO: 2461808 - RNA, 22 nt, Human
acaaggcugaccaagagagaaa

SEQ ID NO: 2461809 - RNA, 15 nt, Human
acaaggcaaggcugu

SEQ ID NO: 2461810 - RNA, 23 nt, Human
acaagaaaucccuguuuaauauu

SEQ ID NO: 2461811 - RNA, 21 nt, Human
acaagaaaucccuguuuaaua

SEQ ID NO: 2461812 - RNA, 20 nt, Human
acaaggcaaggcugucaauu

SEQ ID NO: 2461813 - RNA, 18 nt, Human
acaaggccaucugggcuc

SEQ ID NO: 2461814 - RNA, 11 nt, Human
acaaggcccca

SEQ ID NO: 2461815 - RNA, 13 nt, Human
acaaggccccaga

SEQ ID NO: 2461816 - RNA, 17 nt, Human
acaaggcauucaagugu

SEQ ID NO: 2461817 - RNA, 23 nt, Human
acaaggcauucaaguguacagug

SEQ ID NO: 2461818 - RNA, 15 nt, Human
acaaggccccagaga

SEQ ID NO: 2461819 - RNA, 16 nt, Human
acaaggccccagagac

SEQ ID NO: 2461820 - RNA, 17 nt, Human
acaaggccccagagacu

SEQ ID NO: 2461821 - RNA, 18 nt, Human
acaaggccccagagacuc

SEQ ID NO: 2461822 - RNA, 17 nt, Human
acaaggcuagaucauga

SEQ ID NO: 2461823 - RNA, 13 nt, Human
acaaggcugacca

SEQ ID NO: 2461824 - RNA, 18 nt, Human
acaaggcugaccaagaga

SEQ ID NO: 2461825 - RNA, 20 nt, Human
acaaggcugaccaagagaga

SEQ ID NO: 2461826 - RNA, 20 nt, Human
acaaaauucgaccugauuua

SEQ ID NO: 2461827 - RNA, 14 nt, Human
acaaaauuucuauu

SEQ ID NO: 2461828 - RNA, 15 nt, Human
acaaaauuuaguuuu

SEQ ID NO: 2461829 - RNA, 20 nt, Human
acaaaauuuaguuuuuguuc

SEQ ID NO: 2461830 - RNA, 22 nt, Human
acaaaauguaggguuauaauaa

SEQ ID NO: 2461831 - RNA, 14 nt, Human
acaacgugcauugu

SEQ ID NO: 2461832 - RNA, 13 nt, Human
acaacgugcauug

SEQ ID NO: 2461833 - RNA, 18 nt, Human
acaacgugcauugugcuu

SEQ ID NO: 2461834 - RNA, 17 nt, Human
acaacgugcauugugcu

SEQ ID NO: 2461835 - RNA, 16 nt, Human
acaacgugcauugugc

SEQ ID NO: 2461836 - RNA, 15 nt, Human
acaacgugcauugug

SEQ ID NO: 2461837 - RNA, 19 nt, Human
acaaacaaaauuucuauua

SEQ ID NO: 2461838 - RNA, 18 nt, Human
acaaacaaaauuucuauu

SEQ ID NO: 2461839 - RNA, 16 nt, Human
acaaacaaaauuucua

SEQ ID NO: 2461840 - RNA, 18 nt, Human
acaaccuucuguggcuca

SEQ ID NO: 2461841 - RNA, 15 nt, Human
acaacgaggaagccc

SEQ ID NO: 2461842 - RNA, 14 nt, Human
acaaggcaaggcug

SEQ ID NO: 2461843 - RNA, 12 nt, Human
acaaggcaaggc

SEQ ID NO: 2461844 - RNA, 16 nt, Human
acaagaaaucccuguu

SEQ ID NO: 2461845 - RNA, 15 nt, Human
acaagaaaucccugu

SEQ ID NO: 2461846 - RNA, 17 nt, Human
acaaggauugcuacugu

SEQ ID NO: 2461847 - RNA, 14 nt, Human
acaacgaggaagcc

SEQ ID NO: 2461848 - RNA, 16 nt, Human
acaagaaaaaaugaau

SEQ ID NO: 2461849 - RNA, 16 nt, Human
acaacuaggcuucagc

SEQ ID NO: 2461850 - RNA, 13 nt, Human
acaacuuugccag

SEQ ID NO: 2461851 - RNA, 17 nt, Human
acagccacggccaggcc

SEQ ID NO: 2461852 - RNA, 16 nt, Human
acagccacggccaggc

SEQ ID NO: 2461853 - RNA, 20 nt, Human
acagccacacacacagaaaa

SEQ ID NO: 2461854 - RNA, 21 nt, Human
acagccacacacacagaaaau

SEQ ID NO: 2461855 - RNA, 22 nt, Human
acagccacacacacagaaaaua

SEQ ID NO: 2461856 - RNA, 23 nt, Human
acagccacacacacagaaaauau

SEQ ID NO: 2461857 - RNA, 15 nt, Human
acagccacggccagg

SEQ ID NO: 2461858 - RNA, 18 nt, Human
acagccacggccaggcca

SEQ ID NO: 2461859 - RNA, 18 nt, Human
acagcucuucuccaggcu

SEQ ID NO: 2461860 - RNA, 17 nt, Human
acagcucuguguugcca

SEQ ID NO: 2461861 - RNA, 19 nt, Human
acagcucuguguugccaug

SEQ ID NO: 2461862 - RNA, 15 nt, Human
acaggaucagucuga

SEQ ID NO: 2461863 - RNA, 17 nt, Human
acagcucuucuccaggc

SEQ ID NO: 2461864 - RNA, 16 nt, Human
acagcucuucuccagg

SEQ ID NO: 2461865 - RNA, 14 nt, Human
acaggcaaaugcau

SEQ ID NO: 2461866 - RNA, 16 nt, Human
acaggcaacugaggca

SEQ ID NO: 2461867 - RNA, 18 nt, Human
acaggcaacugaggcaga

SEQ ID NO: 2461868 - RNA, 19 nt, Human
acaggcaacugaggcagac

SEQ ID NO: 2461869 - RNA, 19 nt, Human
acaggcaaaauccuugcuu

SEQ ID NO: 2461870 - RNA, 20 nt, Human
acaggauuugaacucagauc

SEQ ID NO: 2461871 - RNA, 12 nt, Human
acaggcaagcac

SEQ ID NO: 2461872 - RNA, 18 nt, Human
acaggcaaugcuggcugu

SEQ ID NO: 2461873 - RNA, 21 nt, Human
acaggaugaugacuauggaaa

SEQ ID NO: 2461874 - RNA, 20 nt, Human
acagcucuguguugccaugu

SEQ ID NO: 2461875 - RNA, 14 nt, Human
acaggauuauugga

SEQ ID NO: 2461876 - RNA, 14 nt, Human
acaggaugaaggca

SEQ ID NO: 2461877 - RNA, 22 nt, Human
acaggauccuauucucaccagg

SEQ ID NO: 2461878 - RNA, 21 nt, Human
acaggauccuauucucaccag

SEQ ID NO: 2461879 - RNA, 18 nt, Human
acaggaugaccuggauaa

SEQ ID NO: 2461880 - RNA, 19 nt, Human
acaggaugggggcuggccu

SEQ ID NO: 2461881 - RNA, 22 nt, Human
acacugcacucuuaagcuuccg

SEQ ID NO: 2461882 - RNA, 18 nt, Human
acacugcaagagccuugg

SEQ ID NO: 2461883 - RNA, 21 nt, Human
acacuggaggagagaagaaug

SEQ ID NO: 2461884 - RNA, 20 nt, Human
acacuggaggagagaagaau

SEQ ID NO: 2461885 - RNA, 19 nt, Human
acacuggaggagagaagaa

SEQ ID NO: 2461886 - RNA, 18 nt, Human
acacuggaggagagaaga

SEQ ID NO: 2461887 - RNA, 22 nt, Human
acacuggaggagagaagaauga

SEQ ID NO: 2461888 - RNA, 22 nt, Human
acacuggcguagaaguuuuugu

SEQ ID NO: 2461889 - RNA, 14 nt, Human
acacuggccccuca

SEQ ID NO: 2461890 - RNA, 13 nt, Human
acacuggccccuc

SEQ ID NO: 2461891 - RNA, 12 nt, Human
acacuggccccu

SEQ ID NO: 2461892 - RNA, 13 nt, Human
acacuggccccua

SEQ ID NO: 2461893 - RNA, 19 nt, Human
acacugguauuccugccuc

SEQ ID NO: 2461894 - RNA, 18 nt, Human
acacugguauuccugccu

SEQ ID NO: 2461895 - RNA, 17 nt, Human
acacugggugcccaagc

SEQ ID NO: 2461896 - RNA, 21 nt, Human
acacuggcugccagcuauuuu

SEQ ID NO: 2461897 - RNA, 16 nt, Human
acacuggcugccagcu

SEQ ID NO: 2461898 - RNA, 22 nt, Human
acacuggcugccagcuauuuuu

SEQ ID NO: 2461899 - RNA, 21 nt, Human
acacuggggugccgccugccc

SEQ ID NO: 2461900 - RNA, 16 nt, Human
acacuggccccuagaa

SEQ ID NO: 2461901 - RNA, 14 nt, Human
acacuggcugccag

SEQ ID NO: 2461902 - RNA, 21 nt, Human
acacuggcucauauuccugca

SEQ ID NO: 2461903 - RNA, 14 nt, Human
acacugcauguuug

SEQ ID NO: 2461904 - RNA, 15 nt, Human
acacugcauguuugu

SEQ ID NO: 2461905 - RNA, 20 nt, Human
acacugcaggcaucacagcu

SEQ ID NO: 2461906 - RNA, 16 nt, Human
acacugcaggcaucac

SEQ ID NO: 2461907 - RNA, 23 nt, Human
acacugcuuguguuuuuaacuca

SEQ ID NO: 2461908 - RNA, 16 nt, Human
acacuggacuccggcc

SEQ ID NO: 2461909 - RNA, 21 nt, Human
acacugcaggcaucacagcua

SEQ ID NO: 2461910 - RNA, 19 nt, Human
acacugcuuguguuuuuaa

SEQ ID NO: 2461911 - RNA, 15 nt, Human
acagaggcagcccca

SEQ ID NO: 2461912 - RNA, 14 nt, Human
acagaggcagcccc

SEQ ID NO: 2461913 - RNA, 14 nt, Human
acagacacaggccc

SEQ ID NO: 2461914 - RNA, 13 nt, Human
acagacacaggcc

SEQ ID NO: 2461915 - RNA, 23 nt, Human
acagaggcagccccauucugccu

SEQ ID NO: 2461916 - RNA, 19 nt, Human
acagaggcagccccauucu

SEQ ID NO: 2461917 - RNA, 17 nt, Human
acagaggccccagccuc

SEQ ID NO: 2461918 - RNA, 18 nt, Human
acagaggccccagccucc

SEQ ID NO: 2461919 - RNA, 12 nt, Human
acagaggccugc

SEQ ID NO: 2461920 - RNA, 22 nt, Human
acagaggccccagccucccuga

SEQ ID NO: 2461921 - RNA, 15 nt, Human
acagaggccccagcc

SEQ ID NO: 2461922 - RNA, 16 nt, Human
acagaggccccagccu

SEQ ID NO: 2461923 - RNA, 11 nt, Human
acagacacagg

SEQ ID NO: 2461924 - RNA, 13 nt, Human
acagacaaagcgu

SEQ ID NO: 2461925 - RNA, 21 nt, Human
acagaauguuuuacugugaaa

SEQ ID NO: 2461926 - RNA, 18 nt, Human
acagacaaaaacagccuc

SEQ ID NO: 2461927 - RNA, 19 nt, Human
acagacaaaaacagccuca

SEQ ID NO: 2461928 - RNA, 20 nt, Human
acagacaaaaacagccucac

SEQ ID NO: 2461929 - RNA, 18 nt, Human
acagaauugugucugcag

SEQ ID NO: 2461930 - RNA, 20 nt, Human
acagaauguuuuacugugaa

SEQ ID NO: 2461931 - RNA, 17 nt, Human
acagaauucugcuaccu

SEQ ID NO: 2461932 - RNA, 15 nt, Human
acagaauucugcuac

SEQ ID NO: 2461933 - RNA, 21 nt, Human
acacuggugugaccugagggc

SEQ ID NO: 2461934 - RNA, 20 nt, Human
acacuggugugaccugaggg

SEQ ID NO: 2461935 - RNA, 16 nt, Human
acacuggugugaccug

SEQ ID NO: 2461936 - RNA, 14 nt, Human
acacuggugacugc

SEQ ID NO: 2461937 - RNA, 21 nt, Human
acacugguauuccugccucca

SEQ ID NO: 2461938 - RNA, 15 nt, Human
acacuguacugcaau

SEQ ID NO: 2461939 - RNA, 23 nt, Human
acagaaucauaugauucugcuuu

SEQ ID NO: 2461940 - RNA, 22 nt, Human
acagcauaacaagguccaagau

SEQ ID NO: 2461941 - RNA, 20 nt, Human
acagccaacacgcaccugcc

SEQ ID NO: 2461942 - RNA, 21 nt, Human
acagccaacacgcaccugccu

SEQ ID NO: 2461943 - RNA, 22 nt, Human
acagccaacacgcaccugccuc

SEQ ID NO: 2461944 - RNA, 13 nt, Human
acagcaucagggu

SEQ ID NO: 2461945 - RNA, 15 nt, Human
acagcauaacaaggu

SEQ ID NO: 2461946 - RNA, 23 nt, Human
acagccaacagguggcaggacca

SEQ ID NO: 2461947 - RNA, 13 nt, Human
acagccaacaggu

SEQ ID NO: 2461948 - RNA, 24 nt, Human
acagccaacacgcaccugccucag

SEQ ID NO: 2461949 - RNA, 17 nt, Human
acagccaacuauggccu

SEQ ID NO: 2461950 - RNA, 12 nt, Human
acagccacacac

SEQ ID NO: 2461951 - RNA, 13 nt, Human
acagccacacaca

SEQ ID NO: 2461952 - RNA, 14 nt, Human
acagccacacacac

SEQ ID NO: 2461953 - RNA, 15 nt, Human
acagccacacacaca

SEQ ID NO: 2461954 - RNA, 16 nt, Human
acagccacacacacag

SEQ ID NO: 2461955 - RNA, 17 nt, Human
acagccacacacacaga

SEQ ID NO: 2461956 - RNA, 18 nt, Human
acagccacacacacagaa

SEQ ID NO: 2461957 - RNA, 19 nt, Human
acagccacacacacagaaa

SEQ ID NO: 2461958 - RNA, 10 nt, Human
acagccacac

SEQ ID NO: 2461959 - RNA, 11 nt, Human
acagccacaca

SEQ ID NO: 2461960 - RNA, 19 nt, Human
acagccaacuauggccugu

SEQ ID NO: 2461961 - RNA, 22 nt, Human
acagcaguugaaaagacuccaa

SEQ ID NO: 2461962 - RNA, 23 nt, Human
acagcaguugaaaagacuccaaa

SEQ ID NO: 2461963 - RNA, 21 nt, Human
acagcaguugaaaagacucca

SEQ ID NO: 2461964 - RNA, 19 nt, Human
acagagugagacucugucu

SEQ ID NO: 2461965 - RNA, 15 nt, Human
acagagugagacucu

SEQ ID NO: 2461966 - RNA, 14 nt, Human
acagaggggguggc

SEQ ID NO: 2461967 - RNA, 16 nt, Human
acagagggaagaaaag

SEQ ID NO: 2461968 - RNA, 13 nt, Human
acagagucugggu

SEQ ID NO: 2461969 - RNA, 23 nt, Human
acagagucucacuguugcccagg

SEQ ID NO: 2461970 - RNA, 14 nt, Human
acagaggccugccc

SEQ ID NO: 2461971 - RNA, 15 nt, Human
acagagggaagaaaa

SEQ ID NO: 2461972 - RNA, 20 nt, Human
acagagggaagaaaagagcu

SEQ ID NO: 2461973 - RNA, 13 nt, Human
acagaggccugcc

SEQ ID NO: 2461974 - RNA, 17 nt, Human
acagaggcuauuguccc

SEQ ID NO: 2461975 - RNA, 18 nt, Human
acaugugcacaugcacgu

SEQ ID NO: 2461976 - RNA, 16 nt, Human
acaugugcacaugcac

SEQ ID NO: 2461977 - RNA, 16 nt, Human
acaugugacauuuaua

SEQ ID NO: 2461978 - RNA, 15 nt, Human
acaugugacauuuau

SEQ ID NO: 2461979 - RNA, 14 nt, Human
acaugugacauuua

SEQ ID NO: 2461980 - RNA, 13 nt, Human
acaugugacauuu

SEQ ID NO: 2461981 - RNA, 21 nt, Human
acaugugacacauaugcaccu

SEQ ID NO: 2461982 - RNA, 15 nt, Human
acaugugacacauau

SEQ ID NO: 2461983 - RNA, 20 nt, Human
acaugcauuacugcaugcac

SEQ ID NO: 2461984 - RNA, 19 nt, Human
acaugcauacuucaaaagu

SEQ ID NO: 2461985 - RNA, 12 nt, Human
acaugcauuuga

SEQ ID NO: 2461986 - RNA, 12 nt, Human
acaugcauacac

SEQ ID NO: 2461987 - RNA, 13 nt, Human
acaugcauacaca

SEQ ID NO: 2461988 - RNA, 16 nt, Human
acaugauuuccuugaa

SEQ ID NO: 2461989 - RNA, 17 nt, Human
acaugauuuccuugaau

SEQ ID NO: 2461990 - RNA, 23 nt, Human
acaugcagcugcacccucccucc

SEQ ID NO: 2461991 - RNA, 20 nt, Human
acaugcagcccaugcccacc

SEQ ID NO: 2461992 - RNA, 22 nt, Human
acaugcagcccaugcccaccug

SEQ ID NO: 2461993 - RNA, 14 nt, Human
acaugcauacacac

SEQ ID NO: 2461994 - RNA, 15 nt, Human
acaugcauacacaca

SEQ ID NO: 2461995 - RNA, 16 nt, Human
acaugcauacacacac

SEQ ID NO: 2461996 - RNA, 17 nt, Human
acaugcauacacacaca

SEQ ID NO: 2461997 - RNA, 21 nt, Human
acaugcauacuucaaaaguau

SEQ ID NO: 2461998 - RNA, 16 nt, Human
acaugcauuacugcau

SEQ ID NO: 2461999 - RNA, 24 nt, Human
acaugcauacacacacacacacag

SEQ ID NO: 2462000 - RNA, 17 nt, Human
acaugcauacuucaaaa

SEQ ID NO: 2462001 - RNA, 16 nt, Human
acaugcauacuucaaa

SEQ ID NO: 2462002 - RNA, 15 nt, Human
acaucagcacgauuu

SEQ ID NO: 2462003 - RNA, 17 nt, Human
acaucagcacgauuucu

SEQ ID NO: 2462004 - RNA, 15 nt, Human
acauaauuaaagugu

SEQ ID NO: 2462005 - RNA, 13 nt, Human
acauaauuaaagu

SEQ ID NO: 2462006 - RNA, 16 nt, Human
acauaauuaaaguguc

SEQ ID NO: 2462007 - RNA, 18 nt, Human
acaucagcacgauuucug

SEQ ID NO: 2462008 - RNA, 15 nt, Human
acaugauuccuuccu

SEQ ID NO: 2462009 - RNA, 22 nt, Human
acaugauuccuuccuguucuga

SEQ ID NO: 2462010 - RNA, 14 nt, Human
acaugauuccuucc

SEQ ID NO: 2462011 - RNA, 13 nt, Human
acaugauuuccuu

SEQ ID NO: 2462012 - RNA, 13 nt, Human
acaugauucauuu

SEQ ID NO: 2462013 - RNA, 13 nt, Human
acaugauuccuuc

SEQ ID NO: 2462014 - RNA, 19 nt, Human
acaugaucuucuuuauaau

SEQ ID NO: 2462015 - RNA, 16 nt, Human
acauguuuccucuagu

SEQ ID NO: 2462016 - RNA, 23 nt, Human
acauguuucuuuguaaugaaaac

SEQ ID NO: 2462017 - RNA, 22 nt, Human
acauguuucuuuguaaugaaaa

SEQ ID NO: 2462018 - RNA, 19 nt, Human
acauguuucuuuguaauga

SEQ ID NO: 2462019 - RNA, 11 nt, Human
acauguuuccu

SEQ ID NO: 2462020 - RNA, 23 nt, Human
acauguuuauuuauucugcauuu

SEQ ID NO: 2462021 - RNA, 21 nt, Human
acauguuuauuuauucugcau

SEQ ID NO: 2462022 - RNA, 21 nt, Human
acaugugacauuuauauauug

SEQ ID NO: 2462023 - RNA, 17 nt, Human
acaugcauuugagguca

SEQ ID NO: 2462024 - RNA, 20 nt, Human
acauaauguauuguugguaa

SEQ ID NO: 2462025 - RNA, 17 nt, Human
acauaaugggguccugg

SEQ ID NO: 2462026 - RNA, 23 nt, Human
acauaaugcgugcauaccacuuu

SEQ ID NO: 2462027 - RNA, 22 nt, Human
acauaaugcgugcauaccacuu

SEQ ID NO: 2462028 - RNA, 21 nt, Human
acauaaugcgugcauaccacu

SEQ ID NO: 2462029 - RNA, 23 nt, Human
acaggguuuggcugugucuaaac

SEQ ID NO: 2462030 - RNA, 22 nt, Human
acaggguuuggcugugucuaaa

SEQ ID NO: 2462031 - RNA, 19 nt, Human
acaggguuuugccauguug

SEQ ID NO: 2462032 - RNA, 15 nt, Human
acaggguuucaccau

SEQ ID NO: 2462033 - RNA, 14 nt, Human
acaggguugggccc

SEQ ID NO: 2462034 - RNA, 24 nt, Human
acagggucugcucuuucucugcca

SEQ ID NO: 2462035 - RNA, 16 nt, Human
acaggguucaaaaugu

SEQ ID NO: 2462036 - RNA, 23 nt, Human
acaggcaaugcuggcuguuggcu

SEQ ID NO: 2462037 - RNA, 19 nt, Human
acaggcaaugcuggcuguu

SEQ ID NO: 2462038 - RNA, 23 nt, Human
acagggucugcucuuucucugcc

SEQ ID NO: 2462039 - RNA, 22 nt, Human
acagggucugcucuuucucugc

SEQ ID NO: 2462040 - RNA, 15 nt, Human
acagggucugcucuu

SEQ ID NO: 2462041 - RNA, 14 nt, Human
acagggucugcucu

SEQ ID NO: 2462042 - RNA, 23 nt, Human
acagggucucuagugcugugaaa

SEQ ID NO: 2462043 - RNA, 12 nt, Human
acaggcacaaaa

SEQ ID NO: 2462044 - RNA, 22 nt, Human
acaggcaacugaggcagacagc

SEQ ID NO: 2462045 - RNA, 14 nt, Human
acauuuauucugcu

SEQ ID NO: 2462046 - RNA, 12 nt, Human
acauuucccugu

SEQ ID NO: 2462047 - RNA, 21 nt, Human
acauuuccccagaccugagcu

SEQ ID NO: 2462048 - RNA, 13 nt, Human
acauuucccaggg

SEQ ID NO: 2462049 - RNA, 15 nt, Human
acauuuauuuuuaua

SEQ ID NO: 2462050 - RNA, 15 nt, Human
acauuuauucugcuc

SEQ ID NO: 2462051 - RNA, 19 nt, Human
acauuuguucuauagcuuu

SEQ ID NO: 2462052 - RNA, 21 nt, Human
acauuuguguaaacaguguuu

SEQ ID NO: 2462053 - RNA, 14 nt, Human
acauuuuaaauaaa

SEQ ID NO: 2462054 - RNA, 20 nt, Human
acauuuuaaauaaaagaaaa

SEQ ID NO: 2462055 - RNA, 17 nt, Human
acauuuuaaauaaaaga

SEQ ID NO: 2462056 - RNA, 15 nt, Human
acauuuuaaauaaaa

SEQ ID NO: 2462057 - RNA, 15 nt, Human
acauuuuaaauggac

SEQ ID NO: 2462058 - RNA, 15 nt, Human
accaaguauuuauua

SEQ ID NO: 2462059 - RNA, 19 nt, Human
accaaggucuucagccauc

SEQ ID NO: 2462060 - RNA, 15 nt, Human
accaaggucuucagc

SEQ ID NO: 2462061 - RNA, 16 nt, Human
accaaguggaccuuga

SEQ ID NO: 2462062 - RNA, 23 nt, Human
accaaguuauaaaucaaugucac

SEQ ID NO: 2462063 - RNA, 23 nt, Human
accaaguuucagguauuaagaaa

SEQ ID NO: 2462064 - RNA, 14 nt, Human
accaauagauuccc

SEQ ID NO: 2462065 - RNA, 13 nt, Human
accaauagauucc

SEQ ID NO: 2462066 - RNA, 13 nt, Human
accacccugaggc

SEQ ID NO: 2462067 - RNA, 23 nt, Human
accaauagggcugagcucucugu

SEQ ID NO: 2462068 - RNA, 20 nt, Human
accaauauuauacuaagaaa

SEQ ID NO: 2462069 - RNA, 23 nt, Human
accaagccaagggaaccuguguc

SEQ ID NO: 2462070 - RNA, 20 nt, Human
accaagccaagggaaccugu

SEQ ID NO: 2462071 - RNA, 17 nt, Human
accaagcaggaagcuca

SEQ ID NO: 2462072 - RNA, 12 nt, Human
accaagcccagu

SEQ ID NO: 2462073 - RNA, 13 nt, Human
accaagcaggaaa

SEQ ID NO: 2462074 - RNA, 17 nt, Human
accaagcacagcagccu

SEQ ID NO: 2462075 - RNA, 14 nt, Human
accaagcacagcag

SEQ ID NO: 2462076 - RNA, 16 nt, Human
accaagcacagcagcc

SEQ ID NO: 2462077 - RNA, 14 nt, Human
accaagcaucuugg

SEQ ID NO: 2462078 - RNA, 24 nt, Human
accaagcaggaagcucagacuggu

SEQ ID NO: 2462079 - RNA, 13 nt, Human
accaagcaggaag

SEQ ID NO: 2462080 - RNA, 14 nt, Human
accaagcaggaagc

SEQ ID NO: 2462081 - RNA, 15 nt, Human
accaagcaggaagcu

SEQ ID NO: 2462082 - RNA, 16 nt, Human
accaagcaggaagcuc

SEQ ID NO: 2462083 - RNA, 18 nt, Human
accagaugaugggggagg

SEQ ID NO: 2462084 - RNA, 17 nt, Human
accagaugaugggggag

SEQ ID NO: 2462085 - RNA, 17 nt, Human
accagcaauauguaaau

SEQ ID NO: 2462086 - RNA, 17 nt, Human
accagcaauauaucuga

SEQ ID NO: 2462087 - RNA, 23 nt, Human
accagcaacuugucuuuuucugg

SEQ ID NO: 2462088 - RNA, 13 nt, Human
accagcagaaaug

SEQ ID NO: 2462089 - RNA, 15 nt, Human
accagcauuccuuuu

SEQ ID NO: 2462090 - RNA, 15 nt, Human
accagcacugucuca

SEQ ID NO: 2462091 - RNA, 17 nt, Human
accagccaguaaauggg

SEQ ID NO: 2462092 - RNA, 20 nt, Human
accagccaggcucugugcug

SEQ ID NO: 2462093 - RNA, 19 nt, Human
accagccaggcucugugcu

SEQ ID NO: 2462094 - RNA, 17 nt, Human
accagccaggcucugug

SEQ ID NO: 2462095 - RNA, 14 nt, Human
accagccagauccu

SEQ ID NO: 2462096 - RNA, 15 nt, Human
accagccagauccuc

SEQ ID NO: 2462097 - RNA, 17 nt, Human
accagcauuccuuuuga

SEQ ID NO: 2462098 - RNA, 16 nt, Human
accagcacugucucag

SEQ ID NO: 2462099 - RNA, 21 nt, Human
accagccauuggcuauuuaaa

SEQ ID NO: 2462100 - RNA, 23 nt, Human
accagccaggcucugugcugacc

SEQ ID NO: 2462101 - RNA, 22 nt, Human
accagccauacuuaucucucug

SEQ ID NO: 2462102 - RNA, 15 nt, Human
accagcccagauguu

SEQ ID NO: 2462103 - RNA, 14 nt, Human
accagcccagaugu

SEQ ID NO: 2462104 - RNA, 19 nt, Human
accagagcugccaccugcc

SEQ ID NO: 2462105 - RNA, 20 nt, Human
accaccuaggccacuccucc

SEQ ID NO: 2462106 - RNA, 21 nt, Human
accaccuaggccacuccucca

SEQ ID NO: 2462107 - RNA, 16 nt, Human
accaccucacuccugu

SEQ ID NO: 2462108 - RNA, 15 nt, Human
accaccucacuccug

SEQ ID NO: 2462109 - RNA, 13 nt, Human
accaccgcucccc

SEQ ID NO: 2462110 - RNA, 14 nt, Human
accaccgcucccca

SEQ ID NO: 2462111 - RNA, 15 nt, Human
accaccgcuccccag

SEQ ID NO: 2462112 - RNA, 17 nt, Human
accaccgcuccccagcc

SEQ ID NO: 2462113 - RNA, 18 nt, Human
accaccgcuccccagccc

SEQ ID NO: 2462114 - RNA, 19 nt, Human
accaccgcuccccagccca

SEQ ID NO: 2462115 - RNA, 21 nt, Human
accaccgcuccccagcccagg

SEQ ID NO: 2462116 - RNA, 18 nt, Human
accaccuaaucaggcuga

SEQ ID NO: 2462117 - RNA, 23 nt, Human
accaccgcuccccagcccagggu

SEQ ID NO: 2462118 - RNA, 19 nt, Human
accaccuaccuuacaguga

SEQ ID NO: 2462119 - RNA, 16 nt, Human
accaccuaggccacuc

SEQ ID NO: 2462120 - RNA, 17 nt, Human
accaccuaggccacucc

SEQ ID NO: 2462121 - RNA, 18 nt, Human
accaccuaggccacuccu

SEQ ID NO: 2462122 - RNA, 13 nt, Human
accagaucauugu

SEQ ID NO: 2462123 - RNA, 20 nt, Human
accagauaaaauuauagaug

SEQ ID NO: 2462124 - RNA, 20 nt, Human
accagauaagaaugcugguu

SEQ ID NO: 2462125 - RNA, 21 nt, Human
accagauaagaaugcugguuu

SEQ ID NO: 2462126 - RNA, 15 nt, Human
accagaggaaucacu

SEQ ID NO: 2462127 - RNA, 18 nt, Human
accagaggaaucacucuu

SEQ ID NO: 2462128 - RNA, 17 nt, Human
accagagcuguggagag

SEQ ID NO: 2462129 - RNA, 14 nt, Human
accaccucccucac

SEQ ID NO: 2462130 - RNA, 22 nt, Human
accagaggcugcagaaggccaa

SEQ ID NO: 2462131 - RNA, 21 nt, Human
accagaggcugcagaaggcca

SEQ ID NO: 2462132 - RNA, 19 nt, Human
accagaggcugcagaaggc

SEQ ID NO: 2462133 - RNA, 15 nt, Human
accagaggcugcaga

SEQ ID NO: 2462134 - RNA, 14 nt, Human
accagaggcugcag

SEQ ID NO: 2462135 - RNA, 14 nt, Human
accauauuaccaca

SEQ ID NO: 2462136 - RNA, 16 nt, Human
accauauuaccacaga

SEQ ID NO: 2462137 - RNA, 11 nt, Human
acccccugaau

SEQ ID NO: 2462138 - RNA, 14 nt, Human
acccccugcaaagc

SEQ ID NO: 2462139 - RNA, 17 nt, Human
acccccugcaaagccca

SEQ ID NO: 2462140 - RNA, 22 nt, Human
acccccugcaaagcccagcuug

SEQ ID NO: 2462141 - RNA, 18 nt, Human
acccccugcaaagcccag

SEQ ID NO: 2462142 - RNA, 20 nt, Human
acccccugcaaagcccagcu

SEQ ID NO: 2462143 - RNA, 16 nt, Human
acccauguuucucugg

SEQ ID NO: 2462144 - RNA, 14 nt, Human
acccaugugccaag

SEQ ID NO: 2462145 - RNA, 16 nt, Human
acccaugggcucugac

SEQ ID NO: 2462146 - RNA, 17 nt, Human
acccaugggcucugaca

SEQ ID NO: 2462147 - RNA, 14 nt, Human
acccaugggcucug

SEQ ID NO: 2462148 - RNA, 17 nt, Human
acccaugugccaaggug

SEQ ID NO: 2462149 - RNA, 19 nt, Human
acccauuccauuuaucuuu

SEQ ID NO: 2462150 - RNA, 17 nt, Human
acccauuccauuuaucu

SEQ ID NO: 2462151 - RNA, 13 nt, Human
acccauuccuauu

SEQ ID NO: 2462152 - RNA, 23 nt, Human
acccauuuaaauuuuuuuccuua

SEQ ID NO: 2462153 - RNA, 20 nt, Human
acccauuuaaauuuuuuucc

SEQ ID NO: 2462154 - RNA, 17 nt, Human
acccauuccuauuucuu

SEQ ID NO: 2462155 - RNA, 19 nt, Human
acccauucuacacagagca

SEQ ID NO: 2462156 - RNA, 22 nt, Human
acccauucguggugaucaauua

SEQ ID NO: 2462157 - RNA, 18 nt, Human
acccaguugccaucugcg

SEQ ID NO: 2462158 - RNA, 17 nt, Human
acccaguugccaucugc

SEQ ID NO: 2462159 - RNA, 22 nt, Human
acccaccguggaggaggaaggc

SEQ ID NO: 2462160 - RNA, 22 nt, Human
acccaccguccgcccugcuccu

SEQ ID NO: 2462161 - RNA, 20 nt, Human
acccaccguccgcccugcuc

SEQ ID NO: 2462162 - RNA, 15 nt, Human
acccaccguggagga

SEQ ID NO: 2462163 - RNA, 13 nt, Human
acccaccucccug

SEQ ID NO: 2462164 - RNA, 14 nt, Human
acccaccucccugc

SEQ ID NO: 2462165 - RNA, 15 nt, Human
acccaccucccugcc

SEQ ID NO: 2462166 - RNA, 16 nt, Human
acccaccucagccucc

SEQ ID NO: 2462167 - RNA, 16 nt, Human
acccaccucccugccu

SEQ ID NO: 2462168 - RNA, 18 nt, Human
acccaccucccugccucc

SEQ ID NO: 2462169 - RNA, 13 nt, Human
acccaccugcuga

SEQ ID NO: 2462170 - RNA, 11 nt, Human
acccaccugcu

SEQ ID NO: 2462171 - RNA, 21 nt, Human
acccaccuuguuggagccugc

SEQ ID NO: 2462172 - RNA, 20 nt, Human
acccaccuuguuggagccug

SEQ ID NO: 2462173 - RNA, 22 nt, Human
acccagugcccccacugaccag

SEQ ID NO: 2462174 - RNA, 17 nt, Human
acccaccugcugagaga

SEQ ID NO: 2462175 - RNA, 22 nt, Human
acccaccugcugagagacccaa

SEQ ID NO: 2462176 - RNA, 19 nt, Human
acccaccuuguuggagccu

SEQ ID NO: 2462177 - RNA, 19 nt, Human
acccaccugguggccucug

SEQ ID NO: 2462178 - RNA, 15 nt, Human
acccaccucagccuc

SEQ ID NO: 2462179 - RNA, 14 nt, Human
acccaccucagccu

SEQ ID NO: 2462180 - RNA, 13 nt, Human
acccaccucagcc

SEQ ID NO: 2462181 - RNA, 19 nt, Human
acccaccguccgcccugcu

SEQ ID NO: 2462182 - RNA, 17 nt, Human
acccacaccucugccag

SEQ ID NO: 2462183 - RNA, 17 nt, Human
acccaccguccgcccug

SEQ ID NO: 2462184 - RNA, 15 nt, Human
acccacaccucugcc

SEQ ID NO: 2462185 - RNA, 16 nt, Human
acccacaccucugcca

SEQ ID NO: 2462186 - RNA, 17 nt, Human
acccacaagugccacug

SEQ ID NO: 2462187 - RNA, 17 nt, Human
acccacaagaaaugaaa

SEQ ID NO: 2462188 - RNA, 23 nt, Human
acccaagggccuggccugagcug

SEQ ID NO: 2462189 - RNA, 21 nt, Human
acccacaagaaaugaaagcag

SEQ ID NO: 2462190 - RNA, 13 nt, Human
acccacaagugcc

SEQ ID NO: 2462191 - RNA, 20 nt, Human
accauauuaccacagacaua

SEQ ID NO: 2462192 - RNA, 19 nt, Human
accauauucagugcugugg

SEQ ID NO: 2462193 - RNA, 19 nt, Human
accaucccuuuuugaagug

SEQ ID NO: 2462194 - RNA, 15 nt, Human
accaucgcuuuauug

SEQ ID NO: 2462195 - RNA, 17 nt, Human
accauccugcagccucc

SEQ ID NO: 2462196 - RNA, 21 nt, Human
accaucccuuuuugaagugua

SEQ ID NO: 2462197 - RNA, 20 nt, Human
accaucccuuuuugaagugu

SEQ ID NO: 2462198 - RNA, 13 nt, Human
accauccuauuua

SEQ ID NO: 2462199 - RNA, 16 nt, Human
accauccugcagccuc

SEQ ID NO: 2462200 - RNA, 17 nt, Human
accauccgccagggccc

SEQ ID NO: 2462201 - RNA, 16 nt, Human
accauccuauuuaacu

SEQ ID NO: 2462202 - RNA, 22 nt, Human
acccaagggccuggccugagcu

SEQ ID NO: 2462203 - RNA, 19 nt, Human
acccaagggccuggccuga

SEQ ID NO: 2462204 - RNA, 18 nt, Human
acccaagggccuggccug

SEQ ID NO: 2462205 - RNA, 13 nt, Human
accaucuaauagc

SEQ ID NO: 2462206 - RNA, 13 nt, Human
accaucucaggcc

SEQ ID NO: 2462207 - RNA, 14 nt, Human
accaucucaggcca

SEQ ID NO: 2462208 - RNA, 15 nt, Human
accaucucaggccac

SEQ ID NO: 2462209 - RNA, 16 nt, Human
accaucucaggccacc

SEQ ID NO: 2462210 - RNA, 17 nt, Human
accaucucaggccaccu

SEQ ID NO: 2462211 - RNA, 21 nt, Human
accaucucaggccaccugccc

SEQ ID NO: 2462212 - RNA, 12 nt, Human
accccuccagga

SEQ ID NO: 2462213 - RNA, 17 nt, Human
accccucauagcccuca

SEQ ID NO: 2462214 - RNA, 15 nt, Human
accccucaccuugca

SEQ ID NO: 2462215 - RNA, 16 nt, Human
accccucaccuugcaa

SEQ ID NO: 2462216 - RNA, 19 nt, Human
accccucaccuugcaacac

SEQ ID NO: 2462217 - RNA, 22 nt, Human
accccucaccuugcaacacaca

SEQ ID NO: 2462218 - RNA, 18 nt, Human
accccucacucuggccuc

SEQ ID NO: 2462219 - RNA, 15 nt, Human
accccucacucuggc

SEQ ID NO: 2462220 - RNA, 23 nt, Human
accccucaccuugcaacacacag

SEQ ID NO: 2462221 - RNA, 19 nt, Human
accccuccaugugggcuag

SEQ ID NO: 2462222 - RNA, 16 nt, Human
accccuccaugugggc

SEQ ID NO: 2462223 - RNA, 18 nt, Human
acccccuucuccauccac

SEQ ID NO: 2462224 - RNA, 19 nt, Human
acccccuucuccauccaca

SEQ ID NO: 2462225 - RNA, 18 nt, Human
acccccuucuacugagcc

SEQ ID NO: 2462226 - RNA, 19 nt, Human
acccccuucuacugagccu

SEQ ID NO: 2462227 - RNA, 13 nt, Human
acccccuucucug

SEQ ID NO: 2462228 - RNA, 20 nt, Human
accccucacaggagcuuacu

SEQ ID NO: 2462229 - RNA, 14 nt, Human
acccccugcccugc

SEQ ID NO: 2462230 - RNA, 13 nt, Human
acccccugcccug

SEQ ID NO: 2462231 - RNA, 12 nt, Human
acccccuggaga

SEQ ID NO: 2462232 - RNA, 15 nt, Human
acccccugcccugca

SEQ ID NO: 2462233 - RNA, 16 nt, Human
acccccuucagugccc

SEQ ID NO: 2462234 - RNA, 19 nt, Human
acccccuuccuacucccag

SEQ ID NO: 2462235 - RNA, 11 nt, Human
acccccuuccc

SEQ ID NO: 2462236 - RNA, 18 nt, Human
acccccuucagugcccac

SEQ ID NO: 2462237 - RNA, 20 nt, Human
acccccuucagugcccacca

SEQ ID NO: 2462238 - RNA, 16 nt, Human
accccucccagcugac

SEQ ID NO: 2462239 - RNA, 15 nt, Human
accccucccagcuga

SEQ ID NO: 2462240 - RNA, 14 nt, Human
accccucccagcug

SEQ ID NO: 2462241 - RNA, 13 nt, Human
accccucccagcu

SEQ ID NO: 2462242 - RNA, 12 nt, Human
accccucccagc

SEQ ID NO: 2462243 - RNA, 17 nt, Human
accccucacucuggccu

SEQ ID NO: 2462244 - RNA, 11 nt, Human
accccucccau

SEQ ID NO: 2462245 - RNA, 22 nt, Human
accccucccagcugacaguccu

SEQ ID NO: 2462246 - RNA, 19 nt, Human
accccucccauuaggacaa

SEQ ID NO: 2462247 - RNA, 12 nt, Human
accccuccccau

SEQ ID NO: 2462248 - RNA, 18 nt, Human
accccuccccuaaugccu

SEQ ID NO: 2462249 - RNA, 13 nt, Human
aacacggccacau

SEQ ID NO: 2462250 - RNA, 21 nt, Human
aacacggccacaucaaagagg

SEQ ID NO: 2462251 - RNA, 21 nt, Human
aacacguccagaauuuuucau

SEQ ID NO: 2462252 - RNA, 21 nt, Human
aacacccaugaaucaaagaca

SEQ ID NO: 2462253 - RNA, 19 nt, Human
aacacgcaccugccucagg

SEQ ID NO: 2462254 - RNA, 14 nt, Human
aacacuaaaaauaa

SEQ ID NO: 2462255 - RNA, 15 nt, Human
aacacuaaaaauaaa

SEQ ID NO: 2462256 - RNA, 19 nt, Human
aacacuaaacagacuauuu

SEQ ID NO: 2462257 - RNA, 18 nt, Human
aacacuaacauauaaugu

SEQ ID NO: 2462258 - RNA, 17 nt, Human
aaauuuuuuuucauguu

SEQ ID NO: 2462259 - RNA, 22 nt, Human
aaauuuuuuuucauguuuuaac

SEQ ID NO: 2462260 - RNA, 17 nt, Human
aaauuuuuuuuuuaaua

SEQ ID NO: 2462261 - RNA, 23 nt, Human
aaauuuuuuuucauguuuuaaca

SEQ ID NO: 2462262 - RNA, 19 nt, Human
aacaaaaacacuaaaaaua

SEQ ID NO: 2462263 - RNA, 13 nt, Human
aacaaaaaaaucu

SEQ ID NO: 2462264 - RNA, 22 nt, Human
aacaaauucaucaaauggaaga

SEQ ID NO: 2462265 - RNA, 18 nt, Human
aacaaauucauauucugu

SEQ ID NO: 2462266 - RNA, 12 nt, Human
aacaaaaagaac

SEQ ID NO: 2462267 - RNA, 21 nt, Human
aacaaauuagguuuuguacaa

SEQ ID NO: 2462268 - RNA, 11 nt, Human
aacaaaaagaa

SEQ ID NO: 2462269 - RNA, 20 nt, Human
aacaaauuauguuacaucug

SEQ ID NO: 2462270 - RNA, 15 nt, Human
aaauuuuuuuucaug

SEQ ID NO: 2462271 - RNA, 18 nt, Human
aaauuuuuuuuguuucau

SEQ ID NO: 2462272 - RNA, 17 nt, Human
aaauuuuuuuuguuuca

SEQ ID NO: 2462273 - RNA, 16 nt, Human
aacacaucagcuugcc

SEQ ID NO: 2462274 - RNA, 14 nt, Human
aacaaccucaacug

SEQ ID NO: 2462275 - RNA, 18 nt, Human
aacaaccucaacugccua

SEQ ID NO: 2462276 - RNA, 18 nt, Human
aacaaauuuacagagaca

SEQ ID NO: 2462277 - RNA, 16 nt, Human
aacaaauugaacucuu

SEQ ID NO: 2462278 - RNA, 13 nt, Human
aacaacauguaua

SEQ ID NO: 2462279 - RNA, 18 nt, Human
aacacauuugauucugug

SEQ ID NO: 2462280 - RNA, 18 nt, Human
aacaccacagacacacac

SEQ ID NO: 2462281 - RNA, 17 nt, Human
aacaccacagacacaca

SEQ ID NO: 2462282 - RNA, 16 nt, Human
aacaccacagacacac

SEQ ID NO: 2462283 - RNA, 15 nt, Human
aacaccacagacaca

SEQ ID NO: 2462284 - RNA, 14 nt, Human
aacaccacagacac

SEQ ID NO: 2462285 - RNA, 13 nt, Human
aacaccacagaca

SEQ ID NO: 2462286 - RNA, 20 nt, Human
aacacauuugauucugugug

SEQ ID NO: 2462287 - RNA, 21 nt, Human
aacaccaagcacagcagccug

SEQ ID NO: 2462288 - RNA, 17 nt, Human
aacacaucuuuccuguc

SEQ ID NO: 2462289 - RNA, 21 nt, Human
aacacauuaucgggagcagug

SEQ ID NO: 2462290 - RNA, 21 nt, Human
aacacauuaagccuuccacac

SEQ ID NO: 2462291 - RNA, 19 nt, Human
aacaccagccccugcccca

SEQ ID NO: 2462292 - RNA, 18 nt, Human
aacaccagccccugcccc

SEQ ID NO: 2462293 - RNA, 17 nt, Human
aacaccagccccugccc

SEQ ID NO: 2462294 - RNA, 16 nt, Human
aacaccagccccugcc

SEQ ID NO: 2462295 - RNA, 15 nt, Human
aacaccagccccugc

SEQ ID NO: 2462296 - RNA, 13 nt, Human
aacaccagccccu

SEQ ID NO: 2462297 - RNA, 23 nt, Human
aacaccacagacacacacacgca

SEQ ID NO: 2462298 - RNA, 19 nt, Human
aacaccacagacacacaca

SEQ ID NO: 2462299 - RNA, 21 nt, Human
aacaccagguuuauggaaaau

SEQ ID NO: 2462300 - RNA, 23 nt, Human
aacaccagccccugccccagccc

SEQ ID NO: 2462301 - RNA, 22 nt, Human
aacaccagccccugccccagcc

SEQ ID NO: 2462302 - RNA, 20 nt, Human
aacacccagucuguucccca

SEQ ID NO: 2462303 - RNA, 15 nt, Human
aacacgccugcaaac

SEQ ID NO: 2462304 - RNA, 20 nt, Human
aacacgccugcaaacgcugc

SEQ ID NO: 2462305 - RNA, 22 nt, Human
aaauguuguucucuucuuuaaa

SEQ ID NO: 2462306 - RNA, 17 nt, Human
aaauguuggucauuuua

SEQ ID NO: 2462307 - RNA, 19 nt, Human
aaauguuggucauuuuaug

SEQ ID NO: 2462308 - RNA, 23 nt, Human
aaauguuguucauuauuggaggg

SEQ ID NO: 2462309 - RNA, 23 nt, Human
aaauguuggauuuauaaaugcua

SEQ ID NO: 2462310 - RNA, 21 nt, Human
aaauguuuacagggagccucc

SEQ ID NO: 2462311 - RNA, 20 nt, Human
aaauguuuacagggagccuc

SEQ ID NO: 2462312 - RNA, 15 nt, Human
aaauguuucugcagu

SEQ ID NO: 2462313 - RNA, 13 nt, Human
aaauguuucugca

SEQ ID NO: 2462314 - RNA, 22 nt, Human
aaauguuggauuuauaaaugcu

SEQ ID NO: 2462315 - RNA, 17 nt, Human
aaaucuuauaauuuaaa

SEQ ID NO: 2462316 - RNA, 23 nt, Human
aaaugccuuacccucauguucuu

SEQ ID NO: 2462317 - RNA, 21 nt, Human
aaaucuuauauuccauauauu

SEQ ID NO: 2462318 - RNA, 19 nt, Human
aaaucuuauauuccauaua

SEQ ID NO: 2462319 - RNA, 19 nt, Human
aaaugccuuugagacaguu

SEQ ID NO: 2462320 - RNA, 18 nt, Human
aaaugccuuugagacagu

SEQ ID NO: 2462321 - RNA, 17 nt, Human
aaaugccuuugagacag

SEQ ID NO: 2462322 - RNA, 16 nt, Human
aaaugccuuugagaca

SEQ ID NO: 2462323 - RNA, 20 nt, Human
aaaugccuuugagacaguuu

SEQ ID NO: 2462324 - RNA, 15 nt, Human
aaaugccuuuguacu

SEQ ID NO: 2462325 - RNA, 14 nt, Human
aaaugccuuugaga

SEQ ID NO: 2462326 - RNA, 13 nt, Human
aaaugccuuugag

SEQ ID NO: 2462327 - RNA, 23 nt, Human
aaauugccauauugcacaugucu

SEQ ID NO: 2462328 - RNA, 21 nt, Human
aaauugccauauugcacaugu

SEQ ID NO: 2462329 - RNA, 19 nt, Human
aaauugccauauugcacau

SEQ ID NO: 2462330 - RNA, 18 nt, Human
aaauugccauauugcaca

SEQ ID NO: 2462331 - RNA, 14 nt, Human
aaauugcuccuuga

SEQ ID NO: 2462332 - RNA, 22 nt, Human
aaauugcuccuaagcuucaaau

SEQ ID NO: 2462333 - RNA, 13 nt, Human
aaauugcuccuug

SEQ ID NO: 2462334 - RNA, 16 nt, Human
aaauugccauauugca

SEQ ID NO: 2462335 - RNA, 15 nt, Human
aaauugccauauugc

SEQ ID NO: 2462336 - RNA, 19 nt, Human
aaauugacacuuaaaaaug

SEQ ID NO: 2462337 - RNA, 23 nt, Human
aaauugaauaaugguaccagaua

SEQ ID NO: 2462338 - RNA, 13 nt, Human
aaauugaauaaug

SEQ ID NO: 2462339 - RNA, 23 nt, Human
aaauugaaucaguauaaacaaag

SEQ ID NO: 2462340 - RNA, 20 nt, Human
aaauugacacaaguggaccu

SEQ ID NO: 2462341 - RNA, 20 nt, Human
aaauugaaaggcauucucug

SEQ ID NO: 2462342 - RNA, 22 nt, Human
aaauugaaaggcauucucugaa

SEQ ID NO: 2462343 - RNA, 23 nt, Human
aaauugaaaggcauucucugaag

SEQ ID NO: 2462344 - RNA, 21 nt, Human
aaauucuugcaaaguaucccu

SEQ ID NO: 2462345 - RNA, 18 nt, Human
aaauuaacaguccuaacu

SEQ ID NO: 2462346 - RNA, 17 nt, Human
aaauuaaagcugaaaac

SEQ ID NO: 2462347 - RNA, 13 nt, Human
aaauuaaagcuga

SEQ ID NO: 2462348 - RNA, 23 nt, Human
aaauguuucugcaguagucucug

SEQ ID NO: 2462349 - RNA, 21 nt, Human
aaauuaacacugcuuguguuu

SEQ ID NO: 2462350 - RNA, 17 nt, Human
aaauuaacaguccuaac

SEQ ID NO: 2462351 - RNA, 18 nt, Human
aaauucuugcaaaguauc

SEQ ID NO: 2462352 - RNA, 13 nt, Human
aaauuaacacugc

SEQ ID NO: 2462353 - RNA, 12 nt, Human
aaauuaacacug

SEQ ID NO: 2462354 - RNA, 21 nt, Human
aacagcacuggcucucuccag

SEQ ID NO: 2462355 - RNA, 20 nt, Human
aacagcacuggcucucucca

SEQ ID NO: 2462356 - RNA, 23 nt, Human
aacagcacuggcucucuccagga

SEQ ID NO: 2462357 - RNA, 14 nt, Human
aacagcacuggcuc

SEQ ID NO: 2462358 - RNA, 18 nt, Human
aacagcacuggcucucuc

SEQ ID NO: 2462359 - RNA, 16 nt, Human
aacagcagagguucuu

SEQ ID NO: 2462360 - RNA, 17 nt, Human
aacagcagagguucuuu

SEQ ID NO: 2462361 - RNA, 21 nt, Human
aacagcagagguucuuuuaaa

SEQ ID NO: 2462362 - RNA, 13 nt, Human
aacagcaguguuc

SEQ ID NO: 2462363 - RNA, 11 nt, Human
aacagcagugu

SEQ ID NO: 2462364 - RNA, 21 nt, Human
aacagcaggguagucugguuu

SEQ ID NO: 2462365 - RNA, 15 nt, Human
aacagcaguguuccc

SEQ ID NO: 2462366 - RNA, 12 nt, Human
aacagcauugcu

SEQ ID NO: 2462367 - RNA, 14 nt, Human
aacagcauugcuuu

SEQ ID NO: 2462368 - RNA, 15 nt, Human
aacagcauugcuuuc

SEQ ID NO: 2462369 - RNA, 13 nt, Human
aaccacuucccuc

SEQ ID NO: 2462370 - RNA, 12 nt, Human
aaccacuucccu

SEQ ID NO: 2462371 - RNA, 21 nt, Human
aaccacuucccucaucucucc

SEQ ID NO: 2462372 - RNA, 18 nt, Human
aaccagagccauggacuc

SEQ ID NO: 2462373 - RNA, 17 nt, Human
aaccagaagcaacagaa

SEQ ID NO: 2462374 - RNA, 21 nt, Human
aaccagaagcaacagaaaaaa

SEQ ID NO: 2462375 - RNA, 22 nt, Human
aaccagaagcaacagaaaaaau

SEQ ID NO: 2462376 - RNA, 18 nt, Human
aaccagaauaaaguucug

SEQ ID NO: 2462377 - RNA, 22 nt, Human
aaccacuggaaaguuuaugguu

SEQ ID NO: 2462378 - RNA, 14 nt, Human
aaccacggaaaaga

SEQ ID NO: 2462379 - RNA, 19 nt, Human
aaccaccuaaucaggcuga

SEQ ID NO: 2462380 - RNA, 19 nt, Human
aaccaccgcuccccagccc

SEQ ID NO: 2462381 - RNA, 20 nt, Human
aaccaccgcuccccagccca

SEQ ID NO: 2462382 - RNA, 15 nt, Human
aaccacuucagcuga

SEQ ID NO: 2462383 - RNA, 15 nt, Human
aaccacuguaaaaug

SEQ ID NO: 2462384 - RNA, 20 nt, Human
aaccacuguaaaaugaaauu

SEQ ID NO: 2462385 - RNA, 16 nt, Human
aaccacuguaaaauga

SEQ ID NO: 2462386 - RNA, 13 nt, Human
aaccacuuaaaaa

SEQ ID NO: 2462387 - RNA, 19 nt, Human
aaccacuuaaaaaaugucc

SEQ ID NO: 2462388 - RNA, 13 nt, Human
aaccacgcuggac

SEQ ID NO: 2462389 - RNA, 18 nt, Human
aacaucccauugcccugg

SEQ ID NO: 2462390 - RNA, 19 nt, Human
aacaucccauugcccuggu

SEQ ID NO: 2462391 - RNA, 15 nt, Human
aaccaccgcucccca

SEQ ID NO: 2462392 - RNA, 16 nt, Human
aaccaccgcuccccag

SEQ ID NO: 2462393 - RNA, 17 nt, Human
aaccaccgcuccccagc

SEQ ID NO: 2462394 - RNA, 18 nt, Human
aaccaccgcuccccagcc

SEQ ID NO: 2462395 - RNA, 18 nt, Human
aaccaccagaagcccaga

SEQ ID NO: 2462396 - RNA, 19 nt, Human
aaccaccagaagcccagaa

SEQ ID NO: 2462397 - RNA, 16 nt, Human
aacaucccauugcccu

SEQ ID NO: 2462398 - RNA, 16 nt, Human
aacagcuucagguuau

SEQ ID NO: 2462399 - RNA, 15 nt, Human
aacagcuucagguua

SEQ ID NO: 2462400 - RNA, 14 nt, Human
aacagcuucagguu

SEQ ID NO: 2462401 - RNA, 13 nt, Human
aacagcuguggcu

SEQ ID NO: 2462402 - RNA, 16 nt, Human
aacagcuucucaauuu

SEQ ID NO: 2462403 - RNA, 22 nt, Human
aacauccaaggagaaacagaga

SEQ ID NO: 2462404 - RNA, 15 nt, Human
aacauccaauauuuu

SEQ ID NO: 2462405 - RNA, 11 nt, Human
aacauccaaaa

SEQ ID NO: 2462406 - RNA, 16 nt, Human
aacauccaaccuuccc

SEQ ID NO: 2462407 - RNA, 17 nt, Human
aacauccaaccuuccca

SEQ ID NO: 2462408 - RNA, 19 nt, Human
aacauccaaggagaaacag

SEQ ID NO: 2462409 - RNA, 17 nt, Human
aaccuagggugauauua

SEQ ID NO: 2462410 - RNA, 14 nt, Human
aaccuagaagggcu

SEQ ID NO: 2462411 - RNA, 20 nt, Human
aaccuacuuucauacugaag

SEQ ID NO: 2462412 - RNA, 23 nt, Human
aaccuaccuucauuucaggaggg

SEQ ID NO: 2462413 - RNA, 20 nt, Human
aaccuaccaccccuuccugu

SEQ ID NO: 2462414 - RNA, 19 nt, Human
aaccuaccaccccuuccug

SEQ ID NO: 2462415 - RNA, 21 nt, Human
aaccuaccuucauuucaggag

SEQ ID NO: 2462416 - RNA, 18 nt, Human
aaccuaccaccccuuccu

SEQ ID NO: 2462417 - RNA, 22 nt, Human
aaccuaaauuugguucuaggcc

SEQ ID NO: 2462418 - RNA, 15 nt, Human
aaccgagcaaagauc

SEQ ID NO: 2462419 - RNA, 19 nt, Human
aacccuuuugucugccucu

SEQ ID NO: 2462420 - RNA, 16 nt, Human
aacccuuuuggccccc

SEQ ID NO: 2462421 - RNA, 22 nt, Human
aacccuuuuggcccccgagcug

SEQ ID NO: 2462422 - RNA, 15 nt, Human
aaccuaaccccuuuc

SEQ ID NO: 2462423 - RNA, 22 nt, Human
aaccuacuuucauacugaagau

SEQ ID NO: 2462424 - RNA, 12 nt, Human
aaccuagccccu

SEQ ID NO: 2462425 - RNA, 19 nt, Human
aaccuaggagugccccauu

SEQ ID NO: 2462426 - RNA, 21 nt, Human
aacccuaaaaagcagagcuuu

SEQ ID NO: 2462427 - RNA, 21 nt, Human
aacccuugucagugacaguau

SEQ ID NO: 2462428 - RNA, 13 nt, Human
aacccuugucagu

SEQ ID NO: 2462429 - RNA, 15 nt, Human
aacccuugaaaagac

SEQ ID NO: 2462430 - RNA, 15 nt, Human
aacccuauugguaaa

SEQ ID NO: 2462431 - RNA, 21 nt, Human
aacccuucuccucuuguaaau

SEQ ID NO: 2462432 - RNA, 21 nt, Human
aacccuuggagccaauggaga

SEQ ID NO: 2462433 - RNA, 14 nt, Human
aacccuugaaaaga

SEQ ID NO: 2462434 - RNA, 23 nt, Human
aacccuucuccucuuguaaauaa

SEQ ID NO: 2462435 - RNA, 20 nt, Human
aacuuuaugcuaagugaaau

SEQ ID NO: 2462436 - RNA, 21 nt, Human
aacuuuaugcuaagugaaaua

SEQ ID NO: 2462437 - RNA, 14 nt, Human
aacuuuauguguaa

SEQ ID NO: 2462438 - RNA, 13 nt, Human
aacuuuaugugua

SEQ ID NO: 2462439 - RNA, 17 nt, Human
aacuuuauguguaaaua

SEQ ID NO: 2462440 - RNA, 14 nt, Human
aacuuuauuaaaua

SEQ ID NO: 2462441 - RNA, 21 nt, Human
aacuuuaucacauuauuugca

SEQ ID NO: 2462442 - RNA, 15 nt, Human
aacuuaaucuaaaug

SEQ ID NO: 2462443 - RNA, 16 nt, Human
aacuuaaucuaaaugg

SEQ ID NO: 2462444 - RNA, 18 nt, Human
aacuuaaucuaaauggaa

SEQ ID NO: 2462445 - RNA, 20 nt, Human
aacuuaauguucugaauaau

SEQ ID NO: 2462446 - RNA, 18 nt, Human
aacuuaauaguauuuaug

SEQ ID NO: 2462447 - RNA, 12 nt, Human
aacuuacacaca

SEQ ID NO: 2462448 - RNA, 18 nt, Human
aacugacucuuaagaaga

SEQ ID NO: 2462449 - RNA, 15 nt, Human
aacugacucuuaaga

SEQ ID NO: 2462450 - RNA, 20 nt, Human
aacucagaucacuacugcag

SEQ ID NO: 2462451 - RNA, 19 nt, Human
aacucagaucacuacugca

SEQ ID NO: 2462452 - RNA, 18 nt, Human
aacucagaucacuacugc

SEQ ID NO: 2462453 - RNA, 15 nt, Human
aacucagaucacuac

SEQ ID NO: 2462454 - RNA, 12 nt, Human
aacucagaucca

SEQ ID NO: 2462455 - RNA, 13 nt, Human
aacucagauccag

SEQ ID NO: 2462456 - RNA, 14 nt, Human
aacucagauccagg

SEQ ID NO: 2462457 - RNA, 15 nt, Human
aacucagauccaggg

SEQ ID NO: 2462458 - RNA, 13 nt, Human
aacucagaucugu

SEQ ID NO: 2462459 - RNA, 21 nt, Human
aacucagaucacuacugcagu

SEQ ID NO: 2462460 - RNA, 22 nt, Human
aacucagauccagggacagagg

SEQ ID NO: 2462461 - RNA, 20 nt, Human
aacugacucuuaagaagacu

SEQ ID NO: 2462462 - RNA, 19 nt, Human
aacugacucuuaagaagac

SEQ ID NO: 2462463 - RNA, 20 nt, Human
aacugagaugugaacacauc

SEQ ID NO: 2462464 - RNA, 13 nt, Human
aacugacuuuauc

SEQ ID NO: 2462465 - RNA, 19 nt, Human
aacugaccagccuccaugc

SEQ ID NO: 2462466 - RNA, 22 nt, Human
aacugauaguuacuguugugac

SEQ ID NO: 2462467 - RNA, 19 nt, Human
aacuuaaauaaugugaaac

SEQ ID NO: 2462468 - RNA, 16 nt, Human
aacuuaacauauuuac

SEQ ID NO: 2462469 - RNA, 14 nt, Human
aacuuaacauauuu

SEQ ID NO: 2462470 - RNA, 16 nt, Human
aacuuaaauuuuaauu

SEQ ID NO: 2462471 - RNA, 19 nt, Human
aacuuaaauuuuaauuuau

SEQ ID NO: 2462472 - RNA, 17 nt, Human
aacuuaaguuaaacaua

SEQ ID NO: 2462473 - RNA, 21 nt, Human
aacuuaaguugguccuuuaca

SEQ ID NO: 2462474 - RNA, 21 nt, Human
aacuuaacauucuguaaaaug

SEQ ID NO: 2462475 - RNA, 16 nt, Human
aacuuaacauucugua

SEQ ID NO: 2462476 - RNA, 17 nt, Human
aacuuaacauucuguaa

SEQ ID NO: 2462477 - RNA, 23 nt, Human
aacugauaguuacuguugugacc

SEQ ID NO: 2462478 - RNA, 19 nt, Human
aacugauaguuacuguugu

SEQ ID NO: 2462479 - RNA, 17 nt, Human
aacugauaguuacuguu

SEQ ID NO: 2462480 - RNA, 16 nt, Human
aacugauaguuacugu

SEQ ID NO: 2462481 - RNA, 15 nt, Human
aacugauaguuacug

SEQ ID NO: 2462482 - RNA, 17 nt, Human
aacugaguccuuaaaca

SEQ ID NO: 2462483 - RNA, 14 nt, Human
aacugauaaagaug

SEQ ID NO: 2462484 - RNA, 16 nt, Human
aacugagugccuuuug

SEQ ID NO: 2462485 - RNA, 12 nt, Human
aacugaggcaga

SEQ ID NO: 2462486 - RNA, 20 nt, Human
aacugaggcagacagcagcu

SEQ ID NO: 2462487 - RNA, 18 nt, Human
aacugaggaauuuucuuu

SEQ ID NO: 2462488 - RNA, 20 nt, Human
aacugaggaauuuucuuugu

SEQ ID NO: 2462489 - RNA, 18 nt, Human
aacugacuuuauccucag

SEQ ID NO: 2462490 - RNA, 18 nt, Human
aacugagauccuuccuuu

SEQ ID NO: 2462491 - RNA, 20 nt, Human
aacgauuuaauucucuugaa

SEQ ID NO: 2462492 - RNA, 12 nt, Human
aacgauuuagaa

SEQ ID NO: 2462493 - RNA, 18 nt, Human
aacgauuuaauucucuug

SEQ ID NO: 2462494 - RNA, 17 nt, Human
aacgauuuaauucucuu

SEQ ID NO: 2462495 - RNA, 20 nt, Human
aacgcaaagggcugaaagcc

SEQ ID NO: 2462496 - RNA, 18 nt, Human
aacgcaaagggcugaaag

SEQ ID NO: 2462497 - RNA, 13 nt, Human
aacgauuuagaaa

SEQ ID NO: 2462498 - RNA, 20 nt, Human
aacggagccccaggccucug

SEQ ID NO: 2462499 - RNA, 17 nt, Human
aacggaucagaaauaca

SEQ ID NO: 2462500 - RNA, 13 nt, Human
aacggaucagaaa

SEQ ID NO: 2462501 - RNA, 14 nt, Human
aacggagaaaggug

SEQ ID NO: 2462502 - RNA, 19 nt, Human
aacggagagcgccugcccc

SEQ ID NO: 2462503 - RNA, 14 nt, Human
aacgcugccugccc

SEQ ID NO: 2462504 - RNA, 15 nt, Human
aacgcugccugccca

SEQ ID NO: 2462505 - RNA, 21 nt, Human
aacgcuuaaaggugucuuccu

SEQ ID NO: 2462506 - RNA, 15 nt, Human
aacgcugccugcccg

SEQ ID NO: 2462507 - RNA, 12 nt, Human
aacgcugccugc

SEQ ID NO: 2462508 - RNA, 13 nt, Human
aacgcugccugcc

SEQ ID NO: 2462509 - RNA, 11 nt, Human
aacgcugccug

SEQ ID NO: 2462510 - RNA, 11 nt, Human
aacgcagcccu

SEQ ID NO: 2462511 - RNA, 18 nt, Human
aacgcagaugauccauga

SEQ ID NO: 2462512 - RNA, 23 nt, Human
aacgcagcccuagagccugccug

SEQ ID NO: 2462513 - RNA, 22 nt, Human
aacgcagcccuagagccugccu

SEQ ID NO: 2462514 - RNA, 21 nt, Human
aacgcagcccuagagccugcc

SEQ ID NO: 2462515 - RNA, 13 nt, Human
aacgcagcccuag

SEQ ID NO: 2462516 - RNA, 21 nt, Human
aacggauuauuuuuucagacc

SEQ ID NO: 2462517 - RNA, 20 nt, Human
aacggauuauuuuuucagac

SEQ ID NO: 2462518 - RNA, 19 nt, Human
aacggauuauuuuuucaga

SEQ ID NO: 2462519 - RNA, 18 nt, Human
aacggauuauuuuuucag

SEQ ID NO: 2462520 - RNA, 17 nt, Human
aacggauuauuuuuuca

SEQ ID NO: 2462521 - RNA, 16 nt, Human
aacggauuauuuuuuc

SEQ ID NO: 2462522 - RNA, 18 nt, Human
aacggaucagaaauacag

SEQ ID NO: 2462523 - RNA, 15 nt, Human
aacggauuccaaaga

SEQ ID NO: 2462524 - RNA, 22 nt, Human
aacggauuauuuuuucagaccg

SEQ ID NO: 2462525 - RNA, 14 nt, Human
aacggcuccaggau

SEQ ID NO: 2462526 - RNA, 23 nt, Human
aacuauuuaacuugagcuuuaaa

SEQ ID NO: 2462527 - RNA, 16 nt, Human
aacuauuuaacuugag

SEQ ID NO: 2462528 - RNA, 13 nt, Human
aacuauuuaucug

SEQ ID NO: 2462529 - RNA, 20 nt, Human
aacuauuuaucuguguuuuu

SEQ ID NO: 2462530 - RNA, 14 nt, Human
aacuauugcccagg

SEQ ID NO: 2462531 - RNA, 15 nt, Human
aacgggcugcccugc

SEQ ID NO: 2462532 - RNA, 19 nt, Human
aacucaaaacuuaacauau

SEQ ID NO: 2462533 - RNA, 18 nt, Human
aacuauuugucuuucagg

SEQ ID NO: 2462534 - RNA, 20 nt, Human
aacuauuucuuauauaugug

SEQ ID NO: 2462535 - RNA, 19 nt, Human
aacuauuugucuuucagga

SEQ ID NO: 2462536 - RNA, 18 nt, Human
aacuauuucuuauauaug

SEQ ID NO: 2462537 - RNA, 17 nt, Human
aacuauuucuuauauau

SEQ ID NO: 2462538 - RNA, 23 nt, Human
aacuauuuaucuguguuuuugaa

SEQ ID NO: 2462539 - RNA, 21 nt, Human
aacucacugcucaagaagaca

SEQ ID NO: 2462540 - RNA, 14 nt, Human
aacucacugcucaa

SEQ ID NO: 2462541 - RNA, 14 nt, Human
aacucacuuuccuc

SEQ ID NO: 2462542 - RNA, 14 nt, Human
aacucagaucacua

SEQ ID NO: 2462543 - RNA, 14 nt, Human
aacucagagccucc

SEQ ID NO: 2462544 - RNA, 22 nt, Human
aacucacugcucaagaagacau

SEQ ID NO: 2462545 - RNA, 21 nt, Human
aacucagaaacaucaguuacu

SEQ ID NO: 2462546 - RNA, 23 nt, Human
aaagccaaguuuauauacaauua

SEQ ID NO: 2462547 - RNA, 16 nt, Human
aaaggcaaauguguac

SEQ ID NO: 2462548 - RNA, 14 nt, Human
aaaggcaagcacuu

SEQ ID NO: 2462549 - RNA, 13 nt, Human
aaaggcaaggucc

SEQ ID NO: 2462550 - RNA, 21 nt, Human
aaagccguuguuuacuuaaag

SEQ ID NO: 2462551 - RNA, 23 nt, Human
aaagccguuguuuacuuaaagau

SEQ ID NO: 2462552 - RNA, 23 nt, Human
aaagcccuuccaugucgccucug

SEQ ID NO: 2462553 - RNA, 22 nt, Human
aaagcccuuccaugucgccucu

SEQ ID NO: 2462554 - RNA, 16 nt, Human
aaagccuccuccagcc

SEQ ID NO: 2462555 - RNA, 21 nt, Human
aaagccagcguccuccucugu

SEQ ID NO: 2462556 - RNA, 20 nt, Human
aaagccagaaccagaugagu

SEQ ID NO: 2462557 - RNA, 14 nt, Human
aaagccagaagcug

SEQ ID NO: 2462558 - RNA, 19 nt, Human
aaagccagcugccgaccag

SEQ ID NO: 2462559 - RNA, 16 nt, Human
aaagccagugacucca

SEQ ID NO: 2462560 - RNA, 19 nt, Human
aaagcccuuaggaagaauu

SEQ ID NO: 2462561 - RNA, 15 nt, Human
aaagccaaugugaac

SEQ ID NO: 2462562 - RNA, 17 nt, Human
aaagccaaugugaacag

SEQ ID NO: 2462563 - RNA, 17 nt, Human
aaagccaccucucccuc

SEQ ID NO: 2462564 - RNA, 18 nt, Human
aaagccacguuccuuacu

SEQ ID NO: 2462565 - RNA, 12 nt, Human
aaagccaccucu

SEQ ID NO: 2462566 - RNA, 19 nt, Human
aaagccaauaacacacagc

SEQ ID NO: 2462567 - RNA, 16 nt, Human
aaaggcuccaggagca

SEQ ID NO: 2462568 - RNA, 15 nt, Human
aaaggcuccaggagc

SEQ ID NO: 2462569 - RNA, 12 nt, Human
aaaggcccccua

SEQ ID NO: 2462570 - RNA, 14 nt, Human
aaaggccucuuccu

SEQ ID NO: 2462571 - RNA, 17 nt, Human
aaaggccuuuaaaauuu

SEQ ID NO: 2462572 - RNA, 12 nt, Human
aaaggccuuuaa

SEQ ID NO: 2462573 - RNA, 11 nt, Human
aaaggccucuu

SEQ ID NO: 2462574 - RNA, 14 nt, Human
aaaggcagaagcaa

SEQ ID NO: 2462575 - RNA, 17 nt, Human
aaaggcaaauguguaca

SEQ ID NO: 2462576 - RNA, 12 nt, Human
aaaggcacagug

SEQ ID NO: 2462577 - RNA, 17 nt, Human
aaaggcaccuauaaaac

SEQ ID NO: 2462578 - RNA, 17 nt, Human
aaaggcaccaucuaaua

SEQ ID NO: 2462579 - RNA, 20 nt, Human
aaaggcaccuauaaaacagg

SEQ ID NO: 2462580 - RNA, 18 nt, Human
aaaggccaaaccucuguu

SEQ ID NO: 2462581 - RNA, 20 nt, Human
aaaggccaaaccucuguuca

SEQ ID NO: 2462582 - RNA, 21 nt, Human
aaaggcaccuauaaaacaggu

SEQ ID NO: 2462583 - RNA, 19 nt, Human
aaaggccauggagagcugg

SEQ ID NO: 2462584 - RNA, 14 nt, Human
aaaggccauggaga

SEQ ID NO: 2462585 - RNA, 20 nt, Human
aaaggccagcuggcagcaga

SEQ ID NO: 2462586 - RNA, 14 nt, Human
aaaggccagcuggc

SEQ ID NO: 2462587 - RNA, 18 nt, Human
aaaggccagcuggcagca

SEQ ID NO: 2462588 - RNA, 12 nt, Human
aaaggccagcug

SEQ ID NO: 2462589 - RNA, 15 nt, Human
aaauaaauauauaua

SEQ ID NO: 2462590 - RNA, 14 nt, Human
aaauaaauauauau

SEQ ID NO: 2462591 - RNA, 20 nt, Human
aaauaaaugagcuauguauu

SEQ ID NO: 2462592 - RNA, 13 nt, Human
aaauaaaugcaau

SEQ ID NO: 2462593 - RNA, 22 nt, Human
aaauaaaugagcuauguauuaa

SEQ ID NO: 2462594 - RNA, 20 nt, Human
aaauaaauagcuauauccau

SEQ ID NO: 2462595 - RNA, 13 nt, Human
aaauaaauauaua

SEQ ID NO: 2462596 - RNA, 12 nt, Human
aaauaaauauau

SEQ ID NO: 2462597 - RNA, 11 nt, Human
aaauaaauaua

SEQ ID NO: 2462598 - RNA, 16 nt, Human
aaauaaauagcuauau

SEQ ID NO: 2462599 - RNA, 20 nt, Human
aaaggcuccaggagcagcca

SEQ ID NO: 2462600 - RNA, 19 nt, Human
aaaggcuccaggagcagcc

SEQ ID NO: 2462601 - RNA, 21 nt, Human
aaagucauuggcuuuauccuc

SEQ ID NO: 2462602 - RNA, 17 nt, Human
aaagucauuggcuuuau

SEQ ID NO: 2462603 - RNA, 15 nt, Human
aaagucauuggcuuu

SEQ ID NO: 2462604 - RNA, 14 nt, Human
aaagucauuggcuu

SEQ ID NO: 2462605 - RNA, 21 nt, Human
aaagucaugcaaaggcuggga

SEQ ID NO: 2462606 - RNA, 13 nt, Human
aaagucauuggcu

SEQ ID NO: 2462607 - RNA, 21 nt, Human
aaaggcgcagugcuucucuac

SEQ ID NO: 2462608 - RNA, 20 nt, Human
aaagucaugcaaaggcuggg

SEQ ID NO: 2462609 - RNA, 13 nt, Human
aaaguggaaaaau

SEQ ID NO: 2462610 - RNA, 19 nt, Human
aaaguggaaaacaaggaag

SEQ ID NO: 2462611 - RNA, 20 nt, Human
aaaguggaaaacaaggaagu

SEQ ID NO: 2462612 - RNA, 22 nt, Human
aaagucuaaaguuuacaguaaa

SEQ ID NO: 2462613 - RNA, 16 nt, Human
aaagucuaaaguuuac

SEQ ID NO: 2462614 - RNA, 12 nt, Human
aaagucuaaagu

SEQ ID NO: 2462615 - RNA, 15 nt, Human
aaagucgaauuaaua

SEQ ID NO: 2462616 - RNA, 22 nt, Human
aaaguccuuuuuuuccaucuuu

SEQ ID NO: 2462617 - RNA, 16 nt, Human
aaaguccuuuuuuucc

SEQ ID NO: 2462618 - RNA, 18 nt, Human
aaaguccuuuuuuuccau

SEQ ID NO: 2462619 - RNA, 23 nt, Human
aaagucauuggcuuuauccucuu

SEQ ID NO: 2462620 - RNA, 13 nt, Human
aaauaaaacuuuu

SEQ ID NO: 2462621 - RNA, 16 nt, Human
aaauaaaacuuuuuaa

SEQ ID NO: 2462622 - RNA, 16 nt, Human
aaaguggccucuuugu

SEQ ID NO: 2462623 - RNA, 18 nt, Human
aaaguggccucuuugucu

SEQ ID NO: 2462624 - RNA, 14 nt, Human
aaaguggccucuuu

SEQ ID NO: 2462625 - RNA, 17 nt, Human
aaaguggccaugccacc

SEQ ID NO: 2462626 - RNA, 19 nt, Human
aaagucuaaaguuuacagu

SEQ ID NO: 2462627 - RNA, 19 nt, Human
aaauaaaacuuuuuaaaau

SEQ ID NO: 2462628 - RNA, 13 nt, Human
aaauaaaagcagc

SEQ ID NO: 2462629 - RNA, 19 nt, Human
aaauaaaagcagcaucugc

SEQ ID NO: 2462630 - RNA, 15 nt, Human
aaauaaaguauauau

SEQ ID NO: 2462631 - RNA, 17 nt, Human
aaauaaaaccuuucaaa

SEQ ID NO: 2462632 - RNA, 11 nt, Human
aaauaaaagca

SEQ ID NO: 2462633 - RNA, 20 nt, Human
aaauaaaguuugcuuagaaa

SEQ ID NO: 2462634 - RNA, 18 nt, Human
aaauaaaguuggugacag

SEQ ID NO: 2462635 - RNA, 16 nt, Human
aaauaaaguauauaua

SEQ ID NO: 2462636 - RNA, 20 nt, Human
aaauaaaguauauauagaau

SEQ ID NO: 2462637 - RNA, 18 nt, Human
aaauaaaguaucaugcau

SEQ ID NO: 2462638 - RNA, 15 nt, Human
aaauaaaguaucaug

SEQ ID NO: 2462639 - RNA, 19 nt, Human
aaauaaaguaucaugcauu

SEQ ID NO: 2462640 - RNA, 13 nt, Human
aaauauuuauuuu

SEQ ID NO: 2462641 - RNA, 15 nt, Human
aaauauuuauuuuaa

SEQ ID NO: 2462642 - RNA, 20 nt, Human
aaauauuuauuuuaauaaug

SEQ ID NO: 2462643 - RNA, 12 nt, Human
aaaucaaauaug

SEQ ID NO: 2462644 - RNA, 14 nt, Human
aaaucaaauaugca

SEQ ID NO: 2462645 - RNA, 15 nt, Human
aaaucaaauaugcaa

SEQ ID NO: 2462646 - RNA, 16 nt, Human
aaaucaaauaugcaaa

SEQ ID NO: 2462647 - RNA, 12 nt, Human
aaaucuggaagc

SEQ ID NO: 2462648 - RNA, 22 nt, Human
aaaucuguccaaaggaggcugg

SEQ ID NO: 2462649 - RNA, 21 nt, Human
aaaucuguccaaaggaggcug

SEQ ID NO: 2462650 - RNA, 23 nt, Human
aaaucaauuacugguccaaaaga

SEQ ID NO: 2462651 - RNA, 19 nt, Human
aaaucaauuacugguccaa

SEQ ID NO: 2462652 - RNA, 13 nt, Human
aaaucaaugucac

SEQ ID NO: 2462653 - RNA, 19 nt, Human
aaaucaaugcuauaacuau

SEQ ID NO: 2462654 - RNA, 17 nt, Human
aaaucaauacacuaguu

SEQ ID NO: 2462655 - RNA, 22 nt, Human
aaaucaauacacuaguuguuuc

SEQ ID NO: 2462656 - RNA, 15 nt, Human
aaaucaauacacuag

SEQ ID NO: 2462657 - RNA, 23 nt, Human
aaaucaaguauuugggaagugaa

SEQ ID NO: 2462658 - RNA, 18 nt, Human
aaaucaaguauuugggaa

SEQ ID NO: 2462659 - RNA, 24 nt, Human
aaauagcucaggugucccugcacu

SEQ ID NO: 2462660 - RNA, 23 nt, Human
aaauagccaacacccaucuguuu

SEQ ID NO: 2462661 - RNA, 13 nt, Human
aaauagcauuugu

SEQ ID NO: 2462662 - RNA, 22 nt, Human
aaauagcauguauugugucuuu

SEQ ID NO: 2462663 - RNA, 21 nt, Human
aaauagccacuuaccuucaau

SEQ ID NO: 2462664 - RNA, 23 nt, Human
aaauagccacuuaccuucaauaa

SEQ ID NO: 2462665 - RNA, 21 nt, Human
aaauagccgggcaugguggcg

SEQ ID NO: 2462666 - RNA, 17 nt, Human
aaauaguuaagacauga

SEQ ID NO: 2462667 - RNA, 22 nt, Human
aaauaguuaagacaugauuucc

SEQ ID NO: 2462668 - RNA, 21 nt, Human
aaauaguguggaaauuaagaa

SEQ ID NO: 2462669 - RNA, 23 nt, Human
aaauaguugagccagcagacauu

SEQ ID NO: 2462670 - RNA, 20 nt, Human
aaauaguugagccagcagac

SEQ ID NO: 2462671 - RNA, 19 nt, Human
aaauaguugagccagcaga

SEQ ID NO: 2462672 - RNA, 19 nt, Human
aaauaguggugugauuugg

SEQ ID NO: 2462673 - RNA, 20 nt, Human
aaauaguguggaaauuaaga

SEQ ID NO: 2462674 - RNA, 23 nt, Human
aaauaggagaggaugagagccca

SEQ ID NO: 2462675 - RNA, 24 nt, Human
aaauaggagaggaugagagcccag

SEQ ID NO: 2462676 - RNA, 16 nt, Human
aaauaggagaggauga

SEQ ID NO: 2462677 - RNA, 14 nt, Human
aaauaggagaggau

SEQ ID NO: 2462678 - RNA, 16 nt, Human
aaauagcuuguauagu

SEQ ID NO: 2462679 - RNA, 12 nt, Human
aaauagcuauau

SEQ ID NO: 2462680 - RNA, 13 nt, Human
aaauagcucuuuc

SEQ ID NO: 2462681 - RNA, 19 nt, Human
aaauagcuccguggagcag

SEQ ID NO: 2462682 - RNA, 16 nt, Human
aaauagcuauauccau

SEQ ID NO: 2462683 - RNA, 19 nt, Human
aaauagcuauauccaugua

SEQ ID NO: 2462684 - RNA, 15 nt, Human
aaauagcuuguauag

SEQ ID NO: 2462685 - RNA, 18 nt, Human
aaaaucauauugcuucuu

SEQ ID NO: 2462686 - RNA, 14 nt, Human
aaaaucauauugcu

SEQ ID NO: 2462687 - RNA, 13 nt, Human
aaaaucauauugc

SEQ ID NO: 2462688 - RNA, 13 nt, Human
aaaaucauaaacu

SEQ ID NO: 2462689 - RNA, 22 nt, Human
aaaaucauaaacugugugcaga

SEQ ID NO: 2462690 - RNA, 13 nt, Human
aaaaucauggaau

SEQ ID NO: 2462691 - RNA, 12 nt, Human
aaaaucaugaga

SEQ ID NO: 2462692 - RNA, 19 nt, Human
aaaaucauggaaugguuau

SEQ ID NO: 2462693 - RNA, 17 nt, Human
aaaaucauggaaugguu

SEQ ID NO: 2462694 - RNA, 22 nt, Human
aaaaucauggaaugguuauaaa

SEQ ID NO: 2462695 - RNA, 15 nt, Human
aaaaucauguacauu

SEQ ID NO: 2462696 - RNA, 21 nt, Human
aaaaucuacacuccagugaga

SEQ ID NO: 2462697 - RNA, 15 nt, Human
aaaaucuaauauuaa

SEQ ID NO: 2462698 - RNA, 20 nt, Human
aaaauccuugcuuaugacau

SEQ ID NO: 2462699 - RNA, 13 nt, Human
aaaauccuugcuu

SEQ ID NO: 2462700 - RNA, 22 nt, Human
aaaaucccuuaccucggugccu

SEQ ID NO: 2462701 - RNA, 16 nt, Human
aaaaucauguacauuu

SEQ ID NO: 2462702 - RNA, 17 nt, Human
aaaaucauguacauuuc

SEQ ID NO: 2462703 - RNA, 15 nt, Human
aaaaucauguuugcu

SEQ ID NO: 2462704 - RNA, 18 nt, Human
aaaaucauguacauuucu

SEQ ID NO: 2462705 - RNA, 12 nt, Human
aaaaucauugau

SEQ ID NO: 2462706 - RNA, 16 nt, Human
aaaauccucuuccucu

SEQ ID NO: 2462707 - RNA, 17 nt, Human
aaaauaaaacuuuuuaa

SEQ ID NO: 2462708 - RNA, 17 nt, Human
aaaaguucugacuugac

SEQ ID NO: 2462709 - RNA, 14 nt, Human
aaaaguugaaauua

SEQ ID NO: 2462710 - RNA, 12 nt, Human
aaaauaaacaaa

SEQ ID NO: 2462711 - RNA, 14 nt, Human
aaaauaaacaaaua

SEQ ID NO: 2462712 - RNA, 19 nt, Human
aaaauaaaauuaaagcuga

SEQ ID NO: 2462713 - RNA, 21 nt, Human
aaaaguguuuauuuuucauau

SEQ ID NO: 2462714 - RNA, 13 nt, Human
aaaaguguuuauu

SEQ ID NO: 2462715 - RNA, 14 nt, Human
aaaaguuaaaaagu

SEQ ID NO: 2462716 - RNA, 12 nt, Human
aaaaguuauuaa

SEQ ID NO: 2462717 - RNA, 14 nt, Human
aaaaguuagcugag

SEQ ID NO: 2462718 - RNA, 18 nt, Human
aaaaguucugcagauaaa

SEQ ID NO: 2462719 - RNA, 12 nt, Human
aaaaguugaaau

SEQ ID NO: 2462720 - RNA, 17 nt, Human
aaaaguuauuaauauuu

SEQ ID NO: 2462721 - RNA, 17 nt, Human
aaaagugggcuugauuc

SEQ ID NO: 2462722 - RNA, 18 nt, Human
aaaagugggcuugauucu

SEQ ID NO: 2462723 - RNA, 17 nt, Human
aaaagugauuguuggca

SEQ ID NO: 2462724 - RNA, 17 nt, Human
aaaaguggccucuuugu

SEQ ID NO: 2462725 - RNA, 21 nt, Human
aaaagugggccagugugggaa

SEQ ID NO: 2462726 - RNA, 16 nt, Human
aaaaguggccucuuug

SEQ ID NO: 2462727 - RNA, 23 nt, Human
aaaagugaucaauaaaaugugau

SEQ ID NO: 2462728 - RNA, 21 nt, Human
aaaagugaucaauaaaaugug

SEQ ID NO: 2462729 - RNA, 14 nt, Human
aaaaagaaacaaga

SEQ ID NO: 2462730 - RNA, 14 nt, Human
aaaaagaaaagaua

SEQ ID NO: 2462731 - RNA, 13 nt, Human
aaaaagaaaaaag

SEQ ID NO: 2462732 - RNA, 11 nt, Human
aaaaagaaaaa

SEQ ID NO: 2462733 - RNA, 17 nt, Human
aaaaacucgaggacugu

SEQ ID NO: 2462734 - RNA, 21 nt, Human
aaaaacucgaggacuguauuu

SEQ ID NO: 2462735 - RNA, 20 nt, Human
aaaaacucugggaaauaaga

SEQ ID NO: 2462736 - RNA, 16 nt, Human
aaaaagaaacauuugg

SEQ ID NO: 2462737 - RNA, 15 nt, Human
aaaaagaaaggaggg

SEQ ID NO: 2462738 - RNA, 19 nt, Human
aaacagaaacaaaaacacu

SEQ ID NO: 2462739 - RNA, 21 nt, Human
aaacagaaacaaaaacacuaa

SEQ ID NO: 2462740 - RNA, 13 nt, Human
aaacagaaacaaa

SEQ ID NO: 2462741 - RNA, 12 nt, Human
aaacagacacug

SEQ ID NO: 2462742 - RNA, 12 nt, Human
aaacagaagccu

SEQ ID NO: 2462743 - RNA, 13 nt, Human
aaacagacuauuu

SEQ ID NO: 2462744 - RNA, 21 nt, Human
aaacagaacaucauuagaaca

SEQ ID NO: 2462745 - RNA, 22 nt, Human
aaacagaccuaaugcuccuugu

SEQ ID NO: 2462746 - RNA, 13 nt, Human
aaacagaacauca

SEQ ID NO: 2462747 - RNA, 22 nt, Human
aaacagacaaaaacagccucac

SEQ ID NO: 2462748 - RNA, 14 nt, Human
aaaauugauguguu

SEQ ID NO: 2462749 - RNA, 12 nt, Human
aaaauugaugug

SEQ ID NO: 2462750 - RNA, 21 nt, Human
aaaauugaugggauuugguca

SEQ ID NO: 2462751 - RNA, 15 nt, Human
aaacaccuucucugg

SEQ ID NO: 2462752 - RNA, 22 nt, Human
aaacaccuuccagcuccuguaa

SEQ ID NO: 2462753 - RNA, 21 nt, Human
aaaauugauguguuuauuuau

SEQ ID NO: 2462754 - RNA, 15 nt, Human
aaaauugcaaaucuu

SEQ ID NO: 2462755 - RNA, 23 nt, Human
aaaaucuaauauuaaaaauaugg

SEQ ID NO: 2462756 - RNA, 23 nt, Human
aaaauugauauacuuuuuucuua

SEQ ID NO: 2462757 - RNA, 19 nt, Human
aaaaucucaaauuucuaaa

SEQ ID NO: 2462758 - RNA, 22 nt, Human
aaaaucucaaauuucuaaaucu

SEQ ID NO: 2462759 - RNA, 16 nt, Human
aaaaucucaauauuuc

SEQ ID NO: 2462760 - RNA, 16 nt, Human
aaacacuguucucugc

SEQ ID NO: 2462761 - RNA, 13 nt, Human
aaacacugugcac

SEQ ID NO: 2462762 - RNA, 15 nt, Human
aaacacuguguaagc

SEQ ID NO: 2462763 - RNA, 22 nt, Human
aaacacugggagaaaugaaaaa

SEQ ID NO: 2462764 - RNA, 19 nt, Human
aaacacuggggcuggcaca

SEQ ID NO: 2462765 - RNA, 24 nt, Human
aaacacucaguuguucaauaauaa

SEQ ID NO: 2462766 - RNA, 21 nt, Human
aaacacugggagaaaugaaaa

SEQ ID NO: 2462767 - RNA, 14 nt, Human
aaacaccuucucug

SEQ ID NO: 2462768 - RNA, 13 nt, Human
aaacaccuucucu

SEQ ID NO: 2462769 - RNA, 21 nt, Human
aaacacgcacuuagucucuaa

SEQ ID NO: 2462770 - RNA, 12 nt, Human
aaagauauuuug

SEQ ID NO: 2462771 - RNA, 16 nt, Human
aaagauauuuugcuuu

SEQ ID NO: 2462772 - RNA, 22 nt, Human
aaagagugggcugcaucuggga

SEQ ID NO: 2462773 - RNA, 16 nt, Human
aaagaguucuuaagga

SEQ ID NO: 2462774 - RNA, 15 nt, Human
aaagauaaagaugau

SEQ ID NO: 2462775 - RNA, 13 nt, Human
aaagauaaagaug

SEQ ID NO: 2462776 - RNA, 17 nt, Human
aaagauauuuugcuuug

SEQ ID NO: 2462777 - RNA, 12 nt, Human
aaagaguuagaa

SEQ ID NO: 2462778 - RNA, 22 nt, Human
aaagaagguuuguguuuuucug

SEQ ID NO: 2462779 - RNA, 18 nt, Human
aaagaaggaaaaugaucu

SEQ ID NO: 2462780 - RNA, 14 nt, Human
aaagaguaggaaga

SEQ ID NO: 2462781 - RNA, 20 nt, Human
aaagaagguuucagaaagaa

SEQ ID NO: 2462782 - RNA, 16 nt, Human
aaagaagcccccagcu

SEQ ID NO: 2462783 - RNA, 12 nt, Human
aaagaaggaagu

SEQ ID NO: 2462784 - RNA, 21 nt, Human
aaagaagagccggagccucca

SEQ ID NO: 2462785 - RNA, 12 nt, Human
aaagaagagaca

SEQ ID NO: 2462786 - RNA, 21 nt, Human
aaagaagacauguuuuagaca

SEQ ID NO: 2462787 - RNA, 15 nt, Human
aaagaagauguuuaa

SEQ ID NO: 2462788 - RNA, 13 nt, Human
aaagaagauguuu

SEQ ID NO: 2462789 - RNA, 20 nt, Human
aaagaagcccaauauuauaa

SEQ ID NO: 2462790 - RNA, 15 nt, Human
aaagaaauguaaggg

SEQ ID NO: 2462791 - RNA, 18 nt, Human
aaagaagacauguuuuag

SEQ ID NO: 2462792 - RNA, 15 nt, Human
aaagaagacauguuu

SEQ ID NO: 2462793 - RNA, 21 nt, Human
aaacugagaugugaacacauc

SEQ ID NO: 2462794 - RNA, 23 nt, Human
aaacugagaugugaacacaucag

SEQ ID NO: 2462795 - RNA, 14 nt, Human
aaacucugccagcc

SEQ ID NO: 2462796 - RNA, 11 nt, Human
aaacucugcug

SEQ ID NO: 2462797 - RNA, 12 nt, Human
aaacucugcugu

SEQ ID NO: 2462798 - RNA, 14 nt, Human
aaacucugggaaau

SEQ ID NO: 2462799 - RNA, 12 nt, Human
aaacugacuuua

SEQ ID NO: 2462800 - RNA, 21 nt, Human
aaacugagacucagacaggaa

SEQ ID NO: 2462801 - RNA, 22 nt, Human
aaacugagauccuuccuuuuga

SEQ ID NO: 2462802 - RNA, 15 nt, Human
aaagaaauauaccua

SEQ ID NO: 2462803 - RNA, 19 nt, Human
aaacugaggaauuucaccu

SEQ ID NO: 2462804 - RNA, 18 nt, Human
aaacugaggaauuuucuu

SEQ ID NO: 2462805 - RNA, 14 nt, Human
aaacugaggaauuu

SEQ ID NO: 2462806 - RNA, 23 nt, Human
aaacugagacucagacaggaaag

SEQ ID NO: 2462807 - RNA, 17 nt, Human
aaagaaauauaccuaaa

SEQ ID NO: 2462808 - RNA, 23 nt, Human
aaaccaugaagagauuuuucaug

SEQ ID NO: 2462809 - RNA, 18 nt, Human
aaaccaucauugaaaucu

SEQ ID NO: 2462810 - RNA, 13 nt, Human
aaacccucgaggc

SEQ ID NO: 2462811 - RNA, 24 nt, Human
aaacccucgaggcggaucuuugga

SEQ ID NO: 2462812 - RNA, 18 nt, Human
aaacucuccucugcugcu

SEQ ID NO: 2462813 - RNA, 23 nt, Human
aaacucucuuugggaauguuugu

SEQ ID NO: 2462814 - RNA, 22 nt, Human
aaacucucuuugggaauguuug

SEQ ID NO: 2462815 - RNA, 17 nt, Human
aaacucucuuugggaau

SEQ ID NO: 2462816 - RNA, 12 nt, Human
aaacucucugaa

SEQ ID NO: 2462817 - RNA, 13 nt, Human
aaacucucugaac

SEQ ID NO: 2462818 - RNA, 16 nt, Human
aaacccuauugguaaa

SEQ ID NO: 2462819 - RNA, 19 nt, Human
aaacccgacagagggaaga

SEQ ID NO: 2462820 - RNA, 18 nt, Human
aaacccgacagagggaag

SEQ ID NO: 2462821 - RNA, 15 nt, Human
aaaccaugcaaaugc

SEQ ID NO: 2462822 - RNA, 13 nt, Human
aaaccauguagaa

SEQ ID NO: 2462823 - RNA, 16 nt, Human
aaacccgacagaggga

SEQ ID NO: 2462824 - RNA, 20 nt, Human
aaaccauuaugaagaagaga

SEQ ID NO: 2462825 - RNA, 13 nt, Human
aagucuguuuuau

SEQ ID NO: 2462826 - RNA, 14 nt, Human
aagucuguuuuaug

SEQ ID NO: 2462827 - RNA, 12 nt, Human
aagucuguuuua

SEQ ID NO: 2462828 - RNA, 21 nt, Human
aagucugcaacuuuaagcagc

SEQ ID NO: 2462829 - RNA, 18 nt, Human
aagucuggaucugggacc

SEQ ID NO: 2462830 - RNA, 22 nt, Human
aagucugugagauucauucaug

SEQ ID NO: 2462831 - RNA, 23 nt, Human
aagucugugugaugaacuuucuc

SEQ ID NO: 2462832 - RNA, 22 nt, Human
aagucugugugaugaacuuucu

SEQ ID NO: 2462833 - RNA, 15 nt, Human
aagucuccaaagucu

SEQ ID NO: 2462834 - RNA, 18 nt, Human
aagucucuuuucuuuaga

SEQ ID NO: 2462835 - RNA, 21 nt, Human
aaguggaaaaauagccugccu

SEQ ID NO: 2462836 - RNA, 13 nt, Human
aaguggaaauguu

SEQ ID NO: 2462837 - RNA, 17 nt, Human
aagugcuuccaaggcag

SEQ ID NO: 2462838 - RNA, 16 nt, Human
aaguggaccaggacag

SEQ ID NO: 2462839 - RNA, 22 nt, Human
aaguguaaagcauuccaacaaa

SEQ ID NO: 2462840 - RNA, 21 nt, Human
aaguguaaagcauuccaacaa

SEQ ID NO: 2462841 - RNA, 19 nt, Human
aaguggaccaggacaggac

SEQ ID NO: 2462842 - RNA, 20 nt, Human
aaguguaaagcauuccaaca

SEQ ID NO: 2462843 - RNA, 14 nt, Human
aaguguaacagcug

SEQ ID NO: 2462844 - RNA, 15 nt, Human
aaguguaacagcuga

SEQ ID NO: 2462845 - RNA, 16 nt, Human
aaguguaacagcugag

SEQ ID NO: 2462846 - RNA, 17 nt, Human
aaguguaacagcugagg

SEQ ID NO: 2462847 - RNA, 19 nt, Human
aaguggaaaaauagccugc

SEQ ID NO: 2462848 - RNA, 21 nt, Human
aaguguaggcagacacaggga

SEQ ID NO: 2462849 - RNA, 19 nt, Human
aaguguaggcagacacagg

SEQ ID NO: 2462850 - RNA, 17 nt, Human
aaguguaggcagacaca

SEQ ID NO: 2462851 - RNA, 16 nt, Human
aaguguaggcagacac

SEQ ID NO: 2462852 - RNA, 15 nt, Human
aaguguaggcagaca

SEQ ID NO: 2462853 - RNA, 14 nt, Human
aaguguaggcagac

SEQ ID NO: 2462854 - RNA, 13 nt, Human
aaguguaggcaga

SEQ ID NO: 2462855 - RNA, 20 nt, Human
aaguguaggcagacacaggg

SEQ ID NO: 2462856 - RNA, 14 nt, Human
aaguguacauaugu

SEQ ID NO: 2462857 - RNA, 16 nt, Human
aaguguaauagauuau

SEQ ID NO: 2462858 - RNA, 21 nt, Human
aaguguaacagcugaggucuc

SEQ ID NO: 2462859 - RNA, 11 nt, Human
aaguguaacug

SEQ ID NO: 2462860 - RNA, 12 nt, Human
aaguguaacugg

SEQ ID NO: 2462861 - RNA, 19 nt, Human
aaguguaagaaacacacug

SEQ ID NO: 2462862 - RNA, 17 nt, Human
aaguugauauagaacag

SEQ ID NO: 2462863 - RNA, 21 nt, Human
aaguugauauagaacagugcu

SEQ ID NO: 2462864 - RNA, 16 nt, Human
aaguugcagugagcug

SEQ ID NO: 2462865 - RNA, 20 nt, Human
aaguugauauagaacagugc

SEQ ID NO: 2462866 - RNA, 22 nt, Human
aaguugcagugagcugauauca

SEQ ID NO: 2462867 - RNA, 23 nt, Human
aaggugcaguucccccaaccuca

SEQ ID NO: 2462868 - RNA, 14 nt, Human
aaggugcaguuccc

SEQ ID NO: 2462869 - RNA, 18 nt, Human
aaggugccugugaggcag

SEQ ID NO: 2462870 - RNA, 11 nt, Human
aaggugccugu

SEQ ID NO: 2462871 - RNA, 20 nt, Human
aaggugccugugaggcaggg

SEQ ID NO: 2462872 - RNA, 19 nt, Human
aaguagaagucuuagaugu

SEQ ID NO: 2462873 - RNA, 20 nt, Human
aaguagaagucuuagaugua

SEQ ID NO: 2462874 - RNA, 21 nt, Human
aaggugaguuugagcugccuu

SEQ ID NO: 2462875 - RNA, 20 nt, Human
aaggugaguuugagcugccu

SEQ ID NO: 2462876 - RNA, 17 nt, Human
aaggugauauauuuaaa

SEQ ID NO: 2462877 - RNA, 22 nt, Human
aaggugaguuugagcugccuuc

SEQ ID NO: 2462878 - RNA, 20 nt, Human
aaggugaggagcuugaaacc

SEQ ID NO: 2462879 - RNA, 18 nt, Human
aaggucggaggcuuggga

SEQ ID NO: 2462880 - RNA, 14 nt, Human
aaggucggaccagc

SEQ ID NO: 2462881 - RNA, 20 nt, Human
aagguccucugucagucaca

SEQ ID NO: 2462882 - RNA, 22 nt, Human
aaggucggaggcuugggaccgc

SEQ ID NO: 2462883 - RNA, 20 nt, Human
aaggucggaggcuugggacc

SEQ ID NO: 2462884 - RNA, 17 nt, Human
aaggugacccaaugauu

SEQ ID NO: 2462885 - RNA, 21 nt, Human
aaguagggacuucugucuuca

SEQ ID NO: 2462886 - RNA, 15 nt, Human
aaguagggggucuaa

SEQ ID NO: 2462887 - RNA, 18 nt, Human
aaguaguaaaaauuaaaa

SEQ ID NO: 2462888 - RNA, 15 nt, Human
aaguaguaaaaauua

SEQ ID NO: 2462889 - RNA, 13 nt, Human
aaguaguaaaaau

SEQ ID NO: 2462890 - RNA, 19 nt, Human
aaguagggguuguggguga

SEQ ID NO: 2462891 - RNA, 22 nt, Human
aaguaggacuuuccuaaauguu

SEQ ID NO: 2462892 - RNA, 14 nt, Human
aaguaggcaggacc

SEQ ID NO: 2462893 - RNA, 23 nt, Human
aaguaggacuuuccuaaauguuu

SEQ ID NO: 2462894 - RNA, 15 nt, Human
aaguaggcaggacca

SEQ ID NO: 2462895 - RNA, 15 nt, Human
aaguaggcaugaggg

SEQ ID NO: 2462896 - RNA, 21 nt, Human
aaguagaagucuuagauguau

SEQ ID NO: 2462897 - RNA, 18 nt, Human
aaguaucccuacuguaau

SEQ ID NO: 2462898 - RNA, 23 nt, Human
aaguaucccuacuguaauuugug

SEQ ID NO: 2462899 - RNA, 17 nt, Human
aaguaucccuacuguaa

SEQ ID NO: 2462900 - RNA, 14 nt, Human
aaguaguccuguga

SEQ ID NO: 2462901 - RNA, 22 nt, Human
aaguccucuuuucugagaggac

SEQ ID NO: 2462902 - RNA, 23 nt, Human
aaguccugaagaggcgggccagc

SEQ ID NO: 2462903 - RNA, 17 nt, Human
aaguccugaagaggcgg

SEQ ID NO: 2462904 - RNA, 13 nt, Human
aaguccugaagag

SEQ ID NO: 2462905 - RNA, 22 nt, Human
aaguccugaagaggcgggccag

SEQ ID NO: 2462906 - RNA, 18 nt, Human
aaguccuuaccucuuccg

SEQ ID NO: 2462907 - RNA, 21 nt, Human
aaguccuuuuuuuccaucuuu

SEQ ID NO: 2462908 - RNA, 13 nt, Human
aaguccuuuaugu

SEQ ID NO: 2462909 - RNA, 16 nt, Human
aaguccuuuaugugga

SEQ ID NO: 2462910 - RNA, 15 nt, Human
aagucgaauuaauag

SEQ ID NO: 2462911 - RNA, 14 nt, Human
aagucuccaaaguc

SEQ ID NO: 2462912 - RNA, 17 nt, Human
aagucuaugaugcuguu

SEQ ID NO: 2462913 - RNA, 17 nt, Human
aagucuaaauauuuccu

SEQ ID NO: 2462914 - RNA, 21 nt, Human
aagucucacuggcugucagua

SEQ ID NO: 2462915 - RNA, 17 nt, Human
aagucuaaaguuuacag

SEQ ID NO: 2462916 - RNA, 15 nt, Human
aagucuaaaguuuac

SEQ ID NO: 2462917 - RNA, 14 nt, Human
aagucuaaaguuua

SEQ ID NO: 2462918 - RNA, 13 nt, Human
aagucuaaaguuu

SEQ ID NO: 2462919 - RNA, 11 nt, Human
aagucuaaagu

SEQ ID NO: 2462920 - RNA, 15 nt, Human
aagucguugugaggg

SEQ ID NO: 2462921 - RNA, 19 nt, Human
aagucuaggagcugggagg

SEQ ID NO: 2462922 - RNA, 22 nt, Human
aagucuaggagcugggaggaaa

SEQ ID NO: 2462923 - RNA, 20 nt, Human
aagucuaaaguuuacaguaa

SEQ ID NO: 2462924 - RNA, 19 nt, Human
aagucuaaaguuuacagua

SEQ ID NO: 2462925 - RNA, 21 nt, Human
aagucuaaaguuuacaguaaa

SEQ ID NO: 2462926 - RNA, 16 nt, Human
aagucuaaauauuucc

SEQ ID NO: 2462927 - RNA, 18 nt, Human
aaguccaagcauuuagau

SEQ ID NO: 2462928 - RNA, 12 nt, Human
aaguccaaugug

SEQ ID NO: 2462929 - RNA, 17 nt, Human
aaguaucuacaugcggu

SEQ ID NO: 2462930 - RNA, 17 nt, Human
aaguccaagcauaccaa

SEQ ID NO: 2462931 - RNA, 19 nt, Human
aaguaguaaaaauuaaaaa

SEQ ID NO: 2462932 - RNA, 17 nt, Human
aaguaguguaucacagu

SEQ ID NO: 2462933 - RNA, 18 nt, Human
aaguauccugcuucugau

SEQ ID NO: 2462934 - RNA, 17 nt, Human
aaguccuacaagcuaaa

SEQ ID NO: 2462935 - RNA, 18 nt, Human
aaguccucuuuucugaga

SEQ ID NO: 2462936 - RNA, 22 nt, Human
aagucccuguuuucugagcccg

SEQ ID NO: 2462937 - RNA, 21 nt, Human
aagucccuguuuucugagccc

SEQ ID NO: 2462938 - RNA, 22 nt, Human
aagucccuguaauuguuguuug

SEQ ID NO: 2462939 - RNA, 22 nt, Human
aaguccagauuuacacugggag

SEQ ID NO: 2462940 - RNA, 19 nt, Human
aaguccagauuuacacugg

SEQ ID NO: 2462941 - RNA, 16 nt, Human
aagggaaacugccagc

SEQ ID NO: 2462942 - RNA, 17 nt, Human
aagggaaacugccagca

SEQ ID NO: 2462943 - RNA, 16 nt, Human
aagggaaaagucucuu

SEQ ID NO: 2462944 - RNA, 23 nt, Human
aagggcauuggccauucuauugu

SEQ ID NO: 2462945 - RNA, 11 nt, Human
aagggccagag

SEQ ID NO: 2462946 - RNA, 12 nt, Human
aagggccagagc

SEQ ID NO: 2462947 - RNA, 13 nt, Human
aagggccagagcc

SEQ ID NO: 2462948 - RNA, 14 nt, Human
aagggccagagcca

SEQ ID NO: 2462949 - RNA, 15 nt, Human
aagggccagagccag

SEQ ID NO: 2462950 - RNA, 16 nt, Human
aagggccagagccagg

SEQ ID NO: 2462951 - RNA, 18 nt, Human
aaggucauuuuuuuuaag

SEQ ID NO: 2462952 - RNA, 19 nt, Human
aaggucauuuuuuuuaaga

SEQ ID NO: 2462953 - RNA, 17 nt, Human
aagggccagagccaggg

SEQ ID NO: 2462954 - RNA, 14 nt, Human
aagggccaguccug

SEQ ID NO: 2462955 - RNA, 16 nt, Human
aagggccaguccugcc

SEQ ID NO: 2462956 - RNA, 19 nt, Human
aagggccaugcugaaggga

SEQ ID NO: 2462957 - RNA, 17 nt, Human
aagggccaugcugaagg

SEQ ID NO: 2462958 - RNA, 16 nt, Human
aagggccaugcugaag

SEQ ID NO: 2462959 - RNA, 18 nt, Human
aagggccagucugggcug

SEQ ID NO: 2462960 - RNA, 14 nt, Human
aagggccagucugg

SEQ ID NO: 2462961 - RNA, 9 nt, Human
aagggccag

SEQ ID NO: 2462962 - RNA, 22 nt, Human
aagggccaguccugccuggcca

SEQ ID NO: 2462963 - RNA, 16 nt, Human
aagggacauguuuuga

SEQ ID NO: 2462964 - RNA, 17 nt, Human
aagggaaguugugccuu

SEQ ID NO: 2462965 - RNA, 18 nt, Human
aagggaaggaacucuggc

SEQ ID NO: 2462966 - RNA, 23 nt, Human
aagggaaggccccacagacaagg

SEQ ID NO: 2462967 - RNA, 15 nt, Human
aagggaaccuguguc

SEQ ID NO: 2462968 - RNA, 16 nt, Human
aagggaaauaucauuu

SEQ ID NO: 2462969 - RNA, 23 nt, Human
aagggaacagugaggugcccagc

SEQ ID NO: 2462970 - RNA, 23 nt, Human
aagggaaacugccagcaacgcag

SEQ ID NO: 2462971 - RNA, 15 nt, Human
aagggaaauaucauu

SEQ ID NO: 2462972 - RNA, 14 nt, Human
aagggaaauaucau

SEQ ID NO: 2462973 - RNA, 12 nt, Human
aagggaaauaga

SEQ ID NO: 2462974 - RNA, 13 nt, Human
aagggaaauauca

SEQ ID NO: 2462975 - RNA, 13 nt, Human
aagggaccaaggc

SEQ ID NO: 2462976 - RNA, 20 nt, Human
aagggacauguuuugauaaa

SEQ ID NO: 2462977 - RNA, 19 nt, Human
aagggacauguuuugauaa

SEQ ID NO: 2462978 - RNA, 15 nt, Human
aagggagaagaaagg

SEQ ID NO: 2462979 - RNA, 16 nt, Human
aagggagaagaaaggu

SEQ ID NO: 2462980 - RNA, 17 nt, Human
aagggagagaccucauc

SEQ ID NO: 2462981 - RNA, 16 nt, Human
aagggagagagagagg

SEQ ID NO: 2462982 - RNA, 24 nt, Human
aagggagcacuggguugacuuuca

SEQ ID NO: 2462983 - RNA, 17 nt, Human
aagggagcagaacugaa

SEQ ID NO: 2462984 - RNA, 17 nt, Human
aagggagagcggggcag

SEQ ID NO: 2462985 - RNA, 18 nt, Human
aagggagcuaucaggaac

SEQ ID NO: 2462986 - RNA, 17 nt, Human
aagcgauucuucugcuu

SEQ ID NO: 2462987 - RNA, 21 nt, Human
aagcgauucuucugcuucagc

SEQ ID NO: 2462988 - RNA, 21 nt, Human
aagcggagguugcagggagcc

SEQ ID NO: 2462989 - RNA, 14 nt, Human
aagcuaauuugcau

SEQ ID NO: 2462990 - RNA, 19 nt, Human
aagcuacagguuacaacag

SEQ ID NO: 2462991 - RNA, 18 nt, Human
aagcuacagguuacaaca

SEQ ID NO: 2462992 - RNA, 15 nt, Human
aagcuacagguuaca

SEQ ID NO: 2462993 - RNA, 14 nt, Human
aagcuacagguuac

SEQ ID NO: 2462994 - RNA, 13 nt, Human
aagcuacagguua

SEQ ID NO: 2462995 - RNA, 15 nt, Human
aagcuaauuugcauu

SEQ ID NO: 2462996 - RNA, 22 nt, Human
aagcuaauuugcauuaaauuca

SEQ ID NO: 2462997 - RNA, 23 nt, Human
aagcuaauuugcauuaaauucac

SEQ ID NO: 2462998 - RNA, 23 nt, Human
aagcggaaaagguuuuauuuugu

SEQ ID NO: 2462999 - RNA, 21 nt, Human
aaggauuguaaaaaaaaaugc

SEQ ID NO: 2463000 - RNA, 14 nt, Human
aaggauuguaaaaa

SEQ ID NO: 2463001 - RNA, 13 nt, Human
aaggauuguaaaa

SEQ ID NO: 2463002 - RNA, 12 nt, Human
aaggauuguaaa

SEQ ID NO: 2463003 - RNA, 15 nt, Human
aaggauugcuacugu

SEQ ID NO: 2463004 - RNA, 15 nt, Human
aaggauguucuagca

SEQ ID NO: 2463005 - RNA, 23 nt, Human
aaggacuuccuguccagcuccaa

SEQ ID NO: 2463006 - RNA, 16 nt, Human
aaggaugugggggaag

SEQ ID NO: 2463007 - RNA, 15 nt, Human
aaggauguugguguu

SEQ ID NO: 2463008 - RNA, 16 nt, Human
aaggauucauguggaa

SEQ ID NO: 2463009 - RNA, 20 nt, Human
aaggcagcucuaaaugucaa

SEQ ID NO: 2463010 - RNA, 14 nt, Human
aaggcaggaagaga

SEQ ID NO: 2463011 - RNA, 13 nt, Human
aaggcaggaagag

SEQ ID NO: 2463012 - RNA, 12 nt, Human
aaggcaggaaga

SEQ ID NO: 2463013 - RNA, 23 nt, Human
aaggauuguaaaaaaaaaugccu

SEQ ID NO: 2463014 - RNA, 16 nt, Human
aaggcaggaaugugug

SEQ ID NO: 2463015 - RNA, 19 nt, Human
aaggcaggaauguguggca

SEQ ID NO: 2463016 - RNA, 12 nt, Human
aaggcagggagg

SEQ ID NO: 2463017 - RNA, 18 nt, Human
aaggcagggaaaggcucu

SEQ ID NO: 2463018 - RNA, 20 nt, Human
aaggcagggagcgagggaga

SEQ ID NO: 2463019 - RNA, 13 nt, Human
aaggacagccccu

SEQ ID NO: 2463020 - RNA, 19 nt, Human
aaggacagccccuccucca

SEQ ID NO: 2463021 - RNA, 17 nt, Human
aaggacagaguaugaac

SEQ ID NO: 2463022 - RNA, 18 nt, Human
aaggacacuuccugccua

SEQ ID NO: 2463023 - RNA, 13 nt, Human
aaggacacuagaa

SEQ ID NO: 2463024 - RNA, 21 nt, Human
aagcugugugcucuccaagcc

SEQ ID NO: 2463025 - RNA, 17 nt, Human
aaggacacuuccugccu

SEQ ID NO: 2463026 - RNA, 16 nt, Human
aaggacacuuccugcc

SEQ ID NO: 2463027 - RNA, 14 nt, Human
aaggacacuuccug

SEQ ID NO: 2463028 - RNA, 20 nt, Human
aagcuguguccuugcaccug

SEQ ID NO: 2463029 - RNA, 17 nt, Human
aaggacuuccuguccag

SEQ ID NO: 2463030 - RNA, 20 nt, Human
aaggacuuccuguccagcuc

SEQ ID NO: 2463031 - RNA, 21 nt, Human
aaggacuuccuguccagcucc

SEQ ID NO: 2463032 - RNA, 22 nt, Human
aaggacuuccuguccagcucca

SEQ ID NO: 2463033 - RNA, 23 nt, Human
aaggacuguuuuuuccugagcuu

SEQ ID NO: 2463034 - RNA, 21 nt, Human
aaggacugugacaggcagcag

SEQ ID NO: 2463035 - RNA, 18 nt, Human
aagcuguguggcagucug

SEQ ID NO: 2463036 - RNA, 20 nt, Human
aagcugugccacccugggcu

SEQ ID NO: 2463037 - RNA, 16 nt, Human
aagcugugccacccug

SEQ ID NO: 2463038 - RNA, 13 nt, Human
aagcuguggccag

SEQ ID NO: 2463039 - RNA, 21 nt, Human
aagcugugccacccugggcuc

SEQ ID NO: 2463040 - RNA, 12 nt, Human
aagcuguguccu

SEQ ID NO: 2463041 - RNA, 22 nt, Human
aagcuguguccuugcaccugca

SEQ ID NO: 2463042 - RNA, 14 nt, Human
aagcugugccaccc

SEQ ID NO: 2463043 - RNA, 22 nt, Human
aagcugugagacagugggaaau

SEQ ID NO: 2463044 - RNA, 13 nt, Human
aagcugugagaca

SEQ ID NO: 2463045 - RNA, 23 nt, Human
aagcuguaguagcccuuucugug

SEQ ID NO: 2463046 - RNA, 19 nt, Human
aagcugugacuucuccagg

SEQ ID NO: 2463047 - RNA, 22 nt, Human
aagcuguaguagcccuuucugu

SEQ ID NO: 2463048 - RNA, 18 nt, Human
aagcuguaaaaagagaga

SEQ ID NO: 2463049 - RNA, 17 nt, Human
aagcuguaaaaagagag

SEQ ID NO: 2463050 - RNA, 17 nt, Human
aagcugguaaacuauuu

SEQ ID NO: 2463051 - RNA, 21 nt, Human
aagcuggucccacucagucca

SEQ ID NO: 2463052 - RNA, 18 nt, Human
aagcuggucccacucagu

SEQ ID NO: 2463053 - RNA, 22 nt, Human
aagcuacagguuacaacagauu

SEQ ID NO: 2463054 - RNA, 21 nt, Human
aagcuacagguuacaacagau

SEQ ID NO: 2463055 - RNA, 20 nt, Human
aagcuacagguuacaacaga

SEQ ID NO: 2463056 - RNA, 19 nt, Human
aagcuaccucaaacuucca

SEQ ID NO: 2463057 - RNA, 15 nt, Human
aagcugggcagguug

SEQ ID NO: 2463058 - RNA, 18 nt, Human
aagcugggccccagccca

SEQ ID NO: 2463059 - RNA, 17 nt, Human
aagcugggccccagccc

SEQ ID NO: 2463060 - RNA, 19 nt, Human
aagcugggccccagcccac

SEQ ID NO: 2463061 - RNA, 16 nt, Human
aagauguuugucagau

SEQ ID NO: 2463062 - RNA, 18 nt, Human
aagauguuuaacuuaauc

SEQ ID NO: 2463063 - RNA, 14 nt, Human
aagauguuuaacuu

SEQ ID NO: 2463064 - RNA, 18 nt, Human
aagauuacuuagaggaaa

SEQ ID NO: 2463065 - RNA, 19 nt, Human
aagauucccagagacagga

SEQ ID NO: 2463066 - RNA, 20 nt, Human
aagauuacuuagaggaaaua

SEQ ID NO: 2463067 - RNA, 20 nt, Human
aagauucccagagacaggaa

SEQ ID NO: 2463068 - RNA, 12 nt, Human
aagaguguacug

SEQ ID NO: 2463069 - RNA, 12 nt, Human
aagauaaaugug

SEQ ID NO: 2463070 - RNA, 23 nt, Human
aagauacaguuacucagaauucu

SEQ ID NO: 2463071 - RNA, 13 nt, Human
aagauaaaugugc

SEQ ID NO: 2463072 - RNA, 14 nt, Human
aagauacgacuuua

SEQ ID NO: 2463073 - RNA, 15 nt, Human
aagauacgacuuuau

SEQ ID NO: 2463074 - RNA, 18 nt, Human
aagauacgacuuuauuuu

SEQ ID NO: 2463075 - RNA, 21 nt, Human
aagauacgacuuuauuuucug

SEQ ID NO: 2463076 - RNA, 14 nt, Human
aagauaaagaugau

SEQ ID NO: 2463077 - RNA, 12 nt, Human
aagauaaagaug

SEQ ID NO: 2463078 - RNA, 13 nt, Human
aagauaccuaaaa

SEQ ID NO: 2463079 - RNA, 22 nt, Human
aagauaccuaaaagagauuuca

SEQ ID NO: 2463080 - RNA, 17 nt, Human
aagauaaagaugaucua

SEQ ID NO: 2463081 - RNA, 20 nt, Human
aagagugcgccgagucuguc

SEQ ID NO: 2463082 - RNA, 20 nt, Human
aagagugggggagagcaggc

SEQ ID NO: 2463083 - RNA, 19 nt, Human
aagagugggggagagcagg

SEQ ID NO: 2463084 - RNA, 16 nt, Human
aagagugggcugcauc

SEQ ID NO: 2463085 - RNA, 23 nt, Human
aagagugauagucuuuugcuuuu

SEQ ID NO: 2463086 - RNA, 15 nt, Human
aagagugaaaaauga

SEQ ID NO: 2463087 - RNA, 14 nt, Human
aagagugcauuuuc

SEQ ID NO: 2463088 - RNA, 22 nt, Human
aagagugacaguggauugcauu

SEQ ID NO: 2463089 - RNA, 17 nt, Human
aacuuucauuuuuuucc

SEQ ID NO: 2463090 - RNA, 14 nt, Human
aacuuucauuuuuu

SEQ ID NO: 2463091 - RNA, 11 nt, Human
aacuuucauuu

SEQ ID NO: 2463092 - RNA, 17 nt, Human
aacuuuauuaaauacaa

SEQ ID NO: 2463093 - RNA, 19 nt, Human
aacuuuauuaaauacaaaa

SEQ ID NO: 2463094 - RNA, 23 nt, Human
aacuuuauuaaauacaaaacuuc

SEQ ID NO: 2463095 - RNA, 21 nt, Human
aacuuuauuaaauacaaaacu

SEQ ID NO: 2463096 - RNA, 14 nt, Human
aacuuuccucgccu

SEQ ID NO: 2463097 - RNA, 23 nt, Human
aagccagcaggcucucaggccag

SEQ ID NO: 2463098 - RNA, 20 nt, Human
aagccagcaggcucucaggc

SEQ ID NO: 2463099 - RNA, 11 nt, Human
aagccagccuu

SEQ ID NO: 2463100 - RNA, 14 nt, Human
aagccagcguccuc

SEQ ID NO: 2463101 - RNA, 17 nt, Human
aagccagcguccuccuc

SEQ ID NO: 2463102 - RNA, 19 nt, Human
aagcagauggaaugcugug

SEQ ID NO: 2463103 - RNA, 17 nt, Human
aagcagauggaaugcug

SEQ ID NO: 2463104 - RNA, 19 nt, Human
aagcagaugcaaagaggca

SEQ ID NO: 2463105 - RNA, 18 nt, Human
aagcagaugcaaagaggc

SEQ ID NO: 2463106 - RNA, 21 nt, Human
aagcagaugcaaagaggcaag

SEQ ID NO: 2463107 - RNA, 23 nt, Human
aagcagaugcaaagaggcaagag

SEQ ID NO: 2463108 - RNA, 13 nt, Human
aagcagcccuugg

SEQ ID NO: 2463109 - RNA, 14 nt, Human
aagcagccaagcuc

SEQ ID NO: 2463110 - RNA, 16 nt, Human
aagcagccaagcuccu

SEQ ID NO: 2463111 - RNA, 20 nt, Human
aagcagauggaaugcugugu

SEQ ID NO: 2463112 - RNA, 17 nt, Human
aagcagcguuucuauga

SEQ ID NO: 2463113 - RNA, 20 nt, Human
aagcagcguuucuaugacac

SEQ ID NO: 2463114 - RNA, 14 nt, Human
aagcagcguuucua

SEQ ID NO: 2463115 - RNA, 22 nt, Human
aagcagccucuccccaggucca

SEQ ID NO: 2463116 - RNA, 17 nt, Human
aagcagccucuccccag

SEQ ID NO: 2463117 - RNA, 16 nt, Human
aagcagccucucccca

SEQ ID NO: 2463118 - RNA, 16 nt, Human
aagcagcccuuggcca

SEQ ID NO: 2463119 - RNA, 21 nt, Human
aagcagccaagcuccuuggga

SEQ ID NO: 2463120 - RNA, 19 nt, Human
aagccacaggccugagauu

SEQ ID NO: 2463121 - RNA, 17 nt, Human
aagccacaggccugaga

SEQ ID NO: 2463122 - RNA, 15 nt, Human
aagccacaggccuga

SEQ ID NO: 2463123 - RNA, 14 nt, Human
aagccacaggccug

SEQ ID NO: 2463124 - RNA, 23 nt, Human
aagccacaggccugagauuucau

SEQ ID NO: 2463125 - RNA, 22 nt, Human
aagccacaggccugagauuuca

SEQ ID NO: 2463126 - RNA, 19 nt, Human
aagccagcaggcucucagg

SEQ ID NO: 2463127 - RNA, 21 nt, Human
aagccaauuuuucugcacuga

SEQ ID NO: 2463128 - RNA, 20 nt, Human
aagccaauuuuucugcacug

SEQ ID NO: 2463129 - RNA, 18 nt, Human
aagccaauuuuucugcac

SEQ ID NO: 2463130 - RNA, 17 nt, Human
aagccaauuuuucugca

SEQ ID NO: 2463131 - RNA, 16 nt, Human
aagccaauuuuucugc

SEQ ID NO: 2463132 - RNA, 14 nt, Human
aagccaauuuuucu

SEQ ID NO: 2463133 - RNA, 13 nt, Human
aagccaauuuuuc

SEQ ID NO: 2463134 - RNA, 18 nt, Human
aagccacaagaaauuuga

SEQ ID NO: 2463135 - RNA, 15 nt, Human
aagccacaagaaauu

SEQ ID NO: 2463136 - RNA, 22 nt, Human
aagccaauuuuucugcacugag

SEQ ID NO: 2463137 - RNA, 11 nt, Human
aagccacagaa

SEQ ID NO: 2463138 - RNA, 16 nt, Human
aagccacaagaaauuu

SEQ ID NO: 2463139 - RNA, 14 nt, Human
aagccacagcuggu

SEQ ID NO: 2463140 - RNA, 21 nt, Human
aagcagcguuucuaugacaca

SEQ ID NO: 2463141 - RNA, 22 nt, Human
aagcagcguuucuaugacacau

SEQ ID NO: 2463142 - RNA, 11 nt, Human
aagccaauuuu

SEQ ID NO: 2463143 - RNA, 17 nt, Human
aagccaauucagacagg

SEQ ID NO: 2463144 - RNA, 13 nt, Human
aagcagcucaaag

SEQ ID NO: 2463145 - RNA, 16 nt, Human
aagcagcucaaaggca

SEQ ID NO: 2463146 - RNA, 18 nt, Human
aagcagcucaaaggcaca

SEQ ID NO: 2463147 - RNA, 19 nt, Human
aagcagcucaaaggcacag

SEQ ID NO: 2463148 - RNA, 20 nt, Human
aagcagcgaccgcccccucc

SEQ ID NO: 2463149 - RNA, 19 nt, Human
aagcagcgaccgcccccuc

SEQ ID NO: 2463150 - RNA, 17 nt, Human
aagcagcccuuggccag

SEQ ID NO: 2463151 - RNA, 22 nt, Human
aagcagcggucagcagacaagg

SEQ ID NO: 2463152 - RNA, 20 nt, Human
aauuaaaaaaaaaaaacuuu

SEQ ID NO: 2463153 - RNA, 21 nt, Human
aauuaaaaaaaaagaucuguu

SEQ ID NO: 2463154 - RNA, 22 nt, Human
aauguuuuuuuuuaaagacuuu

SEQ ID NO: 2463155 - RNA, 20 nt, Human
aauguuuuuuuuuaaagacu

SEQ ID NO: 2463156 - RNA, 15 nt, Human
aauguuuuuuuuuaa

SEQ ID NO: 2463157 - RNA, 23 nt, Human
aaugccuuacccucauguucuua

SEQ ID NO: 2463158 - RNA, 22 nt, Human
aaugcgcaggcuggcccugccc

SEQ ID NO: 2463159 - RNA, 21 nt, Human
aaugcgcaggcuggcccugcc

SEQ ID NO: 2463160 - RNA, 23 nt, Human
aaugccuuugagacaguuucuua

SEQ ID NO: 2463161 - RNA, 22 nt, Human
aaugccuuugagacaguuucuu

SEQ ID NO: 2463162 - RNA, 20 nt, Human
aaugccuuugagacaguuuc

SEQ ID NO: 2463163 - RNA, 19 nt, Human
aaugccuuugagacaguuu

SEQ ID NO: 2463164 - RNA, 18 nt, Human
aaugccuuugagacaguu

SEQ ID NO: 2463165 - RNA, 17 nt, Human
aaugccuuugagacagu

SEQ ID NO: 2463166 - RNA, 16 nt, Human
aaugccuuugagacag

SEQ ID NO: 2463167 - RNA, 14 nt, Human
aaugccuuugagac

SEQ ID NO: 2463168 - RNA, 13 nt, Human
aaugccuuugaga

SEQ ID NO: 2463169 - RNA, 12 nt, Human
aaugccuuugag

SEQ ID NO: 2463170 - RNA, 12 nt, Human
aaugccuuuaaa

SEQ ID NO: 2463171 - RNA, 19 nt, Human
aaugcuagguuaauuccaa

SEQ ID NO: 2463172 - RNA, 18 nt, Human
aaugcuagguuaauucca

SEQ ID NO: 2463173 - RNA, 19 nt, Human
aaugcgugcauaccacuuu

SEQ ID NO: 2463174 - RNA, 18 nt, Human
aaugcgugcauaccacuu

SEQ ID NO: 2463175 - RNA, 14 nt, Human
aaugcguaauuaaa

SEQ ID NO: 2463176 - RNA, 20 nt, Human
aaugcggccgcauucccuga

SEQ ID NO: 2463177 - RNA, 18 nt, Human
aauguccaugauggaaua

SEQ ID NO: 2463178 - RNA, 17 nt, Human
aauguccuccagaagcc

SEQ ID NO: 2463179 - RNA, 18 nt, Human
aauguccuccagaagccu

SEQ ID NO: 2463180 - RNA, 17 nt, Human
aaugucuaaaugcugaa

SEQ ID NO: 2463181 - RNA, 15 nt, Human
aaugucuaaaugcug

SEQ ID NO: 2463182 - RNA, 12 nt, Human
aaugucuaaaug

SEQ ID NO: 2463183 - RNA, 21 nt, Human
aauguccuccagaagccucug

SEQ ID NO: 2463184 - RNA, 23 nt, Human
aauguccuccagaagccucuggc

SEQ ID NO: 2463185 - RNA, 22 nt, Human
aaugucuuuuuuuuaaugugcu

SEQ ID NO: 2463186 - RNA, 21 nt, Human
aaugucuuuuuuuuaaugugc

SEQ ID NO: 2463187 - RNA, 15 nt, Human
aaugucuuuugaaua

SEQ ID NO: 2463188 - RNA, 13 nt, Human
aaugucuuuugaa

SEQ ID NO: 2463189 - RNA, 18 nt, Human
aaugucuuuguuggaaaa

SEQ ID NO: 2463190 - RNA, 22 nt, Human
aaugucuuuguuggaaaagaau

SEQ ID NO: 2463191 - RNA, 23 nt, Human
aauguuuacacucuuuguaagag

SEQ ID NO: 2463192 - RNA, 20 nt, Human
aauguuuacacucuuuguaa

SEQ ID NO: 2463193 - RNA, 14 nt, Human
aauguuuaaugcug

SEQ ID NO: 2463194 - RNA, 17 nt, Human
aaugucuuuugaauauu

SEQ ID NO: 2463195 - RNA, 17 nt, Human
aaugugaaaagaaaaau

SEQ ID NO: 2463196 - RNA, 15 nt, Human
aaugugaaaagaaaa

SEQ ID NO: 2463197 - RNA, 22 nt, Human
aauguuuacagauccccaagcc

SEQ ID NO: 2463198 - RNA, 20 nt, Human
aauguuuagcaaauacauau

SEQ ID NO: 2463199 - RNA, 22 nt, Human
aauguuuacagggagccuccug

SEQ ID NO: 2463200 - RNA, 21 nt, Human
aauguuuacagggagccuccu

SEQ ID NO: 2463201 - RNA, 15 nt, Human
aauguuuaugagcca

SEQ ID NO: 2463202 - RNA, 16 nt, Human
aauguuuaugagccag

SEQ ID NO: 2463203 - RNA, 17 nt, Human
aauguuuaugagccaga

SEQ ID NO: 2463204 - RNA, 18 nt, Human
aauguuuaugagccagac

SEQ ID NO: 2463205 - RNA, 21 nt, Human
aauguuuaugcaaggaaggaa

SEQ ID NO: 2463206 - RNA, 22 nt, Human
aauguuuaugcaaggaaggaaa

SEQ ID NO: 2463207 - RNA, 23 nt, Human
aauguuucaaacauauauaacaa

SEQ ID NO: 2463208 - RNA, 23 nt, Human
aauguuuaugcaaggaaggaaag

SEQ ID NO: 2463209 - RNA, 20 nt, Human
aauguuuauuccugauaaua

SEQ ID NO: 2463210 - RNA, 22 nt, Human
aauguuuaugagccagacaaau

SEQ ID NO: 2463211 - RNA, 12 nt, Human
aauguuuccuuu

SEQ ID NO: 2463212 - RNA, 16 nt, Human
aauguuugccucugcc

SEQ ID NO: 2463213 - RNA, 15 nt, Human
aauguuugccucugc

SEQ ID NO: 2463214 - RNA, 23 nt, Human
aauguuucuucuagguucuaaaa

SEQ ID NO: 2463215 - RNA, 15 nt, Human
aauguuucugcagua

SEQ ID NO: 2463216 - RNA, 22 nt, Human
aauguuucuucuagguucuaaa

SEQ ID NO: 2463217 - RNA, 16 nt, Human
aauguuuauuccuuga

SEQ ID NO: 2463218 - RNA, 15 nt, Human
aauguuuauuccuug

SEQ ID NO: 2463219 - RNA, 20 nt, Human
aauguuuccaaccuggagua

SEQ ID NO: 2463220 - RNA, 13 nt, Human
aauguuuccuuua

SEQ ID NO: 2463221 - RNA, 19 nt, Human
aaugguguuguaugccuuu

SEQ ID NO: 2463222 - RNA, 13 nt, Human
aaugguuaaaaga

SEQ ID NO: 2463223 - RNA, 14 nt, Human
aaugguuauaaaag

SEQ ID NO: 2463224 - RNA, 17 nt, Human
aaugguguuuuuuuaau

SEQ ID NO: 2463225 - RNA, 23 nt, Human
aaugcugcccaugccaccgcuuc

SEQ ID NO: 2463226 - RNA, 22 nt, Human
aaugcugcccaugccaccgcuu

SEQ ID NO: 2463227 - RNA, 21 nt, Human
aaugcugcauuuuaauuuuaa

SEQ ID NO: 2463228 - RNA, 16 nt, Human
aaugcugcauuuuaau

SEQ ID NO: 2463229 - RNA, 14 nt, Human
aaugcugcauuuua

SEQ ID NO: 2463230 - RNA, 20 nt, Human
aaugcugcagauuugggcug

SEQ ID NO: 2463231 - RNA, 12 nt, Human
aaugcugcagau

SEQ ID NO: 2463232 - RNA, 18 nt, Human
aaugcugccugccugucu

SEQ ID NO: 2463233 - RNA, 14 nt, Human
aaugcugccugccu

SEQ ID NO: 2463234 - RNA, 12 nt, Human
aaugcugccugc

SEQ ID NO: 2463235 - RNA, 15 nt, Human
aaugcugccugccug

SEQ ID NO: 2463236 - RNA, 19 nt, Human
aaugcugcgcccuucccca

SEQ ID NO: 2463237 - RNA, 18 nt, Human
aaugcugaaaaaacaccu

SEQ ID NO: 2463238 - RNA, 18 nt, Human
aaugcugaacauugcaua

SEQ ID NO: 2463239 - RNA, 21 nt, Human
aaugcuagguuaauuccaauu

SEQ ID NO: 2463240 - RNA, 23 nt, Human
aaugcuauaacuauguugauaaa

SEQ ID NO: 2463241 - RNA, 17 nt, Human
aaugucaucagaacuuu

SEQ ID NO: 2463242 - RNA, 19 nt, Human
aaugucauuaaaauaaaua

SEQ ID NO: 2463243 - RNA, 13 nt, Human
aaugucaguaugu

SEQ ID NO: 2463244 - RNA, 15 nt, Human
aaugucaguaugugg

SEQ ID NO: 2463245 - RNA, 21 nt, Human
aaugucagauacaauguauuu

SEQ ID NO: 2463246 - RNA, 18 nt, Human
aaugucagauacaaugua

SEQ ID NO: 2463247 - RNA, 17 nt, Human
aaugucagauacaaugu

SEQ ID NO: 2463248 - RNA, 16 nt, Human
aaugucagauacaaug

SEQ ID NO: 2463249 - RNA, 18 nt, Human
aaugucaggaacagaagg

SEQ ID NO: 2463250 - RNA, 20 nt, Human
aaugucaggaacagaaggau

SEQ ID NO: 2463251 - RNA, 19 nt, Human
aaugguuauaaaagugauu

SEQ ID NO: 2463252 - RNA, 17 nt, Human
aaugguuauaaaaguga

SEQ ID NO: 2463253 - RNA, 16 nt, Human
aaugguuauaaaagug

SEQ ID NO: 2463254 - RNA, 15 nt, Human
aaugguuauaaaagu

SEQ ID NO: 2463255 - RNA, 19 nt, Human
aaugguuccaugccugagg

SEQ ID NO: 2463256 - RNA, 14 nt, Human
aaugguuccaugcc

SEQ ID NO: 2463257 - RNA, 13 nt, Human
aaugguuguauua

SEQ ID NO: 2463258 - RNA, 12 nt, Human
aaugguuguauu

SEQ ID NO: 2463259 - RNA, 15 nt, Human
aaugguugccuuaaa

SEQ ID NO: 2463260 - RNA, 21 nt, Human
aaugguuccaugccugagggu

SEQ ID NO: 2463261 - RNA, 17 nt, Human
aaugguugacuggguuu

SEQ ID NO: 2463262 - RNA, 19 nt, Human
aaugucagaaaccaguuau

SEQ ID NO: 2463263 - RNA, 15 nt, Human
aaugucagauacaau

SEQ ID NO: 2463264 - RNA, 17 nt, Human
aaugucacuuaaaggcu

SEQ ID NO: 2463265 - RNA, 16 nt, Human
aaugguuguauuagau

SEQ ID NO: 2463266 - RNA, 15 nt, Human
aaugguuguauuaga

SEQ ID NO: 2463267 - RNA, 18 nt, Human
aaugguugccuuaaagaa

SEQ ID NO: 2463268 - RNA, 23 nt, Human
aaugucaccaccuucccagcucu

SEQ ID NO: 2463269 - RNA, 18 nt, Human
aauccaagcaaaugugaa

SEQ ID NO: 2463270 - RNA, 17 nt, Human
aauccaagcaaauguga

SEQ ID NO: 2463271 - RNA, 15 nt, Human
aauccaaugaaauga

SEQ ID NO: 2463272 - RNA, 17 nt, Human
aauccagacccggcugc

SEQ ID NO: 2463273 - RNA, 19 nt, Human
aauccagacccggcugcgu

SEQ ID NO: 2463274 - RNA, 16 nt, Human
aaucucaaauuucuaa

SEQ ID NO: 2463275 - RNA, 15 nt, Human
aaucucaaauuucua

SEQ ID NO: 2463276 - RNA, 13 nt, Human
aauccagccugcu

SEQ ID NO: 2463277 - RNA, 23 nt, Human
aauccaagcgaggucaacagaga

SEQ ID NO: 2463278 - RNA, 20 nt, Human
aaucucuuuuugcuuucgaa

SEQ ID NO: 2463279 - RNA, 15 nt, Human
aaucucuuuuugacu

SEQ ID NO: 2463280 - RNA, 19 nt, Human
aaugaaaguauaacugagu

SEQ ID NO: 2463281 - RNA, 22 nt, Human
aaugaaagcauguggcauguuc

SEQ ID NO: 2463282 - RNA, 17 nt, Human
aaugaaaguauaacuga

SEQ ID NO: 2463283 - RNA, 13 nt, Human
aaucucugugccu

SEQ ID NO: 2463284 - RNA, 20 nt, Human
aaucucucgguuccacgucc

SEQ ID NO: 2463285 - RNA, 17 nt, Human
aaucucaaauuucuaaa

SEQ ID NO: 2463286 - RNA, 18 nt, Human
aaucucaaauuucuaaau

SEQ ID NO: 2463287 - RNA, 18 nt, Human
aauccaggcagauccagg

SEQ ID NO: 2463288 - RNA, 17 nt, Human
aauccaggcagauccag

SEQ ID NO: 2463289 - RNA, 16 nt, Human
aaucucuccauucccg

SEQ ID NO: 2463290 - RNA, 21 nt, Human
aaugauuaugaauuacauuug

SEQ ID NO: 2463291 - RNA, 23 nt, Human
aaugauuaugaauuacauuugua

SEQ ID NO: 2463292 - RNA, 16 nt, Human
aaugauuaauuaaaac

SEQ ID NO: 2463293 - RNA, 19 nt, Human
aaugaagcuuuauacgugu

SEQ ID NO: 2463294 - RNA, 23 nt, Human
aaugaucuagguuuaacucagau

SEQ ID NO: 2463295 - RNA, 22 nt, Human
aaugaucuagguuuaacucaga

SEQ ID NO: 2463296 - RNA, 19 nt, Human
aaugaucuagguuuaacuc

SEQ ID NO: 2463297 - RNA, 18 nt, Human
aaugaucuagguuuaacu

SEQ ID NO: 2463298 - RNA, 17 nt, Human
aaugaucuagguuuaac

SEQ ID NO: 2463299 - RNA, 16 nt, Human
aaugaucuagguuuaa

SEQ ID NO: 2463300 - RNA, 14 nt, Human
aaugaucuagguuu

SEQ ID NO: 2463301 - RNA, 13 nt, Human
aaugaucuagguu

SEQ ID NO: 2463302 - RNA, 15 nt, Human
aaugauuaugaauua

SEQ ID NO: 2463303 - RNA, 20 nt, Human
aaugauccccagcuguuuau

SEQ ID NO: 2463304 - RNA, 19 nt, Human
aaugauccccagcuguuua

SEQ ID NO: 2463305 - RNA, 22 nt, Human
aaugauccccagcuguuuaugc

SEQ ID NO: 2463306 - RNA, 22 nt, Human
aaugaagguuaggauuuaacag

SEQ ID NO: 2463307 - RNA, 21 nt, Human
aaugaagguuaggauuuaaca

SEQ ID NO: 2463308 - RNA, 22 nt, Human
aaugaaggugucagaauaauaa

SEQ ID NO: 2463309 - RNA, 19 nt, Human
aaugaaaugcucuccuuuc

SEQ ID NO: 2463310 - RNA, 22 nt, Human
aaugaaggcgggccugcaagcc

SEQ ID NO: 2463311 - RNA, 14 nt, Human
aaugaaauaucugu

SEQ ID NO: 2463312 - RNA, 21 nt, Human
aaugaaauccugcuucagugu

SEQ ID NO: 2463313 - RNA, 17 nt, Human
aaugaaaugcucuccuu

SEQ ID NO: 2463314 - RNA, 18 nt, Human
aaugaaaugcucuccuuu

SEQ ID NO: 2463315 - RNA, 22 nt, Human
aaugaaauaucuguauuuaauu

SEQ ID NO: 2463316 - RNA, 12 nt, Human
aaugaaauaucu

SEQ ID NO: 2463317 - RNA, 14 nt, Human
aaugaaauacacaa

SEQ ID NO: 2463318 - RNA, 13 nt, Human
aaugaaauacugu

SEQ ID NO: 2463319 - RNA, 15 nt, Human
aaugaaaguuugcac

SEQ ID NO: 2463320 - RNA, 21 nt, Human
aaugaaauaauguacaucugg

SEQ ID NO: 2463321 - RNA, 15 nt, Human
aaugaaguuugaaug

SEQ ID NO: 2463322 - RNA, 14 nt, Human
aaugaaguuugaau

SEQ ID NO: 2463323 - RNA, 13 nt, Human
aaugaaguuugaa

SEQ ID NO: 2463324 - RNA, 12 nt, Human
aaugaaguuuga

SEQ ID NO: 2463325 - RNA, 16 nt, Human
aaugaaguuugaaugu

SEQ ID NO: 2463326 - RNA, 16 nt, Human
aaugaucauaagucua

SEQ ID NO: 2463327 - RNA, 20 nt, Human
aaugauccccaagugugaac

SEQ ID NO: 2463328 - RNA, 16 nt, Human
aaugauccccagcugu

SEQ ID NO: 2463329 - RNA, 14 nt, Human
aaugaagucucuga

SEQ ID NO: 2463330 - RNA, 16 nt, Human
aaugaagucucugaag

SEQ ID NO: 2463331 - RNA, 16 nt, Human
aaugaaguauuucuca

SEQ ID NO: 2463332 - RNA, 23 nt, Human
aaugaagucucugaagugaaacu

SEQ ID NO: 2463333 - RNA, 17 nt, Human
aaugaaguuguagguaa

SEQ ID NO: 2463334 - RNA, 15 nt, Human
aauauuagaugugau

SEQ ID NO: 2463335 - RNA, 14 nt, Human
aauauuagauguga

SEQ ID NO: 2463336 - RNA, 13 nt, Human
aauauuagaugug

SEQ ID NO: 2463337 - RNA, 12 nt, Human
aauauuagaugu

SEQ ID NO: 2463338 - RNA, 13 nt, Human
aauauuagaaaca

SEQ ID NO: 2463339 - RNA, 17 nt, Human
aauauuaaacccuggau

SEQ ID NO: 2463340 - RNA, 21 nt, Human
aauauuagugaccucagcuuu

SEQ ID NO: 2463341 - RNA, 19 nt, Human
aauauuagcuuuacuguuu

SEQ ID NO: 2463342 - RNA, 21 nt, Human
aauauuagcuuuacuguuugu

SEQ ID NO: 2463343 - RNA, 19 nt, Human
aauauuagaugugauuuaa

SEQ ID NO: 2463344 - RNA, 18 nt, Human
aauauuagaugugauuua

SEQ ID NO: 2463345 - RNA, 17 nt, Human
aauauuagaugugauuu

SEQ ID NO: 2463346 - RNA, 16 nt, Human
aauauuagaugugauu

SEQ ID NO: 2463347 - RNA, 15 nt, Human
aauauuagcuuuacu

SEQ ID NO: 2463348 - RNA, 18 nt, Human
aauauuagcuuuacuguu

SEQ ID NO: 2463349 - RNA, 22 nt, Human
aauauuauacuaagaaaagaua

SEQ ID NO: 2463350 - RNA, 15 nt, Human
aauauuauacuaaga

SEQ ID NO: 2463351 - RNA, 20 nt, Human
aauauuagaugugauuuaau

SEQ ID NO: 2463352 - RNA, 16 nt, Human
aauauuauacuaagaa

SEQ ID NO: 2463353 - RNA, 23 nt, Human
aaucaagggcaaaaagucuacau

SEQ ID NO: 2463354 - RNA, 15 nt, Human
aaucaagcuucaguu

SEQ ID NO: 2463355 - RNA, 23 nt, Human
aaucaagccucuggucacauggc

SEQ ID NO: 2463356 - RNA, 13 nt, Human
aaucaagccucug

SEQ ID NO: 2463357 - RNA, 20 nt, Human
aaucaagauuuaauccuaga

SEQ ID NO: 2463358 - RNA, 14 nt, Human
aaucaagagcugcc

SEQ ID NO: 2463359 - RNA, 13 nt, Human
aaucaagagcugc

SEQ ID NO: 2463360 - RNA, 17 nt, Human
aaucaagagcugcccuc

SEQ ID NO: 2463361 - RNA, 16 nt, Human
aaucaagagcugcccu

SEQ ID NO: 2463362 - RNA, 15 nt, Human
aaucaccgaaaacgu

SEQ ID NO: 2463363 - RNA, 20 nt, Human
aaucaccacaccaaaccucu

SEQ ID NO: 2463364 - RNA, 15 nt, Human
aaucaccaaaggcuc

SEQ ID NO: 2463365 - RNA, 14 nt, Human
aaucaccgaaaacg

SEQ ID NO: 2463366 - RNA, 19 nt, Human
aaucacauucgaguguuuc

SEQ ID NO: 2463367 - RNA, 14 nt, Human
aauauacuguaaag

SEQ ID NO: 2463368 - RNA, 15 nt, Human
aauauacuguaaaga

SEQ ID NO: 2463369 - RNA, 16 nt, Human
aauauacuguaaagaa

SEQ ID NO: 2463370 - RNA, 17 nt, Human
aauauacuguaaagaaa

SEQ ID NO: 2463371 - RNA, 18 nt, Human
aauauacuguaaagaaag

SEQ ID NO: 2463372 - RNA, 21 nt, Human
aauauacuguaaagaaagaga

SEQ ID NO: 2463373 - RNA, 22 nt, Human
aauauacuguaaagaaagagag

SEQ ID NO: 2463374 - RNA, 23 nt, Human
aauauacuguaaagaaagagaga

SEQ ID NO: 2463375 - RNA, 12 nt, Human
aauauacuguaa

SEQ ID NO: 2463376 - RNA, 13 nt, Human
aauauacuguaaa

SEQ ID NO: 2463377 - RNA, 11 nt, Human
aauauacugua

SEQ ID NO: 2463378 - RNA, 17 nt, Human
aauauacuauauuuaug

SEQ ID NO: 2463379 - RNA, 18 nt, Human
aauauacauucaaacuua

SEQ ID NO: 2463380 - RNA, 19 nt, Human
aauauacauucaaacuuaa

SEQ ID NO: 2463381 - RNA, 13 nt, Human
aauauacacacag

SEQ ID NO: 2463382 - RNA, 13 nt, Human
aauagacaauuua

SEQ ID NO: 2463383 - RNA, 20 nt, Human
aauagaauauaauuaucgga

SEQ ID NO: 2463384 - RNA, 17 nt, Human
aauagaauauaauuauc

SEQ ID NO: 2463385 - RNA, 22 nt, Human
aauagaaggauguacauuucca

SEQ ID NO: 2463386 - RNA, 19 nt, Human
aauagaaggauguacauuu

SEQ ID NO: 2463387 - RNA, 20 nt, Human
aauagaaggauguacauuuc

SEQ ID NO: 2463388 - RNA, 22 nt, Human
aauauguuuuuuagaucaaaua

SEQ ID NO: 2463389 - RNA, 21 nt, Human
aauauguuuuuuagaucaaau

SEQ ID NO: 2463390 - RNA, 19 nt, Human
aauauauggcagaguugua

SEQ ID NO: 2463391 - RNA, 14 nt, Human
aauauauggcagag

SEQ ID NO: 2463392 - RNA, 21 nt, Human
aauauaucuaaauugaauaau

SEQ ID NO: 2463393 - RNA, 20 nt, Human
aauauaucuaaauugaauaa

SEQ ID NO: 2463394 - RNA, 15 nt, Human
aauauacuuguggac

SEQ ID NO: 2463395 - RNA, 13 nt, Human
aauauacuugugg

SEQ ID NO: 2463396 - RNA, 16 nt, Human
aauauauaucaaauau

SEQ ID NO: 2463397 - RNA, 16 nt, Human
aauauacuuguggacu

SEQ ID NO: 2463398 - RNA, 19 nt, Human
aauauaccccuuaguguuu

SEQ ID NO: 2463399 - RNA, 17 nt, Human
aauauauaucugcuguc

SEQ ID NO: 2463400 - RNA, 18 nt, Human
aauauaucuaaauugaau

SEQ ID NO: 2463401 - RNA, 17 nt, Human
aauauaucuaaauugaa

SEQ ID NO: 2463402 - RNA, 22 nt, Human
aauauaucccagaaauuagaaa

SEQ ID NO: 2463403 - RNA, 16 nt, Human
aauauaucccagaaau

SEQ ID NO: 2463404 - RNA, 16 nt, Human
aauacuguauuuugua

SEQ ID NO: 2463405 - RNA, 22 nt, Human
aauacuguacaaugacuuuauu

SEQ ID NO: 2463406 - RNA, 20 nt, Human
aauacuugucaauauuuaaa

SEQ ID NO: 2463407 - RNA, 18 nt, Human
aauacuugucaauauuua

SEQ ID NO: 2463408 - RNA, 17 nt, Human
aauacuugucaauauuu

SEQ ID NO: 2463409 - RNA, 10 nt, Human
aauacuuguc

SEQ ID NO: 2463410 - RNA, 22 nt, Human
aauacugccagaugcugauguu

SEQ ID NO: 2463411 - RNA, 20 nt, Human
aauacugccagaugcugaug

SEQ ID NO: 2463412 - RNA, 19 nt, Human
aauacugccagaugcugau

SEQ ID NO: 2463413 - RNA, 18 nt, Human
aauacugccagaugcuga

SEQ ID NO: 2463414 - RNA, 24 nt, Human
aauacugccagaugcugauguuca

SEQ ID NO: 2463415 - RNA, 23 nt, Human
aauacugccagaugcugauguuc

SEQ ID NO: 2463416 - RNA, 17 nt, Human
aauacugccagaugcug

SEQ ID NO: 2463417 - RNA, 16 nt, Human
aauacugccagaugcu

SEQ ID NO: 2463418 - RNA, 17 nt, Human
aauacuuuaaaggaaaa

SEQ ID NO: 2463419 - RNA, 16 nt, Human
aauacuuuaaaggaaa

SEQ ID NO: 2463420 - RNA, 15 nt, Human
aauacuuuaaaggaa

SEQ ID NO: 2463421 - RNA, 14 nt, Human
aauacuuuaaagga

SEQ ID NO: 2463422 - RNA, 11 nt, Human
aauacuuuugc

SEQ ID NO: 2463423 - RNA, 15 nt, Human
aauacuuuuuacaau

SEQ ID NO: 2463424 - RNA, 18 nt, Human
aauagaaaacugaaaauc

SEQ ID NO: 2463425 - RNA, 17 nt, Human
aauagaaaacugaaaau

SEQ ID NO: 2463426 - RNA, 19 nt, Human
aauagaaaacugaaaaucu

SEQ ID NO: 2463427 - RNA, 10 nt, Human
aauacuuuuu

SEQ ID NO: 2463428 - RNA, 13 nt, Human
aauagaaaacuga

SEQ ID NO: 2463429 - RNA, 20 nt, Human
aauacucuacccucuuagaa

SEQ ID NO: 2463430 - RNA, 22 nt, Human
aauacucuacccucuuagaaaa

SEQ ID NO: 2463431 - RNA, 23 nt, Human
aauacucuuaggaagagaaacca

SEQ ID NO: 2463432 - RNA, 16 nt, Human
aauacucauguguaug

SEQ ID NO: 2463433 - RNA, 15 nt, Human
aauacucauguguau

SEQ ID NO: 2463434 - RNA, 14 nt, Human
aauacucaugugua

SEQ ID NO: 2463435 - RNA, 13 nt, Human
aauacucaugugu

SEQ ID NO: 2463436 - RNA, 12 nt, Human
aauacucaugug

SEQ ID NO: 2463437 - RNA, 23 nt, Human
aauacucauaaugugaaguguua

SEQ ID NO: 2463438 - RNA, 19 nt, Human
aauacucauaaugugaagu

SEQ ID NO: 2463439 - RNA, 18 nt, Human
aauacucauaaugugaag

SEQ ID NO: 2463440 - RNA, 21 nt, Human
aauacuauuuuuacugccacu

SEQ ID NO: 2463441 - RNA, 19 nt, Human
aauacuauuuuuacugcca

SEQ ID NO: 2463442 - RNA, 17 nt, Human
aauacuauuuuuacugc

SEQ ID NO: 2463443 - RNA, 16 nt, Human
aauacuauuuuuacug

SEQ ID NO: 2463444 - RNA, 17 nt, Human
aauacucauaaugugaa

SEQ ID NO: 2463445 - RNA, 16 nt, Human
aauacucauaauguga

SEQ ID NO: 2463446 - RNA, 17 nt, Human
aauacuaccuugaaaau

SEQ ID NO: 2463447 - RNA, 18 nt, Human
aauacuaccuugaaaaua

SEQ ID NO: 2463448 - RNA, 21 nt, Human
aauacuaccuugaaaauaaga

SEQ ID NO: 2463449 - RNA, 19 nt, Human
aauacuagggagaagguuu

SEQ ID NO: 2463450 - RNA, 15 nt, Human
aauacuauuuuuacu

SEQ ID NO: 2463451 - RNA, 17 nt, Human
aauacuaguugugaccu

SEQ ID NO: 2463452 - RNA, 14 nt, Human
aauacuaguuguga

SEQ ID NO: 2463453 - RNA, 15 nt, Human
aauacuacuccugua

SEQ ID NO: 2463454 - RNA, 21 nt, Human
aauacuauauuuauacuguau

SEQ ID NO: 2463455 - RNA, 12 nt, Human
agacagccccag

SEQ ID NO: 2463456 - RNA, 21 nt, Human
agacagauacuccuccaaggu

SEQ ID NO: 2463457 - RNA, 15 nt, Human
agacagauacuccuc

SEQ ID NO: 2463458 - RNA, 15 nt, Human
agacagcccgggcuc

SEQ ID NO: 2463459 - RNA, 14 nt, Human
agacagcccgggcu

SEQ ID NO: 2463460 - RNA, 18 nt, Human
agacagccccagagcagg

SEQ ID NO: 2463461 - RNA, 17 nt, Human
agacagccccagagcag

SEQ ID NO: 2463462 - RNA, 15 nt, Human
agacagccccagagc

SEQ ID NO: 2463463 - RNA, 13 nt, Human
agacagccccaga

SEQ ID NO: 2463464 - RNA, 17 nt, Human
agacagcuccacccugg

SEQ ID NO: 2463465 - RNA, 20 nt, Human
agacagccccagagcagggu

SEQ ID NO: 2463466 - RNA, 19 nt, Human
agacagccccagagcaggg

SEQ ID NO: 2463467 - RNA, 21 nt, Human
agacagcuccacccuggccga

SEQ ID NO: 2463468 - RNA, 15 nt, Human
agacagcucccucug

SEQ ID NO: 2463469 - RNA, 18 nt, Human
agacagcucccucugccu

SEQ ID NO: 2463470 - RNA, 19 nt, Human
agacagcucccucugccug

SEQ ID NO: 2463471 - RNA, 14 nt, Human
agacaacccugcaa

SEQ ID NO: 2463472 - RNA, 20 nt, Human
agacaacccugcaaaggacu

SEQ ID NO: 2463473 - RNA, 21 nt, Human
agacaacccugcaaaggacug

SEQ ID NO: 2463474 - RNA, 15 nt, Human
agacaacagaaguca

SEQ ID NO: 2463475 - RNA, 13 nt, Human
agacaacagaagu

SEQ ID NO: 2463476 - RNA, 14 nt, Human
agacaacagaaguc

SEQ ID NO: 2463477 - RNA, 15 nt, Human
agacaagagauggga

SEQ ID NO: 2463478 - RNA, 23 nt, Human
agacagagucucacuguugccca

SEQ ID NO: 2463479 - RNA, 17 nt, Human
agacaagaaaucccugu

SEQ ID NO: 2463480 - RNA, 13 nt, Human
agacaagaaaucc

SEQ ID NO: 2463481 - RNA, 21 nt, Human
agacaagacuucaguauguug

SEQ ID NO: 2463482 - RNA, 19 nt, Human
agacaagacuucaguaugu

SEQ ID NO: 2463483 - RNA, 18 nt, Human
agacaagaaaucccuguu

SEQ ID NO: 2463484 - RNA, 15 nt, Human
agacaagacuucagu

SEQ ID NO: 2463485 - RNA, 17 nt, Human
agacaaauucuguuucu

SEQ ID NO: 2463486 - RNA, 18 nt, Human
agacaaauucuguuucuu

SEQ ID NO: 2463487 - RNA, 19 nt, Human
agacaaauucuguuucuug

SEQ ID NO: 2463488 - RNA, 21 nt, Human
agacaaauucuguuucuugag

SEQ ID NO: 2463489 - RNA, 21 nt, Human
agacgcugugcugcccugccc

SEQ ID NO: 2463490 - RNA, 13 nt, Human
agacccccacccc

SEQ ID NO: 2463491 - RNA, 14 nt, Human
agacccccaccccu

SEQ ID NO: 2463492 - RNA, 16 nt, Human
agacccccaccccuuc

SEQ ID NO: 2463493 - RNA, 17 nt, Human
agacccccaccccuucc

SEQ ID NO: 2463494 - RNA, 19 nt, Human
agacccccaccccuucccc

SEQ ID NO: 2463495 - RNA, 20 nt, Human
agacccccaccccuucccca

SEQ ID NO: 2463496 - RNA, 21 nt, Human
agacccccaccccuuccccac

SEQ ID NO: 2463497 - RNA, 12 nt, Human
agacccccacuc

SEQ ID NO: 2463498 - RNA, 23 nt, Human
agaccccacccaagcuuggcagc

SEQ ID NO: 2463499 - RNA, 20 nt, Human
agaccccacccaagcuuggc

SEQ ID NO: 2463500 - RNA, 16 nt, Human
agaccccacccaagcu

SEQ ID NO: 2463501 - RNA, 15 nt, Human
agaccccacccaagc

SEQ ID NO: 2463502 - RNA, 12 nt, Human
agaccccaccca

SEQ ID NO: 2463503 - RNA, 13 nt, Human
agacccccacacc

SEQ ID NO: 2463504 - RNA, 14 nt, Human
agacccccacaccu

SEQ ID NO: 2463505 - RNA, 15 nt, Human
agacccccacaccuc

SEQ ID NO: 2463506 - RNA, 11 nt, Human
agacccccacc

SEQ ID NO: 2463507 - RNA, 12 nt, Human
agacccccaccc

SEQ ID NO: 2463508 - RNA, 12 nt, Human
agacagcucuua

SEQ ID NO: 2463509 - RNA, 11 nt, Human
agacagcucuu

SEQ ID NO: 2463510 - RNA, 12 nt, Human
agacagcugccu

SEQ ID NO: 2463511 - RNA, 16 nt, Human
agacccauuccuauuu

SEQ ID NO: 2463512 - RNA, 20 nt, Human
agacagcucccucugccuga

SEQ ID NO: 2463513 - RNA, 15 nt, Human
agacccauuccuauu

SEQ ID NO: 2463514 - RNA, 18 nt, Human
agacggagucccaccuug

SEQ ID NO: 2463515 - RNA, 19 nt, Human
agacgguucaccagccucu

SEQ ID NO: 2463516 - RNA, 20 nt, Human
agacguacguaucagcggcc

SEQ ID NO: 2463517 - RNA, 17 nt, Human
agacguaggggaggggu

SEQ ID NO: 2463518 - RNA, 16 nt, Human
agacguaugcuuauuu

SEQ ID NO: 2463519 - RNA, 22 nt, Human
agacgcugugcugcccugccca

SEQ ID NO: 2463520 - RNA, 21 nt, Human
agacggaggccuacucuucca

SEQ ID NO: 2463521 - RNA, 13 nt, Human
agacccccacucu

SEQ ID NO: 2463522 - RNA, 13 nt, Human
agacguguacaua

SEQ ID NO: 2463523 - RNA, 18 nt, Human
agacguaugcuuauuuua

SEQ ID NO: 2463524 - RNA, 19 nt, Human
agacguaugcuuauuuuaa

SEQ ID NO: 2463525 - RNA, 14 nt, Human
agacgucccuccac

SEQ ID NO: 2463526 - RNA, 17 nt, Human
agacgugauuuugcugu

SEQ ID NO: 2463527 - RNA, 17 nt, Human
agagagccauuuuguga

SEQ ID NO: 2463528 - RNA, 15 nt, Human
agagagccauuuugu

SEQ ID NO: 2463529 - RNA, 13 nt, Human
agagagccauuuu

SEQ ID NO: 2463530 - RNA, 23 nt, Human
agagagcagcuucugccacuucc

SEQ ID NO: 2463531 - RNA, 19 nt, Human
agagagcagcuucugccac

SEQ ID NO: 2463532 - RNA, 17 nt, Human
agagagcagcuucugcc

SEQ ID NO: 2463533 - RNA, 18 nt, Human
agagagcaccccucucug

SEQ ID NO: 2463534 - RNA, 16 nt, Human
agagaagacccuucuc

SEQ ID NO: 2463535 - RNA, 16 nt, Human
agagagcggucucagg

SEQ ID NO: 2463536 - RNA, 21 nt, Human
agagagcggucucaggcuggu

SEQ ID NO: 2463537 - RNA, 19 nt, Human
agagagccauuuugugaau

SEQ ID NO: 2463538 - RNA, 18 nt, Human
agagagccauuuugugaa

SEQ ID NO: 2463539 - RNA, 18 nt, Human
agagagcgagcgcuaccc

SEQ ID NO: 2463540 - RNA, 15 nt, Human
agagaaaauaaaaag

SEQ ID NO: 2463541 - RNA, 16 nt, Human
agagaaaauaaaaagu

SEQ ID NO: 2463542 - RNA, 17 nt, Human
agagaaaauaaaaaguu

SEQ ID NO: 2463543 - RNA, 20 nt, Human
agagaaccuggaguuccuga

SEQ ID NO: 2463544 - RNA, 23 nt, Human
agagaaccucacgcaccucccau

SEQ ID NO: 2463545 - RNA, 17 nt, Human
agagaacuuccagaucc

SEQ ID NO: 2463546 - RNA, 11 nt, Human
agagaagacaa

SEQ ID NO: 2463547 - RNA, 15 nt, Human
agagaagaaugagcc

SEQ ID NO: 2463548 - RNA, 12 nt, Human
agagaagaauga

SEQ ID NO: 2463549 - RNA, 14 nt, Human
agagaacuguggcc

SEQ ID NO: 2463550 - RNA, 22 nt, Human
agagaacuaacacuauuuuaug

SEQ ID NO: 2463551 - RNA, 16 nt, Human
agagaacuaacacuau

SEQ ID NO: 2463552 - RNA, 15 nt, Human
agagaacgcagcccu

SEQ ID NO: 2463553 - RNA, 14 nt, Human
agagaacgcagccc

SEQ ID NO: 2463554 - RNA, 21 nt, Human
agagaggguggugaccucugc

SEQ ID NO: 2463555 - RNA, 20 nt, Human
agagaggguggugaccucug

SEQ ID NO: 2463556 - RNA, 22 nt, Human
agagaggguggugaccucugcc

SEQ ID NO: 2463557 - RNA, 23 nt, Human
agagagcugguaguuaguagcau

SEQ ID NO: 2463558 - RNA, 11 nt, Human
agagagcuggu

SEQ ID NO: 2463559 - RNA, 12 nt, Human
agagagcuggua

SEQ ID NO: 2463560 - RNA, 16 nt, Human
agagcccacgccccca

SEQ ID NO: 2463561 - RNA, 15 nt, Human
agagcccagcuccaa

SEQ ID NO: 2463562 - RNA, 13 nt, Human
agagcccacgccc

SEQ ID NO: 2463563 - RNA, 19 nt, Human
agagcccaccuuggcucaa

SEQ ID NO: 2463564 - RNA, 21 nt, Human
agacugcauuauauuuauuac

SEQ ID NO: 2463565 - RNA, 23 nt, Human
agacugcgggaugguccuggggc

SEQ ID NO: 2463566 - RNA, 23 nt, Human
agacugcgauuugucccaggucc

SEQ ID NO: 2463567 - RNA, 20 nt, Human
agacugcgggaugguccugg

SEQ ID NO: 2463568 - RNA, 22 nt, Human
agacugcgggaugguccugggg

SEQ ID NO: 2463569 - RNA, 16 nt, Human
agacuggaagcacagc

SEQ ID NO: 2463570 - RNA, 17 nt, Human
agacuggaagcacagcu

SEQ ID NO: 2463571 - RNA, 19 nt, Human
agacuggaagcacagcuuc

SEQ ID NO: 2463572 - RNA, 14 nt, Human
agacuggaagcuaa

SEQ ID NO: 2463573 - RNA, 19 nt, Human
agacuggaagcuaauuugc

SEQ ID NO: 2463574 - RNA, 14 nt, Human
agacugcugggacu

SEQ ID NO: 2463575 - RNA, 15 nt, Human
agacugcugggacug

SEQ ID NO: 2463576 - RNA, 13 nt, Human
agagaaaauaaaa

SEQ ID NO: 2463577 - RNA, 14 nt, Human
agagaaaauaaaaa

SEQ ID NO: 2463578 - RNA, 12 nt, Human
agagaaaauaaa

SEQ ID NO: 2463579 - RNA, 21 nt, Human
agagaaaagaaaaaaaaagaa

SEQ ID NO: 2463580 - RNA, 12 nt, Human
agagaaaagaaa

SEQ ID NO: 2463581 - RNA, 13 nt, Human
agagaaaagaaaa

SEQ ID NO: 2463582 - RNA, 14 nt, Human
agagaaaagaaaaa

SEQ ID NO: 2463583 - RNA, 15 nt, Human
agagaaaagaaaaaa

SEQ ID NO: 2463584 - RNA, 20 nt, Human
agagaaaacuuauuugagug

SEQ ID NO: 2463585 - RNA, 19 nt, Human
agagaaaacuuauuugagu

SEQ ID NO: 2463586 - RNA, 18 nt, Human
agagaaaacuuauuugag

SEQ ID NO: 2463587 - RNA, 10 nt, Human
agagaaaaga

SEQ ID NO: 2463588 - RNA, 11 nt, Human
agagaaaagaa

SEQ ID NO: 2463589 - RNA, 16 nt, Human
agauaucgacuuguuu

SEQ ID NO: 2463590 - RNA, 17 nt, Human
agaguuauuuaggcuuu

SEQ ID NO: 2463591 - RNA, 20 nt, Human
agaguucaauggcugcugaa

SEQ ID NO: 2463592 - RNA, 18 nt, Human
agaguucaauggcugcug

SEQ ID NO: 2463593 - RNA, 17 nt, Human
agaguucaauggcugcu

SEQ ID NO: 2463594 - RNA, 21 nt, Human
agaguucaauggcugcugaag

SEQ ID NO: 2463595 - RNA, 16 nt, Human
agaguucacuauaaau

SEQ ID NO: 2463596 - RNA, 16 nt, Human
agaguuccugcggagu

SEQ ID NO: 2463597 - RNA, 19 nt, Human
agaguuccccaugcagaca

SEQ ID NO: 2463598 - RNA, 14 nt, Human
agaguuagacuguu

SEQ ID NO: 2463599 - RNA, 13 nt, Human
agaguuagacugu

SEQ ID NO: 2463600 - RNA, 12 nt, Human
agaguuagacug

SEQ ID NO: 2463601 - RNA, 17 nt, Human
agaguuagacuguuggg

SEQ ID NO: 2463602 - RNA, 15 nt, Human
agaguuagacuguug

SEQ ID NO: 2463603 - RNA, 19 nt, Human
agaguuaguuucuuuggga

SEQ ID NO: 2463604 - RNA, 21 nt, Human
agauauauuaaaaauauaaaa

SEQ ID NO: 2463605 - RNA, 20 nt, Human
agauauauuaaaaauauaaa

SEQ ID NO: 2463606 - RNA, 19 nt, Human
agauauauuaaaaauauaa

SEQ ID NO: 2463607 - RNA, 18 nt, Human
agauauauuaaaaauaua

SEQ ID NO: 2463608 - RNA, 20 nt, Human
agauauauuuuuaagauaau

SEQ ID NO: 2463609 - RNA, 20 nt, Human
agauauauuaagugacuguu

SEQ ID NO: 2463610 - RNA, 17 nt, Human
agauauauuuuuaagau

SEQ ID NO: 2463611 - RNA, 16 nt, Human
agauauauuuuucaca

SEQ ID NO: 2463612 - RNA, 23 nt, Human
agauauauuuuuaagauaauaau

SEQ ID NO: 2463613 - RNA, 21 nt, Human
agauauauuuuuaagauaaua

SEQ ID NO: 2463614 - RNA, 14 nt, Human
agauauauuuuuca

SEQ ID NO: 2463615 - RNA, 15 nt, Human
agauauauuuuucac

SEQ ID NO: 2463616 - RNA, 17 nt, Human
agauauauuaaaaauau

SEQ ID NO: 2463617 - RNA, 13 nt, Human
agauauauuaaaa

SEQ ID NO: 2463618 - RNA, 22 nt, Human
agaguuccugcggagugaagag

SEQ ID NO: 2463619 - RNA, 14 nt, Human
agaguucugcucua

SEQ ID NO: 2463620 - RNA, 19 nt, Human
agauauaugcucugcaugu

SEQ ID NO: 2463621 - RNA, 14 nt, Human
agaucuucuguggg

SEQ ID NO: 2463622 - RNA, 17 nt, Human
agaugaaaaagcaugua

SEQ ID NO: 2463623 - RNA, 19 nt, Human
agaugaaaaagcauguaca

SEQ ID NO: 2463624 - RNA, 12 nt, Human
agaucuuucagg

SEQ ID NO: 2463625 - RNA, 13 nt, Human
agaucuuucagga

SEQ ID NO: 2463626 - RNA, 21 nt, Human
agaucuuucaggaaagacgga

SEQ ID NO: 2463627 - RNA, 23 nt, Human
agaugggagcuccucuccuggag

SEQ ID NO: 2463628 - RNA, 18 nt, Human
agaugggagcuccucucc

SEQ ID NO: 2463629 - RNA, 16 nt, Human
agaugggaugcuugcc

SEQ ID NO: 2463630 - RNA, 22 nt, Human
agaugggcauggggugggccuc

SEQ ID NO: 2463631 - RNA, 16 nt, Human
agaugggcuuguuuuc

SEQ ID NO: 2463632 - RNA, 17 nt, Human
agaugggcuuguuuucu

SEQ ID NO: 2463633 - RNA, 14 nt, Human
agauggcugugccu

SEQ ID NO: 2463634 - RNA, 13 nt, Human
agaugggagcucc

SEQ ID NO: 2463635 - RNA, 22 nt, Human
agauggcugacuuugcucuuuc

SEQ ID NO: 2463636 - RNA, 14 nt, Human
agauggcuccucuc

SEQ ID NO: 2463637 - RNA, 15 nt, Human
agauggcuccucuca

SEQ ID NO: 2463638 - RNA, 20 nt, Human
agauggcgagcauccuggcc

SEQ ID NO: 2463639 - RNA, 14 nt, Human
agaugaaacacaaa

SEQ ID NO: 2463640 - RNA, 22 nt, Human
agaugaaaaagcauguacagug

SEQ ID NO: 2463641 - RNA, 21 nt, Human
agaugaaaaagcauguacagu

SEQ ID NO: 2463642 - RNA, 20 nt, Human
agaugaaaaagcauguacag

SEQ ID NO: 2463643 - RNA, 13 nt, Human
agaugaaagagga

SEQ ID NO: 2463644 - RNA, 17 nt, Human
agaugaaacacaaacaa

SEQ ID NO: 2463645 - RNA, 23 nt, Human
agaugaaaucuuacagcugggug

SEQ ID NO: 2463646 - RNA, 20 nt, Human
agaugaaaucuuacagcugg

SEQ ID NO: 2463647 - RNA, 14 nt, Human
agauggcacuuuga

SEQ ID NO: 2463648 - RNA, 23 nt, Human
agaugaaagaggagguuuggggu

SEQ ID NO: 2463649 - RNA, 17 nt, Human
agaugaaagaggagguu

SEQ ID NO: 2463650 - RNA, 14 nt, Human
agauggcagucacu

SEQ ID NO: 2463651 - RNA, 19 nt, Human
agauggcccagcuccccaa

SEQ ID NO: 2463652 - RNA, 17 nt, Human
agauggcauccugugaa

SEQ ID NO: 2463653 - RNA, 19 nt, Human
agauggcauccugugaagu

SEQ ID NO: 2463654 - RNA, 19 nt, Human
agauggccugagaagagag

SEQ ID NO: 2463655 - RNA, 14 nt, Human
agagcccaggccuc

SEQ ID NO: 2463656 - RNA, 13 nt, Human
agagcccaggccu

SEQ ID NO: 2463657 - RNA, 15 nt, Human
agagcccaggccucc

SEQ ID NO: 2463658 - RNA, 14 nt, Human
agagccccacacgg

SEQ ID NO: 2463659 - RNA, 19 nt, Human
agaggaacuguccagagag

SEQ ID NO: 2463660 - RNA, 18 nt, Human
agaggaacuguccagaga

SEQ ID NO: 2463661 - RNA, 17 nt, Human
agaggaacuguccagag

SEQ ID NO: 2463662 - RNA, 15 nt, Human
agaggaacuguccag

SEQ ID NO: 2463663 - RNA, 12 nt, Human
agaggaacuguc

SEQ ID NO: 2463664 - RNA, 16 nt, Human
agaggaaggagaggag

SEQ ID NO: 2463665 - RNA, 14 nt, Human
agaggaaccaaccc

SEQ ID NO: 2463666 - RNA, 16 nt, Human
agaggagagaggaccc

SEQ ID NO: 2463667 - RNA, 15 nt, Human
agaggagagaggacc

SEQ ID NO: 2463668 - RNA, 10 nt, Human
agaggagaga

SEQ ID NO: 2463669 - RNA, 15 nt, Human
agaggagaaacacau

SEQ ID NO: 2463670 - RNA, 22 nt, Human
agaggacuguagggagggcggc

SEQ ID NO: 2463671 - RNA, 22 nt, Human
agaggacgagcgauugaggugu

SEQ ID NO: 2463672 - RNA, 14 nt, Human
agaggagaaacaca

SEQ ID NO: 2463673 - RNA, 15 nt, Human
agaggaccggcggcu

SEQ ID NO: 2463674 - RNA, 19 nt, Human
agaggacucacuugcccac

SEQ ID NO: 2463675 - RNA, 16 nt, Human
agaggacgugggcggc

SEQ ID NO: 2463676 - RNA, 14 nt, Human
agaggacgugggcg

SEQ ID NO: 2463677 - RNA, 20 nt, Human
agaggacaguauuugugggg

SEQ ID NO: 2463678 - RNA, 18 nt, Human
agaggacagaucaauggc

SEQ ID NO: 2463679 - RNA, 23 nt, Human
agaggacagaucaauggcgcagu

SEQ ID NO: 2463680 - RNA, 13 nt, Human
agaggaagagcag

SEQ ID NO: 2463681 - RNA, 22 nt, Human
agaggaagaauuuguuaucagu

SEQ ID NO: 2463682 - RNA, 21 nt, Human
agaggaacuguccagagagca

SEQ ID NO: 2463683 - RNA, 20 nt, Human
agaggaacuguccagagagc

SEQ ID NO: 2463684 - RNA, 15 nt, Human
agaggaaggggccag

SEQ ID NO: 2463685 - RNA, 16 nt, Human
agaggacaagggaaau

SEQ ID NO: 2463686 - RNA, 15 nt, Human
agaggagagaggcag

SEQ ID NO: 2463687 - RNA, 13 nt, Human
agaggagagaggc

SEQ ID NO: 2463688 - RNA, 12 nt, Human
agaggagagagg

SEQ ID NO: 2463689 - RNA, 11 nt, Human
agaggagagag

SEQ ID NO: 2463690 - RNA, 17 nt, Human
agagggaugcauggaga

SEQ ID NO: 2463691 - RNA, 12 nt, Human
agagggcacaga

SEQ ID NO: 2463692 - RNA, 23 nt, Human
agagggcaugcgcacaaggcuga

SEQ ID NO: 2463693 - RNA, 14 nt, Human
agagggcccaggca

SEQ ID NO: 2463694 - RNA, 16 nt, Human
agagggcccaggcagg

SEQ ID NO: 2463695 - RNA, 17 nt, Human
agagggcccaggcaggc

SEQ ID NO: 2463696 - RNA, 12 nt, Human
agaggagagcca

SEQ ID NO: 2463697 - RNA, 17 nt, Human
agaggagagaggcagag

SEQ ID NO: 2463698 - RNA, 16 nt, Human
agagggcacucugcuu

SEQ ID NO: 2463699 - RNA, 18 nt, Human
agagggccaagacuuggc

SEQ ID NO: 2463700 - RNA, 16 nt, Human
agagggcacacacugu

SEQ ID NO: 2463701 - RNA, 14 nt, Human
agagggcagaggcu

SEQ ID NO: 2463702 - RNA, 22 nt, Human
agaggguggugaccucugccug

SEQ ID NO: 2463703 - RNA, 20 nt, Human
agaggguggugaccucugcc

SEQ ID NO: 2463704 - RNA, 19 nt, Human
agaggguggugaccucugc

SEQ ID NO: 2463705 - RNA, 18 nt, Human
agagggcccugguguuuc

SEQ ID NO: 2463706 - RNA, 13 nt, Human
agagggcccuggu

SEQ ID NO: 2463707 - RNA, 21 nt, Human
agagggcccaggcaggccacc

SEQ ID NO: 2463708 - RNA, 23 nt, Human
agagggcccugguguuucuagca

SEQ ID NO: 2463709 - RNA, 19 nt, Human
agaguggcuccucccggug

SEQ ID NO: 2463710 - RNA, 15 nt, Human
agaguggcuccuccc

SEQ ID NO: 2463711 - RNA, 11 nt, Human
agagugggagc

SEQ ID NO: 2463712 - RNA, 23 nt, Human
agaguggcuccucccggugccca

SEQ ID NO: 2463713 - RNA, 18 nt, Human
agagugggcugcaucugg

SEQ ID NO: 2463714 - RNA, 20 nt, Human
agagugucuucacggcagga

SEQ ID NO: 2463715 - RNA, 19 nt, Human
agaguggggauaugauuua

SEQ ID NO: 2463716 - RNA, 14 nt, Human
agagugugccugaa

SEQ ID NO: 2463717 - RNA, 14 nt, Human
agagugucuuucca

SEQ ID NO: 2463718 - RNA, 15 nt, Human
agagugucuuuccac

SEQ ID NO: 2463719 - RNA, 22 nt, Human
agagugucuucacggcaggaca

SEQ ID NO: 2463720 - RNA, 19 nt, Human
agagugugaaauagacauu

SEQ ID NO: 2463721 - RNA, 19 nt, Human
agagugugggaagggagag

SEQ ID NO: 2463722 - RNA, 20 nt, Human
agagugugggaagggagagc

SEQ ID NO: 2463723 - RNA, 17 nt, Human
agaguguggccuucgga

SEQ ID NO: 2463724 - RNA, 18 nt, Human
agaugggggcaagaagau

SEQ ID NO: 2463725 - RNA, 17 nt, Human
agaugggggcaagaaga

SEQ ID NO: 2463726 - RNA, 16 nt, Human
agaugggggcaagaag

SEQ ID NO: 2463727 - RNA, 15 nt, Human
agaugggggcaagaa

SEQ ID NO: 2463728 - RNA, 18 nt, Human
agaugggggaaagcacag

SEQ ID NO: 2463729 - RNA, 15 nt, Human
agauggggccucugu

SEQ ID NO: 2463730 - RNA, 14 nt, Human
agauggggccucug

SEQ ID NO: 2463731 - RNA, 15 nt, Human
agaugggggaaagca

SEQ ID NO: 2463732 - RNA, 18 nt, Human
agaugggcuuguuuucuu

SEQ ID NO: 2463733 - RNA, 19 nt, Human
agaugggcuuguuuucuug

SEQ ID NO: 2463734 - RNA, 12 nt, Human
agcacugaccug

SEQ ID NO: 2463735 - RNA, 16 nt, Human
agcacugacuucuaag

SEQ ID NO: 2463736 - RNA, 23 nt, Human
agcacugacuagggaaaugauca

SEQ ID NO: 2463737 - RNA, 22 nt, Human
agcacugaccugucaugccccc

SEQ ID NO: 2463738 - RNA, 20 nt, Human
agcacugaccugucaugccc

SEQ ID NO: 2463739 - RNA, 13 nt, Human
agcacugaccugu

SEQ ID NO: 2463740 - RNA, 17 nt, Human
agcacuggguugacuuu

SEQ ID NO: 2463741 - RNA, 19 nt, Human
agcacagacccugcccugu

SEQ ID NO: 2463742 - RNA, 18 nt, Human
agcacagacccugcccug

SEQ ID NO: 2463743 - RNA, 20 nt, Human
agcacagacccugcccugug

SEQ ID NO: 2463744 - RNA, 16 nt, Human
agcacagaaggaggag

SEQ ID NO: 2463745 - RNA, 14 nt, Human
agcacacagggcag

SEQ ID NO: 2463746 - RNA, 17 nt, Human
agcacagacccugcccu

SEQ ID NO: 2463747 - RNA, 14 nt, Human
agcacacuguagca

SEQ ID NO: 2463748 - RNA, 19 nt, Human
agcacacuguagcauuaca

SEQ ID NO: 2463749 - RNA, 19 nt, Human
agcacagaaacagaggaga

SEQ ID NO: 2463750 - RNA, 13 nt, Human
agcacagaaggag

SEQ ID NO: 2463751 - RNA, 23 nt, Human
agcacacuugacaucaacugcau

SEQ ID NO: 2463752 - RNA, 20 nt, Human
agcacacucauccccucacu

SEQ ID NO: 2463753 - RNA, 14 nt, Human
agcacacucauccc

SEQ ID NO: 2463754 - RNA, 13 nt, Human
agcagcguuucua

SEQ ID NO: 2463755 - RNA, 22 nt, Human
agcagcgguuuggggagcagag

SEQ ID NO: 2463756 - RNA, 23 nt, Human
agcagcgguuuggggagcagaga

SEQ ID NO: 2463757 - RNA, 22 nt, Human
agcagcgaccaccccugccucc

SEQ ID NO: 2463758 - RNA, 23 nt, Human
agcagcgaccgcccccuccucua

SEQ ID NO: 2463759 - RNA, 21 nt, Human
agcagcgaccaccccugccuc

SEQ ID NO: 2463760 - RNA, 20 nt, Human
agcagcgaccaccccugccu

SEQ ID NO: 2463761 - RNA, 18 nt, Human
agcagcgaccgcccccuc

SEQ ID NO: 2463762 - RNA, 14 nt, Human
agcagcgccuuucc

SEQ ID NO: 2463763 - RNA, 15 nt, Human
agcagcgccuuuccc

SEQ ID NO: 2463764 - RNA, 15 nt, Human
agcagcgguggccuc

SEQ ID NO: 2463765 - RNA, 21 nt, Human
agcagcggggcgaagcccagg

SEQ ID NO: 2463766 - RNA, 16 nt, Human
agcagcgguggccucu

SEQ ID NO: 2463767 - RNA, 17 nt, Human
agcagcgguuuggggag

SEQ ID NO: 2463768 - RNA, 17 nt, Human
agcacuguuccagccug

SEQ ID NO: 2463769 - RNA, 16 nt, Human
agcacuguuccagccu

SEQ ID NO: 2463770 - RNA, 19 nt, Human
agcacugugcucagggcua

SEQ ID NO: 2463771 - RNA, 18 nt, Human
agcacugugcucagggcu

SEQ ID NO: 2463772 - RNA, 15 nt, Human
agcacugugcucagg

SEQ ID NO: 2463773 - RNA, 14 nt, Human
agcacugugcucag

SEQ ID NO: 2463774 - RNA, 23 nt, Human
agcacugugcuaauaacagugca

SEQ ID NO: 2463775 - RNA, 15 nt, Human
agcacugugcuaaua

SEQ ID NO: 2463776 - RNA, 20 nt, Human
agcacuguuccagccugccc

SEQ ID NO: 2463777 - RNA, 18 nt, Human
agcagcgaccaccccugc

SEQ ID NO: 2463778 - RNA, 16 nt, Human
agcacugucccuugcc

SEQ ID NO: 2463779 - RNA, 15 nt, Human
agcacugucccuugc

SEQ ID NO: 2463780 - RNA, 13 nt, Human
agcacugucccuu

SEQ ID NO: 2463781 - RNA, 12 nt, Human
agcacugucccu

SEQ ID NO: 2463782 - RNA, 22 nt, Human
agcacugucccuugccucaaug

SEQ ID NO: 2463783 - RNA, 19 nt, Human
agcacugucccuugccuca

SEQ ID NO: 2463784 - RNA, 19 nt, Human
agcacuggguugcagggga

SEQ ID NO: 2463785 - RNA, 14 nt, Human
agcacugucucagu

SEQ ID NO: 2463786 - RNA, 14 nt, Human
agcacugugcuaau

SEQ ID NO: 2463787 - RNA, 20 nt, Human
agcacugucucaguuucacu

SEQ ID NO: 2463788 - RNA, 20 nt, Human
agcagugcaugcugucccuu

SEQ ID NO: 2463789 - RNA, 19 nt, Human
agcagugcaugcugucccu

SEQ ID NO: 2463790 - RNA, 15 nt, Human
agcagcuucaccaga

SEQ ID NO: 2463791 - RNA, 22 nt, Human
agcagcugguaaucuugcucug

SEQ ID NO: 2463792 - RNA, 18 nt, Human
agcagugcaugcuguccc

SEQ ID NO: 2463793 - RNA, 16 nt, Human
agcagugccuuccaua

SEQ ID NO: 2463794 - RNA, 17 nt, Human
agcagugccuuccauaa

SEQ ID NO: 2463795 - RNA, 20 nt, Human
agcagugccuuccauaauua

SEQ ID NO: 2463796 - RNA, 18 nt, Human
agcagcuggacuacccac

SEQ ID NO: 2463797 - RNA, 13 nt, Human
agcagcuggacua

SEQ ID NO: 2463798 - RNA, 10 nt, Human
agcagcugga

SEQ ID NO: 2463799 - RNA, 18 nt, Human
agcagcuuagacuaaggc

SEQ ID NO: 2463800 - RNA, 18 nt, Human
agcagcugaacagccaaa

SEQ ID NO: 2463801 - RNA, 23 nt, Human
agcagcucuugcuaaucaguguc

SEQ ID NO: 2463802 - RNA, 23 nt, Human
agcagcugaaauaugcuggcugg

SEQ ID NO: 2463803 - RNA, 22 nt, Human
agcagcugaaauaugcuggcug

SEQ ID NO: 2463804 - RNA, 17 nt, Human
agcagcucuugcuaauc

SEQ ID NO: 2463805 - RNA, 16 nt, Human
agcagcucuugcuaau

SEQ ID NO: 2463806 - RNA, 15 nt, Human
agcagcucuugcuaa

SEQ ID NO: 2463807 - RNA, 13 nt, Human
agcagcucuugcu

SEQ ID NO: 2463808 - RNA, 12 nt, Human
agcagcucuccc

SEQ ID NO: 2463809 - RNA, 14 nt, Human
agcagcucuccccu

SEQ ID NO: 2463810 - RNA, 13 nt, Human
agcaguugaaaag

SEQ ID NO: 2463811 - RNA, 16 nt, Human
agcaguugaaaagacu

SEQ ID NO: 2463812 - RNA, 14 nt, Human
agcaguuccggauu

SEQ ID NO: 2463813 - RNA, 22 nt, Human
agcaguuaacuuuaagacugag

SEQ ID NO: 2463814 - RNA, 15 nt, Human
agcaguuaacuuuaa

SEQ ID NO: 2463815 - RNA, 21 nt, Human
agcaguguuccccaucugggu

SEQ ID NO: 2463816 - RNA, 21 nt, Human
agcaguuacaaaaaccuuccc

SEQ ID NO: 2463817 - RNA, 15 nt, Human
agcagugugaggcca

SEQ ID NO: 2463818 - RNA, 21 nt, Human
agcagugugaggccagggcag

SEQ ID NO: 2463819 - RNA, 20 nt, Human
agcagugucuuccauaaugu

SEQ ID NO: 2463820 - RNA, 18 nt, Human
agcagugggccuggccag

SEQ ID NO: 2463821 - RNA, 13 nt, Human
agcagugucauca

SEQ ID NO: 2463822 - RNA, 19 nt, Human
agcagugccuuccauaauu

SEQ ID NO: 2463823 - RNA, 19 nt, Human
agcagugucaucagaagau

SEQ ID NO: 2463824 - RNA, 15 nt, Human
agcagugucaucaga

SEQ ID NO: 2463825 - RNA, 20 nt, Human
agcagugucaucagaagaua

SEQ ID NO: 2463826 - RNA, 15 nt, Human
agcagugucuuccau

SEQ ID NO: 2463827 - RNA, 16 nt, Human
agcagugucuuccaua

SEQ ID NO: 2463828 - RNA, 17 nt, Human
agcagugucuuccauaa

SEQ ID NO: 2463829 - RNA, 22 nt, Human
agcagugucuuccauaauguau

SEQ ID NO: 2463830 - RNA, 23 nt, Human
agcauccuggcacccggccccug

SEQ ID NO: 2463831 - RNA, 22 nt, Human
agcauccuggcacccggccccu

SEQ ID NO: 2463832 - RNA, 18 nt, Human
agcauccuggcacccggc

SEQ ID NO: 2463833 - RNA, 19 nt, Human
agcauccuuuucugcagag

SEQ ID NO: 2463834 - RNA, 21 nt, Human
agcauccuuuucugcagaggg

SEQ ID NO: 2463835 - RNA, 20 nt, Human
agcaugaauuuuuuucaucu

SEQ ID NO: 2463836 - RNA, 22 nt, Human
agcaugaaugguauggaacucu

SEQ ID NO: 2463837 - RNA, 22 nt, Human
agcaugacaagccccaggcagg

SEQ ID NO: 2463838 - RNA, 20 nt, Human
agcaugacaagccccaggca

SEQ ID NO: 2463839 - RNA, 21 nt, Human
agcaugacaagccccaggcag

SEQ ID NO: 2463840 - RNA, 17 nt, Human
agcaugacaagccccag

SEQ ID NO: 2463841 - RNA, 18 nt, Human
agcaugacaagccccagg

SEQ ID NO: 2463842 - RNA, 19 nt, Human
agcaugacaagccccaggc

SEQ ID NO: 2463843 - RNA, 14 nt, Human
agcaugacauuucu

SEQ ID NO: 2463844 - RNA, 15 nt, Human
agcaugacauuucuu

SEQ ID NO: 2463845 - RNA, 18 nt, Human
agcaugaccugugaccag

SEQ ID NO: 2463846 - RNA, 18 nt, Human
agccaauccccuccuugg

SEQ ID NO: 2463847 - RNA, 16 nt, Human
agccaauccccuccuu

SEQ ID NO: 2463848 - RNA, 15 nt, Human
agccagcacacaggg

SEQ ID NO: 2463849 - RNA, 17 nt, Human
agccagcacacagggca

SEQ ID NO: 2463850 - RNA, 18 nt, Human
agccagcacacagggcag

SEQ ID NO: 2463851 - RNA, 20 nt, Human
agccaauccccuccuugggc

SEQ ID NO: 2463852 - RNA, 19 nt, Human
agccagcacacagggcagu

SEQ ID NO: 2463853 - RNA, 23 nt, Human
agccagcaccuggcaucgcacca

SEQ ID NO: 2463854 - RNA, 15 nt, Human
agccagcaccuggca

SEQ ID NO: 2463855 - RNA, 14 nt, Human
agccagcaccuggc

SEQ ID NO: 2463856 - RNA, 13 nt, Human
agccagcaccugg

SEQ ID NO: 2463857 - RNA, 15 nt, Human
agccagcacuuguau

SEQ ID NO: 2463858 - RNA, 20 nt, Human
agccagcacuuguccagcug

SEQ ID NO: 2463859 - RNA, 21 nt, Human
agccagcacuuguccagcuga

SEQ ID NO: 2463860 - RNA, 22 nt, Human
agccagcacuuguccagcugag

SEQ ID NO: 2463861 - RNA, 15 nt, Human
agccaauccccuccu

SEQ ID NO: 2463862 - RNA, 14 nt, Human
agccaauccccucc

SEQ ID NO: 2463863 - RNA, 13 nt, Human
agccaauccccuc

SEQ ID NO: 2463864 - RNA, 18 nt, Human
agccaauaacacacagcu

SEQ ID NO: 2463865 - RNA, 14 nt, Human
agccaauauuuuuc

SEQ ID NO: 2463866 - RNA, 23 nt, Human
agccaagugugguagagugugcc

SEQ ID NO: 2463867 - RNA, 20 nt, Human
agccaaguggggugcuggga

SEQ ID NO: 2463868 - RNA, 16 nt, Human
agccaaguggggugcu

SEQ ID NO: 2463869 - RNA, 13 nt, Human
agccaaguggggu

SEQ ID NO: 2463870 - RNA, 18 nt, Human
agccaaguccagauuuac

SEQ ID NO: 2463871 - RNA, 15 nt, Human
agccaaguccagauu

SEQ ID NO: 2463872 - RNA, 13 nt, Human
agccaaguccaga

SEQ ID NO: 2463873 - RNA, 21 nt, Human
agccaagucagcuuugccuuc

SEQ ID NO: 2463874 - RNA, 23 nt, Human
agccaagucagcuuugccuucca

SEQ ID NO: 2463875 - RNA, 14 nt, Human
agccaaccccugug

SEQ ID NO: 2463876 - RNA, 16 nt, Human
agccaaccccugugga

SEQ ID NO: 2463877 - RNA, 15 nt, Human
agccaacagguggca

SEQ ID NO: 2463878 - RNA, 23 nt, Human
agccaacacccugucuaaaaaac

SEQ ID NO: 2463879 - RNA, 22 nt, Human
agccaacacgcaccugccucag

SEQ ID NO: 2463880 - RNA, 21 nt, Human
agccaacagguggcaggacca

SEQ ID NO: 2463881 - RNA, 17 nt, Human
agccaacagguggcagg

SEQ ID NO: 2463882 - RNA, 23 nt, Human
agccaacagguggcaggaccagg

SEQ ID NO: 2463883 - RNA, 21 nt, Human
agccaacagucaaaacagaga

SEQ ID NO: 2463884 - RNA, 18 nt, Human
agccaacacgcaccugcc

SEQ ID NO: 2463885 - RNA, 19 nt, Human
agccaacacgcaccugccu

SEQ ID NO: 2463886 - RNA, 18 nt, Human
agccaacagaagcuucca

SEQ ID NO: 2463887 - RNA, 19 nt, Human
agccaacacccaucuguuu

SEQ ID NO: 2463888 - RNA, 15 nt, Human
agccaaaugguuuaa

SEQ ID NO: 2463889 - RNA, 20 nt, Human
agccaaauguaauugaauaa

SEQ ID NO: 2463890 - RNA, 16 nt, Human
agcauggagcuggccg

SEQ ID NO: 2463891 - RNA, 13 nt, Human
agcauggagcugg

SEQ ID NO: 2463892 - RNA, 14 nt, Human
agcauggagcuggc

SEQ ID NO: 2463893 - RNA, 17 nt, Human
agccaaaucaaaauaug

SEQ ID NO: 2463894 - RNA, 23 nt, Human
agcaugccuggauggggcugcac

SEQ ID NO: 2463895 - RNA, 20 nt, Human
agcaugccuggauggggcug

SEQ ID NO: 2463896 - RNA, 19 nt, Human
agcaugagagaauuguauc

SEQ ID NO: 2463897 - RNA, 22 nt, Human
agcaugaccugugaccagcacu

SEQ ID NO: 2463898 - RNA, 23 nt, Human
agcaugaccugugaccagcacug

SEQ ID NO: 2463899 - RNA, 21 nt, Human
agcaugcugugauugugccua

SEQ ID NO: 2463900 - RNA, 20 nt, Human
agccagcaggcucucaggcc

SEQ ID NO: 2463901 - RNA, 15 nt, Human
agccagcagacauug

SEQ ID NO: 2463902 - RNA, 14 nt, Human
agccagcagacauu

SEQ ID NO: 2463903 - RNA, 16 nt, Human
agccagcagacauugu

SEQ ID NO: 2463904 - RNA, 17 nt, Human
agccagcaggcucucag

SEQ ID NO: 2463905 - RNA, 19 nt, Human
agccagcaggcucucaggc

SEQ ID NO: 2463906 - RNA, 18 nt, Human
agccagcaggcucucagg

SEQ ID NO: 2463907 - RNA, 19 nt, Human
agcccgggcugccugggcu

SEQ ID NO: 2463908 - RNA, 18 nt, Human
agcccgggcugccugggc

SEQ ID NO: 2463909 - RNA, 17 nt, Human
agcccgggcugccuggg

SEQ ID NO: 2463910 - RNA, 16 nt, Human
agcccgggcugccugg

SEQ ID NO: 2463911 - RNA, 21 nt, Human
agcccgggcugccugggcugu

SEQ ID NO: 2463912 - RNA, 20 nt, Human
agcccgggcugccugggcug

SEQ ID NO: 2463913 - RNA, 15 nt, Human
agcccgggcugccug

SEQ ID NO: 2463914 - RNA, 14 nt, Human
agcccgggcugccu

SEQ ID NO: 2463915 - RNA, 13 nt, Human
agcccgggcugcc

SEQ ID NO: 2463916 - RNA, 12 nt, Human
agcccgggcugc

SEQ ID NO: 2463917 - RNA, 16 nt, Human
agccccauuccuggga

SEQ ID NO: 2463918 - RNA, 16 nt, Human
agccccauucugccug

SEQ ID NO: 2463919 - RNA, 13 nt, Human
agccccauucugc

SEQ ID NO: 2463920 - RNA, 14 nt, Human
agcccucaaaguga

SEQ ID NO: 2463921 - RNA, 19 nt, Human
agcccuaaaucuagacuca

SEQ ID NO: 2463922 - RNA, 13 nt, Human
agcccucaaagug

SEQ ID NO: 2463923 - RNA, 22 nt, Human
agcccucaccccugguucucau

SEQ ID NO: 2463924 - RNA, 17 nt, Human
agcccucacccuggggc

SEQ ID NO: 2463925 - RNA, 22 nt, Human
agcccuaaaauuccacugcguu

SEQ ID NO: 2463926 - RNA, 17 nt, Human
agcccguguggccccuu

SEQ ID NO: 2463927 - RNA, 18 nt, Human
agcccguguggccccuuc

SEQ ID NO: 2463928 - RNA, 19 nt, Human
agcccguguggccccuuca

SEQ ID NO: 2463929 - RNA, 14 nt, Human
agcccgucucagug

SEQ ID NO: 2463930 - RNA, 15 nt, Human
agcccgucucagugu

SEQ ID NO: 2463931 - RNA, 15 nt, Human
agcccguguggcccc

SEQ ID NO: 2463932 - RNA, 16 nt, Human
agcccguguggccccu

SEQ ID NO: 2463933 - RNA, 23 nt, Human
agccccaugcuggagccugugua

SEQ ID NO: 2463934 - RNA, 22 nt, Human
agccccaugcuggagccugugu

SEQ ID NO: 2463935 - RNA, 21 nt, Human
agccccaugcuggagccugug

SEQ ID NO: 2463936 - RNA, 20 nt, Human
agccccaugcuggagccugu

SEQ ID NO: 2463937 - RNA, 13 nt, Human
agccccauuccug

SEQ ID NO: 2463938 - RNA, 19 nt, Human
agccccaugcuggagccug

SEQ ID NO: 2463939 - RNA, 18 nt, Human
agccccaugcuggagccu

SEQ ID NO: 2463940 - RNA, 17 nt, Human
agccccaugcuggagcc

SEQ ID NO: 2463941 - RNA, 16 nt, Human
agccccaugcuggagc

SEQ ID NO: 2463942 - RNA, 20 nt, Human
agccccagugccaagcacag

SEQ ID NO: 2463943 - RNA, 23 nt, Human
agccccagugccaagcacagugc

SEQ ID NO: 2463944 - RNA, 14 nt, Human
agccccaugcugga

SEQ ID NO: 2463945 - RNA, 15 nt, Human
agccccagugcccac

SEQ ID NO: 2463946 - RNA, 14 nt, Human
agccccagugccca

SEQ ID NO: 2463947 - RNA, 13 nt, Human
agccccagugccc

SEQ ID NO: 2463948 - RNA, 13 nt, Human
agccccagugcca

SEQ ID NO: 2463949 - RNA, 13 nt, Human
agccuccuccuga

SEQ ID NO: 2463950 - RNA, 12 nt, Human
agccuccuccug

SEQ ID NO: 2463951 - RNA, 14 nt, Human
agccgcuccugucu

SEQ ID NO: 2463952 - RNA, 20 nt, Human
agccgccauugccaccagga

SEQ ID NO: 2463953 - RNA, 21 nt, Human
agccgccauugccaccaggag

SEQ ID NO: 2463954 - RNA, 22 nt, Human
agccgccauugccaccaggaga

SEQ ID NO: 2463955 - RNA, 15 nt, Human
agccgcugagcgagg

SEQ ID NO: 2463956 - RNA, 19 nt, Human
agccgcugagcgaggagau

SEQ ID NO: 2463957 - RNA, 12 nt, Human
agccgcucggag

SEQ ID NO: 2463958 - RNA, 22 nt, Human
agccgcuccugucugccagcca

SEQ ID NO: 2463959 - RNA, 16 nt, Human
agccgcuccugucugc

SEQ ID NO: 2463960 - RNA, 17 nt, Human
agccgcuccugucugcc

SEQ ID NO: 2463961 - RNA, 19 nt, Human
agccgcuccugucugccag

SEQ ID NO: 2463962 - RNA, 21 nt, Human
agccgcuccugucugccagcc

SEQ ID NO: 2463963 - RNA, 13 nt, Human
agccgcuggggcc

SEQ ID NO: 2463964 - RNA, 22 nt, Human
agccgcugcccggcgcccucug

SEQ ID NO: 2463965 - RNA, 18 nt, Human
agccgcugcccggcgccc

SEQ ID NO: 2463966 - RNA, 17 nt, Human
agccgcugcccggcgcc

SEQ ID NO: 2463967 - RNA, 12 nt, Human
agccgcugcccg

SEQ ID NO: 2463968 - RNA, 22 nt, Human
agccggccucucuggccuccca

SEQ ID NO: 2463969 - RNA, 19 nt, Human
agccggccucucuggccuc

SEQ ID NO: 2463970 - RNA, 18 nt, Human
agccggccucucuggccu

SEQ ID NO: 2463971 - RNA, 12 nt, Human
agccgcugcugg

SEQ ID NO: 2463972 - RNA, 18 nt, Human
agccggcggcccaagccc

SEQ ID NO: 2463973 - RNA, 13 nt, Human
agccggcggccca

SEQ ID NO: 2463974 - RNA, 23 nt, Human
agccggccucucuggccucccac

SEQ ID NO: 2463975 - RNA, 17 nt, Human
agccgggccccugggcu

SEQ ID NO: 2463976 - RNA, 16 nt, Human
agccgggccccugggc

SEQ ID NO: 2463977 - RNA, 18 nt, Human
agccgggccccugggcuu

SEQ ID NO: 2463978 - RNA, 14 nt, Human
agccgggccccugg

SEQ ID NO: 2463979 - RNA, 20 nt, Human
agccgggaaagaagagccgg

SEQ ID NO: 2463980 - RNA, 23 nt, Human
agccgggaacagacaacagaagu

SEQ ID NO: 2463981 - RNA, 21 nt, Human
agccgccaugcuccuggccca

SEQ ID NO: 2463982 - RNA, 17 nt, Human
agccgccauugccacca

SEQ ID NO: 2463983 - RNA, 18 nt, Human
agccgccauugccaccag

SEQ ID NO: 2463984 - RNA, 19 nt, Human
agccgccauugccaccagg

SEQ ID NO: 2463985 - RNA, 14 nt, Human
agcccucgucuccc

SEQ ID NO: 2463986 - RNA, 17 nt, Human
agcccuccuuccacgga

SEQ ID NO: 2463987 - RNA, 12 nt, Human
agcccuccuucc

SEQ ID NO: 2463988 - RNA, 13 nt, Human
agcccuccuucca

SEQ ID NO: 2463989 - RNA, 14 nt, Human
agcccuccucaccc

SEQ ID NO: 2463990 - RNA, 11 nt, Human
agcccuccuuc

SEQ ID NO: 2463991 - RNA, 12 nt, Human
agcccucuucca

SEQ ID NO: 2463992 - RNA, 11 nt, Human
agcccucuucc

SEQ ID NO: 2463993 - RNA, 15 nt, Human
agcccucuuccauca

SEQ ID NO: 2463994 - RNA, 13 nt, Human
agcccucuuccau

SEQ ID NO: 2463995 - RNA, 17 nt, Human
agccgcaucuucuccau

SEQ ID NO: 2463996 - RNA, 21 nt, Human
agccgcaucuucuccaucugg

SEQ ID NO: 2463997 - RNA, 15 nt, Human
agcccuccaaaagca

SEQ ID NO: 2463998 - RNA, 16 nt, Human
agcccucaucccgagc

SEQ ID NO: 2463999 - RNA, 19 nt, Human
agcccucagaacccuuggc

SEQ ID NO: 2464000 - RNA, 24 nt, Human
agcccucagaacccuuggcuugcc

SEQ ID NO: 2464001 - RNA, 15 nt, Human
agcccucagaacccu

SEQ ID NO: 2464002 - RNA, 18 nt, Human
agcccucagaacccuugg

SEQ ID NO: 2464003 - RNA, 14 nt, Human
agcccucagaaccc

SEQ ID NO: 2464004 - RNA, 23 nt, Human
agcccucaccccugguucucauc

SEQ ID NO: 2464005 - RNA, 24 nt, Human
agcccuccgccauucucaagcccu

SEQ ID NO: 2464006 - RNA, 12 nt, Human
agcccuccucac

SEQ ID NO: 2464007 - RNA, 13 nt, Human
agcccuccucacc

SEQ ID NO: 2464008 - RNA, 23 nt, Human
agcccuccgccauucucaagccc

SEQ ID NO: 2464009 - RNA, 21 nt, Human
agcccucccuguccuccucgg

SEQ ID NO: 2464010 - RNA, 22 nt, Human
agcccucccuguccuccucgga

SEQ ID NO: 2464011 - RNA, 14 nt, Human
agcccucccugucc

SEQ ID NO: 2464012 - RNA, 17 nt, Human
agcccuccaaaagcacu

SEQ ID NO: 2464013 - RNA, 15 nt, Human
agcccucccuguccu

SEQ ID NO: 2464014 - RNA, 16 nt, Human
agcccucccuguccuc

SEQ ID NO: 2464015 - RNA, 17 nt, Human
agcccucccuguccucc

SEQ ID NO: 2464016 - RNA, 19 nt, Human
agcccucccuguccuccuc

SEQ ID NO: 2464017 - RNA, 20 nt, Human
agcccucccuguccuccucg

SEQ ID NO: 2464018 - RNA, 21 nt, Human
agccgggcgugguggugagug

SEQ ID NO: 2464019 - RNA, 19 nt, Human
agccgucagccaaauguaa

SEQ ID NO: 2464020 - RNA, 19 nt, Human
agccgggccuggggcuccu

SEQ ID NO: 2464021 - RNA, 13 nt, Human
agccgggccuggg

SEQ ID NO: 2464022 - RNA, 20 nt, Human
agccgucagccaaauguaau

SEQ ID NO: 2464023 - RNA, 22 nt, Human
agccgggcgugguggcgggcac

SEQ ID NO: 2464024 - RNA, 20 nt, Human
agccgugaugcucaggcuug

SEQ ID NO: 2464025 - RNA, 19 nt, Human
agccgugaugcucaggcuu

SEQ ID NO: 2464026 - RNA, 18 nt, Human
agccgugaugcucaggcu

SEQ ID NO: 2464027 - RNA, 17 nt, Human
agccgugaugcucaggc

SEQ ID NO: 2464028 - RNA, 16 nt, Human
agccgugccuucagcu

SEQ ID NO: 2464029 - RNA, 15 nt, Human
agccgugccuucagc

SEQ ID NO: 2464030 - RNA, 17 nt, Human
agccgugccuucagcuc

SEQ ID NO: 2464031 - RNA, 21 nt, Human
agccucccaaagugcugggau

SEQ ID NO: 2464032 - RNA, 22 nt, Human
agccucccacgacugcccggca

SEQ ID NO: 2464033 - RNA, 18 nt, Human
agccgugcucgccccagc

SEQ ID NO: 2464034 - RNA, 17 nt, Human
agccucccaaguagcug

SEQ ID NO: 2464035 - RNA, 16 nt, Human
agccgugcccugcccc

SEQ ID NO: 2464036 - RNA, 19 nt, Human
agccucccgaguagcuggg

SEQ ID NO: 2464037 - RNA, 18 nt, Human
agccucccgaguagcugg

SEQ ID NO: 2464038 - RNA, 20 nt, Human
agccucccgaguagcuggga

SEQ ID NO: 2464039 - RNA, 16 nt, Human
agccucccugaagccu

SEQ ID NO: 2464040 - RNA, 17 nt, Human
agccucccauccagggc

SEQ ID NO: 2464041 - RNA, 13 nt, Human
agccucccacccc

SEQ ID NO: 2464042 - RNA, 23 nt, Human
agccuccggaguagcugggacca

SEQ ID NO: 2464043 - RNA, 20 nt, Human
agccuccucaucccguguuc

SEQ ID NO: 2464044 - RNA, 17 nt, Human
agccuccguauuucaga

SEQ ID NO: 2464045 - RNA, 18 nt, Human
agccuccguauuucagac

SEQ ID NO: 2464046 - RNA, 14 nt, Human
agccuccuccagcc

SEQ ID NO: 2464047 - RNA, 18 nt, Human
agccuccgagagggagag

SEQ ID NO: 2464048 - RNA, 17 nt, Human
agccuccgagagggaga

SEQ ID NO: 2464049 - RNA, 16 nt, Human
agccuccgagagggag

SEQ ID NO: 2464050 - RNA, 14 nt, Human
agccuccgagaggg

SEQ ID NO: 2464051 - RNA, 18 nt, Human
agccucccugucggccug

SEQ ID NO: 2464052 - RNA, 18 nt, Human
agccucccauccagggcc

SEQ ID NO: 2464053 - RNA, 20 nt, Human
aggagaaucacuugaaccug

SEQ ID NO: 2464054 - RNA, 15 nt, Human
aggagaaugagccuc

SEQ ID NO: 2464055 - RNA, 16 nt, Human
aggagaauccaagcga

SEQ ID NO: 2464056 - RNA, 18 nt, Human
aggagaauccaagcgagg

SEQ ID NO: 2464057 - RNA, 20 nt, Human
aggagaauugcuugaaccug

SEQ ID NO: 2464058 - RNA, 20 nt, Human
aggagaauggcgugaacccg

SEQ ID NO: 2464059 - RNA, 19 nt, Human
aggagacacaacaacuccu

SEQ ID NO: 2464060 - RNA, 11 nt, Human
aggagacacaa

SEQ ID NO: 2464061 - RNA, 22 nt, Human
aggaguccaggccauggaggca

SEQ ID NO: 2464062 - RNA, 14 nt, Human
aggagucccaagga

SEQ ID NO: 2464063 - RNA, 20 nt, Human
aggaguccacuuuguuucgu

SEQ ID NO: 2464064 - RNA, 14 nt, Human
aggagucagagaga

SEQ ID NO: 2464065 - RNA, 12 nt, Human
aggagaaggaag

SEQ ID NO: 2464066 - RNA, 16 nt, Human
aggagaaggaaggaga

SEQ ID NO: 2464067 - RNA, 19 nt, Human
aggaccuagggauguucug

SEQ ID NO: 2464068 - RNA, 15 nt, Human
aggaccucagcugcu

SEQ ID NO: 2464069 - RNA, 18 nt, Human
aggaccucagcugcuucu

SEQ ID NO: 2464070 - RNA, 22 nt, Human
aggaccuagggauguucuggcc

SEQ ID NO: 2464071 - RNA, 13 nt, Human
aggaccucaggug

SEQ ID NO: 2464072 - RNA, 16 nt, Human
aggaccggcggcucgg

SEQ ID NO: 2464073 - RNA, 22 nt, Human
aggacccuucccuugagcccuc

SEQ ID NO: 2464074 - RNA, 12 nt, Human
aggagucccugg

SEQ ID NO: 2464075 - RNA, 21 nt, Human
aggagucccugccaucauguu

SEQ ID NO: 2464076 - RNA, 16 nt, Human
aggagucccaaggaaa

SEQ ID NO: 2464077 - RNA, 17 nt, Human
aggagucccaaggaaag

SEQ ID NO: 2464078 - RNA, 21 nt, Human
aggagugggaaaacacugcca

SEQ ID NO: 2464079 - RNA, 18 nt, Human
aggaguggguugauuuca

SEQ ID NO: 2464080 - RNA, 21 nt, Human
aggaugcuuguacauaaugcg

SEQ ID NO: 2464081 - RNA, 23 nt, Human
aggaugcuuguacauaaugcgug

SEQ ID NO: 2464082 - RNA, 16 nt, Human
aggaguuaagaguagc

SEQ ID NO: 2464083 - RNA, 18 nt, Human
aggagugugugauuuuuu

SEQ ID NO: 2464084 - RNA, 16 nt, Human
aggaguguggccacgu

SEQ ID NO: 2464085 - RNA, 16 nt, Human
aggagugugagaauca

SEQ ID NO: 2464086 - RNA, 22 nt, Human
aggaguuaguggauuacugcca

SEQ ID NO: 2464087 - RNA, 17 nt, Human
aggaguuaagaguagca

SEQ ID NO: 2464088 - RNA, 17 nt, Human
aggaguuagaggccagc

SEQ ID NO: 2464089 - RNA, 12 nt, Human
aggaguucaaug

SEQ ID NO: 2464090 - RNA, 20 nt, Human
aggaguuagaggccagccug

SEQ ID NO: 2464091 - RNA, 17 nt, Human
aggaugucacagggcca

SEQ ID NO: 2464092 - RNA, 16 nt, Human
aggaugucacagggcc

SEQ ID NO: 2464093 - RNA, 15 nt, Human
aggaugucacagggc

SEQ ID NO: 2464094 - RNA, 14 nt, Human
aggauuaaauaaug

SEQ ID NO: 2464095 - RNA, 18 nt, Human
aggauguucugggacaca

SEQ ID NO: 2464096 - RNA, 20 nt, Human
aggauuaaauaauguaaaua

SEQ ID NO: 2464097 - RNA, 14 nt, Human
aggauguuuuucau

SEQ ID NO: 2464098 - RNA, 18 nt, Human
aggaugucacagggccaa

SEQ ID NO: 2464099 - RNA, 16 nt, Human
aggauuacaugcaugu

SEQ ID NO: 2464100 - RNA, 14 nt, Human
aggauuauuggaaa

SEQ ID NO: 2464101 - RNA, 22 nt, Human
aggauguucuagcauggcugcc

SEQ ID NO: 2464102 - RNA, 22 nt, Human
aggauguacaaggacagccccu

SEQ ID NO: 2464103 - RNA, 16 nt, Human
aggauguucugggaca

SEQ ID NO: 2464104 - RNA, 15 nt, Human
aggauguucugggac

SEQ ID NO: 2464105 - RNA, 23 nt, Human
aggaugguucccuugaugaagaa

SEQ ID NO: 2464106 - RNA, 17 nt, Human
aggauggagccagcucu

SEQ ID NO: 2464107 - RNA, 19 nt, Human
aggauggagagaggggaau

SEQ ID NO: 2464108 - RNA, 18 nt, Human
aggauguaaacagugccu

SEQ ID NO: 2464109 - RNA, 19 nt, Human
aggauguaaacagugccug

SEQ ID NO: 2464110 - RNA, 22 nt, Human
aggauguaaacagugccugcug

SEQ ID NO: 2464111 - RNA, 20 nt, Human
aggauguaaacagugccugc

SEQ ID NO: 2464112 - RNA, 21 nt, Human
aggauguaaacagugccugcu

SEQ ID NO: 2464113 - RNA, 16 nt, Human
aggaguucaaugaucu

SEQ ID NO: 2464114 - RNA, 15 nt, Human
aggaguucaaugauc

SEQ ID NO: 2464115 - RNA, 14 nt, Human
aggaguucaaugau

SEQ ID NO: 2464116 - RNA, 13 nt, Human
aggaguucaauga

SEQ ID NO: 2464117 - RNA, 17 nt, Human
aggaguucaaugaucua

SEQ ID NO: 2464118 - RNA, 14 nt, Human
aggauggaacacgg

SEQ ID NO: 2464119 - RNA, 14 nt, Human
aggauggagagagg

SEQ ID NO: 2464120 - RNA, 15 nt, Human
aggauggagagaggg

SEQ ID NO: 2464121 - RNA, 16 nt, Human
aggauggagagagggg

SEQ ID NO: 2464122 - RNA, 17 nt, Human
aggauggagagagggga

SEQ ID NO: 2464123 - RNA, 19 nt, Human
aggauggaacacggccaca

SEQ ID NO: 2464124 - RNA, 13 nt, Human
aggauggagagag

SEQ ID NO: 2464125 - RNA, 21 nt, Human
aggaaucaugugccaagcaga

SEQ ID NO: 2464126 - RNA, 17 nt, Human
aggaauccagacccggc

SEQ ID NO: 2464127 - RNA, 20 nt, Human
aggaauccagacccggcugc

SEQ ID NO: 2464128 - RNA, 17 nt, Human
aggaauccacucccagg

SEQ ID NO: 2464129 - RNA, 16 nt, Human
aggaauccacucccag

SEQ ID NO: 2464130 - RNA, 21 nt, Human
aggaauccacucccaggcagc

SEQ ID NO: 2464131 - RNA, 22 nt, Human
agcuuuuuaauuguuguuucuu

SEQ ID NO: 2464132 - RNA, 13 nt, Human
agcuuuuugucuu

SEQ ID NO: 2464133 - RNA, 23 nt, Human
aggaaucaugucaggccugugug

SEQ ID NO: 2464134 - RNA, 14 nt, Human
agcuuuuccucccu

SEQ ID NO: 2464135 - RNA, 18 nt, Human
agcuuuugaauaaaaacu

SEQ ID NO: 2464136 - RNA, 21 nt, Human
agcuuuucccuuuuuuuaagu

SEQ ID NO: 2464137 - RNA, 21 nt, Human
agcuuuuuaauuguuguuucu

SEQ ID NO: 2464138 - RNA, 17 nt, Human
agcuuuuuaauuguugu

SEQ ID NO: 2464139 - RNA, 22 nt, Human
agcuuuuuauuccuccugcuca

SEQ ID NO: 2464140 - RNA, 19 nt, Human
agcuuuuuccagaggcuau

SEQ ID NO: 2464141 - RNA, 15 nt, Human
agcuuuuuaauuguu

SEQ ID NO: 2464142 - RNA, 14 nt, Human
agcuuuuuaauugu

SEQ ID NO: 2464143 - RNA, 13 nt, Human
agcuuuugcuuuu

SEQ ID NO: 2464144 - RNA, 18 nt, Human
aggacccagacccagugg

SEQ ID NO: 2464145 - RNA, 20 nt, Human
aggacccaucacgccugugc

SEQ ID NO: 2464146 - RNA, 18 nt, Human
aggacccaucacgccugu

SEQ ID NO: 2464147 - RNA, 20 nt, Human
aggacccuucccuugagccc

SEQ ID NO: 2464148 - RNA, 13 nt, Human
aggacccuucccu

SEQ ID NO: 2464149 - RNA, 12 nt, Human
aggacccuuccc

SEQ ID NO: 2464150 - RNA, 12 nt, Human
aggacccagacc

SEQ ID NO: 2464151 - RNA, 13 nt, Human
aggacccagagga

SEQ ID NO: 2464152 - RNA, 15 nt, Human
aggacccagaggaag

SEQ ID NO: 2464153 - RNA, 15 nt, Human
aggacccagacccag

SEQ ID NO: 2464154 - RNA, 14 nt, Human
aggacccagaccca

SEQ ID NO: 2464155 - RNA, 13 nt, Human
aggacccagaccc

SEQ ID NO: 2464156 - RNA, 22 nt, Human
agcuccccucggagaagagcug

SEQ ID NO: 2464157 - RNA, 17 nt, Human
agcucccuaggagacca

SEQ ID NO: 2464158 - RNA, 15 nt, Human
agcucccuaggagac

SEQ ID NO: 2464159 - RNA, 14 nt, Human
agcucccuucucug

SEQ ID NO: 2464160 - RNA, 13 nt, Human
agcucccuucucu

SEQ ID NO: 2464161 - RNA, 23 nt, Human
agcucccuucucuguagggaacu

SEQ ID NO: 2464162 - RNA, 16 nt, Human
agcucccuucucugua

SEQ ID NO: 2464163 - RNA, 13 nt, Human
agcucccucugcc

SEQ ID NO: 2464164 - RNA, 14 nt, Human
agcucccucugccu

SEQ ID NO: 2464165 - RNA, 17 nt, Human
agcuccuagcagagaga

SEQ ID NO: 2464166 - RNA, 17 nt, Human
agcuccgccucccgggu

SEQ ID NO: 2464167 - RNA, 23 nt, Human
agcuccgcuuucuacccagcgag

SEQ ID NO: 2464168 - RNA, 21 nt, Human
agcuccgcuuucuacccagcg

SEQ ID NO: 2464169 - RNA, 20 nt, Human
agcuccgcuuucuacccagc

SEQ ID NO: 2464170 - RNA, 13 nt, Human
agcuccuuccugg

SEQ ID NO: 2464171 - RNA, 15 nt, Human
agcuccuuccuggag

SEQ ID NO: 2464172 - RNA, 19 nt, Human
agcuccuuccuggagacug

SEQ ID NO: 2464173 - RNA, 13 nt, Human
agcuccuucuguc

SEQ ID NO: 2464174 - RNA, 15 nt, Human
agcuccguggagcag

SEQ ID NO: 2464175 - RNA, 14 nt, Human
agcuccguggagca

SEQ ID NO: 2464176 - RNA, 15 nt, Human
agcuccuagcagaga

SEQ ID NO: 2464177 - RNA, 12 nt, Human
agcuccuucugu

SEQ ID NO: 2464178 - RNA, 15 nt, Human
agcugagagacuuuu

SEQ ID NO: 2464179 - RNA, 16 nt, Human
agcugagagaaaauaa

SEQ ID NO: 2464180 - RNA, 23 nt, Human
agcugagauuauaggcaccuacc

SEQ ID NO: 2464181 - RNA, 14 nt, Human
agcugagcaggugu

SEQ ID NO: 2464182 - RNA, 21 nt, Human
agcugcgguccacccaggagc

SEQ ID NO: 2464183 - RNA, 14 nt, Human
agcugagagacuuu

SEQ ID NO: 2464184 - RNA, 15 nt, Human
agcugagcaccaggg

SEQ ID NO: 2464185 - RNA, 13 nt, Human
agcugagcaggga

SEQ ID NO: 2464186 - RNA, 15 nt, Human
agcugagcagggaga

SEQ ID NO: 2464187 - RNA, 21 nt, Human
agcugaacaauaggcuguucc

SEQ ID NO: 2464188 - RNA, 22 nt, Human
agcugaacaauaggcuguuccc

SEQ ID NO: 2464189 - RNA, 18 nt, Human
agcugaaaugcugcauuu

SEQ ID NO: 2464190 - RNA, 16 nt, Human
agcugaaaugcugcau

SEQ ID NO: 2464191 - RNA, 20 nt, Human
agcugaaaugcugcauuuua

SEQ ID NO: 2464192 - RNA, 13 nt, Human
agcugaaaugcug

SEQ ID NO: 2464193 - RNA, 12 nt, Human
agcugaaauacu

SEQ ID NO: 2464194 - RNA, 20 nt, Human
agcugaaauaugcuggcugg

SEQ ID NO: 2464195 - RNA, 22 nt, Human
agcugaaaaaucacauccuggc

SEQ ID NO: 2464196 - RNA, 21 nt, Human
agcugaaaaaucacauccugg

SEQ ID NO: 2464197 - RNA, 19 nt, Human
agcugaaaaaucacauccu

SEQ ID NO: 2464198 - RNA, 22 nt, Human
agcugaaaaccuaaguccuuua

SEQ ID NO: 2464199 - RNA, 23 nt, Human
agcugaaaaaucacauccuggcc

SEQ ID NO: 2464200 - RNA, 12 nt, Human
agcugaaaauau

SEQ ID NO: 2464201 - RNA, 18 nt, Human
agcugaaauaugcuggcu

SEQ ID NO: 2464202 - RNA, 21 nt, Human
agcugcuauagccuggggugg

SEQ ID NO: 2464203 - RNA, 15 nt, Human
agcugcuauagccug

SEQ ID NO: 2464204 - RNA, 16 nt, Human
agcugcuauagccugg

SEQ ID NO: 2464205 - RNA, 19 nt, Human
agcugcuacaaagaagaca

SEQ ID NO: 2464206 - RNA, 18 nt, Human
agcugcuacaaagaagac

SEQ ID NO: 2464207 - RNA, 17 nt, Human
agcugcuacaaagaaga

SEQ ID NO: 2464208 - RNA, 16 nt, Human
agcugcuacaaagaag

SEQ ID NO: 2464209 - RNA, 21 nt, Human
agcugcuacaaagaagacaug

SEQ ID NO: 2464210 - RNA, 20 nt, Human
agcugcuacaaagaagacau

SEQ ID NO: 2464211 - RNA, 22 nt, Human
agcugcuacaaagaagacaugu

SEQ ID NO: 2464212 - RNA, 15 nt, Human
agcugcuacaaagaa

SEQ ID NO: 2464213 - RNA, 14 nt, Human
agcugcuacaaaga

SEQ ID NO: 2464214 - RNA, 13 nt, Human
agcugcuacaaag

SEQ ID NO: 2464215 - RNA, 11 nt, Human
agcugcuacaa

SEQ ID NO: 2464216 - RNA, 23 nt, Human
agcugcgguccacccaggagccc

SEQ ID NO: 2464217 - RNA, 16 nt, Human
agcugcucagggaaaa

SEQ ID NO: 2464218 - RNA, 23 nt, Human
agcugcucacuaccuccucaggg

SEQ ID NO: 2464219 - RNA, 21 nt, Human
agcugcucagggaaaagcagc

SEQ ID NO: 2464220 - RNA, 19 nt, Human
agcuucugguacucuccua

SEQ ID NO: 2464221 - RNA, 17 nt, Human
agcuucugguacucucc

SEQ ID NO: 2464222 - RNA, 16 nt, Human
agcuucugguacucuc

SEQ ID NO: 2464223 - RNA, 15 nt, Human
agcuucugguacucu

SEQ ID NO: 2464224 - RNA, 14 nt, Human
agcuucugguacuc

SEQ ID NO: 2464225 - RNA, 22 nt, Human
agcuucugcuuuucugcccugg

SEQ ID NO: 2464226 - RNA, 23 nt, Human
agcuucugcuuuucugcccuggc

SEQ ID NO: 2464227 - RNA, 21 nt, Human
agcuucugcuuuucugcccug

SEQ ID NO: 2464228 - RNA, 20 nt, Human
agcuucugcuuuucugcccu

SEQ ID NO: 2464229 - RNA, 21 nt, Human
agcuucuggugaccuuccaag

SEQ ID NO: 2464230 - RNA, 22 nt, Human
agcuucuggugaccuuccaaga

SEQ ID NO: 2464231 - RNA, 12 nt, Human
agcuucuguccu

SEQ ID NO: 2464232 - RNA, 23 nt, Human
agcuucugguacucuccuagaga

SEQ ID NO: 2464233 - RNA, 21 nt, Human
agcuucugguacucuccuaga

SEQ ID NO: 2464234 - RNA, 20 nt, Human
agcuucugguacucuccuag

SEQ ID NO: 2464235 - RNA, 19 nt, Human
agcuucuguugcugccuca

SEQ ID NO: 2464236 - RNA, 22 nt, Human
agcuuccaugauucuauuuaua

SEQ ID NO: 2464237 - RNA, 17 nt, Human
agcuuccaguccaaucu

SEQ ID NO: 2464238 - RNA, 23 nt, Human
agcuucccucccguguguucucc

SEQ ID NO: 2464239 - RNA, 22 nt, Human
agcuuccuacccacaccucugc

SEQ ID NO: 2464240 - RNA, 20 nt, Human
agcuucccccccaccacagg

SEQ ID NO: 2464241 - RNA, 22 nt, Human
agcuucccccccaccacaggcc

SEQ ID NO: 2464242 - RNA, 17 nt, Human
agcuuccccucucuccu

SEQ ID NO: 2464243 - RNA, 23 nt, Human
agcuuccauuccaagccugacca

SEQ ID NO: 2464244 - RNA, 20 nt, Human
agguaaaagcaucacaugaa

SEQ ID NO: 2464245 - RNA, 17 nt, Human
agguaaaagugugagca

SEQ ID NO: 2464246 - RNA, 18 nt, Human
agguaaaucagacuauga

SEQ ID NO: 2464247 - RNA, 13 nt, Human
agguaaacaguuc

SEQ ID NO: 2464248 - RNA, 19 nt, Human
agguaaaauugaaaggcau

SEQ ID NO: 2464249 - RNA, 23 nt, Human
agguaaaucagacuaugaaguuu

SEQ ID NO: 2464250 - RNA, 15 nt, Human
agguaaacuccuguc

SEQ ID NO: 2464251 - RNA, 14 nt, Human
agguaaacuccugu

SEQ ID NO: 2464252 - RNA, 14 nt, Human
agguaaacaguucu

SEQ ID NO: 2464253 - RNA, 17 nt, Human
agguaacagaacagcuu

SEQ ID NO: 2464254 - RNA, 15 nt, Human
agguaacagaacagc

SEQ ID NO: 2464255 - RNA, 14 nt, Human
agguaacagaacag

SEQ ID NO: 2464256 - RNA, 13 nt, Human
agguaacagaaca

SEQ ID NO: 2464257 - RNA, 19 nt, Human
agguaaucgaccugccucg

SEQ ID NO: 2464258 - RNA, 21 nt, Human
agguaacagaacagcuucagg

SEQ ID NO: 2464259 - RNA, 19 nt, Human
agguaacagaacagcuuca

SEQ ID NO: 2464260 - RNA, 18 nt, Human
agguaacagaacagcuuc

SEQ ID NO: 2464261 - RNA, 21 nt, Human
agguaaucgaccugccucggc

SEQ ID NO: 2464262 - RNA, 11 nt, Human
aggucccuaau

SEQ ID NO: 2464263 - RNA, 12 nt, Human
aggucccuaaua

SEQ ID NO: 2464264 - RNA, 19 nt, Human
agguaauuucuugugccuc

SEQ ID NO: 2464265 - RNA, 17 nt, Human
agguacaaccuguucug

SEQ ID NO: 2464266 - RNA, 14 nt, Human
agguaaugagggac

SEQ ID NO: 2464267 - RNA, 13 nt, Human
agguaaugaggga

SEQ ID NO: 2464268 - RNA, 17 nt, Human
agguaaugagggacugg

SEQ ID NO: 2464269 - RNA, 16 nt, Human
agguaauuucuugugc

SEQ ID NO: 2464270 - RNA, 16 nt, Human
agguaaugugaauaaa

SEQ ID NO: 2464271 - RNA, 15 nt, Human
aggucccuaauaaag

SEQ ID NO: 2464272 - RNA, 13 nt, Human
aggucccuaauaa

SEQ ID NO: 2464273 - RNA, 21 nt, Human
aggucucggacuaagccuacc

SEQ ID NO: 2464274 - RNA, 23 nt, Human
aggucucgcugaugcugggcugg

SEQ ID NO: 2464275 - RNA, 22 nt, Human
aggucucgcugaugcugggcug

SEQ ID NO: 2464276 - RNA, 21 nt, Human
aggucucgcugaugcugggcu

SEQ ID NO: 2464277 - RNA, 20 nt, Human
aggucucgcugaugcugggc

SEQ ID NO: 2464278 - RNA, 19 nt, Human
aggucucgcugaugcuggg

SEQ ID NO: 2464279 - RNA, 17 nt, Human
aggucucgcugaugcug

SEQ ID NO: 2464280 - RNA, 16 nt, Human
aggucccuaauaaagc

SEQ ID NO: 2464281 - RNA, 16 nt, Human
agguacacagcucuag

SEQ ID NO: 2464282 - RNA, 12 nt, Human
agguacacucuu

SEQ ID NO: 2464283 - RNA, 18 nt, Human
aggucuguucuuuccaaa

SEQ ID NO: 2464284 - RNA, 20 nt, Human
aggucugacacgucugccua

SEQ ID NO: 2464285 - RNA, 16 nt, Human
aggucucuuccccucu

SEQ ID NO: 2464286 - RNA, 19 nt, Human
aggucucugccggcucuuu

SEQ ID NO: 2464287 - RNA, 16 nt, Human
aggucucugccggcuc

SEQ ID NO: 2464288 - RNA, 15 nt, Human
aggucucugccggcu

SEQ ID NO: 2464289 - RNA, 13 nt, Human
aggucucuucccc

SEQ ID NO: 2464290 - RNA, 12 nt, Human
aggucucuuccc

SEQ ID NO: 2464291 - RNA, 15 nt, Human
aggucucuuccccuc

SEQ ID NO: 2464292 - RNA, 15 nt, Human
aggucucuugaggga

SEQ ID NO: 2464293 - RNA, 16 nt, Human
aggucucuugagggag

SEQ ID NO: 2464294 - RNA, 13 nt, Human
aggucugaaaugg

SEQ ID NO: 2464295 - RNA, 15 nt, Human
aggucugaaauggag

SEQ ID NO: 2464296 - RNA, 21 nt, Human
aggucugaaauggagguccuu

SEQ ID NO: 2464297 - RNA, 19 nt, Human
aggugcuacaaaaacacag

SEQ ID NO: 2464298 - RNA, 20 nt, Human
aggugcuacaaaaacacagc

SEQ ID NO: 2464299 - RNA, 21 nt, Human
aggugcuacaaaaacacagca

SEQ ID NO: 2464300 - RNA, 22 nt, Human
aggugcuacaaaaacacagcaa

SEQ ID NO: 2464301 - RNA, 22 nt, Human
aggucuguucuuuccaaaguac

SEQ ID NO: 2464302 - RNA, 23 nt, Human
aggucuguucuuuccaaaguaca

SEQ ID NO: 2464303 - RNA, 18 nt, Human
aggugcuacaaaaacaca

SEQ ID NO: 2464304 - RNA, 22 nt, Human
aggucuggagaagcucccagga

SEQ ID NO: 2464305 - RNA, 14 nt, Human
aggucugcucggcc

SEQ ID NO: 2464306 - RNA, 13 nt, Human
agguucccuuuga

SEQ ID NO: 2464307 - RNA, 22 nt, Human
agguucccuuugacgccauccc

SEQ ID NO: 2464308 - RNA, 14 nt, Human
agguucaaagauau

SEQ ID NO: 2464309 - RNA, 17 nt, Human
agguuauuuuaguuucu

SEQ ID NO: 2464310 - RNA, 16 nt, Human
agguuauuuauuuaaa

SEQ ID NO: 2464311 - RNA, 15 nt, Human
agguuauuuauuuaa

SEQ ID NO: 2464312 - RNA, 17 nt, Human
agguuaucugucccagg

SEQ ID NO: 2464313 - RNA, 15 nt, Human
agguucaaagauauu

SEQ ID NO: 2464314 - RNA, 18 nt, Human
agguuaggauuuaacagu

SEQ ID NO: 2464315 - RNA, 22 nt, Human
agguuagauuuuguauucaggg

SEQ ID NO: 2464316 - RNA, 20 nt, Human
agguuagaaccuagaagggc

SEQ ID NO: 2464317 - RNA, 18 nt, Human
agguuagaaccuagaagg

SEQ ID NO: 2464318 - RNA, 21 nt, Human
agguuaggaguucgagaccag

SEQ ID NO: 2464319 - RNA, 21 nt, Human
agguuacccuguaacaugcaa

SEQ ID NO: 2464320 - RNA, 16 nt, Human
agguuaccaagaagcc

SEQ ID NO: 2464321 - RNA, 15 nt, Human
agguuaccaagaagc

SEQ ID NO: 2464322 - RNA, 17 nt, Human
agguuacccuguaacau

SEQ ID NO: 2464323 - RNA, 20 nt, Human
agguuaucgaaauaacaaug

SEQ ID NO: 2464324 - RNA, 19 nt, Human
agguuaucgaaauaacaau

SEQ ID NO: 2464325 - RNA, 18 nt, Human
agguuaucgaaauaacaa

SEQ ID NO: 2464326 - RNA, 17 nt, Human
agguuaucgaaauaaca

SEQ ID NO: 2464327 - RNA, 16 nt, Human
agguuaucugucccag

SEQ ID NO: 2464328 - RNA, 14 nt, Human
agguuauaggucac

SEQ ID NO: 2464329 - RNA, 17 nt, Human
agguuauaggucacucc

SEQ ID NO: 2464330 - RNA, 14 nt, Human
agguuaucgaaaua

SEQ ID NO: 2464331 - RNA, 19 nt, Human
agguuauaggucacuccug

SEQ ID NO: 2464332 - RNA, 20 nt, Human
agguuauuuuaguuucuguu

SEQ ID NO: 2464333 - RNA, 19 nt, Human
agguuauuuuaguuucugu

SEQ ID NO: 2464334 - RNA, 18 nt, Human
agguuccgcuuggagcag

SEQ ID NO: 2464335 - RNA, 21 nt, Human
agguuccgcuuggagcagagg

SEQ ID NO: 2464336 - RNA, 23 nt, Human
agguuccgcuuggagcagagggg

SEQ ID NO: 2464337 - RNA, 23 nt, Human
agguucccuuugacgccauccca

SEQ ID NO: 2464338 - RNA, 12 nt, Human
agguuccucugc

SEQ ID NO: 2464339 - RNA, 23 nt, Human
aggugcuacaaaaacacagcaag

SEQ ID NO: 2464340 - RNA, 24 nt, Human
aggugcuacaaaaacacagcaagg

SEQ ID NO: 2464341 - RNA, 22 nt, Human
aggugcuaggaacacuccuuca

SEQ ID NO: 2464342 - RNA, 19 nt, Human
aggugcuaggaacacuccu

SEQ ID NO: 2464343 - RNA, 23 nt, Human
aggugcuaggaacacuccuucac

SEQ ID NO: 2464344 - RNA, 21 nt, Human
aggugcuacacccuuuuccag

SEQ ID NO: 2464345 - RNA, 20 nt, Human
aggugcuacacccuuuucca

SEQ ID NO: 2464346 - RNA, 17 nt, Human
agguggaauuauuuuaa

SEQ ID NO: 2464347 - RNA, 21 nt, Human
agguggaauuauuuuaaaaga

SEQ ID NO: 2464348 - RNA, 18 nt, Human
aggugcucacaccccauu

SEQ ID NO: 2464349 - RNA, 15 nt, Human
aggugcucauuggcu

SEQ ID NO: 2464350 - RNA, 17 nt, Human
agguggaagcccuccuu

SEQ ID NO: 2464351 - RNA, 19 nt, Human
agguggaagcccuccuucc

SEQ ID NO: 2464352 - RNA, 20 nt, Human
agguggaagcccuccuucca

SEQ ID NO: 2464353 - RNA, 21 nt, Human
agguggaagcccuccuuccac

SEQ ID NO: 2464354 - RNA, 22 nt, Human
agguuaaaaaaaggcauuguuu

SEQ ID NO: 2464355 - RNA, 24 nt, Human
agguuacaacagauuugugaacuc

SEQ ID NO: 2464356 - RNA, 23 nt, Human
agguuacaacagauuugugaacu

SEQ ID NO: 2464357 - RNA, 22 nt, Human
agguuacaacagauuugugaac

SEQ ID NO: 2464358 - RNA, 21 nt, Human
agguuacaacagauuugugaa

SEQ ID NO: 2464359 - RNA, 15 nt, Human
agguuacaagccugc

SEQ ID NO: 2464360 - RNA, 21 nt, Human
agguuacaagccugcacaaua

SEQ ID NO: 2464361 - RNA, 19 nt, Human
agguuacaacagauuugug

SEQ ID NO: 2464362 - RNA, 16 nt, Human
agguuacaacagauuu

SEQ ID NO: 2464363 - RNA, 16 nt, Human
agguuaaggcugagga

SEQ ID NO: 2464364 - RNA, 17 nt, Human
agguuaaggcugaggaa

SEQ ID NO: 2464365 - RNA, 24 nt, Human
agguuaaggcugaggaaaggccag

SEQ ID NO: 2464366 - RNA, 14 nt, Human
agguguuuauacag

SEQ ID NO: 2464367 - RNA, 12 nt, Human
agguguuuauac

SEQ ID NO: 2464368 - RNA, 18 nt, Human
agguggagcaaagugagg

SEQ ID NO: 2464369 - RNA, 11 nt, Human
agguggagcaa

SEQ ID NO: 2464370 - RNA, 16 nt, Human
agguggacuggaaggg

SEQ ID NO: 2464371 - RNA, 14 nt, Human
agguggacacacaa

SEQ ID NO: 2464372 - RNA, 16 nt, Human
agguggaucacagagg

SEQ ID NO: 2464373 - RNA, 17 nt, Human
agguggaucaccugagg

SEQ ID NO: 2464374 - RNA, 20 nt, Human
agguggaggcugcagugagc

SEQ ID NO: 2464375 - RNA, 20 nt, Human
agguggagguugcagugagc

SEQ ID NO: 2464376 - RNA, 21 nt, Human
aggguccuggggaaccugacc

SEQ ID NO: 2464377 - RNA, 23 nt, Human
aggguccuggggaaccugacccc

SEQ ID NO: 2464378 - RNA, 14 nt, Human
aggguccuucccuc

SEQ ID NO: 2464379 - RNA, 21 nt, Human
aggguccuggcuccugagggg

SEQ ID NO: 2464380 - RNA, 16 nt, Human
aggguccuucccucuc

SEQ ID NO: 2464381 - RNA, 17 nt, Human
aggguccuucccucucc

SEQ ID NO: 2464382 - RNA, 12 nt, Human
aggguccugggg

SEQ ID NO: 2464383 - RNA, 15 nt, Human
aggguccuggggaac

SEQ ID NO: 2464384 - RNA, 19 nt, Human
aggguccuggcuccugagg

SEQ ID NO: 2464385 - RNA, 20 nt, Human
aggguccuggcuccugaggg

SEQ ID NO: 2464386 - RNA, 17 nt, Human
aggguccuggcuccuga

SEQ ID NO: 2464387 - RNA, 12 nt, Human
agggucccuggg

SEQ ID NO: 2464388 - RNA, 20 nt, Human
agggucccucuguguauuug

SEQ ID NO: 2464389 - RNA, 18 nt, Human
agggucccucuguguauu

SEQ ID NO: 2464390 - RNA, 15 nt, Human
agggucccucugugu

SEQ ID NO: 2464391 - RNA, 14 nt, Human
agggucccucugug

SEQ ID NO: 2464392 - RNA, 11 nt, Human
agggucccugg

SEQ ID NO: 2464393 - RNA, 15 nt, Human
aggguccccaccugg

SEQ ID NO: 2464394 - RNA, 20 nt, Human
agggucccauuucucacuga

SEQ ID NO: 2464395 - RNA, 19 nt, Human
agggucccaagcugggccc

SEQ ID NO: 2464396 - RNA, 18 nt, Human
agggucccaagcugggcc

SEQ ID NO: 2464397 - RNA, 12 nt, Human
agggucccucug

SEQ ID NO: 2464398 - RNA, 18 nt, Human
aggguccccaccugggac

SEQ ID NO: 2464399 - RNA, 17 nt, Human
agggucccaagcugggc

SEQ ID NO: 2464400 - RNA, 13 nt, Human
agggucccaagcu

SEQ ID NO: 2464401 - RNA, 12 nt, Human
agggucccaagc

SEQ ID NO: 2464402 - RNA, 23 nt, Human
aggguccacaggaagugaagaau

SEQ ID NO: 2464403 - RNA, 21 nt, Human
aggggccucuuaugggcuggg

SEQ ID NO: 2464404 - RNA, 20 nt, Human
aggggccucuuaugggcugg

SEQ ID NO: 2464405 - RNA, 19 nt, Human
aggggccucuuaugggcug

SEQ ID NO: 2464406 - RNA, 15 nt, Human
aggguaucuggugac

SEQ ID NO: 2464407 - RNA, 21 nt, Human
aggguaucaggugcugccauc

SEQ ID NO: 2464408 - RNA, 18 nt, Human
aggguaucaggugcugcc

SEQ ID NO: 2464409 - RNA, 16 nt, Human
aggggccuaggccuca

SEQ ID NO: 2464410 - RNA, 19 nt, Human
aggggccuaggccucagcc

SEQ ID NO: 2464411 - RNA, 23 nt, Human
aggggccuaggccucagccagag

SEQ ID NO: 2464412 - RNA, 19 nt, Human
aggguaucaggugcugcca

SEQ ID NO: 2464413 - RNA, 18 nt, Human
agggucaggagaggggca

SEQ ID NO: 2464414 - RNA, 14 nt, Human
agggucaggagagg

SEQ ID NO: 2464415 - RNA, 15 nt, Human
agggucaggagaggg

SEQ ID NO: 2464416 - RNA, 22 nt, Human
agggucauaucacucaggcccu

SEQ ID NO: 2464417 - RNA, 21 nt, Human
agggucagacgccugaggaac

SEQ ID NO: 2464418 - RNA, 13 nt, Human
agggucagagagg

SEQ ID NO: 2464419 - RNA, 21 nt, Human
agggucagagaggagucagag

SEQ ID NO: 2464420 - RNA, 21 nt, Human
agggucaggaaggaugagcau

SEQ ID NO: 2464421 - RNA, 22 nt, Human
agggucaggaaggaugagcauu

SEQ ID NO: 2464422 - RNA, 13 nt, Human
agggucaggaagg

SEQ ID NO: 2464423 - RNA, 19 nt, Human
aggcuagaaccuggcaagc

SEQ ID NO: 2464424 - RNA, 13 nt, Human
aggcuaaacaucc

SEQ ID NO: 2464425 - RNA, 21 nt, Human
aggcuaaacauccaauauuuu

SEQ ID NO: 2464426 - RNA, 21 nt, Human
aggcuagaaccaccugccuau

SEQ ID NO: 2464427 - RNA, 17 nt, Human
aggcuacugucagcucc

SEQ ID NO: 2464428 - RNA, 23 nt, Human
aggcuacuguaaggcaaucaugg

SEQ ID NO: 2464429 - RNA, 18 nt, Human
aggcguucuucgaggugg

SEQ ID NO: 2464430 - RNA, 18 nt, Human
aggcguggagcugccuga

SEQ ID NO: 2464431 - RNA, 17 nt, Human
aggcguggagcugccug

SEQ ID NO: 2464432 - RNA, 16 nt, Human
aggcguggagcugccu

SEQ ID NO: 2464433 - RNA, 15 nt, Human
aggcguggagcugcc

SEQ ID NO: 2464434 - RNA, 19 nt, Human
aggcguucuucgaggugga

SEQ ID NO: 2464435 - RNA, 18 nt, Human
aggcgucuguauauuuug

SEQ ID NO: 2464436 - RNA, 21 nt, Human
aggcgucuguauauuuuggga

SEQ ID NO: 2464437 - RNA, 21 nt, Human
aggcguccgcgcgccagcaca

SEQ ID NO: 2464438 - RNA, 21 nt, Human
aggcgugagccaccgugccug

SEQ ID NO: 2464439 - RNA, 14 nt, Human
aggcgugaggaugg

SEQ ID NO: 2464440 - RNA, 13 nt, Human
aggcgugaggaug

SEQ ID NO: 2464441 - RNA, 23 nt, Human
aggcccuucucuccagccccugg

SEQ ID NO: 2464442 - RNA, 22 nt, Human
aggcccuucucuccagccccug

SEQ ID NO: 2464443 - RNA, 17 nt, Human
aggcccuuuccucaggc

SEQ ID NO: 2464444 - RNA, 16 nt, Human
aggcccuuuccucagg

SEQ ID NO: 2464445 - RNA, 17 nt, Human
aggccgaagaagggucc

SEQ ID NO: 2464446 - RNA, 18 nt, Human
aggccgaagaaggguccu

SEQ ID NO: 2464447 - RNA, 22 nt, Human
aggccgaagaaggguccuuccc

SEQ ID NO: 2464448 - RNA, 18 nt, Human
aggccgcagcucuugccc

SEQ ID NO: 2464449 - RNA, 17 nt, Human
aggccgcagcucuugcc

SEQ ID NO: 2464450 - RNA, 24 nt, Human
aggccgaagcucuggcugaacccu

SEQ ID NO: 2464451 - RNA, 23 nt, Human
aggccgaagcucuggcugaaccc

SEQ ID NO: 2464452 - RNA, 19 nt, Human
aggccgaagcucuggcuga

SEQ ID NO: 2464453 - RNA, 17 nt, Human
aggccgaagcucuggcu

SEQ ID NO: 2464454 - RNA, 16 nt, Human
aggccgaagcucuggc

SEQ ID NO: 2464455 - RNA, 15 nt, Human
aggccgaagcucugg

SEQ ID NO: 2464456 - RNA, 14 nt, Human
aggccgaagcucug

SEQ ID NO: 2464457 - RNA, 16 nt, Human
aggccgcagcucuugc

SEQ ID NO: 2464458 - RNA, 13 nt, Human
aggccgcagcucu

SEQ ID NO: 2464459 - RNA, 12 nt, Human
aggccgcagcuc

SEQ ID NO: 2464460 - RNA, 16 nt, Human
aggccgagaagccagu

SEQ ID NO: 2464461 - RNA, 17 nt, Human
aggccgagaagccagug

SEQ ID NO: 2464462 - RNA, 15 nt, Human
aggccgagaagcaag

SEQ ID NO: 2464463 - RNA, 19 nt, Human
aggccgagaagcaagaaag

SEQ ID NO: 2464464 - RNA, 16 nt, Human
aggcccuuauuuucaa

SEQ ID NO: 2464465 - RNA, 20 nt, Human
aggcccuuauuuucaagaaa

SEQ ID NO: 2464466 - RNA, 22 nt, Human
aggcccuuauuuucaagaaacu

SEQ ID NO: 2464467 - RNA, 21 nt, Human
aggcccuucucuccagccccu

SEQ ID NO: 2464468 - RNA, 20 nt, Human
aggcccuucucuccagcccc

SEQ ID NO: 2464469 - RNA, 18 nt, Human
aggcccuuccucuccacu

SEQ ID NO: 2464470 - RNA, 17 nt, Human
aggcccuuccucuccac

SEQ ID NO: 2464471 - RNA, 15 nt, Human
aggcccuuccucucc

SEQ ID NO: 2464472 - RNA, 13 nt, Human
aggcccuuccucu

SEQ ID NO: 2464473 - RNA, 22 nt, Human
aggcugguucggauuuggggug

SEQ ID NO: 2464474 - RNA, 20 nt, Human
aggcugucaauuacaggaag

SEQ ID NO: 2464475 - RNA, 18 nt, Human
aggcuguaucccaugagc

SEQ ID NO: 2464476 - RNA, 13 nt, Human
aggcuguauccca

SEQ ID NO: 2464477 - RNA, 16 nt, Human
aggcuagauguaugua

SEQ ID NO: 2464478 - RNA, 15 nt, Human
aggcuagauguaugu

SEQ ID NO: 2464479 - RNA, 17 nt, Human
aggcuagauguauguac

SEQ ID NO: 2464480 - RNA, 17 nt, Human
aggcuggugggaggggc

SEQ ID NO: 2464481 - RNA, 14 nt, Human
aggcuggugggagg

SEQ ID NO: 2464482 - RNA, 12 nt, Human
aggcugguggga

SEQ ID NO: 2464483 - RNA, 17 nt, Human
aggcugguggcccagga

SEQ ID NO: 2464484 - RNA, 16 nt, Human
aggcugguggcccagg

SEQ ID NO: 2464485 - RNA, 15 nt, Human
aggcugguggcccag

SEQ ID NO: 2464486 - RNA, 20 nt, Human
aggcuagagugcaguggcau

SEQ ID NO: 2464487 - RNA, 15 nt, Human
aggcuagaucaugaa

SEQ ID NO: 2464488 - RNA, 21 nt, Human
aggcugucaauuacaggaagu

SEQ ID NO: 2464489 - RNA, 16 nt, Human
aggcuguccuguacau

SEQ ID NO: 2464490 - RNA, 15 nt, Human
aggcuguccuguaca

SEQ ID NO: 2464491 - RNA, 18 nt, Human
aggcuggugggaggggcg

SEQ ID NO: 2464492 - RNA, 22 nt, Human
agggacagaggggguggccucc

SEQ ID NO: 2464493 - RNA, 15 nt, Human
aggcugucuggccag

SEQ ID NO: 2464494 - RNA, 21 nt, Human
aggcuguccuguacauugugg

SEQ ID NO: 2464495 - RNA, 19 nt, Human
aggcuguccuuacccaucu

SEQ ID NO: 2464496 - RNA, 21 nt, Human
aggcuguccuuacccaucugc

SEQ ID NO: 2464497 - RNA, 23 nt, Human
agggacagaggggguggccuccc

SEQ ID NO: 2464498 - RNA, 22 nt, Human
agggacagaugaaugccgugga

SEQ ID NO: 2464499 - RNA, 17 nt, Human
aggcugucuggccaggc

SEQ ID NO: 2464500 - RNA, 14 nt, Human
agggaccuugaagg

SEQ ID NO: 2464501 - RNA, 16 nt, Human
agggaccucucccagg

SEQ ID NO: 2464502 - RNA, 13 nt, Human
agggaccucuccc

SEQ ID NO: 2464503 - RNA, 15 nt, Human
agggaccucucccag

SEQ ID NO: 2464504 - RNA, 23 nt, Human
agggacgccugggggugccagga

SEQ ID NO: 2464505 - RNA, 18 nt, Human
agggacgccugggggugc

SEQ ID NO: 2464506 - RNA, 22 nt, Human
agggacgccugggggugccagg

SEQ ID NO: 2464507 - RNA, 13 nt, Human
agggacgccuggg

SEQ ID NO: 2464508 - RNA, 15 nt, Human
agggacgccuggggg

SEQ ID NO: 2464509 - RNA, 15 nt, Human
agggaccuugaaggg

SEQ ID NO: 2464510 - RNA, 16 nt, Human
auaccugugccucggc

SEQ ID NO: 2464511 - RNA, 14 nt, Human
auaccucugugugc

SEQ ID NO: 2464512 - RNA, 20 nt, Human
auaccuuccuucccugggcu

SEQ ID NO: 2464513 - RNA, 17 nt, Human
auaccuacauguauuug

SEQ ID NO: 2464514 - RNA, 21 nt, Human
auaccuacauguauuuguuug

SEQ ID NO: 2464515 - RNA, 12 nt, Human
auacccaccccc

SEQ ID NO: 2464516 - RNA, 14 nt, Human
auacccaaauccuc

SEQ ID NO: 2464517 - RNA, 22 nt, Human
auaccauuuuuuaaggaaacaa

SEQ ID NO: 2464518 - RNA, 20 nt, Human
auaccauuuuuuaaggaaac

SEQ ID NO: 2464519 - RNA, 23 nt, Human
auacccaaauccucuccagcuau

SEQ ID NO: 2464520 - RNA, 18 nt, Human
auacccaaauccucucca

SEQ ID NO: 2464521 - RNA, 11 nt, Human
auacccacccc

SEQ ID NO: 2464522 - RNA, 18 nt, Human
auaccugucccccugaca

SEQ ID NO: 2464523 - RNA, 13 nt, Human
auaccucugugug

SEQ ID NO: 2464524 - RNA, 12 nt, Human
auaccucugugu

SEQ ID NO: 2464525 - RNA, 17 nt, Human
auaccugucccccugac

SEQ ID NO: 2464526 - RNA, 15 nt, Human
auaccucacccugcu

SEQ ID NO: 2464527 - RNA, 15 nt, Human
auaccucaaccuaug

SEQ ID NO: 2464528 - RNA, 18 nt, Human
auaccucaaccuauggua

SEQ ID NO: 2464529 - RNA, 17 nt, Human
auacacacucaaaucaa

SEQ ID NO: 2464530 - RNA, 18 nt, Human
auacacacucaaaucaag

SEQ ID NO: 2464531 - RNA, 18 nt, Human
auacaccacuacauucug

SEQ ID NO: 2464532 - RNA, 20 nt, Human
auacacacucaaaucaagaa

SEQ ID NO: 2464533 - RNA, 19 nt, Human
auacacacauaugucauau

SEQ ID NO: 2464534 - RNA, 21 nt, Human
auacaccacuacauucuguua

SEQ ID NO: 2464535 - RNA, 19 nt, Human
auacaccacuacauucugu

SEQ ID NO: 2464536 - RNA, 20 nt, Human
auacaccacuacauucuguu

SEQ ID NO: 2464537 - RNA, 18 nt, Human
auaaugggcuuagagcag

SEQ ID NO: 2464538 - RNA, 22 nt, Human
auaauguauaaagaacaaggua

SEQ ID NO: 2464539 - RNA, 15 nt, Human
auaauguaagcucua

SEQ ID NO: 2464540 - RNA, 23 nt, Human
auaauguuucaaacauauauaac

SEQ ID NO: 2464541 - RNA, 11 nt, Human
auaaugucucu

SEQ ID NO: 2464542 - RNA, 14 nt, Human
auaauguauuguug

SEQ ID NO: 2464543 - RNA, 22 nt, Human
auacacacacacacacagccac

SEQ ID NO: 2464544 - RNA, 23 nt, Human
auacacacacacacacagccaca

SEQ ID NO: 2464545 - RNA, 13 nt, Human
auacacacaguua

SEQ ID NO: 2464546 - RNA, 14 nt, Human
auacacacauaugu

SEQ ID NO: 2464547 - RNA, 21 nt, Human
auacacacacacacacagcca

SEQ ID NO: 2464548 - RNA, 20 nt, Human
auaauuaaauuuugaguucu

SEQ ID NO: 2464549 - RNA, 20 nt, Human
auaauuaaaguguccauuga

SEQ ID NO: 2464550 - RNA, 16 nt, Human
auaauuaaagugucca

SEQ ID NO: 2464551 - RNA, 15 nt, Human
auaaugucucuguga

SEQ ID NO: 2464552 - RNA, 13 nt, Human
auaauguuugcua

SEQ ID NO: 2464553 - RNA, 15 nt, Human
auaauuaaagugucc

SEQ ID NO: 2464554 - RNA, 13 nt, Human
auaauuaaagugu

SEQ ID NO: 2464555 - RNA, 12 nt, Human
auaauuaaagug

SEQ ID NO: 2464556 - RNA, 14 nt, Human
auaauguuugcuau

SEQ ID NO: 2464557 - RNA, 21 nt, Human
auaaugcgugcauaccacuuu

SEQ ID NO: 2464558 - RNA, 20 nt, Human
auaaugcgugcauaccacuu

SEQ ID NO: 2464559 - RNA, 16 nt, Human
auaaggccuuaauaug

SEQ ID NO: 2464560 - RNA, 21 nt, Human
auaaugggauuuucuuuucuu

SEQ ID NO: 2464561 - RNA, 14 nt, Human
auaauguaagcucu

SEQ ID NO: 2464562 - RNA, 15 nt, Human
auaaugcuacugucu

SEQ ID NO: 2464563 - RNA, 18 nt, Human
auaaugcuguugccucau

SEQ ID NO: 2464564 - RNA, 19 nt, Human
auaaggccauaaaacaggu

SEQ ID NO: 2464565 - RNA, 14 nt, Human
auaaggaucagaac

SEQ ID NO: 2464566 - RNA, 20 nt, Human
auaaggaucagaacagcaga

SEQ ID NO: 2464567 - RNA, 22 nt, Human
auaaggaucagaacagcagagg

SEQ ID NO: 2464568 - RNA, 18 nt, Human
auaaggaaagcaauaaau

SEQ ID NO: 2464569 - RNA, 14 nt, Human
auaacaacuucaua

SEQ ID NO: 2464570 - RNA, 15 nt, Human
auaacaaccuggaga

SEQ ID NO: 2464571 - RNA, 14 nt, Human
auaacaagaucuuu

SEQ ID NO: 2464572 - RNA, 20 nt, Human
auaacagugcauauuccuuu

SEQ ID NO: 2464573 - RNA, 18 nt, Human
auaaaggauuaaugucaa

SEQ ID NO: 2464574 - RNA, 22 nt, Human
auaaauuuuuuuuguuucauau

SEQ ID NO: 2464575 - RNA, 19 nt, Human
auaaauuuuuuuuguuuca

SEQ ID NO: 2464576 - RNA, 15 nt, Human
auaaaagaaaaaaua

SEQ ID NO: 2464577 - RNA, 16 nt, Human
auaaaaauauguacaa

SEQ ID NO: 2464578 - RNA, 22 nt, Human
auaaaaauauuguguugugaau

SEQ ID NO: 2464579 - RNA, 17 nt, Human
auaaaacuuuuuaaaau

SEQ ID NO: 2464580 - RNA, 21 nt, Human
auaaacuuuaccuuuuuuaua

SEQ ID NO: 2464581 - RNA, 16 nt, Human
auaaacuuuaccuuuu

SEQ ID NO: 2464582 - RNA, 24 nt, Human
auaaacuuuaccuuuuuuauacau

SEQ ID NO: 2464583 - RNA, 20 nt, Human
auaaacuuuuuucuuacugu

SEQ ID NO: 2464584 - RNA, 23 nt, Human
auaaacuuuuuuuugagaauggu

SEQ ID NO: 2464585 - RNA, 15 nt, Human
auaaaacuuuuuaaa

SEQ ID NO: 2464586 - RNA, 11 nt, Human
auaaaacuuuu

SEQ ID NO: 2464587 - RNA, 13 nt, Human
auaaaaaguuaaa

SEQ ID NO: 2464588 - RNA, 18 nt, Human
auaaaaaguuaaaaaguu

SEQ ID NO: 2464589 - RNA, 13 nt, Human
auaaaaauaaauu

SEQ ID NO: 2464590 - RNA, 14 nt, Human
auaaaaauauugug

SEQ ID NO: 2464591 - RNA, 22 nt, Human
auaaaaauaaauuugguucuaa

SEQ ID NO: 2464592 - RNA, 11 nt, Human
auaaaaaguua

SEQ ID NO: 2464593 - RNA, 12 nt, Human
auaaaaaguuaa

SEQ ID NO: 2464594 - RNA, 10 nt, Human
auaaaaaguu

SEQ ID NO: 2464595 - RNA, 20 nt, Human
auaaaaagugacacagcagc

SEQ ID NO: 2464596 - RNA, 19 nt, Human
auaaaaagugacacagcag

SEQ ID NO: 2464597 - RNA, 21 nt, Human
auaaaaaggcaccuauaaaac

SEQ ID NO: 2464598 - RNA, 17 nt, Human
auaaaaagugacacagc

SEQ ID NO: 2464599 - RNA, 14 nt, Human
auaaagcagcguuu

SEQ ID NO: 2464600 - RNA, 18 nt, Human
auaaagcagcguuucuau

SEQ ID NO: 2464601 - RNA, 19 nt, Human
auaaagcagcguuucuaug

SEQ ID NO: 2464602 - RNA, 20 nt, Human
auaaagcagcguuucuauga

SEQ ID NO: 2464603 - RNA, 13 nt, Human
auaaagcagcguu

SEQ ID NO: 2464604 - RNA, 21 nt, Human
auaaagcaauuuuccuugaag

SEQ ID NO: 2464605 - RNA, 20 nt, Human
auaaagcaauuuuccuugaa

SEQ ID NO: 2464606 - RNA, 19 nt, Human
auaaagcaauuuuccuuga

SEQ ID NO: 2464607 - RNA, 14 nt, Human
auaaagaagauguu

SEQ ID NO: 2464608 - RNA, 21 nt, Human
auaaagaacaagguaguuuuu

SEQ ID NO: 2464609 - RNA, 17 nt, Human
auaaagaaauugcaaua

SEQ ID NO: 2464610 - RNA, 15 nt, Human
auaaagaacaaggua

SEQ ID NO: 2464611 - RNA, 23 nt, Human
auaaagaagcaauaaagaagagu

SEQ ID NO: 2464612 - RNA, 12 nt, Human
auaaagacaccu

SEQ ID NO: 2464613 - RNA, 14 nt, Human
auaaaggaugugau

SEQ ID NO: 2464614 - RNA, 17 nt, Human
auaaaggaugugauugu

SEQ ID NO: 2464615 - RNA, 21 nt, Human
auaaaggaugugauuguggaa

SEQ ID NO: 2464616 - RNA, 22 nt, Human
auaaaggaugugauuguggaau

SEQ ID NO: 2464617 - RNA, 13 nt, Human
auaaaggauguga

SEQ ID NO: 2464618 - RNA, 18 nt, Human
auaaagcuguguggcagu

SEQ ID NO: 2464619 - RNA, 20 nt, Human
auaaaggaaaaaagagaagu

SEQ ID NO: 2464620 - RNA, 18 nt, Human
auaaagccuguauucuca

SEQ ID NO: 2464621 - RNA, 20 nt, Human
auaaagccuuggauguauau

SEQ ID NO: 2464622 - RNA, 15 nt, Human
auaaagcaggcagaa

SEQ ID NO: 2464623 - RNA, 23 nt, Human
auaaagcaauuuuccuugaagcc

SEQ ID NO: 2464624 - RNA, 16 nt, Human
auaaagccacugaaaa

SEQ ID NO: 2464625 - RNA, 20 nt, Human
auaaagccuguuuugucuuu

SEQ ID NO: 2464626 - RNA, 14 nt, Human
auaaagccugcuuu

SEQ ID NO: 2464627 - RNA, 14 nt, Human
auaaagcauuuaua

SEQ ID NO: 2464628 - RNA, 12 nt, Human
auaaagccacug

SEQ ID NO: 2464629 - RNA, 18 nt, Human
auaaagcauuuauaaauu

SEQ ID NO: 2464630 - RNA, 20 nt, Human
auaaagcccugggaucacug

SEQ ID NO: 2464631 - RNA, 14 nt, Human
auaaagcccuggga

SEQ ID NO: 2464632 - RNA, 14 nt, Human
auauacuguaaaga

SEQ ID NO: 2464633 - RNA, 15 nt, Human
auauacuguaaagaa

SEQ ID NO: 2464634 - RNA, 18 nt, Human
auauacuguaaagaaaga

SEQ ID NO: 2464635 - RNA, 19 nt, Human
auauacuguaaagaaagag

SEQ ID NO: 2464636 - RNA, 20 nt, Human
auauacuguaaagaaagaga

SEQ ID NO: 2464637 - RNA, 21 nt, Human
auauacuguaaagaaagagag

SEQ ID NO: 2464638 - RNA, 22 nt, Human
auauacuguaaagaaagagaga

SEQ ID NO: 2464639 - RNA, 23 nt, Human
auauacuguaaagaaagagagaa

SEQ ID NO: 2464640 - RNA, 15 nt, Human
auauacuuaaaugga

SEQ ID NO: 2464641 - RNA, 24 nt, Human
auauacuguaaagaaagagagaaa

SEQ ID NO: 2464642 - RNA, 15 nt, Human
auauacuuguggacu

SEQ ID NO: 2464643 - RNA, 14 nt, Human
auauacuuguggac

SEQ ID NO: 2464644 - RNA, 21 nt, Human
auauacuuguggacuaaaaga

SEQ ID NO: 2464645 - RNA, 10 nt, Human
auauacugua

SEQ ID NO: 2464646 - RNA, 11 nt, Human
auauacuguaa

SEQ ID NO: 2464647 - RNA, 12 nt, Human
auauacuguaaa

SEQ ID NO: 2464648 - RNA, 13 nt, Human
auauacuguaaag

SEQ ID NO: 2464649 - RNA, 22 nt, Human
auagucaaaccauaaacuucau

SEQ ID NO: 2464650 - RNA, 20 nt, Human
auagucaaaccauaaacuuc

SEQ ID NO: 2464651 - RNA, 19 nt, Human
auagucaaaccauaaacuu

SEQ ID NO: 2464652 - RNA, 22 nt, Human
auauacucuagaugaaguuuua

SEQ ID NO: 2464653 - RNA, 14 nt, Human
auagucaaauugug

SEQ ID NO: 2464654 - RNA, 23 nt, Human
auaguauuugagaguucuaaauu

SEQ ID NO: 2464655 - RNA, 23 nt, Human
auauagaucaguuauaaguagca

SEQ ID NO: 2464656 - RNA, 16 nt, Human
auauagagauguuuuu

SEQ ID NO: 2464657 - RNA, 15 nt, Human
auauagagauguuuu

SEQ ID NO: 2464658 - RNA, 22 nt, Human
auauagagauguuuuuaaaagu

SEQ ID NO: 2464659 - RNA, 20 nt, Human
auauacuuuuuuuucuuuaa

SEQ ID NO: 2464660 - RNA, 11 nt, Human
auauacuuuuu

SEQ ID NO: 2464661 - RNA, 15 nt, Human
auauagaacagugcu

SEQ ID NO: 2464662 - RNA, 22 nt, Human
auauacuuuuuucuuauuuaac

SEQ ID NO: 2464663 - RNA, 14 nt, Human
auauagagauguuu

SEQ ID NO: 2464664 - RNA, 13 nt, Human
auauagagauguu

SEQ ID NO: 2464665 - RNA, 15 nt, Human
auaggugcuacaaaa

SEQ ID NO: 2464666 - RNA, 21 nt, Human
auaggugcuacaaaaacacag

SEQ ID NO: 2464667 - RNA, 23 nt, Human
auaggugcuacaaaaacacagca

SEQ ID NO: 2464668 - RNA, 13 nt, Human
auagguggccucu

SEQ ID NO: 2464669 - RNA, 14 nt, Human
auaggugcuacaaa

SEQ ID NO: 2464670 - RNA, 22 nt, Human
auaggucacuggcucuccaagu

SEQ ID NO: 2464671 - RNA, 23 nt, Human
auaggucagugaggcccagggag

SEQ ID NO: 2464672 - RNA, 21 nt, Human
auagguauaaguggugugugu

SEQ ID NO: 2464673 - RNA, 18 nt, Human
auagcccaucccugccug

SEQ ID NO: 2464674 - RNA, 17 nt, Human
auagcccaucccugccu

SEQ ID NO: 2464675 - RNA, 21 nt, Human
auaggucacuggcucuccaag

SEQ ID NO: 2464676 - RNA, 20 nt, Human
auaggucacuggcucuccaa

SEQ ID NO: 2464677 - RNA, 19 nt, Human
auaggucacuggcucucca

SEQ ID NO: 2464678 - RNA, 17 nt, Human
auaggucacuggcucuc

SEQ ID NO: 2464679 - RNA, 16 nt, Human
auaggucacuggcucu

SEQ ID NO: 2464680 - RNA, 15 nt, Human
auaggucacuggcuc

SEQ ID NO: 2464681 - RNA, 15 nt, Human
auaggucacuccugg

SEQ ID NO: 2464682 - RNA, 16 nt, Human
auaggucacuccuggg

SEQ ID NO: 2464683 - RNA, 15 nt, Human
auagguuuaauaauu

SEQ ID NO: 2464684 - RNA, 20 nt, Human
auagguugccaauaauacac

SEQ ID NO: 2464685 - RNA, 18 nt, Human
auagguuguaaauguguu

SEQ ID NO: 2464686 - RNA, 21 nt, Human
auaguauuugagaguucuaaa

SEQ ID NO: 2464687 - RNA, 20 nt, Human
auaguauuugagaguucuaa

SEQ ID NO: 2464688 - RNA, 21 nt, Human
auaguauuccauugugugagu

SEQ ID NO: 2464689 - RNA, 22 nt, Human
auaguauuccauugugugagug

SEQ ID NO: 2464690 - RNA, 18 nt, Human
auaguaugguggcugggu

SEQ ID NO: 2464691 - RNA, 17 nt, Human
auaguaugguggcuggg

SEQ ID NO: 2464692 - RNA, 18 nt, Human
auagcagcuuauucacaa

SEQ ID NO: 2464693 - RNA, 12 nt, Human
auagcccagaca

SEQ ID NO: 2464694 - RNA, 17 nt, Human
auagcccagacacagaa

SEQ ID NO: 2464695 - RNA, 13 nt, Human
auagcccagacac

SEQ ID NO: 2464696 - RNA, 14 nt, Human
auagcccagaucag

SEQ ID NO: 2464697 - RNA, 16 nt, Human
auagcccaucccugcc

SEQ ID NO: 2464698 - RNA, 14 nt, Human
auagcccagguccu

SEQ ID NO: 2464699 - RNA, 22 nt, Human
auagccacaucccuuugaaaca

SEQ ID NO: 2464700 - RNA, 23 nt, Human
auagccacauuuggaauacuuuu

SEQ ID NO: 2464701 - RNA, 16 nt, Human
auagccaccccagaaa

SEQ ID NO: 2464702 - RNA, 19 nt, Human
auagccacuuaccuucaau

SEQ ID NO: 2464703 - RNA, 21 nt, Human
auagccacuuaccuucaauaa

SEQ ID NO: 2464704 - RNA, 23 nt, Human
auagccacuuaccuucaauaaag

SEQ ID NO: 2464705 - RNA, 13 nt, Human
auagccacauuug

SEQ ID NO: 2464706 - RNA, 16 nt, Human
auagccacauuuggaa

SEQ ID NO: 2464707 - RNA, 21 nt, Human
auagccacauuuggaauacuu

SEQ ID NO: 2464708 - RNA, 22 nt, Human
auagccacauuuggaauacuuu

SEQ ID NO: 2464709 - RNA, 21 nt, Human
auagccaaggccaaaggaagc

SEQ ID NO: 2464710 - RNA, 15 nt, Human
auagccaaggccaaa

SEQ ID NO: 2464711 - RNA, 14 nt, Human
auaucaaaaagacu

SEQ ID NO: 2464712 - RNA, 16 nt, Human
auaucaaauauauuca

SEQ ID NO: 2464713 - RNA, 21 nt, Human
auaucaacagauaguuguguu

SEQ ID NO: 2464714 - RNA, 17 nt, Human
auaucaucaguauugaa

SEQ ID NO: 2464715 - RNA, 22 nt, Human
auaucaucaguauugaagcauu

SEQ ID NO: 2464716 - RNA, 21 nt, Human
auaucaugagugaauaaaugu

SEQ ID NO: 2464717 - RNA, 23 nt, Human
auaucauuauaacugaaggagaa

SEQ ID NO: 2464718 - RNA, 12 nt, Human
auauccaaaagc

SEQ ID NO: 2464719 - RNA, 19 nt, Human
auauccaaaagcuuuuuau

SEQ ID NO: 2464720 - RNA, 23 nt, Human
auaucauuuauuuuuuacauuau

SEQ ID NO: 2464721 - RNA, 21 nt, Human
auaucauuuauuuuuuacauu

SEQ ID NO: 2464722 - RNA, 22 nt, Human
auaugcuucuguuuuauaauuu

SEQ ID NO: 2464723 - RNA, 20 nt, Human
auaugcuucuguuuuauaau

SEQ ID NO: 2464724 - RNA, 21 nt, Human
auaugcuuauacacuuacacu

SEQ ID NO: 2464725 - RNA, 19 nt, Human
auauuaccacagacauacu

SEQ ID NO: 2464726 - RNA, 22 nt, Human
auauuaccacagacauacuaac

SEQ ID NO: 2464727 - RNA, 16 nt, Human
auauuacuagcauaug

SEQ ID NO: 2464728 - RNA, 15 nt, Human
auauuauauauauau

SEQ ID NO: 2464729 - RNA, 14 nt, Human
auauuagaaguguu

SEQ ID NO: 2464730 - RNA, 23 nt, Human
auauuaugaagcuuuuaugugaa

SEQ ID NO: 2464731 - RNA, 19 nt, Human
auauuaucaugcaaaugcu

SEQ ID NO: 2464732 - RNA, 21 nt, Human
auauuaucaugcaaaugcugu

SEQ ID NO: 2464733 - RNA, 16 nt, Human
auauuauguuaaaacu

SEQ ID NO: 2464734 - RNA, 21 nt, Human
auauuauguauuuauauuuug

SEQ ID NO: 2464735 - RNA, 13 nt, Human
auauuauguguuu

SEQ ID NO: 2464736 - RNA, 16 nt, Human
auauuauggaagauuu

SEQ ID NO: 2464737 - RNA, 22 nt, Human
auauuauuaguuuugauuuaau

SEQ ID NO: 2464738 - RNA, 19 nt, Human
auauuauuaguuuugauuu

SEQ ID NO: 2464739 - RNA, 13 nt, Human
auauuauuucuag

SEQ ID NO: 2464740 - RNA, 17 nt, Human
auauuauucauucauuu

SEQ ID NO: 2464741 - RNA, 13 nt, Human
auauuuauuuuaa

SEQ ID NO: 2464742 - RNA, 14 nt, Human
auauuuauugcuuu

SEQ ID NO: 2464743 - RNA, 13 nt, Human
auauuuauugcuu

SEQ ID NO: 2464744 - RNA, 12 nt, Human
auauuuauugcu

SEQ ID NO: 2464745 - RNA, 19 nt, Human
auauuuacuucuuauacau

SEQ ID NO: 2464746 - RNA, 23 nt, Human
auauuuacuaagccacaagaaau

SEQ ID NO: 2464747 - RNA, 23 nt, Human
auauuuauuauuuucaccuguuu

SEQ ID NO: 2464748 - RNA, 22 nt, Human
auauuauuucuaggaagaauuu

SEQ ID NO: 2464749 - RNA, 20 nt, Human
auauuauuucuaggaagaau

SEQ ID NO: 2464750 - RNA, 14 nt, Human
auauuauuucuagg

SEQ ID NO: 2464751 - RNA, 16 nt, Human
auauuuacauaugaaa

SEQ ID NO: 2464752 - RNA, 18 nt, Human
auauuuacauaugaaauu

SEQ ID NO: 2464753 - RNA, 19 nt, Human
auauuuacauaugaaauuu

SEQ ID NO: 2464754 - RNA, 20 nt, Human
auauuuacauaugaaauuua

SEQ ID NO: 2464755 - RNA, 15 nt, Human
auauuuacauaugaa

SEQ ID NO: 2464756 - RNA, 21 nt, Human
auauuuacaugaauugcauuu

SEQ ID NO: 2464757 - RNA, 14 nt, Human
auauuuacguauga

SEQ ID NO: 2464758 - RNA, 20 nt, Human
aguuguuugauucagacagc

SEQ ID NO: 2464759 - RNA, 11 nt, Human
aguuguuugau

SEQ ID NO: 2464760 - RNA, 13 nt, Human
aguuguuugaugc

SEQ ID NO: 2464761 - RNA, 16 nt, Human
aguuguuucauugacu

SEQ ID NO: 2464762 - RNA, 19 nt, Human
aguuguuucauugacuauc

SEQ ID NO: 2464763 - RNA, 19 nt, Human
aguuguuggccuccggccu

SEQ ID NO: 2464764 - RNA, 13 nt, Human
aguuguuucauug

SEQ ID NO: 2464765 - RNA, 15 nt, Human
aguuguuucauugac

SEQ ID NO: 2464766 - RNA, 15 nt, Human
aguuguuggccuccg

SEQ ID NO: 2464767 - RNA, 14 nt, Human
aguuguuggccucc

SEQ ID NO: 2464768 - RNA, 13 nt, Human
aguuguuggccuc

SEQ ID NO: 2464769 - RNA, 15 nt, Human
aguuguugcccuggg

SEQ ID NO: 2464770 - RNA, 14 nt, Human
aguugaagacagag

SEQ ID NO: 2464771 - RNA, 18 nt, Human
aguuguggaaagccucug

SEQ ID NO: 2464772 - RNA, 19 nt, Human
aguuguggaaagccucugc

SEQ ID NO: 2464773 - RNA, 20 nt, Human
aguuguggaaagccucugcu

SEQ ID NO: 2464774 - RNA, 21 nt, Human
aguuguggaaagccucugcug

SEQ ID NO: 2464775 - RNA, 19 nt, Human
aguuguggugcugacaaag

SEQ ID NO: 2464776 - RNA, 17 nt, Human
aguugugggugggagag

SEQ ID NO: 2464777 - RNA, 20 nt, Human
aguuguggagagugcaacag

SEQ ID NO: 2464778 - RNA, 20 nt, Human
aguuguggugcugacaaagc

SEQ ID NO: 2464779 - RNA, 23 nt, Human
aguugaaaaucuuauaauuuaaa

SEQ ID NO: 2464780 - RNA, 22 nt, Human
aguugaaaagacuccaaagaaa

SEQ ID NO: 2464781 - RNA, 23 nt, Human
aguugaacugauaguuacuguug

SEQ ID NO: 2464782 - RNA, 13 nt, Human
aguugaacugaua

SEQ ID NO: 2464783 - RNA, 20 nt, Human
aguguuuuuguaaagugugg

SEQ ID NO: 2464784 - RNA, 21 nt, Human
aguguuuuuaccucugucuug

SEQ ID NO: 2464785 - RNA, 17 nt, Human
aguguuuuuaccucugu

SEQ ID NO: 2464786 - RNA, 16 nt, Human
aguguuuuuaccucug

SEQ ID NO: 2464787 - RNA, 14 nt, Human
aguuaaacauaaau

SEQ ID NO: 2464788 - RNA, 13 nt, Human
aguuaaagcagug

SEQ ID NO: 2464789 - RNA, 15 nt, Human
aguguuuuuguaaag

SEQ ID NO: 2464790 - RNA, 14 nt, Human
aguguuuuuguaaa

SEQ ID NO: 2464791 - RNA, 18 nt, Human
aguguuuuuguaaagugu

SEQ ID NO: 2464792 - RNA, 14 nt, Human
aguuaagccuuugg

SEQ ID NO: 2464793 - RNA, 15 nt, Human
aguuaagugaauguc

SEQ ID NO: 2464794 - RNA, 21 nt, Human
aguuaauauaucccagaaauu

SEQ ID NO: 2464795 - RNA, 20 nt, Human
aguuaauauaucccagaaau

SEQ ID NO: 2464796 - RNA, 15 nt, Human
aguuaauauugugaa

SEQ ID NO: 2464797 - RNA, 13 nt, Human
aguuaagccuuug

SEQ ID NO: 2464798 - RNA, 16 nt, Human
aguuaaagugaauaac

SEQ ID NO: 2464799 - RNA, 12 nt, Human
aguuaaauaaau

SEQ ID NO: 2464800 - RNA, 16 nt, Human
aguuacagacaaagcg

SEQ ID NO: 2464801 - RNA, 14 nt, Human
aguuacagacaaag

SEQ ID NO: 2464802 - RNA, 18 nt, Human
aguuacacuaaaagguga

SEQ ID NO: 2464803 - RNA, 20 nt, Human
aguuaaugaugguugauggg

SEQ ID NO: 2464804 - RNA, 17 nt, Human
aguuacagacaaagcgu

SEQ ID NO: 2464805 - RNA, 19 nt, Human
aguucagguaacaggcaga

SEQ ID NO: 2464806 - RNA, 20 nt, Human
aguucagguaacaggcagau

SEQ ID NO: 2464807 - RNA, 16 nt, Human
aguuacagaaaguggu

SEQ ID NO: 2464808 - RNA, 15 nt, Human
aguuacagaaagugg

SEQ ID NO: 2464809 - RNA, 13 nt, Human
aguuacagaaagu

SEQ ID NO: 2464810 - RNA, 12 nt, Human
aguuacagaaag

SEQ ID NO: 2464811 - RNA, 19 nt, Human
aguucagguagcugccccu

SEQ ID NO: 2464812 - RNA, 20 nt, Human
aguucagguagcugccccug

SEQ ID NO: 2464813 - RNA, 21 nt, Human
aguucagguagcugccccugg

SEQ ID NO: 2464814 - RNA, 18 nt, Human
aguucauaaauuuauggu

SEQ ID NO: 2464815 - RNA, 24 nt, Human
aguucaguuccucuuugcauggaa

SEQ ID NO: 2464816 - RNA, 23 nt, Human
aguucaguuccucuuugcaugga

SEQ ID NO: 2464817 - RNA, 20 nt, Human
aguucaguuccucuuugcau

SEQ ID NO: 2464818 - RNA, 16 nt, Human
aguucaguuccucuuu

SEQ ID NO: 2464819 - RNA, 23 nt, Human
aguucaguggcagggcucaggau

SEQ ID NO: 2464820 - RNA, 22 nt, Human
aguucaguggcagggcucagga

SEQ ID NO: 2464821 - RNA, 21 nt, Human
aguucaguggcagggcucagg

SEQ ID NO: 2464822 - RNA, 19 nt, Human
aguucaguggcagggcuca

SEQ ID NO: 2464823 - RNA, 18 nt, Human
aguucaguggcagggcuc

SEQ ID NO: 2464824 - RNA, 13 nt, Human
aguucaguggcag

SEQ ID NO: 2464825 - RNA, 19 nt, Human
aguucaguggcacucaaca

SEQ ID NO: 2464826 - RNA, 11 nt, Human
aguucaguggc

SEQ ID NO: 2464827 - RNA, 20 nt, Human
aguucaguaccuggaggagg

SEQ ID NO: 2464828 - RNA, 19 nt, Human
aguucaguaccuggaggag

SEQ ID NO: 2464829 - RNA, 17 nt, Human
aguucaguaccuggagg

SEQ ID NO: 2464830 - RNA, 16 nt, Human
aguucaguaccuggag

SEQ ID NO: 2464831 - RNA, 15 nt, Human
aguucaguaccugga

SEQ ID NO: 2464832 - RNA, 14 nt, Human
aguucaguaccugg

SEQ ID NO: 2464833 - RNA, 22 nt, Human
aguugaaaaucuuauaauuuaa

SEQ ID NO: 2464834 - RNA, 21 nt, Human
aguugaaaagacuccaaagaa

SEQ ID NO: 2464835 - RNA, 13 nt, Human
aguucaugagaau

SEQ ID NO: 2464836 - RNA, 21 nt, Human
aguucaugagaaucuauauuu

SEQ ID NO: 2464837 - RNA, 23 nt, Human
aguucauguuugcuucauaaaug

SEQ ID NO: 2464838 - RNA, 19 nt, Human
aguucaguuuuaccagaug

SEQ ID NO: 2464839 - RNA, 17 nt, Human
aguucauguuugcuuca

SEQ ID NO: 2464840 - RNA, 17 nt, Human
agugucuuaauuaaaag

SEQ ID NO: 2464841 - RNA, 18 nt, Human
agugucuuaauuaaaaga

SEQ ID NO: 2464842 - RNA, 21 nt, Human
agugucuuaauuaaaagaaua

SEQ ID NO: 2464843 - RNA, 14 nt, Human
aguguccuuagaac

SEQ ID NO: 2464844 - RNA, 16 nt, Human
aguguauggaaauaaa

SEQ ID NO: 2464845 - RNA, 18 nt, Human
aguguaugacugcacaug

SEQ ID NO: 2464846 - RNA, 20 nt, Human
aguguauggaaauaaaugua

SEQ ID NO: 2464847 - RNA, 21 nt, Human
aguguauggaaauaaauguau

SEQ ID NO: 2464848 - RNA, 22 nt, Human
aguguauggaaauaaauguauc

SEQ ID NO: 2464849 - RNA, 17 nt, Human
aguguaugcacgugugc

SEQ ID NO: 2464850 - RNA, 14 nt, Human
agugggagcugccu

SEQ ID NO: 2464851 - RNA, 22 nt, Human
aguggcuucauuagagcaggcg

SEQ ID NO: 2464852 - RNA, 21 nt, Human
aguggcuucauuagagcaggc

SEQ ID NO: 2464853 - RNA, 20 nt, Human
aguggcuucauuagagcagg

SEQ ID NO: 2464854 - RNA, 12 nt, Human
agugggagaaaa

SEQ ID NO: 2464855 - RNA, 13 nt, Human
agugggagaaaac

SEQ ID NO: 2464856 - RNA, 17 nt, Human
agugggagaaaacacuu

SEQ ID NO: 2464857 - RNA, 15 nt, Human
agugggagcugccug

SEQ ID NO: 2464858 - RNA, 16 nt, Human
agugggagcugccugu

SEQ ID NO: 2464859 - RNA, 14 nt, Human
agugggagccaggg

SEQ ID NO: 2464860 - RNA, 14 nt, Human
aguguauaucagaa

SEQ ID NO: 2464861 - RNA, 14 nt, Human
agugggagaaaaca

SEQ ID NO: 2464862 - RNA, 17 nt, Human
aguguauuuuuuuacua

SEQ ID NO: 2464863 - RNA, 18 nt, Human
aguguauuuuuuuacuaa

SEQ ID NO: 2464864 - RNA, 20 nt, Human
aguguccaaagcagggucug

SEQ ID NO: 2464865 - RNA, 17 nt, Human
aguguccaaagcagggu

SEQ ID NO: 2464866 - RNA, 14 nt, Human
aguguccaaagcag

SEQ ID NO: 2464867 - RNA, 15 nt, Human
agugucaaguugugc

SEQ ID NO: 2464868 - RNA, 14 nt, Human
agugucaaguugug

SEQ ID NO: 2464869 - RNA, 20 nt, Human
agugucaaauaaacacugug

SEQ ID NO: 2464870 - RNA, 21 nt, Human
agugucaaauaaacacugugu

SEQ ID NO: 2464871 - RNA, 19 nt, Human
agugucaaauaaacacugu

SEQ ID NO: 2464872 - RNA, 17 nt, Human
agugucaaauaaacacu

SEQ ID NO: 2464873 - RNA, 15 nt, Human
agugucaaauaaaca

SEQ ID NO: 2464874 - RNA, 21 nt, Human
aguguauuuuucaauaaagca

SEQ ID NO: 2464875 - RNA, 14 nt, Human
aguguauuuguauu

SEQ ID NO: 2464876 - RNA, 16 nt, Human
aguguauuuuucaaua

SEQ ID NO: 2464877 - RNA, 19 nt, Human
aguguccccuccacuguca

SEQ ID NO: 2464878 - RNA, 17 nt, Human
aguguccccuccacugu

SEQ ID NO: 2464879 - RNA, 15 nt, Human
aguguccccuccacu

SEQ ID NO: 2464880 - RNA, 14 nt, Human
aguguccccuccac

SEQ ID NO: 2464881 - RNA, 13 nt, Human
aguguccccucca

SEQ ID NO: 2464882 - RNA, 23 nt, Human
aguguccauugacauguacagag

SEQ ID NO: 2464883 - RNA, 22 nt, Human
aguguccauugacauguacaga

SEQ ID NO: 2464884 - RNA, 21 nt, Human
aguguccauugacauguacag

SEQ ID NO: 2464885 - RNA, 20 nt, Human
aguguccauugacauguaca

SEQ ID NO: 2464886 - RNA, 21 nt, Human
aguguccaaagcagggucugg

SEQ ID NO: 2464887 - RNA, 15 nt, Human
agugucuuaauuaaa

SEQ ID NO: 2464888 - RNA, 21 nt, Human
aguguccccuccacugucaca

SEQ ID NO: 2464889 - RNA, 14 nt, Human
aguggcucaacauu

SEQ ID NO: 2464890 - RNA, 14 nt, Human
aguggcucacgccu

SEQ ID NO: 2464891 - RNA, 17 nt, Human
aguggcugguccagggc

SEQ ID NO: 2464892 - RNA, 15 nt, Human
aguggcugguccagg

SEQ ID NO: 2464893 - RNA, 22 nt, Human
aguggcugcugcccaggcccag

SEQ ID NO: 2464894 - RNA, 19 nt, Human
aguggcugcugcccaggcc

SEQ ID NO: 2464895 - RNA, 17 nt, Human
aguggcugcugcccagg

SEQ ID NO: 2464896 - RNA, 16 nt, Human
aguggcugcugcccag

SEQ ID NO: 2464897 - RNA, 14 nt, Human
aguggcugcugccc

SEQ ID NO: 2464898 - RNA, 13 nt, Human
aguggcugcugcc

SEQ ID NO: 2464899 - RNA, 16 nt, Human
aguggcuggaucugug

SEQ ID NO: 2464900 - RNA, 21 nt, Human
aguggcuccucccggugccca

SEQ ID NO: 2464901 - RNA, 11 nt, Human
aguggcugcug

SEQ ID NO: 2464902 - RNA, 12 nt, Human
aguggcugcugc

SEQ ID NO: 2464903 - RNA, 14 nt, Human
aguggcugcugacu

SEQ ID NO: 2464904 - RNA, 17 nt, Human
aguggcuccucccggug

SEQ ID NO: 2464905 - RNA, 13 nt, Human
aguggcuccuccc

SEQ ID NO: 2464906 - RNA, 23 nt, Human
aguggcuuaaaacaacacucaca

SEQ ID NO: 2464907 - RNA, 19 nt, Human
aguggcugguccagggcua

SEQ ID NO: 2464908 - RNA, 18 nt, Human
aguggcugguccagggcu

SEQ ID NO: 2464909 - RNA, 16 nt, Human
aguggcugucaucagc

SEQ ID NO: 2464910 - RNA, 17 nt, Human
aguggcugucaucagcc

SEQ ID NO: 2464911 - RNA, 17 nt, Human
aguggcuguccagugcc

SEQ ID NO: 2464912 - RNA, 13 nt, Human
aguggcuguccag

SEQ ID NO: 2464913 - RNA, 12 nt, Human
aguggcugucca

SEQ ID NO: 2464914 - RNA, 19 nt, Human
aguggcuguccagugccca

SEQ ID NO: 2464915 - RNA, 18 nt, Human
aguggcuguccagugccc

SEQ ID NO: 2464916 - RNA, 19 nt, Human
aguggcuuacuacaugugg

SEQ ID NO: 2464917 - RNA, 19 nt, Human
aguggcuucauuagagcag

SEQ ID NO: 2464918 - RNA, 17 nt, Human
aguggcuucaucuguca

SEQ ID NO: 2464919 - RNA, 15 nt, Human
aguggcuucaaaaua

SEQ ID NO: 2464920 - RNA, 23 nt, Human
aguggcuguccagugcccauucc

SEQ ID NO: 2464921 - RNA, 18 nt, Human
aguauggguuagggaaaa

SEQ ID NO: 2464922 - RNA, 22 nt, Human
aguauggugagagaagccugug

SEQ ID NO: 2464923 - RNA, 17 nt, Human
aguaugggacuggccuc

SEQ ID NO: 2464924 - RNA, 20 nt, Human
aguaugggacuggccucugc

SEQ ID NO: 2464925 - RNA, 17 nt, Human
agucaaaccauaaacuu

SEQ ID NO: 2464926 - RNA, 13 nt, Human
agucaaaccauaa

SEQ ID NO: 2464927 - RNA, 20 nt, Human
agucaaaccauaaacuucau

SEQ ID NO: 2464928 - RNA, 18 nt, Human
agucaaaccauaaacuuc

SEQ ID NO: 2464929 - RNA, 13 nt, Human
agucaaagacauu

SEQ ID NO: 2464930 - RNA, 21 nt, Human
agucaaaaggugccugugagg

SEQ ID NO: 2464931 - RNA, 18 nt, Human
agucaaaaggugccugug

SEQ ID NO: 2464932 - RNA, 19 nt, Human
agucaaauugugugaaagg

SEQ ID NO: 2464933 - RNA, 23 nt, Human
agucaaauugugugaaagguacu

SEQ ID NO: 2464934 - RNA, 15 nt, Human
agucaaauuaauaau

SEQ ID NO: 2464935 - RNA, 18 nt, Human
agucaaauuaauaaucuu

SEQ ID NO: 2464936 - RNA, 14 nt, Human
agucaaauuaauaa

SEQ ID NO: 2464937 - RNA, 23 nt, Human
agucaaaugguaggcauuuccua

SEQ ID NO: 2464938 - RNA, 15 nt, Human
agucaaacugugcca

SEQ ID NO: 2464939 - RNA, 22 nt, Human
agucaaaugguaggcauuuccu

SEQ ID NO: 2464940 - RNA, 12 nt, Human
agucaaaguaaa

SEQ ID NO: 2464941 - RNA, 21 nt, Human
agucaaaguaaaacuugcugc

SEQ ID NO: 2464942 - RNA, 16 nt, Human
agucaacaaacuauuu

SEQ ID NO: 2464943 - RNA, 22 nt, Human
agucaaauuugaaaauaauugu

SEQ ID NO: 2464944 - RNA, 20 nt, Human
agucaaauuaauaaucuuau

SEQ ID NO: 2464945 - RNA, 22 nt, Human
agucaaauuaauaaucuuauua

SEQ ID NO: 2464946 - RNA, 15 nt, Human
aguaugaggcauuug

SEQ ID NO: 2464947 - RNA, 16 nt, Human
aguaugaggcauuugu

SEQ ID NO: 2464948 - RNA, 23 nt, Human
aguaugcuugaaaagauaaauua

SEQ ID NO: 2464949 - RNA, 19 nt, Human
aguauggagcucagagagg

SEQ ID NO: 2464950 - RNA, 14 nt, Human
aguauggagcucag

SEQ ID NO: 2464951 - RNA, 20 nt, Human
aguaugcuuggacugaaggg

SEQ ID NO: 2464952 - RNA, 12 nt, Human
aguaugaaaaua

SEQ ID NO: 2464953 - RNA, 16 nt, Human
aguaucuuuuuauuca

SEQ ID NO: 2464954 - RNA, 18 nt, Human
aguaugaaucuaugccaa

SEQ ID NO: 2464955 - RNA, 17 nt, Human
aguaugaaucuaugcca

SEQ ID NO: 2464956 - RNA, 16 nt, Human
aguaugaaucuaugcc

SEQ ID NO: 2464957 - RNA, 15 nt, Human
aguaugaaucuaugc

SEQ ID NO: 2464958 - RNA, 13 nt, Human
aguaugaaucuau

SEQ ID NO: 2464959 - RNA, 17 nt, Human
aguaucuuuuuucaaaa

SEQ ID NO: 2464960 - RNA, 13 nt, Human
aguaugaaaauaa

SEQ ID NO: 2464961 - RNA, 16 nt, Human
aguaugaauaaagaca

SEQ ID NO: 2464962 - RNA, 15 nt, Human
aguaucuugaagacu

SEQ ID NO: 2464963 - RNA, 12 nt, Human
aguaucuugaag

SEQ ID NO: 2464964 - RNA, 11 nt, Human
aguaucuugaa

SEQ ID NO: 2464965 - RNA, 18 nt, Human
aguaucuguaucucucuc

SEQ ID NO: 2464966 - RNA, 15 nt, Human
aguaucuguaucucu

SEQ ID NO: 2464967 - RNA, 14 nt, Human
aguaucuucaugua

SEQ ID NO: 2464968 - RNA, 14 nt, Human
aguaucugggaacu

SEQ ID NO: 2464969 - RNA, 23 nt, Human
aguaucucggaccuuucagcugu

SEQ ID NO: 2464970 - RNA, 22 nt, Human
aguaucucggaccuuucagcug

SEQ ID NO: 2464971 - RNA, 18 nt, Human
aguaucuccucgcaagcu

SEQ ID NO: 2464972 - RNA, 19 nt, Human
aguaucuccucgcaagcug

SEQ ID NO: 2464973 - RNA, 15 nt, Human
aguaucucagggccu

SEQ ID NO: 2464974 - RNA, 23 nt, Human
agugacccggaggccacaugagu

SEQ ID NO: 2464975 - RNA, 19 nt, Human
agugacccggaggccacau

SEQ ID NO: 2464976 - RNA, 18 nt, Human
agugacccggaggccaca

SEQ ID NO: 2464977 - RNA, 17 nt, Human
agugacccggaggccac

SEQ ID NO: 2464978 - RNA, 16 nt, Human
agugacccggaggcca

SEQ ID NO: 2464979 - RNA, 15 nt, Human
agugacccggaggcc

SEQ ID NO: 2464980 - RNA, 15 nt, Human
agugacaguauuuug

SEQ ID NO: 2464981 - RNA, 18 nt, Human
agugaccauacuaauuau

SEQ ID NO: 2464982 - RNA, 22 nt, Human
agugacaucucuuugaugucau

SEQ ID NO: 2464983 - RNA, 23 nt, Human
agugacagggaagcuacagguua

SEQ ID NO: 2464984 - RNA, 22 nt, Human
agugacagggaagcuacagguu

SEQ ID NO: 2464985 - RNA, 20 nt, Human
agugacagggaagcuacagg

SEQ ID NO: 2464986 - RNA, 19 nt, Human
agugacagggaagcuacag

SEQ ID NO: 2464987 - RNA, 20 nt, Human
agugacaguggauugcauuu

SEQ ID NO: 2464988 - RNA, 19 nt, Human
agugacaguggauugcauu

SEQ ID NO: 2464989 - RNA, 15 nt, Human
agucugaaggcuggg

SEQ ID NO: 2464990 - RNA, 13 nt, Human
agucugaaggcug

SEQ ID NO: 2464991 - RNA, 16 nt, Human
agucugaaggcugggu

SEQ ID NO: 2464992 - RNA, 22 nt, Human
agucugauccaggaggccgggg

SEQ ID NO: 2464993 - RNA, 12 nt, Human
aguccuguaaug

SEQ ID NO: 2464994 - RNA, 20 nt, Human
aguccugugaaugccacugc

SEQ ID NO: 2464995 - RNA, 19 nt, Human
aguccugugaaugccacug

SEQ ID NO: 2464996 - RNA, 18 nt, Human
aguccugugaaugccacu

SEQ ID NO: 2464997 - RNA, 13 nt, Human
aguccugugaaug

SEQ ID NO: 2464998 - RNA, 22 nt, Human
aguccugggagaaccucaggcu

SEQ ID NO: 2464999 - RNA, 21 nt, Human
aguccuggcaugggaaugaau

SEQ ID NO: 2465000 - RNA, 20 nt, Human
aguccuggcaugggaaugaa

SEQ ID NO: 2465001 - RNA, 22 nt, Human
aguccuggcaugggaaugaaug

SEQ ID NO: 2465002 - RNA, 14 nt, Human
aguccuggccuggc

SEQ ID NO: 2465003 - RNA, 13 nt, Human
aguccuggccugg

SEQ ID NO: 2465004 - RNA, 20 nt, Human
aguccuggccuggcuucucc

SEQ ID NO: 2465005 - RNA, 18 nt, Human
aguccuggccuggcuucu

SEQ ID NO: 2465006 - RNA, 21 nt, Human
aguccugggagaaccucaggc

SEQ ID NO: 2465007 - RNA, 23 nt, Human
agugaagaaaagugaaugcucaa

SEQ ID NO: 2465008 - RNA, 22 nt, Human
agugaagaaaagugaaugcuca

SEQ ID NO: 2465009 - RNA, 19 nt, Human
agugaagaaaagugaaugc

SEQ ID NO: 2465010 - RNA, 16 nt, Human
agugaagaaaagugaa

SEQ ID NO: 2465011 - RNA, 14 nt, Human
agugaagacaauga

SEQ ID NO: 2465012 - RNA, 16 nt, Human
agugaagacaaugacu

SEQ ID NO: 2465013 - RNA, 20 nt, Human
agugaagaggggcagcccuu

SEQ ID NO: 2465014 - RNA, 19 nt, Human
agugaagaggggcagcccu

SEQ ID NO: 2465015 - RNA, 17 nt, Human
agugaagaggggcagcc

SEQ ID NO: 2465016 - RNA, 16 nt, Human
agugaagaggggcagc

SEQ ID NO: 2465017 - RNA, 15 nt, Human
agugaaggcuucucu

SEQ ID NO: 2465018 - RNA, 21 nt, Human
agugaaggcuucucucugugg

SEQ ID NO: 2465019 - RNA, 15 nt, Human
agugaagaggggcag

SEQ ID NO: 2465020 - RNA, 14 nt, Human
agugaagaggggca

SEQ ID NO: 2465021 - RNA, 13 nt, Human
agugaagaggggc

SEQ ID NO: 2465022 - RNA, 16 nt, Human
agugaagacuggaagc

SEQ ID NO: 2465023 - RNA, 19 nt, Human
agugaagagggagaaggga

SEQ ID NO: 2465024 - RNA, 13 nt, Human
agugacagggaag

SEQ ID NO: 2465025 - RNA, 16 nt, Human
agugacagggaagcua

SEQ ID NO: 2465026 - RNA, 18 nt, Human
agugaagguuuacaauuu

SEQ ID NO: 2465027 - RNA, 21 nt, Human
agugaagaggggcagcccuug

SEQ ID NO: 2465028 - RNA, 15 nt, Human
agugaagguuuacaa

SEQ ID NO: 2465029 - RNA, 23 nt, Human
agugaagguuuacaauuuacaaa

SEQ ID NO: 2465030 - RNA, 18 nt, Human
agucugauucccaagcuc

SEQ ID NO: 2465031 - RNA, 16 nt, Human
agucugauucccaagc

SEQ ID NO: 2465032 - RNA, 21 nt, Human
agucugaucgugacgcugaau

SEQ ID NO: 2465033 - RNA, 20 nt, Human
agucugaucgugacgcugaa

SEQ ID NO: 2465034 - RNA, 18 nt, Human
agucugaucgugacgcug

SEQ ID NO: 2465035 - RNA, 15 nt, Human
aguccugggaugugg

SEQ ID NO: 2465036 - RNA, 23 nt, Human
agucugaucgugacgcugaauaa

SEQ ID NO: 2465037 - RNA, 22 nt, Human
agucugaucgugacgcugaaua

SEQ ID NO: 2465038 - RNA, 19 nt, Human
agucugaugauuucuugaa

SEQ ID NO: 2465039 - RNA, 20 nt, Human
agucugcugcccuccauccc

SEQ ID NO: 2465040 - RNA, 18 nt, Human
agucugcugcccuccauc

SEQ ID NO: 2465041 - RNA, 20 nt, Human
agugaacuugggccacugug

SEQ ID NO: 2465042 - RNA, 17 nt, Human
agucuggaaugcagugg

SEQ ID NO: 2465043 - RNA, 13 nt, Human
agucugcugcccu

SEQ ID NO: 2465044 - RNA, 15 nt, Human
agucugcugcccucc

SEQ ID NO: 2465045 - RNA, 16 nt, Human
agucugcugcccucca

SEQ ID NO: 2465046 - RNA, 17 nt, Human
agucugcugcccuccau

SEQ ID NO: 2465047 - RNA, 17 nt, Human
agucugcuauauuuuca

SEQ ID NO: 2465048 - RNA, 16 nt, Human
agucugcuauauuuuc

SEQ ID NO: 2465049 - RNA, 16 nt, Human
auggcuuaauguuuau

SEQ ID NO: 2465050 - RNA, 14 nt, Human
auggcuuaauguuu

SEQ ID NO: 2465051 - RNA, 16 nt, Human
auggcuguggagugug

SEQ ID NO: 2465052 - RNA, 20 nt, Human
auggcugugccucugccugu

SEQ ID NO: 2465053 - RNA, 19 nt, Human
auggcugugccucugccug

SEQ ID NO: 2465054 - RNA, 16 nt, Human
auggcuuccuccuccc

SEQ ID NO: 2465055 - RNA, 15 nt, Human
auggcuuccuccucc

SEQ ID NO: 2465056 - RNA, 12 nt, Human
auggcuuccucc

SEQ ID NO: 2465057 - RNA, 21 nt, Human
auggcuuccaagguggucugc

SEQ ID NO: 2465058 - RNA, 16 nt, Human
auggcuuccaaggugg

SEQ ID NO: 2465059 - RNA, 19 nt, Human
auggcuuauccagcuggug

SEQ ID NO: 2465060 - RNA, 18 nt, Human
auggcuuauccagcuggu

SEQ ID NO: 2465061 - RNA, 17 nt, Human
auggcuuauccagcugg

SEQ ID NO: 2465062 - RNA, 21 nt, Human
auggcuuaauguuuauuccug

SEQ ID NO: 2465063 - RNA, 16 nt, Human
auggcuuaguuuucau

SEQ ID NO: 2465064 - RNA, 22 nt, Human
augcugcccaugccaccgcuuc

SEQ ID NO: 2465065 - RNA, 17 nt, Human
augcugcccaugccacc

SEQ ID NO: 2465066 - RNA, 15 nt, Human
augcugcccaugcca

SEQ ID NO: 2465067 - RNA, 12 nt, Human
augcugccccuc

SEQ ID NO: 2465068 - RNA, 11 nt, Human
augcugcccug

SEQ ID NO: 2465069 - RNA, 22 nt, Human
augcugauguucaguguaauuu

SEQ ID NO: 2465070 - RNA, 21 nt, Human
augcugauguucaguguaauu

SEQ ID NO: 2465071 - RNA, 20 nt, Human
augcugcagauuugggcugg

SEQ ID NO: 2465072 - RNA, 18 nt, Human
augcugcaggacuugaga

SEQ ID NO: 2465073 - RNA, 23 nt, Human
augcugcauuuuaauuuuaacca

SEQ ID NO: 2465074 - RNA, 24 nt, Human
augcugauguucaguguaauuucu

SEQ ID NO: 2465075 - RNA, 19 nt, Human
augcugcaggacuugagaa

SEQ ID NO: 2465076 - RNA, 14 nt, Human
augcugccaaauuu

SEQ ID NO: 2465077 - RNA, 15 nt, Human
augcucuucugugga

SEQ ID NO: 2465078 - RNA, 19 nt, Human
augcugaagccaaagccaa

SEQ ID NO: 2465079 - RNA, 14 nt, Human
augcugaaaccaag

SEQ ID NO: 2465080 - RNA, 23 nt, Human
augcugaacauugcauauaacuu

SEQ ID NO: 2465081 - RNA, 17 nt, Human
augcugaacauugcaua

SEQ ID NO: 2465082 - RNA, 16 nt, Human
augcugaaacaggaga

SEQ ID NO: 2465083 - RNA, 18 nt, Human
augcugaaacaggagaga

SEQ ID NO: 2465084 - RNA, 17 nt, Human
augcugaaaaaacaccu

SEQ ID NO: 2465085 - RNA, 15 nt, Human
augcugaaacaggag

SEQ ID NO: 2465086 - RNA, 16 nt, Human
augcucuuuacuucau

SEQ ID NO: 2465087 - RNA, 22 nt, Human
auggauuggauuauuuaauaac

SEQ ID NO: 2465088 - RNA, 20 nt, Human
auggauuggauuauuuaaua

SEQ ID NO: 2465089 - RNA, 18 nt, Human
auggcugugccucugccu

SEQ ID NO: 2465090 - RNA, 15 nt, Human
auggauuuccagcca

SEQ ID NO: 2465091 - RNA, 15 nt, Human
auggauuggauuauu

SEQ ID NO: 2465092 - RNA, 20 nt, Human
auggauugauaauugcauuc

SEQ ID NO: 2465093 - RNA, 18 nt, Human
auggauugauaauugcau

SEQ ID NO: 2465094 - RNA, 19 nt, Human
auggauucuccacucaguu

SEQ ID NO: 2465095 - RNA, 17 nt, Human
auggauucucagauauu

SEQ ID NO: 2465096 - RNA, 18 nt, Human
auggauucucagauauuu

SEQ ID NO: 2465097 - RNA, 19 nt, Human
auggauucucagauauuua

SEQ ID NO: 2465098 - RNA, 22 nt, Human
auggauucucagauauuuauau

SEQ ID NO: 2465099 - RNA, 14 nt, Human
auggauucucagau

SEQ ID NO: 2465100 - RNA, 16 nt, Human
auggauucucagauau

SEQ ID NO: 2465101 - RNA, 18 nt, Human
auggaggauggagagagg

SEQ ID NO: 2465102 - RNA, 11 nt, Human
auggaggagaa

SEQ ID NO: 2465103 - RNA, 13 nt, Human
auggaggagaaga

SEQ ID NO: 2465104 - RNA, 15 nt, Human
auggaggagaagaau

SEQ ID NO: 2465105 - RNA, 17 nt, Human
auggaggagaagaauuu

SEQ ID NO: 2465106 - RNA, 14 nt, Human
auggaggaggaggc

SEQ ID NO: 2465107 - RNA, 16 nt, Human
auggaggaggaggcaa

SEQ ID NO: 2465108 - RNA, 15 nt, Human
auggaggaggaggca

SEQ ID NO: 2465109 - RNA, 16 nt, Human
auggaggauggagaga

SEQ ID NO: 2465110 - RNA, 12 nt, Human
auggaggcacac

SEQ ID NO: 2465111 - RNA, 13 nt, Human
auggaggaauaug

SEQ ID NO: 2465112 - RNA, 22 nt, Human
auggaggaaaaccaagccgugg

SEQ ID NO: 2465113 - RNA, 16 nt, Human
auggaggaaaaccaag

SEQ ID NO: 2465114 - RNA, 13 nt, Human
augcuuguacaua

SEQ ID NO: 2465115 - RNA, 14 nt, Human
augcuuguacauaa

SEQ ID NO: 2465116 - RNA, 12 nt, Human
augcuuguacau

SEQ ID NO: 2465117 - RNA, 15 nt, Human
augcuuggcuucuca

SEQ ID NO: 2465118 - RNA, 16 nt, Human
auggaaaccugaaaaa

SEQ ID NO: 2465119 - RNA, 20 nt, Human
auggaaaaggaagacuagag

SEQ ID NO: 2465120 - RNA, 14 nt, Human
auggaaaaggaaga

SEQ ID NO: 2465121 - RNA, 12 nt, Human
auggaaaaggaa

SEQ ID NO: 2465122 - RNA, 22 nt, Human
auggaaaggagaggaaagaacu

SEQ ID NO: 2465123 - RNA, 19 nt, Human
auggaaaggagaggaaaga

SEQ ID NO: 2465124 - RNA, 15 nt, Human
auggaaaggagagga

SEQ ID NO: 2465125 - RNA, 17 nt, Human
auggaaagaaucuaaua

SEQ ID NO: 2465126 - RNA, 11 nt, Human
auggaaagaau

SEQ ID NO: 2465127 - RNA, 22 nt, Human
auggaaacuguugccagagaug

SEQ ID NO: 2465128 - RNA, 15 nt, Human
auggaaacugaaugc

SEQ ID NO: 2465129 - RNA, 14 nt, Human
auggaaacugaaug

SEQ ID NO: 2465130 - RNA, 16 nt, Human
auggaaacugaaugcu

SEQ ID NO: 2465131 - RNA, 20 nt, Human
auggaaacuguugccagaga

SEQ ID NO: 2465132 - RNA, 13 nt, Human
auggaaacgguga

SEQ ID NO: 2465133 - RNA, 23 nt, Human
auggaaaccugaaaaaaaguuua

SEQ ID NO: 2465134 - RNA, 13 nt, Human
auggaaacugaau

SEQ ID NO: 2465135 - RNA, 14 nt, Human
augccugagggugg

SEQ ID NO: 2465136 - RNA, 12 nt, Human
augccugagggu

SEQ ID NO: 2465137 - RNA, 15 nt, Human
augccugagggugga

SEQ ID NO: 2465138 - RNA, 22 nt, Human
augccucugccaaaggauguga

SEQ ID NO: 2465139 - RNA, 18 nt, Human
augccucugccaaaggau

SEQ ID NO: 2465140 - RNA, 19 nt, Human
augccucucucaggccaaa

SEQ ID NO: 2465141 - RNA, 16 nt, Human
augcaugaaguaauau

SEQ ID NO: 2465142 - RNA, 17 nt, Human
augccucucucaggcca

SEQ ID NO: 2465143 - RNA, 15 nt, Human
augcaucuguccuca

SEQ ID NO: 2465144 - RNA, 19 nt, Human
augcaucuccaccugcucc

SEQ ID NO: 2465145 - RNA, 20 nt, Human
augcaucuggcucaccgggu

SEQ ID NO: 2465146 - RNA, 17 nt, Human
augcaucuccaccugcu

SEQ ID NO: 2465147 - RNA, 14 nt, Human
augcaucuccaccu

SEQ ID NO: 2465148 - RNA, 18 nt, Human
augcaucuuacugaaggu

SEQ ID NO: 2465149 - RNA, 14 nt, Human
augcaucuuacuga

SEQ ID NO: 2465150 - RNA, 16 nt, Human
augcaucuuacugaag

SEQ ID NO: 2465151 - RNA, 16 nt, Human
augcauauuauuuuau

SEQ ID NO: 2465152 - RNA, 22 nt, Human
augcaucucacuggaugcaaag

SEQ ID NO: 2465153 - RNA, 17 nt, Human
augcauauccugagcca

SEQ ID NO: 2465154 - RNA, 18 nt, Human
augcauauccugagccau

SEQ ID NO: 2465155 - RNA, 17 nt, Human
augcacaaacagaggcc

SEQ ID NO: 2465156 - RNA, 16 nt, Human
augcacaaacagaggc

SEQ ID NO: 2465157 - RNA, 16 nt, Human
augcacagaguuguua

SEQ ID NO: 2465158 - RNA, 16 nt, Human
augcacaccucccccu

SEQ ID NO: 2465159 - RNA, 20 nt, Human
augcacacuagccucuccag

SEQ ID NO: 2465160 - RNA, 22 nt, Human
augcacacuagccucuccagga

SEQ ID NO: 2465161 - RNA, 17 nt, Human
augcacagaguuguuac

SEQ ID NO: 2465162 - RNA, 18 nt, Human
augcacagaguuguuaca

SEQ ID NO: 2465163 - RNA, 11 nt, Human
augcauauacu

SEQ ID NO: 2465164 - RNA, 22 nt, Human
augcauaguucccauguuaaau

SEQ ID NO: 2465165 - RNA, 17 nt, Human
augaugccaugaggaac

SEQ ID NO: 2465166 - RNA, 16 nt, Human
augaugccaugaggaa

SEQ ID NO: 2465167 - RNA, 15 nt, Human
augauguuucacaua

SEQ ID NO: 2465168 - RNA, 21 nt, Human
augauguuucgugaaguauac

SEQ ID NO: 2465169 - RNA, 15 nt, Human
augcacaaacagagg

SEQ ID NO: 2465170 - RNA, 16 nt, Human
augcacaaaaagaugc

SEQ ID NO: 2465171 - RNA, 17 nt, Human
augcaauuuccuuuuuu

SEQ ID NO: 2465172 - RNA, 20 nt, Human
augcaauuuugcauuugaau

SEQ ID NO: 2465173 - RNA, 24 nt, Human
augauguuuuccaugaguccccug

SEQ ID NO: 2465174 - RNA, 15 nt, Human
augauguguugugau

SEQ ID NO: 2465175 - RNA, 14 nt, Human
augauguguuguga

SEQ ID NO: 2465176 - RNA, 24 nt, Human
augaugccacaccaagcugugcca

SEQ ID NO: 2465177 - RNA, 22 nt, Human
augaugccacaccaagcugugc

SEQ ID NO: 2465178 - RNA, 18 nt, Human
augaugccacaccaagcu

SEQ ID NO: 2465179 - RNA, 12 nt, Human
augaugccacac

SEQ ID NO: 2465180 - RNA, 18 nt, Human
augaugccaaccucugga

SEQ ID NO: 2465181 - RNA, 17 nt, Human
augaugccaaccucugg

SEQ ID NO: 2465182 - RNA, 17 nt, Human
augauggagcgcaccug

SEQ ID NO: 2465183 - RNA, 16 nt, Human
auguggcuugagaaau

SEQ ID NO: 2465184 - RNA, 21 nt, Human
auguggcuugagaaauaugga

SEQ ID NO: 2465185 - RNA, 22 nt, Human
auguggcuguaucuuguuuuuc

SEQ ID NO: 2465186 - RNA, 11 nt, Human
augugggaggg

SEQ ID NO: 2465187 - RNA, 10 nt, Human
augugggagg

SEQ ID NO: 2465188 - RNA, 13 nt, Human
auguucugggaca

SEQ ID NO: 2465189 - RNA, 19 nt, Human
auguuugccucugccucug

SEQ ID NO: 2465190 - RNA, 13 nt, Human
auguuuccaaccu

SEQ ID NO: 2465191 - RNA, 21 nt, Human
auguuucacauaaaaccucau

SEQ ID NO: 2465192 - RNA, 15 nt, Human
auguuuccagacuuc

SEQ ID NO: 2465193 - RNA, 19 nt, Human
auguuucacgaaguuuguu

SEQ ID NO: 2465194 - RNA, 22 nt, Human
auguuucauguuuugugacuau

SEQ ID NO: 2465195 - RNA, 16 nt, Human
auguuugcuauugaca

SEQ ID NO: 2465196 - RNA, 22 nt, Human
auguuugccucugccucugaca

SEQ ID NO: 2465197 - RNA, 12 nt, Human
auguuuuagcau

SEQ ID NO: 2465198 - RNA, 22 nt, Human
auguuuuagacaaauacucaug

SEQ ID NO: 2465199 - RNA, 19 nt, Human
auguuuuagacaaauacuc

SEQ ID NO: 2465200 - RNA, 16 nt, Human
auguuuuacugugaaa

SEQ ID NO: 2465201 - RNA, 20 nt, Human
auguuuuaccguaauaauua

SEQ ID NO: 2465202 - RNA, 14 nt, Human
auguuuuagaguua

SEQ ID NO: 2465203 - RNA, 23 nt, Human
auguuuuagacaaauacucaugu

SEQ ID NO: 2465204 - RNA, 19 nt, Human
auguuuuagaguuaacaau

SEQ ID NO: 2465205 - RNA, 19 nt, Human
auguuuuaauuccaugaau

SEQ ID NO: 2465206 - RNA, 20 nt, Human
auguuugcuucauaaaugaa

SEQ ID NO: 2465207 - RNA, 18 nt, Human
auguuugcuucauaaaug

SEQ ID NO: 2465208 - RNA, 20 nt, Human
auuaaauacagacacuaagu

SEQ ID NO: 2465209 - RNA, 19 nt, Human
auuaaauacagacacuaag

SEQ ID NO: 2465210 - RNA, 17 nt, Human
auuaaauacagacacua

SEQ ID NO: 2465211 - RNA, 14 nt, Human
auuaaauacagaca

SEQ ID NO: 2465212 - RNA, 12 nt, Human
auuaaauacaga

SEQ ID NO: 2465213 - RNA, 17 nt, Human
auuaaauacaaaacuuc

SEQ ID NO: 2465214 - RNA, 19 nt, Human
auuaaauacaaaacuucca

SEQ ID NO: 2465215 - RNA, 16 nt, Human
auuaaauacaaaacuu

SEQ ID NO: 2465216 - RNA, 18 nt, Human
auuaaaucuaugaaguau

SEQ ID NO: 2465217 - RNA, 22 nt, Human
auuaaauauguuagcaaagagu

SEQ ID NO: 2465218 - RNA, 20 nt, Human
auuaaauauguuagcaaaga

SEQ ID NO: 2465219 - RNA, 15 nt, Human
auuaaauauaauaug

SEQ ID NO: 2465220 - RNA, 18 nt, Human
auguucuaagucuuucca

SEQ ID NO: 2465221 - RNA, 19 nt, Human
auguucuaagucuuuccau

SEQ ID NO: 2465222 - RNA, 22 nt, Human
auguucuauuucagugccaaua

SEQ ID NO: 2465223 - RNA, 16 nt, Human
auguucucuaucauuu

SEQ ID NO: 2465224 - RNA, 15 nt, Human
auguucucuaucauu

SEQ ID NO: 2465225 - RNA, 14 nt, Human
auguucucuaucau

SEQ ID NO: 2465226 - RNA, 12 nt, Human
auguucugggac

SEQ ID NO: 2465227 - RNA, 11 nt, Human
auguucuggga

SEQ ID NO: 2465228 - RNA, 21 nt, Human
auguucucuaucauuuaauaa

SEQ ID NO: 2465229 - RNA, 20 nt, Human
auguucucuaucauuuaaua

SEQ ID NO: 2465230 - RNA, 19 nt, Human
auguucucuaucauuuaau

SEQ ID NO: 2465231 - RNA, 18 nt, Human
auguucucuaucauuuaa

SEQ ID NO: 2465232 - RNA, 13 nt, Human
auguucuggcccu

SEQ ID NO: 2465233 - RNA, 13 nt, Human
auguucugcuuuc

SEQ ID NO: 2465234 - RNA, 13 nt, Human
augugugagugug

SEQ ID NO: 2465235 - RNA, 22 nt, Human
augugugaggagcugcuggcuu

SEQ ID NO: 2465236 - RNA, 22 nt, Human
augugugcaacaggguauggac

SEQ ID NO: 2465237 - RNA, 16 nt, Human
augugugagugugugc

SEQ ID NO: 2465238 - RNA, 17 nt, Human
augugugagugugugca

SEQ ID NO: 2465239 - RNA, 15 nt, Human
augugugaggagcug

SEQ ID NO: 2465240 - RNA, 19 nt, Human
augugugaggagcugcugg

SEQ ID NO: 2465241 - RNA, 18 nt, Human
augugggcagugauguca

SEQ ID NO: 2465242 - RNA, 22 nt, Human
augugugccauagaguuuaaca

SEQ ID NO: 2465243 - RNA, 20 nt, Human
augugugccauagaguuuaa

SEQ ID NO: 2465244 - RNA, 18 nt, Human
augugugccauagaguuu

SEQ ID NO: 2465245 - RNA, 11 nt, Human
augugugccau

SEQ ID NO: 2465246 - RNA, 15 nt, Human
augugugcaugugug

SEQ ID NO: 2465247 - RNA, 12 nt, Human
augugugcaugu

SEQ ID NO: 2465248 - RNA, 15 nt, Human
augugugcgagugug

SEQ ID NO: 2465249 - RNA, 19 nt, Human
auguuccugaauucuauuu

SEQ ID NO: 2465250 - RNA, 17 nt, Human
augugugcucuucuucu

SEQ ID NO: 2465251 - RNA, 18 nt, Human
augugugcgagugugugc

SEQ ID NO: 2465252 - RNA, 19 nt, Human
augugugcgagugugugca

SEQ ID NO: 2465253 - RNA, 17 nt, Human
auguucuaagaagugaa

SEQ ID NO: 2465254 - RNA, 20 nt, Human
auguuccuucaagaucaugu

SEQ ID NO: 2465255 - RNA, 23 nt, Human
auguuccugaauucuauuugcug

SEQ ID NO: 2465256 - RNA, 14 nt, Human
augugaaguguuaa

SEQ ID NO: 2465257 - RNA, 13 nt, Human
augugaaguguua

SEQ ID NO: 2465258 - RNA, 21 nt, Human
augugaauaaaauuauuuugg

SEQ ID NO: 2465259 - RNA, 20 nt, Human
augugaaguguuaauacuag

SEQ ID NO: 2465260 - RNA, 19 nt, Human
augugaaguguuaauacua

SEQ ID NO: 2465261 - RNA, 16 nt, Human
augugaaguguuaaua

SEQ ID NO: 2465262 - RNA, 12 nt, Human
augugaaucaga

SEQ ID NO: 2465263 - RNA, 15 nt, Human
augugaaucagaccc

SEQ ID NO: 2465264 - RNA, 16 nt, Human
augugaaucagacccu

SEQ ID NO: 2465265 - RNA, 21 nt, Human
augugaaucagacccuacccc

SEQ ID NO: 2465266 - RNA, 18 nt, Human
augugaauugccugcaga

SEQ ID NO: 2465267 - RNA, 16 nt, Human
augugaaugggaaaag

SEQ ID NO: 2465268 - RNA, 20 nt, Human
augugaaugaucucucugaa

SEQ ID NO: 2465269 - RNA, 18 nt, Human
augucuucauuucauugu

SEQ ID NO: 2465270 - RNA, 17 nt, Human
augucuucauuucauug

SEQ ID NO: 2465271 - RNA, 22 nt, Human
augucuucauaccuacauguau

SEQ ID NO: 2465272 - RNA, 21 nt, Human
augucuucauaccuacaugua

SEQ ID NO: 2465273 - RNA, 23 nt, Human
augucuuaaugaaguuugaaugu

SEQ ID NO: 2465274 - RNA, 17 nt, Human
augucuucguacaguuc

SEQ ID NO: 2465275 - RNA, 19 nt, Human
augucuucauuucauugua

SEQ ID NO: 2465276 - RNA, 20 nt, Human
augucuucauuucauuguau

SEQ ID NO: 2465277 - RNA, 13 nt, Human
augucuuccugga

SEQ ID NO: 2465278 - RNA, 19 nt, Human
augucuuaaugaaguuuga

SEQ ID NO: 2465279 - RNA, 21 nt, Human
augucuuaaugaaguuugaau

SEQ ID NO: 2465280 - RNA, 20 nt, Human
augucuuaaugaaguuugaa

SEQ ID NO: 2465281 - RNA, 14 nt, Human
augucuuuucuugc

SEQ ID NO: 2465282 - RNA, 23 nt, Human
augucuuuguuggaaaagaauac

SEQ ID NO: 2465283 - RNA, 22 nt, Human
augucuucguacaguucuucgg

SEQ ID NO: 2465284 - RNA, 20 nt, Human
augucuucguacaguucuuc

SEQ ID NO: 2465285 - RNA, 10 nt, Human
augucuugug

SEQ ID NO: 2465286 - RNA, 11 nt, Human
augucuugugu

SEQ ID NO: 2465287 - RNA, 22 nt, Human
augucuuuaggcagcagcuuuu

SEQ ID NO: 2465288 - RNA, 23 nt, Human
augugaaaccuuuuuuaagauuu

SEQ ID NO: 2465289 - RNA, 22 nt, Human
augugaaaccuuuuuuaagauu

SEQ ID NO: 2465290 - RNA, 21 nt, Human
augugaaaccuuuuuuaagau

SEQ ID NO: 2465291 - RNA, 20 nt, Human
augugaaaccuuuuuuaaga

SEQ ID NO: 2465292 - RNA, 22 nt, Human
augugaaacuggauuaaacuua

SEQ ID NO: 2465293 - RNA, 19 nt, Human
augugaaaccuuuuuuaag

SEQ ID NO: 2465294 - RNA, 18 nt, Human
augugaaaccuuuuuuaa

SEQ ID NO: 2465295 - RNA, 15 nt, Human
augugaaaccuuuuu

SEQ ID NO: 2465296 - RNA, 13 nt, Human
augugaaaccuuu

SEQ ID NO: 2465297 - RNA, 12 nt, Human
augugaaaccuu

SEQ ID NO: 2465298 - RNA, 15 nt, Human
augucuuuugaauau

SEQ ID NO: 2465299 - RNA, 15 nt, Human
augugaaacauguuu

SEQ ID NO: 2465300 - RNA, 20 nt, Human
augucuuuguuggaaaagaa

SEQ ID NO: 2465301 - RNA, 12 nt, Human
augugaaagcac

SEQ ID NO: 2465302 - RNA, 13 nt, Human
augugaacccggg

SEQ ID NO: 2465303 - RNA, 12 nt, Human
augugaagccaa

SEQ ID NO: 2465304 - RNA, 21 nt, Human
augugaagccaauucagacag

SEQ ID NO: 2465305 - RNA, 22 nt, Human
augugaagccaauucagacagg

SEQ ID NO: 2465306 - RNA, 15 nt, Human
augugaacuuuauua

SEQ ID NO: 2465307 - RNA, 16 nt, Human
augugaacccgggacg

SEQ ID NO: 2465308 - RNA, 17 nt, Human
augugaacuuuauuaaa

SEQ ID NO: 2465309 - RNA, 13 nt, Human
auggucagcuccc

SEQ ID NO: 2465310 - RNA, 12 nt, Human
auggucagcucc

SEQ ID NO: 2465311 - RNA, 20 nt, Human
auggucagcucccuucucug

SEQ ID NO: 2465312 - RNA, 22 nt, Human
auggucaucuuggagggaccaa

SEQ ID NO: 2465313 - RNA, 22 nt, Human
auggucaucuuuuucucuaaaa

SEQ ID NO: 2465314 - RNA, 12 nt, Human
augguccugggg

SEQ ID NO: 2465315 - RNA, 14 nt, Human
augguccuggggcu

SEQ ID NO: 2465316 - RNA, 17 nt, Human
augguccuggggcucug

SEQ ID NO: 2465317 - RNA, 19 nt, Human
augguccuggggcucugug

SEQ ID NO: 2465318 - RNA, 20 nt, Human
augguccuggggcucugugc

SEQ ID NO: 2465319 - RNA, 14 nt, Human
auggucgcccagga

SEQ ID NO: 2465320 - RNA, 15 nt, Human
auggucacacacuga

SEQ ID NO: 2465321 - RNA, 16 nt, Human
auggucacacacugau

SEQ ID NO: 2465322 - RNA, 18 nt, Human
auggucacacacugaugc

SEQ ID NO: 2465323 - RNA, 19 nt, Human
auggucacacacugaugcu

SEQ ID NO: 2465324 - RNA, 19 nt, Human
auggucaccaaaucagcug

SEQ ID NO: 2465325 - RNA, 17 nt, Human
auggucacgcaccuggg

SEQ ID NO: 2465326 - RNA, 20 nt, Human
auggucacacacugaugcuu

SEQ ID NO: 2465327 - RNA, 18 nt, Human
auggucagcccuagggug

SEQ ID NO: 2465328 - RNA, 19 nt, Human
auggucagcguugcauguc

SEQ ID NO: 2465329 - RNA, 18 nt, Human
auggucagcguugcaugu

SEQ ID NO: 2465330 - RNA, 16 nt, Human
auggucagcguugcau

SEQ ID NO: 2465331 - RNA, 19 nt, Human
augguauagcaaauguuuu

SEQ ID NO: 2465332 - RNA, 21 nt, Human
augguauauuugguacuguau

SEQ ID NO: 2465333 - RNA, 20 nt, Human
augguaugagcugagggggg

SEQ ID NO: 2465334 - RNA, 14 nt, Human
augguaugagcuga

SEQ ID NO: 2465335 - RNA, 14 nt, Human
auggucacacacug

SEQ ID NO: 2465336 - RNA, 20 nt, Human
auggucaacacuuaaggguu

SEQ ID NO: 2465337 - RNA, 19 nt, Human
augguauaaugguugacug

SEQ ID NO: 2465338 - RNA, 14 nt, Human
auguaagggaaacu

SEQ ID NO: 2465339 - RNA, 16 nt, Human
auguaagggaaacugc

SEQ ID NO: 2465340 - RNA, 15 nt, Human
auggucggaaaacau

SEQ ID NO: 2465341 - RNA, 15 nt, Human
auggucgcccaggag

SEQ ID NO: 2465342 - RNA, 16 nt, Human
auggucgcccaggaga

SEQ ID NO: 2465343 - RNA, 16 nt, Human
auguaagcugaaaaua

SEQ ID NO: 2465344 - RNA, 17 nt, Human
auguaagcugaaaauau

SEQ ID NO: 2465345 - RNA, 15 nt, Human
auguaagcuguuuau

SEQ ID NO: 2465346 - RNA, 14 nt, Human
auguaagcuguuua

SEQ ID NO: 2465347 - RNA, 22 nt, Human
auguaagcuguuuauuuuauau

SEQ ID NO: 2465348 - RNA, 19 nt, Human
auguaagggaaacugccag

SEQ ID NO: 2465349 - RNA, 15 nt, Human
auguaauuaaguacu

SEQ ID NO: 2465350 - RNA, 17 nt, Human
auguaauuaaguacuau

SEQ ID NO: 2465351 - RNA, 22 nt, Human
auguauugcacauuguaaaaag

SEQ ID NO: 2465352 - RNA, 17 nt, Human
auguauugcacauugua

SEQ ID NO: 2465353 - RNA, 16 nt, Human
auguauugcacauugu

SEQ ID NO: 2465354 - RNA, 14 nt, Human
auguauugauaaga

SEQ ID NO: 2465355 - RNA, 20 nt, Human
auguauucuagcuaauguaa

SEQ ID NO: 2465356 - RNA, 24 nt, Human
auguauucagcuuuaguagauauu

SEQ ID NO: 2465357 - RNA, 22 nt, Human
auguauuauuucauuauguaaa

SEQ ID NO: 2465358 - RNA, 15 nt, Human
auguauuauuucauu

SEQ ID NO: 2465359 - RNA, 19 nt, Human
auguauucuagcuaaugua

SEQ ID NO: 2465360 - RNA, 20 nt, Human
auguauuauucugcagcaug

SEQ ID NO: 2465361 - RNA, 23 nt, Human
auguaauuaaguacuauguauca

SEQ ID NO: 2465362 - RNA, 23 nt, Human
auguauuuuauuguaacagacau

SEQ ID NO: 2465363 - RNA, 20 nt, Human
auguauuuuauuguaacaga

SEQ ID NO: 2465364 - RNA, 16 nt, Human
auguauuuuauuguaa

SEQ ID NO: 2465365 - RNA, 15 nt, Human
auguauuuuauugua

SEQ ID NO: 2465366 - RNA, 14 nt, Human
auguauuuuauugu

SEQ ID NO: 2465367 - RNA, 14 nt, Human
auguauuuguuugc

SEQ ID NO: 2465368 - RNA, 16 nt, Human
auguauuggccuggag

SEQ ID NO: 2465369 - RNA, 15 nt, Human
auguauuggccugga

SEQ ID NO: 2465370 - RNA, 13 nt, Human
auguauuggccug

SEQ ID NO: 2465371 - RNA, 17 nt, Human
auguauuuuuguacccu

SEQ ID NO: 2465372 - RNA, 14 nt, Human
augaggcauuuggc

SEQ ID NO: 2465373 - RNA, 13 nt, Human
augaggcagagga

SEQ ID NO: 2465374 - RNA, 21 nt, Human
augaggcaaugucaggaacag

SEQ ID NO: 2465375 - RNA, 22 nt, Human
augaggaugcagagucagcaga

SEQ ID NO: 2465376 - RNA, 18 nt, Human
augaggcaaugucaggaa

SEQ ID NO: 2465377 - RNA, 13 nt, Human
augaggacauguu

SEQ ID NO: 2465378 - RNA, 14 nt, Human
augaggaguugcug

SEQ ID NO: 2465379 - RNA, 20 nt, Human
augaggaugcagagucagca

SEQ ID NO: 2465380 - RNA, 21 nt, Human
augaggaugcagagucagcag

SEQ ID NO: 2465381 - RNA, 12 nt, Human
augaggaaugua

SEQ ID NO: 2465382 - RNA, 23 nt, Human
augaggaauaauuauuuauuuaa

SEQ ID NO: 2465383 - RNA, 14 nt, Human
augaggaauaauua

SEQ ID NO: 2465384 - RNA, 22 nt, Human
augagcucuacccagggccugc

SEQ ID NO: 2465385 - RNA, 17 nt, Human
augaggaauguauaugu

SEQ ID NO: 2465386 - RNA, 15 nt, Human
augaggaauguauau

SEQ ID NO: 2465387 - RNA, 14 nt, Human
augaggaggaagga

SEQ ID NO: 2465388 - RNA, 23 nt, Human
augaccuuucaauaggaaaaacu

SEQ ID NO: 2465389 - RNA, 22 nt, Human
augaccuuucaauaggaaaaac

SEQ ID NO: 2465390 - RNA, 21 nt, Human
augaccuuucaauaggaaaaa

SEQ ID NO: 2465391 - RNA, 15 nt, Human
augagcucuacccag

SEQ ID NO: 2465392 - RNA, 16 nt, Human
augagcucuacccagg

SEQ ID NO: 2465393 - RNA, 18 nt, Human
augagcucuacccagggc

SEQ ID NO: 2465394 - RNA, 19 nt, Human
augagcucuacccagggcc

SEQ ID NO: 2465395 - RNA, 21 nt, Human
augagcucgcauuugucaaug

SEQ ID NO: 2465396 - RNA, 22 nt, Human
augagcucgcauuugucaauga

SEQ ID NO: 2465397 - RNA, 21 nt, Human
augagcuccagacccccagca

SEQ ID NO: 2465398 - RNA, 22 nt, Human
augagcuccagacccccagcaa

SEQ ID NO: 2465399 - RNA, 14 nt, Human
augagcuccucuuc

SEQ ID NO: 2465400 - RNA, 22 nt, Human
augagcuccucuuccuggcuuc

SEQ ID NO: 2465401 - RNA, 14 nt, Human
augagcuccagacc

SEQ ID NO: 2465402 - RNA, 15 nt, Human
augagcuccagaccc

SEQ ID NO: 2465403 - RNA, 16 nt, Human
augagcuccagacccc

SEQ ID NO: 2465404 - RNA, 17 nt, Human
augagcuccagaccccc

SEQ ID NO: 2465405 - RNA, 20 nt, Human
augagcuccagacccccagc

SEQ ID NO: 2465406 - RNA, 13 nt, Human
augaaagacugua

SEQ ID NO: 2465407 - RNA, 16 nt, Human
augaaagacuguacaa

SEQ ID NO: 2465408 - RNA, 17 nt, Human
augaaagacuguacaaa

SEQ ID NO: 2465409 - RNA, 19 nt, Human
augaaagacuguacaaagu

SEQ ID NO: 2465410 - RNA, 14 nt, Human
augaaaaagcaugu

SEQ ID NO: 2465411 - RNA, 20 nt, Human
augaaaaacaaaaauaacau

SEQ ID NO: 2465412 - RNA, 16 nt, Human
augaaaaaauguauau

SEQ ID NO: 2465413 - RNA, 23 nt, Human
augaaaaaauauauaucaaauau

SEQ ID NO: 2465414 - RNA, 18 nt, Human
augaaaaagcauguacag

SEQ ID NO: 2465415 - RNA, 16 nt, Human
augaaaaagcauguac

SEQ ID NO: 2465416 - RNA, 15 nt, Human
augaaaaagcaugua

SEQ ID NO: 2465417 - RNA, 21 nt, Human
augaaaaagcauguacagugu

SEQ ID NO: 2465418 - RNA, 19 nt, Human
augaaaaagcauguacagu

SEQ ID NO: 2465419 - RNA, 13 nt, Human
augaaaaauagca

SEQ ID NO: 2465420 - RNA, 16 nt, Human
augaaaaauuuaagca

SEQ ID NO: 2465421 - RNA, 17 nt, Human
augaaaaauuuaagcau

SEQ ID NO: 2465422 - RNA, 18 nt, Human
augaaaaauuuaagcauu

SEQ ID NO: 2465423 - RNA, 13 nt, Human
augaaaaauauga

SEQ ID NO: 2465424 - RNA, 13 nt, Human
augaaaaauucuc

SEQ ID NO: 2465425 - RNA, 20 nt, Human
augaaguuugaauguuaaau

SEQ ID NO: 2465426 - RNA, 19 nt, Human
augaaguuugaauguuaaa

SEQ ID NO: 2465427 - RNA, 14 nt, Human
augaaguuuuacau

SEQ ID NO: 2465428 - RNA, 16 nt, Human
augaaguuuuacauug

SEQ ID NO: 2465429 - RNA, 19 nt, Human
augaaguuuuuuuuauaca

SEQ ID NO: 2465430 - RNA, 18 nt, Human
augaaguuugaauguuaa

SEQ ID NO: 2465431 - RNA, 16 nt, Human
augaaguuugaauguu

SEQ ID NO: 2465432 - RNA, 15 nt, Human
augaaguuugaaugu

SEQ ID NO: 2465433 - RNA, 14 nt, Human
augaaguuugaaug

SEQ ID NO: 2465434 - RNA, 19 nt, Human
augaaguuugaacuucaua

SEQ ID NO: 2465435 - RNA, 18 nt, Human
augaaguuugaacuucau

SEQ ID NO: 2465436 - RNA, 13 nt, Human
augaaguuugaau

SEQ ID NO: 2465437 - RNA, 23 nt, Human
augaaguuuccuuggcuggugca

SEQ ID NO: 2465438 - RNA, 22 nt, Human
augaagcuuuuaugugaaacau

SEQ ID NO: 2465439 - RNA, 21 nt, Human
augaaggagaggcaacaucca

SEQ ID NO: 2465440 - RNA, 19 nt, Human
augaaaaauuuaagcauug

SEQ ID NO: 2465441 - RNA, 20 nt, Human
augaaaaauuuaagcauugu

SEQ ID NO: 2465442 - RNA, 22 nt, Human
augaaggcagaaaaaugucauu

SEQ ID NO: 2465443 - RNA, 16 nt, Human
augaaggcaaaaaaau

SEQ ID NO: 2465444 - RNA, 20 nt, Human
augaagguuaggauuuaaca

SEQ ID NO: 2465445 - RNA, 16 nt, Human
augaagguuaggauuu

SEQ ID NO: 2465446 - RNA, 18 nt, Human
augaaggugucauacaga

SEQ ID NO: 2465447 - RNA, 17 nt, Human
augaagggaaaggauau

SEQ ID NO: 2465448 - RNA, 22 nt, Human
augaagguuaggauuuaacagu

SEQ ID NO: 2465449 - RNA, 21 nt, Human
augaagguuaggauuuaacag

SEQ ID NO: 2465450 - RNA, 17 nt, Human
augaagguuucugaaaa

SEQ ID NO: 2465451 - RNA, 19 nt, Human
augaagguuucugaaaauu

SEQ ID NO: 2465452 - RNA, 17 nt, Human
aucuugaauuguaagga

SEQ ID NO: 2465453 - RNA, 16 nt, Human
aucuugaauuguaacu

SEQ ID NO: 2465454 - RNA, 18 nt, Human
aucuugaauaauguaaga

SEQ ID NO: 2465455 - RNA, 22 nt, Human
aucuucugaacuuggcgcugcc

SEQ ID NO: 2465456 - RNA, 11 nt, Human
aucugggaaag

SEQ ID NO: 2465457 - RNA, 16 nt, Human
aucugggaagauuucu

SEQ ID NO: 2465458 - RNA, 21 nt, Human
aucuucugccuuagucucagu

SEQ ID NO: 2465459 - RNA, 14 nt, Human
aucuucugccuucu

SEQ ID NO: 2465460 - RNA, 17 nt, Human
aucuucugcaauugcuu

SEQ ID NO: 2465461 - RNA, 14 nt, Human
aucugggaaagaca

SEQ ID NO: 2465462 - RNA, 16 nt, Human
aucugggacccuuucc

SEQ ID NO: 2465463 - RNA, 22 nt, Human
aucugggaaaauaccccaucau

SEQ ID NO: 2465464 - RNA, 18 nt, Human
aucuugaagacuuuucuu

SEQ ID NO: 2465465 - RNA, 20 nt, Human
aucuucuuaugcaauuuccu

SEQ ID NO: 2465466 - RNA, 14 nt, Human
aucuucuucaccau

SEQ ID NO: 2465467 - RNA, 12 nt, Human
aucuugaaggaa

SEQ ID NO: 2465468 - RNA, 16 nt, Human
aucuucugccuucuca

SEQ ID NO: 2465469 - RNA, 18 nt, Human
aucuucugccuucucaug

SEQ ID NO: 2465470 - RNA, 20 nt, Human
aucuucuggagucuccagug

SEQ ID NO: 2465471 - RNA, 18 nt, Human
aucuucuggagucuccag

SEQ ID NO: 2465472 - RNA, 17 nt, Human
aucuucuuaugcaauuu

SEQ ID NO: 2465473 - RNA, 14 nt, Human
aucuucuuuauaau

SEQ ID NO: 2465474 - RNA, 20 nt, Human
aucuaucugcuuaugcaguu

SEQ ID NO: 2465475 - RNA, 19 nt, Human
aucuaucugcuuaugcagu

SEQ ID NO: 2465476 - RNA, 19 nt, Human
aucuaucucaucuaucuca

SEQ ID NO: 2465477 - RNA, 22 nt, Human
aucuaucaauagucaagaaaaa

SEQ ID NO: 2465478 - RNA, 20 nt, Human
aucuaucaauagucaagaaa

SEQ ID NO: 2465479 - RNA, 17 nt, Human
aucuaucaauagucaag

SEQ ID NO: 2465480 - RNA, 15 nt, Human
aucuaucaauaguca

SEQ ID NO: 2465481 - RNA, 23 nt, Human
aucuauucucuccaaaaaugcac

SEQ ID NO: 2465482 - RNA, 21 nt, Human
aucucccccagccccauccuc

SEQ ID NO: 2465483 - RNA, 21 nt, Human
aucucccucacugaaaccagg

SEQ ID NO: 2465484 - RNA, 15 nt, Human
aucucccgcugcugc

SEQ ID NO: 2465485 - RNA, 23 nt, Human
aucuccccuugcacuaaaguaug

SEQ ID NO: 2465486 - RNA, 15 nt, Human
aucucccugccgccu

SEQ ID NO: 2465487 - RNA, 19 nt, Human
aucucccugccgccucaau

SEQ ID NO: 2465488 - RNA, 12 nt, Human
aucucccugccg

SEQ ID NO: 2465489 - RNA, 14 nt, Human
aucucccucccaca

SEQ ID NO: 2465490 - RNA, 19 nt, Human
aucuaugccaaagaucacu

SEQ ID NO: 2465491 - RNA, 17 nt, Human
aucuaugccaaagauca

SEQ ID NO: 2465492 - RNA, 17 nt, Human
aucuauggucgggagac

SEQ ID NO: 2465493 - RNA, 16 nt, Human
aucuaugcauuuucug

SEQ ID NO: 2465494 - RNA, 18 nt, Human
aucuaugcauuuucugga

SEQ ID NO: 2465495 - RNA, 20 nt, Human
aucuaugaaguauauaaugg

SEQ ID NO: 2465496 - RNA, 19 nt, Human
aucuaugaaguauauaaug

SEQ ID NO: 2465497 - RNA, 18 nt, Human
aucuaugaaguauauaau

SEQ ID NO: 2465498 - RNA, 15 nt, Human
aucuaugaaguauau

SEQ ID NO: 2465499 - RNA, 18 nt, Human
aucuaucuuauauaguuu

SEQ ID NO: 2465500 - RNA, 17 nt, Human
aucuauucagacaagca

SEQ ID NO: 2465501 - RNA, 15 nt, Human
aucuauucagacaag

SEQ ID NO: 2465502 - RNA, 18 nt, Human
aucuauuauacuguauua

SEQ ID NO: 2465503 - RNA, 17 nt, Human
aucuauuauacuguauu

SEQ ID NO: 2465504 - RNA, 22 nt, Human
aucuauucagacaagcaacagg

SEQ ID NO: 2465505 - RNA, 21 nt, Human
aucuauucagacaagcaacag

SEQ ID NO: 2465506 - RNA, 19 nt, Human
aucuauuccugguagaaua

SEQ ID NO: 2465507 - RNA, 16 nt, Human
aucuauuauacuguau

SEQ ID NO: 2465508 - RNA, 14 nt, Human
aucuauuauacugu

SEQ ID NO: 2465509 - RNA, 21 nt, Human
aucuaugccaaagaucacuug

SEQ ID NO: 2465510 - RNA, 17 nt, Human
aucuggcaacaucuuua

SEQ ID NO: 2465511 - RNA, 19 nt, Human
aucuggacuccucugucca

SEQ ID NO: 2465512 - RNA, 23 nt, Human
aucuggccguugauguuggcugg

SEQ ID NO: 2465513 - RNA, 21 nt, Human
aucuggaccccaucugugaau

SEQ ID NO: 2465514 - RNA, 12 nt, Human
aucuggcagggu

SEQ ID NO: 2465515 - RNA, 18 nt, Human
aucuggacuccucugucc

SEQ ID NO: 2465516 - RNA, 17 nt, Human
aucuggacuccucuguc

SEQ ID NO: 2465517 - RNA, 16 nt, Human
aucuggacuccucugu

SEQ ID NO: 2465518 - RNA, 15 nt, Human
aucuggacuccucug

SEQ ID NO: 2465519 - RNA, 18 nt, Human
aucuggaaccaucagaaa

SEQ ID NO: 2465520 - RNA, 11 nt, Human
aucuggaaccc

SEQ ID NO: 2465521 - RNA, 14 nt, Human
aucuggaacccaga

SEQ ID NO: 2465522 - RNA, 15 nt, Human
aucuggaacccagac

SEQ ID NO: 2465523 - RNA, 16 nt, Human
aucuggaacccagacu

SEQ ID NO: 2465524 - RNA, 17 nt, Human
aucuggaacccagacuc

SEQ ID NO: 2465525 - RNA, 18 nt, Human
aucuggaacccagacuca

SEQ ID NO: 2465526 - RNA, 22 nt, Human
aucuggaccccaucugugaaua

SEQ ID NO: 2465527 - RNA, 12 nt, Human
aucugcuucagu

SEQ ID NO: 2465528 - RNA, 14 nt, Human
aucugcuucagugg

SEQ ID NO: 2465529 - RNA, 21 nt, Human
aucugcuuacaauucccugcu

SEQ ID NO: 2465530 - RNA, 19 nt, Human
aucugcuuacaauucccug

SEQ ID NO: 2465531 - RNA, 15 nt, Human
aucugcuuaugcagu

SEQ ID NO: 2465532 - RNA, 22 nt, Human
aucugcuuuuuaaagaaugcuc

SEQ ID NO: 2465533 - RNA, 18 nt, Human
aucucugugccuucgucu

SEQ ID NO: 2465534 - RNA, 15 nt, Human
aucucugugccuucg

SEQ ID NO: 2465535 - RNA, 14 nt, Human
aucucugugccuuc

SEQ ID NO: 2465536 - RNA, 13 nt, Human
aucucugugccuu

SEQ ID NO: 2465537 - RNA, 15 nt, Human
aucucugugugcaca

SEQ ID NO: 2465538 - RNA, 17 nt, Human
aucucugugugcacaaa

SEQ ID NO: 2465539 - RNA, 19 nt, Human
aucucugugugcacaaaua

SEQ ID NO: 2465540 - RNA, 13 nt, Human
aucucguuucaaa

SEQ ID NO: 2465541 - RNA, 15 nt, Human
aucucgugggagagc

SEQ ID NO: 2465542 - RNA, 17 nt, Human
aucucugcuuuggaaau

SEQ ID NO: 2465543 - RNA, 16 nt, Human
aucucggcucacugca

SEQ ID NO: 2465544 - RNA, 14 nt, Human
aucucgugggagag

SEQ ID NO: 2465545 - RNA, 14 nt, Human
aucucggcucacug

SEQ ID NO: 2465546 - RNA, 15 nt, Human
aucucggcucacugc

SEQ ID NO: 2465547 - RNA, 19 nt, Human
aucuccugugcauggguga

SEQ ID NO: 2465548 - RNA, 15 nt, Human
aucuccuuucaggga

SEQ ID NO: 2465549 - RNA, 20 nt, Human
aucucgccaccccuccuucc

SEQ ID NO: 2465550 - RNA, 21 nt, Human
aucucgccaccccuccuuccu

SEQ ID NO: 2465551 - RNA, 14 nt, Human
aucuccugugcaug

SEQ ID NO: 2465552 - RNA, 15 nt, Human
aucuccugugcaugg

SEQ ID NO: 2465553 - RNA, 18 nt, Human
aucuccugugcaugggug

SEQ ID NO: 2465554 - RNA, 19 nt, Human
auccucccaccucagccuc

SEQ ID NO: 2465555 - RNA, 18 nt, Human
auccucccaccucagccu

SEQ ID NO: 2465556 - RNA, 23 nt, Human
auccuccagguuuuucaauuaaa

SEQ ID NO: 2465557 - RNA, 20 nt, Human
auccucccaccucagccucc

SEQ ID NO: 2465558 - RNA, 19 nt, Human
aucggcccacagcucccac

SEQ ID NO: 2465559 - RNA, 20 nt, Human
aucggcccacagcucccacc

SEQ ID NO: 2465560 - RNA, 21 nt, Human
aucggaucuggggcucuggga

SEQ ID NO: 2465561 - RNA, 23 nt, Human
aucggaggcuugucagagcuggg

SEQ ID NO: 2465562 - RNA, 18 nt, Human
aucggaggcuugucagag

SEQ ID NO: 2465563 - RNA, 20 nt, Human
aucggaggcuugucagagcu

SEQ ID NO: 2465564 - RNA, 21 nt, Human
aucggaggcuugucagagcug

SEQ ID NO: 2465565 - RNA, 22 nt, Human
aucggaggcuugucagagcugg

SEQ ID NO: 2465566 - RNA, 22 nt, Human
aucgcuguguguuaguucccaa

SEQ ID NO: 2465567 - RNA, 23 nt, Human
aucgcuguguguuaguucccaac

SEQ ID NO: 2465568 - RNA, 17 nt, Human
aucgcuucauguaacua

SEQ ID NO: 2465569 - RNA, 15 nt, Human
aucggagccuccucu

SEQ ID NO: 2465570 - RNA, 16 nt, Human
aucggagccuccucuc

SEQ ID NO: 2465571 - RNA, 18 nt, Human
aucggaagcagugccuuc

SEQ ID NO: 2465572 - RNA, 13 nt, Human
aucggagacagug

SEQ ID NO: 2465573 - RNA, 14 nt, Human
aucggaagcagugc

SEQ ID NO: 2465574 - RNA, 22 nt, Human
aucggaagcagugccuuccaua

SEQ ID NO: 2465575 - RNA, 14 nt, Human
aucccauuuaaaaa

SEQ ID NO: 2465576 - RNA, 15 nt, Human
auccaggcagaucca

SEQ ID NO: 2465577 - RNA, 16 nt, Human
auccaggcagauccag

SEQ ID NO: 2465578 - RNA, 14 nt, Human
auccaggcagaucc

SEQ ID NO: 2465579 - RNA, 13 nt, Human
auccccaagccug

SEQ ID NO: 2465580 - RNA, 14 nt, Human
aucccauugcccug

SEQ ID NO: 2465581 - RNA, 16 nt, Human
aucccauugcccuggu

SEQ ID NO: 2465582 - RNA, 17 nt, Human
aucccauugcccugguu

SEQ ID NO: 2465583 - RNA, 15 nt, Human
aucccauuuaaaaaa

SEQ ID NO: 2465584 - RNA, 14 nt, Human
auccagcuggugag

SEQ ID NO: 2465585 - RNA, 22 nt, Human
auccagcuccccuucugaauca

SEQ ID NO: 2465586 - RNA, 13 nt, Human
auccagaaagaaa

SEQ ID NO: 2465587 - RNA, 14 nt, Human
auccagaaagaaaa

SEQ ID NO: 2465588 - RNA, 15 nt, Human
auccagaaagaaaaa

SEQ ID NO: 2465589 - RNA, 15 nt, Human
auccagcuauguuau

SEQ ID NO: 2465590 - RNA, 20 nt, Human
auccagaauugaccuuuuga

SEQ ID NO: 2465591 - RNA, 22 nt, Human
auccaggacuauauuugggccu

SEQ ID NO: 2465592 - RNA, 23 nt, Human
auccaggacuauauuugggccug

SEQ ID NO: 2465593 - RNA, 15 nt, Human
auccaggacucuguc

SEQ ID NO: 2465594 - RNA, 13 nt, Human
auccaggacucug

SEQ ID NO: 2465595 - RNA, 16 nt, Human
auccagaaagaaaacu

SEQ ID NO: 2465596 - RNA, 18 nt, Human
auccagaaagaaaacuug

SEQ ID NO: 2465597 - RNA, 15 nt, Human
auccagacccggcug

SEQ ID NO: 2465598 - RNA, 23 nt, Human
auccuccaggugcacaagcucca

SEQ ID NO: 2465599 - RNA, 23 nt, Human
auccuccagcuucugguacucuc

SEQ ID NO: 2465600 - RNA, 14 nt, Human
auccuccagguuuu

SEQ ID NO: 2465601 - RNA, 13 nt, Human
auccuccagguuu

SEQ ID NO: 2465602 - RNA, 12 nt, Human
auccuccagguu

SEQ ID NO: 2465603 - RNA, 22 nt, Human
auccuccagguuuuucaauuaa

SEQ ID NO: 2465604 - RNA, 21 nt, Human
auccuccagguuuuucaauua

SEQ ID NO: 2465605 - RNA, 20 nt, Human
auccuccagguuuuucaauu

SEQ ID NO: 2465606 - RNA, 19 nt, Human
auccuccagguuuuucaau

SEQ ID NO: 2465607 - RNA, 18 nt, Human
auccuccagguuuuucaa

SEQ ID NO: 2465608 - RNA, 17 nt, Human
auccuccagguuuuuca

SEQ ID NO: 2465609 - RNA, 16 nt, Human
auccuccagguuuuuc

SEQ ID NO: 2465610 - RNA, 15 nt, Human
auccuccagguuuuu

SEQ ID NO: 2465611 - RNA, 15 nt, Human
auccucccaccucag

SEQ ID NO: 2465612 - RNA, 11 nt, Human
auccuccaggu

SEQ ID NO: 2465613 - RNA, 14 nt, Human
auccuccagcuucu

SEQ ID NO: 2465614 - RNA, 13 nt, Human
auccuccagcuuc

SEQ ID NO: 2465615 - RNA, 12 nt, Human
auccuccagcuu

SEQ ID NO: 2465616 - RNA, 11 nt, Human
auccuccagcu

SEQ ID NO: 2465617 - RNA, 13 nt, Human
auccuccagcagg

SEQ ID NO: 2465618 - RNA, 15 nt, Human
auccuccagcaggga

SEQ ID NO: 2465619 - RNA, 11 nt, Human
auccuccagca

SEQ ID NO: 2465620 - RNA, 23 nt, Human
auccuccaacuucauuugaugcu

SEQ ID NO: 2465621 - RNA, 21 nt, Human
auccucauauggcccaguguc

SEQ ID NO: 2465622 - RNA, 20 nt, Human
auccucauauggcccagugu

SEQ ID NO: 2465623 - RNA, 16 nt, Human
auccucauauggccca

SEQ ID NO: 2465624 - RNA, 21 nt, Human
auccucaaacacugcaggcau

SEQ ID NO: 2465625 - RNA, 19 nt, Human
auccuccacguucugcuca

SEQ ID NO: 2465626 - RNA, 23 nt, Human
auccucauuugggguagcuagag

SEQ ID NO: 2465627 - RNA, 12 nt, Human
auccuauguuuu

SEQ ID NO: 2465628 - RNA, 16 nt, Human
auccuaugugauuuua

SEQ ID NO: 2465629 - RNA, 17 nt, Human
auccuaugugauuuuaa

SEQ ID NO: 2465630 - RNA, 20 nt, Human
auccuauguuuuuguucaaa

SEQ ID NO: 2465631 - RNA, 18 nt, Human
auccuauucucaccagga

SEQ ID NO: 2465632 - RNA, 23 nt, Human
auccuaugugauuuuaacucugu

SEQ ID NO: 2465633 - RNA, 18 nt, Human
auccccuggacugggagg

SEQ ID NO: 2465634 - RNA, 12 nt, Human
auccuaugugau

SEQ ID NO: 2465635 - RNA, 14 nt, Human
auccuaugugauuu

SEQ ID NO: 2465636 - RNA, 21 nt, Human
auccccuucucaucacucccc

SEQ ID NO: 2465637 - RNA, 19 nt, Human
auccucaaacacugcaggc

SEQ ID NO: 2465638 - RNA, 17 nt, Human
auccucaaacacugcag

SEQ ID NO: 2465639 - RNA, 16 nt, Human
auccucaaacacugca

SEQ ID NO: 2465640 - RNA, 15 nt, Human
auccucaaacacugc

SEQ ID NO: 2465641 - RNA, 20 nt, Human
auccuauucucaccaggaag

SEQ ID NO: 2465642 - RNA, 22 nt, Human
auccccgcagugugcacuaagg

SEQ ID NO: 2465643 - RNA, 18 nt, Human
auccccgcagugugcacu

SEQ ID NO: 2465644 - RNA, 15 nt, Human
auccccucccuguca

SEQ ID NO: 2465645 - RNA, 13 nt, Human
auccccucccagu

SEQ ID NO: 2465646 - RNA, 13 nt, Human
auccccucaggac

SEQ ID NO: 2465647 - RNA, 15 nt, Human
auccccuguagagug

SEQ ID NO: 2465648 - RNA, 15 nt, Human
auccccucucccccc

SEQ ID NO: 2465649 - RNA, 15 nt, Human
auccccuccuugggc

SEQ ID NO: 2465650 - RNA, 14 nt, Human
auccccuccuuggg

SEQ ID NO: 2465651 - RNA, 19 nt, Human
auccccucccugucaaagc

SEQ ID NO: 2465652 - RNA, 23 nt, Human
auccccucuccccccccccucca

SEQ ID NO: 2465653 - RNA, 12 nt, Human
aucacagggcag

SEQ ID NO: 2465654 - RNA, 15 nt, Human
aucacagggcagagc

SEQ ID NO: 2465655 - RNA, 16 nt, Human
aucacagcugcuuucu

SEQ ID NO: 2465656 - RNA, 22 nt, Human
aucacagcuucagccaggagcu

SEQ ID NO: 2465657 - RNA, 21 nt, Human
aucacagcuucagccaggagc

SEQ ID NO: 2465658 - RNA, 21 nt, Human
aucacagccucugaaaaccaa

SEQ ID NO: 2465659 - RNA, 12 nt, Human
aucacagcugcu

SEQ ID NO: 2465660 - RNA, 18 nt, Human
aucacagcuucagccagg

SEQ ID NO: 2465661 - RNA, 14 nt, Human
aucacagcuucagc

SEQ ID NO: 2465662 - RNA, 23 nt, Human
aucacccgcuaagagggagggag

SEQ ID NO: 2465663 - RNA, 19 nt, Human
aucaccaacgucugugcca

SEQ ID NO: 2465664 - RNA, 18 nt, Human
aucaccaacgucugugcc

SEQ ID NO: 2465665 - RNA, 15 nt, Human
aucacauguggacuu

SEQ ID NO: 2465666 - RNA, 19 nt, Human
aucacagggcagagccggg

SEQ ID NO: 2465667 - RNA, 14 nt, Human
aucacauguauguu

SEQ ID NO: 2465668 - RNA, 20 nt, Human
aucacagggcagagccggga

SEQ ID NO: 2465669 - RNA, 17 nt, Human
auauuuauuuauuuauu

SEQ ID NO: 2465670 - RNA, 15 nt, Human
auauuuauuuuaaua

SEQ ID NO: 2465671 - RNA, 14 nt, Human
auauuuauuuuaau

SEQ ID NO: 2465672 - RNA, 17 nt, Human
auauuuauuuuaauaau

SEQ ID NO: 2465673 - RNA, 23 nt, Human
auauuuauuguuuauuuaucagu

SEQ ID NO: 2465674 - RNA, 21 nt, Human
auauuuauugcuuuauaaaua

SEQ ID NO: 2465675 - RNA, 18 nt, Human
auauuuauugcuuuauaa

SEQ ID NO: 2465676 - RNA, 14 nt, Human
auauuuauugugcu

SEQ ID NO: 2465677 - RNA, 22 nt, Human
auauuuauuguuuauuuaucag

SEQ ID NO: 2465678 - RNA, 19 nt, Human
aucagcacgauuucuguuu

SEQ ID NO: 2465679 - RNA, 20 nt, Human
aucagcacgauuucuguuua

SEQ ID NO: 2465680 - RNA, 19 nt, Human
aucacccuuaccaugugcc

SEQ ID NO: 2465681 - RNA, 23 nt, Human
aucacccuuaccaugugccugau

SEQ ID NO: 2465682 - RNA, 12 nt, Human
aucagccaauua

SEQ ID NO: 2465683 - RNA, 23 nt, Human
aucagcacgauuucuguuuagau

SEQ ID NO: 2465684 - RNA, 21 nt, Human
aucaccgaaaacguggcugcu

SEQ ID NO: 2465685 - RNA, 19 nt, Human
aucaccgaaaacguggcug

SEQ ID NO: 2465686 - RNA, 14 nt, Human
aucaccgaaaacgu

SEQ ID NO: 2465687 - RNA, 22 nt, Human
aucacauuauuugcauguuacc

SEQ ID NO: 2465688 - RNA, 17 nt, Human
aucacauguauguuuug

SEQ ID NO: 2465689 - RNA, 16 nt, Human
aucacauguauguuuu

SEQ ID NO: 2465690 - RNA, 15 nt, Human
aucacauuauuugca

SEQ ID NO: 2465691 - RNA, 16 nt, Human
aucacauuauuugcau

SEQ ID NO: 2465692 - RNA, 21 nt, Human
aucagccugucucuuccauau

SEQ ID NO: 2465693 - RNA, 19 nt, Human
aucagccugucucuuccau

SEQ ID NO: 2465694 - RNA, 18 nt, Human
aucagccugucucuucca

SEQ ID NO: 2465695 - RNA, 20 nt, Human
aucagccugcuccagcuguu

SEQ ID NO: 2465696 - RNA, 14 nt, Human
aucagccugucucu

SEQ ID NO: 2465697 - RNA, 19 nt, Human
aucagccugcuccagcugu

SEQ ID NO: 2465698 - RNA, 17 nt, Human
aucagccugcuccagcu

SEQ ID NO: 2465699 - RNA, 18 nt, Human
aucagccugcuccagcug

SEQ ID NO: 2465700 - RNA, 14 nt, Human
aucagccugugcca

SEQ ID NO: 2465701 - RNA, 23 nt, Human
aucagcggccccuugacucuggg

SEQ ID NO: 2465702 - RNA, 15 nt, Human
aucagcuauuuacug

SEQ ID NO: 2465703 - RNA, 14 nt, Human
aucagcuauuuacu

SEQ ID NO: 2465704 - RNA, 21 nt, Human
aucagcugcugaaacaacaaa

SEQ ID NO: 2465705 - RNA, 13 nt, Human
aucagcuccuucc

SEQ ID NO: 2465706 - RNA, 15 nt, Human
aucagcuccuuccug

SEQ ID NO: 2465707 - RNA, 18 nt, Human
aucagcuccacuuucagu

SEQ ID NO: 2465708 - RNA, 16 nt, Human
aucaugugaaaucauu

SEQ ID NO: 2465709 - RNA, 14 nt, Human
aucaugugaaauca

SEQ ID NO: 2465710 - RNA, 21 nt, Human
aucaugugaacccgggacgca

SEQ ID NO: 2465711 - RNA, 20 nt, Human
aucauguguaaucaauaaac

SEQ ID NO: 2465712 - RNA, 19 nt, Human
aucauguguaaucaauaaa

SEQ ID NO: 2465713 - RNA, 15 nt, Human
aucauguguaaucaa

SEQ ID NO: 2465714 - RNA, 13 nt, Human
aucauguguaauc

SEQ ID NO: 2465715 - RNA, 21 nt, Human
aucauguguaaucaauaaacg

SEQ ID NO: 2465716 - RNA, 22 nt, Human
aucagcugcugaaacaacaaau

SEQ ID NO: 2465717 - RNA, 23 nt, Human
aucagcugcugaaacaacaaaua

SEQ ID NO: 2465718 - RNA, 15 nt, Human
aucaugugaaaucau

SEQ ID NO: 2465719 - RNA, 17 nt, Human
aucagcuccuuccugga

SEQ ID NO: 2465720 - RNA, 22 nt, Human
aucagcuggucaaacaaacucu

SEQ ID NO: 2465721 - RNA, 20 nt, Human
cugggcaccggggccucgga

SEQ ID NO: 2465722 - RNA, 12 nt, Human
cugggcagaagg

SEQ ID NO: 2465723 - RNA, 20 nt, Human
cugggcaccuggggaguggg

SEQ ID NO: 2465724 - RNA, 16 nt, Human
cugggcaccuggggag

SEQ ID NO: 2465725 - RNA, 17 nt, Human
cugggcaccuggggagu

SEQ ID NO: 2465726 - RNA, 19 nt, Human
cugggcaccuggggagugg

SEQ ID NO: 2465727 - RNA, 15 nt, Human
cugggcagaaggaag

SEQ ID NO: 2465728 - RNA, 14 nt, Human
cugggcauugcuuu

SEQ ID NO: 2465729 - RNA, 16 nt, Human
cugggcauugcuuucc

SEQ ID NO: 2465730 - RNA, 17 nt, Human
cugggcauugcuuucca

SEQ ID NO: 2465731 - RNA, 12 nt, Human
cugggccagaau

SEQ ID NO: 2465732 - RNA, 18 nt, Human
cugggccacuucugggug

SEQ ID NO: 2465733 - RNA, 21 nt, Human
cugggccaaguuccucuagug

SEQ ID NO: 2465734 - RNA, 19 nt, Human
cugggccaacucaccugag

SEQ ID NO: 2465735 - RNA, 15 nt, Human
cugggccaaguuccu

SEQ ID NO: 2465736 - RNA, 18 nt, Human
cugggccaaguuccucua

SEQ ID NO: 2465737 - RNA, 20 nt, Human
cugggccaaguuccucuagu

SEQ ID NO: 2465738 - RNA, 13 nt, Human
cugggccagagua

SEQ ID NO: 2465739 - RNA, 12 nt, Human
cugggcauuuuc

SEQ ID NO: 2465740 - RNA, 14 nt, Human
cugggccagaauuu

SEQ ID NO: 2465741 - RNA, 14 nt, Human
cuggggagaaagua

SEQ ID NO: 2465742 - RNA, 16 nt, Human
cuggggaugucucuca

SEQ ID NO: 2465743 - RNA, 17 nt, Human
cuggggaugucucucau

SEQ ID NO: 2465744 - RNA, 21 nt, Human
cuggggcacuuggcagcgcgg

SEQ ID NO: 2465745 - RNA, 20 nt, Human
cuggggagugggacagaguc

SEQ ID NO: 2465746 - RNA, 15 nt, Human
cuggggagcccgucu

SEQ ID NO: 2465747 - RNA, 12 nt, Human
cuggggagcccg

SEQ ID NO: 2465748 - RNA, 20 nt, Human
cuggggagcccgucucagug

SEQ ID NO: 2465749 - RNA, 17 nt, Human
cuggggagugggacaga

SEQ ID NO: 2465750 - RNA, 20 nt, Human
cuggguucacugcaaccucc

SEQ ID NO: 2465751 - RNA, 18 nt, Human
cuggguucacugcaaccu

SEQ ID NO: 2465752 - RNA, 18 nt, Human
cuggguucagaaaugcug

SEQ ID NO: 2465753 - RNA, 22 nt, Human
cugggugggugguggggagggg

SEQ ID NO: 2465754 - RNA, 20 nt, Human
cugggugggugguggggagg

SEQ ID NO: 2465755 - RNA, 19 nt, Human
cugggugggugguggggag

SEQ ID NO: 2465756 - RNA, 18 nt, Human
cuggguggguggugggga

SEQ ID NO: 2465757 - RNA, 17 nt, Human
cuggguggguggugggg

SEQ ID NO: 2465758 - RNA, 15 nt, Human
cuggguggguggugg

SEQ ID NO: 2465759 - RNA, 12 nt, Human
cugggugggugg

SEQ ID NO: 2465760 - RNA, 22 nt, Human
cuggguucagaaaugcugccug

SEQ ID NO: 2465761 - RNA, 21 nt, Human
cuggguucagaaaugcugccu

SEQ ID NO: 2465762 - RNA, 23 nt, Human
cuggguucagaaaugcugccugc

SEQ ID NO: 2465763 - RNA, 16 nt, Human
cuggucuucuuugggu

SEQ ID NO: 2465764 - RNA, 19 nt, Human
cuggguggccucgggacac

SEQ ID NO: 2465765 - RNA, 18 nt, Human
cuggggcugaccuuccuc

SEQ ID NO: 2465766 - RNA, 23 nt, Human
cuggguggccucgggacaccugc

SEQ ID NO: 2465767 - RNA, 13 nt, Human
cugggugggcucu

SEQ ID NO: 2465768 - RNA, 15 nt, Human
cugggugggcucugu

SEQ ID NO: 2465769 - RNA, 14 nt, Human
cugggugggcucug

SEQ ID NO: 2465770 - RNA, 15 nt, Human
cuggguggggcagug

SEQ ID NO: 2465771 - RNA, 15 nt, Human
cuggguucacugcaa

SEQ ID NO: 2465772 - RNA, 13 nt, Human
cuggguggggcug

SEQ ID NO: 2465773 - RNA, 17 nt, Human
cuggguggggcugcucc

SEQ ID NO: 2465774 - RNA, 18 nt, Human
cuggguggggcugcuccu

SEQ ID NO: 2465775 - RNA, 20 nt, Human
cuggguggggcugcuccucc

SEQ ID NO: 2465776 - RNA, 21 nt, Human
cuggguggggcugcuccucca

SEQ ID NO: 2465777 - RNA, 22 nt, Human
cuggguggggcugcuccuccag

SEQ ID NO: 2465778 - RNA, 16 nt, Human
cuggguggggugagga

SEQ ID NO: 2465779 - RNA, 21 nt, Human
cuggguggggugaggaccacu

SEQ ID NO: 2465780 - RNA, 15 nt, Human
cuggggcagucaccu

SEQ ID NO: 2465781 - RNA, 15 nt, Human
cuggggccacacaga

SEQ ID NO: 2465782 - RNA, 15 nt, Human
cuggggccaggcugg

SEQ ID NO: 2465783 - RNA, 17 nt, Human
cuggggccacacagaaa

SEQ ID NO: 2465784 - RNA, 18 nt, Human
cuggggcuagggggagcc

SEQ ID NO: 2465785 - RNA, 18 nt, Human
cuggggccacacagaaac

SEQ ID NO: 2465786 - RNA, 19 nt, Human
cuggggcuaggcuggagcc

SEQ ID NO: 2465787 - RNA, 19 nt, Human
cuggggcuccuuucuccag

SEQ ID NO: 2465788 - RNA, 22 nt, Human
cuggggcucccuucaucuccag

SEQ ID NO: 2465789 - RNA, 14 nt, Human
cuggggcucccuuc

SEQ ID NO: 2465790 - RNA, 12 nt, Human
cuggggcucccu

SEQ ID NO: 2465791 - RNA, 23 nt, Human
cuggggcuccuuucuccagccag

SEQ ID NO: 2465792 - RNA, 20 nt, Human
cuggggcuccuuucuccagc

SEQ ID NO: 2465793 - RNA, 14 nt, Human
cuggggcucuggga

SEQ ID NO: 2465794 - RNA, 15 nt, Human
cuggggcucugggau

SEQ ID NO: 2465795 - RNA, 14 nt, Human
cuggggcucugugc

SEQ ID NO: 2465796 - RNA, 17 nt, Human
cuggggcucugugcagg

SEQ ID NO: 2465797 - RNA, 19 nt, Human
cuggggcucugugcaggga

SEQ ID NO: 2465798 - RNA, 14 nt, Human
cuggggcugaccuu

SEQ ID NO: 2465799 - RNA, 13 nt, Human
cuggggcugaagg

SEQ ID NO: 2465800 - RNA, 16 nt, Human
cuggguggccucggga

SEQ ID NO: 2465801 - RNA, 18 nt, Human
cuggcagaguugaagaca

SEQ ID NO: 2465802 - RNA, 17 nt, Human
cuggcagaguugaagac

SEQ ID NO: 2465803 - RNA, 23 nt, Human
cuggcagaaugcuagcucugagc

SEQ ID NO: 2465804 - RNA, 19 nt, Human
cuggcagaguugaagacag

SEQ ID NO: 2465805 - RNA, 14 nt, Human
cuggcagaggaggg

SEQ ID NO: 2465806 - RNA, 15 nt, Human
cuggcagcagagugu

SEQ ID NO: 2465807 - RNA, 12 nt, Human
cuggcagccccu

SEQ ID NO: 2465808 - RNA, 11 nt, Human
cuggcagccca

SEQ ID NO: 2465809 - RNA, 22 nt, Human
cuggcagccgugccuucagcuc

SEQ ID NO: 2465810 - RNA, 21 nt, Human
cuggcagccgugccuucagcu

SEQ ID NO: 2465811 - RNA, 14 nt, Human
cuggcagccuccca

SEQ ID NO: 2465812 - RNA, 15 nt, Human
cuggcagccucccau

SEQ ID NO: 2465813 - RNA, 12 nt, Human
cuggcagccucc

SEQ ID NO: 2465814 - RNA, 13 nt, Human
cuggcagccccug

SEQ ID NO: 2465815 - RNA, 20 nt, Human
cuggcagccgugccuucagc

SEQ ID NO: 2465816 - RNA, 19 nt, Human
cuggcagccgugccuucag

SEQ ID NO: 2465817 - RNA, 20 nt, Human
cugggacuuccuugcucucc

SEQ ID NO: 2465818 - RNA, 18 nt, Human
cugggacuuccuugcucu

SEQ ID NO: 2465819 - RNA, 17 nt, Human
cugggacuuccuugcuc

SEQ ID NO: 2465820 - RNA, 16 nt, Human
cugggacuuccuugcu

SEQ ID NO: 2465821 - RNA, 21 nt, Human
cugggacuuccuugcucuccc

SEQ ID NO: 2465822 - RNA, 16 nt, Human
cugggacugagccagu

SEQ ID NO: 2465823 - RNA, 15 nt, Human
cugggacugagccag

SEQ ID NO: 2465824 - RNA, 14 nt, Human
cugggacugagcca

SEQ ID NO: 2465825 - RNA, 13 nt, Human
cugggacugagcc

SEQ ID NO: 2465826 - RNA, 21 nt, Human
cugggacucagccuucagaca

SEQ ID NO: 2465827 - RNA, 18 nt, Human
cugggacucagccuucag

SEQ ID NO: 2465828 - RNA, 14 nt, Human
cugggacuuccuug

SEQ ID NO: 2465829 - RNA, 20 nt, Human
cugggacugagccaguccca

SEQ ID NO: 2465830 - RNA, 13 nt, Human
cugggacuggcca

SEQ ID NO: 2465831 - RNA, 14 nt, Human
cugggacuggccag

SEQ ID NO: 2465832 - RNA, 17 nt, Human
cugggacucagccuuca

SEQ ID NO: 2465833 - RNA, 16 nt, Human
cugggacucagccuuc

SEQ ID NO: 2465834 - RNA, 15 nt, Human
cugggacucagccuu

SEQ ID NO: 2465835 - RNA, 14 nt, Human
cugggacucagccu

SEQ ID NO: 2465836 - RNA, 13 nt, Human
cugggacucagcc

SEQ ID NO: 2465837 - RNA, 23 nt, Human
cugggaauguauuauucugcagc

SEQ ID NO: 2465838 - RNA, 24 nt, Human
cuggcucugcaaugggcacuggga

SEQ ID NO: 2465839 - RNA, 24 nt, Human
cuggcucugagcgccuccauccaa

SEQ ID NO: 2465840 - RNA, 18 nt, Human
cugggaauaagugccagg

SEQ ID NO: 2465841 - RNA, 18 nt, Human
cuggcucugcaaugggca

SEQ ID NO: 2465842 - RNA, 13 nt, Human
cugggaauguauu

SEQ ID NO: 2465843 - RNA, 18 nt, Human
cugggaauguauuauucu

SEQ ID NO: 2465844 - RNA, 19 nt, Human
cugggaauguauuauucug

SEQ ID NO: 2465845 - RNA, 22 nt, Human
cugggaauguauuauucugcag

SEQ ID NO: 2465846 - RNA, 11 nt, Human
cugggacacag

SEQ ID NO: 2465847 - RNA, 21 nt, Human
cuggcucugagcgccuccauc

SEQ ID NO: 2465848 - RNA, 20 nt, Human
cuggcucugagcgccuccau

SEQ ID NO: 2465849 - RNA, 13 nt, Human
cuggcucugagcg

SEQ ID NO: 2465850 - RNA, 12 nt, Human
cuggcucugagc

SEQ ID NO: 2465851 - RNA, 16 nt, Human
cuggcucucuccagga

SEQ ID NO: 2465852 - RNA, 15 nt, Human
cuggcucucuccagg

SEQ ID NO: 2465853 - RNA, 14 nt, Human
cuggcucucuccag

SEQ ID NO: 2465854 - RNA, 13 nt, Human
cuggcucucucca

SEQ ID NO: 2465855 - RNA, 23 nt, Human
cuggcucuccaagugccagaggu

SEQ ID NO: 2465856 - RNA, 14 nt, Human
cuggcucuccaagu

SEQ ID NO: 2465857 - RNA, 13 nt, Human
cuggcucuccaag

SEQ ID NO: 2465858 - RNA, 12 nt, Human
cuggcucuccaa

SEQ ID NO: 2465859 - RNA, 17 nt, Human
cuggcucucaugggguc

SEQ ID NO: 2465860 - RNA, 22 nt, Human
cuggccguugauguuggcuggg

SEQ ID NO: 2465861 - RNA, 19 nt, Human
cuggcucuccaagugccag

SEQ ID NO: 2465862 - RNA, 17 nt, Human
cuggcucuccaagugcc

SEQ ID NO: 2465863 - RNA, 16 nt, Human
cuggcucuccaagugc

SEQ ID NO: 2465864 - RNA, 15 nt, Human
cuggcucuccaagug

SEQ ID NO: 2465865 - RNA, 22 nt, Human
cuggcucuccaagugccagagg

SEQ ID NO: 2465866 - RNA, 20 nt, Human
cuggcucuccaagugccaga

SEQ ID NO: 2465867 - RNA, 20 nt, Human
cuggcucucccauuuccuga

SEQ ID NO: 2465868 - RNA, 14 nt, Human
cuggccuagcauac

SEQ ID NO: 2465869 - RNA, 23 nt, Human
cuggccguugauguuggcuggga

SEQ ID NO: 2465870 - RNA, 15 nt, Human
cuggccgugggccug

SEQ ID NO: 2465871 - RNA, 23 nt, Human
cuggccggucugcaagucagagg

SEQ ID NO: 2465872 - RNA, 22 nt, Human
cuggccggucugcaagucagag

SEQ ID NO: 2465873 - RNA, 19 nt, Human
cuggccgucacuugugggg

SEQ ID NO: 2465874 - RNA, 15 nt, Human
cuggcccugcccugg

SEQ ID NO: 2465875 - RNA, 16 nt, Human
cuggccgggagccuga

SEQ ID NO: 2465876 - RNA, 22 nt, Human
cuggccgggaccccgagccugg

SEQ ID NO: 2465877 - RNA, 16 nt, Human
cuggccggucugcaag

SEQ ID NO: 2465878 - RNA, 21 nt, Human
cuggccggucugcaagucaga

SEQ ID NO: 2465879 - RNA, 20 nt, Human
cuggccggucugcaagucag

SEQ ID NO: 2465880 - RNA, 17 nt, Human
cuggccggucugcaagu

SEQ ID NO: 2465881 - RNA, 18 nt, Human
cuggccccugagaucucu

SEQ ID NO: 2465882 - RNA, 22 nt, Human
cuggccccugagaucucugcag

SEQ ID NO: 2465883 - RNA, 12 nt, Human
cuggccccuggg

SEQ ID NO: 2465884 - RNA, 23 nt, Human
cuggccccugagaucucugcagg

SEQ ID NO: 2465885 - RNA, 20 nt, Human
cuggcagccucccauccagg

SEQ ID NO: 2465886 - RNA, 22 nt, Human
cuggcagccucccauccagggc

SEQ ID NO: 2465887 - RNA, 22 nt, Human
cuggccccucagggucccuggu

SEQ ID NO: 2465888 - RNA, 11 nt, Human
cuggcccugcc

SEQ ID NO: 2465889 - RNA, 13 nt, Human
cuggcccugcccu

SEQ ID NO: 2465890 - RNA, 20 nt, Human
cuggcccugagguguggggg

SEQ ID NO: 2465891 - RNA, 19 nt, Human
cuggcccugaggugugggg

SEQ ID NO: 2465892 - RNA, 17 nt, Human
cuggcccugaggugugg

SEQ ID NO: 2465893 - RNA, 14 nt, Human
cuggcccugcccug

SEQ ID NO: 2465894 - RNA, 14 nt, Human
cuggcccucugugu

SEQ ID NO: 2465895 - RNA, 13 nt, Human
cuggcccucugug

SEQ ID NO: 2465896 - RNA, 14 nt, Human
cuggcccugaggug

SEQ ID NO: 2465897 - RNA, 16 nt, Human
cuggcccucuguguug

SEQ ID NO: 2465898 - RNA, 13 nt, Human
cuggcccugaggu

SEQ ID NO: 2465899 - RNA, 14 nt, Human
cuggccccuggguc

SEQ ID NO: 2465900 - RNA, 13 nt, Human
cuggccccugggu

SEQ ID NO: 2465901 - RNA, 18 nt, Human
cuggcccgucauguuccu

SEQ ID NO: 2465902 - RNA, 22 nt, Human
cugccuguugggccaggagccu

SEQ ID NO: 2465903 - RNA, 21 nt, Human
cugccuguugggccaggagcc

SEQ ID NO: 2465904 - RNA, 23 nt, Human
cugccuguugggccaggagccuc

SEQ ID NO: 2465905 - RNA, 15 nt, Human
cugccuguaguuagg

SEQ ID NO: 2465906 - RNA, 22 nt, Human
cugcuagcacuuggagccaagg

SEQ ID NO: 2465907 - RNA, 15 nt, Human
cugcucagcuucucc

SEQ ID NO: 2465908 - RNA, 19 nt, Human
cugcuauauuuucaugacu

SEQ ID NO: 2465909 - RNA, 17 nt, Human
cugcuauauuuucauga

SEQ ID NO: 2465910 - RNA, 15 nt, Human
cugcuauagccuggg

SEQ ID NO: 2465911 - RNA, 14 nt, Human
cugcuauagccugg

SEQ ID NO: 2465912 - RNA, 23 nt, Human
cugcuaggugggccagccccucc

SEQ ID NO: 2465913 - RNA, 19 nt, Human
cugcuaggcgagugccagg

SEQ ID NO: 2465914 - RNA, 18 nt, Human
cugcuaggcgagugccag

SEQ ID NO: 2465915 - RNA, 15 nt, Human
cugcuaggcgagugc

SEQ ID NO: 2465916 - RNA, 22 nt, Human
cugcuaggcgagugccaggacu

SEQ ID NO: 2465917 - RNA, 20 nt, Human
cugcuaggcgagugccagga

SEQ ID NO: 2465918 - RNA, 23 nt, Human
cugcuaggcgagugccaggacuc

SEQ ID NO: 2465919 - RNA, 15 nt, Human
cugcuaggugggcca

SEQ ID NO: 2465920 - RNA, 16 nt, Human
cugcuaggugggccag

SEQ ID NO: 2465921 - RNA, 20 nt, Human
cugcuaggugggccagcccc

SEQ ID NO: 2465922 - RNA, 21 nt, Human
cugcuaggugggccagccccu

SEQ ID NO: 2465923 - RNA, 22 nt, Human
cugcuaggugggccagccccuc

SEQ ID NO: 2465924 - RNA, 19 nt, Human
cugcugaccuccacagcuu

SEQ ID NO: 2465925 - RNA, 18 nt, Human
cugcugacuguuuucucu

SEQ ID NO: 2465926 - RNA, 21 nt, Human
cugcugacuguuuucucuuga

SEQ ID NO: 2465927 - RNA, 16 nt, Human
cugcucaucauucucu

SEQ ID NO: 2465928 - RNA, 17 nt, Human
cugcucaucauucucug

SEQ ID NO: 2465929 - RNA, 18 nt, Human
cugcucaucauucucugu

SEQ ID NO: 2465930 - RNA, 22 nt, Human
cugcucaucauucucugucuca

SEQ ID NO: 2465931 - RNA, 22 nt, Human
cugcugacccagccuguuuuaa

SEQ ID NO: 2465932 - RNA, 18 nt, Human
cugcucagcuucuccugu

SEQ ID NO: 2465933 - RNA, 16 nt, Human
cugcugaccuccacag

SEQ ID NO: 2465934 - RNA, 18 nt, Human
cugcugaccuccacagcu

SEQ ID NO: 2465935 - RNA, 19 nt, Human
cugcucaguaaagcacuug

SEQ ID NO: 2465936 - RNA, 15 nt, Human
cugcucauauuguga

SEQ ID NO: 2465937 - RNA, 19 nt, Human
cugcucauauugugauucu

SEQ ID NO: 2465938 - RNA, 12 nt, Human
cugcucaucauu

SEQ ID NO: 2465939 - RNA, 18 nt, Human
cugcucaguaaagcacuu

SEQ ID NO: 2465940 - RNA, 23 nt, Human
cugcucagggaaaagcagcucuc

SEQ ID NO: 2465941 - RNA, 23 nt, Human
cugcuauauuuucaugacuuuuc

SEQ ID NO: 2465942 - RNA, 16 nt, Human
cugcucagcuucuccu

SEQ ID NO: 2465943 - RNA, 22 nt, Human
cugcucagggaaaagcagcucu

SEQ ID NO: 2465944 - RNA, 20 nt, Human
cugccuccccucuccuuccu

SEQ ID NO: 2465945 - RNA, 20 nt, Human
cugccucccucacccugagc

SEQ ID NO: 2465946 - RNA, 19 nt, Human
cugccucccucacccugag

SEQ ID NO: 2465947 - RNA, 18 nt, Human
cugccucccucacccuga

SEQ ID NO: 2465948 - RNA, 22 nt, Human
cugccuccccugugcaguccug

SEQ ID NO: 2465949 - RNA, 22 nt, Human
cugccucccucacccugagccc

SEQ ID NO: 2465950 - RNA, 21 nt, Human
cugccucccucacccugagcc

SEQ ID NO: 2465951 - RNA, 14 nt, Human
cugccucccuucau

SEQ ID NO: 2465952 - RNA, 17 nt, Human
cugccuccccugugcag

SEQ ID NO: 2465953 - RNA, 16 nt, Human
cugccuccccugugca

SEQ ID NO: 2465954 - RNA, 14 nt, Human
cugccucccucacc

SEQ ID NO: 2465955 - RNA, 13 nt, Human
cugccuccccugu

SEQ ID NO: 2465956 - RNA, 19 nt, Human
cugaucugacauccccacu

SEQ ID NO: 2465957 - RNA, 18 nt, Human
cugaucugacauccccac

SEQ ID NO: 2465958 - RNA, 20 nt, Human
cugaucugaugcaagcaaga

SEQ ID NO: 2465959 - RNA, 22 nt, Human
cugaucugugcuuuccagcuca

SEQ ID NO: 2465960 - RNA, 21 nt, Human
cugaucugugcuuuccagcuc

SEQ ID NO: 2465961 - RNA, 20 nt, Human
cugaucugugcuuuccagcu

SEQ ID NO: 2465962 - RNA, 18 nt, Human
cugaucugugcuuuccag

SEQ ID NO: 2465963 - RNA, 17 nt, Human
cugaucugugcuuucca

SEQ ID NO: 2465964 - RNA, 13 nt, Human
cugaucugugcuu

SEQ ID NO: 2465965 - RNA, 13 nt, Human
cugaucugguuug

SEQ ID NO: 2465966 - RNA, 23 nt, Human
cugaucugugcuuuccagcucac

SEQ ID NO: 2465967 - RNA, 20 nt, Human
cugaugaacuuauucuguag

SEQ ID NO: 2465968 - RNA, 21 nt, Human
cugaugaacucuuaaucaaau

SEQ ID NO: 2465969 - RNA, 20 nt, Human
cugccuguugggccaggagc

SEQ ID NO: 2465970 - RNA, 19 nt, Human
cugccuguucagcuccagc

SEQ ID NO: 2465971 - RNA, 18 nt, Human
cugccuguucagcuccag

SEQ ID NO: 2465972 - RNA, 17 nt, Human
cugccuguucagcucca

SEQ ID NO: 2465973 - RNA, 17 nt, Human
cugccugguccucacac

SEQ ID NO: 2465974 - RNA, 19 nt, Human
cugccugguccucacacuc

SEQ ID NO: 2465975 - RNA, 23 nt, Human
cugccugguccucacacucaccc

SEQ ID NO: 2465976 - RNA, 16 nt, Human
cugccugguccucaca

SEQ ID NO: 2465977 - RNA, 20 nt, Human
cugccuguagcccacucugc

SEQ ID NO: 2465978 - RNA, 22 nt, Human
cugccuguagcccacucugcuc

SEQ ID NO: 2465979 - RNA, 23 nt, Human
cugccuguagcccacucugcucg

SEQ ID NO: 2465980 - RNA, 13 nt, Human
cugccuguaguua

SEQ ID NO: 2465981 - RNA, 15 nt, Human
cugccuguagcccac

SEQ ID NO: 2465982 - RNA, 19 nt, Human
cugccuguagcccacucug

SEQ ID NO: 2465983 - RNA, 16 nt, Human
cugccuguagcaguga

SEQ ID NO: 2465984 - RNA, 19 nt, Human
cugccuguaacuugagagu

SEQ ID NO: 2465985 - RNA, 23 nt, Human
cugccucucccaucacuucccua

SEQ ID NO: 2465986 - RNA, 15 nt, Human
cugccucucccauca

SEQ ID NO: 2465987 - RNA, 22 nt, Human
cugccucucccaucacuucccu

SEQ ID NO: 2465988 - RNA, 24 nt, Human
cugccuccucuucaacugaccagc

SEQ ID NO: 2465989 - RNA, 15 nt, Human
cugccuccucuucaa

SEQ ID NO: 2465990 - RNA, 14 nt, Human
cugccuccucuuca

SEQ ID NO: 2465991 - RNA, 13 nt, Human
cugccuccucuuc

SEQ ID NO: 2465992 - RNA, 15 nt, Human
cugccucccuucaug

SEQ ID NO: 2465993 - RNA, 17 nt, Human
cugccucccuucaugca

SEQ ID NO: 2465994 - RNA, 18 nt, Human
cugccucccuucaugcau

SEQ ID NO: 2465995 - RNA, 19 nt, Human
cugccucccuucaugcaug

SEQ ID NO: 2465996 - RNA, 21 nt, Human
cugccucccuucaugcaugga

SEQ ID NO: 2465997 - RNA, 23 nt, Human
cugccucccuucaugcauggaaa

SEQ ID NO: 2465998 - RNA, 23 nt, Human
cugccuccgcgugaucaaagcca

SEQ ID NO: 2465999 - RNA, 21 nt, Human
cugcuucaaggauccugagcc

SEQ ID NO: 2466000 - RNA, 13 nt, Human
cugcuucaaggau

SEQ ID NO: 2466001 - RNA, 12 nt, Human
cugcuucaagga

SEQ ID NO: 2466002 - RNA, 19 nt, Human
cugcuucaaauauuucccu

SEQ ID NO: 2466003 - RNA, 23 nt, Human
cugcuucaaggauccugagccag

SEQ ID NO: 2466004 - RNA, 22 nt, Human
cugcuucaaggauccugagcca

SEQ ID NO: 2466005 - RNA, 20 nt, Human
cugcuuuugucuaugggacu

SEQ ID NO: 2466006 - RNA, 14 nt, Human
cugcuucaaauauu

SEQ ID NO: 2466007 - RNA, 22 nt, Human
cuggaguuucauguacaagaug

SEQ ID NO: 2466008 - RNA, 13 nt, Human
cuggaguuucaug

SEQ ID NO: 2466009 - RNA, 18 nt, Human
cuggaguugaucuggaac

SEQ ID NO: 2466010 - RNA, 23 nt, Human
cuggaguuuuuguuuggagagca

SEQ ID NO: 2466011 - RNA, 22 nt, Human
cuggaguuuuuguuuggagagc

SEQ ID NO: 2466012 - RNA, 18 nt, Human
cuggaguuucauguacaa

SEQ ID NO: 2466013 - RNA, 14 nt, Human
cuggauaacuuagg

SEQ ID NO: 2466014 - RNA, 17 nt, Human
cuggauaaagccacuga

SEQ ID NO: 2466015 - RNA, 16 nt, Human
cuggauaaagccacug

SEQ ID NO: 2466016 - RNA, 13 nt, Human
cuggauaaaauga

SEQ ID NO: 2466017 - RNA, 15 nt, Human
cuggauaggagccug

SEQ ID NO: 2466018 - RNA, 13 nt, Human
cuggauaggagcc

SEQ ID NO: 2466019 - RNA, 15 nt, Human
cuggauaacuuaggu

SEQ ID NO: 2466020 - RNA, 19 nt, Human
cuggauaggagccugcugg

SEQ ID NO: 2466021 - RNA, 18 nt, Human
cuggauaggagccugcug

SEQ ID NO: 2466022 - RNA, 20 nt, Human
cuggauaggagccugcuggu

SEQ ID NO: 2466023 - RNA, 13 nt, Human
cuggauauuuuca

SEQ ID NO: 2466024 - RNA, 15 nt, Human
cuggauauuuucaaa

SEQ ID NO: 2466025 - RNA, 16 nt, Human
cuggauauuuucaaau

SEQ ID NO: 2466026 - RNA, 22 nt, Human
cuggaucacagcugcuuucugu

SEQ ID NO: 2466027 - RNA, 16 nt, Human
cuggaucacagcugcu

SEQ ID NO: 2466028 - RNA, 14 nt, Human
cuggaucacagcug

SEQ ID NO: 2466029 - RNA, 23 nt, Human
cuggaucaaaguaggcaggacca

SEQ ID NO: 2466030 - RNA, 21 nt, Human
cuggauauuuucaaauuguau

SEQ ID NO: 2466031 - RNA, 22 nt, Human
cuggauauuuucaaauuguauc

SEQ ID NO: 2466032 - RNA, 21 nt, Human
cugcuuuugucuaugggacuc

SEQ ID NO: 2466033 - RNA, 19 nt, Human
cugcuuuuuaaagaaugcu

SEQ ID NO: 2466034 - RNA, 19 nt, Human
cugcuuuugucuaugggac

SEQ ID NO: 2466035 - RNA, 14 nt, Human
cuggaacuugggga

SEQ ID NO: 2466036 - RNA, 21 nt, Human
cugcuucaauacccaaauccu

SEQ ID NO: 2466037 - RNA, 13 nt, Human
cuggaagacagag

SEQ ID NO: 2466038 - RNA, 12 nt, Human
cuggaagagagg

SEQ ID NO: 2466039 - RNA, 18 nt, Human
cuggaagauccugcgggu

SEQ ID NO: 2466040 - RNA, 14 nt, Human
cuggaagauccugc

SEQ ID NO: 2466041 - RNA, 21 nt, Human
cuggaagacagagaccuccug

SEQ ID NO: 2466042 - RNA, 13 nt, Human
cuggaagagagga

SEQ ID NO: 2466043 - RNA, 23 nt, Human
cuggacugaagccugcaggaguu

SEQ ID NO: 2466044 - RNA, 23 nt, Human
cuggacucucagucucugagcag

SEQ ID NO: 2466045 - RNA, 18 nt, Human
cuggacuuuccugcaacu

SEQ ID NO: 2466046 - RNA, 16 nt, Human
cuggacuuuccugcaa

SEQ ID NO: 2466047 - RNA, 15 nt, Human
cuggacuuuccugca

SEQ ID NO: 2466048 - RNA, 14 nt, Human
cuggacuuuccugc

SEQ ID NO: 2466049 - RNA, 13 nt, Human
cuggacuuuccug

SEQ ID NO: 2466050 - RNA, 20 nt, Human
cuggaguugaucuggaaccc

SEQ ID NO: 2466051 - RNA, 22 nt, Human
cuggaguugaucuggaacccag

SEQ ID NO: 2466052 - RNA, 14 nt, Human
cuggagaaaaugga

SEQ ID NO: 2466053 - RNA, 13 nt, Human
cuggacuuggagg

SEQ ID NO: 2466054 - RNA, 22 nt, Human
cuggacugccuugaauaucccc

SEQ ID NO: 2466055 - RNA, 20 nt, Human
cuggacuugagcuuggcagc

SEQ ID NO: 2466056 - RNA, 22 nt, Human
cuggacugaagccugcaggagu

SEQ ID NO: 2466057 - RNA, 20 nt, Human
cuggacugccuugaauaucc

SEQ ID NO: 2466058 - RNA, 18 nt, Human
cuggacuugagcuuggca

SEQ ID NO: 2466059 - RNA, 18 nt, Human
cuggacugaggccugagc

SEQ ID NO: 2466060 - RNA, 16 nt, Human
cuggacugaggccuga

SEQ ID NO: 2466061 - RNA, 15 nt, Human
cuggacugaggccug

SEQ ID NO: 2466062 - RNA, 13 nt, Human
cuggacugaggcc

SEQ ID NO: 2466063 - RNA, 16 nt, Human
cuggacugaagccugc

SEQ ID NO: 2466064 - RNA, 19 nt, Human
cuggacugaagccugcagg

SEQ ID NO: 2466065 - RNA, 12 nt, Human
cuggacugaggc

SEQ ID NO: 2466066 - RNA, 16 nt, Human
cugucgcccagucugg

SEQ ID NO: 2466067 - RNA, 19 nt, Human
cugucgccuuagcauguuu

SEQ ID NO: 2466068 - RNA, 18 nt, Human
cugucgccuuagcauguu

SEQ ID NO: 2466069 - RNA, 22 nt, Human
cuguccuguacauugugggaug

SEQ ID NO: 2466070 - RNA, 17 nt, Human
cugucgccuuagcaugu

SEQ ID NO: 2466071 - RNA, 14 nt, Human
cuguccuguacauu

SEQ ID NO: 2466072 - RNA, 17 nt, Human
cuguccuggugucacuu

SEQ ID NO: 2466073 - RNA, 15 nt, Human
cugucgcccagucug

SEQ ID NO: 2466074 - RNA, 18 nt, Human
cuguccugggcugguggc

SEQ ID NO: 2466075 - RNA, 14 nt, Human
cuguccugggcugg

SEQ ID NO: 2466076 - RNA, 23 nt, Human
cuguccugggcgcccuggaagcc

SEQ ID NO: 2466077 - RNA, 22 nt, Human
cuguccugggcgcccuggaagc

SEQ ID NO: 2466078 - RNA, 21 nt, Human
cuguccugggcgcccuggaag

SEQ ID NO: 2466079 - RNA, 19 nt, Human
cuguccugggcgcccugga

SEQ ID NO: 2466080 - RNA, 18 nt, Human
cuguccugggcgcccugg

SEQ ID NO: 2466081 - RNA, 13 nt, Human
cuguccugggcgc

SEQ ID NO: 2466082 - RNA, 13 nt, Human
cuguccugggccu

SEQ ID NO: 2466083 - RNA, 14 nt, Human
cuguccugggccug

SEQ ID NO: 2466084 - RNA, 12 nt, Human
cuguccugggcg

SEQ ID NO: 2466085 - RNA, 11 nt, Human
cuguccugggc

SEQ ID NO: 2466086 - RNA, 18 nt, Human
cuguccugggccugcaga

SEQ ID NO: 2466087 - RNA, 15 nt, Human
cuguccucuucugca

SEQ ID NO: 2466088 - RNA, 21 nt, Human
cuguccugggagugagcuggu

SEQ ID NO: 2466089 - RNA, 21 nt, Human
cuguccucccauccccuggac

SEQ ID NO: 2466090 - RNA, 16 nt, Human
cuguccuccugguggg

SEQ ID NO: 2466091 - RNA, 14 nt, Human
cuguccuccuggug

SEQ ID NO: 2466092 - RNA, 12 nt, Human
cuguccuccucg

SEQ ID NO: 2466093 - RNA, 23 nt, Human
cuguccuccucggaucaccgaga

SEQ ID NO: 2466094 - RNA, 21 nt, Human
cuguccuccugguggguccag

SEQ ID NO: 2466095 - RNA, 20 nt, Human
cuguccucucuggcugggga

SEQ ID NO: 2466096 - RNA, 19 nt, Human
cuguccuccuggugggucc

SEQ ID NO: 2466097 - RNA, 19 nt, Human
cuguccucccauccccugg

SEQ ID NO: 2466098 - RNA, 18 nt, Human
cuguccucccauccccug

SEQ ID NO: 2466099 - RNA, 16 nt, Human
cuguccucccaucccc

SEQ ID NO: 2466100 - RNA, 15 nt, Human
cuguccuccaagcca

SEQ ID NO: 2466101 - RNA, 17 nt, Human
cuguccuccaagccagc

SEQ ID NO: 2466102 - RNA, 20 nt, Human
cugucaauuacaggaaguac

SEQ ID NO: 2466103 - RNA, 19 nt, Human
cugucaauuacaggaagua

SEQ ID NO: 2466104 - RNA, 23 nt, Human
cugucaauuacaggaaguacugg

SEQ ID NO: 2466105 - RNA, 23 nt, Human
cuguagucccagccacucgggag

SEQ ID NO: 2466106 - RNA, 18 nt, Human
cuguagucccagccacuc

SEQ ID NO: 2466107 - RNA, 17 nt, Human
cuguagucccagccacu

SEQ ID NO: 2466108 - RNA, 15 nt, Human
cuguagucccagcca

SEQ ID NO: 2466109 - RNA, 19 nt, Human
cugucaauuucccugacuc

SEQ ID NO: 2466110 - RNA, 18 nt, Human
cugucaauuucccugacu

SEQ ID NO: 2466111 - RNA, 17 nt, Human
cugucaauuucccugac

SEQ ID NO: 2466112 - RNA, 15 nt, Human
cugucaucaauugaa

SEQ ID NO: 2466113 - RNA, 22 nt, Human
cugucagugccgccgccucgcc

SEQ ID NO: 2466114 - RNA, 18 nt, Human
cugucagugccgccgccu

SEQ ID NO: 2466115 - RNA, 17 nt, Human
cugucagugccgccgcc

SEQ ID NO: 2466116 - RNA, 16 nt, Human
cugucacaccagccau

SEQ ID NO: 2466117 - RNA, 15 nt, Human
cugucacaccagcca

SEQ ID NO: 2466118 - RNA, 13 nt, Human
cugucacaccagc

SEQ ID NO: 2466119 - RNA, 14 nt, Human
cugucauagaaauu

SEQ ID NO: 2466120 - RNA, 16 nt, Human
cugucauagaaauuac

SEQ ID NO: 2466121 - RNA, 19 nt, Human
cugucauaagaaugaauaa

SEQ ID NO: 2466122 - RNA, 15 nt, Human
cuggugaagcucacu

SEQ ID NO: 2466123 - RNA, 14 nt, Human
cuggugacaccagc

SEQ ID NO: 2466124 - RNA, 17 nt, Human
cuggugacaccagccuu

SEQ ID NO: 2466125 - RNA, 15 nt, Human
cuggugacaccagcc

SEQ ID NO: 2466126 - RNA, 16 nt, Human
cuggugacaccagccu

SEQ ID NO: 2466127 - RNA, 20 nt, Human
cuggugaagcucacuucugg

SEQ ID NO: 2466128 - RNA, 15 nt, Human
cuggucuuuccucug

SEQ ID NO: 2466129 - RNA, 20 nt, Human
cuggucuuguggaauuggga

SEQ ID NO: 2466130 - RNA, 18 nt, Human
cuggucuuguggaauugg

SEQ ID NO: 2466131 - RNA, 14 nt, Human
cuggucuugagaug

SEQ ID NO: 2466132 - RNA, 15 nt, Human
cuggucuugagaugu

SEQ ID NO: 2466133 - RNA, 20 nt, Human
cugguugguguugcagaagg

SEQ ID NO: 2466134 - RNA, 21 nt, Human
cugguugguguugcagaaggu

SEQ ID NO: 2466135 - RNA, 13 nt, Human
cugguugucauuu

SEQ ID NO: 2466136 - RNA, 14 nt, Human
cugguugucauuuu

SEQ ID NO: 2466137 - RNA, 12 nt, Human
cuguaaacugug

SEQ ID NO: 2466138 - RNA, 13 nt, Human
cuguaaacugugu

SEQ ID NO: 2466139 - RNA, 19 nt, Human
cuguaaacucaaaacuuaa

SEQ ID NO: 2466140 - RNA, 13 nt, Human
cugguuuccugcc

SEQ ID NO: 2466141 - RNA, 14 nt, Human
cugguuuccugccc

SEQ ID NO: 2466142 - RNA, 15 nt, Human
cugguuuacacuuua

SEQ ID NO: 2466143 - RNA, 15 nt, Human
cugguugucauuuuu

SEQ ID NO: 2466144 - RNA, 23 nt, Human
cugguuucauuucuacugugacu

SEQ ID NO: 2466145 - RNA, 18 nt, Human
cugguuucacuggcccaa

SEQ ID NO: 2466146 - RNA, 13 nt, Human
cugguuucacugg

SEQ ID NO: 2466147 - RNA, 17 nt, Human
cugguuucacuggccca

SEQ ID NO: 2466148 - RNA, 14 nt, Human
cuguaaagaaagag

SEQ ID NO: 2466149 - RNA, 15 nt, Human
cuguaaagaaagaga

SEQ ID NO: 2466150 - RNA, 16 nt, Human
cuguaaagaaagagag

SEQ ID NO: 2466151 - RNA, 17 nt, Human
cuguaaagaaagagaga

SEQ ID NO: 2466152 - RNA, 13 nt, Human
cuguaaagaaaga

SEQ ID NO: 2466153 - RNA, 22 nt, Human
cuguaaacucaaaacuuaacau

SEQ ID NO: 2466154 - RNA, 14 nt, Human
cuguaaacugugua

SEQ ID NO: 2466155 - RNA, 20 nt, Human
cuguaaacuguguauuccaa

SEQ ID NO: 2466156 - RNA, 18 nt, Human
cuguaaagaaagagagaa

SEQ ID NO: 2466157 - RNA, 19 nt, Human
cuguaaagaaagagagaaa

SEQ ID NO: 2466158 - RNA, 20 nt, Human
cuguaaagaaagagagaaaa

SEQ ID NO: 2466159 - RNA, 21 nt, Human
cuguaaagaaagagagaaaau

SEQ ID NO: 2466160 - RNA, 22 nt, Human
cuguaaagaaagagagaaaaua

SEQ ID NO: 2466161 - RNA, 23 nt, Human
cuguaaagaaagagagaaaauaa

SEQ ID NO: 2466162 - RNA, 22 nt, Human
cuguaaagagaccuaccucagg

SEQ ID NO: 2466163 - RNA, 20 nt, Human
cuguaaagagaccuaccuca

SEQ ID NO: 2466164 - RNA, 17 nt, Human
cuguagagggcccuggu

SEQ ID NO: 2466165 - RNA, 21 nt, Human
cuguagggcuggaccuauguc

SEQ ID NO: 2466166 - RNA, 24 nt, Human
cuguaggguaauuaguaacaugug

SEQ ID NO: 2466167 - RNA, 18 nt, Human
cuguaguaaacuauuuau

SEQ ID NO: 2466168 - RNA, 19 nt, Human
cuguaguaaacuauuuauc

SEQ ID NO: 2466169 - RNA, 20 nt, Human
cuguaguaaacuauuuaucu

SEQ ID NO: 2466170 - RNA, 21 nt, Human
cuguaguagcccuuucugugu

SEQ ID NO: 2466171 - RNA, 14 nt, Human
cuguagucccagcc

SEQ ID NO: 2466172 - RNA, 12 nt, Human
cuguagucccag

SEQ ID NO: 2466173 - RNA, 19 nt, Human
cuguaguagcccuuucugu

SEQ ID NO: 2466174 - RNA, 18 nt, Human
cuguaguagcccuuucug

SEQ ID NO: 2466175 - RNA, 13 nt, Human
cuguagaguggga

SEQ ID NO: 2466176 - RNA, 20 nt, Human
cuguagaaaugguuguauua

SEQ ID NO: 2466177 - RNA, 18 nt, Human
cuguacuuaauaaauuca

SEQ ID NO: 2466178 - RNA, 22 nt, Human
cuguagaccuagggaggaccuu

SEQ ID NO: 2466179 - RNA, 16 nt, Human
cuguagagggcccugg

SEQ ID NO: 2466180 - RNA, 21 nt, Human
cuguagagcuagaacauggag

SEQ ID NO: 2466181 - RNA, 15 nt, Human
cuguagaagagggau

SEQ ID NO: 2466182 - RNA, 19 nt, Human
cuguagaaaugguuguauu

SEQ ID NO: 2466183 - RNA, 17 nt, Human
cuguagaaaugguugua

SEQ ID NO: 2466184 - RNA, 13 nt, Human
cuguagaaauggu

SEQ ID NO: 2466185 - RNA, 15 nt, Human
cuguacuucaaguua

SEQ ID NO: 2466186 - RNA, 19 nt, Human
cuguagaaaagggaacuga

SEQ ID NO: 2466187 - RNA, 19 nt, Human
cuguaaccucuucagaggc

SEQ ID NO: 2466188 - RNA, 20 nt, Human
cuguaaccucuucagaggcc

SEQ ID NO: 2466189 - RNA, 22 nt, Human
cuguaaccucuucagaggcccu

SEQ ID NO: 2466190 - RNA, 23 nt, Human
cuguaaccucuucagaggcccuc

SEQ ID NO: 2466191 - RNA, 19 nt, Human
cuguaacauacuggccugg

SEQ ID NO: 2466192 - RNA, 15 nt, Human
cuguaaccucuucag

SEQ ID NO: 2466193 - RNA, 16 nt, Human
cuguaacacuuuacaa

SEQ ID NO: 2466194 - RNA, 19 nt, Human
cuguaacucuaaaagaucc

SEQ ID NO: 2466195 - RNA, 15 nt, Human
cuguaacucuaaaag

SEQ ID NO: 2466196 - RNA, 22 nt, Human
cuguacugauuuuuguaagaca

SEQ ID NO: 2466197 - RNA, 20 nt, Human
cuguacugauuuuuguaaga

SEQ ID NO: 2466198 - RNA, 15 nt, Human
cuguacucuuagaug

SEQ ID NO: 2466199 - RNA, 20 nt, Human
cuguacuguucugugucuuu

SEQ ID NO: 2466200 - RNA, 13 nt, Human
cuguacuuaauaa

SEQ ID NO: 2466201 - RNA, 16 nt, Human
cuguacuuaauaaauu

SEQ ID NO: 2466202 - RNA, 17 nt, Human
cuguacuguucuguguc

SEQ ID NO: 2466203 - RNA, 16 nt, Human
cugugacccccagcuc

SEQ ID NO: 2466204 - RNA, 17 nt, Human
cugugacccccagcucc

SEQ ID NO: 2466205 - RNA, 18 nt, Human
cugugacccccagcuccg

SEQ ID NO: 2466206 - RNA, 21 nt, Human
cugugacccccagcuccggcc

SEQ ID NO: 2466207 - RNA, 23 nt, Human
cugugaccucaggcacuagccuu

SEQ ID NO: 2466208 - RNA, 22 nt, Human
cugugaccucaggcacuagccu

SEQ ID NO: 2466209 - RNA, 17 nt, Human
cugugaccucuccccug

SEQ ID NO: 2466210 - RNA, 17 nt, Human
cugugaccucaggcacu

SEQ ID NO: 2466211 - RNA, 14 nt, Human
cugugaccucaggc

SEQ ID NO: 2466212 - RNA, 13 nt, Human
cugugacccccag

SEQ ID NO: 2466213 - RNA, 15 nt, Human
cugugacccccagcu

SEQ ID NO: 2466214 - RNA, 14 nt, Human
cugugcugcccugc

SEQ ID NO: 2466215 - RNA, 13 nt, Human
cugugcugcccug

SEQ ID NO: 2466216 - RNA, 12 nt, Human
cugugcugcccu

SEQ ID NO: 2466217 - RNA, 14 nt, Human
cugugcgcugacaa

SEQ ID NO: 2466218 - RNA, 18 nt, Human
cugugccugccugggagu

SEQ ID NO: 2466219 - RNA, 21 nt, Human
cugugccuuugaguuuccuca

SEQ ID NO: 2466220 - RNA, 16 nt, Human
cugugccuuuugccau

SEQ ID NO: 2466221 - RNA, 19 nt, Human
cugugccugaccuugagga

SEQ ID NO: 2466222 - RNA, 17 nt, Human
cugugccugaccuugag

SEQ ID NO: 2466223 - RNA, 15 nt, Human
cugugccugaauauu

SEQ ID NO: 2466224 - RNA, 19 nt, Human
cugugccuucuuuugauua

SEQ ID NO: 2466225 - RNA, 16 nt, Human
cugugaccugccccgc

SEQ ID NO: 2466226 - RNA, 22 nt, Human
cugugaccugccccgcccagcu

SEQ ID NO: 2466227 - RNA, 19 nt, Human
cuguuauaaucuuucacag

SEQ ID NO: 2466228 - RNA, 13 nt, Human
cuguuauaaucuu

SEQ ID NO: 2466229 - RNA, 15 nt, Human
cugugucuaaacugc

SEQ ID NO: 2466230 - RNA, 14 nt, Human
cugugucuaaacug

SEQ ID NO: 2466231 - RNA, 16 nt, Human
cugugucuaaacugca

SEQ ID NO: 2466232 - RNA, 13 nt, Human
cuguuagucauuu

SEQ ID NO: 2466233 - RNA, 15 nt, Human
cuguuagucauuugc

SEQ ID NO: 2466234 - RNA, 14 nt, Human
cuguuagucauuug

SEQ ID NO: 2466235 - RNA, 18 nt, Human
cuguuagucauuugcuga

SEQ ID NO: 2466236 - RNA, 22 nt, Human
cugugucccaugacccaccccu

SEQ ID NO: 2466237 - RNA, 21 nt, Human
cugugucccaugacccacccc

SEQ ID NO: 2466238 - RNA, 20 nt, Human
cugugucccaugacccaccc

SEQ ID NO: 2466239 - RNA, 22 nt, Human
cugugucacuggcugccuccac

SEQ ID NO: 2466240 - RNA, 21 nt, Human
cugugucacuggcugccucca

SEQ ID NO: 2466241 - RNA, 20 nt, Human
cugugucacuggcugccucc

SEQ ID NO: 2466242 - RNA, 19 nt, Human
cugugucacuggcugccuc

SEQ ID NO: 2466243 - RNA, 18 nt, Human
cugugucacuggcugccu

SEQ ID NO: 2466244 - RNA, 17 nt, Human
cuguguccuggugcucu

SEQ ID NO: 2466245 - RNA, 15 nt, Human
cuguguccuggugcu

SEQ ID NO: 2466246 - RNA, 14 nt, Human
cuguguccuggugc

SEQ ID NO: 2466247 - RNA, 13 nt, Human
cuguguccuggug

SEQ ID NO: 2466248 - RNA, 23 nt, Human
cugugucccaugacccaccccug

SEQ ID NO: 2466249 - RNA, 20 nt, Human
cuguguccuggugcucucug

SEQ ID NO: 2466250 - RNA, 19 nt, Human
cuguguccuggugcucucu

SEQ ID NO: 2466251 - RNA, 23 nt, Human
cuguguccuggugcucucugcca

SEQ ID NO: 2466252 - RNA, 16 nt, Human
cuguguccuucccugc

SEQ ID NO: 2466253 - RNA, 15 nt, Human
cuguguccuucccug

SEQ ID NO: 2466254 - RNA, 14 nt, Human
cuguguccuugcac

SEQ ID NO: 2466255 - RNA, 16 nt, Human
cuguguccuugcaccu

SEQ ID NO: 2466256 - RNA, 18 nt, Human
cuguguccuugcaccugc

SEQ ID NO: 2466257 - RNA, 19 nt, Human
cuguguccuugcaccugca

SEQ ID NO: 2466258 - RNA, 16 nt, Human
cugugucguagccaag

SEQ ID NO: 2466259 - RNA, 13 nt, Human
cugugucuaaacu

SEQ ID NO: 2466260 - RNA, 12 nt, Human
cugugucuaaac

SEQ ID NO: 2466261 - RNA, 11 nt, Human
cugugucuaaa

SEQ ID NO: 2466262 - RNA, 22 nt, Human
cuguguccuugcaccugcaucc

SEQ ID NO: 2466263 - RNA, 19 nt, Human
cugugcugcccugcccacc

SEQ ID NO: 2466264 - RNA, 18 nt, Human
cugugcugcccugcccac

SEQ ID NO: 2466265 - RNA, 17 nt, Human
cugugcugcccugccca

SEQ ID NO: 2466266 - RNA, 15 nt, Human
cugugcugcccugcc

SEQ ID NO: 2466267 - RNA, 17 nt, Human
cugugucagcauagaag

SEQ ID NO: 2466268 - RNA, 19 nt, Human
cugugucagcauagaagua

SEQ ID NO: 2466269 - RNA, 17 nt, Human
cugugucacuggcugcc

SEQ ID NO: 2466270 - RNA, 16 nt, Human
cugugucacuggcugc

SEQ ID NO: 2466271 - RNA, 15 nt, Human
cugugucacuggcug

SEQ ID NO: 2466272 - RNA, 14 nt, Human
cugugucacuggcu

SEQ ID NO: 2466273 - RNA, 14 nt, Human
cugugucacuacgu

SEQ ID NO: 2466274 - RNA, 15 nt, Human
cuuagggcaccaggg

SEQ ID NO: 2466275 - RNA, 16 nt, Human
cuuaggggcugcugac

SEQ ID NO: 2466276 - RNA, 23 nt, Human
cuuaggccuuccucucuccagau

SEQ ID NO: 2466277 - RNA, 21 nt, Human
cuuagggaaggauacaaaagc

SEQ ID NO: 2466278 - RNA, 12 nt, Human
cuuaggccuucc

SEQ ID NO: 2466279 - RNA, 13 nt, Human
cuuaggccuuccu

SEQ ID NO: 2466280 - RNA, 15 nt, Human
cuuaggccuuccucu

SEQ ID NO: 2466281 - RNA, 17 nt, Human
cuuaggccuuccucucu

SEQ ID NO: 2466282 - RNA, 19 nt, Human
cuuagggaaggauacaaaa

SEQ ID NO: 2466283 - RNA, 16 nt, Human
cuuaggaugugugcau

SEQ ID NO: 2466284 - RNA, 14 nt, Human
cuuaggaugugugc

SEQ ID NO: 2466285 - RNA, 18 nt, Human
cuuaggagcagagcucug

SEQ ID NO: 2466286 - RNA, 16 nt, Human
cuuaggagcagagcuc

SEQ ID NO: 2466287 - RNA, 22 nt, Human
cuuaggaugugugcaugugugu

SEQ ID NO: 2466288 - RNA, 18 nt, Human
cuuaggaugugugcaugu

SEQ ID NO: 2466289 - RNA, 14 nt, Human
cuuaggcagggaag

SEQ ID NO: 2466290 - RNA, 15 nt, Human
cuuaggccagcacca

SEQ ID NO: 2466291 - RNA, 19 nt, Human
cuuaggcaugacuguagaa

SEQ ID NO: 2466292 - RNA, 15 nt, Human
cuuaggcagggaagu

SEQ ID NO: 2466293 - RNA, 15 nt, Human
cuuaggagagaccga

SEQ ID NO: 2466294 - RNA, 20 nt, Human
cuuaggacagggucccugcu

SEQ ID NO: 2466295 - RNA, 11 nt, Human
cuuaggaagga

SEQ ID NO: 2466296 - RNA, 22 nt, Human
cuuaggaagagaaaccagggag

SEQ ID NO: 2466297 - RNA, 17 nt, Human
cuuagcuuuuuaauugu

SEQ ID NO: 2466298 - RNA, 16 nt, Human
cuuagcuuuuuaauug

SEQ ID NO: 2466299 - RNA, 17 nt, Human
cuuaggaagagaaacca

SEQ ID NO: 2466300 - RNA, 15 nt, Human
cuuaggaagaauuuu

SEQ ID NO: 2466301 - RNA, 22 nt, Human
cuuagcucauucuccuuguguu

SEQ ID NO: 2466302 - RNA, 17 nt, Human
cuuagcccccacccacu

SEQ ID NO: 2466303 - RNA, 13 nt, Human
cuuagcccccacc

SEQ ID NO: 2466304 - RNA, 20 nt, Human
cuuagcccccacccacuucc

SEQ ID NO: 2466305 - RNA, 18 nt, Human
cuuagcccccacccacuu

SEQ ID NO: 2466306 - RNA, 11 nt, Human
cuuagccuccc

SEQ ID NO: 2466307 - RNA, 22 nt, Human
cuuagccuccugaccugaggcu

SEQ ID NO: 2466308 - RNA, 21 nt, Human
cuuagccuccugaccugaggc

SEQ ID NO: 2466309 - RNA, 17 nt, Human
cuuagccuccugaccug

SEQ ID NO: 2466310 - RNA, 14 nt, Human
cuuagccuccugac

SEQ ID NO: 2466311 - RNA, 14 nt, Human
cuuagccucccuga

SEQ ID NO: 2466312 - RNA, 15 nt, Human
cuuagccucccugaa

SEQ ID NO: 2466313 - RNA, 16 nt, Human
cuuaccagcagagcac

SEQ ID NO: 2466314 - RNA, 13 nt, Human
cuuaccaggaagc

SEQ ID NO: 2466315 - RNA, 15 nt, Human
cuuaccauaugugcu

SEQ ID NO: 2466316 - RNA, 13 nt, Human
cuuaccauuaaag

SEQ ID NO: 2466317 - RNA, 18 nt, Human
cuuagcauguuugcugaa

SEQ ID NO: 2466318 - RNA, 17 nt, Human
cuuagcauguuugcuga

SEQ ID NO: 2466319 - RNA, 16 nt, Human
cuuagcauguuugcug

SEQ ID NO: 2466320 - RNA, 14 nt, Human
cuuaccaugugccu

SEQ ID NO: 2466321 - RNA, 18 nt, Human
cuuagcauguguugaaaa

SEQ ID NO: 2466322 - RNA, 14 nt, Human
cuuagcuuuuuaau

SEQ ID NO: 2466323 - RNA, 18 nt, Human
cuuagcuuugcucugcca

SEQ ID NO: 2466324 - RNA, 23 nt, Human
cuuagcuucuauuauagccacau

SEQ ID NO: 2466325 - RNA, 23 nt, Human
cuuagcuuagaccucagccugug

SEQ ID NO: 2466326 - RNA, 21 nt, Human
cuuagcuuagaccucagccug

SEQ ID NO: 2466327 - RNA, 22 nt, Human
cuuagcuuagaccucagccugu

SEQ ID NO: 2466328 - RNA, 17 nt, Human
cuuagcugucugcucag

SEQ ID NO: 2466329 - RNA, 14 nt, Human
cuuagcuuagaccu

SEQ ID NO: 2466330 - RNA, 15 nt, Human
cuuagcuuagaccuc

SEQ ID NO: 2466331 - RNA, 16 nt, Human
cuuagcuuagaccuca

SEQ ID NO: 2466332 - RNA, 17 nt, Human
cuuagcuuagaccucag

SEQ ID NO: 2466333 - RNA, 18 nt, Human
cuuagcuuagaccucagc

SEQ ID NO: 2466334 - RNA, 19 nt, Human
cuuagcuuagaccucagcc

SEQ ID NO: 2466335 - RNA, 20 nt, Human
cuuagcuuagaccucagccu

SEQ ID NO: 2466336 - RNA, 14 nt, Human
cuuagcuaucagaa

SEQ ID NO: 2466337 - RNA, 14 nt, Human
cuuagcuccccucc

SEQ ID NO: 2466338 - RNA, 23 nt, Human
cuuagcucauucuccuuguguua

SEQ ID NO: 2466339 - RNA, 11 nt, Human
cuuagcugagu

SEQ ID NO: 2466340 - RNA, 17 nt, Human
cuuagcucuuaauuguu

SEQ ID NO: 2466341 - RNA, 17 nt, Human
cuuagcuccccuccaac

SEQ ID NO: 2466342 - RNA, 13 nt, Human
cuuagcugggaga

SEQ ID NO: 2466343 - RNA, 14 nt, Human
cuuagcugucugcu

SEQ ID NO: 2466344 - RNA, 14 nt, Human
cuuagcugagugga

SEQ ID NO: 2466345 - RNA, 14 nt, Human
cuguuggcuggggg

SEQ ID NO: 2466346 - RNA, 22 nt, Human
cuguuggcugggggccucagug

SEQ ID NO: 2466347 - RNA, 19 nt, Human
cuguuggcugggggccuca

SEQ ID NO: 2466348 - RNA, 23 nt, Human
cuguugggguggguauaaaagau

SEQ ID NO: 2466349 - RNA, 22 nt, Human
cuguugggguggguauaaaaga

SEQ ID NO: 2466350 - RNA, 16 nt, Human
cuguuguaacuaggcu

SEQ ID NO: 2466351 - RNA, 20 nt, Human
cuguugguuccaagcccugg

SEQ ID NO: 2466352 - RNA, 14 nt, Human
cuguugguuccaag

SEQ ID NO: 2466353 - RNA, 20 nt, Human
cuguugggguggguauaaaa

SEQ ID NO: 2466354 - RNA, 21 nt, Human
cuuaaaaaugguuuaaauggu

SEQ ID NO: 2466355 - RNA, 14 nt, Human
cuguuuaagagaca

SEQ ID NO: 2466356 - RNA, 12 nt, Human
cuguuuaagaga

SEQ ID NO: 2466357 - RNA, 23 nt, Human
cuguuuaaauguuuuucuaugua

SEQ ID NO: 2466358 - RNA, 20 nt, Human
cuguuuaaauguuuuucuau

SEQ ID NO: 2466359 - RNA, 14 nt, Human
cuguuguacauuua

SEQ ID NO: 2466360 - RNA, 13 nt, Human
cuguuguacauuu

SEQ ID NO: 2466361 - RNA, 12 nt, Human
cuguuguacauu

SEQ ID NO: 2466362 - RNA, 22 nt, Human
cuguuguaacuaggcucagaga

SEQ ID NO: 2466363 - RNA, 19 nt, Human
cuguuguacauuuaugauu

SEQ ID NO: 2466364 - RNA, 18 nt, Human
cuguuguacauuuaugau

SEQ ID NO: 2466365 - RNA, 17 nt, Human
cuguuguacauuuauga

SEQ ID NO: 2466366 - RNA, 15 nt, Human
cuguuguacauuuau

SEQ ID NO: 2466367 - RNA, 22 nt, Human
cuguuguacauuuaugauuuaa

SEQ ID NO: 2466368 - RNA, 22 nt, Human
cuguuuaaauauuucaagacau

SEQ ID NO: 2466369 - RNA, 19 nt, Human
cuguuuaaauauuucaaga

SEQ ID NO: 2466370 - RNA, 20 nt, Human
cuguuguuuuguuuuaaaua

SEQ ID NO: 2466371 - RNA, 16 nt, Human
cuguuguuuuguuuua

SEQ ID NO: 2466372 - RNA, 17 nt, Human
cuguuguuucuaaacaa

SEQ ID NO: 2466373 - RNA, 12 nt, Human
cuguugucauug

SEQ ID NO: 2466374 - RNA, 23 nt, Human
cuguuguuguuaaugaaaauguc

SEQ ID NO: 2466375 - RNA, 22 nt, Human
cuguuguauaaauuuauuuacu

SEQ ID NO: 2466376 - RNA, 13 nt, Human
cuuaaaaccaaag

SEQ ID NO: 2466377 - RNA, 13 nt, Human
cuuaaauaauaaa

SEQ ID NO: 2466378 - RNA, 21 nt, Human
cuuaaauaauaaacaguggaa

SEQ ID NO: 2466379 - RNA, 22 nt, Human
cuuaaauaauaaagaucaugua

SEQ ID NO: 2466380 - RNA, 20 nt, Human
cuuaauuuugguuguauucu

SEQ ID NO: 2466381 - RNA, 23 nt, Human
cuuaauuuugguuguauucuuug

SEQ ID NO: 2466382 - RNA, 21 nt, Human
cuuaauuuugguuguauucuu

SEQ ID NO: 2466383 - RNA, 18 nt, Human
cuuaaaaauguaaauauu

SEQ ID NO: 2466384 - RNA, 17 nt, Human
cuuaaaaauguaaauau

SEQ ID NO: 2466385 - RNA, 16 nt, Human
cuuaaaaauguaaaua

SEQ ID NO: 2466386 - RNA, 15 nt, Human
cuuaaaaauguaaau

SEQ ID NO: 2466387 - RNA, 20 nt, Human
cuguuuaauauuuaaacagc

SEQ ID NO: 2466388 - RNA, 18 nt, Human
cuguuuaauauuuaaaca

SEQ ID NO: 2466389 - RNA, 16 nt, Human
cuguuuaauauuuaaa

SEQ ID NO: 2466390 - RNA, 14 nt, Human
cuuaaaacaacacu

SEQ ID NO: 2466391 - RNA, 21 nt, Human
cuuaccagauaaugcuacuuu

SEQ ID NO: 2466392 - RNA, 13 nt, Human
cuuaccagaagcu

SEQ ID NO: 2466393 - RNA, 19 nt, Human
cuuaccaacuuucuguaaa

SEQ ID NO: 2466394 - RNA, 17 nt, Human
cuuaccaacuuucugua

SEQ ID NO: 2466395 - RNA, 16 nt, Human
cuuaccaacuuucugu

SEQ ID NO: 2466396 - RNA, 15 nt, Human
cuuaccaacuuucug

SEQ ID NO: 2466397 - RNA, 22 nt, Human
cuuacauuuuuacaauaaauaa

SEQ ID NO: 2466398 - RNA, 15 nt, Human
cuuaccagcagagca

SEQ ID NO: 2466399 - RNA, 13 nt, Human
cuuacauuuccug

SEQ ID NO: 2466400 - RNA, 12 nt, Human
cuuacauuuccu

SEQ ID NO: 2466401 - RNA, 20 nt, Human
cuuacauuguucaauuagaa

SEQ ID NO: 2466402 - RNA, 15 nt, Human
cuuacauugugaaac

SEQ ID NO: 2466403 - RNA, 17 nt, Human
cuuacauuuuuacaaua

SEQ ID NO: 2466404 - RNA, 14 nt, Human
cuuacauuuuuaca

SEQ ID NO: 2466405 - RNA, 14 nt, Human
cuuaccaacuuucu

SEQ ID NO: 2466406 - RNA, 20 nt, Human
cuuacauuuuacuuuuuccu

SEQ ID NO: 2466407 - RNA, 21 nt, Human
cuuacaauuuuuuuaauuuug

SEQ ID NO: 2466408 - RNA, 20 nt, Human
cuuacaauuuuuuuaauuuu

SEQ ID NO: 2466409 - RNA, 20 nt, Human
cuuacaauucccugcugucg

SEQ ID NO: 2466410 - RNA, 19 nt, Human
cuuacaauucccugcuguc

SEQ ID NO: 2466411 - RNA, 23 nt, Human
cuuacaauuuuuuuaauuuugua

SEQ ID NO: 2466412 - RNA, 22 nt, Human
cuuacaauuuuuuuaauuuugu

SEQ ID NO: 2466413 - RNA, 22 nt, Human
cuuacauuagcaguuugcuuug

SEQ ID NO: 2466414 - RNA, 21 nt, Human
cuuacauuagcaguuugcuuu

SEQ ID NO: 2466415 - RNA, 18 nt, Human
cuuacaagccuaagaauc

SEQ ID NO: 2466416 - RNA, 16 nt, Human
cuuacaauucccugcu

SEQ ID NO: 2466417 - RNA, 17 nt, Human
cuuacaagccagcugga

SEQ ID NO: 2466418 - RNA, 16 nt, Human
cuuacaagccagcugg

SEQ ID NO: 2466419 - RNA, 19 nt, Human
cugugucccaugacccacc

SEQ ID NO: 2466420 - RNA, 14 nt, Human
cuguuauaacucug

SEQ ID NO: 2466421 - RNA, 16 nt, Human
cuguuauuuagacuca

SEQ ID NO: 2466422 - RNA, 14 nt, Human
cuguuauuuagacu

SEQ ID NO: 2466423 - RNA, 14 nt, Human
cuguuauuuauaau

SEQ ID NO: 2466424 - RNA, 20 nt, Human
cuguuauuuauaaucacuuu

SEQ ID NO: 2466425 - RNA, 17 nt, Human
cuguuauuucuauuuuu

SEQ ID NO: 2466426 - RNA, 23 nt, Human
cuguucaagagcacacuuggccc

SEQ ID NO: 2466427 - RNA, 21 nt, Human
cuguucaagagcacacuuggc

SEQ ID NO: 2466428 - RNA, 17 nt, Human
cuguucaauguuuaaug

SEQ ID NO: 2466429 - RNA, 12 nt, Human
cuguucaagagc

SEQ ID NO: 2466430 - RNA, 16 nt, Human
cuguuauuucuauuuu

SEQ ID NO: 2466431 - RNA, 17 nt, Human
gaaacaacucuuugaga

SEQ ID NO: 2466432 - RNA, 20 nt, Human
gaaacaacucuuugagaaac

SEQ ID NO: 2466433 - RNA, 14 nt, Human
gaaacaacuuggaa

SEQ ID NO: 2466434 - RNA, 13 nt, Human
gaaacaaagaagg

SEQ ID NO: 2466435 - RNA, 21 nt, Human
gaaaauucaaaaaguguuuau

SEQ ID NO: 2466436 - RNA, 20 nt, Human
gaaaauucaaaaaguguuua

SEQ ID NO: 2466437 - RNA, 19 nt, Human
gaaaauucaaaaaguguuu

SEQ ID NO: 2466438 - RNA, 14 nt, Human
gaaacaaagaaggu

SEQ ID NO: 2466439 - RNA, 17 nt, Human
gaaaauucaaaaagugu

SEQ ID NO: 2466440 - RNA, 17 nt, Human
gaaaauuauuuuaaaca

SEQ ID NO: 2466441 - RNA, 16 nt, Human
gaaaauuauuugcaua

SEQ ID NO: 2466442 - RNA, 22 nt, Human
gaaacaaagcuuagcaggagag

SEQ ID NO: 2466443 - RNA, 19 nt, Human
gaaacaaagcuuagcagga

SEQ ID NO: 2466444 - RNA, 15 nt, Human
gaaacaaagcuuagc

SEQ ID NO: 2466445 - RNA, 15 nt, Human
gaaacaacagcuuua

SEQ ID NO: 2466446 - RNA, 21 nt, Human
gaaacaacagcuuuaaaagaa

SEQ ID NO: 2466447 - RNA, 15 nt, Human
gaaaauuauuugcau

SEQ ID NO: 2466448 - RNA, 15 nt, Human
gaaaauguugagaau

SEQ ID NO: 2466449 - RNA, 17 nt, Human
gaaaauguugagaaucc

SEQ ID NO: 2466450 - RNA, 20 nt, Human
gaaaauguugagaaucccaa

SEQ ID NO: 2466451 - RNA, 23 nt, Human
gaaaaugucuauucaaaauauca

SEQ ID NO: 2466452 - RNA, 15 nt, Human
gaaaauguuauuuaa

SEQ ID NO: 2466453 - RNA, 16 nt, Human
gaaaauguuauuuaac

SEQ ID NO: 2466454 - RNA, 12 nt, Human
gaaaaugugugu

SEQ ID NO: 2466455 - RNA, 15 nt, Human
gaaaaugugugugug

SEQ ID NO: 2466456 - RNA, 14 nt, Human
gaaaaugucuugug

SEQ ID NO: 2466457 - RNA, 23 nt, Human
gaaaaugucagaaaccaguuaug

SEQ ID NO: 2466458 - RNA, 14 nt, Human
gaaaagcaccugcc

SEQ ID NO: 2466459 - RNA, 14 nt, Human
gaaaagauguagau

SEQ ID NO: 2466460 - RNA, 17 nt, Human
gaaaagauguagauuua

SEQ ID NO: 2466461 - RNA, 18 nt, Human
gaaaagauguagauuuau

SEQ ID NO: 2466462 - RNA, 19 nt, Human
gaaaagauguagauuuauu

SEQ ID NO: 2466463 - RNA, 23 nt, Human
gaaaagauuuuaaucaaguugaa

SEQ ID NO: 2466464 - RNA, 13 nt, Human
gaaaagauuuuaa

SEQ ID NO: 2466465 - RNA, 17 nt, Human
gaaaagauuuuaaucaa

SEQ ID NO: 2466466 - RNA, 21 nt, Human
gaaaagauguagauuuauuuc

SEQ ID NO: 2466467 - RNA, 14 nt, Human
gaaaagacuccaaa

SEQ ID NO: 2466468 - RNA, 19 nt, Human
gaaaagaauacagaaagau

SEQ ID NO: 2466469 - RNA, 22 nt, Human
gaaaagaaaucuaugauuccag

SEQ ID NO: 2466470 - RNA, 16 nt, Human
gaaaagaauacagaaa

SEQ ID NO: 2466471 - RNA, 18 nt, Human
gaaaagaauacagaaaga

SEQ ID NO: 2466472 - RNA, 16 nt, Human
gaaaagacuccaaaga

SEQ ID NO: 2466473 - RNA, 17 nt, Human
gaaaagacuccaaagaa

SEQ ID NO: 2466474 - RNA, 13 nt, Human
gaaaagauaaaga

SEQ ID NO: 2466475 - RNA, 20 nt, Human
gaaaagaggaguuucgaggu

SEQ ID NO: 2466476 - RNA, 12 nt, Human
gaaaagaggagu

SEQ ID NO: 2466477 - RNA, 21 nt, Human
gaaaagagauggccugagaag

SEQ ID NO: 2466478 - RNA, 14 nt, Human
gaaaagagauggcc

SEQ ID NO: 2466479 - RNA, 21 nt, Human
gaaaagagauauuuuaaaaug

SEQ ID NO: 2466480 - RNA, 22 nt, Human
gaaaagauacgacuuuauuuuc

SEQ ID NO: 2466481 - RNA, 21 nt, Human
gaaaagaggaguuucgaggua

SEQ ID NO: 2466482 - RNA, 16 nt, Human
gaaaagauacgacuuu

SEQ ID NO: 2466483 - RNA, 19 nt, Human
gaaaagauacgacuuuauu

SEQ ID NO: 2466484 - RNA, 20 nt, Human
gaaaagauacgacuuuauuu

SEQ ID NO: 2466485 - RNA, 23 nt, Human
gaaaagaaaaaugagccuggcaa

SEQ ID NO: 2466486 - RNA, 21 nt, Human
gaaaacuuuaugcuaagugaa

SEQ ID NO: 2466487 - RNA, 18 nt, Human
gaaaacuuguauuaugug

SEQ ID NO: 2466488 - RNA, 22 nt, Human
gaaaacuuguauuauguguguu

SEQ ID NO: 2466489 - RNA, 19 nt, Human
gaaaacuuguauuaugugu

SEQ ID NO: 2466490 - RNA, 14 nt, Human
gaaaaaaguuguag

SEQ ID NO: 2466491 - RNA, 22 nt, Human
gaaaaaaguuguaggcgaauca

SEQ ID NO: 2466492 - RNA, 23 nt, Human
gaaaaaaguuguaggcgaaucau

SEQ ID NO: 2466493 - RNA, 17 nt, Human
gaaaaaauaacacacau

SEQ ID NO: 2466494 - RNA, 17 nt, Human
gaaaaaagagaaaagaa

SEQ ID NO: 2466495 - RNA, 18 nt, Human
gaaaaaagagaaaagaaa

SEQ ID NO: 2466496 - RNA, 10 nt, Human
gaaaaaagag

SEQ ID NO: 2466497 - RNA, 16 nt, Human
gaaaaaagagaaaaga

SEQ ID NO: 2466498 - RNA, 19 nt, Human
gaaaaaacaccuagcuuua

SEQ ID NO: 2466499 - RNA, 16 nt, Human
gaaaaaaaugacuaaa

SEQ ID NO: 2466500 - RNA, 13 nt, Human
gaaagggcccaga

SEQ ID NO: 2466501 - RNA, 15 nt, Human
gaaaggcuccaggag

SEQ ID NO: 2466502 - RNA, 14 nt, Human
gaaaggcuccagga

SEQ ID NO: 2466503 - RNA, 13 nt, Human
gaaaggcuccagg

SEQ ID NO: 2466504 - RNA, 23 nt, Human
gaaagaaaguugcacggcugcug

SEQ ID NO: 2466505 - RNA, 22 nt, Human
gaaagaaaguugcacggcugcu

SEQ ID NO: 2466506 - RNA, 23 nt, Human
gaaagaacauggacuuguauauu

SEQ ID NO: 2466507 - RNA, 20 nt, Human
gaaagaacauggacuuguau

SEQ ID NO: 2466508 - RNA, 19 nt, Human
gaaagaacauggacuugua

SEQ ID NO: 2466509 - RNA, 17 nt, Human
gaaacuggguuccugca

SEQ ID NO: 2466510 - RNA, 17 nt, Human
gaaacuggcacugaauu

SEQ ID NO: 2466511 - RNA, 18 nt, Human
gaaagaaaaucaggcugg

SEQ ID NO: 2466512 - RNA, 16 nt, Human
gaaagaaaauaugcau

SEQ ID NO: 2466513 - RNA, 17 nt, Human
gaaagaaaauaugcauc

SEQ ID NO: 2466514 - RNA, 21 nt, Human
gaaagaaacccgacagaggga

SEQ ID NO: 2466515 - RNA, 22 nt, Human
gaaagaaacccgacagagggaa

SEQ ID NO: 2466516 - RNA, 15 nt, Human
gaaagaaagaaggaa

SEQ ID NO: 2466517 - RNA, 13 nt, Human
gaaacuggauuaa

SEQ ID NO: 2466518 - RNA, 17 nt, Human
gaaacuggauuaaacuu

SEQ ID NO: 2466519 - RNA, 21 nt, Human
gaaacugcuuguuuccuagca

SEQ ID NO: 2466520 - RNA, 17 nt, Human
gaacacucaugcugaaa

SEQ ID NO: 2466521 - RNA, 18 nt, Human
gaacacuccaauuaagga

SEQ ID NO: 2466522 - RNA, 22 nt, Human
gaacacuaaccugaccgugggc

SEQ ID NO: 2466523 - RNA, 16 nt, Human
gaacacuaaccugacc

SEQ ID NO: 2466524 - RNA, 22 nt, Human
gaacacguccagaauuuuucau

SEQ ID NO: 2466525 - RNA, 13 nt, Human
gaacacuagccag

SEQ ID NO: 2466526 - RNA, 16 nt, Human
gaacacucaugcugaa

SEQ ID NO: 2466527 - RNA, 14 nt, Human
gaacacggccacau

SEQ ID NO: 2466528 - RNA, 22 nt, Human
gaacacggccacaucaaagagg

SEQ ID NO: 2466529 - RNA, 21 nt, Human
gaacacccgacuccucaaaag

SEQ ID NO: 2466530 - RNA, 16 nt, Human
gaacacccuauauuuu

SEQ ID NO: 2466531 - RNA, 14 nt, Human
gaacacccucgaag

SEQ ID NO: 2466532 - RNA, 21 nt, Human
gaacaaguuguuucauugacu

SEQ ID NO: 2466533 - RNA, 19 nt, Human
gaacaaguuguuucauuga

SEQ ID NO: 2466534 - RNA, 22 nt, Human
gaacaagucccuguaauuguug

SEQ ID NO: 2466535 - RNA, 17 nt, Human
gaacacaaacuguaaau

SEQ ID NO: 2466536 - RNA, 14 nt, Human
gaacaaucaaagca

SEQ ID NO: 2466537 - RNA, 21 nt, Human
gaacaaugugcuaugugaaga

SEQ ID NO: 2466538 - RNA, 20 nt, Human
gaacaauauugacuuugucu

SEQ ID NO: 2466539 - RNA, 19 nt, Human
gaacaauauugacuuuguc

SEQ ID NO: 2466540 - RNA, 19 nt, Human
gaacacaaacuguaaauaa

SEQ ID NO: 2466541 - RNA, 22 nt, Human
gaacacacuguguccuggugcu

SEQ ID NO: 2466542 - RNA, 16 nt, Human
gaacacacuguguccu

SEQ ID NO: 2466543 - RNA, 14 nt, Human
gaacacacuguguc

SEQ ID NO: 2466544 - RNA, 14 nt, Human
gaacacacuccauc

SEQ ID NO: 2466545 - RNA, 17 nt, Human
gaacacaggcaaaaucc

SEQ ID NO: 2466546 - RNA, 15 nt, Human
gaacacagaaagccu

SEQ ID NO: 2466547 - RNA, 17 nt, Human
gaacacauaauucagga

SEQ ID NO: 2466548 - RNA, 20 nt, Human
gaacacauaauucaggaagc

SEQ ID NO: 2466549 - RNA, 21 nt, Human
gaacaccagagaccucaaauu

SEQ ID NO: 2466550 - RNA, 15 nt, Human
gaacaaagugagaca

SEQ ID NO: 2466551 - RNA, 22 nt, Human
gaacaaaggacagaguaugaac

SEQ ID NO: 2466552 - RNA, 19 nt, Human
gaacaaagcagccacgagg

SEQ ID NO: 2466553 - RNA, 15 nt, Human
gaacaaagcagccac

SEQ ID NO: 2466554 - RNA, 16 nt, Human
gaacaaagcagccacg

SEQ ID NO: 2466555 - RNA, 14 nt, Human
gaacaaagcagcca

SEQ ID NO: 2466556 - RNA, 19 nt, Human
gaacaaaaaaaucugcaga

SEQ ID NO: 2466557 - RNA, 21 nt, Human
gaacaaaaaaaucugcagaag

SEQ ID NO: 2466558 - RNA, 16 nt, Human
gaacaaaaaaaucugc

SEQ ID NO: 2466559 - RNA, 19 nt, Human
gaaaugaaaacauguaaua

SEQ ID NO: 2466560 - RNA, 22 nt, Human
gaaaucuguaucuguagugaga

SEQ ID NO: 2466561 - RNA, 19 nt, Human
gaaaucucacuuuucucca

SEQ ID NO: 2466562 - RNA, 11 nt, Human
gaaaugaaaaa

SEQ ID NO: 2466563 - RNA, 14 nt, Human
gaaaucuuuuaaaa

SEQ ID NO: 2466564 - RNA, 19 nt, Human
gaaaucuuacagcugggug

SEQ ID NO: 2466565 - RNA, 20 nt, Human
gaaaucugugccugagaaca

SEQ ID NO: 2466566 - RNA, 16 nt, Human
gaaaugaaaacaugua

SEQ ID NO: 2466567 - RNA, 13 nt, Human
gaaaugaaagaaa

SEQ ID NO: 2466568 - RNA, 15 nt, Human
gaaaggggagagccu

SEQ ID NO: 2466569 - RNA, 20 nt, Human
gaaagggcaacaauaaaaua

SEQ ID NO: 2466570 - RNA, 20 nt, Human
gaaaggggagagccugcugg

SEQ ID NO: 2466571 - RNA, 18 nt, Human
gaaaggggagagccugcu

SEQ ID NO: 2466572 - RNA, 13 nt, Human
gaaaggggagccc

SEQ ID NO: 2466573 - RNA, 15 nt, Human
gaaaggggagcccac

SEQ ID NO: 2466574 - RNA, 16 nt, Human
gaaaggggagcccacu

SEQ ID NO: 2466575 - RNA, 16 nt, Human
gaaagggcccagagag

SEQ ID NO: 2466576 - RNA, 15 nt, Human
gaaagggcccagaga

SEQ ID NO: 2466577 - RNA, 18 nt, Human
gaaaucuaugauuccagg

SEQ ID NO: 2466578 - RNA, 15 nt, Human
gaaaucuaguauuuc

SEQ ID NO: 2466579 - RNA, 20 nt, Human
gaaaucuaugauuccaggug

SEQ ID NO: 2466580 - RNA, 12 nt, Human
gaaaucucaccc

SEQ ID NO: 2466581 - RNA, 23 nt, Human
gaaaucccuguuuaauauuuaaa

SEQ ID NO: 2466582 - RNA, 22 nt, Human
gaaaucccuguuuaauauuuaa

SEQ ID NO: 2466583 - RNA, 21 nt, Human
gaaaucccuguuuaauauuua

SEQ ID NO: 2466584 - RNA, 19 nt, Human
gaaaucccuguuuaauauu

SEQ ID NO: 2466585 - RNA, 21 nt, Human
gaaaggggagagccugcuggc

SEQ ID NO: 2466586 - RNA, 18 nt, Human
gaaaucccuguuuaauau

SEQ ID NO: 2466587 - RNA, 22 nt, Human
gaaccaccacacccagcccacu

SEQ ID NO: 2466588 - RNA, 21 nt, Human
gaaccaccacacccagcccac

SEQ ID NO: 2466589 - RNA, 20 nt, Human
gaaccaccacacccagccca

SEQ ID NO: 2466590 - RNA, 18 nt, Human
gaaccaccacacccagcc

SEQ ID NO: 2466591 - RNA, 16 nt, Human
gaagacgccugagcuc

SEQ ID NO: 2466592 - RNA, 15 nt, Human
gaagacgccugagcu

SEQ ID NO: 2466593 - RNA, 23 nt, Human
gaagacgaggcccucgggcccag

SEQ ID NO: 2466594 - RNA, 22 nt, Human
gaagacgaggcccucgggccca

SEQ ID NO: 2466595 - RNA, 14 nt, Human
gaagacgaggcccu

SEQ ID NO: 2466596 - RNA, 16 nt, Human
gaagacucauucuucu

SEQ ID NO: 2466597 - RNA, 18 nt, Human
gaagacucauucuucugu

SEQ ID NO: 2466598 - RNA, 17 nt, Human
gaagacucauucuucug

SEQ ID NO: 2466599 - RNA, 22 nt, Human
gaagcacaugccucucucaggc

SEQ ID NO: 2466600 - RNA, 14 nt, Human
gaagcacaugccuc

SEQ ID NO: 2466601 - RNA, 14 nt, Human
gaagcacagcuuca

SEQ ID NO: 2466602 - RNA, 13 nt, Human
gaagcacagcuuc

SEQ ID NO: 2466603 - RNA, 21 nt, Human
gaagcacaugccucucucagg

SEQ ID NO: 2466604 - RNA, 14 nt, Human
gaagcacauguuua

SEQ ID NO: 2466605 - RNA, 16 nt, Human
gaagcaccauaacuuu

SEQ ID NO: 2466606 - RNA, 19 nt, Human
gaagcacuguuccagccug

SEQ ID NO: 2466607 - RNA, 16 nt, Human
gaagcaccccaugcca

SEQ ID NO: 2466608 - RNA, 21 nt, Human
gaagcaccccaugccaaagcu

SEQ ID NO: 2466609 - RNA, 22 nt, Human
gaagcagccucuccccaggucc

SEQ ID NO: 2466610 - RNA, 12 nt, Human
gaagcagccucu

SEQ ID NO: 2466611 - RNA, 23 nt, Human
gaagcagaugcaaagaggcaaga

SEQ ID NO: 2466612 - RNA, 18 nt, Human
gaagcaggcuacacugac

SEQ ID NO: 2466613 - RNA, 14 nt, Human
gaagcaggcuacac

SEQ ID NO: 2466614 - RNA, 12 nt, Human
gaagcagcucuu

SEQ ID NO: 2466615 - RNA, 13 nt, Human
gaagcaggcugga

SEQ ID NO: 2466616 - RNA, 12 nt, Human
gaagcaggcugg

SEQ ID NO: 2466617 - RNA, 23 nt, Human
gaagcaggcuacacugacacugg

SEQ ID NO: 2466618 - RNA, 19 nt, Human
gaagcaggcuacacugaca

SEQ ID NO: 2466619 - RNA, 15 nt, Human
gaagcaggcuggagg

SEQ ID NO: 2466620 - RNA, 15 nt, Human
gaagcagugagccgc

SEQ ID NO: 2466621 - RNA, 23 nt, Human
gaagcagguugaggggcuccugg

SEQ ID NO: 2466622 - RNA, 19 nt, Human
gaagcagguugaggggcuc

SEQ ID NO: 2466623 - RNA, 22 nt, Human
gaagcagguugaggggcuccug

SEQ ID NO: 2466624 - RNA, 12 nt, Human
gaagcagguucc

SEQ ID NO: 2466625 - RNA, 19 nt, Human
gaagcagguucccaagcuc

SEQ ID NO: 2466626 - RNA, 18 nt, Human
gaagcagguugaggggcu

SEQ ID NO: 2466627 - RNA, 13 nt, Human
gaagacagcucuu

SEQ ID NO: 2466628 - RNA, 12 nt, Human
gaagacagcucu

SEQ ID NO: 2466629 - RNA, 15 nt, Human
gaagacagagcuaca

SEQ ID NO: 2466630 - RNA, 13 nt, Human
gaagacagagcua

SEQ ID NO: 2466631 - RNA, 16 nt, Human
gaagacacugaugggc

SEQ ID NO: 2466632 - RNA, 15 nt, Human
gaacugcaugcugcu

SEQ ID NO: 2466633 - RNA, 15 nt, Human
gaacugcauauguuu

SEQ ID NO: 2466634 - RNA, 21 nt, Human
gaacugcauauguuucgcuga

SEQ ID NO: 2466635 - RNA, 21 nt, Human
gaagacacugaugggcaaccc

SEQ ID NO: 2466636 - RNA, 18 nt, Human
gaagacagagaccuccug

SEQ ID NO: 2466637 - RNA, 19 nt, Human
gaacugcaugcugcuggac

SEQ ID NO: 2466638 - RNA, 23 nt, Human
gaagacaccagagcagaugcaga

SEQ ID NO: 2466639 - RNA, 21 nt, Human
gaagacacugaaauauacaca

SEQ ID NO: 2466640 - RNA, 19 nt, Human
gaagaccucaccuagaaau

SEQ ID NO: 2466641 - RNA, 18 nt, Human
gaagaccccacccaagcu

SEQ ID NO: 2466642 - RNA, 22 nt, Human
gaagaccuggcaaggacacaga

SEQ ID NO: 2466643 - RNA, 20 nt, Human
gaagaccucaccuagaaauu

SEQ ID NO: 2466644 - RNA, 22 nt, Human
gaagaccugcugagggaccagc

SEQ ID NO: 2466645 - RNA, 20 nt, Human
gaagaccagcuuugcaguga

SEQ ID NO: 2466646 - RNA, 18 nt, Human
gaagaccagacuguggag

SEQ ID NO: 2466647 - RNA, 22 nt, Human
gaagaccacauccacacacgca

SEQ ID NO: 2466648 - RNA, 21 nt, Human
gaagaccacauccacacacgc

SEQ ID NO: 2466649 - RNA, 20 nt, Human
gaagaccacauccacacacg

SEQ ID NO: 2466650 - RNA, 14 nt, Human
gaagaccacaucca

SEQ ID NO: 2466651 - RNA, 23 nt, Human
gaagaccaaucucuugaauccca

SEQ ID NO: 2466652 - RNA, 18 nt, Human
gaagacauguuuuagaca

SEQ ID NO: 2466653 - RNA, 16 nt, Human
gaagaccccacccaag

SEQ ID NO: 2466654 - RNA, 15 nt, Human
gaagaccccacccaa

SEQ ID NO: 2466655 - RNA, 14 nt, Human
gaagacccuccccg

SEQ ID NO: 2466656 - RNA, 14 nt, Human
gaagaccccaccca

SEQ ID NO: 2466657 - RNA, 15 nt, Human
gaagacagcucuuau

SEQ ID NO: 2466658 - RNA, 14 nt, Human
gaagacagcucuua

SEQ ID NO: 2466659 - RNA, 18 nt, Human
gaagacaugaaccaagug

SEQ ID NO: 2466660 - RNA, 21 nt, Human
gaagacagagaccuccugccu

SEQ ID NO: 2466661 - RNA, 15 nt, Human
gaagacaggacagug

SEQ ID NO: 2466662 - RNA, 21 nt, Human
gaagacauggagacuccugcc

SEQ ID NO: 2466663 - RNA, 20 nt, Human
gaagacauggagacuccugc

SEQ ID NO: 2466664 - RNA, 15 nt, Human
gaagacauggagacu

SEQ ID NO: 2466665 - RNA, 12 nt, Human
gaagacauguuu

SEQ ID NO: 2466666 - RNA, 22 nt, Human
gaagacauggggaggaaggaca

SEQ ID NO: 2466667 - RNA, 18 nt, Human
gaacucuuagaaaugaag

SEQ ID NO: 2466668 - RNA, 15 nt, Human
gaacucuuagaaaug

SEQ ID NO: 2466669 - RNA, 20 nt, Human
gaacucuuaaucaaauagca

SEQ ID NO: 2466670 - RNA, 13 nt, Human
gaacucuuaauca

SEQ ID NO: 2466671 - RNA, 20 nt, Human
gaacucuggcuuccagguau

SEQ ID NO: 2466672 - RNA, 18 nt, Human
gaacucugggcugccaug

SEQ ID NO: 2466673 - RNA, 14 nt, Human
gaacuccuggccuc

SEQ ID NO: 2466674 - RNA, 17 nt, Human
gaacucuggcuuccagg

SEQ ID NO: 2466675 - RNA, 19 nt, Human
gaacucuggcuuccaggua

SEQ ID NO: 2466676 - RNA, 19 nt, Human
gaaccccgucgaggggcuc

SEQ ID NO: 2466677 - RNA, 20 nt, Human
gaacuccuggaaauaucagu

SEQ ID NO: 2466678 - RNA, 17 nt, Human
gaacccgggaggcagag

SEQ ID NO: 2466679 - RNA, 19 nt, Human
gaacccgggaggcagaggu

SEQ ID NO: 2466680 - RNA, 15 nt, Human
gaacuccugaccuca

SEQ ID NO: 2466681 - RNA, 14 nt, Human
gaacuccugaccuc

SEQ ID NO: 2466682 - RNA, 13 nt, Human
gaacuccuggccu

SEQ ID NO: 2466683 - RNA, 23 nt, Human
gaacugcaggcccuggccucccc

SEQ ID NO: 2466684 - RNA, 21 nt, Human
gaacugcaggcccuggccucc

SEQ ID NO: 2466685 - RNA, 19 nt, Human
gaacugcaggcccuggccu

SEQ ID NO: 2466686 - RNA, 18 nt, Human
gaacugcaggcccuggcc

SEQ ID NO: 2466687 - RNA, 17 nt, Human
gaacugcaggcccuggc

SEQ ID NO: 2466688 - RNA, 16 nt, Human
gaacugcaggcccugg

SEQ ID NO: 2466689 - RNA, 14 nt, Human
gaacugcaggcccu

SEQ ID NO: 2466690 - RNA, 12 nt, Human
gaacugcaggcc

SEQ ID NO: 2466691 - RNA, 19 nt, Human
gaacugcagaccuguccuc

SEQ ID NO: 2466692 - RNA, 18 nt, Human
gaacugcagaccuguccu

SEQ ID NO: 2466693 - RNA, 17 nt, Human
gaacugcagaccugucc

SEQ ID NO: 2466694 - RNA, 16 nt, Human
gaacugcagaccuguc

SEQ ID NO: 2466695 - RNA, 13 nt, Human
gaacugauaguua

SEQ ID NO: 2466696 - RNA, 19 nt, Human
gaacugauaguuacuguug

SEQ ID NO: 2466697 - RNA, 15 nt, Human
gaacugagcuuggaa

SEQ ID NO: 2466698 - RNA, 16 nt, Human
gaacugagcuuggaag

SEQ ID NO: 2466699 - RNA, 21 nt, Human
gaacugagcuuggaagcuucu

SEQ ID NO: 2466700 - RNA, 22 nt, Human
gaacugagcuuggaagcuucug

SEQ ID NO: 2466701 - RNA, 14 nt, Human
gaacugagcuugga

SEQ ID NO: 2466702 - RNA, 21 nt, Human
gaacugagcuccucugggcag

SEQ ID NO: 2466703 - RNA, 21 nt, Human
gaaccccccucccacccaccg

SEQ ID NO: 2466704 - RNA, 17 nt, Human
gaaccccccucccaccc

SEQ ID NO: 2466705 - RNA, 20 nt, Human
gaaccccggggugcccacag

SEQ ID NO: 2466706 - RNA, 18 nt, Human
gaaccccuggcuccaggc

SEQ ID NO: 2466707 - RNA, 21 nt, Human
gaaccccuacaugaaacagaa

SEQ ID NO: 2466708 - RNA, 17 nt, Human
gaaccccuucauccucu

SEQ ID NO: 2466709 - RNA, 22 nt, Human
gaaccccuggcuccaggccagg

SEQ ID NO: 2466710 - RNA, 17 nt, Human
gaacccaggacgcuucu

SEQ ID NO: 2466711 - RNA, 15 nt, Human
gaacccaggacgcuu

SEQ ID NO: 2466712 - RNA, 16 nt, Human
gaacccaggaggugga

SEQ ID NO: 2466713 - RNA, 23 nt, Human
gaacccauuccauuuaucuuucu

SEQ ID NO: 2466714 - RNA, 19 nt, Human
gaacccaggacgcuucuga

SEQ ID NO: 2466715 - RNA, 14 nt, Human
gaaccccccuccca

SEQ ID NO: 2466716 - RNA, 17 nt, Human
gaaccccaaggagggag

SEQ ID NO: 2466717 - RNA, 16 nt, Human
gaacccaaguccaagc

SEQ ID NO: 2466718 - RNA, 17 nt, Human
gaacccaaguccaagca

SEQ ID NO: 2466719 - RNA, 16 nt, Human
gaacccagacucagac

SEQ ID NO: 2466720 - RNA, 17 nt, Human
gaacccagacucagaca

SEQ ID NO: 2466721 - RNA, 19 nt, Human
gaacccagacucagacauu

SEQ ID NO: 2466722 - RNA, 13 nt, Human
gaacccagacuca

SEQ ID NO: 2466723 - RNA, 15 nt, Human
gaacccaccugcuga

SEQ ID NO: 2466724 - RNA, 19 nt, Human
gaacccaccugcugagaga

SEQ ID NO: 2466725 - RNA, 12 nt, Human
gaacccaccugc

SEQ ID NO: 2466726 - RNA, 13 nt, Human
gaacccaccugcu

SEQ ID NO: 2466727 - RNA, 14 nt, Human
gaacccaccugcug

SEQ ID NO: 2466728 - RNA, 13 nt, Human
gaaccaggagcug

SEQ ID NO: 2466729 - RNA, 23 nt, Human
gaaccagaugaguaaaggaguaa

SEQ ID NO: 2466730 - RNA, 21 nt, Human
gaaccaggaaauggaacccca

SEQ ID NO: 2466731 - RNA, 12 nt, Human
gaaccagagcca

SEQ ID NO: 2466732 - RNA, 19 nt, Human
gaaccagagccauggacuc

SEQ ID NO: 2466733 - RNA, 23 nt, Human
gaaccagagccauggacucuaca

SEQ ID NO: 2466734 - RNA, 14 nt, Human
gaaccacuucccuc

SEQ ID NO: 2466735 - RNA, 19 nt, Human
gaaccacuacaugcagccc

SEQ ID NO: 2466736 - RNA, 23 nt, Human
gaaccaccacacccagcccacuu

SEQ ID NO: 2466737 - RNA, 12 nt, Human
gaaccaucagaa

SEQ ID NO: 2466738 - RNA, 20 nt, Human
gaaccaucauuauaaacgug

SEQ ID NO: 2466739 - RNA, 19 nt, Human
gaaccaguuucagguguuu

SEQ ID NO: 2466740 - RNA, 19 nt, Human
gaaccaguccccccacccu

SEQ ID NO: 2466741 - RNA, 18 nt, Human
gaaccagggagaccgagc

SEQ ID NO: 2466742 - RNA, 22 nt, Human
gaaccauggucggaaaacaugc

SEQ ID NO: 2466743 - RNA, 18 nt, Human
gaaccaugaagacaggau

SEQ ID NO: 2466744 - RNA, 17 nt, Human
gaaccaugaagacagga

SEQ ID NO: 2466745 - RNA, 16 nt, Human
gaaccaugaagacagg

SEQ ID NO: 2466746 - RNA, 21 nt, Human
gaaccaugucagcaaaaagca

SEQ ID NO: 2466747 - RNA, 23 nt, Human
gaaccaugucagcaaaaagcaaa

SEQ ID NO: 2466748 - RNA, 17 nt, Human
cuuucuaaugugugaau

SEQ ID NO: 2466749 - RNA, 16 nt, Human
cuuucuacccagcgag

SEQ ID NO: 2466750 - RNA, 15 nt, Human
cuuucuacccagcga

SEQ ID NO: 2466751 - RNA, 19 nt, Human
cuuucuacaguauuaugua

SEQ ID NO: 2466752 - RNA, 20 nt, Human
cuuucuacagggcugacauu

SEQ ID NO: 2466753 - RNA, 15 nt, Human
cuuucuacaauguga

SEQ ID NO: 2466754 - RNA, 18 nt, Human
cuuucuacaaugugaacu

SEQ ID NO: 2466755 - RNA, 14 nt, Human
cuuucuacaggcca

SEQ ID NO: 2466756 - RNA, 20 nt, Human
cuuucuacaaugugaacuuu

SEQ ID NO: 2466757 - RNA, 16 nt, Human
cuuucuauuguacaga

SEQ ID NO: 2466758 - RNA, 15 nt, Human
cuuucuauuguacag

SEQ ID NO: 2466759 - RNA, 16 nt, Human
cuuucuauugaaaaau

SEQ ID NO: 2466760 - RNA, 23 nt, Human
cuuucuacaguauuauguacucu

SEQ ID NO: 2466761 - RNA, 17 nt, Human
cuuucuauuguacagaa

SEQ ID NO: 2466762 - RNA, 17 nt, Human
cuuugacgccaucccag

SEQ ID NO: 2466763 - RNA, 16 nt, Human
cuuugacgccauccca

SEQ ID NO: 2466764 - RNA, 16 nt, Human
cuuugacucaccuguu

SEQ ID NO: 2466765 - RNA, 23 nt, Human
cuuugaccugccucccuucaugc

SEQ ID NO: 2466766 - RNA, 14 nt, Human
cuuugacucaccug

SEQ ID NO: 2466767 - RNA, 19 nt, Human
cuuugacucaccuguuacu

SEQ ID NO: 2466768 - RNA, 21 nt, Human
cuuugacucuuuugccauuaa

SEQ ID NO: 2466769 - RNA, 16 nt, Human
cuuugacugagcagac

SEQ ID NO: 2466770 - RNA, 14 nt, Human
cuuugaccuguugg

SEQ ID NO: 2466771 - RNA, 20 nt, Human
cuuugaccugccucccuuca

SEQ ID NO: 2466772 - RNA, 18 nt, Human
cuuucucccacugaguuu

SEQ ID NO: 2466773 - RNA, 18 nt, Human
cuuugaccugccucccuu

SEQ ID NO: 2466774 - RNA, 20 nt, Human
cuuucuccagccagcaauga

SEQ ID NO: 2466775 - RNA, 19 nt, Human
cuuucuccagccagcaaug

SEQ ID NO: 2466776 - RNA, 16 nt, Human
cuuucuccagccagca

SEQ ID NO: 2466777 - RNA, 15 nt, Human
cuuucuccagccagc

SEQ ID NO: 2466778 - RNA, 14 nt, Human
cuuucuccagccag

SEQ ID NO: 2466779 - RNA, 13 nt, Human
cuuucuccagcca

SEQ ID NO: 2466780 - RNA, 20 nt, Human
cuuucucagccucugaauau

SEQ ID NO: 2466781 - RNA, 16 nt, Human
cuuucucaguuuucau

SEQ ID NO: 2466782 - RNA, 17 nt, Human
cuuucucaguuuucaua

SEQ ID NO: 2466783 - RNA, 20 nt, Human
cuuucucaguuuucauaagu

SEQ ID NO: 2466784 - RNA, 15 nt, Human
cuuucucaguuuuca

SEQ ID NO: 2466785 - RNA, 22 nt, Human
cuuucucagccgcuucugacug

SEQ ID NO: 2466786 - RNA, 21 nt, Human
cuuucucagccgcuucugacu

SEQ ID NO: 2466787 - RNA, 20 nt, Human
cuuuuauaaacuuuaccuuu

SEQ ID NO: 2466788 - RNA, 21 nt, Human
cuuuuauaaacuuuaccuuuu

SEQ ID NO: 2466789 - RNA, 22 nt, Human
cuuuguauucucuccuguaccu

SEQ ID NO: 2466790 - RNA, 19 nt, Human
cuuuuauaaacuuuaccuu

SEQ ID NO: 2466791 - RNA, 21 nt, Human
cuuuuauaauaaaaggaaaag

SEQ ID NO: 2466792 - RNA, 14 nt, Human
cuuuuauaauaaaa

SEQ ID NO: 2466793 - RNA, 20 nt, Human
cuuuguaugucauuuccuuc

SEQ ID NO: 2466794 - RNA, 22 nt, Human
cuuuuauaacuaguccuuuacu

SEQ ID NO: 2466795 - RNA, 16 nt, Human
cuuuguaaugaaaacc

SEQ ID NO: 2466796 - RNA, 21 nt, Human
cuuuguaaugucaccaccuuc

SEQ ID NO: 2466797 - RNA, 22 nt, Human
cuuuguaaugucaccaccuucc

SEQ ID NO: 2466798 - RNA, 13 nt, Human
cuuuguaaugaaa

SEQ ID NO: 2466799 - RNA, 13 nt, Human
cuuuguaauggga

SEQ ID NO: 2466800 - RNA, 17 nt, Human
cuuuguaaugucaccac

SEQ ID NO: 2466801 - RNA, 17 nt, Human
cuuuguauucucuccug

SEQ ID NO: 2466802 - RNA, 18 nt, Human
cuuuguauauuauuucua

SEQ ID NO: 2466803 - RNA, 12 nt, Human
cuuuguaugcac

SEQ ID NO: 2466804 - RNA, 15 nt, Human
cuuuguaaugaaaac

SEQ ID NO: 2466805 - RNA, 14 nt, Human
cuuuguaaugaaaa

SEQ ID NO: 2466806 - RNA, 14 nt, Human
cuuugguucuggcc

SEQ ID NO: 2466807 - RNA, 19 nt, Human
cuuugguucuggccagaau

SEQ ID NO: 2466808 - RNA, 21 nt, Human
cuuugguucuggccagaaugc

SEQ ID NO: 2466809 - RNA, 19 nt, Human
cuuugguuuuuuucuucug

SEQ ID NO: 2466810 - RNA, 17 nt, Human
cuuugguuuuuuucuuc

SEQ ID NO: 2466811 - RNA, 11 nt, Human
cuuugguuuuu

SEQ ID NO: 2466812 - RNA, 22 nt, Human
cuuugauucuccuucagcccuc

SEQ ID NO: 2466813 - RNA, 19 nt, Human
cuuugauucuccuucagcc

SEQ ID NO: 2466814 - RNA, 18 nt, Human
cuuugauucuccuucagc

SEQ ID NO: 2466815 - RNA, 16 nt, Human
cuuugauucuccuuca

SEQ ID NO: 2466816 - RNA, 19 nt, Human
cuuugagauagaagaacug

SEQ ID NO: 2466817 - RNA, 15 nt, Human
cuuugauucuccuuc

SEQ ID NO: 2466818 - RNA, 18 nt, Human
cuuugagauagaagaacu

SEQ ID NO: 2466819 - RNA, 14 nt, Human
cuuugacuuuuugc

SEQ ID NO: 2466820 - RNA, 15 nt, Human
cuuugacuuuuugca

SEQ ID NO: 2466821 - RNA, 17 nt, Human
cuuugacuuuuugcauu

SEQ ID NO: 2466822 - RNA, 16 nt, Human
cuuugagacaguuucu

SEQ ID NO: 2466823 - RNA, 15 nt, Human
cuuugagacaguuuc

SEQ ID NO: 2466824 - RNA, 13 nt, Human
cuuugagacaguu

SEQ ID NO: 2466825 - RNA, 18 nt, Human
cuuugagacaguuucuua

SEQ ID NO: 2466826 - RNA, 17 nt, Human
cuuugagacaguuucuu

SEQ ID NO: 2466827 - RNA, 17 nt, Human
cuuugagacugggucuc

SEQ ID NO: 2466828 - RNA, 18 nt, Human
cuuugcacagcucuccgg

SEQ ID NO: 2466829 - RNA, 15 nt, Human
cuuugcaaaggagcu

SEQ ID NO: 2466830 - RNA, 16 nt, Human
cuuugcaaaggagcuc

SEQ ID NO: 2466831 - RNA, 20 nt, Human
cuuugauucuccuucagccc

SEQ ID NO: 2466832 - RNA, 14 nt, Human
cuuugguucagcua

SEQ ID NO: 2466833 - RNA, 15 nt, Human
cuuggguaggcggga

SEQ ID NO: 2466834 - RNA, 18 nt, Human
cuuggguggagaagccau

SEQ ID NO: 2466835 - RNA, 17 nt, Human
cuuggguggagaagcca

SEQ ID NO: 2466836 - RNA, 15 nt, Human
cuuggguggagaagc

SEQ ID NO: 2466837 - RNA, 23 nt, Human
cuugggucccccacgugacagug

SEQ ID NO: 2466838 - RNA, 20 nt, Human
cuugggguuuucaguaugaa

SEQ ID NO: 2466839 - RNA, 17 nt, Human
cuugggucccagggaag

SEQ ID NO: 2466840 - RNA, 16 nt, Human
cuuggucugugagaug

SEQ ID NO: 2466841 - RNA, 14 nt, Human
cuugguccugcugc

SEQ ID NO: 2466842 - RNA, 19 nt, Human
cuuggucugugagaugcua

SEQ ID NO: 2466843 - RNA, 16 nt, Human
cuugguccaggaaaug

SEQ ID NO: 2466844 - RNA, 16 nt, Human
cuuggucaccagcucc

SEQ ID NO: 2466845 - RNA, 14 nt, Human
cuuggucaccagcu

SEQ ID NO: 2466846 - RNA, 15 nt, Human
cuuggucuuauuuau

SEQ ID NO: 2466847 - RNA, 22 nt, Human
cuugguagaagcccuucuaccu

SEQ ID NO: 2466848 - RNA, 14 nt, Human
cuuggucacauaca

SEQ ID NO: 2466849 - RNA, 15 nt, Human
cuugguaagaagccg

SEQ ID NO: 2466850 - RNA, 23 nt, Human
cuugguacuacuagaugucuuua

SEQ ID NO: 2466851 - RNA, 22 nt, Human
cuuggguguaacaggucuccuc

SEQ ID NO: 2466852 - RNA, 20 nt, Human
cuuggguggagaagccauug

SEQ ID NO: 2466853 - RNA, 19 nt, Human
cuuggguggagaagccauu

SEQ ID NO: 2466854 - RNA, 23 nt, Human
cuuggguggagaagccauugucu

SEQ ID NO: 2466855 - RNA, 21 nt, Human
cuuggguguaacaggucuccu

SEQ ID NO: 2466856 - RNA, 14 nt, Human
cuuggguucugaua

SEQ ID NO: 2466857 - RNA, 17 nt, Human
cuuggguuuuuguuacc

SEQ ID NO: 2466858 - RNA, 23 nt, Human
cuuggguucaagugauucuccug

SEQ ID NO: 2466859 - RNA, 19 nt, Human
cuugucuuuggacccugag

SEQ ID NO: 2466860 - RNA, 18 nt, Human
cuugucuuuggacccuga

SEQ ID NO: 2466861 - RNA, 15 nt, Human
cuugucuuuggaccc

SEQ ID NO: 2466862 - RNA, 13 nt, Human
cuugucuuuggac

SEQ ID NO: 2466863 - RNA, 17 nt, Human
cuugugacccagcacug

SEQ ID NO: 2466864 - RNA, 13 nt, Human
cuugugacccagc

SEQ ID NO: 2466865 - RNA, 20 nt, Human
cuugugacagauuauacaga

SEQ ID NO: 2466866 - RNA, 19 nt, Human
cuugugacagauuauacag

SEQ ID NO: 2466867 - RNA, 12 nt, Human
cuugugacauau

SEQ ID NO: 2466868 - RNA, 21 nt, Human
cuugugacauauuaugucuuc

SEQ ID NO: 2466869 - RNA, 23 nt, Human
cuugucucaaugcucauaacgga

SEQ ID NO: 2466870 - RNA, 19 nt, Human
cuugucucaaugcucauaa

SEQ ID NO: 2466871 - RNA, 18 nt, Human
cuugucucaaugcucaua

SEQ ID NO: 2466872 - RNA, 17 nt, Human
cuugucucaaugcucau

SEQ ID NO: 2466873 - RNA, 16 nt, Human
cuugucucaaugcuca

SEQ ID NO: 2466874 - RNA, 14 nt, Human
cuugucucaaugcu

SEQ ID NO: 2466875 - RNA, 17 nt, Human
cuugucuauuuuugucu

SEQ ID NO: 2466876 - RNA, 20 nt, Human
cuugguguccuuucccucca

SEQ ID NO: 2466877 - RNA, 21 nt, Human
cuugguguccuuucccuccac

SEQ ID NO: 2466878 - RNA, 16 nt, Human
cuuggucuucccaggc

SEQ ID NO: 2466879 - RNA, 15 nt, Human
cuuggucuucccagg

SEQ ID NO: 2466880 - RNA, 20 nt, Human
cuuggugaauuuuuuuuucc

SEQ ID NO: 2466881 - RNA, 22 nt, Human
cuuggugaauuuuuuuuuccua

SEQ ID NO: 2466882 - RNA, 17 nt, Human
cuugguguaguugaacu

SEQ ID NO: 2466883 - RNA, 15 nt, Human
cuugguguccaccug

SEQ ID NO: 2466884 - RNA, 19 nt, Human
cuuggugucgggcaugaca

SEQ ID NO: 2466885 - RNA, 20 nt, Human
cuuggugucgggcaugacac

SEQ ID NO: 2466886 - RNA, 16 nt, Human
cuugguguccaccugg

SEQ ID NO: 2466887 - RNA, 17 nt, Human
cuugguguccaccuggc

SEQ ID NO: 2466888 - RNA, 19 nt, Human
cuugguguccaccuggccc

SEQ ID NO: 2466889 - RNA, 14 nt, Human
cuugguguccuuuc

SEQ ID NO: 2466890 - RNA, 15 nt, Human
cuuucagaugucuuc

SEQ ID NO: 2466891 - RNA, 12 nt, Human
cuuucagauguc

SEQ ID NO: 2466892 - RNA, 15 nt, Human
cuuucacuauuuccu

SEQ ID NO: 2466893 - RNA, 20 nt, Human
cuuucagaugucuucugccu

SEQ ID NO: 2466894 - RNA, 19 nt, Human
cuuucagaugucuucugcc

SEQ ID NO: 2466895 - RNA, 17 nt, Human
cuuucagaugucuucug

SEQ ID NO: 2466896 - RNA, 16 nt, Human
cuuucagaugucuucu

SEQ ID NO: 2466897 - RNA, 22 nt, Human
cuuucagaugucuucugccugu

SEQ ID NO: 2466898 - RNA, 21 nt, Human
cuuucagaugucuucugccug

SEQ ID NO: 2466899 - RNA, 23 nt, Human
cuuucagaugucuucugccuguu

SEQ ID NO: 2466900 - RNA, 18 nt, Human
cuuuaauuaccaaccugu

SEQ ID NO: 2466901 - RNA, 19 nt, Human
cuuuaauuaccaaccuguu

SEQ ID NO: 2466902 - RNA, 21 nt, Human
cuuguggaagcaaaaaucuga

SEQ ID NO: 2466903 - RNA, 20 nt, Human
cuugugcuuuuccuauuugu

SEQ ID NO: 2466904 - RNA, 18 nt, Human
cuuguggaauugggagcu

SEQ ID NO: 2466905 - RNA, 21 nt, Human
cuuuaauuuauuuuugcaugg

SEQ ID NO: 2466906 - RNA, 19 nt, Human
cuuuaauuuauuuuugcau

SEQ ID NO: 2466907 - RNA, 18 nt, Human
cuuuaauuuauuuuugca

SEQ ID NO: 2466908 - RNA, 16 nt, Human
cuuuaauuuauuuuug

SEQ ID NO: 2466909 - RNA, 22 nt, Human
cuuuaauuuauuuuugcauggc

SEQ ID NO: 2466910 - RNA, 21 nt, Human
cuuuacagguauuuauaauau

SEQ ID NO: 2466911 - RNA, 20 nt, Human
cuuuaauucucaugugaucc

SEQ ID NO: 2466912 - RNA, 17 nt, Human
cuuuaauucucauguga

SEQ ID NO: 2466913 - RNA, 19 nt, Human
cuuuaauucucuuucaaag

SEQ ID NO: 2466914 - RNA, 23 nt, Human
cuuuaauuguuaagauaugaugu

SEQ ID NO: 2466915 - RNA, 17 nt, Human
cuugugccacacccucc

SEQ ID NO: 2466916 - RNA, 18 nt, Human
cuugugccaacacucaag

SEQ ID NO: 2466917 - RNA, 11 nt, Human
cuugugccaua

SEQ ID NO: 2466918 - RNA, 14 nt, Human
cuugugccuggcuc

SEQ ID NO: 2466919 - RNA, 19 nt, Human
cuugugccauagucacaug

SEQ ID NO: 2466920 - RNA, 19 nt, Human
cuugugcagaaaacauugu

SEQ ID NO: 2466921 - RNA, 18 nt, Human
cuugugcagaaaacauug

SEQ ID NO: 2466922 - RNA, 17 nt, Human
cuugugcagaaaacauu

SEQ ID NO: 2466923 - RNA, 16 nt, Human
cuugugcagaaaacau

SEQ ID NO: 2466924 - RNA, 21 nt, Human
cuugugcagaaaacauuguuc

SEQ ID NO: 2466925 - RNA, 20 nt, Human
cuugugcagaaaacauuguu

SEQ ID NO: 2466926 - RNA, 15 nt, Human
cuugugcaguguuga

SEQ ID NO: 2466927 - RNA, 23 nt, Human
cuuuaaugucacaggcaggucca

SEQ ID NO: 2466928 - RNA, 23 nt, Human
cuugugcuggauggagcccaggc

SEQ ID NO: 2466929 - RNA, 22 nt, Human
cuugugcuggauggagcccagg

SEQ ID NO: 2466930 - RNA, 21 nt, Human
cuugugcuggauggagcccag

SEQ ID NO: 2466931 - RNA, 15 nt, Human
cuugugccuggcuca

SEQ ID NO: 2466932 - RNA, 16 nt, Human
cuugugccuggcucag

SEQ ID NO: 2466933 - RNA, 20 nt, Human
cuugugcugaucgugcuaaa

SEQ ID NO: 2466934 - RNA, 20 nt, Human
cuuucacccuuuucuguuug

SEQ ID NO: 2466935 - RNA, 15 nt, Human
cuuucacccuuuucu

SEQ ID NO: 2466936 - RNA, 14 nt, Human
cuuucacccuuuuc

SEQ ID NO: 2466937 - RNA, 17 nt, Human
cuuuaccacccccacac

SEQ ID NO: 2466938 - RNA, 16 nt, Human
cuuuaccacccccaca

SEQ ID NO: 2466939 - RNA, 14 nt, Human
cuuuaccaccccca

SEQ ID NO: 2466940 - RNA, 22 nt, Human
cuuucaccccagggccugagcc

SEQ ID NO: 2466941 - RNA, 23 nt, Human
cuuucaccccagggccugagccu

SEQ ID NO: 2466942 - RNA, 19 nt, Human
cuuuacaugcaauuuauua

SEQ ID NO: 2466943 - RNA, 14 nt, Human
cuuuacaugcaauu

SEQ ID NO: 2466944 - RNA, 17 nt, Human
cuuuacaugcaauuuau

SEQ ID NO: 2466945 - RNA, 17 nt, Human
cuuuacaugacacagcu

SEQ ID NO: 2466946 - RNA, 20 nt, Human
cuuuacaugggguuuucaau

SEQ ID NO: 2466947 - RNA, 13 nt, Human
cuuccuccuggug

SEQ ID NO: 2466948 - RNA, 18 nt, Human
cuuccucuagaagccaag

SEQ ID NO: 2466949 - RNA, 19 nt, Human
cuuccucgcagagaggcca

SEQ ID NO: 2466950 - RNA, 18 nt, Human
cuuccucgcagagaggcc

SEQ ID NO: 2466951 - RNA, 16 nt, Human
cuuccucgcagagagg

SEQ ID NO: 2466952 - RNA, 22 nt, Human
cuuccuccuuuucuuucucucu

SEQ ID NO: 2466953 - RNA, 22 nt, Human
cuuccuccugggcccucucugc

SEQ ID NO: 2466954 - RNA, 19 nt, Human
cuuccucugaggcuggauc

SEQ ID NO: 2466955 - RNA, 15 nt, Human
cuuccucugaggcug

SEQ ID NO: 2466956 - RNA, 22 nt, Human
cuuccucugaggcugaaauuca

SEQ ID NO: 2466957 - RNA, 22 nt, Human
cuuccucuuuccaucuacccuc

SEQ ID NO: 2466958 - RNA, 14 nt, Human
cuuccucugaggcu

SEQ ID NO: 2466959 - RNA, 12 nt, Human
cuuccucugagg

SEQ ID NO: 2466960 - RNA, 16 nt, Human
cuuccucucuccagau

SEQ ID NO: 2466961 - RNA, 16 nt, Human
cuuccucugaggcuga

SEQ ID NO: 2466962 - RNA, 21 nt, Human
cuuccucuuuccaucuacccu

SEQ ID NO: 2466963 - RNA, 15 nt, Human
cuuccucuccacugc

SEQ ID NO: 2466964 - RNA, 14 nt, Human
cuuccucuccacug

SEQ ID NO: 2466965 - RNA, 13 nt, Human
cuuccucuccacu

SEQ ID NO: 2466966 - RNA, 14 nt, Human
cuuccucugagccu

SEQ ID NO: 2466967 - RNA, 15 nt, Human
cuuccucugagccuu

SEQ ID NO: 2466968 - RNA, 19 nt, Human
cuuccucuagaagccaagg

SEQ ID NO: 2466969 - RNA, 15 nt, Human
cuuccucucuccaga

SEQ ID NO: 2466970 - RNA, 14 nt, Human
cuuccucuccaccc

SEQ ID NO: 2466971 - RNA, 13 nt, Human
cuucuaaguaaaa

SEQ ID NO: 2466972 - RNA, 17 nt, Human
cuucuaaguaaaaccac

SEQ ID NO: 2466973 - RNA, 16 nt, Human
cuuccugacacuuuaa

SEQ ID NO: 2466974 - RNA, 17 nt, Human
cuuccugacacuuuaau

SEQ ID NO: 2466975 - RNA, 15 nt, Human
cuuccugacacuuua

SEQ ID NO: 2466976 - RNA, 18 nt, Human
cuuccugacacuuuaauu

SEQ ID NO: 2466977 - RNA, 13 nt, Human
cuuccugaagcug

SEQ ID NO: 2466978 - RNA, 16 nt, Human
cuucuagguucuaaaa

SEQ ID NO: 2466979 - RNA, 21 nt, Human
cuucuaaguaaaaccacagca

SEQ ID NO: 2466980 - RNA, 23 nt, Human
cuucuaaauggcaaaggaaggug

SEQ ID NO: 2466981 - RNA, 23 nt, Human
cuucuaaagguguugucccuucu

SEQ ID NO: 2466982 - RNA, 13 nt, Human
cuucuaaaugcau

SEQ ID NO: 2466983 - RNA, 21 nt, Human
cuucuaggguuauugcauuug

SEQ ID NO: 2466984 - RNA, 20 nt, Human
cuucuagguggcaaggcugu

SEQ ID NO: 2466985 - RNA, 15 nt, Human
cuucuaaaugcauau

SEQ ID NO: 2466986 - RNA, 13 nt, Human
cuucucacauuua

SEQ ID NO: 2466987 - RNA, 20 nt, Human
cuucucacauuuauauuuuu

SEQ ID NO: 2466988 - RNA, 14 nt, Human
cuucuaguuuccca

SEQ ID NO: 2466989 - RNA, 22 nt, Human
cuucuagguggcaaggcugugc

SEQ ID NO: 2466990 - RNA, 15 nt, Human
cuucuaguuucccac

SEQ ID NO: 2466991 - RNA, 13 nt, Human
cuucucugucuca

SEQ ID NO: 2466992 - RNA, 21 nt, Human
cuucucugugaacgauuuaga

SEQ ID NO: 2466993 - RNA, 13 nt, Human
cuucucuguucau

SEQ ID NO: 2466994 - RNA, 22 nt, Human
cuucucugugaacgauuuagaa

SEQ ID NO: 2466995 - RNA, 14 nt, Human
cuucucuguucauu

SEQ ID NO: 2466996 - RNA, 17 nt, Human
cuucucuguucauuucc

SEQ ID NO: 2466997 - RNA, 21 nt, Human
cuucucuguuccauugaaucu

SEQ ID NO: 2466998 - RNA, 12 nt, Human
cuucucuuaauu

SEQ ID NO: 2466999 - RNA, 14 nt, Human
cuucucuuaauuua

SEQ ID NO: 2467000 - RNA, 15 nt, Human
cuucucuuaauuuaa

SEQ ID NO: 2467001 - RNA, 16 nt, Human
cuucucuuaauuuaau

SEQ ID NO: 2467002 - RNA, 14 nt, Human
cuucuucagagacu

SEQ ID NO: 2467003 - RNA, 13 nt, Human
cuucuucagagac

SEQ ID NO: 2467004 - RNA, 15 nt, Human
cuucuucacccagcu

SEQ ID NO: 2467005 - RNA, 14 nt, Human
cuucuucacccagc

SEQ ID NO: 2467006 - RNA, 13 nt, Human
cuucuucaccauu

SEQ ID NO: 2467007 - RNA, 17 nt, Human
cuucuuauucucacucc

SEQ ID NO: 2467008 - RNA, 20 nt, Human
cuucuuauucucacuccacc

SEQ ID NO: 2467009 - RNA, 22 nt, Human
cuucuuauucucacuccaccac

SEQ ID NO: 2467010 - RNA, 21 nt, Human
cuucuuacaauaauucuauga

SEQ ID NO: 2467011 - RNA, 13 nt, Human
cuucuuacaugca

SEQ ID NO: 2467012 - RNA, 23 nt, Human
cuucuucacccagcuaaucugua

SEQ ID NO: 2467013 - RNA, 22 nt, Human
cuucuucacccagcuaaucugu

SEQ ID NO: 2467014 - RNA, 18 nt, Human
cuucuucacccagcuaau

SEQ ID NO: 2467015 - RNA, 16 nt, Human
cuucuucacccagcua

SEQ ID NO: 2467016 - RNA, 20 nt, Human
cuucuucagaagacacugca

SEQ ID NO: 2467017 - RNA, 19 nt, Human
cuucugaaugcugcuacuu

SEQ ID NO: 2467018 - RNA, 16 nt, Human
cuucugaaugcugcua

SEQ ID NO: 2467019 - RNA, 15 nt, Human
cuucugaaugcugcu

SEQ ID NO: 2467020 - RNA, 22 nt, Human
cuucucuuccuuuuaucaguag

SEQ ID NO: 2467021 - RNA, 14 nt, Human
cuucucuuccugua

SEQ ID NO: 2467022 - RNA, 13 nt, Human
cuucucuuccugu

SEQ ID NO: 2467023 - RNA, 14 nt, Human
cuucugaccacacu

SEQ ID NO: 2467024 - RNA, 15 nt, Human
cuucugaccacacuu

SEQ ID NO: 2467025 - RNA, 17 nt, Human
cuucugaccacacuucc

SEQ ID NO: 2467026 - RNA, 18 nt, Human
cuucugaccacacuuccu

SEQ ID NO: 2467027 - RNA, 19 nt, Human
cuucugaccacacuuccug

SEQ ID NO: 2467028 - RNA, 18 nt, Human
cuucugaccacagcauca

SEQ ID NO: 2467029 - RNA, 23 nt, Human
cuucugaccacacuuccugucca

SEQ ID NO: 2467030 - RNA, 21 nt, Human
cuucugaccacagcaucauuu

SEQ ID NO: 2467031 - RNA, 16 nt, Human
cuucuuaaaugagaag

SEQ ID NO: 2467032 - RNA, 21 nt, Human
cuucuuaaaugagaaggaauu

SEQ ID NO: 2467033 - RNA, 21 nt, Human
cuucuuaaccccaguaagcca

SEQ ID NO: 2467034 - RNA, 18 nt, Human
cuucuuaauauaacugcc

SEQ ID NO: 2467035 - RNA, 22 nt, Human
cuucuuaaucuuuucacaaaua

SEQ ID NO: 2467036 - RNA, 21 nt, Human
cuucuuaaucuuuucacaaau

SEQ ID NO: 2467037 - RNA, 23 nt, Human
cuucuuaaucuuuucacaaauaa

SEQ ID NO: 2467038 - RNA, 20 nt, Human
cuucuuaaucuuuucacaaa

SEQ ID NO: 2467039 - RNA, 17 nt, Human
cuucuuaaucuuuucac

SEQ ID NO: 2467040 - RNA, 16 nt, Human
cuucuuaaucuuuuca

SEQ ID NO: 2467041 - RNA, 20 nt, Human
cuucuuaauauaacugccuu

SEQ ID NO: 2467042 - RNA, 14 nt, Human
cuugaagggccaga

SEQ ID NO: 2467043 - RNA, 15 nt, Human
cuugaagggccagag

SEQ ID NO: 2467044 - RNA, 16 nt, Human
cuugaagggccagagc

SEQ ID NO: 2467045 - RNA, 17 nt, Human
cuugaagggccagagcc

SEQ ID NO: 2467046 - RNA, 18 nt, Human
cuugaagggccagagcca

SEQ ID NO: 2467047 - RNA, 19 nt, Human
cuugaagggccagagccag

SEQ ID NO: 2467048 - RNA, 21 nt, Human
cuugaagggccagagccaggg

SEQ ID NO: 2467049 - RNA, 13 nt, Human
cuugaagggccag

SEQ ID NO: 2467050 - RNA, 23 nt, Human
cuugaaggaucuguuuuuaaaaa

SEQ ID NO: 2467051 - RNA, 17 nt, Human
cuugauauccucuuuga

SEQ ID NO: 2467052 - RNA, 22 nt, Human
cuugauauccucuuugagugaa

SEQ ID NO: 2467053 - RNA, 23 nt, Human
cuugaucaacaucuuuucuugcc

SEQ ID NO: 2467054 - RNA, 17 nt, Human
cuugaucaacaucuuuu

SEQ ID NO: 2467055 - RNA, 19 nt, Human
cuugaccagcagaucccag

SEQ ID NO: 2467056 - RNA, 20 nt, Human
cuugaccagcagaucccagc

SEQ ID NO: 2467057 - RNA, 21 nt, Human
cuugaccagcagaucccagcu

SEQ ID NO: 2467058 - RNA, 18 nt, Human
cuugauguguuaucucuu

SEQ ID NO: 2467059 - RNA, 14 nt, Human
cuugauguugcuua

SEQ ID NO: 2467060 - RNA, 20 nt, Human
cuugauuaagaucucagugg

SEQ ID NO: 2467061 - RNA, 16 nt, Human
cuugauuauccauauu

SEQ ID NO: 2467062 - RNA, 23 nt, Human
cuugauguugcuuagucacuuau

SEQ ID NO: 2467063 - RNA, 18 nt, Human
cuugauucacaaugaaau

SEQ ID NO: 2467064 - RNA, 20 nt, Human
cuugacagggcacaccgggc

SEQ ID NO: 2467065 - RNA, 16 nt, Human
cuugacaucaacugca

SEQ ID NO: 2467066 - RNA, 21 nt, Human
cuugaauuguaacuguucuug

SEQ ID NO: 2467067 - RNA, 22 nt, Human
cuugaauuguaacuguucuuga

SEQ ID NO: 2467068 - RNA, 14 nt, Human
cuugacauucaagg

SEQ ID NO: 2467069 - RNA, 19 nt, Human
cuugacauaauuucacuga

SEQ ID NO: 2467070 - RNA, 12 nt, Human
cuugaccaagca

SEQ ID NO: 2467071 - RNA, 15 nt, Human
cuugaccaagcagga

SEQ ID NO: 2467072 - RNA, 17 nt, Human
cuugaccaagcaggaag

SEQ ID NO: 2467073 - RNA, 18 nt, Human
cuugaccaagcaggaagc

SEQ ID NO: 2467074 - RNA, 19 nt, Human
cuugaccaagcaggaagcu

SEQ ID NO: 2467075 - RNA, 20 nt, Human
cuugaccaagcaggaagcuc

SEQ ID NO: 2467076 - RNA, 23 nt, Human
cuugaccaagcaggaagcucaga

SEQ ID NO: 2467077 - RNA, 11 nt, Human
cuugaccagca

SEQ ID NO: 2467078 - RNA, 13 nt, Human
cuugaaugucuuu

SEQ ID NO: 2467079 - RNA, 19 nt, Human
cuugaauguggcuugagaa

SEQ ID NO: 2467080 - RNA, 22 nt, Human
cuugaauguggcuugagaaaua

SEQ ID NO: 2467081 - RNA, 17 nt, Human
cuugaauuguaacuguu

SEQ ID NO: 2467082 - RNA, 20 nt, Human
cuugaauuguaacuguucuu

SEQ ID NO: 2467083 - RNA, 20 nt, Human
cuugaauguggcuugagaaa

SEQ ID NO: 2467084 - RNA, 14 nt, Human
cuugaaggugcuga

SEQ ID NO: 2467085 - RNA, 22 nt, Human
cuugaaggugcugacggccagg

SEQ ID NO: 2467086 - RNA, 20 nt, Human
cuugaagggccagagccagg

SEQ ID NO: 2467087 - RNA, 16 nt, Human
cuugaaggguaaagaa

SEQ ID NO: 2467088 - RNA, 16 nt, Human
cuuggccuugggcuuc

SEQ ID NO: 2467089 - RNA, 23 nt, Human
cuuggccugucucauccccaggg

SEQ ID NO: 2467090 - RNA, 17 nt, Human
cuuggccugucucaucc

SEQ ID NO: 2467091 - RNA, 22 nt, Human
cuuggccugucucauccccagg

SEQ ID NO: 2467092 - RNA, 24 nt, Human
cuuggauuguccccgacccuugcc

SEQ ID NO: 2467093 - RNA, 23 nt, Human
cuuggauuguccccgacccuugc

SEQ ID NO: 2467094 - RNA, 13 nt, Human
cuugcuaugauga

SEQ ID NO: 2467095 - RNA, 22 nt, Human
cuuggauuguccccgacccuug

SEQ ID NO: 2467096 - RNA, 15 nt, Human
cuuggcaacagaagc

SEQ ID NO: 2467097 - RNA, 13 nt, Human
cuuggcaacagaa

SEQ ID NO: 2467098 - RNA, 20 nt, Human
cuuggcaacagaagcaguug

SEQ ID NO: 2467099 - RNA, 11 nt, Human
cuuggccucag

SEQ ID NO: 2467100 - RNA, 16 nt, Human
cuuggccugcugugau

SEQ ID NO: 2467101 - RNA, 15 nt, Human
cuuggccugcuguga

SEQ ID NO: 2467102 - RNA, 13 nt, Human
cuuggccugcugu

SEQ ID NO: 2467103 - RNA, 12 nt, Human
cuuggccugcug

SEQ ID NO: 2467104 - RNA, 17 nt, Human
cuuggccugaucagacc

SEQ ID NO: 2467105 - RNA, 12 nt, Human
cuuggccucaga

SEQ ID NO: 2467106 - RNA, 23 nt, Human
cuuggccucagaauucacaaaau

SEQ ID NO: 2467107 - RNA, 12 nt, Human
cuugauucauaa

SEQ ID NO: 2467108 - RNA, 20 nt, Human
cuugauuuuagccuucucug

SEQ ID NO: 2467109 - RNA, 21 nt, Human
cuugauuuuagccuucucugu

SEQ ID NO: 2467110 - RNA, 19 nt, Human
cuugauuuuagccuucucu

SEQ ID NO: 2467111 - RNA, 16 nt, Human
cuugcaaaaaggguca

SEQ ID NO: 2467112 - RNA, 14 nt, Human
cuugauuuugcaaa

SEQ ID NO: 2467113 - RNA, 12 nt, Human
cuugauuuuugc

SEQ ID NO: 2467114 - RNA, 15 nt, Human
cuugcaaaaaggguc

SEQ ID NO: 2467115 - RNA, 22 nt, Human
cuugcuaaucagugucucacac

SEQ ID NO: 2467116 - RNA, 21 nt, Human
cuugcuaaucagugucucaca

SEQ ID NO: 2467117 - RNA, 20 nt, Human
cuugcuaaucagugucucac

SEQ ID NO: 2467118 - RNA, 19 nt, Human
cuugcuaaucagugucuca

SEQ ID NO: 2467119 - RNA, 23 nt, Human
cuugcuaaucagugucucacacu

SEQ ID NO: 2467120 - RNA, 14 nt, Human
cuugcuaccucagu

SEQ ID NO: 2467121 - RNA, 16 nt, Human
cuugcuaccucaaggg

SEQ ID NO: 2467122 - RNA, 12 nt, Human
cuugcaaaguau

SEQ ID NO: 2467123 - RNA, 18 nt, Human
cuugcuaaucagugucuc

SEQ ID NO: 2467124 - RNA, 17 nt, Human
cuugcuaaucagugucu

SEQ ID NO: 2467125 - RNA, 16 nt, Human
cuugcuaaucaguguc

SEQ ID NO: 2467126 - RNA, 15 nt, Human
cuugcuaaucagugu

SEQ ID NO: 2467127 - RNA, 15 nt, Human
cuugcguaugucugu

SEQ ID NO: 2467128 - RNA, 22 nt, Human
cuugcgguauccgcccccaaua

SEQ ID NO: 2467129 - RNA, 18 nt, Human
gaucuggguucacugcaa

SEQ ID NO: 2467130 - RNA, 22 nt, Human
gaguugauagcacagacccugc

SEQ ID NO: 2467131 - RNA, 21 nt, Human
gaucuggaaccucagccuggc

SEQ ID NO: 2467132 - RNA, 23 nt, Human
gaucuggaaccucagccuggcca

SEQ ID NO: 2467133 - RNA, 17 nt, Human
gaucugggacccuuucc

SEQ ID NO: 2467134 - RNA, 20 nt, Human
gaucuggguucacugcaacc

SEQ ID NO: 2467135 - RNA, 17 nt, Human
gaucuggggcucuggga

SEQ ID NO: 2467136 - RNA, 22 nt, Human
gaucugggacccuuuccuuccu

SEQ ID NO: 2467137 - RNA, 18 nt, Human
gaucuggggcucugggau

SEQ ID NO: 2467138 - RNA, 23 nt, Human
gaucugggacccuuuccuuccuu

SEQ ID NO: 2467139 - RNA, 14 nt, Human
gaugaggccucuug

SEQ ID NO: 2467140 - RNA, 22 nt, Human
gaugaggccgcuagaggccuga

SEQ ID NO: 2467141 - RNA, 21 nt, Human
gaugaggccgcuagaggccug

SEQ ID NO: 2467142 - RNA, 19 nt, Human
gaugaggccgcuagaggcc

SEQ ID NO: 2467143 - RNA, 13 nt, Human
gaugaggcagagg

SEQ ID NO: 2467144 - RNA, 19 nt, Human
gaugagcucuacccagggc

SEQ ID NO: 2467145 - RNA, 20 nt, Human
gaugagcucuacccagggcc

SEQ ID NO: 2467146 - RNA, 20 nt, Human
gaugagcuggaaggagugag

SEQ ID NO: 2467147 - RNA, 11 nt, Human
gaugagcucua

SEQ ID NO: 2467148 - RNA, 16 nt, Human
gaugagcucuacccag

SEQ ID NO: 2467149 - RNA, 23 nt, Human
gaugaggccucuuggaccucugc

SEQ ID NO: 2467150 - RNA, 22 nt, Human
gaugaggccucuuggaccucug

SEQ ID NO: 2467151 - RNA, 14 nt, Human
gaugaugacuaugg

SEQ ID NO: 2467152 - RNA, 17 nt, Human
gaugaugugccugggug

SEQ ID NO: 2467153 - RNA, 15 nt, Human
gaugaugugccuggg

SEQ ID NO: 2467154 - RNA, 14 nt, Human
gaugaugugccugg

SEQ ID NO: 2467155 - RNA, 22 nt, Human
gaugaugguugcaaaagacuaa

SEQ ID NO: 2467156 - RNA, 15 nt, Human
gaugaugguguuuug

SEQ ID NO: 2467157 - RNA, 21 nt, Human
gaugauggucuucagccucuu

SEQ ID NO: 2467158 - RNA, 15 nt, Human
gaugaugccacacca

SEQ ID NO: 2467159 - RNA, 13 nt, Human
gaugaugccacac

SEQ ID NO: 2467160 - RNA, 19 nt, Human
gaugaugccaaccucugga

SEQ ID NO: 2467161 - RNA, 14 nt, Human
gaugaugcugccag

SEQ ID NO: 2467162 - RNA, 19 nt, Human
gaugaugggaauuguguga

SEQ ID NO: 2467163 - RNA, 17 nt, Human
gaugaugggaauugugu

SEQ ID NO: 2467164 - RNA, 20 nt, Human
gaugcuggucauguguuuga

SEQ ID NO: 2467165 - RNA, 17 nt, Human
gaugcugguaauggcca

SEQ ID NO: 2467166 - RNA, 23 nt, Human
gaugcuggguuggugcacaguga

SEQ ID NO: 2467167 - RNA, 20 nt, Human
gaugcuggguuggugcacag

SEQ ID NO: 2467168 - RNA, 19 nt, Human
gaugcuggguuggugcaca

SEQ ID NO: 2467169 - RNA, 17 nt, Human
gaugcugggcugggugc

SEQ ID NO: 2467170 - RNA, 15 nt, Human
gaugauucagaaauu

SEQ ID NO: 2467171 - RNA, 15 nt, Human
gaugcugggcugggu

SEQ ID NO: 2467172 - RNA, 14 nt, Human
gaugcugggcuggg

SEQ ID NO: 2467173 - RNA, 22 nt, Human
gaugcugggcuggcucccucuu

SEQ ID NO: 2467174 - RNA, 17 nt, Human
gaugcugggcuggcucc

SEQ ID NO: 2467175 - RNA, 23 nt, Human
gaugcuucucacugccaugccag

SEQ ID NO: 2467176 - RNA, 16 nt, Human
gaugcugugcuaugaa

SEQ ID NO: 2467177 - RNA, 20 nt, Human
gaugcugguaauggccaugg

SEQ ID NO: 2467178 - RNA, 17 nt, Human
gauguacagucugucau

SEQ ID NO: 2467179 - RNA, 16 nt, Human
gauguacagucuguca

SEQ ID NO: 2467180 - RNA, 19 nt, Human
gauguacagucugucauga

SEQ ID NO: 2467181 - RNA, 18 nt, Human
gauguacagucugucaug

SEQ ID NO: 2467182 - RNA, 15 nt, Human
gauguacauuuccaa

SEQ ID NO: 2467183 - RNA, 19 nt, Human
gauguaccaugaaacaaag

SEQ ID NO: 2467184 - RNA, 22 nt, Human
gauguacauuuccaaauucaca

SEQ ID NO: 2467185 - RNA, 12 nt, Human
gauguaaaguga

SEQ ID NO: 2467186 - RNA, 19 nt, Human
gauggauauauguuuuuga

SEQ ID NO: 2467187 - RNA, 22 nt, Human
gaugucagccgagccgggccug

SEQ ID NO: 2467188 - RNA, 17 nt, Human
gaugucccaacuuguaa

SEQ ID NO: 2467189 - RNA, 17 nt, Human
gauguccacagaugccu

SEQ ID NO: 2467190 - RNA, 20 nt, Human
gauguccacagaugccucca

SEQ ID NO: 2467191 - RNA, 20 nt, Human
gauguccagaagaauauuca

SEQ ID NO: 2467192 - RNA, 12 nt, Human
gauguccagaag

SEQ ID NO: 2467193 - RNA, 18 nt, Human
gaugucccaacuuguaaa

SEQ ID NO: 2467194 - RNA, 21 nt, Human
gauguccucaccacaugcgga

SEQ ID NO: 2467195 - RNA, 20 nt, Human
gaugucccuuucuuggccag

SEQ ID NO: 2467196 - RNA, 21 nt, Human
gaugucccuuucuuggccagu

SEQ ID NO: 2467197 - RNA, 19 nt, Human
gauggaguucuugugccau

SEQ ID NO: 2467198 - RNA, 18 nt, Human
gauggaguucuugugcca

SEQ ID NO: 2467199 - RNA, 18 nt, Human
gauggaguccagggaaga

SEQ ID NO: 2467200 - RNA, 16 nt, Human
gauggagguuucauac

SEQ ID NO: 2467201 - RNA, 16 nt, Human
gauggaguucuugugc

SEQ ID NO: 2467202 - RNA, 18 nt, Human
gauggauaaccuauauga

SEQ ID NO: 2467203 - RNA, 21 nt, Human
gaugcuuuucugucucugccu

SEQ ID NO: 2467204 - RNA, 22 nt, Human
gauggagcgcaccugcccccug

SEQ ID NO: 2467205 - RNA, 23 nt, Human
gauggaggaaaaccaagccgugg

SEQ ID NO: 2467206 - RNA, 13 nt, Human
gauggaggagaag

SEQ ID NO: 2467207 - RNA, 14 nt, Human
gauggaggagaaga

SEQ ID NO: 2467208 - RNA, 12 nt, Human
gauggaggagga

SEQ ID NO: 2467209 - RNA, 11 nt, Human
gauggaggagg

SEQ ID NO: 2467210 - RNA, 21 nt, Human
gauggaggggugguccugacu

SEQ ID NO: 2467211 - RNA, 22 nt, Human
gauggaggggugguccugacuc

SEQ ID NO: 2467212 - RNA, 19 nt, Human
gauggagguucucucggag

SEQ ID NO: 2467213 - RNA, 14 nt, Human
gaugcuuguacaua

SEQ ID NO: 2467214 - RNA, 16 nt, Human
gaugcuuguacauaau

SEQ ID NO: 2467215 - RNA, 23 nt, Human
gaugcuuuguuucuuucauauga

SEQ ID NO: 2467216 - RNA, 13 nt, Human
gaugcuguuugac

SEQ ID NO: 2467217 - RNA, 17 nt, Human
gaugcuuuuagcucaaa

SEQ ID NO: 2467218 - RNA, 20 nt, Human
gaugcuuuucugucucugcc

SEQ ID NO: 2467219 - RNA, 17 nt, Human
gaugcuuuucugucucu

SEQ ID NO: 2467220 - RNA, 16 nt, Human
gaugcuuuucugucuc

SEQ ID NO: 2467221 - RNA, 21 nt, Human
gaugcuuuaagugcacaacau

SEQ ID NO: 2467222 - RNA, 14 nt, Human
gaugcuguuugaca

SEQ ID NO: 2467223 - RNA, 12 nt, Human
gaugcuguugcc

SEQ ID NO: 2467224 - RNA, 15 nt, Human
gaugucuucugccug

SEQ ID NO: 2467225 - RNA, 14 nt, Human
gaugucuucugccu

SEQ ID NO: 2467226 - RNA, 13 nt, Human
gaugucuucugcc

SEQ ID NO: 2467227 - RNA, 21 nt, Human
gaugucuucguacaguucuuc

SEQ ID NO: 2467228 - RNA, 18 nt, Human
gaugucuucugccuguua

SEQ ID NO: 2467229 - RNA, 16 nt, Human
gaugucuucugccugu

SEQ ID NO: 2467230 - RNA, 20 nt, Human
gaugucuucugccuguuaua

SEQ ID NO: 2467231 - RNA, 19 nt, Human
gaugugaguugcacagcua

SEQ ID NO: 2467232 - RNA, 20 nt, Human
gaugucuucguacaguucuu

SEQ ID NO: 2467233 - RNA, 22 nt, Human
gaugucuuccuuggagggggga

SEQ ID NO: 2467234 - RNA, 18 nt, Human
gaugucuucauaccuaca

SEQ ID NO: 2467235 - RNA, 14 nt, Human
gaugucuucauacc

SEQ ID NO: 2467236 - RNA, 21 nt, Human
gaugucugccaauuuuugccu

SEQ ID NO: 2467237 - RNA, 22 nt, Human
gaugucugccaauuuuugccuu

SEQ ID NO: 2467238 - RNA, 14 nt, Human
gaugucugccaauu

SEQ ID NO: 2467239 - RNA, 17 nt, Human
gauguccucaccacaug

SEQ ID NO: 2467240 - RNA, 14 nt, Human
gaugucuaauaguu

SEQ ID NO: 2467241 - RNA, 18 nt, Human
gaugugauauauaagugu

SEQ ID NO: 2467242 - RNA, 11 nt, Human
gaugugauaua

SEQ ID NO: 2467243 - RNA, 15 nt, Human
gaugugauuguggaa

SEQ ID NO: 2467244 - RNA, 16 nt, Human
gaugugauuguggaau

SEQ ID NO: 2467245 - RNA, 18 nt, Human
gaugugauuguggaaugg

SEQ ID NO: 2467246 - RNA, 24 nt, Human
gaugugauuuaauaguguuaauca

SEQ ID NO: 2467247 - RNA, 23 nt, Human
gaugugauuuaauaguguuaauc

SEQ ID NO: 2467248 - RNA, 18 nt, Human
gaugugauuuaauagugu

SEQ ID NO: 2467249 - RNA, 15 nt, Human
gaugugcaugggagc

SEQ ID NO: 2467250 - RNA, 21 nt, Human
gaugugcauuuuugugaaaug

SEQ ID NO: 2467251 - RNA, 14 nt, Human
gaugugcacccaug

SEQ ID NO: 2467252 - RNA, 23 nt, Human
gaugugcauuuuugugaaaugaa

SEQ ID NO: 2467253 - RNA, 19 nt, Human
gauucuccugccucagccu

SEQ ID NO: 2467254 - RNA, 21 nt, Human
gauucuccugccucagccucc

SEQ ID NO: 2467255 - RNA, 20 nt, Human
gauucuccugccucagccuc

SEQ ID NO: 2467256 - RNA, 16 nt, Human
gauucuccugugcuag

SEQ ID NO: 2467257 - RNA, 14 nt, Human
gauucuccugugcu

SEQ ID NO: 2467258 - RNA, 12 nt, Human
gauucuguacau

SEQ ID NO: 2467259 - RNA, 15 nt, Human
gauucuguggaacaa

SEQ ID NO: 2467260 - RNA, 19 nt, Human
gauucuguguguuuucaua

SEQ ID NO: 2467261 - RNA, 22 nt, Human
gauucuguguguuuucauaaua

SEQ ID NO: 2467262 - RNA, 23 nt, Human
gauucuuauggacaaugacccag

SEQ ID NO: 2467263 - RNA, 21 nt, Human
gauucuucugcuucagccucc

SEQ ID NO: 2467264 - RNA, 20 nt, Human
gauuuaacagaaauguacag

SEQ ID NO: 2467265 - RNA, 23 nt, Human
gauuuaacagaaauguacagcaa

SEQ ID NO: 2467266 - RNA, 23 nt, Human
gauucuuggcccgcacagagcug

SEQ ID NO: 2467267 - RNA, 19 nt, Human
gauucuuuccauuaugauu

SEQ ID NO: 2467268 - RNA, 16 nt, Human
gauuucacucuccuug

SEQ ID NO: 2467269 - RNA, 13 nt, Human
gauuucacucucc

SEQ ID NO: 2467270 - RNA, 19 nt, Human
gauuuaacagucauuuaaa

SEQ ID NO: 2467271 - RNA, 18 nt, Human
gauuuaacagucauuuaa

SEQ ID NO: 2467272 - RNA, 17 nt, Human
gauuuaacagucauuua

SEQ ID NO: 2467273 - RNA, 20 nt, Human
gauucuuucccaauucacau

SEQ ID NO: 2467274 - RNA, 18 nt, Human
gauuuaagacacuuuuug

SEQ ID NO: 2467275 - RNA, 13 nt, Human
gauuuaauaaaau

SEQ ID NO: 2467276 - RNA, 14 nt, Human
gauuuaauaaaaua

SEQ ID NO: 2467277 - RNA, 22 nt, Human
gauuuaagggauggaaaaggaa

SEQ ID NO: 2467278 - RNA, 18 nt, Human
gauuucacucuccuuggu

SEQ ID NO: 2467279 - RNA, 17 nt, Human
gauuucacucuccuugg

SEQ ID NO: 2467280 - RNA, 17 nt, Human
gauuucagcucacugca

SEQ ID NO: 2467281 - RNA, 20 nt, Human
gauuucagcucacugcaacc

SEQ ID NO: 2467282 - RNA, 15 nt, Human
gauuucagcucacug

SEQ ID NO: 2467283 - RNA, 17 nt, Human
gauuuaauaaaauaauu

SEQ ID NO: 2467284 - RNA, 15 nt, Human
gauuuaauaaaauaa

SEQ ID NO: 2467285 - RNA, 21 nt, Human
gauuucagaaagagcaagucu

SEQ ID NO: 2467286 - RNA, 18 nt, Human
gcaaaaaaaaaaaaaagc

SEQ ID NO: 2467287 - RNA, 20 nt, Human
gcaaaaaacucgaggacugu

SEQ ID NO: 2467288 - RNA, 15 nt, Human
gauuucaucugcucu

SEQ ID NO: 2467289 - RNA, 12 nt, Human
gauuucaucugc

SEQ ID NO: 2467290 - RNA, 23 nt, Human
gauuuuuuuuuccuucagugccu

SEQ ID NO: 2467291 - RNA, 22 nt, Human
gauuuuuuuuuccuucagugcc

SEQ ID NO: 2467292 - RNA, 20 nt, Human
gauuucaggauacucuguca

SEQ ID NO: 2467293 - RNA, 22 nt, Human
gauuucaggauacucugucaga

SEQ ID NO: 2467294 - RNA, 22 nt, Human
gcacuaugaggaauaauuauuu

SEQ ID NO: 2467295 - RNA, 15 nt, Human
gcacuccagccuggg

SEQ ID NO: 2467296 - RNA, 13 nt, Human
gcacucaacauga

SEQ ID NO: 2467297 - RNA, 22 nt, Human
gcacucacacaggacccccuuc

SEQ ID NO: 2467298 - RNA, 16 nt, Human
gcacucacacaggacc

SEQ ID NO: 2467299 - RNA, 16 nt, Human
gcacuccagccugggc

SEQ ID NO: 2467300 - RNA, 17 nt, Human
gcacuccagccugggca

SEQ ID NO: 2467301 - RNA, 21 nt, Human
gcacuccagccugggcgacag

SEQ ID NO: 2467302 - RNA, 15 nt, Human
gcacuccaugcuuag

SEQ ID NO: 2467303 - RNA, 16 nt, Human
gcacuccaugagcacc

SEQ ID NO: 2467304 - RNA, 23 nt, Human
gcacucacacaggacccccuucc

SEQ ID NO: 2467305 - RNA, 23 nt, Human
gcacuccaugcuuagucacugcc

SEQ ID NO: 2467306 - RNA, 21 nt, Human
gcacuccaugcuuagucacug

SEQ ID NO: 2467307 - RNA, 17 nt, Human
gcacuccagccugggug

SEQ ID NO: 2467308 - RNA, 21 nt, Human
gcacucuaaaagguucaggga

SEQ ID NO: 2467309 - RNA, 17 nt, Human
gcacucuaaaagguuca

SEQ ID NO: 2467310 - RNA, 21 nt, Human
gcacucgggaaaccuggggcu

SEQ ID NO: 2467311 - RNA, 22 nt, Human
gcacuauagccuaggugacaga

SEQ ID NO: 2467312 - RNA, 12 nt, Human
gcaccuccugcc

SEQ ID NO: 2467313 - RNA, 23 nt, Human
gcaccuccccccacugcaggccc

SEQ ID NO: 2467314 - RNA, 19 nt, Human
gcaccuccccccacugcag

SEQ ID NO: 2467315 - RNA, 21 nt, Human
gcaccuccccccacugcaggc

SEQ ID NO: 2467316 - RNA, 17 nt, Human
gcaccucccauccuaau

SEQ ID NO: 2467317 - RNA, 13 nt, Human
gcaccucccccca

SEQ ID NO: 2467318 - RNA, 17 nt, Human
gcaccuccccccacugc

SEQ ID NO: 2467319 - RNA, 18 nt, Human
gcaccuccccccacugca

SEQ ID NO: 2467320 - RNA, 12 nt, Human
gcacacauuuuu

SEQ ID NO: 2467321 - RNA, 11 nt, Human
gcacacauuuu

SEQ ID NO: 2467322 - RNA, 13 nt, Human
gcacacagggcag

SEQ ID NO: 2467323 - RNA, 20 nt, Human
gcacacaccagagcccaccu

SEQ ID NO: 2467324 - RNA, 16 nt, Human
gcacacaccucagagg

SEQ ID NO: 2467325 - RNA, 21 nt, Human
gcacacaccuguagucccagc

SEQ ID NO: 2467326 - RNA, 17 nt, Human
gcacacacugugcuuuc

SEQ ID NO: 2467327 - RNA, 12 nt, Human
gcacacacugug

SEQ ID NO: 2467328 - RNA, 11 nt, Human
gcacacacugu

SEQ ID NO: 2467329 - RNA, 13 nt, Human
gcacacaccugua

SEQ ID NO: 2467330 - RNA, 19 nt, Human
gcacacacugugcuuucua

SEQ ID NO: 2467331 - RNA, 11 nt, Human
gcacacagcac

SEQ ID NO: 2467332 - RNA, 23 nt, Human
gcacacagcacgggggccaagga

SEQ ID NO: 2467333 - RNA, 19 nt, Human
gcacacagcugcagagaca

SEQ ID NO: 2467334 - RNA, 16 nt, Human
gcaccggcuggccugg

SEQ ID NO: 2467335 - RNA, 15 nt, Human
gcaccggcuggccug

SEQ ID NO: 2467336 - RNA, 17 nt, Human
gcaccuaauccaggcag

SEQ ID NO: 2467337 - RNA, 18 nt, Human
gcaccuaauccaggcaga

SEQ ID NO: 2467338 - RNA, 16 nt, Human
gcaccuaauccaggca

SEQ ID NO: 2467339 - RNA, 17 nt, Human
gcaccggcuggccuggc

SEQ ID NO: 2467340 - RNA, 17 nt, Human
gcaccuaccaccacgcc

SEQ ID NO: 2467341 - RNA, 18 nt, Human
gcaccuaccaccacgccc

SEQ ID NO: 2467342 - RNA, 18 nt, Human
gcaccuccacauccucca

SEQ ID NO: 2467343 - RNA, 11 nt, Human
gcaccucccau

SEQ ID NO: 2467344 - RNA, 14 nt, Human
gcaccucccauccu

SEQ ID NO: 2467345 - RNA, 21 nt, Human
gcaccuacaguguacagucuu

SEQ ID NO: 2467346 - RNA, 19 nt, Human
gcaccuacaguguacaguc

SEQ ID NO: 2467347 - RNA, 22 nt, Human
gcaccuaauccaggcagaucca

SEQ ID NO: 2467348 - RNA, 23 nt, Human
gcaccuaauccaggcagauccag

SEQ ID NO: 2467349 - RNA, 18 nt, Human
gcaccuacaguguacagu

SEQ ID NO: 2467350 - RNA, 18 nt, Human
gcaaccuccgccucuugg

SEQ ID NO: 2467351 - RNA, 22 nt, Human
gcaacccuggugaccagcacca

SEQ ID NO: 2467352 - RNA, 23 nt, Human
gcaaccgucuguuaugcugugac

SEQ ID NO: 2467353 - RNA, 21 nt, Human
gcaacccuuaccccuuagccu

SEQ ID NO: 2467354 - RNA, 12 nt, Human
gcaacccuccua

SEQ ID NO: 2467355 - RNA, 23 nt, Human
gcaacccuccuaucaccuccccu

SEQ ID NO: 2467356 - RNA, 18 nt, Human
gcaacccccagccugcua

SEQ ID NO: 2467357 - RNA, 17 nt, Human
gcaacccccagccugcu

SEQ ID NO: 2467358 - RNA, 16 nt, Human
gcaaaagaugcuucuc

SEQ ID NO: 2467359 - RNA, 22 nt, Human
gcaaaacagcguuuaagacugu

SEQ ID NO: 2467360 - RNA, 21 nt, Human
gcaaaaccacuagaacucucc

SEQ ID NO: 2467361 - RNA, 23 nt, Human
gcaaaacucuacuuaauccaaug

SEQ ID NO: 2467362 - RNA, 22 nt, Human
gcaaaacucuacuuaauccaau

SEQ ID NO: 2467363 - RNA, 17 nt, Human
gcaaaacucuacuuaau

SEQ ID NO: 2467364 - RNA, 20 nt, Human
gcaaaacgcauggagugugu

SEQ ID NO: 2467365 - RNA, 12 nt, Human
gcaaaacugaau

SEQ ID NO: 2467366 - RNA, 16 nt, Human
gcaaaagacuaauuua

SEQ ID NO: 2467367 - RNA, 15 nt, Human
gcaaaagaugcuucu

SEQ ID NO: 2467368 - RNA, 19 nt, Human
gcacacaccagagcccacc

SEQ ID NO: 2467369 - RNA, 18 nt, Human
gcacacaccagagcccac

SEQ ID NO: 2467370 - RNA, 17 nt, Human
gcacacaccagagccca

SEQ ID NO: 2467371 - RNA, 16 nt, Human
gcacacaccagagccc

SEQ ID NO: 2467372 - RNA, 15 nt, Human
gcacacaccagagcc

SEQ ID NO: 2467373 - RNA, 14 nt, Human
gcacacaccagagc

SEQ ID NO: 2467374 - RNA, 12 nt, Human
gcacacaccaga

SEQ ID NO: 2467375 - RNA, 23 nt, Human
gcaauaauggucccauccaggca

SEQ ID NO: 2467376 - RNA, 22 nt, Human
gcaauaauggucccauccaggc

SEQ ID NO: 2467377 - RNA, 21 nt, Human
gcaauaauggucccauccagg

SEQ ID NO: 2467378 - RNA, 20 nt, Human
gcaauaauggucccauccag

SEQ ID NO: 2467379 - RNA, 23 nt, Human
gcaauaccguguugguuuugacu

SEQ ID NO: 2467380 - RNA, 18 nt, Human
gcaauagucaaauugugu

SEQ ID NO: 2467381 - RNA, 23 nt, Human
gcaauaaggggagaguaacccug

SEQ ID NO: 2467382 - RNA, 19 nt, Human
gcaauaauggucccaucca

SEQ ID NO: 2467383 - RNA, 13 nt, Human
gcaauaaagaaga

SEQ ID NO: 2467384 - RNA, 18 nt, Human
gcaauaauggucccaucc

SEQ ID NO: 2467385 - RNA, 11 nt, Human
gcaauaaagca

SEQ ID NO: 2467386 - RNA, 22 nt, Human
gcaaguuucuagcuagaaauau

SEQ ID NO: 2467387 - RNA, 21 nt, Human
gcaaguucuagagaagaggcu

SEQ ID NO: 2467388 - RNA, 21 nt, Human
gcauccuggcacccggccccu

SEQ ID NO: 2467389 - RNA, 17 nt, Human
gcauccuggcacccggc

SEQ ID NO: 2467390 - RNA, 18 nt, Human
gcauggcaucaccuccac

SEQ ID NO: 2467391 - RNA, 20 nt, Human
gcaucgcaccauucugacuc

SEQ ID NO: 2467392 - RNA, 13 nt, Human
gcauccuucugcc

SEQ ID NO: 2467393 - RNA, 13 nt, Human
gcauggccaggug

SEQ ID NO: 2467394 - RNA, 17 nt, Human
gcauggccagcagcuug

SEQ ID NO: 2467395 - RNA, 17 nt, Human
gcauggccagguggcca

SEQ ID NO: 2467396 - RNA, 14 nt, Human
gcauggccaggugg

SEQ ID NO: 2467397 - RNA, 23 nt, Human
gcauccuggcacccggccccugc

SEQ ID NO: 2467398 - RNA, 22 nt, Human
gcauccuggcacccggccccug

SEQ ID NO: 2467399 - RNA, 13 nt, Human
gcaucgcaaugua

SEQ ID NO: 2467400 - RNA, 18 nt, Human
gcaucgcaccauucugac

SEQ ID NO: 2467401 - RNA, 20 nt, Human
gcauccuuuucugcagaggg

SEQ ID NO: 2467402 - RNA, 14 nt, Human
gcauccuggcaccc

SEQ ID NO: 2467403 - RNA, 17 nt, Human
gcauccugugaaguccu

SEQ ID NO: 2467404 - RNA, 14 nt, Human
gcauccugugaagu

SEQ ID NO: 2467405 - RNA, 16 nt, Human
gcauuguaaaugugcu

SEQ ID NO: 2467406 - RNA, 20 nt, Human
gcauuggcagcaggugcugc

SEQ ID NO: 2467407 - RNA, 21 nt, Human
gcauuggcagcaggugcugcu

SEQ ID NO: 2467408 - RNA, 20 nt, Human
gcaugugacucugaagcuga

SEQ ID NO: 2467409 - RNA, 15 nt, Human
gcauuguaucgaugu

SEQ ID NO: 2467410 - RNA, 19 nt, Human
gcauuguaucgauguuaug

SEQ ID NO: 2467411 - RNA, 17 nt, Human
gcauugugaacugacag

SEQ ID NO: 2467412 - RNA, 16 nt, Human
gcauugucccugugcc

SEQ ID NO: 2467413 - RNA, 21 nt, Human
gcauguauugugucuuuugca

SEQ ID NO: 2467414 - RNA, 23 nt, Human
gcauguauugugucuuuugcaug

SEQ ID NO: 2467415 - RNA, 19 nt, Human
gcauguccuguaaagguua

SEQ ID NO: 2467416 - RNA, 23 nt, Human
gcaugucgugaccaacuagacau

SEQ ID NO: 2467417 - RNA, 23 nt, Human
gcaugucccuaccgagucucuuc

SEQ ID NO: 2467418 - RNA, 17 nt, Human
gcaugugaugagaggaa

SEQ ID NO: 2467419 - RNA, 12 nt, Human
gcaugugaagaa

SEQ ID NO: 2467420 - RNA, 15 nt, Human
gcaugugacucugaa

SEQ ID NO: 2467421 - RNA, 21 nt, Human
gcaugugacucugaagcugac

SEQ ID NO: 2467422 - RNA, 21 nt, Human
gcaugugaaaaucaaauacau

SEQ ID NO: 2467423 - RNA, 16 nt, Human
gcaugggaaugaaugu

SEQ ID NO: 2467424 - RNA, 13 nt, Human
gcaugggaaugaa

SEQ ID NO: 2467425 - RNA, 19 nt, Human
gcaugggaaugaaugucag

SEQ ID NO: 2467426 - RNA, 15 nt, Human
gcaugggcacucccu

SEQ ID NO: 2467427 - RNA, 13 nt, Human
gcauggcccuggg

SEQ ID NO: 2467428 - RNA, 12 nt, Human
gcauggcccugg

SEQ ID NO: 2467429 - RNA, 13 nt, Human
gcaugggccuggc

SEQ ID NO: 2467430 - RNA, 20 nt, Human
gcauguauugugucuuuugc

SEQ ID NO: 2467431 - RNA, 20 nt, Human
gcauguauuggccuggaggu

SEQ ID NO: 2467432 - RNA, 19 nt, Human
gcauguauuggccuggagg

SEQ ID NO: 2467433 - RNA, 18 nt, Human
gcauguauuggccuggag

SEQ ID NO: 2467434 - RNA, 17 nt, Human
gcauguauuggccugga

SEQ ID NO: 2467435 - RNA, 16 nt, Human
gcauguauuggccugg

SEQ ID NO: 2467436 - RNA, 15 nt, Human
gcauguauuggccug

SEQ ID NO: 2467437 - RNA, 15 nt, Human
gcauguaugucuugg

SEQ ID NO: 2467438 - RNA, 14 nt, Human
gcauguaugucuug

SEQ ID NO: 2467439 - RNA, 20 nt, Human
gcauguaccauuugcauggc

SEQ ID NO: 2467440 - RNA, 14 nt, Human
gcauguaggagaau

SEQ ID NO: 2467441 - RNA, 15 nt, Human
gcauguaggagaauc

SEQ ID NO: 2467442 - RNA, 22 nt, Human
gcauggggauaaaggagaaggc

SEQ ID NO: 2467443 - RNA, 22 nt, Human
gcaugggccuggccaccucucu

SEQ ID NO: 2467444 - RNA, 23 nt, Human
gcauggggauaaaggagaaggca

SEQ ID NO: 2467445 - RNA, 18 nt, Human
gcauguaccauuugcaug

SEQ ID NO: 2467446 - RNA, 23 nt, Human
gcauguacaguguucuguuuaau

SEQ ID NO: 2467447 - RNA, 22 nt, Human
gcauguacccuaaggucauuac

SEQ ID NO: 2467448 - RNA, 18 nt, Human
gccaagaauucuuaaaua

SEQ ID NO: 2467449 - RNA, 14 nt, Human
gccaagaauucuua

SEQ ID NO: 2467450 - RNA, 21 nt, Human
gccaagaaacgucuucuaaac

SEQ ID NO: 2467451 - RNA, 22 nt, Human
gccaagaaacgucuucuaaacu

SEQ ID NO: 2467452 - RNA, 15 nt, Human
gccaagaaacgucuu

SEQ ID NO: 2467453 - RNA, 18 nt, Human
gccaagaaguuuaaggaa

SEQ ID NO: 2467454 - RNA, 22 nt, Human
gccaagacuuggcaacagaagc

SEQ ID NO: 2467455 - RNA, 18 nt, Human
gccaagacuuggcaacag

SEQ ID NO: 2467456 - RNA, 12 nt, Human
gccaagacuugg

SEQ ID NO: 2467457 - RNA, 13 nt, Human
gccaagaggcugc

SEQ ID NO: 2467458 - RNA, 14 nt, Human
gccaagaggcugca

SEQ ID NO: 2467459 - RNA, 12 nt, Human
gccaagaggcug

SEQ ID NO: 2467460 - RNA, 16 nt, Human
gccaagagcagaggca

SEQ ID NO: 2467461 - RNA, 20 nt, Human
gccaagagcagaggcagcga

SEQ ID NO: 2467462 - RNA, 20 nt, Human
gccaacuuguaaauacacca

SEQ ID NO: 2467463 - RNA, 18 nt, Human
gccaacuuguaaauacac

SEQ ID NO: 2467464 - RNA, 17 nt, Human
gccaacuuguaaauaca

SEQ ID NO: 2467465 - RNA, 15 nt, Human
gccaacuuguaaaua

SEQ ID NO: 2467466 - RNA, 14 nt, Human
gccaacuuguaaau

SEQ ID NO: 2467467 - RNA, 13 nt, Human
gccaacuuguaaa

SEQ ID NO: 2467468 - RNA, 14 nt, Human
gccaacuuggcuuu

SEQ ID NO: 2467469 - RNA, 23 nt, Human
gccaacuugagggcccagagcag

SEQ ID NO: 2467470 - RNA, 22 nt, Human
gccaacuugagggcccagagca

SEQ ID NO: 2467471 - RNA, 21 nt, Human
gccaacuugagggcccagagc

SEQ ID NO: 2467472 - RNA, 20 nt, Human
gccaacuugagggcccagag

SEQ ID NO: 2467473 - RNA, 15 nt, Human
gccaacuugagggcc

SEQ ID NO: 2467474 - RNA, 20 nt, Human
gccaacuucuucagagcuga

SEQ ID NO: 2467475 - RNA, 19 nt, Human
gccaacuucuucagagcug

SEQ ID NO: 2467476 - RNA, 12 nt, Human
gccaacuguugu

SEQ ID NO: 2467477 - RNA, 19 nt, Human
gccaacugcugcuuuuuga

SEQ ID NO: 2467478 - RNA, 19 nt, Human
gccaacuauggccugugga

SEQ ID NO: 2467479 - RNA, 12 nt, Human
gccaacugcugc

SEQ ID NO: 2467480 - RNA, 15 nt, Human
gccaacuauggccug

SEQ ID NO: 2467481 - RNA, 14 nt, Human
gccaacuauggccu

SEQ ID NO: 2467482 - RNA, 23 nt, Human
gccaacgacaaagccaaacucug

SEQ ID NO: 2467483 - RNA, 22 nt, Human
gccaaccuguaauaaauaugag

SEQ ID NO: 2467484 - RNA, 21 nt, Human
gccaaccuguaauaaauauga

SEQ ID NO: 2467485 - RNA, 14 nt, Human
gccaacgacaaagc

SEQ ID NO: 2467486 - RNA, 20 nt, Human
gccaaccuguaauaaauaug

SEQ ID NO: 2467487 - RNA, 18 nt, Human
gccaaccuguaauaaaua

SEQ ID NO: 2467488 - RNA, 16 nt, Human
gccaaccuguaauaaa

SEQ ID NO: 2467489 - RNA, 15 nt, Human
gccaaccccugugga

SEQ ID NO: 2467490 - RNA, 21 nt, Human
gcauuuccuaucaccuauuuc

SEQ ID NO: 2467491 - RNA, 23 nt, Human
gcauuuccaacaccacagacaca

SEQ ID NO: 2467492 - RNA, 22 nt, Human
gcauuuccaacaccacagacac

SEQ ID NO: 2467493 - RNA, 21 nt, Human
gcauuuccaacaccacagaca

SEQ ID NO: 2467494 - RNA, 22 nt, Human
gcauuucauucuucucuagcug

SEQ ID NO: 2467495 - RNA, 20 nt, Human
gcauuucauucuucucuagc

SEQ ID NO: 2467496 - RNA, 13 nt, Human
gcauuucauucuu

SEQ ID NO: 2467497 - RNA, 11 nt, Human
gcauuucauuc

SEQ ID NO: 2467498 - RNA, 18 nt, Human
gcauuuaaaacagacacu

SEQ ID NO: 2467499 - RNA, 23 nt, Human
gcauuguuugcuuauuguuccaa

SEQ ID NO: 2467500 - RNA, 16 nt, Human
gcauuuauuugugaug

SEQ ID NO: 2467501 - RNA, 17 nt, Human
gcauuuauuugugauga

SEQ ID NO: 2467502 - RNA, 19 nt, Human
gcauuuauggucaacacuu

SEQ ID NO: 2467503 - RNA, 12 nt, Human
gcauuuaaaaga

SEQ ID NO: 2467504 - RNA, 15 nt, Human
gcauuuaaaagauac

SEQ ID NO: 2467505 - RNA, 23 nt, Human
gcauuguugagguggucugaaug

SEQ ID NO: 2467506 - RNA, 16 nt, Human
gcauuguugagguggu

SEQ ID NO: 2467507 - RNA, 17 nt, Human
gcauuguuugcuuauug

SEQ ID NO: 2467508 - RNA, 18 nt, Human
gcauuguuugcuuauugu

SEQ ID NO: 2467509 - RNA, 20 nt, Human
gcauuguuugcuuauuguuc

SEQ ID NO: 2467510 - RNA, 21 nt, Human
gcauuguuugcuuauuguucc

SEQ ID NO: 2467511 - RNA, 22 nt, Human
gcauuguuugcuuauuguucca

SEQ ID NO: 2467512 - RNA, 18 nt, Human
gcauugugaacugacagg

SEQ ID NO: 2467513 - RNA, 16 nt, Human
gcauuguggcugucag

SEQ ID NO: 2467514 - RNA, 19 nt, Human
gcauuguggcugucagcag

SEQ ID NO: 2467515 - RNA, 15 nt, Human
gcauuguugaggugg

SEQ ID NO: 2467516 - RNA, 13 nt, Human
gcauuucugaagu

SEQ ID NO: 2467517 - RNA, 12 nt, Human
gcauuucugaag

SEQ ID NO: 2467518 - RNA, 13 nt, Human
gcauuucucuggg

SEQ ID NO: 2467519 - RNA, 14 nt, Human
gcauuugaaaauuu

SEQ ID NO: 2467520 - RNA, 13 nt, Human
gcauuugaaugca

SEQ ID NO: 2467521 - RNA, 12 nt, Human
gcauuugaaugc

SEQ ID NO: 2467522 - RNA, 21 nt, Human
gcauuucuugauguugcuuag

SEQ ID NO: 2467523 - RNA, 20 nt, Human
gcauuucuugauguugcuua

SEQ ID NO: 2467524 - RNA, 10 nt, Human
gcauuugaau

SEQ ID NO: 2467525 - RNA, 16 nt, Human
gcauuugaaaauuuug

SEQ ID NO: 2467526 - RNA, 16 nt, Human
gcauuugaaugcauuu

SEQ ID NO: 2467527 - RNA, 15 nt, Human
gcauuugaaugcauu

SEQ ID NO: 2467528 - RNA, 19 nt, Human
gccaacagaagcuuccauu

SEQ ID NO: 2467529 - RNA, 16 nt, Human
gccaacagguggcagg

SEQ ID NO: 2467530 - RNA, 23 nt, Human
gccaacaguguuaggccuggcac

SEQ ID NO: 2467531 - RNA, 22 nt, Human
gccaacaguguuaggccuggca

SEQ ID NO: 2467532 - RNA, 21 nt, Human
gccaacaguguuaggccuggc

SEQ ID NO: 2467533 - RNA, 20 nt, Human
gccaacaguguuaggccugg

SEQ ID NO: 2467534 - RNA, 22 nt, Human
gccaacagguggcaggaccagg

SEQ ID NO: 2467535 - RNA, 19 nt, Human
gccaacagguggcaggacc

SEQ ID NO: 2467536 - RNA, 23 nt, Human
gccaacagguggcaggaccagga

SEQ ID NO: 2467537 - RNA, 20 nt, Human
gccaacagucaaaacagaga

SEQ ID NO: 2467538 - RNA, 14 nt, Human
gccaacauggugaa

SEQ ID NO: 2467539 - RNA, 23 nt, Human
gccaacaucgugaaacccugucu

SEQ ID NO: 2467540 - RNA, 22 nt, Human
gccaacaucgugaaacccuguc

SEQ ID NO: 2467541 - RNA, 20 nt, Human
gccaacaucgugaaacccug

SEQ ID NO: 2467542 - RNA, 23 nt, Human
gccaaccauaccuuccuucccug

SEQ ID NO: 2467543 - RNA, 13 nt, Human
gccaaccauaccu

SEQ ID NO: 2467544 - RNA, 14 nt, Human
gccaaccccugugg

SEQ ID NO: 2467545 - RNA, 22 nt, Human
gccaacccuucuccucuuguaa

SEQ ID NO: 2467546 - RNA, 13 nt, Human
gccaacccuucuc

SEQ ID NO: 2467547 - RNA, 23 nt, Human
gccaacccuucuccucuuguaaa

SEQ ID NO: 2467548 - RNA, 17 nt, Human
gccaagaggcugcagcc

SEQ ID NO: 2467549 - RNA, 23 nt, Human
gccaagacuuggcaacagaagca

SEQ ID NO: 2467550 - RNA, 18 nt, Human
gccaagaucgcgccacug

SEQ ID NO: 2467551 - RNA, 22 nt, Human
gccaagcaccuagccucgcucu

SEQ ID NO: 2467552 - RNA, 18 nt, Human
gccaagcacugugcucag

SEQ ID NO: 2467553 - RNA, 15 nt, Human
gccaagcacugugcu

SEQ ID NO: 2467554 - RNA, 23 nt, Human
gccaagcacugugcucagggcua

SEQ ID NO: 2467555 - RNA, 12 nt, Human
gccaagcagcca

SEQ ID NO: 2467556 - RNA, 20 nt, Human
gccaagcaaccuggguccaa

SEQ ID NO: 2467557 - RNA, 19 nt, Human
gccaagcaaccugggucca

SEQ ID NO: 2467558 - RNA, 18 nt, Human
gccaagcaaccugggucc

SEQ ID NO: 2467559 - RNA, 13 nt, Human
gccaagcaaccug

SEQ ID NO: 2467560 - RNA, 21 nt, Human
gccaagcacagugguggcagg

SEQ ID NO: 2467561 - RNA, 16 nt, Human
gccaagcacaguggug

SEQ ID NO: 2467562 - RNA, 12 nt, Human
gccaagcacagu

SEQ ID NO: 2467563 - RNA, 20 nt, Human
gccaagcacagugccugcau

SEQ ID NO: 2467564 - RNA, 14 nt, Human
gccaaggagcugcu

SEQ ID NO: 2467565 - RNA, 15 nt, Human
gccaaggagcugcua

SEQ ID NO: 2467566 - RNA, 16 nt, Human
gccaaggagcugcuau

SEQ ID NO: 2467567 - RNA, 20 nt, Human
gccaaggagcugcuauagcc

SEQ ID NO: 2467568 - RNA, 12 nt, Human
gccaaggagcug

SEQ ID NO: 2467569 - RNA, 13 nt, Human
gccaaggagcugc

SEQ ID NO: 2467570 - RNA, 11 nt, Human
gccaaggagcu

SEQ ID NO: 2467571 - RNA, 17 nt, Human
gccaaggacugccgacc

SEQ ID NO: 2467572 - RNA, 14 nt, Human
gccaaggacugccg

SEQ ID NO: 2467573 - RNA, 20 nt, Human
gccaagcucaggaccaggca

SEQ ID NO: 2467574 - RNA, 13 nt, Human
gccaagcuagaau

SEQ ID NO: 2467575 - RNA, 22 nt, Human
gccaagcccuccccaucccaug

SEQ ID NO: 2467576 - RNA, 22 nt, Human
gccaagcauuuaauguagccau

SEQ ID NO: 2467577 - RNA, 21 nt, Human
gccaagcccuccccaucccau

SEQ ID NO: 2467578 - RNA, 14 nt, Human
gccaagcagggagg

SEQ ID NO: 2467579 - RNA, 14 nt, Human
gccaagcagccaag

SEQ ID NO: 2467580 - RNA, 16 nt, Human
gccaagcuccaagccc

SEQ ID NO: 2467581 - RNA, 23 nt, Human
gccaagcucaggaccaggcaaug

SEQ ID NO: 2467582 - RNA, 16 nt, Human
gccaagcuccuuggga

SEQ ID NO: 2467583 - RNA, 17 nt, Human
gccaagcuccuugggag

SEQ ID NO: 2467584 - RNA, 19 nt, Human
gccaagcuccuugggaggc

SEQ ID NO: 2467585 - RNA, 17 nt, Human
gccaaggccaaaggaag

SEQ ID NO: 2467586 - RNA, 19 nt, Human
gccaaggccaaaggaagca

SEQ ID NO: 2467587 - RNA, 11 nt, Human
gccaaggccaa

SEQ ID NO: 2467588 - RNA, 23 nt, Human
gccaaggaggguggaucaccuga

SEQ ID NO: 2467589 - RNA, 21 nt, Human
gccaaggagggugagugcaag

SEQ ID NO: 2467590 - RNA, 21 nt, Human
gccaaggagcugcuauagccu

SEQ ID NO: 2467591 - RNA, 23 nt, Human
gccaaggagcugcuauagccugg

SEQ ID NO: 2467592 - RNA, 20 nt, Human
gccaaggagggugagugcaa

SEQ ID NO: 2467593 - RNA, 16 nt, Human
gcacuuuguucuggcu

SEQ ID NO: 2467594 - RNA, 20 nt, Human
gcacuuugggaggcugaggc

SEQ ID NO: 2467595 - RNA, 21 nt, Human
gcacuuugggaggcugaggcg

SEQ ID NO: 2467596 - RNA, 16 nt, Human
gcacuuugggaggccu

SEQ ID NO: 2467597 - RNA, 16 nt, Human
gcacuuugggaggcug

SEQ ID NO: 2467598 - RNA, 19 nt, Human
gcacucugugcccaugggc

SEQ ID NO: 2467599 - RNA, 14 nt, Human
gcacucugugccca

SEQ ID NO: 2467600 - RNA, 13 nt, Human
gcacucugugccc

SEQ ID NO: 2467601 - RNA, 12 nt, Human
gcacucugugcc

SEQ ID NO: 2467602 - RNA, 11 nt, Human
gcacucugugc

SEQ ID NO: 2467603 - RNA, 19 nt, Human
gcacucuguuauuuagacu

SEQ ID NO: 2467604 - RNA, 21 nt, Human
gcacucugugcccaugggcac

SEQ ID NO: 2467605 - RNA, 20 nt, Human
gcacucugugcccaugggca

SEQ ID NO: 2467606 - RNA, 14 nt, Human
gcacucuguuauuu

SEQ ID NO: 2467607 - RNA, 16 nt, Human
gcacucuuaagcuucc

SEQ ID NO: 2467608 - RNA, 20 nt, Human
gcacuuucuauccucuguaa

SEQ ID NO: 2467609 - RNA, 17 nt, Human
gcacugaagugcuuagu

SEQ ID NO: 2467610 - RNA, 22 nt, Human
gcacuuucuacaaugugaacuu

SEQ ID NO: 2467611 - RNA, 16 nt, Human
gcaggcucucaggcca

SEQ ID NO: 2467612 - RNA, 15 nt, Human
gcaggcucucaggcc

SEQ ID NO: 2467613 - RNA, 14 nt, Human
gcaggcucucaggc

SEQ ID NO: 2467614 - RNA, 13 nt, Human
gcaggcucucagg

SEQ ID NO: 2467615 - RNA, 12 nt, Human
gcaggcucucag

SEQ ID NO: 2467616 - RNA, 22 nt, Human
gcaggcucgggcuccccagccc

SEQ ID NO: 2467617 - RNA, 21 nt, Human
gcagcuugaggguugggcugg

SEQ ID NO: 2467618 - RNA, 19 nt, Human
gcagcuugaggguugggcu

SEQ ID NO: 2467619 - RNA, 23 nt, Human
gcaggcuggcagcucuccaguca

SEQ ID NO: 2467620 - RNA, 22 nt, Human
gcaggcuggcagcucuccaguc

SEQ ID NO: 2467621 - RNA, 14 nt, Human
gcaggcuggccagu

SEQ ID NO: 2467622 - RNA, 12 nt, Human
gcaggcuggcca

SEQ ID NO: 2467623 - RNA, 13 nt, Human
gcaggcuggcccu

SEQ ID NO: 2467624 - RNA, 22 nt, Human
gcaggcuggccaguccaggcug

SEQ ID NO: 2467625 - RNA, 22 nt, Human
gcagggaaaggcucugaaagcc

SEQ ID NO: 2467626 - RNA, 22 nt, Human
gcagggaaacagcuaaugggac

SEQ ID NO: 2467627 - RNA, 17 nt, Human
gcaggcucucaggccag

SEQ ID NO: 2467628 - RNA, 12 nt, Human
gcagcuugcccc

SEQ ID NO: 2467629 - RNA, 15 nt, Human
gcaggcugacaucug

SEQ ID NO: 2467630 - RNA, 20 nt, Human
gcaggcuggagguaaggccu

SEQ ID NO: 2467631 - RNA, 13 nt, Human
gcagcuugccccg

SEQ ID NO: 2467632 - RNA, 16 nt, Human
gcaggcuggcaccgcc

SEQ ID NO: 2467633 - RNA, 18 nt, Human
gcaggcuggcagcucucc

SEQ ID NO: 2467634 - RNA, 17 nt, Human
gcaggcuggcagcucuc

SEQ ID NO: 2467635 - RNA, 18 nt, Human
gcaggcuggcaccgccuu

SEQ ID NO: 2467636 - RNA, 19 nt, Human
gcaggcuggcaccgccuuc

SEQ ID NO: 2467637 - RNA, 20 nt, Human
gcagcugcuuuugucuaugg

SEQ ID NO: 2467638 - RNA, 13 nt, Human
gcagcugcuuuug

SEQ ID NO: 2467639 - RNA, 23 nt, Human
gcagcugcgguccacccaggagc

SEQ ID NO: 2467640 - RNA, 22 nt, Human
gcagcugcgguccacccaggag

SEQ ID NO: 2467641 - RNA, 15 nt, Human
gcagcuucugccacu

SEQ ID NO: 2467642 - RNA, 14 nt, Human
gcagcuucugccac

SEQ ID NO: 2467643 - RNA, 12 nt, Human
gcagcuuccaga

SEQ ID NO: 2467644 - RNA, 13 nt, Human
gcagcuucaguug

SEQ ID NO: 2467645 - RNA, 14 nt, Human
gcagcuucaccaga

SEQ ID NO: 2467646 - RNA, 15 nt, Human
gcagcuuauucacaa

SEQ ID NO: 2467647 - RNA, 14 nt, Human
gcagcuucuguccu

SEQ ID NO: 2467648 - RNA, 18 nt, Human
gcagcuucugccacuucc

SEQ ID NO: 2467649 - RNA, 17 nt, Human
gcagcuucugccacuuc

SEQ ID NO: 2467650 - RNA, 20 nt, Human
gcagcuucugccacuuccca

SEQ ID NO: 2467651 - RNA, 16 nt, Human
gcagcuugaggguugg

SEQ ID NO: 2467652 - RNA, 15 nt, Human
gcagcuggacuaccc

SEQ ID NO: 2467653 - RNA, 23 nt, Human
gcagcuggaaaagggucuuggga

SEQ ID NO: 2467654 - RNA, 16 nt, Human
gcagcuggacuaccca

SEQ ID NO: 2467655 - RNA, 15 nt, Human
gcagcugggcccaac

SEQ ID NO: 2467656 - RNA, 14 nt, Human
gcagcugggcccaa

SEQ ID NO: 2467657 - RNA, 22 nt, Human
gcagcugggcccaacccugucu

SEQ ID NO: 2467658 - RNA, 21 nt, Human
gcagcugggcccaacccuguc

SEQ ID NO: 2467659 - RNA, 19 nt, Human
gcagcugggcccaacccug

SEQ ID NO: 2467660 - RNA, 16 nt, Human
gcagcugggcccaacc

SEQ ID NO: 2467661 - RNA, 23 nt, Human
gcagcugggcccaacccugucug

SEQ ID NO: 2467662 - RNA, 14 nt, Human
gcagcuguuagagu

SEQ ID NO: 2467663 - RNA, 21 nt, Human
gcagcuguuuuaguuaaauuu

SEQ ID NO: 2467664 - RNA, 16 nt, Human
gcagcuguuuaaaugu

SEQ ID NO: 2467665 - RNA, 16 nt, Human
gcagcuguugcaguga

SEQ ID NO: 2467666 - RNA, 17 nt, Human
gcagcuguuagagucca

SEQ ID NO: 2467667 - RNA, 15 nt, Human
gcauaaauaugcagu

SEQ ID NO: 2467668 - RNA, 14 nt, Human
gcauaaauaugcag

SEQ ID NO: 2467669 - RNA, 16 nt, Human
gcauaacaauuccucu

SEQ ID NO: 2467670 - RNA, 17 nt, Human
gcauaacaauuccucua

SEQ ID NO: 2467671 - RNA, 13 nt, Human
gcauacacacaca

SEQ ID NO: 2467672 - RNA, 14 nt, Human
gcauacacacacac

SEQ ID NO: 2467673 - RNA, 21 nt, Human
gcauacacacacacacacagc

SEQ ID NO: 2467674 - RNA, 22 nt, Human
gcauacacacacacacacagcc

SEQ ID NO: 2467675 - RNA, 18 nt, Human
gcauaacaagguccaaga

SEQ ID NO: 2467676 - RNA, 11 nt, Human
gcauacacaca

SEQ ID NO: 2467677 - RNA, 13 nt, Human
gcauacaaucuga

SEQ ID NO: 2467678 - RNA, 23 nt, Human
gcaguugccagucaccccggcca

SEQ ID NO: 2467679 - RNA, 14 nt, Human
gcaguugccaguca

SEQ ID NO: 2467680 - RNA, 13 nt, Human
gcauaaauaugca

SEQ ID NO: 2467681 - RNA, 14 nt, Human
gcauaaaggccuuu

SEQ ID NO: 2467682 - RNA, 15 nt, Human
gcauaaaaauuagcc

SEQ ID NO: 2467683 - RNA, 20 nt, Human
gcagguucuucuuccugaag

SEQ ID NO: 2467684 - RNA, 18 nt, Human
gcagguucccaagcucag

SEQ ID NO: 2467685 - RNA, 19 nt, Human
gcagguucccaagcucaga

SEQ ID NO: 2467686 - RNA, 15 nt, Human
gcagguucccaagcu

SEQ ID NO: 2467687 - RNA, 16 nt, Human
gcagguucccaagcuc

SEQ ID NO: 2467688 - RNA, 13 nt, Human
gcagguucccaag

SEQ ID NO: 2467689 - RNA, 22 nt, Human
gcaguugaaaagacuccaaaga

SEQ ID NO: 2467690 - RNA, 17 nt, Human
gcaguugacagcaggug

SEQ ID NO: 2467691 - RNA, 22 nt, Human
gcaguugaaugacaacagaagc

SEQ ID NO: 2467692 - RNA, 22 nt, Human
gcagguucuucuuccugaagcu

SEQ ID NO: 2467693 - RNA, 15 nt, Human
gcaguugacagcagg

SEQ ID NO: 2467694 - RNA, 16 nt, Human
gcagguuagaaccuag

SEQ ID NO: 2467695 - RNA, 20 nt, Human
gcaggugguggcacugagcc

SEQ ID NO: 2467696 - RNA, 14 nt, Human
gcaggugguggcac

SEQ ID NO: 2467697 - RNA, 21 nt, Human
gcaggugguccugagaccuga

SEQ ID NO: 2467698 - RNA, 16 nt, Human
gcaggugguccugaga

SEQ ID NO: 2467699 - RNA, 22 nt, Human
gcaggugguggcacugagcccc

SEQ ID NO: 2467700 - RNA, 21 nt, Human
gcaggugguggcacugagccc

SEQ ID NO: 2467701 - RNA, 23 nt, Human
gcaggugguggcacugagccccc

SEQ ID NO: 2467702 - RNA, 22 nt, Human
gcaggugucauauauggggggc

SEQ ID NO: 2467703 - RNA, 15 nt, Human
gcaggugguccugag

SEQ ID NO: 2467704 - RNA, 17 nt, Human
gcagguggggagggggu

SEQ ID NO: 2467705 - RNA, 20 nt, Human
gcagggaaggggaggcagcc

SEQ ID NO: 2467706 - RNA, 21 nt, Human
gcagggaaguguaagaaacac

SEQ ID NO: 2467707 - RNA, 21 nt, Human
gcagggaaggggaggcagccg

SEQ ID NO: 2467708 - RNA, 15 nt, Human
gcauaccacuuuugu

SEQ ID NO: 2467709 - RNA, 16 nt, Human
gcauaccacuuuuguu

SEQ ID NO: 2467710 - RNA, 23 nt, Human
gcauacacacacacacacagcca

SEQ ID NO: 2467711 - RNA, 17 nt, Human
gcauacauuuauaaugu

SEQ ID NO: 2467712 - RNA, 17 nt, Human
gagaagcggcuggcagc

SEQ ID NO: 2467713 - RNA, 18 nt, Human
gacuuugggauaggaaaa

SEQ ID NO: 2467714 - RNA, 16 nt, Human
gacuuuggcugcaugc

SEQ ID NO: 2467715 - RNA, 15 nt, Human
gacuuugcuucccau

SEQ ID NO: 2467716 - RNA, 13 nt, Human
gacuuugugaucc

SEQ ID NO: 2467717 - RNA, 22 nt, Human
gacuuuguaccccccaaccccu

SEQ ID NO: 2467718 - RNA, 19 nt, Human
gacuuuggcugcaugcgag

SEQ ID NO: 2467719 - RNA, 22 nt, Human
gacuuuguuaguuucuccaagc

SEQ ID NO: 2467720 - RNA, 14 nt, Human
gacuuuucugcaaa

SEQ ID NO: 2467721 - RNA, 13 nt, Human
gacuuuucugcaa

SEQ ID NO: 2467722 - RNA, 23 nt, Human
gacuuuucuguccgagcuuugaa

SEQ ID NO: 2467723 - RNA, 14 nt, Human
gacuuuguaccccc

SEQ ID NO: 2467724 - RNA, 17 nt, Human
gacuuuuccauguaucu

SEQ ID NO: 2467725 - RNA, 18 nt, Human
gacuuuuccauguaucua

SEQ ID NO: 2467726 - RNA, 19 nt, Human
gacuuuucgaccaauucaa

SEQ ID NO: 2467727 - RNA, 22 nt, Human
gacuuuucgaccaauucaaccc

SEQ ID NO: 2467728 - RNA, 21 nt, Human
gacuuuucuguccgagcuuug

SEQ ID NO: 2467729 - RNA, 16 nt, Human
gacuguuuucucuuga

SEQ ID NO: 2467730 - RNA, 18 nt, Human
gacuguuuucucuugaga

SEQ ID NO: 2467731 - RNA, 18 nt, Human
gacuguuuuuacccauau

SEQ ID NO: 2467732 - RNA, 14 nt, Human
gacuguuuuuuccu

SEQ ID NO: 2467733 - RNA, 16 nt, Human
gacuuucugccuggag

SEQ ID NO: 2467734 - RNA, 19 nt, Human
gacuguuuuuuccugagcu

SEQ ID NO: 2467735 - RNA, 20 nt, Human
gacuguuuuuuccugagcuu

SEQ ID NO: 2467736 - RNA, 17 nt, Human
gacuguuuuuacccaua

SEQ ID NO: 2467737 - RNA, 13 nt, Human
gacuguuuuuacc

SEQ ID NO: 2467738 - RNA, 21 nt, Human
gacuguuuucucucggcuccc

SEQ ID NO: 2467739 - RNA, 19 nt, Human
gacuguuuucucucggcuc

SEQ ID NO: 2467740 - RNA, 14 nt, Human
gacuuuggaaagag

SEQ ID NO: 2467741 - RNA, 14 nt, Human
gacuuuggaaagac

SEQ ID NO: 2467742 - RNA, 13 nt, Human
gacuuucuguugg

SEQ ID NO: 2467743 - RNA, 11 nt, Human
gacuuucuguu

SEQ ID NO: 2467744 - RNA, 18 nt, Human
gacuuucugccuggagug

SEQ ID NO: 2467745 - RNA, 21 nt, Human
gacuuugcagccggcacaggg

SEQ ID NO: 2467746 - RNA, 20 nt, Human
gacugugugcucaggagccc

SEQ ID NO: 2467747 - RNA, 17 nt, Human
gacugugugcucaggag

SEQ ID NO: 2467748 - RNA, 16 nt, Human
gacugugugcucagga

SEQ ID NO: 2467749 - RNA, 14 nt, Human
gacugugugcucag

SEQ ID NO: 2467750 - RNA, 15 nt, Human
gacugucauagaaau

SEQ ID NO: 2467751 - RNA, 21 nt, Human
gacugucucaagagggcacug

SEQ ID NO: 2467752 - RNA, 20 nt, Human
gacuguauuugugacuaauu

SEQ ID NO: 2467753 - RNA, 19 nt, Human
gacuguauuugugacuaau

SEQ ID NO: 2467754 - RNA, 17 nt, Human
gacuguauuugugacua

SEQ ID NO: 2467755 - RNA, 23 nt, Human
gacugucucaagagggcacuggu

SEQ ID NO: 2467756 - RNA, 22 nt, Human
gacugucucaagagggcacugg

SEQ ID NO: 2467757 - RNA, 23 nt, Human
gacuguauuugugacuaauugua

SEQ ID NO: 2467758 - RNA, 22 nt, Human
gacuguauuugugacuaauugu

SEQ ID NO: 2467759 - RNA, 18 nt, Human
gacugucuccauggcccu

SEQ ID NO: 2467760 - RNA, 22 nt, Human
gacuguguauucuaguuuuguc

SEQ ID NO: 2467761 - RNA, 14 nt, Human
gacucaaugcacug

SEQ ID NO: 2467762 - RNA, 16 nt, Human
gacucaagugucucag

SEQ ID NO: 2467763 - RNA, 15 nt, Human
gacucaauaaaauca

SEQ ID NO: 2467764 - RNA, 17 nt, Human
gacucaauaaaaucaug

SEQ ID NO: 2467765 - RNA, 17 nt, Human
gacucaaguccuuaccu

SEQ ID NO: 2467766 - RNA, 17 nt, Human
gacucaaugcacugaca

SEQ ID NO: 2467767 - RNA, 17 nt, Human
gacucacaagaagacca

SEQ ID NO: 2467768 - RNA, 15 nt, Human
gacucacaagaagac

SEQ ID NO: 2467769 - RNA, 19 nt, Human
gacucacaaccugaaccua

SEQ ID NO: 2467770 - RNA, 17 nt, Human
gacucaauuucucccca

SEQ ID NO: 2467771 - RNA, 16 nt, Human
gacucaauuucucccc

SEQ ID NO: 2467772 - RNA, 18 nt, Human
gacucacaaccugaaccu

SEQ ID NO: 2467773 - RNA, 17 nt, Human
gacuguacuccucccag

SEQ ID NO: 2467774 - RNA, 16 nt, Human
gacuguacuccuccca

SEQ ID NO: 2467775 - RNA, 22 nt, Human
gacuguacaaaguagaagucuu

SEQ ID NO: 2467776 - RNA, 22 nt, Human
gacugguguuaucaccgugggc

SEQ ID NO: 2467777 - RNA, 22 nt, Human
gacucacaagaagaccagacug

SEQ ID NO: 2467778 - RNA, 21 nt, Human
gacucacaagaagaccagacu

SEQ ID NO: 2467779 - RNA, 13 nt, Human
gacgcugugcugc

SEQ ID NO: 2467780 - RNA, 20 nt, Human
gacgcugguagagauggagg

SEQ ID NO: 2467781 - RNA, 21 nt, Human
gacgcugguagagauggagga

SEQ ID NO: 2467782 - RNA, 15 nt, Human
gacccuccccgcacc

SEQ ID NO: 2467783 - RNA, 17 nt, Human
gacccuccccgcacccc

SEQ ID NO: 2467784 - RNA, 20 nt, Human
gacccuccuguugcacccag

SEQ ID NO: 2467785 - RNA, 18 nt, Human
gacccuccuguugcaccc

SEQ ID NO: 2467786 - RNA, 15 nt, Human
gacccuccuguugca

SEQ ID NO: 2467787 - RNA, 19 nt, Human
gacccuccuccucccccag

SEQ ID NO: 2467788 - RNA, 22 nt, Human
gacccuccuccucccccagagg

SEQ ID NO: 2467789 - RNA, 11 nt, Human
gacccucucaa

SEQ ID NO: 2467790 - RNA, 15 nt, Human
gacccucguggccuu

SEQ ID NO: 2467791 - RNA, 22 nt, Human
gacccuccuguugcacccagcc

SEQ ID NO: 2467792 - RNA, 21 nt, Human
gacccuccuguugcacccagc

SEQ ID NO: 2467793 - RNA, 23 nt, Human
gacccuccuguugcacccagccc

SEQ ID NO: 2467794 - RNA, 18 nt, Human
gacccucguggccuuccc

SEQ ID NO: 2467795 - RNA, 12 nt, Human
gacgcugugcug

SEQ ID NO: 2467796 - RNA, 17 nt, Human
gacgcugaauaaauguc

SEQ ID NO: 2467797 - RNA, 16 nt, Human
gacgcugaauaaaugu

SEQ ID NO: 2467798 - RNA, 13 nt, Human
gacgcugaauaaa

SEQ ID NO: 2467799 - RNA, 18 nt, Human
gacgcugguagagaugga

SEQ ID NO: 2467800 - RNA, 18 nt, Human
gacuagugaggaaagauu

SEQ ID NO: 2467801 - RNA, 17 nt, Human
gacuauagcccaggucc

SEQ ID NO: 2467802 - RNA, 22 nt, Human
gacucaacauguuacugaccag

SEQ ID NO: 2467803 - RNA, 22 nt, Human
gacuauucaaacagucucagga

SEQ ID NO: 2467804 - RNA, 15 nt, Human
gacuauggagcugag

SEQ ID NO: 2467805 - RNA, 14 nt, Human
gacucaaaccaaau

SEQ ID NO: 2467806 - RNA, 19 nt, Human
gacucaaaucuccaguauu

SEQ ID NO: 2467807 - RNA, 18 nt, Human
gacucaaaguuucagaga

SEQ ID NO: 2467808 - RNA, 22 nt, Human
gacucaaaugcucagaccagcu

SEQ ID NO: 2467809 - RNA, 15 nt, Human
gacuauucaaacagu

SEQ ID NO: 2467810 - RNA, 16 nt, Human
gacuauucaaacaguc

SEQ ID NO: 2467811 - RNA, 19 nt, Human
gacuauauuugggccugcu

SEQ ID NO: 2467812 - RNA, 21 nt, Human
gacuauauuugggccugcucc

SEQ ID NO: 2467813 - RNA, 19 nt, Human
gacuaugcguuuuuauaaa

SEQ ID NO: 2467814 - RNA, 19 nt, Human
gacuauauagagauguuuu

SEQ ID NO: 2467815 - RNA, 16 nt, Human
gacuauauagagaugu

SEQ ID NO: 2467816 - RNA, 23 nt, Human
gacuauauagagauguuuuuaaa

SEQ ID NO: 2467817 - RNA, 20 nt, Human
gacuauauagagauguuuuu

SEQ ID NO: 2467818 - RNA, 18 nt, Human
gacuauauuguacacacc

SEQ ID NO: 2467819 - RNA, 16 nt, Human
gaagcauguuucaugu

SEQ ID NO: 2467820 - RNA, 19 nt, Human
gaagcauguuucauguuuu

SEQ ID NO: 2467821 - RNA, 14 nt, Human
gaagcauguuucau

SEQ ID NO: 2467822 - RNA, 13 nt, Human
gaagcauguuuca

SEQ ID NO: 2467823 - RNA, 12 nt, Human
gaagcauguuuc

SEQ ID NO: 2467824 - RNA, 17 nt, Human
gaagcauguaggagaau

SEQ ID NO: 2467825 - RNA, 16 nt, Human
gaagcaugaaaaagca

SEQ ID NO: 2467826 - RNA, 16 nt, Human
gaagcauguaggagaa

SEQ ID NO: 2467827 - RNA, 17 nt, Human
gaagcagugccuuccau

SEQ ID NO: 2467828 - RNA, 18 nt, Human
gaagcagugccuuccaua

SEQ ID NO: 2467829 - RNA, 19 nt, Human
gaagcagugccuuccauaa

SEQ ID NO: 2467830 - RNA, 16 nt, Human
gaagcagugagccgca

SEQ ID NO: 2467831 - RNA, 14 nt, Human
gaagcaguuguguc

SEQ ID NO: 2467832 - RNA, 13 nt, Human
gaagcaguugugu

SEQ ID NO: 2467833 - RNA, 22 nt, Human
gaagcaucuuccagaaguguga

SEQ ID NO: 2467834 - RNA, 16 nt, Human
gaagcaguugugucag

SEQ ID NO: 2467835 - RNA, 13 nt, Human
gaagcaugaaaaa

SEQ ID NO: 2467836 - RNA, 15 nt, Human
gacacucagaccuga

SEQ ID NO: 2467837 - RNA, 13 nt, Human
gacacucagaccu

SEQ ID NO: 2467838 - RNA, 22 nt, Human
gacacuccuagagaacgcagcc

SEQ ID NO: 2467839 - RNA, 21 nt, Human
gacacuccuagagaacgcagc

SEQ ID NO: 2467840 - RNA, 14 nt, Human
gacacuccuagaga

SEQ ID NO: 2467841 - RNA, 16 nt, Human
gacacuccagugccag

SEQ ID NO: 2467842 - RNA, 15 nt, Human
gacacucccuugggc

SEQ ID NO: 2467843 - RNA, 21 nt, Human
gacacucccuugggcucccug

SEQ ID NO: 2467844 - RNA, 19 nt, Human
gacacuccagugccagcaa

SEQ ID NO: 2467845 - RNA, 14 nt, Human
gacacuccagugcc

SEQ ID NO: 2467846 - RNA, 12 nt, Human
gacacuccagug

SEQ ID NO: 2467847 - RNA, 16 nt, Human
gacacuccccgaaguc

SEQ ID NO: 2467848 - RNA, 21 nt, Human
gacacuccccgaagucuuuug

SEQ ID NO: 2467849 - RNA, 14 nt, Human
gacagaaagcagaa

SEQ ID NO: 2467850 - RNA, 21 nt, Human
gacacuuuucaugugugauuu

SEQ ID NO: 2467851 - RNA, 12 nt, Human
gacacucugcuc

SEQ ID NO: 2467852 - RNA, 19 nt, Human
gacacuuuuuugaguggau

SEQ ID NO: 2467853 - RNA, 20 nt, Human
gacagaaagcagaacaguga

SEQ ID NO: 2467854 - RNA, 16 nt, Human
gacagaaaacauguuu

SEQ ID NO: 2467855 - RNA, 13 nt, Human
gacagcccuccau

SEQ ID NO: 2467856 - RNA, 21 nt, Human
gacagcccuucuuuccacaga

SEQ ID NO: 2467857 - RNA, 16 nt, Human
gacagccucccacccc

SEQ ID NO: 2467858 - RNA, 12 nt, Human
gacagaaagcag

SEQ ID NO: 2467859 - RNA, 11 nt, Human
gacagccuccc

SEQ ID NO: 2467860 - RNA, 15 nt, Human
gacagcuccuucugu

SEQ ID NO: 2467861 - RNA, 14 nt, Human
gacagcuccuucug

SEQ ID NO: 2467862 - RNA, 12 nt, Human
gacagccuggca

SEQ ID NO: 2467863 - RNA, 11 nt, Human
gacagccuggc

SEQ ID NO: 2467864 - RNA, 13 nt, Human
gacagcuccuucu

SEQ ID NO: 2467865 - RNA, 18 nt, Human
gacaggggcaggaggaag

SEQ ID NO: 2467866 - RNA, 21 nt, Human
gacagggcuggcccagcccug

SEQ ID NO: 2467867 - RNA, 20 nt, Human
gacagggcuggcccagcccu

SEQ ID NO: 2467868 - RNA, 22 nt, Human
gacagggcuggcccagcccugc

SEQ ID NO: 2467869 - RNA, 20 nt, Human
gacaggggcaggaggaaggg

SEQ ID NO: 2467870 - RNA, 19 nt, Human
gacagggcuggcccagccc

SEQ ID NO: 2467871 - RNA, 18 nt, Human
gacagggcuggcccagcc

SEQ ID NO: 2467872 - RNA, 17 nt, Human
gacagggcuggcccagc

SEQ ID NO: 2467873 - RNA, 15 nt, Human
gacagggcuggccca

SEQ ID NO: 2467874 - RNA, 12 nt, Human
gacagggcuggc

SEQ ID NO: 2467875 - RNA, 14 nt, Human
gacagggcuggccc

SEQ ID NO: 2467876 - RNA, 22 nt, Human
gacagguuugggaccccuggug

SEQ ID NO: 2467877 - RNA, 17 nt, Human
gacaguaucacugucuu

SEQ ID NO: 2467878 - RNA, 21 nt, Human
gacaguaucacugucuuuccu

SEQ ID NO: 2467879 - RNA, 15 nt, Human
gacaguauacagucc

SEQ ID NO: 2467880 - RNA, 19 nt, Human
gacagguuugggaccccug

SEQ ID NO: 2467881 - RNA, 20 nt, Human
gacaggguuuggcugugucu

SEQ ID NO: 2467882 - RNA, 17 nt, Human
gacaggguuucaccaug

SEQ ID NO: 2467883 - RNA, 20 nt, Human
gacaguauggcagcuuuccu

SEQ ID NO: 2467884 - RNA, 21 nt, Human
gacaguaugagucaaugugca

SEQ ID NO: 2467885 - RNA, 22 nt, Human
gacaguaugagucaaugugcag

SEQ ID NO: 2467886 - RNA, 22 nt, Human
gaccagcuuuucccaaaagccc

SEQ ID NO: 2467887 - RNA, 16 nt, Human
gaccaggacaggacca

SEQ ID NO: 2467888 - RNA, 22 nt, Human
gaccaggacuauagcccagguc

SEQ ID NO: 2467889 - RNA, 14 nt, Human
gaccaggacuauag

SEQ ID NO: 2467890 - RNA, 14 nt, Human
gaccaggacucccu

SEQ ID NO: 2467891 - RNA, 16 nt, Human
gaccaggacucccucc

SEQ ID NO: 2467892 - RNA, 17 nt, Human
gaccaggacucccuccu

SEQ ID NO: 2467893 - RNA, 19 nt, Human
gaccaggacucccuccuca

SEQ ID NO: 2467894 - RNA, 21 nt, Human
gaccaggacucccuccucacc

SEQ ID NO: 2467895 - RNA, 23 nt, Human
gaccaggagggcacuggagcugu

SEQ ID NO: 2467896 - RNA, 16 nt, Human
gaccaggagggcacug

SEQ ID NO: 2467897 - RNA, 23 nt, Human
gaccaggacucccuccucaccuc

SEQ ID NO: 2467898 - RNA, 13 nt, Human
gaccaggccuggg

SEQ ID NO: 2467899 - RNA, 23 nt, Human
gaccaggcauccuccacaauagc

SEQ ID NO: 2467900 - RNA, 15 nt, Human
gaccaguaauuguga

SEQ ID NO: 2467901 - RNA, 21 nt, Human
gaccagguuauuuuaaaaaga

SEQ ID NO: 2467902 - RNA, 17 nt, Human
gaccagucaaccugggc

SEQ ID NO: 2467903 - RNA, 15 nt, Human
gaccagucugacccu

SEQ ID NO: 2467904 - RNA, 18 nt, Human
gaccagucaaccugggca

SEQ ID NO: 2467905 - RNA, 22 nt, Human
gaccaggggugauuucagagag

SEQ ID NO: 2467906 - RNA, 23 nt, Human
gaccaggucuuggagcugagccu

SEQ ID NO: 2467907 - RNA, 22 nt, Human
gaccaggucuuggagcugagcc

SEQ ID NO: 2467908 - RNA, 23 nt, Human
gaccaggggugauuucagagagg

SEQ ID NO: 2467909 - RNA, 15 nt, Human
gaccaucccugaagg

SEQ ID NO: 2467910 - RNA, 14 nt, Human
gaccaucccugaag

SEQ ID NO: 2467911 - RNA, 16 nt, Human
gaccauaacagccaac

SEQ ID NO: 2467912 - RNA, 19 nt, Human
gaccaguuuaaccugaugc

SEQ ID NO: 2467913 - RNA, 20 nt, Human
gaccaguugggagcacugga

SEQ ID NO: 2467914 - RNA, 17 nt, Human
gaccaguugggagcacu

SEQ ID NO: 2467915 - RNA, 15 nt, Human
gaccaguugggagca

SEQ ID NO: 2467916 - RNA, 14 nt, Human
gaccaguugggagc

SEQ ID NO: 2467917 - RNA, 14 nt, Human
gaccaguggucuca

SEQ ID NO: 2467918 - RNA, 15 nt, Human
gaccaguugcacuug

SEQ ID NO: 2467919 - RNA, 17 nt, Human
gaccaucccugaaggcc

SEQ ID NO: 2467920 - RNA, 16 nt, Human
gaccaucccugaaggc

SEQ ID NO: 2467921 - RNA, 22 nt, Human
gaccaugcucaucugcuggucc

SEQ ID NO: 2467922 - RNA, 21 nt, Human
gaccaugcucaucugcugguc

SEQ ID NO: 2467923 - RNA, 19 nt, Human
gaccauaacagccaacagg

SEQ ID NO: 2467924 - RNA, 16 nt, Human
gaccauucuccaccug

SEQ ID NO: 2467925 - RNA, 23 nt, Human
gaccccugcucaguaaagcacuu

SEQ ID NO: 2467926 - RNA, 16 nt, Human
gaccccuggccuccgg

SEQ ID NO: 2467927 - RNA, 15 nt, Human
gaccccuggccuccg

SEQ ID NO: 2467928 - RNA, 14 nt, Human
gaccccuggccucc

SEQ ID NO: 2467929 - RNA, 13 nt, Human
gaccccuggccuc

SEQ ID NO: 2467930 - RNA, 13 nt, Human
gaccccuggcuuu

SEQ ID NO: 2467931 - RNA, 22 nt, Human
gaccccuggcuuuucacugcug

SEQ ID NO: 2467932 - RNA, 21 nt, Human
gaccccuggcuuuucacugcu

SEQ ID NO: 2467933 - RNA, 14 nt, Human
gacccgcucuggac

SEQ ID NO: 2467934 - RNA, 13 nt, Human
gacccgcucugga

SEQ ID NO: 2467935 - RNA, 20 nt, Human
gaccccuuuucagcuucugc

SEQ ID NO: 2467936 - RNA, 17 nt, Human
gaccccuuuucagcuuc

SEQ ID NO: 2467937 - RNA, 18 nt, Human
gaccccuuuucagcuucu

SEQ ID NO: 2467938 - RNA, 13 nt, Human
gacccggcugcgu

SEQ ID NO: 2467939 - RNA, 12 nt, Human
gacccggcugcg

SEQ ID NO: 2467940 - RNA, 16 nt, Human
gacccuauugcugcuu

SEQ ID NO: 2467941 - RNA, 16 nt, Human
gacccuaccccaccac

SEQ ID NO: 2467942 - RNA, 14 nt, Human
gacccuacaggaga

SEQ ID NO: 2467943 - RNA, 15 nt, Human
gacccuacaggagag

SEQ ID NO: 2467944 - RNA, 11 nt, Human
gacccuacccc

SEQ ID NO: 2467945 - RNA, 14 nt, Human
gacccuaccccacc

SEQ ID NO: 2467946 - RNA, 14 nt, Human
gacccguccauuug

SEQ ID NO: 2467947 - RNA, 16 nt, Human
gacccgcucuggacca

SEQ ID NO: 2467948 - RNA, 21 nt, Human
gacccggagcuaacacuggcc

SEQ ID NO: 2467949 - RNA, 18 nt, Human
gacccuaagaccggcggc

SEQ ID NO: 2467950 - RNA, 16 nt, Human
gacccuaaaucuugac

SEQ ID NO: 2467951 - RNA, 22 nt, Human
gacccguucaacuuuuccuuug

SEQ ID NO: 2467952 - RNA, 11 nt, Human
gagaagcugcu

SEQ ID NO: 2467953 - RNA, 20 nt, Human
gagaagcuaaaaccugagcu

SEQ ID NO: 2467954 - RNA, 17 nt, Human
gagaagcucccaggaac

SEQ ID NO: 2467955 - RNA, 19 nt, Human
gagaagcuccucuccccag

SEQ ID NO: 2467956 - RNA, 19 nt, Human
gagaagcuaaaaccugagc

SEQ ID NO: 2467957 - RNA, 23 nt, Human
gagaagcugaugcuuugcuucaa

SEQ ID NO: 2467958 - RNA, 22 nt, Human
gagaagcuccucuccccagccc

SEQ ID NO: 2467959 - RNA, 23 nt, Human
gagcaguggcugguccagggcua

SEQ ID NO: 2467960 - RNA, 14 nt, Human
gagcaguggcuggu

SEQ ID NO: 2467961 - RNA, 17 nt, Human
gagcagugcaggcacag

SEQ ID NO: 2467962 - RNA, 16 nt, Human
gagcagugcaggcaca

SEQ ID NO: 2467963 - RNA, 15 nt, Human
gagcagugcaggcac

SEQ ID NO: 2467964 - RNA, 14 nt, Human
gagcagugcaggca

SEQ ID NO: 2467965 - RNA, 21 nt, Human
gagcagugaaugauucagugu

SEQ ID NO: 2467966 - RNA, 22 nt, Human
gagcaucaggccaggcccucug

SEQ ID NO: 2467967 - RNA, 20 nt, Human
gagcaucaggccaggcccuc

SEQ ID NO: 2467968 - RNA, 15 nt, Human
gagcagugggccugg

SEQ ID NO: 2467969 - RNA, 17 nt, Human
gagcagugggccuggcc

SEQ ID NO: 2467970 - RNA, 18 nt, Human
gagcagugggccuggcca

SEQ ID NO: 2467971 - RNA, 11 nt, Human
gagcagugucu

SEQ ID NO: 2467972 - RNA, 12 nt, Human
gagcagugucuu

SEQ ID NO: 2467973 - RNA, 20 nt, Human
gagcuguggacuuuguucac

SEQ ID NO: 2467974 - RNA, 18 nt, Human
gagcugugcaggugggga

SEQ ID NO: 2467975 - RNA, 17 nt, Human
gagcuguucacagccag

SEQ ID NO: 2467976 - RNA, 19 nt, Human
gagcugccuguucagcucc

SEQ ID NO: 2467977 - RNA, 16 nt, Human
gagcugccuguucagc

SEQ ID NO: 2467978 - RNA, 15 nt, Human
gagcugccuguucag

SEQ ID NO: 2467979 - RNA, 17 nt, Human
gagcggagaaaggaagg

SEQ ID NO: 2467980 - RNA, 18 nt, Human
gagcgcuuucuggaaaag

SEQ ID NO: 2467981 - RNA, 13 nt, Human
gagcggaaagcag

SEQ ID NO: 2467982 - RNA, 14 nt, Human
gagcggaaagcagc

SEQ ID NO: 2467983 - RNA, 15 nt, Human
gagcggaaagcagcu

SEQ ID NO: 2467984 - RNA, 16 nt, Human
gagcggaaagcagcuc

SEQ ID NO: 2467985 - RNA, 17 nt, Human
gagcggaaagcagcuca

SEQ ID NO: 2467986 - RNA, 18 nt, Human
gagcuggugcauuacaga

SEQ ID NO: 2467987 - RNA, 17 nt, Human
gagcuggugcauuacag

SEQ ID NO: 2467988 - RNA, 15 nt, Human
gagcuggugcccgga

SEQ ID NO: 2467989 - RNA, 16 nt, Human
gagcuggugcccggag

SEQ ID NO: 2467990 - RNA, 17 nt, Human
gagcuggugcccggaga

SEQ ID NO: 2467991 - RNA, 21 nt, Human
gagcuggugcccggagauugg

SEQ ID NO: 2467992 - RNA, 20 nt, Human
gagcugugcaucagcuagaa

SEQ ID NO: 2467993 - RNA, 18 nt, Human
gagcugguugggaagaca

SEQ ID NO: 2467994 - RNA, 18 nt, Human
gagcuguauuaagccacu

SEQ ID NO: 2467995 - RNA, 14 nt, Human
gagcuggugucuga

SEQ ID NO: 2467996 - RNA, 17 nt, Human
gagccuguguaacagcu

SEQ ID NO: 2467997 - RNA, 16 nt, Human
gagccuguguaacagc

SEQ ID NO: 2467998 - RNA, 15 nt, Human
gagccuguguaacag

SEQ ID NO: 2467999 - RNA, 14 nt, Human
gagccuguguaaca

SEQ ID NO: 2468000 - RNA, 13 nt, Human
gagccuguguaac

SEQ ID NO: 2468001 - RNA, 21 nt, Human
gagcccucaaagugaggggaa

SEQ ID NO: 2468002 - RNA, 19 nt, Human
gagccugugccuccucacc

SEQ ID NO: 2468003 - RNA, 21 nt, Human
gagccuguguaacagcuccuu

SEQ ID NO: 2468004 - RNA, 20 nt, Human
gagccuguguaacagcuccu

SEQ ID NO: 2468005 - RNA, 19 nt, Human
gagccuguguaacagcucc

SEQ ID NO: 2468006 - RNA, 18 nt, Human
gagccuguguaacagcuc

SEQ ID NO: 2468007 - RNA, 22 nt, Human
gagccuguguaacagcuccuug

SEQ ID NO: 2468008 - RNA, 20 nt, Human
gagcccgggcugccugggcu

SEQ ID NO: 2468009 - RNA, 22 nt, Human
gagcccgggcugccugggcugu

SEQ ID NO: 2468010 - RNA, 19 nt, Human
gagcccgggcugccugggc

SEQ ID NO: 2468011 - RNA, 18 nt, Human
gagcccgggcugccuggg

SEQ ID NO: 2468012 - RNA, 13 nt, Human
gagcccucagaac

SEQ ID NO: 2468013 - RNA, 15 nt, Human
gagcccucaaaguga

SEQ ID NO: 2468014 - RNA, 22 nt, Human
gagccccuucugcucagcucug

SEQ ID NO: 2468015 - RNA, 17 nt, Human
gagcaucaggccaggcc

SEQ ID NO: 2468016 - RNA, 17 nt, Human
gagcccgcacccccacc

SEQ ID NO: 2468017 - RNA, 19 nt, Human
gagcccgcacccccacccu

SEQ ID NO: 2468018 - RNA, 20 nt, Human
gagcccgcacccccacccuu

SEQ ID NO: 2468019 - RNA, 23 nt, Human
gagcccgcacccccacccuuugg

SEQ ID NO: 2468020 - RNA, 17 nt, Human
gagcccgggcugccugg

SEQ ID NO: 2468021 - RNA, 15 nt, Human
gagcccgggcugccu

SEQ ID NO: 2468022 - RNA, 14 nt, Human
gagcccgggcugcc

SEQ ID NO: 2468023 - RNA, 22 nt, Human
gagcccgggagcugcugcccug

SEQ ID NO: 2468024 - RNA, 14 nt, Human
gagcccgggagcug

SEQ ID NO: 2468025 - RNA, 17 nt, Human
gagcccggcgccccugc

SEQ ID NO: 2468026 - RNA, 17 nt, Human
gagcccggaugcuucuc

SEQ ID NO: 2468027 - RNA, 13 nt, Human
gagcgacagugag

SEQ ID NO: 2468028 - RNA, 15 nt, Human
gagcgacagugagac

SEQ ID NO: 2468029 - RNA, 13 nt, Human
gagccuuccaggg

SEQ ID NO: 2468030 - RNA, 12 nt, Human
gagccuuccagg

SEQ ID NO: 2468031 - RNA, 23 nt, Human
gagcgcuccugccgcagagcugg

SEQ ID NO: 2468032 - RNA, 22 nt, Human
gagcgcuccugccgcagagcug

SEQ ID NO: 2468033 - RNA, 21 nt, Human
gagcgcuccugccgcagagcu

SEQ ID NO: 2468034 - RNA, 15 nt, Human
gagcgcuccugccgc

SEQ ID NO: 2468035 - RNA, 20 nt, Human
gagcgccugccccucccaga

SEQ ID NO: 2468036 - RNA, 15 nt, Human
gagcgcuacccacuu

SEQ ID NO: 2468037 - RNA, 16 nt, Human
gagcgccugccccucc

SEQ ID NO: 2468038 - RNA, 18 nt, Human
gagcgccugccccuccca

SEQ ID NO: 2468039 - RNA, 22 nt, Human
gagcgccugccccucccagaac

SEQ ID NO: 2468040 - RNA, 21 nt, Human
gagcgaggagaugcuccuugg

SEQ ID NO: 2468041 - RNA, 13 nt, Human
gagcgccugcccc

SEQ ID NO: 2468042 - RNA, 15 nt, Human
gagcgccugccccuc

SEQ ID NO: 2468043 - RNA, 18 nt, Human
gagcgaggagaugcuccu

SEQ ID NO: 2468044 - RNA, 16 nt, Human
gagcgagcgcuaccca

SEQ ID NO: 2468045 - RNA, 21 nt, Human
gagcgagacuugguuucaaaa

SEQ ID NO: 2468046 - RNA, 18 nt, Human
gagucagaaguuucugcc

SEQ ID NO: 2468047 - RNA, 14 nt, Human
gagucauauuuuga

SEQ ID NO: 2468048 - RNA, 20 nt, Human
gagucauaaaccuuaaguaa

SEQ ID NO: 2468049 - RNA, 16 nt, Human
gagucauaaaccuuaa

SEQ ID NO: 2468050 - RNA, 18 nt, Human
gagucagugccagguccu

SEQ ID NO: 2468051 - RNA, 15 nt, Human
gagucacugccucuc

SEQ ID NO: 2468052 - RNA, 21 nt, Human
gagucacugccucucccuggc

SEQ ID NO: 2468053 - RNA, 15 nt, Human
gagucagugccaggu

SEQ ID NO: 2468054 - RNA, 23 nt, Human
gagucacugccucucccuggccc

SEQ ID NO: 2468055 - RNA, 12 nt, Human
gagucaugccaa

SEQ ID NO: 2468056 - RNA, 19 nt, Human
gagucaugaucucccugcc

SEQ ID NO: 2468057 - RNA, 20 nt, Human
gagucaugaucucccugccg

SEQ ID NO: 2468058 - RNA, 18 nt, Human
gagucauucguucugugg

SEQ ID NO: 2468059 - RNA, 16 nt, Human
gagucaugaucucccu

SEQ ID NO: 2468060 - RNA, 13 nt, Human
gagucaucuccau

SEQ ID NO: 2468061 - RNA, 18 nt, Human
gagucaugaucucccugc

SEQ ID NO: 2468062 - RNA, 18 nt, Human
gagugagacucugucuca

SEQ ID NO: 2468063 - RNA, 14 nt, Human
gagugagacucugu

SEQ ID NO: 2468064 - RNA, 22 nt, Human
gagugagacccagcccucaucc

SEQ ID NO: 2468065 - RNA, 23 nt, Human
gagugagacccagcccucauccc

SEQ ID NO: 2468066 - RNA, 14 nt, Human
gaguccaagcuggg

SEQ ID NO: 2468067 - RNA, 12 nt, Human
gaguccaagcug

SEQ ID NO: 2468068 - RNA, 22 nt, Human
gaguccaacguggggcagcaca

SEQ ID NO: 2468069 - RNA, 20 nt, Human
gaguccaacguggggcagca

SEQ ID NO: 2468070 - RNA, 13 nt, Human
gagugagacccug

SEQ ID NO: 2468071 - RNA, 19 nt, Human
gagugccaggacuccccag

SEQ ID NO: 2468072 - RNA, 14 nt, Human
gagugccaggacuc

SEQ ID NO: 2468073 - RNA, 13 nt, Human
gagugccaggacu

SEQ ID NO: 2468074 - RNA, 12 nt, Human
gagugccaggac

SEQ ID NO: 2468075 - RNA, 22 nt, Human
gagugccaggacuccccaggcc

SEQ ID NO: 2468076 - RNA, 20 nt, Human
gagugccaggacuccccagg

SEQ ID NO: 2468077 - RNA, 14 nt, Human
gagugcccagaacu

SEQ ID NO: 2468078 - RNA, 18 nt, Human
gagugcagugagccgaga

SEQ ID NO: 2468079 - RNA, 13 nt, Human
gagugcagugagc

SEQ ID NO: 2468080 - RNA, 21 nt, Human
gaguugauagcacagacccug

SEQ ID NO: 2468081 - RNA, 22 nt, Human
gaguugauacuacaguuuguua

SEQ ID NO: 2468082 - RNA, 19 nt, Human
gaguugauacuacaguuug

SEQ ID NO: 2468083 - RNA, 14 nt, Human
gagugccuggccaa

SEQ ID NO: 2468084 - RNA, 23 nt, Human
gagugccccauucuuuuguaauu

SEQ ID NO: 2468085 - RNA, 21 nt, Human
gagucacuggaacacuaauga

SEQ ID NO: 2468086 - RNA, 14 nt, Human
gagucacuggaaca

SEQ ID NO: 2468087 - RNA, 17 nt, Human
gaggugggauccuccag

SEQ ID NO: 2468088 - RNA, 12 nt, Human
gagucacugccu

SEQ ID NO: 2468089 - RNA, 14 nt, Human
gagguggcuggguu

SEQ ID NO: 2468090 - RNA, 13 nt, Human
gaggugggagcag

SEQ ID NO: 2468091 - RNA, 16 nt, Human
gaggugggauccucca

SEQ ID NO: 2468092 - RNA, 15 nt, Human
gaggugggauccucc

SEQ ID NO: 2468093 - RNA, 13 nt, Human
gaggugggauccu

SEQ ID NO: 2468094 - RNA, 22 nt, Human
gagguggccagagcugggaggc

SEQ ID NO: 2468095 - RNA, 21 nt, Human
gagguggccagagcugggagg

SEQ ID NO: 2468096 - RNA, 19 nt, Human
gagguggccagagcuggga

SEQ ID NO: 2468097 - RNA, 17 nt, Human
gagguggccagagcugg

SEQ ID NO: 2468098 - RNA, 23 nt, Human
gagguggccagagcugggaggca

SEQ ID NO: 2468099 - RNA, 20 nt, Human
gagguggcugagccccuguc

SEQ ID NO: 2468100 - RNA, 20 nt, Human
gagguggaucacagaggcuu

SEQ ID NO: 2468101 - RNA, 15 nt, Human
gagguggcagcccug

SEQ ID NO: 2468102 - RNA, 16 nt, Human
gagguggcagcccugu

SEQ ID NO: 2468103 - RNA, 18 nt, Human
gagguggcagcccuguag

SEQ ID NO: 2468104 - RNA, 21 nt, Human
gagguggagcaaagugagggc

SEQ ID NO: 2468105 - RNA, 19 nt, Human
gagguggaggcugcaguga

SEQ ID NO: 2468106 - RNA, 20 nt, Human
gagguggagguugcagugag

SEQ ID NO: 2468107 - RNA, 19 nt, Human
gagguggagguugcaguga

SEQ ID NO: 2468108 - RNA, 18 nt, Human
gagguggaauuauuuuaa

SEQ ID NO: 2468109 - RNA, 13 nt, Human
gaggggacagguc

SEQ ID NO: 2468110 - RNA, 19 nt, Human
gaggggacaaaacccaccu

SEQ ID NO: 2468111 - RNA, 18 nt, Human
gaggggaauaauagaaga

SEQ ID NO: 2468112 - RNA, 19 nt, Human
gaggggaauaauagaagaa

SEQ ID NO: 2468113 - RNA, 23 nt, Human
gaggcugcccccggcccccuggu

SEQ ID NO: 2468114 - RNA, 22 nt, Human
gaggcugcccccggcccccugg

SEQ ID NO: 2468115 - RNA, 21 nt, Human
gaggcugcccccggcccccug

SEQ ID NO: 2468116 - RNA, 20 nt, Human
gaggcugcccccggcccccu

SEQ ID NO: 2468117 - RNA, 19 nt, Human
gaggcugcccccggccccc

SEQ ID NO: 2468118 - RNA, 22 nt, Human
gaggcuccugugcuacuuugcc

SEQ ID NO: 2468119 - RNA, 19 nt, Human
gaggcugcagccaggccac

SEQ ID NO: 2468120 - RNA, 17 nt, Human
gaggcugcccccggccc

SEQ ID NO: 2468121 - RNA, 12 nt, Human
gaggcugccccc

SEQ ID NO: 2468122 - RNA, 9 nt, Human
gaggcugcc

SEQ ID NO: 2468123 - RNA, 23 nt, Human
gaggcugccccaccccuccccau

SEQ ID NO: 2468124 - RNA, 16 nt, Human
gaggcugcagcgagcu

SEQ ID NO: 2468125 - RNA, 14 nt, Human
gaggcugcagucag

SEQ ID NO: 2468126 - RNA, 13 nt, Human
gagggcggcaggg

SEQ ID NO: 2468127 - RNA, 23 nt, Human
gagggcgaccccgucacagccuc

SEQ ID NO: 2468128 - RNA, 19 nt, Human
gagggccugugggagccug

SEQ ID NO: 2468129 - RNA, 14 nt, Human
gaggcugccucucc

SEQ ID NO: 2468130 - RNA, 18 nt, Human
gagggcuagaacuggaga

SEQ ID NO: 2468131 - RNA, 20 nt, Human
gagggcuagaaccuggcagg

SEQ ID NO: 2468132 - RNA, 21 nt, Human
gagggcuagaaccuggagagc

SEQ ID NO: 2468133 - RNA, 19 nt, Human
gagggcuagaaccuggaga

SEQ ID NO: 2468134 - RNA, 18 nt, Human
gagggcuagaaccuggag

SEQ ID NO: 2468135 - RNA, 20 nt, Human
gagggcuagaaccuggaagg

SEQ ID NO: 2468136 - RNA, 16 nt, Human
gagggcuagaaccugg

SEQ ID NO: 2468137 - RNA, 14 nt, Human
gagggcgugggagc

SEQ ID NO: 2468138 - RNA, 23 nt, Human
gagggcggcaggggccuggagau

SEQ ID NO: 2468139 - RNA, 19 nt, Human
gagggcggcaggggccugg

SEQ ID NO: 2468140 - RNA, 17 nt, Human
gagggcuagaaccuaga

SEQ ID NO: 2468141 - RNA, 14 nt, Human
gagggcguggaggg

SEQ ID NO: 2468142 - RNA, 20 nt, Human
gagggcgugacucacccaag

SEQ ID NO: 2468143 - RNA, 15 nt, Human
gagggcuccagacac

SEQ ID NO: 2468144 - RNA, 14 nt, Human
gagggcuccagaca

SEQ ID NO: 2468145 - RNA, 13 nt, Human
gagggcuccagac

SEQ ID NO: 2468146 - RNA, 12 nt, Human
gagggcuccaga

SEQ ID NO: 2468147 - RNA, 22 nt, Human
gagggcuuccucuagaagccaa

SEQ ID NO: 2468148 - RNA, 19 nt, Human
gagggcuuccucuagaagc

SEQ ID NO: 2468149 - RNA, 20 nt, Human
gagggcuagaaucuggagag

SEQ ID NO: 2468150 - RNA, 19 nt, Human
gagggcuagaaucuggaga

SEQ ID NO: 2468151 - RNA, 18 nt, Human
gagggcuagaaucuggag

SEQ ID NO: 2468152 - RNA, 19 nt, Human
gagggcuagaacuggagag

SEQ ID NO: 2468153 - RNA, 21 nt, Human
gagggcuagaaucuggagagc

SEQ ID NO: 2468154 - RNA, 19 nt, Human
gaggggaagaguguacugg

SEQ ID NO: 2468155 - RNA, 21 nt, Human
gagggcuuccucuagaagcca

SEQ ID NO: 2468156 - RNA, 15 nt, Human
gaggggaagggccag

SEQ ID NO: 2468157 - RNA, 14 nt, Human
gaggggaagggcca

SEQ ID NO: 2468158 - RNA, 12 nt, Human
gaggggaacaga

SEQ ID NO: 2468159 - RNA, 17 nt, Human
gaggcucugcccuuggu

SEQ ID NO: 2468160 - RNA, 15 nt, Human
gaggcucugcccuug

SEQ ID NO: 2468161 - RNA, 19 nt, Human
gaggcucuggagcccacug

SEQ ID NO: 2468162 - RNA, 14 nt, Human
gaggcucuggagcc

SEQ ID NO: 2468163 - RNA, 14 nt, Human
gaggcucugcccuu

SEQ ID NO: 2468164 - RNA, 13 nt, Human
gaggcucugcccu

SEQ ID NO: 2468165 - RNA, 12 nt, Human
gaggcucugccc

SEQ ID NO: 2468166 - RNA, 14 nt, Human
gaggcuccagaggg

SEQ ID NO: 2468167 - RNA, 17 nt, Human
gaggcuccagagggcac

SEQ ID NO: 2468168 - RNA, 20 nt, Human
gaggccagagacacaagccu

SEQ ID NO: 2468169 - RNA, 21 nt, Human
gaggccagaggcccccagccc

SEQ ID NO: 2468170 - RNA, 13 nt, Human
gaggccagcccca

SEQ ID NO: 2468171 - RNA, 14 nt, Human
gaggccagccccac

SEQ ID NO: 2468172 - RNA, 12 nt, Human
gaggccagccug

SEQ ID NO: 2468173 - RNA, 22 nt, Human
gaggccagccccacccaggagg

SEQ ID NO: 2468174 - RNA, 13 nt, Human
gaggccagccugg

SEQ ID NO: 2468175 - RNA, 14 nt, Human
gaggccagccuggc

SEQ ID NO: 2468176 - RNA, 16 nt, Human
gaggccagccccaccc

SEQ ID NO: 2468177 - RNA, 18 nt, Human
gaggccagccccacccag

SEQ ID NO: 2468178 - RNA, 20 nt, Human
gaggccagccccacccagga

SEQ ID NO: 2468179 - RNA, 21 nt, Human
gaggccagccccacccaggag

SEQ ID NO: 2468180 - RNA, 23 nt, Human
ggcccuucucuccagccccugga

SEQ ID NO: 2468181 - RNA, 22 nt, Human
ggcccuucucuccagccccugg

SEQ ID NO: 2468182 - RNA, 18 nt, Human
ggcccuuuccucaggcaa

SEQ ID NO: 2468183 - RNA, 16 nt, Human
ggcccuuuccucaggc

SEQ ID NO: 2468184 - RNA, 13 nt, Human
ggcccucuacccc

SEQ ID NO: 2468185 - RNA, 21 nt, Human
ggcccuugcaguucagcacca

SEQ ID NO: 2468186 - RNA, 18 nt, Human
ggccucaccgaguggggg

SEQ ID NO: 2468187 - RNA, 21 nt, Human
ggccgaauccccucccuguca

SEQ ID NO: 2468188 - RNA, 19 nt, Human
ggccucacuaggcuucugg

SEQ ID NO: 2468189 - RNA, 10 nt, Human
ggccucagaa

SEQ ID NO: 2468190 - RNA, 19 nt, Human
ggccgaauccccucccugu

SEQ ID NO: 2468191 - RNA, 16 nt, Human
ggccgaaggcagugca

SEQ ID NO: 2468192 - RNA, 18 nt, Human
ggccgaagcucuggcuga

SEQ ID NO: 2468193 - RNA, 17 nt, Human
ggccgaagcucuggcug

SEQ ID NO: 2468194 - RNA, 16 nt, Human
ggccgaagcucuggcu

SEQ ID NO: 2468195 - RNA, 15 nt, Human
ggccgaagcucuggc

SEQ ID NO: 2468196 - RNA, 14 nt, Human
ggccgaagcucugg

SEQ ID NO: 2468197 - RNA, 23 nt, Human
ggccucaagugauucuccugccu

SEQ ID NO: 2468198 - RNA, 21 nt, Human
ggccucagcaccccugucucu

SEQ ID NO: 2468199 - RNA, 17 nt, Human
ggccucagcaccccugu

SEQ ID NO: 2468200 - RNA, 19 nt, Human
ggccucaccgagugggggc

SEQ ID NO: 2468201 - RNA, 15 nt, Human
ggccucagccagaga

SEQ ID NO: 2468202 - RNA, 17 nt, Human
ggccucagccagagaag

SEQ ID NO: 2468203 - RNA, 20 nt, Human
ggccucagccagagaagcua

SEQ ID NO: 2468204 - RNA, 14 nt, Human
ggccuccauccuga

SEQ ID NO: 2468205 - RNA, 15 nt, Human
ggccuccauccugag

SEQ ID NO: 2468206 - RNA, 16 nt, Human
ggccuccauccugagg

SEQ ID NO: 2468207 - RNA, 16 nt, Human
ggccccugcuucucca

SEQ ID NO: 2468208 - RNA, 23 nt, Human
ggccccugcugguucaggguugg

SEQ ID NO: 2468209 - RNA, 23 nt, Human
ggcccgcuugccucggcuccugc

SEQ ID NO: 2468210 - RNA, 22 nt, Human
ggcccgcuugccucggcuccug

SEQ ID NO: 2468211 - RNA, 19 nt, Human
ggccccugcuucuccagcc

SEQ ID NO: 2468212 - RNA, 21 nt, Human
ggcccgcuugccucggcuccu

SEQ ID NO: 2468213 - RNA, 12 nt, Human
ggcccggccagc

SEQ ID NO: 2468214 - RNA, 13 nt, Human
ggcccggcuccag

SEQ ID NO: 2468215 - RNA, 14 nt, Human
ggccccugcugguu

SEQ ID NO: 2468216 - RNA, 13 nt, Human
ggccccugcuggu

SEQ ID NO: 2468217 - RNA, 21 nt, Human
ggcccuucucuccagccccug

SEQ ID NO: 2468218 - RNA, 20 nt, Human
ggcccuucucuccagccccu

SEQ ID NO: 2468219 - RNA, 21 nt, Human
ggcccucgcugccagcucugu

SEQ ID NO: 2468220 - RNA, 22 nt, Human
ggcccucgcugccagcucugua

SEQ ID NO: 2468221 - RNA, 16 nt, Human
ggcccucgggcccagc

SEQ ID NO: 2468222 - RNA, 15 nt, Human
ggcccucgggcccag

SEQ ID NO: 2468223 - RNA, 23 nt, Human
ggcccucgcugccagcucuguau

SEQ ID NO: 2468224 - RNA, 20 nt, Human
ggcccucgggcccagccccc

SEQ ID NO: 2468225 - RNA, 19 nt, Human
ggcccucgggcccagcccc

SEQ ID NO: 2468226 - RNA, 18 nt, Human
ggcccucgggcccagccc

SEQ ID NO: 2468227 - RNA, 17 nt, Human
ggcccucgggcccagcc

SEQ ID NO: 2468228 - RNA, 19 nt, Human
ggcccuucucuccagcccc

SEQ ID NO: 2468229 - RNA, 15 nt, Human
ggcccggcuccaggc

SEQ ID NO: 2468230 - RNA, 20 nt, Human
ggcccggccagccaugucug

SEQ ID NO: 2468231 - RNA, 23 nt, Human
ggcccggcgcgguggcucacgcc

SEQ ID NO: 2468232 - RNA, 13 nt, Human
ggcccggggcugg

SEQ ID NO: 2468233 - RNA, 19 nt, Human
ggcccggggcuggcggcua

SEQ ID NO: 2468234 - RNA, 22 nt, Human
ggcccggggcuggcggcuacuc

SEQ ID NO: 2468235 - RNA, 16 nt, Human
ggcccuccuacccugc

SEQ ID NO: 2468236 - RNA, 21 nt, Human
ggcccuccuacccugcgccca

SEQ ID NO: 2468237 - RNA, 19 nt, Human
ggcccuccuacccugcgcc

SEQ ID NO: 2468238 - RNA, 17 nt, Human
ggcccuccuacccugcg

SEQ ID NO: 2468239 - RNA, 16 nt, Human
ggcccucgcugccagc

SEQ ID NO: 2468240 - RNA, 19 nt, Human
ggcccucgcugccagcucu

SEQ ID NO: 2468241 - RNA, 15 nt, Human
ggcccucgcugccag

SEQ ID NO: 2468242 - RNA, 20 nt, Human
ggcccuccuacccugcgccc

SEQ ID NO: 2468243 - RNA, 18 nt, Human
ggccagucuguggaucag

SEQ ID NO: 2468244 - RNA, 15 nt, Human
ggccagucuguggau

SEQ ID NO: 2468245 - RNA, 23 nt, Human
ggccagucuguggaucagagaug

SEQ ID NO: 2468246 - RNA, 20 nt, Human
ggccagugugacaaggauug

SEQ ID NO: 2468247 - RNA, 14 nt, Human
ggccagucugugga

SEQ ID NO: 2468248 - RNA, 13 nt, Human
ggccagucugugg

SEQ ID NO: 2468249 - RNA, 16 nt, Human
ggccagucugggcugc

SEQ ID NO: 2468250 - RNA, 15 nt, Human
ggccagucugggcug

SEQ ID NO: 2468251 - RNA, 22 nt, Human
ggccaguccugccuggccaggc

SEQ ID NO: 2468252 - RNA, 18 nt, Human
ggccaguccugccuggcc

SEQ ID NO: 2468253 - RNA, 19 nt, Human
ggccaguccugccuggcca

SEQ ID NO: 2468254 - RNA, 20 nt, Human
ggccaguccugccuggccag

SEQ ID NO: 2468255 - RNA, 21 nt, Human
ggccaguccugccuggccagg

SEQ ID NO: 2468256 - RNA, 22 nt, Human
ggcauagaggcuucuccgccag

SEQ ID NO: 2468257 - RNA, 14 nt, Human
ggcauacuaauaaa

SEQ ID NO: 2468258 - RNA, 16 nt, Human
ggcauagaggcuucuc

SEQ ID NO: 2468259 - RNA, 17 nt, Human
ggccagucccugaggca

SEQ ID NO: 2468260 - RNA, 23 nt, Human
ggccagucccugaggcagguccc

SEQ ID NO: 2468261 - RNA, 19 nt, Human
ggcauagaugcaggugagc

SEQ ID NO: 2468262 - RNA, 16 nt, Human
ggccaguccugccugg

SEQ ID NO: 2468263 - RNA, 19 nt, Human
ggcaguuuuucuguauuuu

SEQ ID NO: 2468264 - RNA, 15 nt, Human
ggcaguuuuucugua

SEQ ID NO: 2468265 - RNA, 12 nt, Human
ggcaguuuuucu

SEQ ID NO: 2468266 - RNA, 16 nt, Human
ggcaguuuuucuguau

SEQ ID NO: 2468267 - RNA, 20 nt, Human
ggcagugguaagcucuggcu

SEQ ID NO: 2468268 - RNA, 21 nt, Human
ggcauacgccuguaguccuag

SEQ ID NO: 2468269 - RNA, 17 nt, Human
ggccaguuggucccccu

SEQ ID NO: 2468270 - RNA, 14 nt, Human
ggccaguugguccc

SEQ ID NO: 2468271 - RNA, 17 nt, Human
ggccagucugggcugcc

SEQ ID NO: 2468272 - RNA, 19 nt, Human
ggccagugugaucccaagu

SEQ ID NO: 2468273 - RNA, 12 nt, Human
ggagagaaaaca

SEQ ID NO: 2468274 - RNA, 15 nt, Human
ggagacugcccagcu

SEQ ID NO: 2468275 - RNA, 20 nt, Human
ggagacucuguggggccuug

SEQ ID NO: 2468276 - RNA, 16 nt, Human
ggagagaagagaaugc

SEQ ID NO: 2468277 - RNA, 24 nt, Human
ggagagaaagugggugagaugcug

SEQ ID NO: 2468278 - RNA, 12 nt, Human
ggagagaagaau

SEQ ID NO: 2468279 - RNA, 18 nt, Human
ggagagaaagugggugag

SEQ ID NO: 2468280 - RNA, 16 nt, Human
ggagagaaagugggug

SEQ ID NO: 2468281 - RNA, 18 nt, Human
ggagagaaacaauaaaga

SEQ ID NO: 2468282 - RNA, 13 nt, Human
ggagagaccucau

SEQ ID NO: 2468283 - RNA, 11 nt, Human
ggagagaccuc

SEQ ID NO: 2468284 - RNA, 18 nt, Human
ggagagaccgagugaacc

SEQ ID NO: 2468285 - RNA, 18 nt, Human
ggagagaaggggaggagg

SEQ ID NO: 2468286 - RNA, 20 nt, Human
ggagagaaggggaggagggc

SEQ ID NO: 2468287 - RNA, 21 nt, Human
ggagagaaggggaggagggcg

SEQ ID NO: 2468288 - RNA, 15 nt, Human
ggagagaccucauca

SEQ ID NO: 2468289 - RNA, 20 nt, Human
ggcagacacagggacuugaa

SEQ ID NO: 2468290 - RNA, 17 nt, Human
ggcagacacagggacuu

SEQ ID NO: 2468291 - RNA, 23 nt, Human
ggcagaaugcuagcucugagcca

SEQ ID NO: 2468292 - RNA, 21 nt, Human
ggcagaaugcuagcucugagc

SEQ ID NO: 2468293 - RNA, 20 nt, Human
ggcagaaugcuagcucugag

SEQ ID NO: 2468294 - RNA, 18 nt, Human
ggcagaaugcuagcucug

SEQ ID NO: 2468295 - RNA, 16 nt, Human
ggcacuugauuccuug

SEQ ID NO: 2468296 - RNA, 19 nt, Human
ggcagacacggaucugaga

SEQ ID NO: 2468297 - RNA, 17 nt, Human
ggcagacacggaucuga

SEQ ID NO: 2468298 - RNA, 13 nt, Human
ggcagacagcagc

SEQ ID NO: 2468299 - RNA, 14 nt, Human
ggcagacagcagcu

SEQ ID NO: 2468300 - RNA, 15 nt, Human
ggcagacagcagcuc

SEQ ID NO: 2468301 - RNA, 16 nt, Human
ggcagacagcagcuca

SEQ ID NO: 2468302 - RNA, 17 nt, Human
ggcagacagcagcucag

SEQ ID NO: 2468303 - RNA, 18 nt, Human
ggcagacagcagcucagg

SEQ ID NO: 2468304 - RNA, 19 nt, Human
ggcagacagcagcucaggc

SEQ ID NO: 2468305 - RNA, 14 nt, Human
ggcacuucacagag

SEQ ID NO: 2468306 - RNA, 13 nt, Human
ggcacuucacaga

SEQ ID NO: 2468307 - RNA, 11 nt, Human
ggcacuucaca

SEQ ID NO: 2468308 - RNA, 21 nt, Human
ggcacuucacagagugugcug

SEQ ID NO: 2468309 - RNA, 15 nt, Human
ggcacuucacagagu

SEQ ID NO: 2468310 - RNA, 14 nt, Human
ggcacugcaggggc

SEQ ID NO: 2468311 - RNA, 23 nt, Human
ggcacugagcccccccaacacug

SEQ ID NO: 2468312 - RNA, 19 nt, Human
ggcacugagcccccccaac

SEQ ID NO: 2468313 - RNA, 13 nt, Human
ggcacugagcccc

SEQ ID NO: 2468314 - RNA, 12 nt, Human
ggcacugccuga

SEQ ID NO: 2468315 - RNA, 15 nt, Human
ggcacugguggcccg

SEQ ID NO: 2468316 - RNA, 16 nt, Human
ggcagacgccggggac

SEQ ID NO: 2468317 - RNA, 21 nt, Human
ggcagacacggaucugagaau

SEQ ID NO: 2468318 - RNA, 20 nt, Human
ggcagacagcagcucaggca

SEQ ID NO: 2468319 - RNA, 13 nt, Human
ggcagcagccauc

SEQ ID NO: 2468320 - RNA, 12 nt, Human
ggcagcagccau

SEQ ID NO: 2468321 - RNA, 13 nt, Human
ggcagcagggcua

SEQ ID NO: 2468322 - RNA, 18 nt, Human
ggcagcagggcuacccug

SEQ ID NO: 2468323 - RNA, 21 nt, Human
ggcagcaggugcugcuacccu

SEQ ID NO: 2468324 - RNA, 19 nt, Human
ggcagcaggugcugcuacc

SEQ ID NO: 2468325 - RNA, 16 nt, Human
ggcagcaggugcugcu

SEQ ID NO: 2468326 - RNA, 15 nt, Human
ggcagcaggugcugc

SEQ ID NO: 2468327 - RNA, 21 nt, Human
ggcagcagggcuacccugagc

SEQ ID NO: 2468328 - RNA, 13 nt, Human
ggcagcaguguga

SEQ ID NO: 2468329 - RNA, 14 nt, Human
ggcagcagugugag

SEQ ID NO: 2468330 - RNA, 19 nt, Human
ggcagcagugugaggccag

SEQ ID NO: 2468331 - RNA, 20 nt, Human
ggcagcagugugaggccagg

SEQ ID NO: 2468332 - RNA, 11 nt, Human
ggcagccccug

SEQ ID NO: 2468333 - RNA, 23 nt, Human
ggcagccccauucugccugccca

SEQ ID NO: 2468334 - RNA, 21 nt, Human
ggcacagaaaauggaagacag

SEQ ID NO: 2468335 - RNA, 20 nt, Human
ggcacagaaaauggaagaca

SEQ ID NO: 2468336 - RNA, 19 nt, Human
ggcacagaaaauggaagac

SEQ ID NO: 2468337 - RNA, 13 nt, Human
ggcacaucagcac

SEQ ID NO: 2468338 - RNA, 18 nt, Human
ggcacagugucugggcug

SEQ ID NO: 2468339 - RNA, 15 nt, Human
ggcacagugucuggg

SEQ ID NO: 2468340 - RNA, 19 nt, Human
ggcacagugucugggcuga

SEQ ID NO: 2468341 - RNA, 17 nt, Human
ggcacaucagaaaggaa

SEQ ID NO: 2468342 - RNA, 23 nt, Human
ggcacucagaagacacugauggg

SEQ ID NO: 2468343 - RNA, 22 nt, Human
ggcacucuguuauuuagacuca

SEQ ID NO: 2468344 - RNA, 12 nt, Human
ggcacugagccc

SEQ ID NO: 2468345 - RNA, 17 nt, Human
ggcacugagauauuuau

SEQ ID NO: 2468346 - RNA, 17 nt, Human
ggcacaguaugucccau

SEQ ID NO: 2468347 - RNA, 19 nt, Human
ggcacagggucugcucuuu

SEQ ID NO: 2468348 - RNA, 18 nt, Human
ggcacagggucugcucuu

SEQ ID NO: 2468349 - RNA, 17 nt, Human
ggcacagggucugcucu

SEQ ID NO: 2468350 - RNA, 21 nt, Human
ggcacaguuuucugagaaaga

SEQ ID NO: 2468351 - RNA, 23 nt, Human
ggcacagaaaauggaagacagcu

SEQ ID NO: 2468352 - RNA, 12 nt, Human
ggcacagggucu

SEQ ID NO: 2468353 - RNA, 20 nt, Human
ggcaguggugguuuucuguu

SEQ ID NO: 2468354 - RNA, 21 nt, Human
ggcaguggugguuuucuguuc

SEQ ID NO: 2468355 - RNA, 11 nt, Human
ggcaguuacau

SEQ ID NO: 2468356 - RNA, 15 nt, Human
ggcaguucugggugc

SEQ ID NO: 2468357 - RNA, 21 nt, Human
ggcaguucugggugcucccua

SEQ ID NO: 2468358 - RNA, 14 nt, Human
ggcaguuggccaga

SEQ ID NO: 2468359 - RNA, 14 nt, Human
ggcaggggacagga

SEQ ID NO: 2468360 - RNA, 15 nt, Human
ggcagggcugaggcc

SEQ ID NO: 2468361 - RNA, 15 nt, Human
ggcagggcugacucu

SEQ ID NO: 2468362 - RNA, 14 nt, Human
ggcagggcucugau

SEQ ID NO: 2468363 - RNA, 13 nt, Human
ggcagggcucuga

SEQ ID NO: 2468364 - RNA, 11 nt, Human
ggcagggcuca

SEQ ID NO: 2468365 - RNA, 13 nt, Human
ggcagggcucagg

SEQ ID NO: 2468366 - RNA, 15 nt, Human
ggcagggcucaggau

SEQ ID NO: 2468367 - RNA, 13 nt, Human
ggcagccgagcuc

SEQ ID NO: 2468368 - RNA, 16 nt, Human
ggcagggccuugccca

SEQ ID NO: 2468369 - RNA, 18 nt, Human
ggcagggccuugcccaga

SEQ ID NO: 2468370 - RNA, 19 nt, Human
ggcagggccuugcccagag

SEQ ID NO: 2468371 - RNA, 20 nt, Human
ggcagggccuugcccagaga

SEQ ID NO: 2468372 - RNA, 21 nt, Human
ggcagggccuugcccagagau

SEQ ID NO: 2468373 - RNA, 22 nt, Human
ggcagccccuguucuggcagag

SEQ ID NO: 2468374 - RNA, 13 nt, Human
ggcagcccuguag

SEQ ID NO: 2468375 - RNA, 21 nt, Human
ggcagcccuugcuuguuggga

SEQ ID NO: 2468376 - RNA, 11 nt, Human
ggcagcccuug

SEQ ID NO: 2468377 - RNA, 15 nt, Human
ggcagcccuguaggg

SEQ ID NO: 2468378 - RNA, 16 nt, Human
ggcugggagagccuuc

SEQ ID NO: 2468379 - RNA, 15 nt, Human
ggcugggagagccuu

SEQ ID NO: 2468380 - RNA, 14 nt, Human
ggcugggagagccu

SEQ ID NO: 2468381 - RNA, 13 nt, Human
ggcugcugaaggc

SEQ ID NO: 2468382 - RNA, 13 nt, Human
ggcugggagagcc

SEQ ID NO: 2468383 - RNA, 21 nt, Human
ggcugcgucuggaggggcccc

SEQ ID NO: 2468384 - RNA, 15 nt, Human
ggcugcucagggcug

SEQ ID NO: 2468385 - RNA, 15 nt, Human
ggcugcuacccagaa

SEQ ID NO: 2468386 - RNA, 16 nt, Human
ggcugcuacccagaaa

SEQ ID NO: 2468387 - RNA, 13 nt, Human
ggcugcugaagcu

SEQ ID NO: 2468388 - RNA, 15 nt, Human
ggcugcuccuccagg

SEQ ID NO: 2468389 - RNA, 18 nt, Human
ggcugcuccuccagggcc

SEQ ID NO: 2468390 - RNA, 19 nt, Human
ggcugcuccuccagggcca

SEQ ID NO: 2468391 - RNA, 23 nt, Human
ggcugcuccuccagggccacgug

SEQ ID NO: 2468392 - RNA, 12 nt, Human
ggcugcuccucc

SEQ ID NO: 2468393 - RNA, 13 nt, Human
ggcugcuccucca

SEQ ID NO: 2468394 - RNA, 18 nt, Human
ggcugacaucuguguuuc

SEQ ID NO: 2468395 - RNA, 13 nt, Human
ggcugaccacagc

SEQ ID NO: 2468396 - RNA, 15 nt, Human
ggcugaccacagcac

SEQ ID NO: 2468397 - RNA, 16 nt, Human
ggcugaccacagcaca

SEQ ID NO: 2468398 - RNA, 17 nt, Human
ggcugaccacagcacag

SEQ ID NO: 2468399 - RNA, 18 nt, Human
ggcugaccacagcacagc

SEQ ID NO: 2468400 - RNA, 20 nt, Human
ggcugccaaugggagcucau

SEQ ID NO: 2468401 - RNA, 19 nt, Human
ggcugccaaugggagcuca

SEQ ID NO: 2468402 - RNA, 15 nt, Human
ggcucuucuccuuuc

SEQ ID NO: 2468403 - RNA, 14 nt, Human
ggcucuucuccuuu

SEQ ID NO: 2468404 - RNA, 20 nt, Human
ggcugaacggggagaaaagg

SEQ ID NO: 2468405 - RNA, 22 nt, Human
ggcugacagacagcccuccauc

SEQ ID NO: 2468406 - RNA, 14 nt, Human
ggcugacaucugug

SEQ ID NO: 2468407 - RNA, 18 nt, Human
ggcugaaggacugugaca

SEQ ID NO: 2468408 - RNA, 24 nt, Human
ggcugacacguccaccccagugca

SEQ ID NO: 2468409 - RNA, 14 nt, Human
ggcugaaggacugu

SEQ ID NO: 2468410 - RNA, 13 nt, Human
ggcugaaggacug

SEQ ID NO: 2468411 - RNA, 16 nt, Human
ggcugaauagcagaag

SEQ ID NO: 2468412 - RNA, 16 nt, Human
ggcucuucuccuuuca

SEQ ID NO: 2468413 - RNA, 22 nt, Human
ggcugcccuggugcugccacac

SEQ ID NO: 2468414 - RNA, 20 nt, Human
ggcugccuccacucccacuu

SEQ ID NO: 2468415 - RNA, 17 nt, Human
ggcugccaaggccagag

SEQ ID NO: 2468416 - RNA, 11 nt, Human
ggcugccuggg

SEQ ID NO: 2468417 - RNA, 16 nt, Human
ggcugccuggccccca

SEQ ID NO: 2468418 - RNA, 15 nt, Human
ggcugccugggcugu

SEQ ID NO: 2468419 - RNA, 14 nt, Human
ggcugccugggcug

SEQ ID NO: 2468420 - RNA, 17 nt, Human
ggcugccugggcuguug

SEQ ID NO: 2468421 - RNA, 16 nt, Human
ggcugccuuagaaccu

SEQ ID NO: 2468422 - RNA, 22 nt, Human
ggcugcggaaugaaccacaucu

SEQ ID NO: 2468423 - RNA, 19 nt, Human
ggcugcccuggugcugcca

SEQ ID NO: 2468424 - RNA, 16 nt, Human
ggcugcccuggugcug

SEQ ID NO: 2468425 - RNA, 15 nt, Human
ggcugcccuggugcu

SEQ ID NO: 2468426 - RNA, 14 nt, Human
ggcugcccuggugc

SEQ ID NO: 2468427 - RNA, 21 nt, Human
ggcugccaaugggagcucaug

SEQ ID NO: 2468428 - RNA, 13 nt, Human
ggcugcccuggug

SEQ ID NO: 2468429 - RNA, 19 nt, Human
ggcugaccacagcacagcc

SEQ ID NO: 2468430 - RNA, 15 nt, Human
ggcugccaaggccag

SEQ ID NO: 2468431 - RNA, 13 nt, Human
ggcucucaggcca

SEQ ID NO: 2468432 - RNA, 14 nt, Human
ggcucucaggccag

SEQ ID NO: 2468433 - RNA, 14 nt, Human
ggcucucagcucag

SEQ ID NO: 2468434 - RNA, 12 nt, Human
ggcucucagcuc

SEQ ID NO: 2468435 - RNA, 19 nt, Human
ggcucucagcucagcgcca

SEQ ID NO: 2468436 - RNA, 15 nt, Human
ggcucugugcaggga

SEQ ID NO: 2468437 - RNA, 19 nt, Human
ggcucugugcugacccucc

SEQ ID NO: 2468438 - RNA, 18 nt, Human
ggcucugugcugacccuc

SEQ ID NO: 2468439 - RNA, 16 nt, Human
ggcucugugcugaccc

SEQ ID NO: 2468440 - RNA, 12 nt, Human
ggcucugugcug

SEQ ID NO: 2468441 - RNA, 14 nt, Human
ggcucugugggcug

SEQ ID NO: 2468442 - RNA, 12 nt, Human
ggcucugugggc

SEQ ID NO: 2468443 - RNA, 20 nt, Human
ggcucugugcugacccuccu

SEQ ID NO: 2468444 - RNA, 20 nt, Human
ggcucuuagcagcuuccaga

SEQ ID NO: 2468445 - RNA, 19 nt, Human
ggcucuuagcagcuuccag

SEQ ID NO: 2468446 - RNA, 18 nt, Human
ggcucugugggcugcacu

SEQ ID NO: 2468447 - RNA, 15 nt, Human
ggcucugugggcugc

SEQ ID NO: 2468448 - RNA, 18 nt, Human
ggcucuuagcagcuucca

SEQ ID NO: 2468449 - RNA, 12 nt, Human
ggcucuuccagg

SEQ ID NO: 2468450 - RNA, 21 nt, Human
ggcucuuagcagcuuccagau

SEQ ID NO: 2468451 - RNA, 17 nt, Human
ggcucuucuccccagag

SEQ ID NO: 2468452 - RNA, 13 nt, Human
ggcucuucuccuu

SEQ ID NO: 2468453 - RNA, 12 nt, Human
ggcucuucuccu

SEQ ID NO: 2468454 - RNA, 11 nt, Human
ggcucucaggc

SEQ ID NO: 2468455 - RNA, 20 nt, Human
ggcuccugugcuacuuugcc

SEQ ID NO: 2468456 - RNA, 13 nt, Human
ggcuccugugcua

SEQ ID NO: 2468457 - RNA, 12 nt, Human
ggcuccugugcu

SEQ ID NO: 2468458 - RNA, 17 nt, Human
ggcuccugugcccuuau

SEQ ID NO: 2468459 - RNA, 14 nt, Human
ggcuccugugcccu

SEQ ID NO: 2468460 - RNA, 13 nt, Human
ggcuccugugccc

SEQ ID NO: 2468461 - RNA, 23 nt, Human
ggcuccugugcuacuuugccuuu

SEQ ID NO: 2468462 - RNA, 20 nt, Human
ggcuccuucccaucgcuguc

SEQ ID NO: 2468463 - RNA, 16 nt, Human
ggcuccugcugcacca

SEQ ID NO: 2468464 - RNA, 15 nt, Human
ggcuccugcugcacc

SEQ ID NO: 2468465 - RNA, 14 nt, Human
ggcuccugcugcac

SEQ ID NO: 2468466 - RNA, 13 nt, Human
ggcuccugcugca

SEQ ID NO: 2468467 - RNA, 12 nt, Human
ggcuccugcugc

SEQ ID NO: 2468468 - RNA, 11 nt, Human
ggcuccugcug

SEQ ID NO: 2468469 - RNA, 19 nt, Human
ggcuccugccuucuguccu

SEQ ID NO: 2468470 - RNA, 18 nt, Human
ggcuccugccuucugucc

SEQ ID NO: 2468471 - RNA, 23 nt, Human
ggcuccugcugcaccaacccagc

SEQ ID NO: 2468472 - RNA, 22 nt, Human
ggcuccugcugcaccaacccag

SEQ ID NO: 2468473 - RNA, 21 nt, Human
ggcuccugcugcaccaaccca

SEQ ID NO: 2468474 - RNA, 13 nt, Human
ggcuccuggaaag

SEQ ID NO: 2468475 - RNA, 14 nt, Human
ggcuccacuugguc

SEQ ID NO: 2468476 - RNA, 17 nt, Human
ggcuccaaacccucgag

SEQ ID NO: 2468477 - RNA, 21 nt, Human
ggcucauauuccugcagccug

SEQ ID NO: 2468478 - RNA, 22 nt, Human
ggcucauauuccugcagccugg

SEQ ID NO: 2468479 - RNA, 15 nt, Human
ggcucacugccaggc

SEQ ID NO: 2468480 - RNA, 13 nt, Human
ggcucagagaugu

SEQ ID NO: 2468481 - RNA, 21 nt, Human
ggcucacugccaggccagccu

SEQ ID NO: 2468482 - RNA, 22 nt, Human
ggcucacugccaggccagccuc

SEQ ID NO: 2468483 - RNA, 20 nt, Human
ggcucacugccaggccagcc

SEQ ID NO: 2468484 - RNA, 19 nt, Human
ggcucacugccaggccagc

SEQ ID NO: 2468485 - RNA, 18 nt, Human
ggcucacugccaggccag

SEQ ID NO: 2468486 - RNA, 16 nt, Human
ggcucacugccaggcc

SEQ ID NO: 2468487 - RNA, 14 nt, Human
ggcucagagugggg

SEQ ID NO: 2468488 - RNA, 18 nt, Human
ggcucagcggggacagcu

SEQ ID NO: 2468489 - RNA, 13 nt, Human
ggcucagaucuca

SEQ ID NO: 2468490 - RNA, 18 nt, Human
ggcucagagaugugcacc

SEQ ID NO: 2468491 - RNA, 13 nt, Human
ggcucagccuggu

SEQ ID NO: 2468492 - RNA, 18 nt, Human
ggcucagggaccacagca

SEQ ID NO: 2468493 - RNA, 17 nt, Human
ggcucagggaccacagc

SEQ ID NO: 2468494 - RNA, 16 nt, Human
ggcucagggaccacag

SEQ ID NO: 2468495 - RNA, 14 nt, Human
ggcucagggaccac

SEQ ID NO: 2468496 - RNA, 20 nt, Human
ggcucagccuggugggccuc

SEQ ID NO: 2468497 - RNA, 22 nt, Human
ggcucaggauuucgugggucug

SEQ ID NO: 2468498 - RNA, 12 nt, Human
ggcucaggaaaa

SEQ ID NO: 2468499 - RNA, 20 nt, Human
ggcucagcggggacagcucc

SEQ ID NO: 2468500 - RNA, 19 nt, Human
ggcucagcggggacagcuc

SEQ ID NO: 2468501 - RNA, 20 nt, Human
ggcucagguggggucacucu

SEQ ID NO: 2468502 - RNA, 19 nt, Human
ggcucagguggggucacuc

SEQ ID NO: 2468503 - RNA, 22 nt, Human
ggcucagggagguuaagugacu

SEQ ID NO: 2468504 - RNA, 14 nt, Human
ggcucagucucagg

SEQ ID NO: 2468505 - RNA, 15 nt, Human
ggcucagucucagga

SEQ ID NO: 2468506 - RNA, 17 nt, Human
ggcucagucucaggagc

SEQ ID NO: 2468507 - RNA, 20 nt, Human
ggcucauagggaagaccugc

SEQ ID NO: 2468508 - RNA, 17 nt, Human
ggcucauauuccugcag

SEQ ID NO: 2468509 - RNA, 20 nt, Human
ggcucauauuccugcagccu

SEQ ID NO: 2468510 - RNA, 22 nt, Human
aaaagauguagauuuauuucau

SEQ ID NO: 2468511 - RNA, 15 nt, Human
aaaacuucagacaua

SEQ ID NO: 2468512 - RNA, 19 nt, Human
aaaacuuaacauauuuacu

SEQ ID NO: 2468513 - RNA, 17 nt, Human
aaaacuuaacauauuua

SEQ ID NO: 2468514 - RNA, 11 nt, Human
aaaacuuauuu

SEQ ID NO: 2468515 - RNA, 15 nt, Human
aaaacuuauuugagu

SEQ ID NO: 2468516 - RNA, 15 nt, Human
aaaacugacagagga

SEQ ID NO: 2468517 - RNA, 17 nt, Human
aaaacugaauuauaaga

SEQ ID NO: 2468518 - RNA, 21 nt, Human
aaaacugaagucugaaauuug

SEQ ID NO: 2468519 - RNA, 16 nt, Human
aaaacugacuccuuag

SEQ ID NO: 2468520 - RNA, 21 nt, Human
aaaagauuuucagaaaauauu

SEQ ID NO: 2468521 - RNA, 12 nt, Human
aaaagcaaaauc

SEQ ID NO: 2468522 - RNA, 14 nt, Human
aaaagcauguacag

SEQ ID NO: 2468523 - RNA, 15 nt, Human
aaaagauuuuaauca

SEQ ID NO: 2468524 - RNA, 21 nt, Human
aaaagauugcugaaauuuuau

SEQ ID NO: 2468525 - RNA, 13 nt, Human
aaaagauuuguuu

SEQ ID NO: 2468526 - RNA, 17 nt, Human
aaaagauuuguuuuguc

SEQ ID NO: 2468527 - RNA, 14 nt, Human
aaaagauuuuaauc

SEQ ID NO: 2468528 - RNA, 21 nt, Human
aaaagauugaaguauuuugcu

SEQ ID NO: 2468529 - RNA, 14 nt, Human
aaaagauugcugaa

SEQ ID NO: 2468530 - RNA, 16 nt, Human
aaaagauugcugaaau

SEQ ID NO: 2468531 - RNA, 18 nt, Human
aaaagauugcugaaauuu

SEQ ID NO: 2468532 - RNA, 12 nt, Human
aaaacuucuuuu

SEQ ID NO: 2468533 - RNA, 23 nt, Human
aaaagauguagauuuauuucauc

SEQ ID NO: 2468534 - RNA, 13 nt, Human
aaaagauucauuu

SEQ ID NO: 2468535 - RNA, 11 nt, Human
aaaagauucau

SEQ ID NO: 2468536 - RNA, 20 nt, Human
aaaaccaucaaaaauauucc

SEQ ID NO: 2468537 - RNA, 22 nt, Human
aaaacccaccuuguuggagccu

SEQ ID NO: 2468538 - RNA, 17 nt, Human
aaaaccugucaaugaua

SEQ ID NO: 2468539 - RNA, 14 nt, Human
aaaaccugucaaug

SEQ ID NO: 2468540 - RNA, 13 nt, Human
aaaaccuuucaaa

SEQ ID NO: 2468541 - RNA, 17 nt, Human
aaaacgcaaagggcuga

SEQ ID NO: 2468542 - RNA, 13 nt, Human
aaaacgcauggag

SEQ ID NO: 2468543 - RNA, 14 nt, Human
aaaacgcauggagu

SEQ ID NO: 2468544 - RNA, 18 nt, Human
aaaacgcauggagugugu

SEQ ID NO: 2468545 - RNA, 14 nt, Human
aaaaccuuuugaaa

SEQ ID NO: 2468546 - RNA, 20 nt, Human
aaaaccuuucaaauuucaca

SEQ ID NO: 2468547 - RNA, 18 nt, Human
aaaacucuccucugcugc

SEQ ID NO: 2468548 - RNA, 16 nt, Human
aaaacggcccucuuga

SEQ ID NO: 2468549 - RNA, 17 nt, Human
aaaacgcauggagugug

SEQ ID NO: 2468550 - RNA, 16 nt, Human
aaaacgguuaaaacug

SEQ ID NO: 2468551 - RNA, 21 nt, Human
aaaacucuacuuaauccaaug

SEQ ID NO: 2468552 - RNA, 18 nt, Human
aaaacgguuaaaacuguc

SEQ ID NO: 2468553 - RNA, 19 nt, Human
aaaacugaagucugaaauu

SEQ ID NO: 2468554 - RNA, 18 nt, Human
aaaacugaagucugaaau

SEQ ID NO: 2468555 - RNA, 17 nt, Human
aaaacugaagucugaaa

SEQ ID NO: 2468556 - RNA, 15 nt, Human
aaaacugaagucuga

SEQ ID NO: 2468557 - RNA, 19 nt, Human
aaaacugaaaaucuaauau

SEQ ID NO: 2468558 - RNA, 18 nt, Human
aaaacugaaaaucuaaua

SEQ ID NO: 2468559 - RNA, 23 nt, Human
aaaacugaaagugaaaguccaga

SEQ ID NO: 2468560 - RNA, 23 nt, Human
aaaaaugggacuucuuuucacau

SEQ ID NO: 2468561 - RNA, 18 nt, Human
aaaaaugggacuucuuuu

SEQ ID NO: 2468562 - RNA, 17 nt, Human
aaaaaugggacuucuuu

SEQ ID NO: 2468563 - RNA, 13 nt, Human
aaaaaugguaauu

SEQ ID NO: 2468564 - RNA, 14 nt, Human
gggaccagccaaga

SEQ ID NO: 2468565 - RNA, 16 nt, Human
aaaaaugggacuucuu

SEQ ID NO: 2468566 - RNA, 17 nt, Human
aaaaaugguuuaaaugg

SEQ ID NO: 2468567 - RNA, 13 nt, Human
aaaaauguaaaua

SEQ ID NO: 2468568 - RNA, 12 nt, Human
aaaaauguaaau

SEQ ID NO: 2468569 - RNA, 15 nt, Human
aaaaauggugccuga

SEQ ID NO: 2468570 - RNA, 20 nt, Human
gggaccagagcugccaccug

SEQ ID NO: 2468571 - RNA, 14 nt, Human
gggaccagagcugc

SEQ ID NO: 2468572 - RNA, 23 nt, Human
gggaccacagcaaggcaccugca

SEQ ID NO: 2468573 - RNA, 22 nt, Human
gggaccacagcaaggcaccugc

SEQ ID NO: 2468574 - RNA, 19 nt, Human
gggaccacagcaaggcacc

SEQ ID NO: 2468575 - RNA, 23 nt, Human
gggaccaaggcaaggcaggugcc

SEQ ID NO: 2468576 - RNA, 19 nt, Human
gggaccaaggcaaggcagg

SEQ ID NO: 2468577 - RNA, 17 nt, Human
gggaccaaggcaaggca

SEQ ID NO: 2468578 - RNA, 12 nt, Human
gggaccaaggca

SEQ ID NO: 2468579 - RNA, 17 nt, Human
gggaccaaggaccccuc

SEQ ID NO: 2468580 - RNA, 15 nt, Human
gggacauugggaagg

SEQ ID NO: 2468581 - RNA, 13 nt, Human
aaaacaugcuaca

SEQ ID NO: 2468582 - RNA, 14 nt, Human
aaaacaugcuacac

SEQ ID NO: 2468583 - RNA, 16 nt, Human
aaaaauguauaugcac

SEQ ID NO: 2468584 - RNA, 13 nt, Human
aaaacaucuauuc

SEQ ID NO: 2468585 - RNA, 16 nt, Human
aaaacaucuauucucu

SEQ ID NO: 2468586 - RNA, 21 nt, Human
aaaacaucuauucucuccaaa

SEQ ID NO: 2468587 - RNA, 16 nt, Human
aaaacauccagauaca

SEQ ID NO: 2468588 - RNA, 21 nt, Human
aaaacauccagauacacccaa

SEQ ID NO: 2468589 - RNA, 11 nt, Human
aaaacaucugg

SEQ ID NO: 2468590 - RNA, 19 nt, Human
aaaaccacagcccugucag

SEQ ID NO: 2468591 - RNA, 20 nt, Human
aaaaccacagcccugucagu

SEQ ID NO: 2468592 - RNA, 16 nt, Human
aaaaccacuagaacuc

SEQ ID NO: 2468593 - RNA, 12 nt, Human
aaaacccaagug

SEQ ID NO: 2468594 - RNA, 17 nt, Human
aaaaccacuagaacucu

SEQ ID NO: 2468595 - RNA, 11 nt, Human
aaaaccaggcc

SEQ ID NO: 2468596 - RNA, 23 nt, Human
gggacuuggaagcuccgcuuucu

SEQ ID NO: 2468597 - RNA, 18 nt, Human
gggacuuggaagcuccgc

SEQ ID NO: 2468598 - RNA, 17 nt, Human
gggacuuggaagcuccg

SEQ ID NO: 2468599 - RNA, 15 nt, Human
gggacuuggaagcuc

SEQ ID NO: 2468600 - RNA, 21 nt, Human
gggagaaccaaaaagaggcua

SEQ ID NO: 2468601 - RNA, 14 nt, Human
aaaaggaagacuag

SEQ ID NO: 2468602 - RNA, 15 nt, Human
aaaaggaagacuaga

SEQ ID NO: 2468603 - RNA, 18 nt, Human
gggacuugaaucuuucca

SEQ ID NO: 2468604 - RNA, 15 nt, Human
gggagaaaagacaug

SEQ ID NO: 2468605 - RNA, 13 nt, Human
gggagaaaauuca

SEQ ID NO: 2468606 - RNA, 15 nt, Human
gggagaaaauucaau

SEQ ID NO: 2468607 - RNA, 10 nt, Human
gggagaaaac

SEQ ID NO: 2468608 - RNA, 16 nt, Human
gggagaaauugacaga

SEQ ID NO: 2468609 - RNA, 14 nt, Human
gggagaaccucagg

SEQ ID NO: 2468610 - RNA, 16 nt, Human
gggagaaccucaggcu

SEQ ID NO: 2468611 - RNA, 15 nt, Human
gggagaaccucaggc

SEQ ID NO: 2468612 - RNA, 10 nt, Human
aaaaggaaaa

SEQ ID NO: 2468613 - RNA, 21 nt, Human
aaaagcuuugaacccugggac

SEQ ID NO: 2468614 - RNA, 21 nt, Human
aaaagccucaacuagucauuu

SEQ ID NO: 2468615 - RNA, 14 nt, Human
aaaaggaaaagcaa

SEQ ID NO: 2468616 - RNA, 14 nt, Human
aaaagcuuuuuauu

SEQ ID NO: 2468617 - RNA, 18 nt, Human
aaaaggaagccaaagagu

SEQ ID NO: 2468618 - RNA, 13 nt, Human
aaaaggaagacua

SEQ ID NO: 2468619 - RNA, 18 nt, Human
aaaagccaagaggcugca

SEQ ID NO: 2468620 - RNA, 22 nt, Human
aaaagcauguacaguguucugu

SEQ ID NO: 2468621 - RNA, 19 nt, Human
aaaagcauguacaguguuc

SEQ ID NO: 2468622 - RNA, 18 nt, Human
aaaagcauguacaguguu

SEQ ID NO: 2468623 - RNA, 15 nt, Human
aaaagcauguacagu

SEQ ID NO: 2468624 - RNA, 19 nt, Human
gggagagccuuccaggggu

SEQ ID NO: 2468625 - RNA, 15 nt, Human
gggagagccuuccag

SEQ ID NO: 2468626 - RNA, 23 nt, Human
gggagcaggcucgggcuccccag

SEQ ID NO: 2468627 - RNA, 13 nt, Human
gggagagccugcu

SEQ ID NO: 2468628 - RNA, 12 nt, Human
gggagagccugc

SEQ ID NO: 2468629 - RNA, 21 nt, Human
gggagaggauuuuuuucugag

SEQ ID NO: 2468630 - RNA, 16 nt, Human
gggagagccugcuggc

SEQ ID NO: 2468631 - RNA, 19 nt, Human
gggagccaugcgcccccuc

SEQ ID NO: 2468632 - RNA, 10 nt, Human
gggaggcuga

SEQ ID NO: 2468633 - RNA, 19 nt, Human
gggagcauagaaggcaggu

SEQ ID NO: 2468634 - RNA, 12 nt, Human
gggagccagggc

SEQ ID NO: 2468635 - RNA, 16 nt, Human
gggagcauggcuguga

SEQ ID NO: 2468636 - RNA, 11 nt, Human
gggagcagugu

SEQ ID NO: 2468637 - RNA, 19 nt, Human
gggagcagugucuuccaua

SEQ ID NO: 2468638 - RNA, 18 nt, Human
gggagcauagaaggcagg

SEQ ID NO: 2468639 - RNA, 20 nt, Human
gggagcagugucuuccauaa

SEQ ID NO: 2468640 - RNA, 17 nt, Human
gggagagggaggucacu

SEQ ID NO: 2468641 - RNA, 22 nt, Human
gggagaggccaugauucgccca

SEQ ID NO: 2468642 - RNA, 15 nt, Human
gggagcagggagguc

SEQ ID NO: 2468643 - RNA, 24 nt, Human
gggagcaggcggugggcacccacc

SEQ ID NO: 2468644 - RNA, 15 nt, Human
gggagggggauccga

SEQ ID NO: 2468645 - RNA, 22 nt, Human
gggagggauucugguuccaggg

SEQ ID NO: 2468646 - RNA, 15 nt, Human
gggaggcugagacag

SEQ ID NO: 2468647 - RNA, 16 nt, Human
gggagggagggcucca

SEQ ID NO: 2468648 - RNA, 15 nt, Human
gggagggagggcucc

SEQ ID NO: 2468649 - RNA, 13 nt, Human
gggaggcuucccc

SEQ ID NO: 2468650 - RNA, 17 nt, Human
gggaggcugagacagga

SEQ ID NO: 2468651 - RNA, 14 nt, Human
gggaggcugaggcg

SEQ ID NO: 2468652 - RNA, 18 nt, Human
gggaggucaaggcugcag

SEQ ID NO: 2468653 - RNA, 17 nt, Human
gggaggggggcacaugc

SEQ ID NO: 2468654 - RNA, 23 nt, Human
gggagggguugccacaggccucc

SEQ ID NO: 2468655 - RNA, 19 nt, Human
gggagggguugccacaggc

SEQ ID NO: 2468656 - RNA, 22 nt, Human
gggagggguaaaauuccuuagc

SEQ ID NO: 2468657 - RNA, 19 nt, Human
gggaugacuaaaauauuua

SEQ ID NO: 2468658 - RNA, 20 nt, Human
gggaugacuaaaauauuuau

SEQ ID NO: 2468659 - RNA, 15 nt, Human
gggaggucgaggcag

SEQ ID NO: 2468660 - RNA, 15 nt, Human
gggaggucacuggaa

SEQ ID NO: 2468661 - RNA, 14 nt, Human
gggaggucauuuug

SEQ ID NO: 2468662 - RNA, 13 nt, Human
gggaagagacuug

SEQ ID NO: 2468663 - RNA, 16 nt, Human
gggaagaaagagaagg

SEQ ID NO: 2468664 - RNA, 19 nt, Human
gggaagaaaagagcuuucu

SEQ ID NO: 2468665 - RNA, 15 nt, Human
gggaagacgaggccc

SEQ ID NO: 2468666 - RNA, 17 nt, Human
gggaagacgccugagcu

SEQ ID NO: 2468667 - RNA, 17 nt, Human
gggacaccugcccugcc

SEQ ID NO: 2468668 - RNA, 16 nt, Human
gggacaccugcccugc

SEQ ID NO: 2468669 - RNA, 17 nt, Human
gggacagagacaccugc

SEQ ID NO: 2468670 - RNA, 14 nt, Human
gggacaccugcccu

SEQ ID NO: 2468671 - RNA, 13 nt, Human
gggacagcuccuu

SEQ ID NO: 2468672 - RNA, 12 nt, Human
gggacagcuccu

SEQ ID NO: 2468673 - RNA, 18 nt, Human
gggacagaggccccagcc

SEQ ID NO: 2468674 - RNA, 19 nt, Human
gggacagaggccccagccu

SEQ ID NO: 2468675 - RNA, 20 nt, Human
gggacagaggccccagccuc

SEQ ID NO: 2468676 - RNA, 21 nt, Human
gggacagaggccccagccucc

SEQ ID NO: 2468677 - RNA, 13 nt, Human
gggacagagcaga

SEQ ID NO: 2468678 - RNA, 17 nt, Human
gggacagaggccccagc

SEQ ID NO: 2468679 - RNA, 18 nt, Human
gggacagagacaccugca

SEQ ID NO: 2468680 - RNA, 20 nt, Human
gggacagagacaccugcacc

SEQ ID NO: 2468681 - RNA, 21 nt, Human
gggacagucaccucauggaau

SEQ ID NO: 2468682 - RNA, 20 nt, Human
gggacagucaccucauggaa

SEQ ID NO: 2468683 - RNA, 22 nt, Human
gggacagucaccucauggaauu

SEQ ID NO: 2468684 - RNA, 15 nt, Human
gggacaucucuuuga

SEQ ID NO: 2468685 - RNA, 20 nt, Human
gggacagggcuggcccagcc

SEQ ID NO: 2468686 - RNA, 19 nt, Human
gggacagggcuggcccagc

SEQ ID NO: 2468687 - RNA, 18 nt, Human
gggacagggcuggcccag

SEQ ID NO: 2468688 - RNA, 17 nt, Human
gggacagggcuggccca

SEQ ID NO: 2468689 - RNA, 17 nt, Human
gggacaggggcaggagg

SEQ ID NO: 2468690 - RNA, 22 nt, Human
gggacagggcuggcccagcccu

SEQ ID NO: 2468691 - RNA, 21 nt, Human
gggacagggcuggcccagccc

SEQ ID NO: 2468692 - RNA, 18 nt, Human
gggacaggggcaggagga

SEQ ID NO: 2468693 - RNA, 13 nt, Human
gggacagggcugg

SEQ ID NO: 2468694 - RNA, 14 nt, Human
gggacagaggccug

SEQ ID NO: 2468695 - RNA, 12 nt, Human
gggacagggcug

SEQ ID NO: 2468696 - RNA, 15 nt, Human
gggacagcuccuucu

SEQ ID NO: 2468697 - RNA, 19 nt, Human
gggaaccucacucuugcca

SEQ ID NO: 2468698 - RNA, 12 nt, Human
gggaacccugcu

SEQ ID NO: 2468699 - RNA, 19 nt, Human
gggaaccaugaagacagga

SEQ ID NO: 2468700 - RNA, 20 nt, Human
gggaacccaaguccaagcau

SEQ ID NO: 2468701 - RNA, 15 nt, Human
gggaaccuguguccg

SEQ ID NO: 2468702 - RNA, 14 nt, Human
gggaaccugugucc

SEQ ID NO: 2468703 - RNA, 13 nt, Human
gggaaccuguguc

SEQ ID NO: 2468704 - RNA, 13 nt, Human
gggaaccuggaac

SEQ ID NO: 2468705 - RNA, 12 nt, Human
gggaaccucacu

SEQ ID NO: 2468706 - RNA, 13 nt, Human
gggaaccugaccc

SEQ ID NO: 2468707 - RNA, 20 nt, Human
gggaacugcagaccuguccu

SEQ ID NO: 2468708 - RNA, 15 nt, Human
gggaacugcagaccu

SEQ ID NO: 2468709 - RNA, 18 nt, Human
gggaagaagcucucuccu

SEQ ID NO: 2468710 - RNA, 18 nt, Human
gggaacgugacugcccca

SEQ ID NO: 2468711 - RNA, 14 nt, Human
gggaacgugacugc

SEQ ID NO: 2468712 - RNA, 17 nt, Human
gggaacgugacugcccc

SEQ ID NO: 2468713 - RNA, 23 nt, Human
gggaacucaccuggggcugcugg

SEQ ID NO: 2468714 - RNA, 22 nt, Human
gggaacucaccuggggcugcug

SEQ ID NO: 2468715 - RNA, 16 nt, Human
gggaacucagauccag

SEQ ID NO: 2468716 - RNA, 13 nt, Human
gggaacuccugga

SEQ ID NO: 2468717 - RNA, 12 nt, Human
gggaacaguguu

SEQ ID NO: 2468718 - RNA, 18 nt, Human
gggaaccaugaagacagg

SEQ ID NO: 2468719 - RNA, 20 nt, Human
gggaacaguguuucccauaa

SEQ ID NO: 2468720 - RNA, 18 nt, Human
ggcuucuggagcccuugg

SEQ ID NO: 2468721 - RNA, 20 nt, Human
ggcuucuggagcccuugggu

SEQ ID NO: 2468722 - RNA, 22 nt, Human
ggcuucugcacccuccacccug

SEQ ID NO: 2468723 - RNA, 13 nt, Human
ggcuucuggagcc

SEQ ID NO: 2468724 - RNA, 16 nt, Human
ggcuucuggagcccuu

SEQ ID NO: 2468725 - RNA, 21 nt, Human
ggcuuccuccugguguggaag

SEQ ID NO: 2468726 - RNA, 22 nt, Human
ggcuucccgcucagcccucccu

SEQ ID NO: 2468727 - RNA, 21 nt, Human
ggcuguaggacucgcagucag

SEQ ID NO: 2468728 - RNA, 15 nt, Human
ggcuguagaaggaga

SEQ ID NO: 2468729 - RNA, 12 nt, Human
ggcuuccuccuc

SEQ ID NO: 2468730 - RNA, 21 nt, Human
ggcuuccucaguuccugcccu

SEQ ID NO: 2468731 - RNA, 21 nt, Human
ggcuucugcacccuccacccu

SEQ ID NO: 2468732 - RNA, 20 nt, Human
ggcuucugcacccuccaccc

SEQ ID NO: 2468733 - RNA, 18 nt, Human
ggcuucugcacccuccac

SEQ ID NO: 2468734 - RNA, 16 nt, Human
ggcuucugcacccucc

SEQ ID NO: 2468735 - RNA, 15 nt, Human
ggcuucugcacccuc

SEQ ID NO: 2468736 - RNA, 14 nt, Human
ggcuucugcacccu

SEQ ID NO: 2468737 - RNA, 13 nt, Human
ggcuucugcaccc

SEQ ID NO: 2468738 - RNA, 14 nt, Human
ggcuucucucugug

SEQ ID NO: 2468739 - RNA, 22 nt, Human
ggcugguucggauuuggggugg

SEQ ID NO: 2468740 - RNA, 18 nt, Human
ggcugguuuggaaugcuu

SEQ ID NO: 2468741 - RNA, 10 nt, Human
ggcugggugc

SEQ ID NO: 2468742 - RNA, 23 nt, Human
ggcugguucggauuuggggugga

SEQ ID NO: 2468743 - RNA, 23 nt, Human
ggcugguuuuguaagaugcuggg

SEQ ID NO: 2468744 - RNA, 22 nt, Human
ggcugguuuuguaagaugcugg

SEQ ID NO: 2468745 - RNA, 21 nt, Human
ggcugguuuuguaagaugcug

SEQ ID NO: 2468746 - RNA, 13 nt, Human
ggcugguuuugua

SEQ ID NO: 2468747 - RNA, 16 nt, Human
ggcuguaaaaugcaug

SEQ ID NO: 2468748 - RNA, 18 nt, Human
ggcuguaucccaugagcc

SEQ ID NO: 2468749 - RNA, 20 nt, Human
ggcuucaguggcagcugcuu

SEQ ID NO: 2468750 - RNA, 19 nt, Human
ggcuucaguggcagcugcu

SEQ ID NO: 2468751 - RNA, 17 nt, Human
ggcuucaguggcagcug

SEQ ID NO: 2468752 - RNA, 18 nt, Human
ggcuucaguggcagcugc

SEQ ID NO: 2468753 - RNA, 18 nt, Human
ggcuucccgcucagcccu

SEQ ID NO: 2468754 - RNA, 17 nt, Human
ggcuucccgcucagccc

SEQ ID NO: 2468755 - RNA, 16 nt, Human
ggcuucccgcucagcc

SEQ ID NO: 2468756 - RNA, 15 nt, Human
ggcuucccgcucagc

SEQ ID NO: 2468757 - RNA, 21 nt, Human
ggcuucccgcucagcccuccc

SEQ ID NO: 2468758 - RNA, 19 nt, Human
ggcuucccgcucagcccuc

SEQ ID NO: 2468759 - RNA, 16 nt, Human
ggcuuccucauaguau

SEQ ID NO: 2468760 - RNA, 9 nt, Human
ggcuucaua

SEQ ID NO: 2468761 - RNA, 11 nt, Human
ggcuucauaca

SEQ ID NO: 2468762 - RNA, 18 nt, Human
ggcuucauccuccucaga

SEQ ID NO: 2468763 - RNA, 22 nt, Human
ggcuucauccuccucagaucuu

SEQ ID NO: 2468764 - RNA, 12 nt, Human
ggcuucauacac

SEQ ID NO: 2468765 - RNA, 14 nt, Human
ggcuucccgcucag

SEQ ID NO: 2468766 - RNA, 20 nt, Human
ggcugggucgcccuggacug

SEQ ID NO: 2468767 - RNA, 17 nt, Human
ggcugggucgcccugga

SEQ ID NO: 2468768 - RNA, 14 nt, Human
ggcugggucgcccu

SEQ ID NO: 2468769 - RNA, 16 nt, Human
aaaaauaauaauaaug

SEQ ID NO: 2468770 - RNA, 21 nt, Human
ggcuggguucuacccaggugc

SEQ ID NO: 2468771 - RNA, 19 nt, Human
ggcuggguucuacccaggu

SEQ ID NO: 2468772 - RNA, 19 nt, Human
ggcuggguggcaccagcag

SEQ ID NO: 2468773 - RNA, 14 nt, Human
ggcugggugcgacc

SEQ ID NO: 2468774 - RNA, 19 nt, Human
ggcugggggccucagugcc

SEQ ID NO: 2468775 - RNA, 17 nt, Human
ggcugggggccucagug

SEQ ID NO: 2468776 - RNA, 16 nt, Human
ggcugggggccucagu

SEQ ID NO: 2468777 - RNA, 15 nt, Human
ggcugggggccucag

SEQ ID NO: 2468778 - RNA, 14 nt, Human
aaaaauaacaauga

SEQ ID NO: 2468779 - RNA, 21 nt, Human
aaaaauaaauuugguucuaau

SEQ ID NO: 2468780 - RNA, 22 nt, Human
aaagauggcugugccucugccu

SEQ ID NO: 2468781 - RNA, 21 nt, Human
aaagauggcugugccucugcc

SEQ ID NO: 2468782 - RNA, 16 nt, Human
aaagauggaugugcuu

SEQ ID NO: 2468783 - RNA, 18 nt, Human
aaagauggggucuguaaa

SEQ ID NO: 2468784 - RNA, 17 nt, Human
aaagauggggucuguaa

SEQ ID NO: 2468785 - RNA, 23 nt, Human
aaagauggcugugccucugccug

SEQ ID NO: 2468786 - RNA, 21 nt, Human
aaagauggggucuguaaaauc

SEQ ID NO: 2468787 - RNA, 19 nt, Human
aaagauggggucuguaaaa

SEQ ID NO: 2468788 - RNA, 22 nt, Human
aaagauggggucuguaaaaucu

SEQ ID NO: 2468789 - RNA, 20 nt, Human
aaagcaauuuuccuugaagc

SEQ ID NO: 2468790 - RNA, 19 nt, Human
aaagcaauuuuccuugaag

SEQ ID NO: 2468791 - RNA, 18 nt, Human
aaagcaauuuuccuugaa

SEQ ID NO: 2468792 - RNA, 17 nt, Human
aaagcaauuuuccuuga

SEQ ID NO: 2468793 - RNA, 16 nt, Human
aaagcaauuuuccuug

SEQ ID NO: 2468794 - RNA, 15 nt, Human
aaagcaauuuuccuu

SEQ ID NO: 2468795 - RNA, 14 nt, Human
aaagcaauuuuccu

SEQ ID NO: 2468796 - RNA, 13 nt, Human
aaagcaauuuucc

SEQ ID NO: 2468797 - RNA, 12 nt, Human
aaagcaauuuuc

SEQ ID NO: 2468798 - RNA, 15 nt, Human
aaagcaauuccaacc

SEQ ID NO: 2468799 - RNA, 14 nt, Human
aaagcaaugcauuu

SEQ ID NO: 2468800 - RNA, 13 nt, Human
aaagcaaugcauu

SEQ ID NO: 2468801 - RNA, 12 nt, Human
aaagcaaugcau

SEQ ID NO: 2468802 - RNA, 14 nt, Human
aaagcaauaugcau

SEQ ID NO: 2468803 - RNA, 14 nt, Human
aaagcaaggaaacu

SEQ ID NO: 2468804 - RNA, 20 nt, Human
aaagcaaggaaacuauguaa

SEQ ID NO: 2468805 - RNA, 22 nt, Human
aaagcaagugauugggacagag

SEQ ID NO: 2468806 - RNA, 23 nt, Human
aaagcaauaauggucccauccag

SEQ ID NO: 2468807 - RNA, 22 nt, Human
aaagcaauaauggucccaucca

SEQ ID NO: 2468808 - RNA, 14 nt, Human
aaagcaauaauggu

SEQ ID NO: 2468809 - RNA, 15 nt, Human
aaagcaauaaaugaa

SEQ ID NO: 2468810 - RNA, 17 nt, Human
aaagcaauaaaugaaug

SEQ ID NO: 2468811 - RNA, 20 nt, Human
gguccugcagucuggcugag

SEQ ID NO: 2468812 - RNA, 12 nt, Human
gguccugcugca

SEQ ID NO: 2468813 - RNA, 17 nt, Human
gguccugagggucccca

SEQ ID NO: 2468814 - RNA, 19 nt, Human
gguccugcagucuggcuga

SEQ ID NO: 2468815 - RNA, 11 nt, Human
gguccugcugc

SEQ ID NO: 2468816 - RNA, 13 nt, Human
gguccuguggcag

SEQ ID NO: 2468817 - RNA, 12 nt, Human
gguccuguggca

SEQ ID NO: 2468818 - RNA, 18 nt, Human
gguccuguggcaggcagc

SEQ ID NO: 2468819 - RNA, 17 nt, Human
gguccuguggcaggcag

SEQ ID NO: 2468820 - RNA, 16 nt, Human
gguccuguggcaggca

SEQ ID NO: 2468821 - RNA, 14 nt, Human
gguccuguggcagg

SEQ ID NO: 2468822 - RNA, 21 nt, Human
gguccuucaaguuagcucagg

SEQ ID NO: 2468823 - RNA, 16 nt, Human
gguccuugcaccccuc

SEQ ID NO: 2468824 - RNA, 22 nt, Human
gguccuuuacacucaggcuuuc

SEQ ID NO: 2468825 - RNA, 20 nt, Human
gguccuuggugugacccucu

SEQ ID NO: 2468826 - RNA, 21 nt, Human
gguccuuugggaaaggagaag

SEQ ID NO: 2468827 - RNA, 22 nt, Human
gguccuguggcaggcagcgcca

SEQ ID NO: 2468828 - RNA, 21 nt, Human
gguccuguggcaggcagcgcc

SEQ ID NO: 2468829 - RNA, 15 nt, Human
gguccuuccaggccc

SEQ ID NO: 2468830 - RNA, 16 nt, Human
gguccuuccaggcccc

SEQ ID NO: 2468831 - RNA, 15 nt, Human
gguccuucccucucc

SEQ ID NO: 2468832 - RNA, 19 nt, Human
gguccuucccucuccccaa

SEQ ID NO: 2468833 - RNA, 19 nt, Human
aaagagaugaugaaaauau

SEQ ID NO: 2468834 - RNA, 20 nt, Human
aaagagaugaugaaaauauu

SEQ ID NO: 2468835 - RNA, 22 nt, Human
aaagagaugaugaaaauauuua

SEQ ID NO: 2468836 - RNA, 20 nt, Human
aaagagauauuuuaaaauga

SEQ ID NO: 2468837 - RNA, 18 nt, Human
aaagagauggccugagaa

SEQ ID NO: 2468838 - RNA, 14 nt, Human
aaagacuguacaaa

SEQ ID NO: 2468839 - RNA, 12 nt, Human
aaagagagguua

SEQ ID NO: 2468840 - RNA, 11 nt, Human
aaagagagguu

SEQ ID NO: 2468841 - RNA, 16 nt, Human
aaagagauauuuuaaa

SEQ ID NO: 2468842 - RNA, 13 nt, Human
aaagagauauuuu

SEQ ID NO: 2468843 - RNA, 12 nt, Human
aaagagauauuu

SEQ ID NO: 2468844 - RNA, 23 nt, Human
aaagacugaguacguugugcauu

SEQ ID NO: 2468845 - RNA, 12 nt, Human
aaagacuggcuu

SEQ ID NO: 2468846 - RNA, 16 nt, Human
aaagacugagcucaag

SEQ ID NO: 2468847 - RNA, 23 nt, Human
aaagacuggcuuuuauuaaugca

SEQ ID NO: 2468848 - RNA, 21 nt, Human
aaagacuggcuuuuauuaaug

SEQ ID NO: 2468849 - RNA, 13 nt, Human
aaagacuggcuuu

SEQ ID NO: 2468850 - RNA, 13 nt, Human
aaagacuguacaa

SEQ ID NO: 2468851 - RNA, 14 nt, Human
aaagaggaaagaau

SEQ ID NO: 2468852 - RNA, 12 nt, Human
aaagaggaaaga

SEQ ID NO: 2468853 - RNA, 18 nt, Human
aaagagcccuugccuccc

SEQ ID NO: 2468854 - RNA, 14 nt, Human
aaagaggagugcuu

SEQ ID NO: 2468855 - RNA, 19 nt, Human
aaagaugcuucucacugcc

SEQ ID NO: 2468856 - RNA, 17 nt, Human
aaagaugcuucucacug

SEQ ID NO: 2468857 - RNA, 14 nt, Human
aaagaugcuucuca

SEQ ID NO: 2468858 - RNA, 15 nt, Human
aaagaggcagcuuga

SEQ ID NO: 2468859 - RNA, 15 nt, Human
aaagaggaaugaagu

SEQ ID NO: 2468860 - RNA, 13 nt, Human
aaagagauuucaa

SEQ ID NO: 2468861 - RNA, 14 nt, Human
aaagagauuucaag

SEQ ID NO: 2468862 - RNA, 15 nt, Human
aaagagcaagucugg

SEQ ID NO: 2468863 - RNA, 18 nt, Human
aaagagcacuuaagagaa

SEQ ID NO: 2468864 - RNA, 12 nt, Human
aaagagcacuua

SEQ ID NO: 2468865 - RNA, 23 nt, Human
aaagagcaagucuggaucuggga

SEQ ID NO: 2468866 - RNA, 15 nt, Human
aaagagcccuugccu

SEQ ID NO: 2468867 - RNA, 22 nt, Human
aaagagcacuuaagagaauauu

SEQ ID NO: 2468868 - RNA, 21 nt, Human
aaagagcacuuaagagaauau

SEQ ID NO: 2468869 - RNA, 20 nt, Human
aaagagcacuuaagagaaua

SEQ ID NO: 2468870 - RNA, 22 nt, Human
aaagagcuuuaguccuagagga

SEQ ID NO: 2468871 - RNA, 22 nt, Human
aaagagcuuucuucccgaaccc

SEQ ID NO: 2468872 - RNA, 18 nt, Human
aaagacuauucaaacagu

SEQ ID NO: 2468873 - RNA, 19 nt, Human
aaagacuauucaaacaguc

SEQ ID NO: 2468874 - RNA, 17 nt, Human
aaagacuauucaaacag

SEQ ID NO: 2468875 - RNA, 22 nt, Human
aaagaccuuuggagcaaagcug

SEQ ID NO: 2468876 - RNA, 23 nt, Human
aaagaccuuguguguauguguac

SEQ ID NO: 2468877 - RNA, 20 nt, Human
aaagaccuuguguguaugug

SEQ ID NO: 2468878 - RNA, 23 nt, Human
aaagacgaccagcauuuaaccaa

SEQ ID NO: 2468879 - RNA, 21 nt, Human
aaagacuauucaaacagucuc

SEQ ID NO: 2468880 - RNA, 15 nt, Human
aaagacuccaaagaa

SEQ ID NO: 2468881 - RNA, 21 nt, Human
aaagacuccaaagaaauguaa

SEQ ID NO: 2468882 - RNA, 19 nt, Human
aaagacugaccaauauugu

SEQ ID NO: 2468883 - RNA, 14 nt, Human
aaagacuccaaaga

SEQ ID NO: 2468884 - RNA, 13 nt, Human
aaagacagugaaa

SEQ ID NO: 2468885 - RNA, 12 nt, Human
aaacuuuucuca

SEQ ID NO: 2468886 - RNA, 14 nt, Human
aaacuuuucucaga

SEQ ID NO: 2468887 - RNA, 9 nt, Human
aaagacaga

SEQ ID NO: 2468888 - RNA, 19 nt, Human
aaagaccuuguguguaugu

SEQ ID NO: 2468889 - RNA, 17 nt, Human
aaagaccuuguguguau

SEQ ID NO: 2468890 - RNA, 13 nt, Human
aaagaccagacua

SEQ ID NO: 2468891 - RNA, 15 nt, Human
aaagaccauuuuucc

SEQ ID NO: 2468892 - RNA, 19 nt, Human
aaagacauucugacaucuu

SEQ ID NO: 2468893 - RNA, 18 nt, Human
aaagacauccauaaagaa

SEQ ID NO: 2468894 - RNA, 15 nt, Human
aaagacaugaauaug

SEQ ID NO: 2468895 - RNA, 19 nt, Human
aaagacauccauaaagaag

SEQ ID NO: 2468896 - RNA, 14 nt, Human
aaagacaucaagca

SEQ ID NO: 2468897 - RNA, 13 nt, Human
aaagacagaagcc

SEQ ID NO: 2468898 - RNA, 14 nt, Human
aaagacagagcugg

SEQ ID NO: 2468899 - RNA, 22 nt, Human
aaagacagggcugauaagcuaa

SEQ ID NO: 2468900 - RNA, 14 nt, Human
ggguggccucccaa

SEQ ID NO: 2468901 - RNA, 17 nt, Human
ggguggggggcuucaua

SEQ ID NO: 2468902 - RNA, 23 nt, Human
ggguggccuaagaguugagcucu

SEQ ID NO: 2468903 - RNA, 12 nt, Human
ggguggggcugc

SEQ ID NO: 2468904 - RNA, 19 nt, Human
ggguggggggcuucauaca

SEQ ID NO: 2468905 - RNA, 19 nt, Human
aaacuucagacauagaauu

SEQ ID NO: 2468906 - RNA, 23 nt, Human
aaacuucagcgguuuauauaagc

SEQ ID NO: 2468907 - RNA, 14 nt, Human
ggguggggcugcuc

SEQ ID NO: 2468908 - RNA, 19 nt, Human
aaacuuccagugcaacacu

SEQ ID NO: 2468909 - RNA, 16 nt, Human
aaacuuguauuaugug

SEQ ID NO: 2468910 - RNA, 19 nt, Human
aaacuuguaaauaaaggaa

SEQ ID NO: 2468911 - RNA, 16 nt, Human
aaacuuguaauuuuuu

SEQ ID NO: 2468912 - RNA, 11 nt, Human
aaacuuguaaa

SEQ ID NO: 2468913 - RNA, 12 nt, Human
aaacuuguaaau

SEQ ID NO: 2468914 - RNA, 24 nt, Human
aaacuuggcucgaaucucugugcc

SEQ ID NO: 2468915 - RNA, 18 nt, Human
aaacuugcuuuaugccuu

SEQ ID NO: 2468916 - RNA, 21 nt, Human
aaacuuccagugcaacacuga

SEQ ID NO: 2468917 - RNA, 14 nt, Human
aaacuuugcuaaau

SEQ ID NO: 2468918 - RNA, 20 nt, Human
aaacuuguaauuuuuuuaau

SEQ ID NO: 2468919 - RNA, 18 nt, Human
aaacuuuccucgccugac

SEQ ID NO: 2468920 - RNA, 17 nt, Human
aaaggagauuggaagga

SEQ ID NO: 2468921 - RNA, 19 nt, Human
aaaggagcccuuaucugug

SEQ ID NO: 2468922 - RNA, 15 nt, Human
aaaggagauaaaucu

SEQ ID NO: 2468923 - RNA, 14 nt, Human
aaaggagauaaauc

SEQ ID NO: 2468924 - RNA, 21 nt, Human
aaaggagagcuagcagcaggg

SEQ ID NO: 2468925 - RNA, 17 nt, Human
aaaggagagcuagcagc

SEQ ID NO: 2468926 - RNA, 22 nt, Human
aaaggaaagagggagguaagga

SEQ ID NO: 2468927 - RNA, 17 nt, Human
aaaggaaaucucacccc

SEQ ID NO: 2468928 - RNA, 12 nt, Human
aaaggaagccaa

SEQ ID NO: 2468929 - RNA, 14 nt, Human
aaaggaagccaaag

SEQ ID NO: 2468930 - RNA, 15 nt, Human
aaaggaagccaaaga

SEQ ID NO: 2468931 - RNA, 15 nt, Human
aaaggaaaugauuga

SEQ ID NO: 2468932 - RNA, 23 nt, Human
aaaggaaaucucaccccauccca

SEQ ID NO: 2468933 - RNA, 13 nt, Human
aaaggaagacuag

SEQ ID NO: 2468934 - RNA, 12 nt, Human
aaaggaagacua

SEQ ID NO: 2468935 - RNA, 14 nt, Human
aaagguacuucaaa

SEQ ID NO: 2468936 - RNA, 14 nt, Human
aaagguaaaucaga

SEQ ID NO: 2468937 - RNA, 15 nt, Human
aaaggggugcuuuua

SEQ ID NO: 2468938 - RNA, 17 nt, Human
aaagggucuugggaaau

SEQ ID NO: 2468939 - RNA, 10 nt, Human
aaagggugaa

SEQ ID NO: 2468940 - RNA, 14 nt, Human
aaagggugaagcua

SEQ ID NO: 2468941 - RNA, 19 nt, Human
aaagggugaagcuauuuau

SEQ ID NO: 2468942 - RNA, 21 nt, Human
aaagggugaagcuauuuaucu

SEQ ID NO: 2468943 - RNA, 18 nt, Human
aaagggugcugcuucccu

SEQ ID NO: 2468944 - RNA, 20 nt, Human
aaagggauggcaagaugugg

SEQ ID NO: 2468945 - RNA, 17 nt, Human
aaagggagagagagagg

SEQ ID NO: 2468946 - RNA, 23 nt, Human
aaagggagcacuggguugacuuu

SEQ ID NO: 2468947 - RNA, 20 nt, Human
aaagggagcagaacugaacc

SEQ ID NO: 2468948 - RNA, 18 nt, Human
aaagggagcuaucaggaa

SEQ ID NO: 2468949 - RNA, 22 nt, Human
aaagggacuuggaagcuccgcu

SEQ ID NO: 2468950 - RNA, 20 nt, Human
aaagggacugagaaauuuau

SEQ ID NO: 2468951 - RNA, 23 nt, Human
aaaggagcccuuaucugugcuca

SEQ ID NO: 2468952 - RNA, 21 nt, Human
aaagcucauauuuuguauaua

SEQ ID NO: 2468953 - RNA, 16 nt, Human
aaagcacuuggacucu

SEQ ID NO: 2468954 - RNA, 22 nt, Human
aaagcacugaccugucaugccc

SEQ ID NO: 2468955 - RNA, 15 nt, Human
aaagcucacuuuacu

SEQ ID NO: 2468956 - RNA, 20 nt, Human
aaagcuccucgagggcaggg

SEQ ID NO: 2468957 - RNA, 17 nt, Human
aaagcuccuagcagaga

SEQ ID NO: 2468958 - RNA, 13 nt, Human
aaagcucauauuu

SEQ ID NO: 2468959 - RNA, 16 nt, Human
aaagcuccuguccucc

SEQ ID NO: 2468960 - RNA, 13 nt, Human
aaagcuccugucc

SEQ ID NO: 2468961 - RNA, 15 nt, Human
aaagcugaaaacugc

SEQ ID NO: 2468962 - RNA, 17 nt, Human
aaagcacugacuucuaa

SEQ ID NO: 2468963 - RNA, 21 nt, Human
aaagcacugacuucuaaguaa

SEQ ID NO: 2468964 - RNA, 19 nt, Human
aaagcacgaaauguuauuu

SEQ ID NO: 2468965 - RNA, 22 nt, Human
aaagcaccagcuucuccaggcu

SEQ ID NO: 2468966 - RNA, 12 nt, Human
aaagcaccugcc

SEQ ID NO: 2468967 - RNA, 17 nt, Human
gguggaucacagaggcu

SEQ ID NO: 2468968 - RNA, 23 nt, Human
aaagcaccaaaauaagaaaagau

SEQ ID NO: 2468969 - RNA, 14 nt, Human
aaagcacggacucu

SEQ ID NO: 2468970 - RNA, 14 nt, Human
aaagcacuauacag

SEQ ID NO: 2468971 - RNA, 13 nt, Human
aaagcaccugccg

SEQ ID NO: 2468972 - RNA, 14 nt, Human
aaagcacugaccug

SEQ ID NO: 2468973 - RNA, 13 nt, Human
aaagcuuuccugc

SEQ ID NO: 2468974 - RNA, 12 nt, Human
aaagcuuuccug

SEQ ID NO: 2468975 - RNA, 15 nt, Human
aaagcuuguuaagau

SEQ ID NO: 2468976 - RNA, 15 nt, Human
aaagcuuuuagaaau

SEQ ID NO: 2468977 - RNA, 22 nt, Human
aaagcuuuccugccccaggccu

SEQ ID NO: 2468978 - RNA, 14 nt, Human
aaagcuuuccugcc

SEQ ID NO: 2468979 - RNA, 23 nt, Human
aaagcuuuccugccccaggccug

SEQ ID NO: 2468980 - RNA, 21 nt, Human
aaagcuuugcuuaugguaaua

SEQ ID NO: 2468981 - RNA, 12 nt, Human
aaagcugaaaac

SEQ ID NO: 2468982 - RNA, 15 nt, Human
aaagcugccuguagu

SEQ ID NO: 2468983 - RNA, 16 nt, Human
aaagcugccuguaguu

SEQ ID NO: 2468984 - RNA, 17 nt, Human
aaagcugccuguaguua

SEQ ID NO: 2468985 - RNA, 21 nt, Human
aaagcugccuguaguuaggaa

SEQ ID NO: 2468986 - RNA, 23 nt, Human
aaagcugccuguaguuaggaaau

SEQ ID NO: 2468987 - RNA, 13 nt, Human
aaagcugcugaca

SEQ ID NO: 2468988 - RNA, 21 nt, Human
aaagcugcucagggaaaagca

SEQ ID NO: 2468989 - RNA, 24 nt, Human
ggugauccacccaccucagccucc

SEQ ID NO: 2468990 - RNA, 23 nt, Human
ggugauccacccaccucagccuc

SEQ ID NO: 2468991 - RNA, 18 nt, Human
ggugauccacccaccuca

SEQ ID NO: 2468992 - RNA, 20 nt, Human
ggugauauccauucuuucug

SEQ ID NO: 2468993 - RNA, 23 nt, Human
ggugaaauuuauuaguuaauaua

SEQ ID NO: 2468994 - RNA, 19 nt, Human
ggugaacaaagcagccacg

SEQ ID NO: 2468995 - RNA, 18 nt, Human
ggugaacaaagcagccac

SEQ ID NO: 2468996 - RNA, 14 nt, Human
ggugaaagggagcu

SEQ ID NO: 2468997 - RNA, 16 nt, Human
ggugcaaugaccuuuc

SEQ ID NO: 2468998 - RNA, 13 nt, Human
ggugcaaugaccu

SEQ ID NO: 2468999 - RNA, 12 nt, Human
ggugcaaugacc

SEQ ID NO: 2469000 - RNA, 18 nt, Human
ggugcaaaguucccuacu

SEQ ID NO: 2469001 - RNA, 19 nt, Human
ggugaucaauuaaauguag

SEQ ID NO: 2469002 - RNA, 12 nt, Human
ggugcaaauccu

SEQ ID NO: 2469003 - RNA, 22 nt, Human
ggugcaacccaaggacugaggg

SEQ ID NO: 2469004 - RNA, 13 nt, Human
ggugaacagaaca

SEQ ID NO: 2469005 - RNA, 13 nt, Human
ggugaaagggagc

SEQ ID NO: 2469006 - RNA, 14 nt, Human
ggucgcccaggaga

SEQ ID NO: 2469007 - RNA, 13 nt, Human
ggucgaggcagga

SEQ ID NO: 2469008 - RNA, 15 nt, Human
gguccuuugggguga

SEQ ID NO: 2469009 - RNA, 20 nt, Human
ggucgaccccaaagccccuu

SEQ ID NO: 2469010 - RNA, 14 nt, Human
ggucgcccuggacu

SEQ ID NO: 2469011 - RNA, 12 nt, Human
ggucgcccagga

SEQ ID NO: 2469012 - RNA, 13 nt, Human
ggucgcccaggag

SEQ ID NO: 2469013 - RNA, 19 nt, Human
ggugcuuuuauagaggcua

SEQ ID NO: 2469014 - RNA, 21 nt, Human
ggugcuuguucccucucccug

SEQ ID NO: 2469015 - RNA, 20 nt, Human
ggugcugggaggagggagag

SEQ ID NO: 2469016 - RNA, 17 nt, Human
ggugcaugaucuugagc

SEQ ID NO: 2469017 - RNA, 19 nt, Human
ggugcauuacagagaggag

SEQ ID NO: 2469018 - RNA, 16 nt, Human
gguggaagaggggaca

SEQ ID NO: 2469019 - RNA, 19 nt, Human
gguggaagaagggagaaga

SEQ ID NO: 2469020 - RNA, 21 nt, Human
ggugcuuuuauagaggcuagc

SEQ ID NO: 2469021 - RNA, 19 nt, Human
gguggaaggcccgaggggc

SEQ ID NO: 2469022 - RNA, 16 nt, Human
gguggaaggcccgagg

SEQ ID NO: 2469023 - RNA, 15 nt, Human
gguggaaggaggcgc

SEQ ID NO: 2469024 - RNA, 13 nt, Human
gguggaagcccuc

SEQ ID NO: 2469025 - RNA, 18 nt, Human
gguggaagcccuccuucc

SEQ ID NO: 2469026 - RNA, 19 nt, Human
gguggaagcccuccuucca

SEQ ID NO: 2469027 - RNA, 20 nt, Human
gguggaagcccuccuuccac

SEQ ID NO: 2469028 - RNA, 15 nt, Human
gguggaauuauuuua

SEQ ID NO: 2469029 - RNA, 15 nt, Human
gguggagaagccauu

SEQ ID NO: 2469030 - RNA, 14 nt, Human
gguggagaagccau

SEQ ID NO: 2469031 - RNA, 13 nt, Human
gguggagaagcca

SEQ ID NO: 2469032 - RNA, 20 nt, Human
gguggaggguggggggcgcu

SEQ ID NO: 2469033 - RNA, 21 nt, Human
gguggagccaguaaacagagg

SEQ ID NO: 2469034 - RNA, 23 nt, Human
gguggagggccacaugggaggcu

SEQ ID NO: 2469035 - RNA, 13 nt, Human
gguggagggccac

SEQ ID NO: 2469036 - RNA, 15 nt, Human
gguggaggcuuccug

SEQ ID NO: 2469037 - RNA, 13 nt, Human
gguggaugccugg

SEQ ID NO: 2469038 - RNA, 15 nt, Human
gguggauauaaauau

SEQ ID NO: 2469039 - RNA, 15 nt, Human
gguggaucacagagg

SEQ ID NO: 2469040 - RNA, 16 nt, Human
gguggaucaccugagg

SEQ ID NO: 2469041 - RNA, 20 nt, Human
gguggagguugcagugagcu

SEQ ID NO: 2469042 - RNA, 13 nt, Human
gguggauauaaau

SEQ ID NO: 2469043 - RNA, 16 nt, Human
ggugcugggccccugc

SEQ ID NO: 2469044 - RNA, 15 nt, Human
ggugcugggccccug

SEQ ID NO: 2469045 - RNA, 13 nt, Human
ggugcugggcccc

SEQ ID NO: 2469046 - RNA, 11 nt, Human
ggugcugggcc

SEQ ID NO: 2469047 - RNA, 21 nt, Human
ggugcauauuuauaaaaauaa

SEQ ID NO: 2469048 - RNA, 21 nt, Human
ggugcauuugaggucuguucu

SEQ ID NO: 2469049 - RNA, 18 nt, Human
ggugcaguugacagcagg

SEQ ID NO: 2469050 - RNA, 16 nt, Human
ggugcagugugaaaag

SEQ ID NO: 2469051 - RNA, 20 nt, Human
ggugcaguugacagcaggug

SEQ ID NO: 2469052 - RNA, 16 nt, Human
ggugcaacccuuaccc

SEQ ID NO: 2469053 - RNA, 23 nt, Human
ggugcaacccaaggacugaggga

SEQ ID NO: 2469054 - RNA, 16 nt, Human
ggugcagagugcccag

SEQ ID NO: 2469055 - RNA, 17 nt, Human
ggugcagagugcccaga

SEQ ID NO: 2469056 - RNA, 19 nt, Human
ggugcagagugcccagaac

SEQ ID NO: 2469057 - RNA, 17 nt, Human
aaacuuaaucuaaaugg

SEQ ID NO: 2469058 - RNA, 18 nt, Human
aaacuuaaucuaaaugga

SEQ ID NO: 2469059 - RNA, 16 nt, Human
aaacuuaaucuaaaug

SEQ ID NO: 2469060 - RNA, 14 nt, Human
aaacuuaaucuaaa

SEQ ID NO: 2469061 - RNA, 18 nt, Human
ggguggcccauccccccu

SEQ ID NO: 2469062 - RNA, 13 nt, Human
ggguggcccaucc

SEQ ID NO: 2469063 - RNA, 17 nt, Human
ggguggccgcugagugg

SEQ ID NO: 2469064 - RNA, 21 nt, Human
ggguggccgcugaguggcagg

SEQ ID NO: 2469065 - RNA, 19 nt, Human
ggguggcccauccccccuc

SEQ ID NO: 2469066 - RNA, 22 nt, Human
ggguggccuaagaguugagcuc

SEQ ID NO: 2469067 - RNA, 11 nt, Human
ggguggcccau

SEQ ID NO: 2469068 - RNA, 19 nt, Human
ggguggcaccagcagccug

SEQ ID NO: 2469069 - RNA, 19 nt, Human
aaacuguguauuccaagac

SEQ ID NO: 2469070 - RNA, 14 nt, Human
ggguggcacugcca

SEQ ID NO: 2469071 - RNA, 19 nt, Human
aaacuguguggacugugau

SEQ ID NO: 2469072 - RNA, 20 nt, Human
aaacuguguggacugugaug

SEQ ID NO: 2469073 - RNA, 13 nt, Human
aaacucuccucug

SEQ ID NO: 2469074 - RNA, 22 nt, Human
aaacugcccccucugcccugcg

SEQ ID NO: 2469075 - RNA, 24 nt, Human
aaacucgaggacuguauuugugac

SEQ ID NO: 2469076 - RNA, 23 nt, Human
aaacucgaggacuguauuuguga

SEQ ID NO: 2469077 - RNA, 20 nt, Human
aaacucuaaacauuaaucaa

SEQ ID NO: 2469078 - RNA, 21 nt, Human
aaacucuaaacauuaaucaau

SEQ ID NO: 2469079 - RNA, 13 nt, Human
aaacugcuuguuu

SEQ ID NO: 2469080 - RNA, 14 nt, Human
aaacugcuuguuuc

SEQ ID NO: 2469081 - RNA, 17 nt, Human
aaacugcuuguuuccua

SEQ ID NO: 2469082 - RNA, 19 nt, Human
aaacugcuuguuuccuagc

SEQ ID NO: 2469083 - RNA, 21 nt, Human
aaacugcccccucugcccugc

SEQ ID NO: 2469084 - RNA, 17 nt, Human
aaacugcguuaaaggcu

SEQ ID NO: 2469085 - RNA, 20 nt, Human
aaacuguguacauaacugaa

SEQ ID NO: 2469086 - RNA, 21 nt, Human
aaacuguguacauaacugaaa

SEQ ID NO: 2469087 - RNA, 16 nt, Human
aaacuguguauuccaa

SEQ ID NO: 2469088 - RNA, 18 nt, Human
aaacuguguauuccaaga

SEQ ID NO: 2469089 - RNA, 10 nt, Human
aaacugugua

SEQ ID NO: 2469090 - RNA, 12 nt, Human
aaacugugcacc

SEQ ID NO: 2469091 - RNA, 22 nt, Human
aaacugcuuguuuccuagcaca

SEQ ID NO: 2469092 - RNA, 12 nt, Human
aaacugucccuu

SEQ ID NO: 2469093 - RNA, 11 nt, Human
aaacucaaaug

SEQ ID NO: 2469094 - RNA, 16 nt, Human
aaacucaccauguaaa

SEQ ID NO: 2469095 - RNA, 18 nt, Human
aaacucaccauguaaaag

SEQ ID NO: 2469096 - RNA, 16 nt, Human
aaacucaccugcuggc

SEQ ID NO: 2469097 - RNA, 18 nt, Human
aaacucaccugcuggccc

SEQ ID NO: 2469098 - RNA, 19 nt, Human
aaacucaccugcuggcccc

SEQ ID NO: 2469099 - RNA, 20 nt, Human
aaacucaccugcuggccccu

SEQ ID NO: 2469100 - RNA, 15 nt, Human
aaacucacugcucaa

SEQ ID NO: 2469101 - RNA, 22 nt, Human
aaacucaccugcuggccccuca

SEQ ID NO: 2469102 - RNA, 19 nt, Human
aaacucaaaacuuaacaua

SEQ ID NO: 2469103 - RNA, 18 nt, Human
aaacucaaaacuuaacau

SEQ ID NO: 2469104 - RNA, 13 nt, Human
aaacucaaaauau

SEQ ID NO: 2469105 - RNA, 15 nt, Human
aaacucaaacuuuuc

SEQ ID NO: 2469106 - RNA, 22 nt, Human
aaacucaaaacuuaacauauuu

SEQ ID NO: 2469107 - RNA, 21 nt, Human
aaacucaaaauauuuguacau

SEQ ID NO: 2469108 - RNA, 13 nt, Human
aaacuauuuaacu

SEQ ID NO: 2469109 - RNA, 17 nt, Human
aaacuauuuaacuugag

SEQ ID NO: 2469110 - RNA, 11 nt, Human
aaacuauuuau

SEQ ID NO: 2469111 - RNA, 13 nt, Human
aaacucaaaacuu

SEQ ID NO: 2469112 - RNA, 20 nt, Human
aaacuauuugucuuucagga

SEQ ID NO: 2469113 - RNA, 13 nt, Human
aaacuauuuaucu

SEQ ID NO: 2469114 - RNA, 22 nt, Human
aaacuauuuaucuguguuuuug

SEQ ID NO: 2469115 - RNA, 17 nt, Human
aaacucagggacagagc

SEQ ID NO: 2469116 - RNA, 13 nt, Human
aaacucagggaca

SEQ ID NO: 2469117 - RNA, 23 nt, Human
aaacucaggauggucaucuugga

SEQ ID NO: 2469118 - RNA, 23 nt, Human
aaacucagccucaauaagccuug

SEQ ID NO: 2469119 - RNA, 16 nt, Human
aaacucacugcucaag

SEQ ID NO: 2469120 - RNA, 20 nt, Human
aaacucacugcucaagaaga

SEQ ID NO: 2469121 - RNA, 19 nt, Human
aaacucagggacagagcca

SEQ ID NO: 2469122 - RNA, 18 nt, Human
aaacucagggacagagcc

SEQ ID NO: 2469123 - RNA, 15 nt, Human
aaacucauuuauaaa

SEQ ID NO: 2469124 - RNA, 24 nt, Human
aaacucauuuauaaagcuaaaaua

SEQ ID NO: 2469125 - RNA, 15 nt, Human
aaacucguuaauuug

SEQ ID NO: 2469126 - RNA, 22 nt, Human
aaacucgaggacuguauuugug

SEQ ID NO: 2469127 - RNA, 20 nt, Human
aaacucgaggacuguauuug

SEQ ID NO: 2469128 - RNA, 19 nt, Human
aaacucgaggacuguauuu

SEQ ID NO: 2469129 - RNA, 17 nt, Human
aaacucgaggacuguau

SEQ ID NO: 2469130 - RNA, 15 nt, Human
aaacucauuuccuau

SEQ ID NO: 2469131 - RNA, 16 nt, Human
aaacucgaggacugua

SEQ ID NO: 2469132 - RNA, 18 nt, Human
aaacuaggugcauauuua

SEQ ID NO: 2469133 - RNA, 17 nt, Human
aaacuaggaaauuuuuu

SEQ ID NO: 2469134 - RNA, 16 nt, Human
aaacguaugcauguga

SEQ ID NO: 2469135 - RNA, 16 nt, Human
aaaccuuuuuuaagau

SEQ ID NO: 2469136 - RNA, 15 nt, Human
aaaccuuuuuuaaga

SEQ ID NO: 2469137 - RNA, 17 nt, Human
aaacgguuaaaacuguc

SEQ ID NO: 2469138 - RNA, 15 nt, Human
aaacgguuaaaacug

SEQ ID NO: 2469139 - RNA, 16 nt, Human
aaacuaucaguuuguc

SEQ ID NO: 2469140 - RNA, 16 nt, Human
aaacuaucuuggugaa

SEQ ID NO: 2469141 - RNA, 11 nt, Human
aaacuaucagu

SEQ ID NO: 2469142 - RNA, 22 nt, Human
aaacuaggugcauauuuauaaa

SEQ ID NO: 2469143 - RNA, 17 nt, Human
aaacguaugcaugugaa

SEQ ID NO: 2469144 - RNA, 18 nt, Human
aaacuagggccaagccca

SEQ ID NO: 2469145 - RNA, 15 nt, Human
aaacauuaagauuga

SEQ ID NO: 2469146 - RNA, 20 nt, Human
aaacauuaagaaaaucauau

SEQ ID NO: 2469147 - RNA, 19 nt, Human
aaacauuaagaaaaucaua

SEQ ID NO: 2469148 - RNA, 18 nt, Human
aaacauuaagaaaaucau

SEQ ID NO: 2469149 - RNA, 20 nt, Human
aaacauuaagauugaggccu

SEQ ID NO: 2469150 - RNA, 15 nt, Human
aaacauuaugaugug

SEQ ID NO: 2469151 - RNA, 23 nt, Human
aaacauucugauuuggaaaaaga

SEQ ID NO: 2469152 - RNA, 12 nt, Human
aaacauucuauc

SEQ ID NO: 2469153 - RNA, 16 nt, Human
aaaccaagccguggcu

SEQ ID NO: 2469154 - RNA, 12 nt, Human
aaacauugaaga

SEQ ID NO: 2469155 - RNA, 16 nt, Human
aaacauugaaguaaug

SEQ ID NO: 2469156 - RNA, 20 nt, Human
aaaccacaaggcuguugcau

SEQ ID NO: 2469157 - RNA, 22 nt, Human
aaaccaagggggaugacaugug

SEQ ID NO: 2469158 - RNA, 23 nt, Human
aaaccaagucaagugaaaaagga

SEQ ID NO: 2469159 - RNA, 12 nt, Human
aaaccacagcag

SEQ ID NO: 2469160 - RNA, 18 nt, Human
aaaccucuaauuuauuuu

SEQ ID NO: 2469161 - RNA, 19 nt, Human
aaaccucuaacccaggucu

SEQ ID NO: 2469162 - RNA, 21 nt, Human
aaaccuccaaaacuccugccc

SEQ ID NO: 2469163 - RNA, 21 nt, Human
aaaccacaaggcuguugcaug

SEQ ID NO: 2469164 - RNA, 22 nt, Human
aaaccucacccgaggcugccca

SEQ ID NO: 2469165 - RNA, 18 nt, Human
aaaccuuuuauauuuagu

SEQ ID NO: 2469166 - RNA, 18 nt, Human
aaaccuuuguuugcaucu

SEQ ID NO: 2469167 - RNA, 13 nt, Human
aaaccuuuugaaa

SEQ ID NO: 2469168 - RNA, 20 nt, Human
aaaccuuuuggaaaaucugc

SEQ ID NO: 2469169 - RNA, 15 nt, Human
aaacgggcucagcaa

SEQ ID NO: 2469170 - RNA, 22 nt, Human
aaaccugaaaaaaaguuuacaa

SEQ ID NO: 2469171 - RNA, 18 nt, Human
aaaccugaccccugcuca

SEQ ID NO: 2469172 - RNA, 17 nt, Human
aaaccuuuagggcagcu

SEQ ID NO: 2469173 - RNA, 19 nt, Human
aaaccuuucaaauuucaca

SEQ ID NO: 2469174 - RNA, 11 nt, Human
aaaccuuucaa

SEQ ID NO: 2469175 - RNA, 17 nt, Human
aaaccuuucaaauuuca

SEQ ID NO: 2469176 - RNA, 15 nt, Human
aaaccucugugagca

SEQ ID NO: 2469177 - RNA, 11 nt, Human
aaaccucuguu

SEQ ID NO: 2469178 - RNA, 14 nt, Human
aaaccucuguucag

SEQ ID NO: 2469179 - RNA, 16 nt, Human
aaaccucuguucagug

SEQ ID NO: 2469180 - RNA, 17 nt, Human
aaaccucuguucagugu

SEQ ID NO: 2469181 - RNA, 16 nt, Human
aaaccugaaaaaaagu

SEQ ID NO: 2469182 - RNA, 21 nt, Human
aaaccucuguucaguguaaau

SEQ ID NO: 2469183 - RNA, 16 nt, Human
aaaccucuacuaaaaa

SEQ ID NO: 2469184 - RNA, 24 nt, Human
aaaccucuaauuuauuuugucgaa

SEQ ID NO: 2469185 - RNA, 20 nt, Human
aaaccucuaauuuauuuugu

SEQ ID NO: 2469186 - RNA, 19 nt, Human
aaaccucuaauuuauuuug

SEQ ID NO: 2469187 - RNA, 11 nt, Human
aaaccucuccu

SEQ ID NO: 2469188 - RNA, 22 nt, Human
aaaccucuccucauguucugcu

SEQ ID NO: 2469189 - RNA, 15 nt, Human
ggggguagagcugau

SEQ ID NO: 2469190 - RNA, 14 nt, Human
ggggguagagcuga

SEQ ID NO: 2469191 - RNA, 23 nt, Human
ggggggcccgccuggcagaacug

SEQ ID NO: 2469192 - RNA, 22 nt, Human
gggggucccagugggaggggca

SEQ ID NO: 2469193 - RNA, 18 nt, Human
gggggucccagugggagg

SEQ ID NO: 2469194 - RNA, 16 nt, Human
ggggguccacccagca

SEQ ID NO: 2469195 - RNA, 20 nt, Human
ggggguagagcugauccaga

SEQ ID NO: 2469196 - RNA, 22 nt, Human
gggggcuauagcuacaggaagc

SEQ ID NO: 2469197 - RNA, 19 nt, Human
gggggugcugggccccugc

SEQ ID NO: 2469198 - RNA, 19 nt, Human
ggguccaggggaugggagg

SEQ ID NO: 2469199 - RNA, 17 nt, Human
ggguccagggagcaggc

SEQ ID NO: 2469200 - RNA, 16 nt, Human
ggguccagggagcagg

SEQ ID NO: 2469201 - RNA, 13 nt, Human
ggggguggaggcu

SEQ ID NO: 2469202 - RNA, 17 nt, Human
ggguccccaucauccca

SEQ ID NO: 2469203 - RNA, 22 nt, Human
ggguccccaucaucccagcugc

SEQ ID NO: 2469204 - RNA, 23 nt, Human
gggucccaagcugggccccagcc

SEQ ID NO: 2469205 - RNA, 22 nt, Human
gggucccaagcugggccccagc

SEQ ID NO: 2469206 - RNA, 20 nt, Human
gggucccaagcugggcccca

SEQ ID NO: 2469207 - RNA, 17 nt, Human
gggucccaagcugggcc

SEQ ID NO: 2469208 - RNA, 15 nt, Human
gggucccaagcuggg

SEQ ID NO: 2469209 - RNA, 13 nt, Human
gggucccaagcug

SEQ ID NO: 2469210 - RNA, 12 nt, Human
ggguccaugggc

SEQ ID NO: 2469211 - RNA, 23 nt, Human
gggucccagugggaggggcaggc

SEQ ID NO: 2469212 - RNA, 22 nt, Human
gggucccagugggaggggcagg

SEQ ID NO: 2469213 - RNA, 17 nt, Human
gggucccagugggaggg

SEQ ID NO: 2469214 - RNA, 16 nt, Human
gggucccagugggagg

SEQ ID NO: 2469215 - RNA, 14 nt, Human
gggucccaguggga

SEQ ID NO: 2469216 - RNA, 17 nt, Human
gggucccacuuccccuc

SEQ ID NO: 2469217 - RNA, 16 nt, Human
gggucccagccacccc

SEQ ID NO: 2469218 - RNA, 15 nt, Human
gggucgcccuggacu

SEQ ID NO: 2469219 - RNA, 13 nt, Human
gggucgcccugga

SEQ ID NO: 2469220 - RNA, 16 nt, Human
aaacauuaagaaaauc

SEQ ID NO: 2469221 - RNA, 15 nt, Human
aaacauuaagaaaau

SEQ ID NO: 2469222 - RNA, 14 nt, Human
aaacauuaagaaaa

SEQ ID NO: 2469223 - RNA, 13 nt, Human
aaacauuaagaaa

SEQ ID NO: 2469224 - RNA, 20 nt, Human
gggucggcugaccaugcuca

SEQ ID NO: 2469225 - RNA, 12 nt, Human
aaacauuaagaa

SEQ ID NO: 2469226 - RNA, 15 nt, Human
gggucggcugaccau

SEQ ID NO: 2469227 - RNA, 14 nt, Human
gggucggcugacca

SEQ ID NO: 2469228 - RNA, 23 nt, Human
gggucggaacccaagcuuagaac

SEQ ID NO: 2469229 - RNA, 18 nt, Human
gggggccucagugccacu

SEQ ID NO: 2469230 - RNA, 17 nt, Human
gggggccucagugccac

SEQ ID NO: 2469231 - RNA, 15 nt, Human
gggggccucagugcc

SEQ ID NO: 2469232 - RNA, 12 nt, Human
gggggccucagu

SEQ ID NO: 2469233 - RNA, 23 nt, Human
ggggccuacagcuuugaucccug

SEQ ID NO: 2469234 - RNA, 20 nt, Human
ggggccuaggccucagccag

SEQ ID NO: 2469235 - RNA, 15 nt, Human
ggggccucagugcca

SEQ ID NO: 2469236 - RNA, 14 nt, Human
gggggccaugagcu

SEQ ID NO: 2469237 - RNA, 15 nt, Human
gggggccaugagcuc

SEQ ID NO: 2469238 - RNA, 17 nt, Human
gggggccccagucagcc

SEQ ID NO: 2469239 - RNA, 21 nt, Human
gggggccaugaggccucagug

SEQ ID NO: 2469240 - RNA, 20 nt, Human
gggggccccagucagccucu

SEQ ID NO: 2469241 - RNA, 19 nt, Human
gggggccccagucagccuc

SEQ ID NO: 2469242 - RNA, 21 nt, Human
gggggccccagucagccucuc

SEQ ID NO: 2469243 - RNA, 23 nt, Human
ggggccuaucagugugcccccca

SEQ ID NO: 2469244 - RNA, 19 nt, Human
ggggccuaucagugugccc

SEQ ID NO: 2469245 - RNA, 23 nt, Human
ggggccuaggccucagccagaga

SEQ ID NO: 2469246 - RNA, 12 nt, Human
ggggccucaggu

SEQ ID NO: 2469247 - RNA, 14 nt, Human
gggggccaggugca

SEQ ID NO: 2469248 - RNA, 19 nt, Human
ggggacuuacaugauucau

SEQ ID NO: 2469249 - RNA, 21 nt, Human
ggggcccugguccuuccaggc

SEQ ID NO: 2469250 - RNA, 14 nt, Human
ggggccgcugccac

SEQ ID NO: 2469251 - RNA, 22 nt, Human
ggggccgcugccacccaccucc

SEQ ID NO: 2469252 - RNA, 21 nt, Human
ggggacuagccccuguggaga

SEQ ID NO: 2469253 - RNA, 16 nt, Human
ggggacucagcccuga

SEQ ID NO: 2469254 - RNA, 14 nt, Human
ggggacugucuuuc

SEQ ID NO: 2469255 - RNA, 11 nt, Human
ggggagaaagu

SEQ ID NO: 2469256 - RNA, 14 nt, Human
ggggacucagcccu

SEQ ID NO: 2469257 - RNA, 15 nt, Human
ggggacucagcccug

SEQ ID NO: 2469258 - RNA, 21 nt, Human
ggggacgcugguagagaugga

SEQ ID NO: 2469259 - RNA, 23 nt, Human
ggggacgcugguagagauggagg

SEQ ID NO: 2469260 - RNA, 23 nt, Human
ggggacggggggccccagucagc

SEQ ID NO: 2469261 - RNA, 18 nt, Human
ggggacggggggccccag

SEQ ID NO: 2469262 - RNA, 13 nt, Human
ggggacucagccc

SEQ ID NO: 2469263 - RNA, 21 nt, Human
ggggacccaauguaggagcug

SEQ ID NO: 2469264 - RNA, 15 nt, Human
ggggacccccgcccc

SEQ ID NO: 2469265 - RNA, 13 nt, Human
ggggacccccgcc

SEQ ID NO: 2469266 - RNA, 11 nt, Human
ggggacccugu

SEQ ID NO: 2469267 - RNA, 18 nt, Human
ggggacccccgcccccug

SEQ ID NO: 2469268 - RNA, 15 nt, Human
aaacagucucaggaa

SEQ ID NO: 2469269 - RNA, 16 nt, Human
aaacauggccuuugcu

SEQ ID NO: 2469270 - RNA, 14 nt, Human
aaacaguagugaua

SEQ ID NO: 2469271 - RNA, 17 nt, Human
aaacaggucaauacagu

SEQ ID NO: 2469272 - RNA, 17 nt, Human
aaacauggccuuugcuu

SEQ ID NO: 2469273 - RNA, 17 nt, Human
aaacaugguuacaauca

SEQ ID NO: 2469274 - RNA, 15 nt, Human
aaacaugguuacaau

SEQ ID NO: 2469275 - RNA, 22 nt, Human
aaacaugggguuggcugggccc

SEQ ID NO: 2469276 - RNA, 21 nt, Human
aaacaugguagaauuggagag

SEQ ID NO: 2469277 - RNA, 17 nt, Human
aaacauguuagaagcaa

SEQ ID NO: 2469278 - RNA, 22 nt, Human
aaacaugucuccuauccugguu

SEQ ID NO: 2469279 - RNA, 18 nt, Human
aaacauguacaaaaucga

SEQ ID NO: 2469280 - RNA, 16 nt, Human
aaacauguuagaagca

SEQ ID NO: 2469281 - RNA, 14 nt, Human
aaacauguguuuua

SEQ ID NO: 2469282 - RNA, 13 nt, Human
ggggaaggcaggg

SEQ ID NO: 2469283 - RNA, 23 nt, Human
ggggaagggccagucugggcugc

SEQ ID NO: 2469284 - RNA, 22 nt, Human
ggggaagggccagucugggcug

SEQ ID NO: 2469285 - RNA, 13 nt, Human
ggggaagggccag

SEQ ID NO: 2469286 - RNA, 13 nt, Human
ggggaagcccugg

SEQ ID NO: 2469287 - RNA, 16 nt, Human
ggggaagaguguacug

SEQ ID NO: 2469288 - RNA, 18 nt, Human
ggggaagagcacagcccu

SEQ ID NO: 2469289 - RNA, 14 nt, Human
ggggaagagcacag

SEQ ID NO: 2469290 - RNA, 14 nt, Human
ggggaagcccugga

SEQ ID NO: 2469291 - RNA, 22 nt, Human
ggggaauguuugccucugccuc

SEQ ID NO: 2469292 - RNA, 18 nt, Human
ggggaauguuugccucug

SEQ ID NO: 2469293 - RNA, 16 nt, Human
ggggaccagagcugcc

SEQ ID NO: 2469294 - RNA, 15 nt, Human
ggggaccagagcugc

SEQ ID NO: 2469295 - RNA, 22 nt, Human
ggggacagaggccugcccgggc

SEQ ID NO: 2469296 - RNA, 19 nt, Human
ggggaauugaggacacuga

SEQ ID NO: 2469297 - RNA, 16 nt, Human
ggggaaguccucuggg

SEQ ID NO: 2469298 - RNA, 15 nt, Human
ggggaauucaucucu

SEQ ID NO: 2469299 - RNA, 13 nt, Human
gggaugagaaagg

SEQ ID NO: 2469300 - RNA, 20 nt, Human
gggaugagcauggagcuggc

SEQ ID NO: 2469301 - RNA, 16 nt, Human
gggaugagaagagggg

SEQ ID NO: 2469302 - RNA, 15 nt, Human
gggaugagaguuuug

SEQ ID NO: 2469303 - RNA, 20 nt, Human
gggaugacaugcacucagcu

SEQ ID NO: 2469304 - RNA, 17 nt, Human
gggaugacuagaggcag

SEQ ID NO: 2469305 - RNA, 15 nt, Human
gggaugacugugauu

SEQ ID NO: 2469306 - RNA, 23 nt, Human
gggaugacuagaggcagggaggg

SEQ ID NO: 2469307 - RNA, 16 nt, Human
aaaauguucagaaggu

SEQ ID NO: 2469308 - RNA, 16 nt, Human
aaaauguuauuuaaca

SEQ ID NO: 2469309 - RNA, 22 nt, Human
gggaugaugccacaccaagcug

SEQ ID NO: 2469310 - RNA, 20 nt, Human
gggaugagcucaagcaggaa

SEQ ID NO: 2469311 - RNA, 15 nt, Human
gggaugagccgcugu

SEQ ID NO: 2469312 - RNA, 21 nt, Human
gggaugagcauggagcuggcc

SEQ ID NO: 2469313 - RNA, 17 nt, Human
gggaugccaucuguggg

SEQ ID NO: 2469314 - RNA, 17 nt, Human
aaaauguugaaaaguca

SEQ ID NO: 2469315 - RNA, 19 nt, Human
aaaauguugaaaagucaaa

SEQ ID NO: 2469316 - RNA, 13 nt, Human
aaaauguugaaaa

SEQ ID NO: 2469317 - RNA, 22 nt, Human
aaaauguuggauuuauaaaugc

SEQ ID NO: 2469318 - RNA, 20 nt, Human
aaaauguuggauuuauaaau

SEQ ID NO: 2469319 - RNA, 19 nt, Human
aaaauguuggauuuauaaa

SEQ ID NO: 2469320 - RNA, 15 nt, Human
aaaauguuggauuua

SEQ ID NO: 2469321 - RNA, 14 nt, Human
aaaauguugagaau

SEQ ID NO: 2469322 - RNA, 18 nt, Human
aaaauguuuuagcaauuu

SEQ ID NO: 2469323 - RNA, 15 nt, Human
aaaauguuuuagcaa

SEQ ID NO: 2469324 - RNA, 21 nt, Human
aaaauguuggucauuuuaugu

SEQ ID NO: 2469325 - RNA, 14 nt, Human
aaaauuuaagcauu

SEQ ID NO: 2469326 - RNA, 15 nt, Human
aaaauuuaagcauug

SEQ ID NO: 2469327 - RNA, 16 nt, Human
aaaauuuaagcauugu

SEQ ID NO: 2469328 - RNA, 15 nt, Human
aaaauuuaagugcgu

SEQ ID NO: 2469329 - RNA, 19 nt, Human
aaaauuuaaguaucuuuuu

SEQ ID NO: 2469330 - RNA, 21 nt, Human
aaaauuuaagcauuguuugcu

SEQ ID NO: 2469331 - RNA, 23 nt, Human
aaaauuuaagcauuguuugcuua

SEQ ID NO: 2469332 - RNA, 22 nt, Human
aaaauuuguuuugacggaugau

SEQ ID NO: 2469333 - RNA, 21 nt, Human
aaaauuuuauaaaauuaagca

SEQ ID NO: 2469334 - RNA, 20 nt, Human
aaaauuucaacaaguagcua

SEQ ID NO: 2469335 - RNA, 16 nt, Human
aaaauuuguuuugacg

SEQ ID NO: 2469336 - RNA, 23 nt, Human
aaaauuuaguuuuuguucuuaau

SEQ ID NO: 2469337 - RNA, 19 nt, Human
aaaauuuaguuuuuguucu

SEQ ID NO: 2469338 - RNA, 16 nt, Human
aaaauuuaguuuuugu

SEQ ID NO: 2469339 - RNA, 15 nt, Human
aaaauuuaguuuuug

SEQ ID NO: 2469340 - RNA, 23 nt, Human
aaaauuuaagugcguguguagag

SEQ ID NO: 2469341 - RNA, 18 nt, Human
aaaauuuaagugcgugug

SEQ ID NO: 2469342 - RNA, 19 nt, Human
aaaauuuagaaauauaauu

SEQ ID NO: 2469343 - RNA, 17 nt, Human
aaacaaagguugagaug

SEQ ID NO: 2469344 - RNA, 22 nt, Human
aaacaaagcuuagcaggagagg

SEQ ID NO: 2469345 - RNA, 17 nt, Human
aaacaaagcuuagcagg

SEQ ID NO: 2469346 - RNA, 15 nt, Human
aaacaaagcuuagca

SEQ ID NO: 2469347 - RNA, 14 nt, Human
aaaauuuuauagcu

SEQ ID NO: 2469348 - RNA, 13 nt, Human
aaacaaagccaga

SEQ ID NO: 2469349 - RNA, 20 nt, Human
aaaauuuugauguuuuaagg

SEQ ID NO: 2469350 - RNA, 13 nt, Human
aaaauuuuauucc

SEQ ID NO: 2469351 - RNA, 12 nt, Human
aaacacagcaag

SEQ ID NO: 2469352 - RNA, 14 nt, Human
aaacacagcaaggg

SEQ ID NO: 2469353 - RNA, 16 nt, Human
aaacacaguuacacuu

SEQ ID NO: 2469354 - RNA, 13 nt, Human
aaacacaguuaca

SEQ ID NO: 2469355 - RNA, 18 nt, Human
aaacacaguuacacuugu

SEQ ID NO: 2469356 - RNA, 20 nt, Human
aaacacaaaaguuagcugag

SEQ ID NO: 2469357 - RNA, 21 nt, Human
aaacacagacauucugccagg

SEQ ID NO: 2469358 - RNA, 20 nt, Human
aaacacaguguuuuuguaaa

SEQ ID NO: 2469359 - RNA, 19 nt, Human
aaacacaguguuuuuguaa

SEQ ID NO: 2469360 - RNA, 16 nt, Human
aaacacaguguuuuug

SEQ ID NO: 2469361 - RNA, 11 nt, Human
aaacacauuuu

SEQ ID NO: 2469362 - RNA, 18 nt, Human
aaacacaucuuuccuguc

SEQ ID NO: 2469363 - RNA, 14 nt, Human
aaacacaucuuccc

SEQ ID NO: 2469364 - RNA, 16 nt, Human
aaacacaucuucccua

SEQ ID NO: 2469365 - RNA, 19 nt, Human
aaacaaauucauauucugu

SEQ ID NO: 2469366 - RNA, 17 nt, Human
aaacaaauaugcaaaag

SEQ ID NO: 2469367 - RNA, 14 nt, Human
aaacaaauaugcaa

SEQ ID NO: 2469368 - RNA, 13 nt, Human
aaacaaauaugca

SEQ ID NO: 2469369 - RNA, 17 nt, Human
aaacaaaguuacuaggu

SEQ ID NO: 2469370 - RNA, 23 nt, Human
aaacaaagcuuagcaggagagga

SEQ ID NO: 2469371 - RNA, 12 nt, Human
aaacaaauaugc

SEQ ID NO: 2469372 - RNA, 15 nt, Human
aaacaauaaaugugc

SEQ ID NO: 2469373 - RNA, 16 nt, Human
aaacaauaaaugugca

SEQ ID NO: 2469374 - RNA, 16 nt, Human
aaacaacaauuucuac

SEQ ID NO: 2469375 - RNA, 21 nt, Human
aaacaaauucauauucugucu

SEQ ID NO: 2469376 - RNA, 22 nt, Human
aaacaauaguaauucucaggcc

SEQ ID NO: 2469377 - RNA, 21 nt, Human
aaacaauacucauaaugugaa

SEQ ID NO: 2469378 - RNA, 14 nt, Human
aaacaauauuguuu

SEQ ID NO: 2469379 - RNA, 15 nt, Human
aaacaauauuguuuc

SEQ ID NO: 2469380 - RNA, 11 nt, Human
aaacacagcaa

SEQ ID NO: 2469381 - RNA, 19 nt, Human
aaacacaaacgggcucagc

SEQ ID NO: 2469382 - RNA, 16 nt, Human
aaacaauauuguuucu

SEQ ID NO: 2469383 - RNA, 17 nt, Human
aaacaauauuguuucua

SEQ ID NO: 2469384 - RNA, 15 nt, Human
guaaagaaagagaga

SEQ ID NO: 2469385 - RNA, 16 nt, Human
guaaagaaagagagaa

SEQ ID NO: 2469386 - RNA, 17 nt, Human
guaaagaaagagagaaa

SEQ ID NO: 2469387 - RNA, 18 nt, Human
guaaagaaagagagaaaa

SEQ ID NO: 2469388 - RNA, 19 nt, Human
guaaagaaagagagaaaau

SEQ ID NO: 2469389 - RNA, 20 nt, Human
guaaagaaagagagaaaaua

SEQ ID NO: 2469390 - RNA, 21 nt, Human
guaaagaaagagagaaaauaa

SEQ ID NO: 2469391 - RNA, 22 nt, Human
guaaagaaagagagaaaauaaa

SEQ ID NO: 2469392 - RNA, 16 nt, Human
guaaacuguggaugau

SEQ ID NO: 2469393 - RNA, 20 nt, Human
guaaacuguguauuccaaga

SEQ ID NO: 2469394 - RNA, 16 nt, Human
guaaacuuuuugugcu

SEQ ID NO: 2469395 - RNA, 14 nt, Human
guaaagaaagagag

SEQ ID NO: 2469396 - RNA, 15 nt, Human
guaacugcugaaaac

SEQ ID NO: 2469397 - RNA, 14 nt, Human
guaacugcugaaaa

SEQ ID NO: 2469398 - RNA, 19 nt, Human
guaacucuaauucccauuu

SEQ ID NO: 2469399 - RNA, 22 nt, Human
guaacugcauugagaacugcau

SEQ ID NO: 2469400 - RNA, 18 nt, Human
guaacugcauugagaacu

SEQ ID NO: 2469401 - RNA, 19 nt, Human
guaacugcauugagaacug

SEQ ID NO: 2469402 - RNA, 15 nt, Human
guaacucaucuguca

SEQ ID NO: 2469403 - RNA, 13 nt, Human
guaacucaucugu

SEQ ID NO: 2469404 - RNA, 23 nt, Human
guaaagaaagagagaaaauaaaa

SEQ ID NO: 2469405 - RNA, 21 nt, Human
guaaagaaauuuaaaagacac

SEQ ID NO: 2469406 - RNA, 23 nt, Human
guaacucuaauucccauuuugca

SEQ ID NO: 2469407 - RNA, 12 nt, Human
guaacuccacca

SEQ ID NO: 2469408 - RNA, 17 nt, Human
guaacuccaccaaccca

SEQ ID NO: 2469409 - RNA, 13 nt, Human
guaacugacaacu

SEQ ID NO: 2469410 - RNA, 20 nt, Human
guaauaggcguaacuaauuu

SEQ ID NO: 2469411 - RNA, 17 nt, Human
guaauagauuauaguug

SEQ ID NO: 2469412 - RNA, 19 nt, Human
guaauaagacauaacguuu

SEQ ID NO: 2469413 - RNA, 14 nt, Human
guaauaagacauaa

SEQ ID NO: 2469414 - RNA, 13 nt, Human
guaauaagacaua

SEQ ID NO: 2469415 - RNA, 13 nt, Human
guaauauauugcu

SEQ ID NO: 2469416 - RNA, 12 nt, Human
guaauauauugc

SEQ ID NO: 2469417 - RNA, 16 nt, Human
guaauaaauaugagug

SEQ ID NO: 2469418 - RNA, 14 nt, Human
guaauaaauaugag

SEQ ID NO: 2469419 - RNA, 13 nt, Human
guaauaaauauga

SEQ ID NO: 2469420 - RNA, 22 nt, Human
guaauaacugugaaguuuacau

SEQ ID NO: 2469421 - RNA, 16 nt, Human
guaauaacugugaagu

SEQ ID NO: 2469422 - RNA, 15 nt, Human
guaauaacugugaag

SEQ ID NO: 2469423 - RNA, 14 nt, Human
guaacuggcugugu

SEQ ID NO: 2469424 - RNA, 15 nt, Human
guaauaaacuuuaau

SEQ ID NO: 2469425 - RNA, 12 nt, Human
guaauaaauaug

SEQ ID NO: 2469426 - RNA, 11 nt, Human
guaauaaauau

SEQ ID NO: 2469427 - RNA, 21 nt, Human
guaauuuaaacaggcccagca

SEQ ID NO: 2469428 - RNA, 20 nt, Human
guaauuuaaacaggcccagc

SEQ ID NO: 2469429 - RNA, 17 nt, Human
guaauuuaguuauugau

SEQ ID NO: 2469430 - RNA, 19 nt, Human
guaauuuaaacaggcccag

SEQ ID NO: 2469431 - RNA, 16 nt, Human
guaauuuaaacaggcc

SEQ ID NO: 2469432 - RNA, 14 nt, Human
guaauuuaaacagg

SEQ ID NO: 2469433 - RNA, 23 nt, Human
guaauuuaaaauugugauguguc

SEQ ID NO: 2469434 - RNA, 16 nt, Human
guaauuugaggacaac

SEQ ID NO: 2469435 - RNA, 22 nt, Human
guaauuugugauacaaugcugu

SEQ ID NO: 2469436 - RNA, 22 nt, Human
guaauuucuuugccuguucagu

SEQ ID NO: 2469437 - RNA, 23 nt, Human
guaauuugagagaaauaugaaga

SEQ ID NO: 2469438 - RNA, 14 nt, Human
guaauuucuuugcc

SEQ ID NO: 2469439 - RNA, 13 nt, Human
guaauuucuuugc

SEQ ID NO: 2469440 - RNA, 11 nt, Human
guaauuuauuu

SEQ ID NO: 2469441 - RNA, 19 nt, Human
guaauuuaaaauugugaug

SEQ ID NO: 2469442 - RNA, 20 nt, Human
guaauuuaaaauugugaugu

SEQ ID NO: 2469443 - RNA, 17 nt, Human
guaauuguuguuuguau

SEQ ID NO: 2469444 - RNA, 19 nt, Human
guaauuguuguuuguaugu

SEQ ID NO: 2469445 - RNA, 21 nt, Human
guaauuguuguuuguauguau

SEQ ID NO: 2469446 - RNA, 23 nt, Human
guaauuguuguuuguauguauaa

SEQ ID NO: 2469447 - RNA, 21 nt, Human
guaauuguugcuaaucuucuu

SEQ ID NO: 2469448 - RNA, 12 nt, Human
guaaucccagcu

SEQ ID NO: 2469449 - RNA, 17 nt, Human
guaaucccagcuacuca

SEQ ID NO: 2469450 - RNA, 18 nt, Human
guaaucccagcuacucag

SEQ ID NO: 2469451 - RNA, 21 nt, Human
guaaucccagcuacucaggag

SEQ ID NO: 2469452 - RNA, 14 nt, Human
guaauaugcacaca

SEQ ID NO: 2469453 - RNA, 16 nt, Human
guaauaugcacacauu

SEQ ID NO: 2469454 - RNA, 17 nt, Human
guaauaugcacacauuu

SEQ ID NO: 2469455 - RNA, 18 nt, Human
guaauaugcacacauuuu

SEQ ID NO: 2469456 - RNA, 21 nt, Human
guaauccaagcaaaugugaau

SEQ ID NO: 2469457 - RNA, 20 nt, Human
guaauauauugcugcuggua

SEQ ID NO: 2469458 - RNA, 18 nt, Human
guaauauauugcugcugg

SEQ ID NO: 2469459 - RNA, 16 nt, Human
guaauauauugcugcu

SEQ ID NO: 2469460 - RNA, 15 nt, Human
guaauauauugcugc

SEQ ID NO: 2469461 - RNA, 22 nt, Human
guaaucauuucuugggcccucc

SEQ ID NO: 2469462 - RNA, 23 nt, Human
guaaucauuucuugggcccuccu

SEQ ID NO: 2469463 - RNA, 20 nt, Human
guaaucccagcacuuuggga

SEQ ID NO: 2469464 - RNA, 18 nt, Human
guaaucccagcacuuugg

SEQ ID NO: 2469465 - RNA, 13 nt, Human
guaaucccagcag

SEQ ID NO: 2469466 - RNA, 15 nt, Human
guaaucccagcacuu

SEQ ID NO: 2469467 - RNA, 16 nt, Human
guaaucccagcacuuu

SEQ ID NO: 2469468 - RNA, 14 nt, Human
guaaucccagcacu

SEQ ID NO: 2469469 - RNA, 17 nt, Human
guaauccaucacuagcc

SEQ ID NO: 2469470 - RNA, 12 nt, Human
guaaucccagca

SEQ ID NO: 2469471 - RNA, 15 nt, Human
guaauccaccugccu

SEQ ID NO: 2469472 - RNA, 21 nt, Human
aaauaauuuuuauauuugaaa

SEQ ID NO: 2469473 - RNA, 23 nt, Human
guacacugccuucucaacuccaa

SEQ ID NO: 2469474 - RNA, 17 nt, Human
guacacguguccuguag

SEQ ID NO: 2469475 - RNA, 14 nt, Human
guacacugaauauu

SEQ ID NO: 2469476 - RNA, 15 nt, Human
guacacugaauauuu

SEQ ID NO: 2469477 - RNA, 15 nt, Human
guacacguguccugu

SEQ ID NO: 2469478 - RNA, 14 nt, Human
guacacguguccug

SEQ ID NO: 2469479 - RNA, 21 nt, Human
guaauuuuguucuaguuuuca

SEQ ID NO: 2469480 - RNA, 21 nt, Human
guaauuuuuuuaauuuacaaa

SEQ ID NO: 2469481 - RNA, 20 nt, Human
guacacagcucuagacacug

SEQ ID NO: 2469482 - RNA, 14 nt, Human
guaauuuugccaaa

SEQ ID NO: 2469483 - RNA, 18 nt, Human
guaauuuuauaugaagau

SEQ ID NO: 2469484 - RNA, 15 nt, Human
guaauuuuauaugaa

SEQ ID NO: 2469485 - RNA, 15 nt, Human
aaauacacacucaaa

SEQ ID NO: 2469486 - RNA, 23 nt, Human
aaauaauuuuuauauuugaaaua

SEQ ID NO: 2469487 - RNA, 22 nt, Human
aaauaauuuuuauauuugaaau

SEQ ID NO: 2469488 - RNA, 15 nt, Human
aaauacaaaacuucc

SEQ ID NO: 2469489 - RNA, 17 nt, Human
aaauacagcuggauugg

SEQ ID NO: 2469490 - RNA, 23 nt, Human
aaauacagauuuugauagcaaag

SEQ ID NO: 2469491 - RNA, 17 nt, Human
aaauacagauuuugaua

SEQ ID NO: 2469492 - RNA, 22 nt, Human
aaauacagacacuaaguuauag

SEQ ID NO: 2469493 - RNA, 15 nt, Human
aaauacagauuuuga

SEQ ID NO: 2469494 - RNA, 20 nt, Human
aaauacaguuugucacauga

SEQ ID NO: 2469495 - RNA, 22 nt, Human
aaauacaguuugucacaugaaa

SEQ ID NO: 2469496 - RNA, 22 nt, Human
aaauacagucuuccauuugcaa

SEQ ID NO: 2469497 - RNA, 23 nt, Human
aaauacagucuuccauuugcaag

SEQ ID NO: 2469498 - RNA, 16 nt, Human
aaauacauauuuccaa

SEQ ID NO: 2469499 - RNA, 13 nt, Human
aaauacaugacau

SEQ ID NO: 2469500 - RNA, 14 nt, Human
aaauacaugcaucu

SEQ ID NO: 2469501 - RNA, 17 nt, Human
aaauacagacacuaagu

SEQ ID NO: 2469502 - RNA, 16 nt, Human
aaauacagacacuaag

SEQ ID NO: 2469503 - RNA, 14 nt, Human
aaauacagacacua

SEQ ID NO: 2469504 - RNA, 23 nt, Human
aaauacaccaccucacuccuguu

SEQ ID NO: 2469505 - RNA, 22 nt, Human
aaauacaccaccucacuccugu

SEQ ID NO: 2469506 - RNA, 21 nt, Human
aaauacaccaccucacuccug

SEQ ID NO: 2469507 - RNA, 17 nt, Human
aaauacacaaguaaaca

SEQ ID NO: 2469508 - RNA, 17 nt, Human
aaauacagauagauaua

SEQ ID NO: 2469509 - RNA, 19 nt, Human
aaauacacacucaaaucaa

SEQ ID NO: 2469510 - RNA, 19 nt, Human
aaauacaacuuaaauaaua

SEQ ID NO: 2469511 - RNA, 18 nt, Human
aaauacacauagcaugua

SEQ ID NO: 2469512 - RNA, 18 nt, Human
aaauaccagccaguaaau

SEQ ID NO: 2469513 - RNA, 20 nt, Human
aaauacuauuuaaagccucc

SEQ ID NO: 2469514 - RNA, 15 nt, Human
aaauacuacuccugu

SEQ ID NO: 2469515 - RNA, 14 nt, Human
aaauacuacuccug

SEQ ID NO: 2469516 - RNA, 23 nt, Human
aaauaccaaaauuauuucagaaa

SEQ ID NO: 2469517 - RNA, 21 nt, Human
aaauaccaaaauuauuucaga

SEQ ID NO: 2469518 - RNA, 16 nt, Human
aaauacucauguguau

SEQ ID NO: 2469519 - RNA, 15 nt, Human
aaauacucaugugua

SEQ ID NO: 2469520 - RNA, 14 nt, Human
aaauacucaugugu

SEQ ID NO: 2469521 - RNA, 22 nt, Human
aaauacuauuuuuacugccacu

SEQ ID NO: 2469522 - RNA, 21 nt, Human
aaauacuauuuuuacugccac

SEQ ID NO: 2469523 - RNA, 16 nt, Human
aaauacuauuuuuacu

SEQ ID NO: 2469524 - RNA, 17 nt, Human
aaauacugccagaugcu

SEQ ID NO: 2469525 - RNA, 13 nt, Human
aaauacugccaga

SEQ ID NO: 2469526 - RNA, 17 nt, Human
aaauacugcaagaaaau

SEQ ID NO: 2469527 - RNA, 21 nt, Human
aaauacucauguguaugggca

SEQ ID NO: 2469528 - RNA, 17 nt, Human
aaauacucauguguaug

SEQ ID NO: 2469529 - RNA, 20 nt, Human
aaauacugccagaugcugau

SEQ ID NO: 2469530 - RNA, 18 nt, Human
aaauacugccagaugcug

SEQ ID NO: 2469531 - RNA, 14 nt, Human
aaauacuguacaau

SEQ ID NO: 2469532 - RNA, 15 nt, Human
aaauacuguacaaug

SEQ ID NO: 2469533 - RNA, 14 nt, Human
aaauauaauugaca

SEQ ID NO: 2469534 - RNA, 23 nt, Human
aaauacugccagaugcugauguu

SEQ ID NO: 2469535 - RNA, 15 nt, Human
aaauauacacacagc

SEQ ID NO: 2469536 - RNA, 21 nt, Human
aaaguacuucuccacccugcu

SEQ ID NO: 2469537 - RNA, 20 nt, Human
aaaguacuucuccacccugc

SEQ ID NO: 2469538 - RNA, 16 nt, Human
aaaguaguccugugaa

SEQ ID NO: 2469539 - RNA, 21 nt, Human
aaaguaguaaaaauuaaaaaa

SEQ ID NO: 2469540 - RNA, 23 nt, Human
aaaguacuucuccacccugcucu

SEQ ID NO: 2469541 - RNA, 18 nt, Human
aaaguauguuagugcaaa

SEQ ID NO: 2469542 - RNA, 18 nt, Human
aaaguaucccuacuguaa

SEQ ID NO: 2469543 - RNA, 14 nt, Human
aaaguaguaaaaau

SEQ ID NO: 2469544 - RNA, 13 nt, Human
aaaguauauauag

SEQ ID NO: 2469545 - RNA, 17 nt, Human
aaaguauauauagaauc

SEQ ID NO: 2469546 - RNA, 18 nt, Human
aaaguauauauagaaucu

SEQ ID NO: 2469547 - RNA, 22 nt, Human
aaaguauauauauauauuauau

SEQ ID NO: 2469548 - RNA, 14 nt, Human
aaaguauauauuua

SEQ ID NO: 2469549 - RNA, 15 nt, Human
aaaguauauauuuau

SEQ ID NO: 2469550 - RNA, 23 nt, Human
aaaguauauauuuauuuaagcuu

SEQ ID NO: 2469551 - RNA, 15 nt, Human
aaaguaucaugcauu

SEQ ID NO: 2469552 - RNA, 14 nt, Human
aaaguaucaugcau

SEQ ID NO: 2469553 - RNA, 12 nt, Human
aaaguaucaugc

SEQ ID NO: 2469554 - RNA, 14 nt, Human
aaaguauauguuag

SEQ ID NO: 2469555 - RNA, 20 nt, Human
aaaguacacuguuucaaacu

SEQ ID NO: 2469556 - RNA, 14 nt, Human
aaagguauaauuuu

SEQ ID NO: 2469557 - RNA, 20 nt, Human
aaagguauuuuaaucaccaa

SEQ ID NO: 2469558 - RNA, 16 nt, Human
aaaggguuuuaaugua

SEQ ID NO: 2469559 - RNA, 16 nt, Human
aaaggguguuuuucug

SEQ ID NO: 2469560 - RNA, 14 nt, Human
aaaggguguacuua

SEQ ID NO: 2469561 - RNA, 16 nt, Human
aaagguauaauuuuau

SEQ ID NO: 2469562 - RNA, 15 nt, Human
aaaguacauuuaaua

SEQ ID NO: 2469563 - RNA, 14 nt, Human
aaaguacauuuaau

SEQ ID NO: 2469564 - RNA, 13 nt, Human
aaaguacauuuaa

SEQ ID NO: 2469565 - RNA, 12 nt, Human
aaaguacauuua

SEQ ID NO: 2469566 - RNA, 19 nt, Human
aaaguacuucuccacccug

SEQ ID NO: 2469567 - RNA, 14 nt, Human
aaaggugaaggaau

SEQ ID NO: 2469568 - RNA, 16 nt, Human
aaaguacauguuaaac

SEQ ID NO: 2469569 - RNA, 22 nt, Human
aaaguauucuucucuuccuuuu

SEQ ID NO: 2469570 - RNA, 12 nt, Human
aaaguauucuuc

SEQ ID NO: 2469571 - RNA, 19 nt, Human
aaaguauucuguacucuua

SEQ ID NO: 2469572 - RNA, 20 nt, Human
aaaguauuuaauuagugcua

SEQ ID NO: 2469573 - RNA, 19 nt, Human
aaaguauuuaauuagugcu

SEQ ID NO: 2469574 - RNA, 18 nt, Human
aaaguauuuaauuagugc

SEQ ID NO: 2469575 - RNA, 17 nt, Human
aaaguauuuaauuagug

SEQ ID NO: 2469576 - RNA, 23 nt, Human
aaaguauuuaauuagugcuaagu

SEQ ID NO: 2469577 - RNA, 21 nt, Human
aaaguauuuaauuagugcuaa

SEQ ID NO: 2469578 - RNA, 16 nt, Human
aaaguaucaugcauuc

SEQ ID NO: 2469579 - RNA, 15 nt, Human
aaaguauuauuuucc

SEQ ID NO: 2469580 - RNA, 16 nt, Human
aaaguauuauuuucca

SEQ ID NO: 2469581 - RNA, 17 nt, Human
aaaguauuauuuuccaa

SEQ ID NO: 2469582 - RNA, 17 nt, Human
aaaguucuguaaaauau

SEQ ID NO: 2469583 - RNA, 16 nt, Human
aaaguucuagugaccg

SEQ ID NO: 2469584 - RNA, 14 nt, Human
aaaguucuguacuc

SEQ ID NO: 2469585 - RNA, 23 nt, Human
aaaguucugcagauaaacaguag

SEQ ID NO: 2469586 - RNA, 21 nt, Human
aaaguucuguacucaaaugua

SEQ ID NO: 2469587 - RNA, 12 nt, Human
aaaguugaaauu

SEQ ID NO: 2469588 - RNA, 15 nt, Human
aaaguuacuagguaa

SEQ ID NO: 2469589 - RNA, 20 nt, Human
aaaguuacuagguaacuuca

SEQ ID NO: 2469590 - RNA, 22 nt, Human
aaaguuacugauucacugcaug

SEQ ID NO: 2469591 - RNA, 21 nt, Human
aaaguuacuagguaacuucau

SEQ ID NO: 2469592 - RNA, 19 nt, Human
aaaguuacuaccugucaag

SEQ ID NO: 2469593 - RNA, 12 nt, Human
aaaguuacuagg

SEQ ID NO: 2469594 - RNA, 14 nt, Human
aaaguuagucuacu

SEQ ID NO: 2469595 - RNA, 14 nt, Human
aaaguuagcugagc

SEQ ID NO: 2469596 - RNA, 20 nt, Human
aaaguuacuuugucagaggc

SEQ ID NO: 2469597 - RNA, 16 nt, Human
aaaguuauauagguuu

SEQ ID NO: 2469598 - RNA, 23 nt, Human
aaaguuagucuacucuuaagcca

SEQ ID NO: 2469599 - RNA, 21 nt, Human
aaaguuauuaauauuuuaauu

SEQ ID NO: 2469600 - RNA, 22 nt, Human
guaaaccccuuuaguggcuuca

SEQ ID NO: 2469601 - RNA, 24 nt, Human
guaaacugugcaccaagcaggaaa

SEQ ID NO: 2469602 - RNA, 13 nt, Human
guaaaccaaagcc

SEQ ID NO: 2469603 - RNA, 22 nt, Human
guaaacauguguuuuaauucca

SEQ ID NO: 2469604 - RNA, 20 nt, Human
guaaacauguguuuuaauuc

SEQ ID NO: 2469605 - RNA, 14 nt, Human
guaaacauguguuu

SEQ ID NO: 2469606 - RNA, 22 nt, Human
guaaacagugccugcugaauga

SEQ ID NO: 2469607 - RNA, 23 nt, Human
guaaacauaauucuuguauauua

SEQ ID NO: 2469608 - RNA, 13 nt, Human
guaaacagugccu

SEQ ID NO: 2469609 - RNA, 14 nt, Human
guaaacagugccug

SEQ ID NO: 2469610 - RNA, 15 nt, Human
guaaacagugccugc

SEQ ID NO: 2469611 - RNA, 17 nt, Human
guaaacagugccugcug

SEQ ID NO: 2469612 - RNA, 18 nt, Human
guaaacagugccugcuga

SEQ ID NO: 2469613 - RNA, 20 nt, Human
guaaacagugccugcugaau

SEQ ID NO: 2469614 - RNA, 14 nt, Human
aaauaauuuuaaac

SEQ ID NO: 2469615 - RNA, 18 nt, Human
aaauaauuuuaaacaaag

SEQ ID NO: 2469616 - RNA, 20 nt, Human
aaauaauuuuaaacaaaggu

SEQ ID NO: 2469617 - RNA, 12 nt, Human
aaauaauuuuaa

SEQ ID NO: 2469618 - RNA, 17 nt, Human
aaauaauugauuucaag

SEQ ID NO: 2469619 - RNA, 20 nt, Human
guaaacagauggcacuuuga

SEQ ID NO: 2469620 - RNA, 19 nt, Human
guaaacagauggcacuuug

SEQ ID NO: 2469621 - RNA, 12 nt, Human
aaauaauuuuau

SEQ ID NO: 2469622 - RNA, 15 nt, Human
aaauaauaauaaugu

SEQ ID NO: 2469623 - RNA, 17 nt, Human
aaauaauaaagaugcuc

SEQ ID NO: 2469624 - RNA, 19 nt, Human
aaauaauaaagaugcucuu

SEQ ID NO: 2469625 - RNA, 13 nt, Human
aaauaauaugcau

SEQ ID NO: 2469626 - RNA, 12 nt, Human
aaauaauaugca

SEQ ID NO: 2469627 - RNA, 14 nt, Human
aaauaauaugcauu

SEQ ID NO: 2469628 - RNA, 12 nt, Human
aaauaauaaauc

SEQ ID NO: 2469629 - RNA, 23 nt, Human
aaauaaucuauuucuaugagaaa

SEQ ID NO: 2469630 - RNA, 22 nt, Human
aaauaaucuauuucuaugagaa

SEQ ID NO: 2469631 - RNA, 13 nt, Human
aaauaaucuauuu

SEQ ID NO: 2469632 - RNA, 14 nt, Human
aaauaaucauucuu

SEQ ID NO: 2469633 - RNA, 15 nt, Human
aaauaaucggcccac

SEQ ID NO: 2469634 - RNA, 14 nt, Human
aaauaagaaaccua

SEQ ID NO: 2469635 - RNA, 15 nt, Human
aaauaagaaaaauca

SEQ ID NO: 2469636 - RNA, 24 nt, Human
aaauaagaaacaacucuuugagaa

SEQ ID NO: 2469637 - RNA, 13 nt, Human
aaauaagaaaaga

SEQ ID NO: 2469638 - RNA, 22 nt, Human
aaauaagaaaagauguagauuu

SEQ ID NO: 2469639 - RNA, 12 nt, Human
aaauaagaaaag

SEQ ID NO: 2469640 - RNA, 16 nt, Human
aaauaacuucaagcaa

SEQ ID NO: 2469641 - RNA, 14 nt, Human
aaauaagaauagaa

SEQ ID NO: 2469642 - RNA, 17 nt, Human
aaauaagaauagaaaua

SEQ ID NO: 2469643 - RNA, 23 nt, Human
aaauaagacggauuuauuuuucc

SEQ ID NO: 2469644 - RNA, 12 nt, Human
aaauaagagaga

SEQ ID NO: 2469645 - RNA, 16 nt, Human
aaaguugguaaaccuu

SEQ ID NO: 2469646 - RNA, 17 nt, Human
aaaguugguaaaccuuu

SEQ ID NO: 2469647 - RNA, 16 nt, Human
aaaguuggugacagau

SEQ ID NO: 2469648 - RNA, 23 nt, Human
aaauaaaaacuaaauuguaaacu

SEQ ID NO: 2469649 - RNA, 10 nt, Human
aaauaaaaag

SEQ ID NO: 2469650 - RNA, 13 nt, Human
aaauaaaaacaaa

SEQ ID NO: 2469651 - RNA, 18 nt, Human
aaaguugugauuccagau

SEQ ID NO: 2469652 - RNA, 20 nt, Human
aaaguuuaaaacagaagccu

SEQ ID NO: 2469653 - RNA, 21 nt, Human
aaauaaaaagugacacagcag

SEQ ID NO: 2469654 - RNA, 20 nt, Human
aaauaaaaagugacacagca

SEQ ID NO: 2469655 - RNA, 12 nt, Human
aaauaaaaaguu

SEQ ID NO: 2469656 - RNA, 13 nt, Human
aaauaaaaaguua

SEQ ID NO: 2469657 - RNA, 14 nt, Human
aaauaaaaaguuaa

SEQ ID NO: 2469658 - RNA, 19 nt, Human
aaauaaaaagugacacagc

SEQ ID NO: 2469659 - RNA, 15 nt, Human
aaauaaaaagugaca

SEQ ID NO: 2469660 - RNA, 14 nt, Human
aaauaaaaagugac

SEQ ID NO: 2469661 - RNA, 14 nt, Human
aaauaaaaacuaaa

SEQ ID NO: 2469662 - RNA, 13 nt, Human
aaauaaaaagaaa

SEQ ID NO: 2469663 - RNA, 15 nt, Human
aaauaaaaaguuaaa

SEQ ID NO: 2469664 - RNA, 19 nt, Human
aaauaaaaaguuaaaaagu

SEQ ID NO: 2469665 - RNA, 16 nt, Human
aaauaaaaauaaauuc

SEQ ID NO: 2469666 - RNA, 14 nt, Human
aaauaaaaauaaau

SEQ ID NO: 2469667 - RNA, 14 nt, Human
aaauaaaaauauug

SEQ ID NO: 2469668 - RNA, 18 nt, Human
aaauaacaauguuaagga

SEQ ID NO: 2469669 - RNA, 13 nt, Human
aaauaacacacau

SEQ ID NO: 2469670 - RNA, 21 nt, Human
aaauaacacacauauaaacau

SEQ ID NO: 2469671 - RNA, 19 nt, Human
aaauaacaauguuaaggaa

SEQ ID NO: 2469672 - RNA, 19 nt, Human
aaauaaccaauccuggaca

SEQ ID NO: 2469673 - RNA, 17 nt, Human
aaauaacuaguguugcu

SEQ ID NO: 2469674 - RNA, 15 nt, Human
aaauaacuucaagca

SEQ ID NO: 2469675 - RNA, 18 nt, Human
aaauaacuucaagcaaac

SEQ ID NO: 2469676 - RNA, 15 nt, Human
guacuauguaucaau

SEQ ID NO: 2469677 - RNA, 17 nt, Human
guacuauguaucaauga

SEQ ID NO: 2469678 - RNA, 13 nt, Human
guacuauucugau

SEQ ID NO: 2469679 - RNA, 21 nt, Human
guacuauuuagauauaacacu

SEQ ID NO: 2469680 - RNA, 15 nt, Human
guacucaaauguagc

SEQ ID NO: 2469681 - RNA, 17 nt, Human
guacucaggaggcugag

SEQ ID NO: 2469682 - RNA, 23 nt, Human
guacucaggaggcugaggggagg

SEQ ID NO: 2469683 - RNA, 14 nt, Human
guacucauuaaaaa

SEQ ID NO: 2469684 - RNA, 23 nt, Human
guacucuccuagagacagaagca

SEQ ID NO: 2469685 - RNA, 14 nt, Human
guacucuccuagag

SEQ ID NO: 2469686 - RNA, 11 nt, Human
guacucuccua

SEQ ID NO: 2469687 - RNA, 17 nt, Human
guacucgcuugugcaga

SEQ ID NO: 2469688 - RNA, 16 nt, Human
guacuccugcaaaauu

SEQ ID NO: 2469689 - RNA, 21 nt, Human
guacuccugcaaaauuuuaua

SEQ ID NO: 2469690 - RNA, 16 nt, Human
guacucugcacauacg

SEQ ID NO: 2469691 - RNA, 14 nt, Human
guacucuuccgaaa

SEQ ID NO: 2469692 - RNA, 15 nt, Human
guacucuccuagaga

SEQ ID NO: 2469693 - RNA, 13 nt, Human
guacucuuccgaa

SEQ ID NO: 2469694 - RNA, 14 nt, Human
guacuccucccagg

SEQ ID NO: 2469695 - RNA, 15 nt, Human
guacuccugcaaaau

SEQ ID NO: 2469696 - RNA, 20 nt, Human
guacucaucaucaacccuaa

SEQ ID NO: 2469697 - RNA, 19 nt, Human
guacuacaguccucccauc

SEQ ID NO: 2469698 - RNA, 18 nt, Human
guacuacaguccucccau

SEQ ID NO: 2469699 - RNA, 14 nt, Human
guacccacugcucu

SEQ ID NO: 2469700 - RNA, 13 nt, Human
guacccacugcuc

SEQ ID NO: 2469701 - RNA, 16 nt, Human
guacuaguuacacauc

SEQ ID NO: 2469702 - RNA, 17 nt, Human
guacuaguuacacaucu

SEQ ID NO: 2469703 - RNA, 13 nt, Human
guacuauguauca

SEQ ID NO: 2469704 - RNA, 17 nt, Human
guacuacaguccuccca

SEQ ID NO: 2469705 - RNA, 15 nt, Human
guacuacuagauguc

SEQ ID NO: 2469706 - RNA, 20 nt, Human
guacuacuagaugucuuuag

SEQ ID NO: 2469707 - RNA, 21 nt, Human
guacuacuagaugucuuuagg

SEQ ID NO: 2469708 - RNA, 22 nt, Human
guacuagagaucugguuuugcu

SEQ ID NO: 2469709 - RNA, 22 nt, Human
guacuagggggaagugacaagg

SEQ ID NO: 2469710 - RNA, 15 nt, Human
guacuguucuguguc

SEQ ID NO: 2469711 - RNA, 14 nt, Human
guacuguucugugu

SEQ ID NO: 2469712 - RNA, 23 nt, Human
guacuguguacagaauucugcua

SEQ ID NO: 2469713 - RNA, 14 nt, Human
guacuuaacuauuc

SEQ ID NO: 2469714 - RNA, 19 nt, Human
guacuuaaaugaaagcaug

SEQ ID NO: 2469715 - RNA, 15 nt, Human
guacuuaauaaauuc

SEQ ID NO: 2469716 - RNA, 18 nt, Human
guacuguucugugucuuu

SEQ ID NO: 2469717 - RNA, 17 nt, Human
guacuguucugugucuu

SEQ ID NO: 2469718 - RNA, 23 nt, Human
guacuguucucuucuugaacacu

SEQ ID NO: 2469719 - RNA, 17 nt, Human
guacuuaaaugaaagca

SEQ ID NO: 2469720 - RNA, 22 nt, Human
guacuucaaauccuugaagauu

SEQ ID NO: 2469721 - RNA, 21 nt, Human
guacuucaaauccuugaagau

SEQ ID NO: 2469722 - RNA, 15 nt, Human
guacuucaugcuguc

SEQ ID NO: 2469723 - RNA, 21 nt, Human
guacuucacugucaggaagaa

SEQ ID NO: 2469724 - RNA, 15 nt, Human
guacuuauuacugcu

SEQ ID NO: 2469725 - RNA, 13 nt, Human
guacuuauuacug

SEQ ID NO: 2469726 - RNA, 16 nt, Human
guacuuagcagcuauc

SEQ ID NO: 2469727 - RNA, 19 nt, Human
guacuuagcagcuaucucu

SEQ ID NO: 2469728 - RNA, 12 nt, Human
guacugagauuu

SEQ ID NO: 2469729 - RNA, 16 nt, Human
guacugagccuuguaa

SEQ ID NO: 2469730 - RNA, 23 nt, Human
guacucuuccgaaaaauccucuu

SEQ ID NO: 2469731 - RNA, 22 nt, Human
guacucuuccgaaaaauccucu

SEQ ID NO: 2469732 - RNA, 16 nt, Human
guacugauuuuuguaa

SEQ ID NO: 2469733 - RNA, 21 nt, Human
guacuggggguugcgggggga

SEQ ID NO: 2469734 - RNA, 12 nt, Human
guacuggggguu

SEQ ID NO: 2469735 - RNA, 16 nt, Human
guacuguaaagagacc

SEQ ID NO: 2469736 - RNA, 14 nt, Human
guacuguaguuuuu

SEQ ID NO: 2469737 - RNA, 16 nt, Human
guacuggagaaaaugg

SEQ ID NO: 2469738 - RNA, 14 nt, Human
guacuggcauggua

SEQ ID NO: 2469739 - RNA, 16 nt, Human
guacuggcaugguacg

SEQ ID NO: 2469740 - RNA, 19 nt, Human
guacuggcugauggaguaa

SEQ ID NO: 2469741 - RNA, 21 nt, Human
guagaagucuuagauguauau

SEQ ID NO: 2469742 - RNA, 15 nt, Human
guagaaggagacaga

SEQ ID NO: 2469743 - RNA, 17 nt, Human
guagaaggguuauauuu

SEQ ID NO: 2469744 - RNA, 21 nt, Human
guagaagcauuccuucuuuga

SEQ ID NO: 2469745 - RNA, 18 nt, Human
guagaagcauuccuucuu

SEQ ID NO: 2469746 - RNA, 22 nt, Human
guagaagcauuccuucuuugau

SEQ ID NO: 2469747 - RNA, 13 nt, Human
guagaaggagaca

SEQ ID NO: 2469748 - RNA, 18 nt, Human
guagaagcccuucuaccu

SEQ ID NO: 2469749 - RNA, 15 nt, Human
guagaagcauuccuu

SEQ ID NO: 2469750 - RNA, 20 nt, Human
guagaagauuugaugcugga

SEQ ID NO: 2469751 - RNA, 13 nt, Human
guagaagagggau

SEQ ID NO: 2469752 - RNA, 12 nt, Human
guagaagauggc

SEQ ID NO: 2469753 - RNA, 14 nt, Human
guagaauguauugu

SEQ ID NO: 2469754 - RNA, 19 nt, Human
guagaaguuuuuguacugu

SEQ ID NO: 2469755 - RNA, 15 nt, Human
guagaaguuuuugua

SEQ ID NO: 2469756 - RNA, 14 nt, Human
guagaaguuuuugu

SEQ ID NO: 2469757 - RNA, 15 nt, Human
guagaaggucggagg

SEQ ID NO: 2469758 - RNA, 19 nt, Human
guagaaggguuauauuuua

SEQ ID NO: 2469759 - RNA, 19 nt, Human
guagaauguauuguaccuu

SEQ ID NO: 2469760 - RNA, 18 nt, Human
guagaauguauuguaccu

SEQ ID NO: 2469761 - RNA, 17 nt, Human
guagaauguauuguacc

SEQ ID NO: 2469762 - RNA, 23 nt, Human
guagaauguauuguaccuuuuaa

SEQ ID NO: 2469763 - RNA, 20 nt, Human
guagaauguauuguaccuuu

SEQ ID NO: 2469764 - RNA, 14 nt, Human
guagaauugcauug

SEQ ID NO: 2469765 - RNA, 15 nt, Human
guagaauugcauuga

SEQ ID NO: 2469766 - RNA, 20 nt, Human
guagaaauaucugaaaaugu

SEQ ID NO: 2469767 - RNA, 18 nt, Human
guacuucaggggcacuuc

SEQ ID NO: 2469768 - RNA, 15 nt, Human
guacuucacugucag

SEQ ID NO: 2469769 - RNA, 18 nt, Human
guacuuauuacugcuaag

SEQ ID NO: 2469770 - RNA, 16 nt, Human
guacuuauuacugcua

SEQ ID NO: 2469771 - RNA, 21 nt, Human
guagaaaggccuuuaaaauuu

SEQ ID NO: 2469772 - RNA, 16 nt, Human
guagaaauaauaugca

SEQ ID NO: 2469773 - RNA, 21 nt, Human
guagaaauaucugaaaaugua

SEQ ID NO: 2469774 - RNA, 23 nt, Human
guagaaauaucugaaaauguaug

SEQ ID NO: 2469775 - RNA, 18 nt, Human
guagaacguaaccacgga

SEQ ID NO: 2469776 - RNA, 19 nt, Human
guagaacguaaccacggaa

SEQ ID NO: 2469777 - RNA, 18 nt, Human
guagaaaugguuguauua

SEQ ID NO: 2469778 - RNA, 17 nt, Human
guagaaaugguuguauu

SEQ ID NO: 2469779 - RNA, 17 nt, Human
guagaaauaauaugcau

SEQ ID NO: 2469780 - RNA, 14 nt, Human
guagaaaugaugau

SEQ ID NO: 2469781 - RNA, 22 nt, Human
guagaaaugguuguauuagaug

SEQ ID NO: 2469782 - RNA, 20 nt, Human
guagaaaugguuguauuaga

SEQ ID NO: 2469783 - RNA, 22 nt, Human
guagaaaggggcccaguccugg

SEQ ID NO: 2469784 - RNA, 22 nt, Human
guagaacacaaggucauuugcu

SEQ ID NO: 2469785 - RNA, 11 nt, Human
guagagccagg

SEQ ID NO: 2469786 - RNA, 15 nt, Human
guagagccagagguc

SEQ ID NO: 2469787 - RNA, 13 nt, Human
guagagaaacacu

SEQ ID NO: 2469788 - RNA, 18 nt, Human
guagagaccgagccucug

SEQ ID NO: 2469789 - RNA, 15 nt, Human
guagagauggaggag

SEQ ID NO: 2469790 - RNA, 10 nt, Human
guagagccag

SEQ ID NO: 2469791 - RNA, 13 nt, Human
guagagacagggu

SEQ ID NO: 2469792 - RNA, 19 nt, Human
guagccgagagccugcucc

SEQ ID NO: 2469793 - RNA, 17 nt, Human
guagcccgccugccagu

SEQ ID NO: 2469794 - RNA, 15 nt, Human
guagcccuggccaga

SEQ ID NO: 2469795 - RNA, 14 nt, Human
guagcccuuucugu

SEQ ID NO: 2469796 - RNA, 17 nt, Human
guagcccuggccagagg

SEQ ID NO: 2469797 - RNA, 16 nt, Human
guagagauggaggagg

SEQ ID NO: 2469798 - RNA, 17 nt, Human
guagagauggaggagga

SEQ ID NO: 2469799 - RNA, 20 nt, Human
guagcccgccugccaguccu

SEQ ID NO: 2469800 - RNA, 16 nt, Human
guagcccgccugccag

SEQ ID NO: 2469801 - RNA, 15 nt, Human
guagcccgccugcca

SEQ ID NO: 2469802 - RNA, 18 nt, Human
guagagccagggucucac

SEQ ID NO: 2469803 - RNA, 15 nt, Human
guagagccagggucu

SEQ ID NO: 2469804 - RNA, 15 nt, Human
guagacauuucucuu

SEQ ID NO: 2469805 - RNA, 14 nt, Human
guagaccaaaauaa

SEQ ID NO: 2469806 - RNA, 15 nt, Human
guagaccaaaauaaa

SEQ ID NO: 2469807 - RNA, 16 nt, Human
guagaccaaaauaaaa

SEQ ID NO: 2469808 - RNA, 22 nt, Human
guagacaagcaauuagacaaga

SEQ ID NO: 2469809 - RNA, 19 nt, Human
guagacacgcucuucuauu

SEQ ID NO: 2469810 - RNA, 18 nt, Human
guagacacgcucuucuau

SEQ ID NO: 2469811 - RNA, 22 nt, Human
guagaccuuguuacuucugagg

SEQ ID NO: 2469812 - RNA, 21 nt, Human
guagaccuuguuacuucugag

SEQ ID NO: 2469813 - RNA, 20 nt, Human
guagaccuuguuacuucuga

SEQ ID NO: 2469814 - RNA, 19 nt, Human
guagaccuuguuacuucug

SEQ ID NO: 2469815 - RNA, 16 nt, Human
guagaccuagggagga

SEQ ID NO: 2469816 - RNA, 17 nt, Human
guagaccuagggaggac

SEQ ID NO: 2469817 - RNA, 20 nt, Human
guagaccuagggaggaccuu

SEQ ID NO: 2469818 - RNA, 12 nt, Human
guagagacaggg

SEQ ID NO: 2469819 - RNA, 11 nt, Human
guagagacagg

SEQ ID NO: 2469820 - RNA, 19 nt, Human
aaaucauuucugcaucagc

SEQ ID NO: 2469821 - RNA, 21 nt, Human
aaaucauuucugcaucagcug

SEQ ID NO: 2469822 - RNA, 22 nt, Human
aaaucauuucugcaucagcugc

SEQ ID NO: 2469823 - RNA, 23 nt, Human
aaaucauuucugcaucagcugcu

SEQ ID NO: 2469824 - RNA, 15 nt, Human
aaauccacuuuaucu

SEQ ID NO: 2469825 - RNA, 16 nt, Human
aaaucauuuuauaugu

SEQ ID NO: 2469826 - RNA, 23 nt, Human
aaaucauuuggguuaauauggcu

SEQ ID NO: 2469827 - RNA, 21 nt, Human
aaaucauuuuauaugucaaag

SEQ ID NO: 2469828 - RNA, 20 nt, Human
aaaucauuuuauaugucaaa

SEQ ID NO: 2469829 - RNA, 12 nt, Human
aaaucauuuggg

SEQ ID NO: 2469830 - RNA, 22 nt, Human
aaaucauaggaaaguauuuuuu

SEQ ID NO: 2469831 - RNA, 16 nt, Human
aaaucaguuacuaaga

SEQ ID NO: 2469832 - RNA, 22 nt, Human
aaaucagucagugcaaauguca

SEQ ID NO: 2469833 - RNA, 12 nt, Human
aaaucauuucug

SEQ ID NO: 2469834 - RNA, 22 nt, Human
aaaucauaagauauuuuucaug

SEQ ID NO: 2469835 - RNA, 23 nt, Human
aaaucauaaacugugugcagacu

SEQ ID NO: 2469836 - RNA, 21 nt, Human
aaaucaguuacuaagaagaaa

SEQ ID NO: 2469837 - RNA, 17 nt, Human
aaaucaguuacuaagaa

SEQ ID NO: 2469838 - RNA, 14 nt, Human
aaaucauaaacugu

SEQ ID NO: 2469839 - RNA, 16 nt, Human
aaaucauaaacugugu

SEQ ID NO: 2469840 - RNA, 19 nt, Human
aaaucagccguguaaccau

SEQ ID NO: 2469841 - RNA, 12 nt, Human
aaaucagccugc

SEQ ID NO: 2469842 - RNA, 16 nt, Human
aaaucagcugcuacua

SEQ ID NO: 2469843 - RNA, 18 nt, Human
aaaucagccugcuccagc

SEQ ID NO: 2469844 - RNA, 17 nt, Human
aaauauacuguaaagaa

SEQ ID NO: 2469845 - RNA, 19 nt, Human
aaauauacuguaaagaaag

SEQ ID NO: 2469846 - RNA, 21 nt, Human
aaauauacuguaaagaaagag

SEQ ID NO: 2469847 - RNA, 23 nt, Human
aaauauacuguaaagaaagagag

SEQ ID NO: 2469848 - RNA, 18 nt, Human
aaauauacuuaaauggaa

SEQ ID NO: 2469849 - RNA, 14 nt, Human
aaauauacuuaaau

SEQ ID NO: 2469850 - RNA, 13 nt, Human
aaauauacuguaa

SEQ ID NO: 2469851 - RNA, 14 nt, Human
aaauauacuguaaa

SEQ ID NO: 2469852 - RNA, 15 nt, Human
aaauauacuguaaag

SEQ ID NO: 2469853 - RNA, 16 nt, Human
aaauauacuguaaaga

SEQ ID NO: 2469854 - RNA, 12 nt, Human
aaauauacugua

SEQ ID NO: 2469855 - RNA, 17 nt, Human
aaauauuauguuaaaac

SEQ ID NO: 2469856 - RNA, 14 nt, Human
aaauauuauguguu

SEQ ID NO: 2469857 - RNA, 15 nt, Human
aaauauuagauguga

SEQ ID NO: 2469858 - RNA, 14 nt, Human
aaauauuagaugug

SEQ ID NO: 2469859 - RNA, 13 nt, Human
aaauauuagaugu

SEQ ID NO: 2469860 - RNA, 17 nt, Human
aaauauuagaaacagcu

SEQ ID NO: 2469861 - RNA, 14 nt, Human
aaauauuagaaaca

SEQ ID NO: 2469862 - RNA, 22 nt, Human
aaauauuagaugugauuuaaua

SEQ ID NO: 2469863 - RNA, 21 nt, Human
aaauauuagaugugauuuaau

SEQ ID NO: 2469864 - RNA, 20 nt, Human
aaauauuagaugugauuuaa

SEQ ID NO: 2469865 - RNA, 18 nt, Human
aaauauuagaugugauuu

SEQ ID NO: 2469866 - RNA, 20 nt, Human
aaauauuauaacuuaaaaaa

SEQ ID NO: 2469867 - RNA, 17 nt, Human
aaaucagccaauuaugu

SEQ ID NO: 2469868 - RNA, 23 nt, Human
aaaucagccaauuauguuaaacu

SEQ ID NO: 2469869 - RNA, 21 nt, Human
aaaucagccaauuauguuaaa

SEQ ID NO: 2469870 - RNA, 20 nt, Human
aaaucagccaauuauguuaa

SEQ ID NO: 2469871 - RNA, 18 nt, Human
aaaucagccaauuauguu

SEQ ID NO: 2469872 - RNA, 21 nt, Human
aaaucagacuaugaaguuuuu

SEQ ID NO: 2469873 - RNA, 14 nt, Human
aaaucagacuauga

SEQ ID NO: 2469874 - RNA, 18 nt, Human
aaauauucccuagaaacu

SEQ ID NO: 2469875 - RNA, 19 nt, Human
aaauauucccuagaaacuu

SEQ ID NO: 2469876 - RNA, 15 nt, Human
aaauauuccugcauu

SEQ ID NO: 2469877 - RNA, 22 nt, Human
aaaucaccacaccaaaccucuc

SEQ ID NO: 2469878 - RNA, 12 nt, Human
aaaucacauccu

SEQ ID NO: 2469879 - RNA, 23 nt, Human
aaauauuccauccauauacuuug

SEQ ID NO: 2469880 - RNA, 16 nt, Human
aaauauucaugcuucu

SEQ ID NO: 2469881 - RNA, 20 nt, Human
aaauauuauuuuaugaaagg

SEQ ID NO: 2469882 - RNA, 15 nt, Human
aaauauuauguguuu

SEQ ID NO: 2469883 - RNA, 23 nt, Human
aaauauuauuguggaaaugaaua

SEQ ID NO: 2469884 - RNA, 17 nt, Human
guacaugaaaacacauu

SEQ ID NO: 2469885 - RNA, 18 nt, Human
guacaugaaaacacauuu

SEQ ID NO: 2469886 - RNA, 19 nt, Human
guacaugaaaacacauuuu

SEQ ID NO: 2469887 - RNA, 20 nt, Human
guacaugaaaacacauuuuu

SEQ ID NO: 2469888 - RNA, 20 nt, Human
guacauguguagccugugca

SEQ ID NO: 2469889 - RNA, 19 nt, Human
guacauguguagccugugc

SEQ ID NO: 2469890 - RNA, 13 nt, Human
guacaugugaggc

SEQ ID NO: 2469891 - RNA, 17 nt, Human
guacauucaauguuuau

SEQ ID NO: 2469892 - RNA, 18 nt, Human
guacauucaauguuuaug

SEQ ID NO: 2469893 - RNA, 11 nt, Human
guacaugagaa

SEQ ID NO: 2469894 - RNA, 10 nt, Human
guacauguau

SEQ ID NO: 2469895 - RNA, 16 nt, Human
guacauggcagaguuu

SEQ ID NO: 2469896 - RNA, 19 nt, Human
guacauggaauaacaugua

SEQ ID NO: 2469897 - RNA, 18 nt, Human
aaauccauacauuugugu

SEQ ID NO: 2469898 - RNA, 23 nt, Human
guacaucccauguaacagaaagg

SEQ ID NO: 2469899 - RNA, 22 nt, Human
guacaucccauguaacagaaag

SEQ ID NO: 2469900 - RNA, 21 nt, Human
guacaucccauguaacagaaa

SEQ ID NO: 2469901 - RNA, 20 nt, Human
guacaucccauguaacagaa

SEQ ID NO: 2469902 - RNA, 17 nt, Human
guacaucccauguaaca

SEQ ID NO: 2469903 - RNA, 20 nt, Human
guacauauuuguggaauaau

SEQ ID NO: 2469904 - RNA, 15 nt, Human
aaauccauacauuug

SEQ ID NO: 2469905 - RNA, 15 nt, Human
aaauccagaaagaaa

SEQ ID NO: 2469906 - RNA, 14 nt, Human
aaauccagaaagaa

SEQ ID NO: 2469907 - RNA, 15 nt, Human
guacaugaaaacaca

SEQ ID NO: 2469908 - RNA, 16 nt, Human
guacaugaaaacacau

SEQ ID NO: 2469909 - RNA, 14 nt, Human
guacaugaaaacac

SEQ ID NO: 2469910 - RNA, 18 nt, Human
guacaucuauuuuggauu

SEQ ID NO: 2469911 - RNA, 20 nt, Human
guacaucuauuuuggauugu

SEQ ID NO: 2469912 - RNA, 14 nt, Human
guacaucuggccuu

SEQ ID NO: 2469913 - RNA, 18 nt, Human
guaccaggucuccuccac

SEQ ID NO: 2469914 - RNA, 17 nt, Human
guaccagcugcgcuugc

SEQ ID NO: 2469915 - RNA, 19 nt, Human
guaccagcugcgcuugcuu

SEQ ID NO: 2469916 - RNA, 22 nt, Human
guaccaggucuccuccaccgcc

SEQ ID NO: 2469917 - RNA, 19 nt, Human
guaccaggucuccuccacc

SEQ ID NO: 2469918 - RNA, 16 nt, Human
guaccagcaauaugua

SEQ ID NO: 2469919 - RNA, 16 nt, Human
guaccagauaaaauua

SEQ ID NO: 2469920 - RNA, 16 nt, Human
guaccagcugcgcuug

SEQ ID NO: 2469921 - RNA, 14 nt, Human
guaccagcugcgcu

SEQ ID NO: 2469922 - RNA, 16 nt, Human
guaccagcccagaugu

SEQ ID NO: 2469923 - RNA, 18 nt, Human
guacccaaaagcucagcc

SEQ ID NO: 2469924 - RNA, 14 nt, Human
guaccauuugcaug

SEQ ID NO: 2469925 - RNA, 21 nt, Human
guaccauuuauacaaauuaga

SEQ ID NO: 2469926 - RNA, 19 nt, Human
guaccauuuauacaaauua

SEQ ID NO: 2469927 - RNA, 12 nt, Human
guacccacugcu

SEQ ID NO: 2469928 - RNA, 20 nt, Human
guaccaugaaacaaagcugc

SEQ ID NO: 2469929 - RNA, 20 nt, Human
guaccauaguaccauuuaua

SEQ ID NO: 2469930 - RNA, 15 nt, Human
guacauuuggagaca

SEQ ID NO: 2469931 - RNA, 16 nt, Human
guacauuucccugugc

SEQ ID NO: 2469932 - RNA, 14 nt, Human
guacauuucccugu

SEQ ID NO: 2469933 - RNA, 18 nt, Human
guacauuucccugugcug

SEQ ID NO: 2469934 - RNA, 22 nt, Human
guacauuuaugauuuaauaaaa

SEQ ID NO: 2469935 - RNA, 21 nt, Human
guacauuuaugauuuaauaaa

SEQ ID NO: 2469936 - RNA, 20 nt, Human
guacauuuaugauuuaauaa

SEQ ID NO: 2469937 - RNA, 19 nt, Human
guacauuuaugauuuaaua

SEQ ID NO: 2469938 - RNA, 18 nt, Human
guacauuuaugauuuaau

SEQ ID NO: 2469939 - RNA, 16 nt, Human
guacauuuaugauuua

SEQ ID NO: 2469940 - RNA, 14 nt, Human
guacauuuaugauu

SEQ ID NO: 2469941 - RNA, 15 nt, Human
guacauuuuguaaca

SEQ ID NO: 2469942 - RNA, 17 nt, Human
guacauuucugaaauga

SEQ ID NO: 2469943 - RNA, 13 nt, Human
guacauuucugaa

SEQ ID NO: 2469944 - RNA, 23 nt, Human
guaccaagacuacuagggaaaug

SEQ ID NO: 2469945 - RNA, 20 nt, Human
guaccaagacuacuagggaa

SEQ ID NO: 2469946 - RNA, 18 nt, Human
guaccaaaugcuuuaaaa

SEQ ID NO: 2469947 - RNA, 16 nt, Human
guaccaaaugcuuuaa

SEQ ID NO: 2469948 - RNA, 15 nt, Human
guaccaaucauuuua

SEQ ID NO: 2469949 - RNA, 14 nt, Human
guaccaaucauuuu

SEQ ID NO: 2469950 - RNA, 21 nt, Human
guaccaaucauuuuaauuauu

SEQ ID NO: 2469951 - RNA, 14 nt, Human
guaccacucaggcc

SEQ ID NO: 2469952 - RNA, 16 nt, Human
gcucugauaggccaag

SEQ ID NO: 2469953 - RNA, 20 nt, Human
gcucugaggcuuccagagag

SEQ ID NO: 2469954 - RNA, 19 nt, Human
gcucugaggcuuccagaga

SEQ ID NO: 2469955 - RNA, 21 nt, Human
gcucugaggcuuccagagagu

SEQ ID NO: 2469956 - RNA, 18 nt, Human
gcucugaggcuuccagag

SEQ ID NO: 2469957 - RNA, 16 nt, Human
gcucugaggcuuccag

SEQ ID NO: 2469958 - RNA, 16 nt, Human
gcucugagccaguuca

SEQ ID NO: 2469959 - RNA, 18 nt, Human
gcucugagcgccuccauc

SEQ ID NO: 2469960 - RNA, 17 nt, Human
gcucugagcgccuccau

SEQ ID NO: 2469961 - RNA, 14 nt, Human
gcucugagcgccuc

SEQ ID NO: 2469962 - RNA, 13 nt, Human
gcucugagccagu

SEQ ID NO: 2469963 - RNA, 17 nt, Human
gcucugaucauccacug

SEQ ID NO: 2469964 - RNA, 23 nt, Human
gcucugaucauccacugugccau

SEQ ID NO: 2469965 - RNA, 23 nt, Human
gcucugcaagaauugaagcagga

SEQ ID NO: 2469966 - RNA, 13 nt, Human
gcucugaucccuc

SEQ ID NO: 2469967 - RNA, 22 nt, Human
gcucugaucccucuacagagcu

SEQ ID NO: 2469968 - RNA, 23 nt, Human
gcucugaucccucuacagagcuu

SEQ ID NO: 2469969 - RNA, 21 nt, Human
gcucugauauuccaugaaugu

SEQ ID NO: 2469970 - RNA, 17 nt, Human
gcucugcaauuccccuc

SEQ ID NO: 2469971 - RNA, 23 nt, Human
gcucugcaaugggcacugggaug

SEQ ID NO: 2469972 - RNA, 20 nt, Human
gcucugccccagaggccucu

SEQ ID NO: 2469973 - RNA, 16 nt, Human
gcucugccccagaggc

SEQ ID NO: 2469974 - RNA, 15 nt, Human
gcucugccccagagg

SEQ ID NO: 2469975 - RNA, 12 nt, Human
gcucugccccag

SEQ ID NO: 2469976 - RNA, 13 nt, Human
gcucugccccagc

SEQ ID NO: 2469977 - RNA, 15 nt, Human
gcucugccccagcuc

SEQ ID NO: 2469978 - RNA, 11 nt, Human
gcucugcccuu

SEQ ID NO: 2469979 - RNA, 21 nt, Human
gcucugccccagaggccucuc

SEQ ID NO: 2469980 - RNA, 20 nt, Human
gcucugccccagcucuggcu

SEQ ID NO: 2469981 - RNA, 18 nt, Human
gcucugccccagcucugg

SEQ ID NO: 2469982 - RNA, 19 nt, Human
gcucugccccagcucuggc

SEQ ID NO: 2469983 - RNA, 23 nt, Human
gcucguguauccuggggcucccu

SEQ ID NO: 2469984 - RNA, 19 nt, Human
gcucguguauccuggggcu

SEQ ID NO: 2469985 - RNA, 18 nt, Human
gcucguguauccuggggc

SEQ ID NO: 2469986 - RNA, 17 nt, Human
gcucguguauccugggg

SEQ ID NO: 2469987 - RNA, 16 nt, Human
gcucguguauccuggg

SEQ ID NO: 2469988 - RNA, 15 nt, Human
gcucguguauccugg

SEQ ID NO: 2469989 - RNA, 21 nt, Human
gcucgucggggggacagcucc

SEQ ID NO: 2469990 - RNA, 12 nt, Human
gcucgguggacc

SEQ ID NO: 2469991 - RNA, 14 nt, Human
gcucgguggaccca

SEQ ID NO: 2469992 - RNA, 17 nt, Human
gcucgguggacccaggg

SEQ ID NO: 2469993 - RNA, 18 nt, Human
gcucgguggacccaggga

SEQ ID NO: 2469994 - RNA, 21 nt, Human
gcuccacacccucucccagga

SEQ ID NO: 2469995 - RNA, 22 nt, Human
gcuccacacccucucccaggac

SEQ ID NO: 2469996 - RNA, 23 nt, Human
gcuccacacccucucccaggacc

SEQ ID NO: 2469997 - RNA, 21 nt, Human
gcuccacucugcuucucugac

SEQ ID NO: 2469998 - RNA, 20 nt, Human
gcuccacucugcuucucuga

SEQ ID NO: 2469999 - RNA, 19 nt, Human
gcuccacucugcuucucug

SEQ ID NO: 2470000 - RNA, 17 nt, Human
gcuccacucugcuucuc

SEQ ID NO: 2470001 - RNA, 15 nt, Human
gcuccacuuggucug

SEQ ID NO: 2470002 - RNA, 22 nt, Human
gcuccacccuuggccugucuca

SEQ ID NO: 2470003 - RNA, 23 nt, Human
gcuccacccuuggccugucucau

SEQ ID NO: 2470004 - RNA, 16 nt, Human
gcuccacucugcuucu

SEQ ID NO: 2470005 - RNA, 15 nt, Human
gcuccacucugcuuc

SEQ ID NO: 2470006 - RNA, 13 nt, Human
gcuccacucugcu

SEQ ID NO: 2470007 - RNA, 19 nt, Human
gcuccacgucugcgccgcc

SEQ ID NO: 2470008 - RNA, 21 nt, Human
gcuccacucugacuggcacag

SEQ ID NO: 2470009 - RNA, 16 nt, Human
gcuccacccuggccga

SEQ ID NO: 2470010 - RNA, 12 nt, Human
gcuccacagugu

SEQ ID NO: 2470011 - RNA, 16 nt, Human
gcuccacagccauccc

SEQ ID NO: 2470012 - RNA, 19 nt, Human
gcuccaccaagaaagcagg

SEQ ID NO: 2470013 - RNA, 12 nt, Human
gcuccaccacau

SEQ ID NO: 2470014 - RNA, 15 nt, Human
gcuccaccacauccu

SEQ ID NO: 2470015 - RNA, 19 nt, Human
gcuccacccuggccgaguc

SEQ ID NO: 2470016 - RNA, 11 nt, Human
gcuccacccuu

SEQ ID NO: 2470017 - RNA, 13 nt, Human
gcuccacccuugg

SEQ ID NO: 2470018 - RNA, 14 nt, Human
gcuccacccuuggc

SEQ ID NO: 2470019 - RNA, 15 nt, Human
gcuccacccuuggcc

SEQ ID NO: 2470020 - RNA, 16 nt, Human
gcuccacccuuggccu

SEQ ID NO: 2470021 - RNA, 17 nt, Human
gcuccacccuuggccug

SEQ ID NO: 2470022 - RNA, 19 nt, Human
gcuccacccuuggccuguc

SEQ ID NO: 2470023 - RNA, 21 nt, Human
gcucccccgggaggggcccgc

SEQ ID NO: 2470024 - RNA, 17 nt, Human
gcucccccgggaggggc

SEQ ID NO: 2470025 - RNA, 15 nt, Human
gcucccccgggaggg

SEQ ID NO: 2470026 - RNA, 20 nt, Human
gcucccccauccuccccuuc

SEQ ID NO: 2470027 - RNA, 17 nt, Human
gcucccccauccucccc

SEQ ID NO: 2470028 - RNA, 18 nt, Human
gcucccccauccuccccu

SEQ ID NO: 2470029 - RNA, 14 nt, Human
gcucccccauccuc

SEQ ID NO: 2470030 - RNA, 16 nt, Human
gcucccccauccuccc

SEQ ID NO: 2470031 - RNA, 20 nt, Human
gcucccccacccccucccca

SEQ ID NO: 2470032 - RNA, 22 nt, Human
gcucccccacccccuccccagg

SEQ ID NO: 2470033 - RNA, 17 nt, Human
gcucccaggcauucccc

SEQ ID NO: 2470034 - RNA, 21 nt, Human
gcuccccagcccuggcucugc

SEQ ID NO: 2470035 - RNA, 12 nt, Human
gcuccccaugug

SEQ ID NO: 2470036 - RNA, 22 nt, Human
gcuccccagcccuggcucugca

SEQ ID NO: 2470037 - RNA, 14 nt, Human
gcuccccauguguc

SEQ ID NO: 2470038 - RNA, 14 nt, Human
gcucccccaccccc

SEQ ID NO: 2470039 - RNA, 15 nt, Human
gcucccccacccccu

SEQ ID NO: 2470040 - RNA, 19 nt, Human
gcucccagcagcccuaagg

SEQ ID NO: 2470041 - RNA, 23 nt, Human
gcucccagcagcccuaaggaucu

SEQ ID NO: 2470042 - RNA, 12 nt, Human
gcucccaggaac

SEQ ID NO: 2470043 - RNA, 12 nt, Human
gcucccagcagc

SEQ ID NO: 2470044 - RNA, 22 nt, Human
gcucccacaggcccuuccucuc

SEQ ID NO: 2470045 - RNA, 18 nt, Human
gcucccaccccacccccu

SEQ ID NO: 2470046 - RNA, 21 nt, Human
gcucccaccccacccccuuca

SEQ ID NO: 2470047 - RNA, 18 nt, Human
gcuccacuuggucuguga

SEQ ID NO: 2470048 - RNA, 19 nt, Human
gcuccacuuggucugugag

SEQ ID NO: 2470049 - RNA, 18 nt, Human
gcuccacugucacccucc

SEQ ID NO: 2470050 - RNA, 12 nt, Human
gcuccacuguca

SEQ ID NO: 2470051 - RNA, 23 nt, Human
gcuccacucugcuucucugacuu

SEQ ID NO: 2470052 - RNA, 18 nt, Human
gcuccagcucaccagccc

SEQ ID NO: 2470053 - RNA, 21 nt, Human
gcucccacaggcccuuccucu

SEQ ID NO: 2470054 - RNA, 20 nt, Human
gcucccacaggcccuuccuc

SEQ ID NO: 2470055 - RNA, 17 nt, Human
gcucccacaggcccuuc

SEQ ID NO: 2470056 - RNA, 16 nt, Human
gcucccacaggcccuu

SEQ ID NO: 2470057 - RNA, 21 nt, Human
gcuccagcucaccagccccag

SEQ ID NO: 2470058 - RNA, 20 nt, Human
gcuccagcucaccagcccca

SEQ ID NO: 2470059 - RNA, 18 nt, Human
gcuccugcugcaccaacc

SEQ ID NO: 2470060 - RNA, 18 nt, Human
gcuccuggaaaggcucag

SEQ ID NO: 2470061 - RNA, 22 nt, Human
gcuccugcugcaccaacccagc

SEQ ID NO: 2470062 - RNA, 23 nt, Human
gcuccuggaaaggcucagucuca

SEQ ID NO: 2470063 - RNA, 21 nt, Human
gcuccuggaaaggcucagucu

SEQ ID NO: 2470064 - RNA, 22 nt, Human
gcuccuggaaaggcucagucuc

SEQ ID NO: 2470065 - RNA, 14 nt, Human
gcuccuggcccacu

SEQ ID NO: 2470066 - RNA, 15 nt, Human
gcuccuggcccacug

SEQ ID NO: 2470067 - RNA, 20 nt, Human
gcuccuggcccacugcaucg

SEQ ID NO: 2470068 - RNA, 19 nt, Human
gcuccuggagccuuugaau

SEQ ID NO: 2470069 - RNA, 18 nt, Human
gcuccuggagccuuugaa

SEQ ID NO: 2470070 - RNA, 18 nt, Human
gcuccuggcccacugcau

SEQ ID NO: 2470071 - RNA, 19 nt, Human
gcuccuggcccacugcauc

SEQ ID NO: 2470072 - RNA, 12 nt, Human
gcuccugccacc

SEQ ID NO: 2470073 - RNA, 18 nt, Human
gcuccugccaccacgccc

SEQ ID NO: 2470074 - RNA, 20 nt, Human
gcuccugcacuuacuugcuu

SEQ ID NO: 2470075 - RNA, 12 nt, Human
gcuccugcacuu

SEQ ID NO: 2470076 - RNA, 22 nt, Human
gcuccugaggggcaucugcccc

SEQ ID NO: 2470077 - RNA, 23 nt, Human
gcuccugaggggcaucugccccu

SEQ ID NO: 2470078 - RNA, 18 nt, Human
gcuccugaggggcaucug

SEQ ID NO: 2470079 - RNA, 21 nt, Human
gcuccugaggggcaucugccc

SEQ ID NO: 2470080 - RNA, 21 nt, Human
gcuccccucggagaagagcug

SEQ ID NO: 2470081 - RNA, 17 nt, Human
gcucccccuccaccugc

SEQ ID NO: 2470082 - RNA, 18 nt, Human
gcucccccuccaccugcu

SEQ ID NO: 2470083 - RNA, 12 nt, Human
gcucccgcccgu

SEQ ID NO: 2470084 - RNA, 19 nt, Human
gcuccccucuauuuagcau

SEQ ID NO: 2470085 - RNA, 21 nt, Human
gcuccccucuauuuagcauga

SEQ ID NO: 2470086 - RNA, 22 nt, Human
gcuagugugguguuuccuggca

SEQ ID NO: 2470087 - RNA, 21 nt, Human
gcuagugugguguuuccuggc

SEQ ID NO: 2470088 - RNA, 21 nt, Human
gcuagugacuugugucccaug

SEQ ID NO: 2470089 - RNA, 14 nt, Human
gcuaugagggccuu

SEQ ID NO: 2470090 - RNA, 12 nt, Human
gcuaugcauuug

SEQ ID NO: 2470091 - RNA, 13 nt, Human
gcuaugcauuuga

SEQ ID NO: 2470092 - RNA, 14 nt, Human
gcuagugacuugug

SEQ ID NO: 2470093 - RNA, 17 nt, Human
gcuaugaucgcgccacu

SEQ ID NO: 2470094 - RNA, 18 nt, Human
gcuauggauggcuucuaa

SEQ ID NO: 2470095 - RNA, 13 nt, Human
gcuaugggagccc

SEQ ID NO: 2470096 - RNA, 14 nt, Human
gcuaugggagcccc

SEQ ID NO: 2470097 - RNA, 19 nt, Human
gcuauucaguaauaacucu

SEQ ID NO: 2470098 - RNA, 23 nt, Human
gcuaggccuggccagaugcacca

SEQ ID NO: 2470099 - RNA, 17 nt, Human
gcuaggccuggccagau

SEQ ID NO: 2470100 - RNA, 23 nt, Human
gcuagucaagcuccuccucccug

SEQ ID NO: 2470101 - RNA, 19 nt, Human
gcuaggcgagugccaggac

SEQ ID NO: 2470102 - RNA, 16 nt, Human
gcuagucuuaagaacu

SEQ ID NO: 2470103 - RNA, 14 nt, Human
gcuagucagagaga

SEQ ID NO: 2470104 - RNA, 18 nt, Human
gcuagucagagagagugu

SEQ ID NO: 2470105 - RNA, 18 nt, Human
gcuaggcgagugccagga

SEQ ID NO: 2470106 - RNA, 16 nt, Human
gcuaggcgagugccag

SEQ ID NO: 2470107 - RNA, 16 nt, Human
gcuaggccuggccaga

SEQ ID NO: 2470108 - RNA, 18 nt, Human
gcucagagagggcaggca

SEQ ID NO: 2470109 - RNA, 16 nt, Human
gcucagagagggcagg

SEQ ID NO: 2470110 - RNA, 17 nt, Human
gcucaggacagaugcca

SEQ ID NO: 2470111 - RNA, 14 nt, Human
gcucaggaccaggc

SEQ ID NO: 2470112 - RNA, 19 nt, Human
gcucagagagggcaggcau

SEQ ID NO: 2470113 - RNA, 20 nt, Human
gcucaggacagaugccacac

SEQ ID NO: 2470114 - RNA, 14 nt, Human
gcucagagagggug

SEQ ID NO: 2470115 - RNA, 20 nt, Human
gcucacugcauccuccgccu

SEQ ID NO: 2470116 - RNA, 13 nt, Human
gcucacugccagg

SEQ ID NO: 2470117 - RNA, 12 nt, Human
gcucacugccag

SEQ ID NO: 2470118 - RNA, 19 nt, Human
gcucacugccaggccagcc

SEQ ID NO: 2470119 - RNA, 17 nt, Human
gcucacugccaggccag

SEQ ID NO: 2470120 - RNA, 15 nt, Human
gcucacugccaggcc

SEQ ID NO: 2470121 - RNA, 14 nt, Human
gcucacugccaggc

SEQ ID NO: 2470122 - RNA, 16 nt, Human
gcucagacauguuuuc

SEQ ID NO: 2470123 - RNA, 20 nt, Human
gcucacugccaggccagccu

SEQ ID NO: 2470124 - RNA, 13 nt, Human
gcucagagagggu

SEQ ID NO: 2470125 - RNA, 15 nt, Human
gcucagacccccacu

SEQ ID NO: 2470126 - RNA, 19 nt, Human
gcucagacccccacucuca

SEQ ID NO: 2470127 - RNA, 13 nt, Human
gcucagagagggc

SEQ ID NO: 2470128 - RNA, 23 nt, Human
gcucagacccccacucucauucc

SEQ ID NO: 2470129 - RNA, 21 nt, Human
gcucagacauguuuuccguga

SEQ ID NO: 2470130 - RNA, 16 nt, Human
gcucagaccagcucuu

SEQ ID NO: 2470131 - RNA, 20 nt, Human
gcucagggccaugcugaggc

SEQ ID NO: 2470132 - RNA, 17 nt, Human
gcucaggugucccugca

SEQ ID NO: 2470133 - RNA, 16 nt, Human
gcucaggugucccugc

SEQ ID NO: 2470134 - RNA, 23 nt, Human
gcucagguggggucacucuggca

SEQ ID NO: 2470135 - RNA, 14 nt, Human
gcucaggugucccu

SEQ ID NO: 2470136 - RNA, 16 nt, Human
gcucaggaccaggcaa

SEQ ID NO: 2470137 - RNA, 15 nt, Human
gcucaggaccaggca

SEQ ID NO: 2470138 - RNA, 16 nt, Human
gcucaggacucagaag

SEQ ID NO: 2470139 - RNA, 14 nt, Human
gcucaggaucucuu

SEQ ID NO: 2470140 - RNA, 18 nt, Human
gcucaggaucucuuagca

SEQ ID NO: 2470141 - RNA, 20 nt, Human
gcucaggccuauaaccccag

SEQ ID NO: 2470142 - RNA, 19 nt, Human
gcucaggcgauccaccugu

SEQ ID NO: 2470143 - RNA, 22 nt, Human
gcucaggcgauccaccugucuc

SEQ ID NO: 2470144 - RNA, 20 nt, Human
gcucagggaccacagcaagg

SEQ ID NO: 2470145 - RNA, 18 nt, Human
gcucagggaccacagcaa

SEQ ID NO: 2470146 - RNA, 19 nt, Human
gcucagggccaugcugagg

SEQ ID NO: 2470147 - RNA, 17 nt, Human
gcucagggaccacagca

SEQ ID NO: 2470148 - RNA, 16 nt, Human
gcucagggaccacagc

SEQ ID NO: 2470149 - RNA, 17 nt, Human
gcucagggaaaggccag

SEQ ID NO: 2470150 - RNA, 24 nt, Human
gcucaggcgauccaccugucucag

SEQ ID NO: 2470151 - RNA, 15 nt, Human
gcucagggaaaagca

SEQ ID NO: 2470152 - RNA, 17 nt, Human
gcucagggaaaagcagc

SEQ ID NO: 2470153 - RNA, 14 nt, Human
gcucacugcagccu

SEQ ID NO: 2470154 - RNA, 13 nt, Human
gcucacugcagcc

SEQ ID NO: 2470155 - RNA, 12 nt, Human
gcucacugcagc

SEQ ID NO: 2470156 - RNA, 11 nt, Human
gcucacugcag

SEQ ID NO: 2470157 - RNA, 16 nt, Human
gcucacugcagccuca

SEQ ID NO: 2470158 - RNA, 15 nt, Human
gcucacugcagccuc

SEQ ID NO: 2470159 - RNA, 16 nt, Human
gcucacucggcacccu

SEQ ID NO: 2470160 - RNA, 16 nt, Human
gcucacugcauccucc

SEQ ID NO: 2470161 - RNA, 17 nt, Human
gcucacugcagccucaa

SEQ ID NO: 2470162 - RNA, 16 nt, Human
gcucacuauggugcca

SEQ ID NO: 2470163 - RNA, 18 nt, Human
gcucacuauggugccaau

SEQ ID NO: 2470164 - RNA, 17 nt, Human
gcucacuaugaaucuau

SEQ ID NO: 2470165 - RNA, 16 nt, Human
gcuauuuuucccccug

SEQ ID NO: 2470166 - RNA, 12 nt, Human
gcuauuuuuccc

SEQ ID NO: 2470167 - RNA, 20 nt, Human
gcucaaaauuugaagaauga

SEQ ID NO: 2470168 - RNA, 15 nt, Human
gcucaaaaaaugagc

SEQ ID NO: 2470169 - RNA, 15 nt, Human
gcuauuuuuauggaa

SEQ ID NO: 2470170 - RNA, 22 nt, Human
gcuauuuuuauuuguuugugca

SEQ ID NO: 2470171 - RNA, 17 nt, Human
gcuaugggagccccagg

SEQ ID NO: 2470172 - RNA, 20 nt, Human
gcuauucaguaauaacucua

SEQ ID NO: 2470173 - RNA, 16 nt, Human
gcuauugacaagucau

SEQ ID NO: 2470174 - RNA, 22 nt, Human
gcuauugauauaaauaaaacau

SEQ ID NO: 2470175 - RNA, 16 nt, Human
gcuagaacucccuuuc

SEQ ID NO: 2470176 - RNA, 18 nt, Human
gcuagaacucccuuucaa

SEQ ID NO: 2470177 - RNA, 18 nt, Human
gcuacugcagcuuuacau

SEQ ID NO: 2470178 - RNA, 19 nt, Human
gcuacugcagcuuuacaug

SEQ ID NO: 2470179 - RNA, 12 nt, Human
gcuagaacuccc

SEQ ID NO: 2470180 - RNA, 13 nt, Human
gcuagaacucccu

SEQ ID NO: 2470181 - RNA, 14 nt, Human
gcuagaacucccuu

SEQ ID NO: 2470182 - RNA, 15 nt, Human
gcuagaacucccuuu

SEQ ID NO: 2470183 - RNA, 18 nt, Human
gcuacucuguuccuucac

SEQ ID NO: 2470184 - RNA, 17 nt, Human
gcuacugauuuuuguga

SEQ ID NO: 2470185 - RNA, 16 nt, Human
gcuacugauuuuugug

SEQ ID NO: 2470186 - RNA, 20 nt, Human
gcuacugauuuccuuuggag

SEQ ID NO: 2470187 - RNA, 17 nt, Human
gcuacugauuuccuuug

SEQ ID NO: 2470188 - RNA, 17 nt, Human
gcuacucuguuccuuca

SEQ ID NO: 2470189 - RNA, 21 nt, Human
gcuacucuaguauuccagacc

SEQ ID NO: 2470190 - RNA, 19 nt, Human
gcuacucuaguauuccaga

SEQ ID NO: 2470191 - RNA, 20 nt, Human
gcuacucuaguauuccagac

SEQ ID NO: 2470192 - RNA, 18 nt, Human
gcuaaucagugucucaca

SEQ ID NO: 2470193 - RNA, 17 nt, Human
gcuaaucagugucucac

SEQ ID NO: 2470194 - RNA, 16 nt, Human
gcuaaucagugucuca

SEQ ID NO: 2470195 - RNA, 15 nt, Human
gcuaaucagugucuc

SEQ ID NO: 2470196 - RNA, 22 nt, Human
gcuaaucagcauucucacuccu

SEQ ID NO: 2470197 - RNA, 17 nt, Human
gcuaaucagcauucuca

SEQ ID NO: 2470198 - RNA, 16 nt, Human
gcuaaucagcauucuc

SEQ ID NO: 2470199 - RNA, 14 nt, Human
gcuaaucagcauuc

SEQ ID NO: 2470200 - RNA, 20 nt, Human
gcuaauaucaauagaaggau

SEQ ID NO: 2470201 - RNA, 20 nt, Human
gcuaaaaaugggacuucuuu

SEQ ID NO: 2470202 - RNA, 14 nt, Human
gcuaaaaaugggac

SEQ ID NO: 2470203 - RNA, 14 nt, Human
gcuaaaaccugagc

SEQ ID NO: 2470204 - RNA, 16 nt, Human
gcuaaaaccugagcua

SEQ ID NO: 2470205 - RNA, 13 nt, Human
gcuaagugugaac

SEQ ID NO: 2470206 - RNA, 23 nt, Human
gcuaagugauccucccaccucag

SEQ ID NO: 2470207 - RNA, 19 nt, Human
gcuaaucuguagggcugga

SEQ ID NO: 2470208 - RNA, 18 nt, Human
gcuaaucuguagggcugg

SEQ ID NO: 2470209 - RNA, 17 nt, Human
gcuaaucuguagggcug

SEQ ID NO: 2470210 - RNA, 19 nt, Human
gcuaaucagugucucacac

SEQ ID NO: 2470211 - RNA, 21 nt, Human
gcuaaucuguagggcuggacc

SEQ ID NO: 2470212 - RNA, 20 nt, Human
gcuaaucuguagggcuggac

SEQ ID NO: 2470213 - RNA, 22 nt, Human
gcuaaucuguagggcuggaccu

SEQ ID NO: 2470214 - RNA, 13 nt, Human
gcuaaugggacac

SEQ ID NO: 2470215 - RNA, 15 nt, Human
gcuaaugggacacua

SEQ ID NO: 2470216 - RNA, 21 nt, Human
gcuaaugaagggaaaggauau

SEQ ID NO: 2470217 - RNA, 11 nt, Human
gcuacucagca

SEQ ID NO: 2470218 - RNA, 14 nt, Human
gcuacucagaagcc

SEQ ID NO: 2470219 - RNA, 21 nt, Human
gcuacucagaagccugaggcu

SEQ ID NO: 2470220 - RNA, 12 nt, Human
gcuacucagcag

SEQ ID NO: 2470221 - RNA, 16 nt, Human
gcuacucagcagcccu

SEQ ID NO: 2470222 - RNA, 17 nt, Human
gcuacucagcagcccuc

SEQ ID NO: 2470223 - RNA, 18 nt, Human
gcuacucagcagcccucc

SEQ ID NO: 2470224 - RNA, 19 nt, Human
gcuacucagcagcccuccu

SEQ ID NO: 2470225 - RNA, 21 nt, Human
gcuacucagcagcccuccuca

SEQ ID NO: 2470226 - RNA, 22 nt, Human
gcuacucagcagcccuccucac

SEQ ID NO: 2470227 - RNA, 24 nt, Human
gcuacucagcagcccuccucaccc

SEQ ID NO: 2470228 - RNA, 14 nt, Human
gcuacucaggaggc

SEQ ID NO: 2470229 - RNA, 15 nt, Human
gcuacucaggaggcu

SEQ ID NO: 2470230 - RNA, 16 nt, Human
gcuacucaggaggcug

SEQ ID NO: 2470231 - RNA, 23 nt, Human
gcuacucaggaggcugaggcaga

SEQ ID NO: 2470232 - RNA, 22 nt, Human
gcuaauucuuugaccuguuggg

SEQ ID NO: 2470233 - RNA, 20 nt, Human
gcuaauucccagagugugaa

SEQ ID NO: 2470234 - RNA, 15 nt, Human
gcuacucagaagccu

SEQ ID NO: 2470235 - RNA, 16 nt, Human
gcuacucagaagccug

SEQ ID NO: 2470236 - RNA, 17 nt, Human
gcuacucagaagccuga

SEQ ID NO: 2470237 - RNA, 18 nt, Human
gcuacucagaagccugag

SEQ ID NO: 2470238 - RNA, 19 nt, Human
gcuacucagaagccugagg

SEQ ID NO: 2470239 - RNA, 18 nt, Human
gcguuucuaugacacaug

SEQ ID NO: 2470240 - RNA, 22 nt, Human
gcguuugaccuuuuauguagua

SEQ ID NO: 2470241 - RNA, 11 nt, Human
gcuaaaaaugg

SEQ ID NO: 2470242 - RNA, 11 nt, Human
gcguguggcuc

SEQ ID NO: 2470243 - RNA, 13 nt, Human
gcguguggcucac

SEQ ID NO: 2470244 - RNA, 14 nt, Human
gcguguggcucacg

SEQ ID NO: 2470245 - RNA, 19 nt, Human
gcguguggcucacgugugu

SEQ ID NO: 2470246 - RNA, 15 nt, Human
gcguguguagaguua

SEQ ID NO: 2470247 - RNA, 12 nt, Human
gcguguguagag

SEQ ID NO: 2470248 - RNA, 18 nt, Human
gcguguguacacgggacu

SEQ ID NO: 2470249 - RNA, 21 nt, Human
gcguguggcucacguguguga

SEQ ID NO: 2470250 - RNA, 21 nt, Human
gcguguguagaguuaagaagc

SEQ ID NO: 2470251 - RNA, 20 nt, Human
gcguguguagaguuaagaag

SEQ ID NO: 2470252 - RNA, 22 nt, Human
gcguguguagaguuaagaagcu

SEQ ID NO: 2470253 - RNA, 17 nt, Human
gcguguguccaugugug

SEQ ID NO: 2470254 - RNA, 23 nt, Human
gcguguguggguggauauaaaua

SEQ ID NO: 2470255 - RNA, 16 nt, Human
gcguguguggguggau

SEQ ID NO: 2470256 - RNA, 18 nt, Human
gcguguguccaugugugu

SEQ ID NO: 2470257 - RNA, 23 nt, Human
gcguguguccaugugugugcaag

SEQ ID NO: 2470258 - RNA, 17 nt, Human
gcgugucaccugugcuu

SEQ ID NO: 2470259 - RNA, 19 nt, Human
gcgugucgugggugugugu

SEQ ID NO: 2470260 - RNA, 18 nt, Human
gcgugugcgugcaugugc

SEQ ID NO: 2470261 - RNA, 15 nt, Human
gcgugguuccuuucu

SEQ ID NO: 2470262 - RNA, 14 nt, Human
gcgugcccucgcug

SEQ ID NO: 2470263 - RNA, 23 nt, Human
gcgugcacacaccagagcccacc

SEQ ID NO: 2470264 - RNA, 19 nt, Human
gcgugcacacaccagagcc

SEQ ID NO: 2470265 - RNA, 16 nt, Human
gcgggaugggccaccg

SEQ ID NO: 2470266 - RNA, 15 nt, Human
gcgggaugggccacc

SEQ ID NO: 2470267 - RNA, 22 nt, Human
gcgggaggauguucugggacac

SEQ ID NO: 2470268 - RNA, 21 nt, Human
gcgggaggauguucugggaca

SEQ ID NO: 2470269 - RNA, 20 nt, Human
gcgugcacacaccagagccc

SEQ ID NO: 2470270 - RNA, 14 nt, Human
gcgggaugggccac

SEQ ID NO: 2470271 - RNA, 20 nt, Human
gcgggaggauguucugggac

SEQ ID NO: 2470272 - RNA, 21 nt, Human
gcgcacuuuccuccuggcaga

SEQ ID NO: 2470273 - RNA, 15 nt, Human
gcgauggucucagaa

SEQ ID NO: 2470274 - RNA, 23 nt, Human
gcgcaagccuguaaucccagcua

SEQ ID NO: 2470275 - RNA, 22 nt, Human
gcgaucuggguucacugcaacc

SEQ ID NO: 2470276 - RNA, 19 nt, Human
gcgaugaauuuggagacuc

SEQ ID NO: 2470277 - RNA, 21 nt, Human
gcgcacccuccccucccgucu

SEQ ID NO: 2470278 - RNA, 18 nt, Human
gcgcacccuccccucccg

SEQ ID NO: 2470279 - RNA, 17 nt, Human
gcgcacccuccccuccc

SEQ ID NO: 2470280 - RNA, 16 nt, Human
gcgcacccuccccucc

SEQ ID NO: 2470281 - RNA, 15 nt, Human
gcgcacccuccccuc

SEQ ID NO: 2470282 - RNA, 13 nt, Human
gcgcacccucccc

SEQ ID NO: 2470283 - RNA, 20 nt, Human
gcgcacaauaguaaccuggg

SEQ ID NO: 2470284 - RNA, 17 nt, Human
gcgcacaaggcugacca

SEQ ID NO: 2470285 - RNA, 18 nt, Human
gcgcacaaggcugaccaa

SEQ ID NO: 2470286 - RNA, 12 nt, Human
gcgcaccugccc

SEQ ID NO: 2470287 - RNA, 17 nt, Human
gcgcaccugcccccugg

SEQ ID NO: 2470288 - RNA, 18 nt, Human
gcgcaccugcccccuggu

SEQ ID NO: 2470289 - RNA, 19 nt, Human
gcgcaccugcccccuggug

SEQ ID NO: 2470290 - RNA, 22 nt, Human
gcgcacugugacccccagcucc

SEQ ID NO: 2470291 - RNA, 15 nt, Human
gcgagcccugguggc

SEQ ID NO: 2470292 - RNA, 17 nt, Human
gcgagcccugguggcag

SEQ ID NO: 2470293 - RNA, 16 nt, Human
gcgaggaggcuccaga

SEQ ID NO: 2470294 - RNA, 17 nt, Human
gcgaggaggcuccagag

SEQ ID NO: 2470295 - RNA, 17 nt, Human
gcgauccaccugucuca

SEQ ID NO: 2470296 - RNA, 21 nt, Human
gcgauccaccugucucagccu

SEQ ID NO: 2470297 - RNA, 20 nt, Human
gcgaggagaugcuccuuggg

SEQ ID NO: 2470298 - RNA, 15 nt, Human
gcgaggaggcuccag

SEQ ID NO: 2470299 - RNA, 19 nt, Human
gcgaggagaugcuccuugg

SEQ ID NO: 2470300 - RNA, 21 nt, Human
gcgagcuaugaucgcgccacu

SEQ ID NO: 2470301 - RNA, 14 nt, Human
gccuugccagagau

SEQ ID NO: 2470302 - RNA, 21 nt, Human
gccuguuggacccgcucugga

SEQ ID NO: 2470303 - RNA, 13 nt, Human
gccuugccagaga

SEQ ID NO: 2470304 - RNA, 17 nt, Human
gccuugccagagaucca

SEQ ID NO: 2470305 - RNA, 12 nt, Human
gccuugcccaga

SEQ ID NO: 2470306 - RNA, 14 nt, Human
gccuugcccagaga

SEQ ID NO: 2470307 - RNA, 15 nt, Human
gccuugcccagagau

SEQ ID NO: 2470308 - RNA, 16 nt, Human
gccuugcccagagaug

SEQ ID NO: 2470309 - RNA, 22 nt, Human
gccuugcccagagaugccucca

SEQ ID NO: 2470310 - RNA, 18 nt, Human
gccuugcgguauccgccc

SEQ ID NO: 2470311 - RNA, 19 nt, Human
gccuugcgguauccgcccc

SEQ ID NO: 2470312 - RNA, 22 nt, Human
gccuugcgguauccgcccccaa

SEQ ID NO: 2470313 - RNA, 20 nt, Human
gccuugcccagagaugccuc

SEQ ID NO: 2470314 - RNA, 22 nt, Human
gccuugcccggauucugggagg

SEQ ID NO: 2470315 - RNA, 21 nt, Human
gccuucggccuccauccugag

SEQ ID NO: 2470316 - RNA, 23 nt, Human
gccuucggccuccauccugaggc

SEQ ID NO: 2470317 - RNA, 20 nt, Human
gccuucggccuccauccuga

SEQ ID NO: 2470318 - RNA, 19 nt, Human
gccuugaccauucuccacc

SEQ ID NO: 2470319 - RNA, 17 nt, Human
gccuugaccauucucca

SEQ ID NO: 2470320 - RNA, 20 nt, Human
gccuugaccauucuccaccu

SEQ ID NO: 2470321 - RNA, 22 nt, Human
gccuguuccccucacuggauga

SEQ ID NO: 2470322 - RNA, 17 nt, Human
gccuguuccccucacug

SEQ ID NO: 2470323 - RNA, 19 nt, Human
gccuguuggacccgcucug

SEQ ID NO: 2470324 - RNA, 20 nt, Human
gccuggccugagcugggaug

SEQ ID NO: 2470325 - RNA, 14 nt, Human
gccuggccugaggu

SEQ ID NO: 2470326 - RNA, 22 nt, Human
gccuggcgggaugggccaccgc

SEQ ID NO: 2470327 - RNA, 21 nt, Human
gccuggcgggaugggccaccg

SEQ ID NO: 2470328 - RNA, 23 nt, Human
gccuggcgggaugggccaccgcc

SEQ ID NO: 2470329 - RNA, 20 nt, Human
gccuggcgggaugggccacc

SEQ ID NO: 2470330 - RNA, 15 nt, Human
gccuggcgggauggg

SEQ ID NO: 2470331 - RNA, 19 nt, Human
gccuggcgacagagcgaga

SEQ ID NO: 2470332 - RNA, 16 nt, Human
gccuggccuggcacac

SEQ ID NO: 2470333 - RNA, 13 nt, Human
gccuggccuggca

SEQ ID NO: 2470334 - RNA, 21 nt, Human
gccuggcgaaaccccaucucu

SEQ ID NO: 2470335 - RNA, 18 nt, Human
gccuggccugagcuggga

SEQ ID NO: 2470336 - RNA, 14 nt, Human
gccuggccugagcu

SEQ ID NO: 2470337 - RNA, 13 nt, Human
gccuggccugagc

SEQ ID NO: 2470338 - RNA, 18 nt, Human
gccuggcucagagccagu

SEQ ID NO: 2470339 - RNA, 17 nt, Human
gccuggcucagagccag

SEQ ID NO: 2470340 - RNA, 16 nt, Human
gccuggcucagagcca

SEQ ID NO: 2470341 - RNA, 14 nt, Human
gccuggcucagagc

SEQ ID NO: 2470342 - RNA, 13 nt, Human
gccuggcucaggu

SEQ ID NO: 2470343 - RNA, 16 nt, Human
gccugugccucuggga

SEQ ID NO: 2470344 - RNA, 17 nt, Human
gccugugccucugggac

SEQ ID NO: 2470345 - RNA, 18 nt, Human
gccuguggccuguguccc

SEQ ID NO: 2470346 - RNA, 19 nt, Human
gccuguggcgccgucucca

SEQ ID NO: 2470347 - RNA, 19 nt, Human
gccugugccuccucacccc

SEQ ID NO: 2470348 - RNA, 18 nt, Human
gccugugccucugggacu

SEQ ID NO: 2470349 - RNA, 17 nt, Human
gccuguguaacagcucc

SEQ ID NO: 2470350 - RNA, 16 nt, Human
gccuguguaacagcuc

SEQ ID NO: 2470351 - RNA, 14 nt, Human
gccuguguaacagc

SEQ ID NO: 2470352 - RNA, 23 nt, Human
gccuguggcgccgucuccagggg

SEQ ID NO: 2470353 - RNA, 21 nt, Human
gccuguggcgccgucuccagg

SEQ ID NO: 2470354 - RNA, 16 nt, Human
gccuguggcggugccu

SEQ ID NO: 2470355 - RNA, 18 nt, Human
gccuguggcggugccugg

SEQ ID NO: 2470356 - RNA, 19 nt, Human
gccuguggcggugccuggg

SEQ ID NO: 2470357 - RNA, 20 nt, Human
gccuguugggccaggagccu

SEQ ID NO: 2470358 - RNA, 18 nt, Human
gccuguugggccaggagc

SEQ ID NO: 2470359 - RNA, 16 nt, Human
gccuguugggccagga

SEQ ID NO: 2470360 - RNA, 15 nt, Human
gccuguugggccagg

SEQ ID NO: 2470361 - RNA, 23 nt, Human
gccuguguaacagcuccuuggga

SEQ ID NO: 2470362 - RNA, 22 nt, Human
gccuguguaacagcuccuuggg

SEQ ID NO: 2470363 - RNA, 19 nt, Human
gccuguguaacagcuccuu

SEQ ID NO: 2470364 - RNA, 18 nt, Human
gccuguguaacagcuccu

SEQ ID NO: 2470365 - RNA, 14 nt, Human
gccuguguccaugc

SEQ ID NO: 2470366 - RNA, 12 nt, Human
gccuguguccau

SEQ ID NO: 2470367 - RNA, 19 nt, Human
gccuguucccauucuugca

SEQ ID NO: 2470368 - RNA, 14 nt, Human
gccuguugggccag

SEQ ID NO: 2470369 - RNA, 20 nt, Human
gccuguucccccgccgcuuu

SEQ ID NO: 2470370 - RNA, 14 nt, Human
gccuguucccccgc

SEQ ID NO: 2470371 - RNA, 23 nt, Human
gccuguucccauucuugcauggc

SEQ ID NO: 2470372 - RNA, 15 nt, Human
gccugcccaggcccc

SEQ ID NO: 2470373 - RNA, 16 nt, Human
gccugaaagaggcuga

SEQ ID NO: 2470374 - RNA, 19 nt, Human
gccucuuugucuaaaacaa

SEQ ID NO: 2470375 - RNA, 23 nt, Human
gccucuuugucuaaaacaauaaa

SEQ ID NO: 2470376 - RNA, 22 nt, Human
gccugcccaggccccugccacc

SEQ ID NO: 2470377 - RNA, 16 nt, Human
gccugccccccucauc

SEQ ID NO: 2470378 - RNA, 18 nt, Human
gccucuuuucucugugcu

SEQ ID NO: 2470379 - RNA, 23 nt, Human
gccugccccaaacaaauaugcaa

SEQ ID NO: 2470380 - RNA, 17 nt, Human
gccugccccaaacaaau

SEQ ID NO: 2470381 - RNA, 20 nt, Human
gccugccccgcccccagucc

SEQ ID NO: 2470382 - RNA, 21 nt, Human
gccugccccgcccccaguccc

SEQ ID NO: 2470383 - RNA, 14 nt, Human
gccugccccuccca

SEQ ID NO: 2470384 - RNA, 15 nt, Human
gccugccccucccag

SEQ ID NO: 2470385 - RNA, 16 nt, Human
gccugccccucccaga

SEQ ID NO: 2470386 - RNA, 15 nt, Human
gccucuuagaugcag

SEQ ID NO: 2470387 - RNA, 16 nt, Human
gccucuuaugggcugg

SEQ ID NO: 2470388 - RNA, 18 nt, Human
gccucuuaugggcugggu

SEQ ID NO: 2470389 - RNA, 17 nt, Human
gccucuuaugggcuggg

SEQ ID NO: 2470390 - RNA, 22 nt, Human
gccucgaacuggcugcaaaggg

SEQ ID NO: 2470391 - RNA, 20 nt, Human
gccucgaacuggcugcaaag

SEQ ID NO: 2470392 - RNA, 20 nt, Human
gccuccuuccaccucccucc

SEQ ID NO: 2470393 - RNA, 19 nt, Human
gccuccuuccaccucccuc

SEQ ID NO: 2470394 - RNA, 17 nt, Human
gccucgacacagagugg

SEQ ID NO: 2470395 - RNA, 20 nt, Human
gccucuuaaagcugccugua

SEQ ID NO: 2470396 - RNA, 18 nt, Human
gccucuuagacuucugcu

SEQ ID NO: 2470397 - RNA, 22 nt, Human
gccucuuaaagcugccuguagu

SEQ ID NO: 2470398 - RNA, 23 nt, Human
gccucuuaaagcugccuguaguu

SEQ ID NO: 2470399 - RNA, 12 nt, Human
gccucuuuucuc

SEQ ID NO: 2470400 - RNA, 17 nt, Human
gccucuuucugucccuu

SEQ ID NO: 2470401 - RNA, 23 nt, Human
gccucuuucaagcagucgugccu

SEQ ID NO: 2470402 - RNA, 23 nt, Human
gccucuuucauccacuagugcaa

SEQ ID NO: 2470403 - RNA, 16 nt, Human
gccucuuucauccacu

SEQ ID NO: 2470404 - RNA, 14 nt, Human
gccugcccaggccc

SEQ ID NO: 2470405 - RNA, 13 nt, Human
gccugcccaggcc

SEQ ID NO: 2470406 - RNA, 22 nt, Human
gccucuucccccugcuuccacc

SEQ ID NO: 2470407 - RNA, 18 nt, Human
gccucuucccccugcuuc

SEQ ID NO: 2470408 - RNA, 16 nt, Human
gccucuucccccugcu

SEQ ID NO: 2470409 - RNA, 14 nt, Human
gccucuucccccug

SEQ ID NO: 2470410 - RNA, 17 nt, Human
gccucuucaaauuagaa

SEQ ID NO: 2470411 - RNA, 19 nt, Human
gccucuuagacuucugcuu

SEQ ID NO: 2470412 - RNA, 21 nt, Human
gccucuuccagucuuccugac

SEQ ID NO: 2470413 - RNA, 21 nt, Human
gccucuuaugggcuggguucu

SEQ ID NO: 2470414 - RNA, 14 nt, Human
gccucuuggguuca

SEQ ID NO: 2470415 - RNA, 21 nt, Human
gccucuuggaccucugcucug

SEQ ID NO: 2470416 - RNA, 14 nt, Human
gccuccaggugugc

SEQ ID NO: 2470417 - RNA, 13 nt, Human
gccuccaggugug

SEQ ID NO: 2470418 - RNA, 12 nt, Human
gccuccaggugu

SEQ ID NO: 2470419 - RNA, 24 nt, Human
gccuccagggcuggacugaggccu

SEQ ID NO: 2470420 - RNA, 23 nt, Human
gccuccagggcuggacugaggcc

SEQ ID NO: 2470421 - RNA, 22 nt, Human
gccuccagggcuggacugaggc

SEQ ID NO: 2470422 - RNA, 21 nt, Human
gccuccagggcuggacugagg

SEQ ID NO: 2470423 - RNA, 12 nt, Human
gccuccauccug

SEQ ID NO: 2470424 - RNA, 15 nt, Human
gccuccauccaaggc

SEQ ID NO: 2470425 - RNA, 23 nt, Human
gccuccugugugugcgccuacag

SEQ ID NO: 2470426 - RNA, 19 nt, Human
gccuccugugugugcgccu

SEQ ID NO: 2470427 - RNA, 17 nt, Human
gccucgaacuggcugca

SEQ ID NO: 2470428 - RNA, 18 nt, Human
gccuccuuccaccucccu

SEQ ID NO: 2470429 - RNA, 17 nt, Human
gccuccuuccaccuccc

SEQ ID NO: 2470430 - RNA, 16 nt, Human
gccuccuuccaccucc

SEQ ID NO: 2470431 - RNA, 17 nt, Human
gccuccauucugaccau

SEQ ID NO: 2470432 - RNA, 17 nt, Human
gccuccauuuaguucuu

SEQ ID NO: 2470433 - RNA, 17 nt, Human
gccucccaaagugcugg

SEQ ID NO: 2470434 - RNA, 16 nt, Human
gccuccauucugacca

SEQ ID NO: 2470435 - RNA, 16 nt, Human
gccucccaaagugcug

SEQ ID NO: 2470436 - RNA, 11 nt, Human
gccuccaugcu

SEQ ID NO: 2470437 - RNA, 16 nt, Human
gccuccauccaaggcc

SEQ ID NO: 2470438 - RNA, 16 nt, Human
gccuccaggugugcac

SEQ ID NO: 2470439 - RNA, 20 nt, Human
gcccucaccccugcccuggg

SEQ ID NO: 2470440 - RNA, 16 nt, Human
gcccccaccuccaccc

SEQ ID NO: 2470441 - RNA, 15 nt, Human
gcccccaccuccacc

SEQ ID NO: 2470442 - RNA, 18 nt, Human
gcccccaccuccacccuc

SEQ ID NO: 2470443 - RNA, 12 nt, Human
gcccccacugac

SEQ ID NO: 2470444 - RNA, 17 nt, Human
gcccccacugaccagaa

SEQ ID NO: 2470445 - RNA, 12 nt, Human
gcccccacuggu

SEQ ID NO: 2470446 - RNA, 18 nt, Human
gcccccaccgugggcagg

SEQ ID NO: 2470447 - RNA, 20 nt, Human
gcccccaccgugggcaggga

SEQ ID NO: 2470448 - RNA, 14 nt, Human
gcccccaccuccac

SEQ ID NO: 2470449 - RNA, 13 nt, Human
gcccccaccucca

SEQ ID NO: 2470450 - RNA, 22 nt, Human
gcccccaccgugggcagggagc

SEQ ID NO: 2470451 - RNA, 17 nt, Human
gcccccaccgugggcag

SEQ ID NO: 2470452 - RNA, 18 nt, Human
gcccccaucucaugcccc

SEQ ID NO: 2470453 - RNA, 19 nt, Human
gcccccacugccuuugacc

SEQ ID NO: 2470454 - RNA, 16 nt, Human
gccccccagccucugg

SEQ ID NO: 2470455 - RNA, 15 nt, Human
gccccccauccuggc

SEQ ID NO: 2470456 - RNA, 13 nt, Human
gccccccacccca

SEQ ID NO: 2470457 - RNA, 14 nt, Human
gccccccaccccag

SEQ ID NO: 2470458 - RNA, 22 nt, Human
gcccccccaacacugugcccug

SEQ ID NO: 2470459 - RNA, 19 nt, Human
gcccccccaacacugugcc

SEQ ID NO: 2470460 - RNA, 17 nt, Human
gcccccccaacacugug

SEQ ID NO: 2470461 - RNA, 20 nt, Human
gccccccauccuggcccauc

SEQ ID NO: 2470462 - RNA, 19 nt, Human
gccccccauccuggcccau

SEQ ID NO: 2470463 - RNA, 18 nt, Human
gccccccauccuggccca

SEQ ID NO: 2470464 - RNA, 17 nt, Human
gccccccauccuggccc

SEQ ID NO: 2470465 - RNA, 16 nt, Human
gccccccauccuggcc

SEQ ID NO: 2470466 - RNA, 23 nt, Human
gcccccccaacacugugcccugg

SEQ ID NO: 2470467 - RNA, 16 nt, Human
gcccccccccaccccu

SEQ ID NO: 2470468 - RNA, 17 nt, Human
gcccccccccaccccug

SEQ ID NO: 2470469 - RNA, 14 nt, Human
gcccccccuuccac

SEQ ID NO: 2470470 - RNA, 13 nt, Human
gcccccccuucca

SEQ ID NO: 2470471 - RNA, 16 nt, Human
gccccugccacccugg

SEQ ID NO: 2470472 - RNA, 17 nt, Human
gccccugccacccuggg

SEQ ID NO: 2470473 - RNA, 11 nt, Human
gccccugccag

SEQ ID NO: 2470474 - RNA, 16 nt, Human
gccccugccagacccc

SEQ ID NO: 2470475 - RNA, 18 nt, Human
gccccugccaccucccug

SEQ ID NO: 2470476 - RNA, 16 nt, Human
gccccccucaaaccuc

SEQ ID NO: 2470477 - RNA, 14 nt, Human
gccccccucaaacc

SEQ ID NO: 2470478 - RNA, 11 nt, Human
gccccccucaa

SEQ ID NO: 2470479 - RNA, 15 nt, Human
gcccccccuuccacu

SEQ ID NO: 2470480 - RNA, 23 nt, Human
gcccgggcugccugggcuguugg

SEQ ID NO: 2470481 - RNA, 18 nt, Human
gcccgggcugccugggcu

SEQ ID NO: 2470482 - RNA, 17 nt, Human
gcccgggcugccugggc

SEQ ID NO: 2470483 - RNA, 16 nt, Human
gcccgggcugccuggg

SEQ ID NO: 2470484 - RNA, 15 nt, Human
gcccgggcugccugg

SEQ ID NO: 2470485 - RNA, 14 nt, Human
gcccgggcugccug

SEQ ID NO: 2470486 - RNA, 13 nt, Human
gcccgggcugccu

SEQ ID NO: 2470487 - RNA, 18 nt, Human
gcccggggcagcugccag

SEQ ID NO: 2470488 - RNA, 14 nt, Human
gcccggggcagcug

SEQ ID NO: 2470489 - RNA, 17 nt, Human
gcccggggcagcugcca

SEQ ID NO: 2470490 - RNA, 22 nt, Human
gcccggggcagcugccagagaa

SEQ ID NO: 2470491 - RNA, 23 nt, Human
gcccgggcucugccucccaucac

SEQ ID NO: 2470492 - RNA, 12 nt, Human
gcccgggcugcc

SEQ ID NO: 2470493 - RNA, 19 nt, Human
gccccugcugccuccccaa

SEQ ID NO: 2470494 - RNA, 16 nt, Human
gccccugcugccuccc

SEQ ID NO: 2470495 - RNA, 17 nt, Human
gccccugcugccucccc

SEQ ID NO: 2470496 - RNA, 20 nt, Human
gccccugcugccuccccaac

SEQ ID NO: 2470497 - RNA, 23 nt, Human
gccccugccucucugcagguccc

SEQ ID NO: 2470498 - RNA, 20 nt, Human
gccccugccucucugcaggu

SEQ ID NO: 2470499 - RNA, 21 nt, Human
gccccugccccagcccaaguc

SEQ ID NO: 2470500 - RNA, 20 nt, Human
gccccugccccagcccaagu

SEQ ID NO: 2470501 - RNA, 15 nt, Human
gccccugccccagcc

SEQ ID NO: 2470502 - RNA, 13 nt, Human
gccccugcugccu

SEQ ID NO: 2470503 - RNA, 15 nt, Human
gccccugcugccucc

SEQ ID NO: 2470504 - RNA, 16 nt, Human
gcccuaaugcgcaggc

SEQ ID NO: 2470505 - RNA, 17 nt, Human
gcccuaaugcgcaggcu

SEQ ID NO: 2470506 - RNA, 19 nt, Human
gcccuaaugcgcaggcugg

SEQ ID NO: 2470507 - RNA, 20 nt, Human
gcccuaaugcgcaggcuggc

SEQ ID NO: 2470508 - RNA, 15 nt, Human
gcccuaaggaucucu

SEQ ID NO: 2470509 - RNA, 13 nt, Human
gcccguccugccu

SEQ ID NO: 2470510 - RNA, 17 nt, Human
gcccguaaacacgccug

SEQ ID NO: 2470511 - RNA, 21 nt, Human
gcccuaaccucugagucacca

SEQ ID NO: 2470512 - RNA, 18 nt, Human
gcccgucauguuccucaa

SEQ ID NO: 2470513 - RNA, 22 nt, Human
gcccucaccccugguucucauc

SEQ ID NO: 2470514 - RNA, 21 nt, Human
gcccucaccccugguucucau

SEQ ID NO: 2470515 - RNA, 18 nt, Human
gcccucaccccugguucu

SEQ ID NO: 2470516 - RNA, 23 nt, Human
gcccucaaggccucccacaguga

SEQ ID NO: 2470517 - RNA, 19 nt, Human
gcccucaccccugcccugg

SEQ ID NO: 2470518 - RNA, 22 nt, Human
gcccucaaggccucccacagug

SEQ ID NO: 2470519 - RNA, 21 nt, Human
gcccucaaggccucccacagu

SEQ ID NO: 2470520 - RNA, 13 nt, Human
gcccucaccccug

SEQ ID NO: 2470521 - RNA, 20 nt, Human
gcccucaaggccucccacag

SEQ ID NO: 2470522 - RNA, 19 nt, Human
gcccucaaggccucccaca

SEQ ID NO: 2470523 - RNA, 18 nt, Human
gcccucaaggccucccac

SEQ ID NO: 2470524 - RNA, 17 nt, Human
gcccucaaggccuccca

SEQ ID NO: 2470525 - RNA, 15 nt, Human
gcccucaaucccagc

SEQ ID NO: 2470526 - RNA, 19 nt, Human
gcccucaaaaugacagcca

SEQ ID NO: 2470527 - RNA, 15 nt, Human
gcccucaaggccucc

SEQ ID NO: 2470528 - RNA, 16 nt, Human
gcccucaaggccuccc

SEQ ID NO: 2470529 - RNA, 20 nt, Human
gccuaggugacagagugaga

SEQ ID NO: 2470530 - RNA, 17 nt, Human
gccuagggccuggucca

SEQ ID NO: 2470531 - RNA, 17 nt, Human
gccuaggggucagggac

SEQ ID NO: 2470532 - RNA, 14 nt, Human
gccuagucccuucc

SEQ ID NO: 2470533 - RNA, 22 nt, Human
gccuagugaaggcuucucucug

SEQ ID NO: 2470534 - RNA, 23 nt, Human
gccuagugaaggcuucucucugu

SEQ ID NO: 2470535 - RNA, 19 nt, Human
gccuagugaaggcuucucu

SEQ ID NO: 2470536 - RNA, 22 nt, Human
gccuaggggucagggaccaagg

SEQ ID NO: 2470537 - RNA, 19 nt, Human
gccuagucccuuccacacc

SEQ ID NO: 2470538 - RNA, 18 nt, Human
gccuaguggggucucccu

SEQ ID NO: 2470539 - RNA, 19 nt, Human
gccuaguggggucucccuc

SEQ ID NO: 2470540 - RNA, 22 nt, Human
gccuaguggggucucccucucc

SEQ ID NO: 2470541 - RNA, 23 nt, Human
gccuaguggggucucccucuccu

SEQ ID NO: 2470542 - RNA, 17 nt, Human
gccuaguucauccaauc

SEQ ID NO: 2470543 - RNA, 21 nt, Human
gccuaguucauccaauccuca

SEQ ID NO: 2470544 - RNA, 21 nt, Human
gccuagcauacguacacauuu

SEQ ID NO: 2470545 - RNA, 22 nt, Human
gccuagcauacguacacauuuu

SEQ ID NO: 2470546 - RNA, 20 nt, Human
gccuagcauacguacacauu

SEQ ID NO: 2470547 - RNA, 16 nt, Human
gccgccgccucgccca

SEQ ID NO: 2470548 - RNA, 15 nt, Human
gccgccgccucgccc

SEQ ID NO: 2470549 - RNA, 14 nt, Human
gccgccgccucgcc

SEQ ID NO: 2470550 - RNA, 13 nt, Human
gccgccgccucuu

SEQ ID NO: 2470551 - RNA, 24 nt, Human
gccgccgccucgcccaccgcaugc

SEQ ID NO: 2470552 - RNA, 23 nt, Human
gccuagcauacguacacauuuua

SEQ ID NO: 2470553 - RNA, 13 nt, Human
gccgccucaaugu

SEQ ID NO: 2470554 - RNA, 15 nt, Human
gccuagccgaccuca

SEQ ID NO: 2470555 - RNA, 16 nt, Human
gccuagccgaccucag

SEQ ID NO: 2470556 - RNA, 17 nt, Human
gccuagccgaccucagc

SEQ ID NO: 2470557 - RNA, 18 nt, Human
gccuagccgaccucagcc

SEQ ID NO: 2470558 - RNA, 14 nt, Human
gccuagcugcuaca

SEQ ID NO: 2470559 - RNA, 14 nt, Human
gccgccucaccccc

SEQ ID NO: 2470560 - RNA, 19 nt, Human
gccuagccgaccucagccu

SEQ ID NO: 2470561 - RNA, 20 nt, Human
gccuagccgaccucagccuu

SEQ ID NO: 2470562 - RNA, 15 nt, Human
gccuaggugacagag

SEQ ID NO: 2470563 - RNA, 14 nt, Human
gccuaggugacaga

SEQ ID NO: 2470564 - RNA, 20 nt, Human
gccuaggccucagccagaga

SEQ ID NO: 2470565 - RNA, 17 nt, Human
gccuaggccucagccag

SEQ ID NO: 2470566 - RNA, 18 nt, Human
gccuaggccucagccaga

SEQ ID NO: 2470567 - RNA, 13 nt, Human
gccuaggugacag

SEQ ID NO: 2470568 - RNA, 24 nt, Human
gccuagcugcuacaaagaagacau

SEQ ID NO: 2470569 - RNA, 23 nt, Human
gccuagcugcuacaaagaagaca

SEQ ID NO: 2470570 - RNA, 22 nt, Human
gccuagcugcuacaaagaagac

SEQ ID NO: 2470571 - RNA, 19 nt, Human
gccuagcugcuacaaagaa

SEQ ID NO: 2470572 - RNA, 17 nt, Human
gccuagcugcuacaaag

SEQ ID NO: 2470573 - RNA, 16 nt, Human
gccuagcugcuacaaa

SEQ ID NO: 2470574 - RNA, 15 nt, Human
gccuagcugcuacaa

SEQ ID NO: 2470575 - RNA, 18 nt, Human
gccuaggagauaucugag

SEQ ID NO: 2470576 - RNA, 11 nt, Human
gccuaggagau

SEQ ID NO: 2470577 - RNA, 20 nt, Human
gccuaggagauaucugaggg

SEQ ID NO: 2470578 - RNA, 17 nt, Human
gccuaggaauucccagc

SEQ ID NO: 2470579 - RNA, 13 nt, Human
gccuaggccucag

SEQ ID NO: 2470580 - RNA, 16 nt, Human
gccuaggccucagcca

SEQ ID NO: 2470581 - RNA, 15 nt, Human
gccgcagcucuugcc

SEQ ID NO: 2470582 - RNA, 14 nt, Human
gccgcagcucuugc

SEQ ID NO: 2470583 - RNA, 13 nt, Human
gccgcagcucuug

SEQ ID NO: 2470584 - RNA, 18 nt, Human
gcccuuaucugugcucag

SEQ ID NO: 2470585 - RNA, 20 nt, Human
gccgcagcucuugcccuucc

SEQ ID NO: 2470586 - RNA, 19 nt, Human
gccgcagcucuugcccuuc

SEQ ID NO: 2470587 - RNA, 15 nt, Human
gccgcaucuucucca

SEQ ID NO: 2470588 - RNA, 17 nt, Human
gccgcaucuucuccauc

SEQ ID NO: 2470589 - RNA, 18 nt, Human
gccgcaucuucuccaucu

SEQ ID NO: 2470590 - RNA, 20 nt, Human
gccgcaucuucuccaucugg

SEQ ID NO: 2470591 - RNA, 14 nt, Human
gccgcauucccuga

SEQ ID NO: 2470592 - RNA, 14 nt, Human
gccgcccaaggccc

SEQ ID NO: 2470593 - RNA, 23 nt, Human
gccgcccccugccccccagccuc

SEQ ID NO: 2470594 - RNA, 18 nt, Human
gccgcccugcgggugaac

SEQ ID NO: 2470595 - RNA, 13 nt, Human
gccgccgccucgc

SEQ ID NO: 2470596 - RNA, 15 nt, Human
gccgccccacccaga

SEQ ID NO: 2470597 - RNA, 17 nt, Human
gccgcccccugcccccc

SEQ ID NO: 2470598 - RNA, 14 nt, Human
gccgccccacccag

SEQ ID NO: 2470599 - RNA, 19 nt, Human
gccgccccagccucugagc

SEQ ID NO: 2470600 - RNA, 15 nt, Human
gcccuuaucugugcu

SEQ ID NO: 2470601 - RNA, 16 nt, Human
gcccuuaucugugcuc

SEQ ID NO: 2470602 - RNA, 22 nt, Human
gcccuuagcagggaaacagcua

SEQ ID NO: 2470603 - RNA, 20 nt, Human
gccgcagcccugcagagggc

SEQ ID NO: 2470604 - RNA, 19 nt, Human
gccgcagcccugcagaggg

SEQ ID NO: 2470605 - RNA, 17 nt, Human
gccgcagccucccucug

SEQ ID NO: 2470606 - RNA, 18 nt, Human
gccgcagccucccucuga

SEQ ID NO: 2470607 - RNA, 21 nt, Human
gcccugucgagacacuugccu

SEQ ID NO: 2470608 - RNA, 16 nt, Human
gcccugucgagacacu

SEQ ID NO: 2470609 - RNA, 23 nt, Human
gcccugucccucccaccucugug

SEQ ID NO: 2470610 - RNA, 22 nt, Human
gcccugucccucccaccucugu

SEQ ID NO: 2470611 - RNA, 21 nt, Human
gcccugucccucccaccucug

SEQ ID NO: 2470612 - RNA, 20 nt, Human
gcccugucccucccaccucu

SEQ ID NO: 2470613 - RNA, 19 nt, Human
gcccugucccucccaccuc

SEQ ID NO: 2470614 - RNA, 22 nt, Human
gcccuguccugccuaaggcuga

SEQ ID NO: 2470615 - RNA, 20 nt, Human
gcccuuagcagggaaacagc

SEQ ID NO: 2470616 - RNA, 11 nt, Human
gcccugucugu

SEQ ID NO: 2470617 - RNA, 17 nt, Human
gcccugucgagacacuu

SEQ ID NO: 2470618 - RNA, 21 nt, Human
gcccugugcaaccucuuggcc

SEQ ID NO: 2470619 - RNA, 19 nt, Human
gcccuuagcagggaaacag

SEQ ID NO: 2470620 - RNA, 13 nt, Human
gcccugccuccuu

SEQ ID NO: 2470621 - RNA, 12 nt, Human
gcccugccuccu

SEQ ID NO: 2470622 - RNA, 18 nt, Human
gcccugcccugguuuccu

SEQ ID NO: 2470623 - RNA, 15 nt, Human
gcccugucagugcag

SEQ ID NO: 2470624 - RNA, 18 nt, Human
gcccugucccucccaccu

SEQ ID NO: 2470625 - RNA, 17 nt, Human
gcccugucccucccacc

SEQ ID NO: 2470626 - RNA, 16 nt, Human
gcccugucccucccac

SEQ ID NO: 2470627 - RNA, 15 nt, Human
gcccugucccuccca

SEQ ID NO: 2470628 - RNA, 13 nt, Human
gcccugucccucc

SEQ ID NO: 2470629 - RNA, 22 nt, Human
gcccugcccaccuggccucugc

SEQ ID NO: 2470630 - RNA, 21 nt, Human
gcccugcccaccuggccucug

SEQ ID NO: 2470631 - RNA, 20 nt, Human
gcccugcccaccuggccucu

SEQ ID NO: 2470632 - RNA, 17 nt, Human
gcccugcccaccuggcc

SEQ ID NO: 2470633 - RNA, 11 nt, Human
gcccugccucc

SEQ ID NO: 2470634 - RNA, 12 nt, Human
gcccugcccugg

SEQ ID NO: 2470635 - RNA, 16 nt, Human
gcccugcccugguuuc

SEQ ID NO: 2470636 - RNA, 11 nt, Human
gcccugcccug

SEQ ID NO: 2470637 - RNA, 15 nt, Human
gcccugcccuagcuc

SEQ ID NO: 2470638 - RNA, 16 nt, Human
gcccugcccuagcucc

SEQ ID NO: 2470639 - RNA, 17 nt, Human
gcccugcccuagcucca

SEQ ID NO: 2470640 - RNA, 18 nt, Human
gcccugcccuagcuccac

SEQ ID NO: 2470641 - RNA, 18 nt, Human
gcccugcagagggcacag

SEQ ID NO: 2470642 - RNA, 16 nt, Human
gcccugcagagggcac

SEQ ID NO: 2470643 - RNA, 21 nt, Human
gcccugcagaggggaaaccag

SEQ ID NO: 2470644 - RNA, 22 nt, Human
gcuggaggugggagcaggagau

SEQ ID NO: 2470645 - RNA, 16 nt, Human
gcuggagguggggccu

SEQ ID NO: 2470646 - RNA, 21 nt, Human
gcuggaggugggagcaggaga

SEQ ID NO: 2470647 - RNA, 19 nt, Human
gcuggaggugggagcagga

SEQ ID NO: 2470648 - RNA, 17 nt, Human
gcuggaggugggagcag

SEQ ID NO: 2470649 - RNA, 16 nt, Human
gcuggaggugggagca

SEQ ID NO: 2470650 - RNA, 15 nt, Human
gcuggaggugggagc

SEQ ID NO: 2470651 - RNA, 14 nt, Human
gcuggaggugggag

SEQ ID NO: 2470652 - RNA, 16 nt, Human
gcuggagguaaggccu

SEQ ID NO: 2470653 - RNA, 13 nt, Human
gcuggaggcaggg

SEQ ID NO: 2470654 - RNA, 14 nt, Human
gcuggaggcagggc

SEQ ID NO: 2470655 - RNA, 15 nt, Human
gcuggaggcagggcc

SEQ ID NO: 2470656 - RNA, 12 nt, Human
gcuggaggcagg

SEQ ID NO: 2470657 - RNA, 16 nt, Human
gcuggaggcagggccu

SEQ ID NO: 2470658 - RNA, 21 nt, Human
gcuggaggcagggccuugccc

SEQ ID NO: 2470659 - RNA, 20 nt, Human
gcuggccuggccccucaggg

SEQ ID NO: 2470660 - RNA, 22 nt, Human
gcuggagugcagugagccgaga

SEQ ID NO: 2470661 - RNA, 17 nt, Human
gcuggagugcagugagc

SEQ ID NO: 2470662 - RNA, 18 nt, Human
gcuggagugcagugagcc

SEQ ID NO: 2470663 - RNA, 20 nt, Human
gcuggcgcagccaaggccga

SEQ ID NO: 2470664 - RNA, 17 nt, Human
gcuggcgcagccaaggc

SEQ ID NO: 2470665 - RNA, 16 nt, Human
gcuggcgcagccaagg

SEQ ID NO: 2470666 - RNA, 14 nt, Human
gcuggcgcagccaa

SEQ ID NO: 2470667 - RNA, 13 nt, Human
gcuggcgcagcca

SEQ ID NO: 2470668 - RNA, 20 nt, Human
gcuggcgugcaguggugcga

SEQ ID NO: 2470669 - RNA, 19 nt, Human
gcuggccuuccugcccuac

SEQ ID NO: 2470670 - RNA, 23 nt, Human
gcuggccuuccugcccuacagag

SEQ ID NO: 2470671 - RNA, 16 nt, Human
gcuggccuuccugccc

SEQ ID NO: 2470672 - RNA, 15 nt, Human
gcuggccuuccugcc

SEQ ID NO: 2470673 - RNA, 13 nt, Human
gcuggccuuccug

SEQ ID NO: 2470674 - RNA, 12 nt, Human
gcuggccuuccu

SEQ ID NO: 2470675 - RNA, 15 nt, Human
gcuggagugcagugg

SEQ ID NO: 2470676 - RNA, 17 nt, Human
gcuggccuggccggcaa

SEQ ID NO: 2470677 - RNA, 14 nt, Human
gcuggccuggccgg

SEQ ID NO: 2470678 - RNA, 15 nt, Human
gcugcugaaggcucg

SEQ ID NO: 2470679 - RNA, 14 nt, Human
gcugcugaaggcuc

SEQ ID NO: 2470680 - RNA, 13 nt, Human
gcugcugaaggcu

SEQ ID NO: 2470681 - RNA, 23 nt, Human
gcucugguccauagagagcaaga

SEQ ID NO: 2470682 - RNA, 16 nt, Human
gcucugguccauagag

SEQ ID NO: 2470683 - RNA, 15 nt, Human
gcucugguccauaga

SEQ ID NO: 2470684 - RNA, 14 nt, Human
gcucugggccauuc

SEQ ID NO: 2470685 - RNA, 20 nt, Human
gcucugggccauucuccaca

SEQ ID NO: 2470686 - RNA, 23 nt, Human
gcucugggccauucuccacagca

SEQ ID NO: 2470687 - RNA, 13 nt, Human
gcucugcccuugg

SEQ ID NO: 2470688 - RNA, 13 nt, Human
gcucugcccugcc

SEQ ID NO: 2470689 - RNA, 15 nt, Human
gcucugcccugcccu

SEQ ID NO: 2470690 - RNA, 21 nt, Human
gcucugggauagcugacccag

SEQ ID NO: 2470691 - RNA, 13 nt, Human
gcugcuggcuggu

SEQ ID NO: 2470692 - RNA, 14 nt, Human
gcugcuggcgccuc

SEQ ID NO: 2470693 - RNA, 20 nt, Human
gcugcuggaucacagcugcu

SEQ ID NO: 2470694 - RNA, 12 nt, Human
gcugcuggcgcc

SEQ ID NO: 2470695 - RNA, 12 nt, Human
gcugcuggagga

SEQ ID NO: 2470696 - RNA, 14 nt, Human
gcugcuggaggaaa

SEQ ID NO: 2470697 - RNA, 18 nt, Human
gcugcuggaucacagcug

SEQ ID NO: 2470698 - RNA, 22 nt, Human
gcugcuggaggaaaacugagac

SEQ ID NO: 2470699 - RNA, 13 nt, Human
gcugcugcugcug

SEQ ID NO: 2470700 - RNA, 15 nt, Human
gcugcugaaggcuca

SEQ ID NO: 2470701 - RNA, 18 nt, Human
gcugcugaaggcucgagc

SEQ ID NO: 2470702 - RNA, 14 nt, Human
gcugcuggagacuc

SEQ ID NO: 2470703 - RNA, 13 nt, Human
gcugcuggagacu

SEQ ID NO: 2470704 - RNA, 21 nt, Human
gcugcuggacaguaucacugu

SEQ ID NO: 2470705 - RNA, 14 nt, Human
gcugcugcugcugc

SEQ ID NO: 2470706 - RNA, 19 nt, Human
gcugcuggcgccucugcaa

SEQ ID NO: 2470707 - RNA, 18 nt, Human
gcugcuggcgccucugca

SEQ ID NO: 2470708 - RNA, 17 nt, Human
gcugcuggcgccucugc

SEQ ID NO: 2470709 - RNA, 16 nt, Human
gcugcuggcgccucug

SEQ ID NO: 2470710 - RNA, 11 nt, Human
gcugcuggcuu

SEQ ID NO: 2470711 - RNA, 21 nt, Human
gcuggguaaacuguggaugau

SEQ ID NO: 2470712 - RNA, 13 nt, Human
gcugggucaggca

SEQ ID NO: 2470713 - RNA, 14 nt, Human
gcugggucaggcag

SEQ ID NO: 2470714 - RNA, 15 nt, Human
gcugggucaggcagg

SEQ ID NO: 2470715 - RNA, 16 nt, Human
gcugggucaggcaggg

SEQ ID NO: 2470716 - RNA, 12 nt, Human
gcugggucgccc

SEQ ID NO: 2470717 - RNA, 18 nt, Human
gcugggugcgaccccauc

SEQ ID NO: 2470718 - RNA, 22 nt, Human
gcugggccccugccucucugca

SEQ ID NO: 2470719 - RNA, 21 nt, Human
gcugggccccugccucucugc

SEQ ID NO: 2470720 - RNA, 23 nt, Human
gcugggccccugccucucugcag

SEQ ID NO: 2470721 - RNA, 12 nt, Human
gcuggcucugag

SEQ ID NO: 2470722 - RNA, 23 nt, Human
gcuggcuccagaugcagggcagu

SEQ ID NO: 2470723 - RNA, 14 nt, Human
gcuggcuccagaug

SEQ ID NO: 2470724 - RNA, 17 nt, Human
gcuggcuccagaugcag

SEQ ID NO: 2470725 - RNA, 21 nt, Human
gcuggcuccagaugcagggca

SEQ ID NO: 2470726 - RNA, 22 nt, Human
gcuggcuccagaugcagggcag

SEQ ID NO: 2470727 - RNA, 15 nt, Human
gcuggcgccucugca

SEQ ID NO: 2470728 - RNA, 14 nt, Human
gcuggcgccucugc

SEQ ID NO: 2470729 - RNA, 13 nt, Human
gcuggcgccucug

SEQ ID NO: 2470730 - RNA, 12 nt, Human
gcuggcgccucu

SEQ ID NO: 2470731 - RNA, 16 nt, Human
gcuggcgccucugcaa

SEQ ID NO: 2470732 - RNA, 16 nt, Human
gcuggcggcuacucag

SEQ ID NO: 2470733 - RNA, 17 nt, Human
gcuggcuguuggcuggg

SEQ ID NO: 2470734 - RNA, 16 nt, Human
gcuggcuguuggcugg

SEQ ID NO: 2470735 - RNA, 15 nt, Human
gcuggcuguuggcug

SEQ ID NO: 2470736 - RNA, 14 nt, Human
gcuggcuggggccu

SEQ ID NO: 2470737 - RNA, 15 nt, Human
gcuggcugggcaugg

SEQ ID NO: 2470738 - RNA, 16 nt, Human
gcuggcugggcaugga

SEQ ID NO: 2470739 - RNA, 21 nt, Human
gcuggguggcaccagcagccu

SEQ ID NO: 2470740 - RNA, 22 nt, Human
gcuggguggcaccagcagccug

SEQ ID NO: 2470741 - RNA, 23 nt, Human
gcuggguggcaccagcagccugg

SEQ ID NO: 2470742 - RNA, 22 nt, Human
gcugggugcgaccccaucugcc

SEQ ID NO: 2470743 - RNA, 21 nt, Human
gcugggugcgaccccaucugc

SEQ ID NO: 2470744 - RNA, 23 nt, Human
gcugggugcgaccccaucugccc

SEQ ID NO: 2470745 - RNA, 22 nt, Human
gcuuccucauaguaugguggcu

SEQ ID NO: 2470746 - RNA, 23 nt, Human
gcuuccuagaaguuacugaaugc

SEQ ID NO: 2470747 - RNA, 19 nt, Human
gcuucuucuccuaugugua

SEQ ID NO: 2470748 - RNA, 18 nt, Human
gcuucuucuccuaugugu

SEQ ID NO: 2470749 - RNA, 20 nt, Human
gcuucuucuccuauguguaa

SEQ ID NO: 2470750 - RNA, 21 nt, Human
gcuucuuccuauuugccaugg

SEQ ID NO: 2470751 - RNA, 14 nt, Human
gcuucuucucaggc

SEQ ID NO: 2470752 - RNA, 19 nt, Human
gcuucuucagaucagugcu

SEQ ID NO: 2470753 - RNA, 16 nt, Human
gcuucuuccaggugcc

SEQ ID NO: 2470754 - RNA, 19 nt, Human
gcuucuuccaggugcccag

SEQ ID NO: 2470755 - RNA, 15 nt, Human
gcuucuuccaggugc

SEQ ID NO: 2470756 - RNA, 16 nt, Human
gcuucuucagaucagu

SEQ ID NO: 2470757 - RNA, 19 nt, Human
gcuucuaccaugaacagaa

SEQ ID NO: 2470758 - RNA, 22 nt, Human
gcuucuaauauuuauugcuuua

SEQ ID NO: 2470759 - RNA, 17 nt, Human
gcuucuaccaugaacag

SEQ ID NO: 2470760 - RNA, 16 nt, Human
gcuuccuccuggaaau

SEQ ID NO: 2470761 - RNA, 13 nt, Human
gcuuccuccugga

SEQ ID NO: 2470762 - RNA, 12 nt, Human
gcuuccuccugg

SEQ ID NO: 2470763 - RNA, 14 nt, Human
gcuuccuccucccu

SEQ ID NO: 2470764 - RNA, 20 nt, Human
gcuuccucuagaagccaagg

SEQ ID NO: 2470765 - RNA, 17 nt, Human
gcuuccucuagaagcca

SEQ ID NO: 2470766 - RNA, 15 nt, Human
gcuuccucuagaagc

SEQ ID NO: 2470767 - RNA, 13 nt, Human
gcuuccuccugcg

SEQ ID NO: 2470768 - RNA, 23 nt, Human
gcuuccucuagaagccaagggaa

SEQ ID NO: 2470769 - RNA, 22 nt, Human
gcuuccucuagaagccaaggga

SEQ ID NO: 2470770 - RNA, 14 nt, Human
gcuucguuuauuuu

SEQ ID NO: 2470771 - RNA, 21 nt, Human
gcuucuaauauuuauugcuuu

SEQ ID NO: 2470772 - RNA, 20 nt, Human
gcuucuaauauuuauugcuu

SEQ ID NO: 2470773 - RNA, 18 nt, Human
gcuucuaauauuuauugc

SEQ ID NO: 2470774 - RNA, 15 nt, Human
gcuucuaauauuuau

SEQ ID NO: 2470775 - RNA, 16 nt, Human
gcuucguuuauuuuca

SEQ ID NO: 2470776 - RNA, 17 nt, Human
gcuucguuuauuuucaa

SEQ ID NO: 2470777 - RNA, 22 nt, Human
gcuucgguuucuaacuuggagc

SEQ ID NO: 2470778 - RNA, 22 nt, Human
gcuuguaacuccaccaacccau

SEQ ID NO: 2470779 - RNA, 22 nt, Human
gcuugagccgggccccugggcu

SEQ ID NO: 2470780 - RNA, 21 nt, Human
gcuugagccgggccccugggc

SEQ ID NO: 2470781 - RNA, 18 nt, Human
gcuugagccgggccccug

SEQ ID NO: 2470782 - RNA, 17 nt, Human
gcuugagccgggccccu

SEQ ID NO: 2470783 - RNA, 20 nt, Human
gcuuguaaauagcucaggug

SEQ ID NO: 2470784 - RNA, 14 nt, Human
gcuugagcucagga

SEQ ID NO: 2470785 - RNA, 18 nt, Human
gcuucuugccucugugcu

SEQ ID NO: 2470786 - RNA, 17 nt, Human
gcuucuugccucugugc

SEQ ID NO: 2470787 - RNA, 16 nt, Human
gcuucuugccucugug

SEQ ID NO: 2470788 - RNA, 15 nt, Human
gcuucuugccucugu

SEQ ID NO: 2470789 - RNA, 14 nt, Human
gcuucuugccucug

SEQ ID NO: 2470790 - RNA, 13 nt, Human
gcuucuugccucu

SEQ ID NO: 2470791 - RNA, 12 nt, Human
gcuucuugccuc

SEQ ID NO: 2470792 - RNA, 22 nt, Human
gcuugacuuuuguauagguaga

SEQ ID NO: 2470793 - RNA, 15 nt, Human
gcuugacuuuuguau

SEQ ID NO: 2470794 - RNA, 20 nt, Human
gcuugagaaauauggacacu

SEQ ID NO: 2470795 - RNA, 12 nt, Human
gcuugagcccag

SEQ ID NO: 2470796 - RNA, 12 nt, Human
gcuugagccggg

SEQ ID NO: 2470797 - RNA, 16 nt, Human
gcuugagcccaggagu

SEQ ID NO: 2470798 - RNA, 14 nt, Human
gcuugagcccagga

SEQ ID NO: 2470799 - RNA, 15 nt, Human
gcuugagcccaggag

SEQ ID NO: 2470800 - RNA, 14 nt, Human
gcuuguauagugua

SEQ ID NO: 2470801 - RNA, 17 nt, Human
gcuuguaucaacacugu

SEQ ID NO: 2470802 - RNA, 13 nt, Human
gcuugucagagcu

SEQ ID NO: 2470803 - RNA, 14 nt, Human
gcuugucagagcug

SEQ ID NO: 2470804 - RNA, 21 nt, Human
gcuuguccaacccgaggcccg

SEQ ID NO: 2470805 - RNA, 15 nt, Human
gcuugucagagcugg

SEQ ID NO: 2470806 - RNA, 16 nt, Human
gcuugucagagcuggg

SEQ ID NO: 2470807 - RNA, 17 nt, Human
gcuugucagagcuggga

SEQ ID NO: 2470808 - RNA, 18 nt, Human
gcuugucagagcugggag

SEQ ID NO: 2470809 - RNA, 12 nt, Human
gcuuguacauaa

SEQ ID NO: 2470810 - RNA, 15 nt, Human
gcuuguaacuccacc

SEQ ID NO: 2470811 - RNA, 16 nt, Human
gcuuguaacuccacca

SEQ ID NO: 2470812 - RNA, 23 nt, Human
gcuuucuguugucauugcuguug

SEQ ID NO: 2470813 - RNA, 16 nt, Human
gcuuucuguugucauu

SEQ ID NO: 2470814 - RNA, 15 nt, Human
gcuuucuguugucau

SEQ ID NO: 2470815 - RNA, 22 nt, Human
gcuuucuguugucauugcuguu

SEQ ID NO: 2470816 - RNA, 12 nt, Human
gcuuucuugcug

SEQ ID NO: 2470817 - RNA, 13 nt, Human
gcuuucuugcugg

SEQ ID NO: 2470818 - RNA, 14 nt, Human
gcuuucuugcuggu

SEQ ID NO: 2470819 - RNA, 18 nt, Human
gcuugucauuaccagacg

SEQ ID NO: 2470820 - RNA, 15 nt, Human
gcuuguccagcgccu

SEQ ID NO: 2470821 - RNA, 16 nt, Human
gcuuguccagcgccua

SEQ ID NO: 2470822 - RNA, 16 nt, Human
gcuuguccccuccuca

SEQ ID NO: 2470823 - RNA, 19 nt, Human
gcuuguccccuccucacuc

SEQ ID NO: 2470824 - RNA, 22 nt, Human
gcuuguccccuccucacucccu

SEQ ID NO: 2470825 - RNA, 21 nt, Human
gcuuucuuucguuuguuuguu

SEQ ID NO: 2470826 - RNA, 20 nt, Human
gcuuucuuucguuuguuugu

SEQ ID NO: 2470827 - RNA, 17 nt, Human
gcuuucuugcugguugu

SEQ ID NO: 2470828 - RNA, 20 nt, Human
gcuuugacucaccuguuacu

SEQ ID NO: 2470829 - RNA, 14 nt, Human
gcuuugacucaccu

SEQ ID NO: 2470830 - RNA, 11 nt, Human
gcuuugaaugu

SEQ ID NO: 2470831 - RNA, 15 nt, Human
gcuuugacugagcag

SEQ ID NO: 2470832 - RNA, 22 nt, Human
gcuuugacugagcagacuggug

SEQ ID NO: 2470833 - RNA, 17 nt, Human
gcuucagccuccccacc

SEQ ID NO: 2470834 - RNA, 19 nt, Human
gcuucagccaggagcuggg

SEQ ID NO: 2470835 - RNA, 12 nt, Human
gcuucagccucc

SEQ ID NO: 2470836 - RNA, 19 nt, Human
gcuucacggaagagccuug

SEQ ID NO: 2470837 - RNA, 15 nt, Human
gcuucagccaggagc

SEQ ID NO: 2470838 - RNA, 18 nt, Human
gcuucacggaagagccuu

SEQ ID NO: 2470839 - RNA, 21 nt, Human
gcuucagccugaggcugagac

SEQ ID NO: 2470840 - RNA, 23 nt, Human
gcuucagccugaggcugagacug

SEQ ID NO: 2470841 - RNA, 12 nt, Human
gcuucagccuga

SEQ ID NO: 2470842 - RNA, 14 nt, Human
gcuucagccugagg

SEQ ID NO: 2470843 - RNA, 15 nt, Human
gcuucagccugaggc

SEQ ID NO: 2470844 - RNA, 20 nt, Human
gcuucagccugaggcugaga

SEQ ID NO: 2470845 - RNA, 19 nt, Human
gcuucaaggauccugagcc

SEQ ID NO: 2470846 - RNA, 18 nt, Human
gcuucaaggauccugagc

SEQ ID NO: 2470847 - RNA, 18 nt, Human
gcuuauuuaauuaaaaaa

SEQ ID NO: 2470848 - RNA, 20 nt, Human
gcuuauucaucuguuuuucu

SEQ ID NO: 2470849 - RNA, 13 nt, Human
gcuuauuguucca

SEQ ID NO: 2470850 - RNA, 14 nt, Human
gcuuauuguuccaa

SEQ ID NO: 2470851 - RNA, 15 nt, Human
gcuuauuguuccaag

SEQ ID NO: 2470852 - RNA, 17 nt, Human
gcuuauuguuccaagac

SEQ ID NO: 2470853 - RNA, 20 nt, Human
gcuuauuguuccaagacauu

SEQ ID NO: 2470854 - RNA, 21 nt, Human
gcuuauuguuccaagacauug

SEQ ID NO: 2470855 - RNA, 22 nt, Human
gcuuauuguuccaagacauugu

SEQ ID NO: 2470856 - RNA, 11 nt, Human
gcuuauuuaau

SEQ ID NO: 2470857 - RNA, 21 nt, Human
gcuucaaggauccugagccag

SEQ ID NO: 2470858 - RNA, 20 nt, Human
gcuucaaggauccugagcca

SEQ ID NO: 2470859 - RNA, 17 nt, Human
gcuucacggaagagccu

SEQ ID NO: 2470860 - RNA, 15 nt, Human
gcuucacggaagagc

SEQ ID NO: 2470861 - RNA, 20 nt, Human
ggacaggaugaccuggauaa

SEQ ID NO: 2470862 - RNA, 17 nt, Human
ggagaaagcacugaccu

SEQ ID NO: 2470863 - RNA, 16 nt, Human
ggagaaacagagacag

SEQ ID NO: 2470864 - RNA, 19 nt, Human
ggagaaacccuugaaaaga

SEQ ID NO: 2470865 - RNA, 9 nt, Human
ggagacuca

SEQ ID NO: 2470866 - RNA, 13 nt, Human
ggagacucaccuc

SEQ ID NO: 2470867 - RNA, 16 nt, Human
ggagacucaccucugc

SEQ ID NO: 2470868 - RNA, 17 nt, Human
ggagacucaccucugcc

SEQ ID NO: 2470869 - RNA, 18 nt, Human
ggagacucaccucugccu

SEQ ID NO: 2470870 - RNA, 19 nt, Human
ggagacucaccucugccuc

SEQ ID NO: 2470871 - RNA, 21 nt, Human
ggagacucaccucugccucaa

SEQ ID NO: 2470872 - RNA, 16 nt, Human
ggagacuccuaggcag

SEQ ID NO: 2470873 - RNA, 13 nt, Human
ggagacuccuagg

SEQ ID NO: 2470874 - RNA, 18 nt, Human
ggagacuccaugagaagc

SEQ ID NO: 2470875 - RNA, 21 nt, Human
ggagacuccaugagaagccgu

SEQ ID NO: 2470876 - RNA, 17 nt, Human
ggagacuccugcccugu

SEQ ID NO: 2470877 - RNA, 12 nt, Human
ggagacuccugc

SEQ ID NO: 2470878 - RNA, 21 nt, Human
ggagacuccuaggcaggacau

SEQ ID NO: 2470879 - RNA, 18 nt, Human
ggagacuccuaggcagga

SEQ ID NO: 2470880 - RNA, 13 nt, Human
ggagacucugugg

SEQ ID NO: 2470881 - RNA, 16 nt, Human
ggagacucuguggggc

SEQ ID NO: 2470882 - RNA, 13 nt, Human
ggagaaacuggaa

SEQ ID NO: 2470883 - RNA, 16 nt, Human
ggagaaaggaagggcu

SEQ ID NO: 2470884 - RNA, 22 nt, Human
ggacuuugcagccggcacaggg

SEQ ID NO: 2470885 - RNA, 15 nt, Human
ggagaaacagagaca

SEQ ID NO: 2470886 - RNA, 17 nt, Human
ggacuuugcagccggca

SEQ ID NO: 2470887 - RNA, 16 nt, Human
ggacuuugcagccggc

SEQ ID NO: 2470888 - RNA, 20 nt, Human
ggacuuuccuaaauguuuaa

SEQ ID NO: 2470889 - RNA, 23 nt, Human
ggacuuucuuuucgccguggcug

SEQ ID NO: 2470890 - RNA, 18 nt, Human
ggacuugaggauuuugag

SEQ ID NO: 2470891 - RNA, 13 nt, Human
ggacuugaaguug

SEQ ID NO: 2470892 - RNA, 12 nt, Human
ggacuugaaguu

SEQ ID NO: 2470893 - RNA, 14 nt, Human
ggacuuggaagcuc

SEQ ID NO: 2470894 - RNA, 19 nt, Human
ggacuugcaaaaaggguca

SEQ ID NO: 2470895 - RNA, 16 nt, Human
ggacuuuccacccccu

SEQ ID NO: 2470896 - RNA, 17 nt, Human
ggacuuuccacccccuc

SEQ ID NO: 2470897 - RNA, 20 nt, Human
ggacuuuccacccccucccu

SEQ ID NO: 2470898 - RNA, 21 nt, Human
ggacuuuccacccccucccug

SEQ ID NO: 2470899 - RNA, 21 nt, Human
ggacuuucuuuucgccguggc

SEQ ID NO: 2470900 - RNA, 11 nt, Human
ggacuucuuuu

SEQ ID NO: 2470901 - RNA, 19 nt, Human
ggacuccccaggccaggcc

SEQ ID NO: 2470902 - RNA, 17 nt, Human
ggacuucuuuucacauu

SEQ ID NO: 2470903 - RNA, 23 nt, Human
ggacuugaaagcauccaugugug

SEQ ID NO: 2470904 - RNA, 18 nt, Human
ggacuccccaggccaggc

SEQ ID NO: 2470905 - RNA, 17 nt, Human
ggacuccccaggccagg

SEQ ID NO: 2470906 - RNA, 16 nt, Human
ggacuccccaggccag

SEQ ID NO: 2470907 - RNA, 14 nt, Human
ggacuccccaggcc

SEQ ID NO: 2470908 - RNA, 20 nt, Human
ggacucccuccucaccucug

SEQ ID NO: 2470909 - RNA, 22 nt, Human
ggacucccuccucaccucugga

SEQ ID NO: 2470910 - RNA, 16 nt, Human
ggacuccggcccuccu

SEQ ID NO: 2470911 - RNA, 18 nt, Human
ggacucaaugcacugaca

SEQ ID NO: 2470912 - RNA, 16 nt, Human
ggacucaaugcacuga

SEQ ID NO: 2470913 - RNA, 17 nt, Human
ggacucagcuccccaga

SEQ ID NO: 2470914 - RNA, 13 nt, Human
ggacucagcuccc

SEQ ID NO: 2470915 - RNA, 21 nt, Human
ggacucagccuucagacagag

SEQ ID NO: 2470916 - RNA, 21 nt, Human
ggacuaagccuaccugcucuc

SEQ ID NO: 2470917 - RNA, 15 nt, Human
ggacucagccuucag

SEQ ID NO: 2470918 - RNA, 17 nt, Human
ggacucagccuucagac

SEQ ID NO: 2470919 - RNA, 13 nt, Human
ggacucagggcag

SEQ ID NO: 2470920 - RNA, 15 nt, Human
ggacucagggcagcg

SEQ ID NO: 2470921 - RNA, 17 nt, Human
ggacucaggaugcccag

SEQ ID NO: 2470922 - RNA, 18 nt, Human
ggacucaggaugcccagg

SEQ ID NO: 2470923 - RNA, 19 nt, Human
ggacucaggaugcccaggg

SEQ ID NO: 2470924 - RNA, 20 nt, Human
ggacucaggaugcccagggc

SEQ ID NO: 2470925 - RNA, 22 nt, Human
ggacucauuuuaaaaaauggaa

SEQ ID NO: 2470926 - RNA, 20 nt, Human
ggacucagggccaugccugc

SEQ ID NO: 2470927 - RNA, 22 nt, Human
ggacucagggcagcgccaggcu

SEQ ID NO: 2470928 - RNA, 20 nt, Human
ggacuccacccauccuauca

SEQ ID NO: 2470929 - RNA, 11 nt, Human
ggacuccaccc

SEQ ID NO: 2470930 - RNA, 24 nt, Human
ggacucauuucauuccuaacacag

SEQ ID NO: 2470931 - RNA, 19 nt, Human
ggacuccagacucucugug

SEQ ID NO: 2470932 - RNA, 14 nt, Human
ggacuccagacucu

SEQ ID NO: 2470933 - RNA, 18 nt, Human
ggacuccagaaucuaaag

SEQ ID NO: 2470934 - RNA, 24 nt, Human
ggacuaacuugucuuuggacccug

SEQ ID NO: 2470935 - RNA, 14 nt, Human
ggacuacaggugug

SEQ ID NO: 2470936 - RNA, 15 nt, Human
ggacucaaugcacug

SEQ ID NO: 2470937 - RNA, 19 nt, Human
ggacuaagccuaccugcuc

SEQ ID NO: 2470938 - RNA, 16 nt, Human
ggacuaagccuaccug

SEQ ID NO: 2470939 - RNA, 23 nt, Human
ggacuauauuugggccugcucca

SEQ ID NO: 2470940 - RNA, 14 nt, Human
ggacuauuauaauu

SEQ ID NO: 2470941 - RNA, 20 nt, Human
ggacuaacuugucuuuggac

SEQ ID NO: 2470942 - RNA, 21 nt, Human
ggacguuccagccggcauggc

SEQ ID NO: 2470943 - RNA, 19 nt, Human
ggacuaaaagauauaagug

SEQ ID NO: 2470944 - RNA, 14 nt, Human
ggacuaaaagauau

SEQ ID NO: 2470945 - RNA, 12 nt, Human
ggacuaaaagau

SEQ ID NO: 2470946 - RNA, 16 nt, Human
ggacguuccagccggc

SEQ ID NO: 2470947 - RNA, 14 nt, Human
ggacguuccagccg

SEQ ID NO: 2470948 - RNA, 13 nt, Human
ggacguuccagcc

SEQ ID NO: 2470949 - RNA, 19 nt, Human
ggacguggcucagccagca

SEQ ID NO: 2470950 - RNA, 15 nt, Human
ggacccccgcccccu

SEQ ID NO: 2470951 - RNA, 14 nt, Human
ggacccccgccccc

SEQ ID NO: 2470952 - RNA, 22 nt, Human
ggacccccgcccccugcccucc

SEQ ID NO: 2470953 - RNA, 20 nt, Human
ggacccccgcccccugcccu

SEQ ID NO: 2470954 - RNA, 19 nt, Human
ggacccccgcccccugccc

SEQ ID NO: 2470955 - RNA, 16 nt, Human
ggacccccgcccccug

SEQ ID NO: 2470956 - RNA, 11 nt, Human
ggacccugagg

SEQ ID NO: 2470957 - RNA, 14 nt, Human
ggacccccuucccc

SEQ ID NO: 2470958 - RNA, 12 nt, Human
ggacccccuucc

SEQ ID NO: 2470959 - RNA, 12 nt, Human
ggacccccugaa

SEQ ID NO: 2470960 - RNA, 15 nt, Human
ggaccccgagccugg

SEQ ID NO: 2470961 - RNA, 23 nt, Human
ggacccccgcccccugcccuccc

SEQ ID NO: 2470962 - RNA, 13 nt, Human
ggacccugaaggg

SEQ ID NO: 2470963 - RNA, 16 nt, Human
ggacccugugacaugg

SEQ ID NO: 2470964 - RNA, 13 nt, Human
ggacccugaggcc

SEQ ID NO: 2470965 - RNA, 12 nt, Human
ggacccugaggc

SEQ ID NO: 2470966 - RNA, 13 nt, Human
ggaccucaggccu

SEQ ID NO: 2470967 - RNA, 22 nt, Human
ggaccgccagauggggccucug

SEQ ID NO: 2470968 - RNA, 15 nt, Human
ggaccgccagauggg

SEQ ID NO: 2470969 - RNA, 17 nt, Human
ggaccgccagauggggc

SEQ ID NO: 2470970 - RNA, 22 nt, Human
ggacccuuuccuuccuucccug

SEQ ID NO: 2470971 - RNA, 23 nt, Human
ggacccugugacauggugccuga

SEQ ID NO: 2470972 - RNA, 22 nt, Human
ggacccugugacauggugccug

SEQ ID NO: 2470973 - RNA, 13 nt, Human
ggacccuguugcu

SEQ ID NO: 2470974 - RNA, 17 nt, Human
ggacccuguugcuaagc

SEQ ID NO: 2470975 - RNA, 21 nt, Human
ggacccuucccuugagcccuc

SEQ ID NO: 2470976 - RNA, 23 nt, Human
ggacccuugagaguaucaggucu

SEQ ID NO: 2470977 - RNA, 12 nt, Human
ggacccuuuccu

SEQ ID NO: 2470978 - RNA, 16 nt, Human
ggacccuuuccuuccu

SEQ ID NO: 2470979 - RNA, 17 nt, Human
ggacccuuuccuuccuu

SEQ ID NO: 2470980 - RNA, 21 nt, Human
ggacccuuuccuuccuucccu

SEQ ID NO: 2470981 - RNA, 23 nt, Human
ggacccuuuccuuccuucccugg

SEQ ID NO: 2470982 - RNA, 18 nt, Human
ggacggugcuccaggcag

SEQ ID NO: 2470983 - RNA, 17 nt, Human
ggacggugcuccaggca

SEQ ID NO: 2470984 - RNA, 15 nt, Human
ggacggugcuccagg

SEQ ID NO: 2470985 - RNA, 14 nt, Human
ggacggugcuccag

SEQ ID NO: 2470986 - RNA, 21 nt, Human
ggacggugcccaagccagagg

SEQ ID NO: 2470987 - RNA, 19 nt, Human
ggacggugcccaagccaga

SEQ ID NO: 2470988 - RNA, 17 nt, Human
ggacggugcccaagcca

SEQ ID NO: 2470989 - RNA, 21 nt, Human
ggacggggggccccagucagc

SEQ ID NO: 2470990 - RNA, 19 nt, Human
ggacggggggccccaguca

SEQ ID NO: 2470991 - RNA, 23 nt, Human
ggacggggggccccagucagccu

SEQ ID NO: 2470992 - RNA, 20 nt, Human
ggacguguuaugacuccaga

SEQ ID NO: 2470993 - RNA, 16 nt, Human
ggacgucccugcccau

SEQ ID NO: 2470994 - RNA, 20 nt, Human
ggacggugcuccaggcaggc

SEQ ID NO: 2470995 - RNA, 18 nt, Human
ggacguccugccaccugg

SEQ ID NO: 2470996 - RNA, 18 nt, Human
ggacguggcucagccagc

SEQ ID NO: 2470997 - RNA, 22 nt, Human
ggacguccugccaccuggggca

SEQ ID NO: 2470998 - RNA, 15 nt, Human
ggaccucaggccugg

SEQ ID NO: 2470999 - RNA, 14 nt, Human
ggaccucaggccug

SEQ ID NO: 2471000 - RNA, 20 nt, Human
ggaccucaggccugggggcu

SEQ ID NO: 2471001 - RNA, 18 nt, Human
ggacggcauuccugcuua

SEQ ID NO: 2471002 - RNA, 21 nt, Human
ggacggccugaugcucccucc

SEQ ID NO: 2471003 - RNA, 22 nt, Human
ggacggccugaugcucccuccc

SEQ ID NO: 2471004 - RNA, 16 nt, Human
ggacggggccggccag

SEQ ID NO: 2471005 - RNA, 13 nt, Human
ggacggggccggc

SEQ ID NO: 2471006 - RNA, 15 nt, Human
ggacggcugggcaca

SEQ ID NO: 2471007 - RNA, 16 nt, Human
ggaacacucugagacu

SEQ ID NO: 2471008 - RNA, 15 nt, Human
ggaacacucugagac

SEQ ID NO: 2471009 - RNA, 11 nt, Human
ggaacagaagg

SEQ ID NO: 2471010 - RNA, 12 nt, Human
ggaacagaagga

SEQ ID NO: 2471011 - RNA, 13 nt, Human
ggaacagaaggau

SEQ ID NO: 2471012 - RNA, 19 nt, Human
ggaacagaaggaugaauga

SEQ ID NO: 2471013 - RNA, 15 nt, Human
ggaacuguccagaga

SEQ ID NO: 2471014 - RNA, 14 nt, Human
ggaacuguccagag

SEQ ID NO: 2471015 - RNA, 20 nt, Human
ggaacugcugggcuuggcag

SEQ ID NO: 2471016 - RNA, 17 nt, Human
ggaacagacaggagaaa

SEQ ID NO: 2471017 - RNA, 19 nt, Human
ggaacagaauguuuuacug

SEQ ID NO: 2471018 - RNA, 13 nt, Human
ggaacagacagga

SEQ ID NO: 2471019 - RNA, 15 nt, Human
ggaacagacaggaga

SEQ ID NO: 2471020 - RNA, 16 nt, Human
ggaacagacaggagaa

SEQ ID NO: 2471021 - RNA, 16 nt, Human
ggaacagaauguuuua

SEQ ID NO: 2471022 - RNA, 12 nt, Human
ggaacagaaugu

SEQ ID NO: 2471023 - RNA, 18 nt, Human
ggaacagacaacagaagu

SEQ ID NO: 2471024 - RNA, 20 nt, Human
ggaacagacaacagaaguca

SEQ ID NO: 2471025 - RNA, 21 nt, Human
ggaacagacaacagaagucau

SEQ ID NO: 2471026 - RNA, 14 nt, Human
ggaacacucugaga

SEQ ID NO: 2471027 - RNA, 12 nt, Human
ggaacacucuga

SEQ ID NO: 2471028 - RNA, 15 nt, Human
ggaagagaaaaaaua

SEQ ID NO: 2471029 - RNA, 13 nt, Human
ggaagagaaacca

SEQ ID NO: 2471030 - RNA, 21 nt, Human
ggaagaccagcuuugcaguga

SEQ ID NO: 2471031 - RNA, 18 nt, Human
ggaagacuuuggaaagag

SEQ ID NO: 2471032 - RNA, 13 nt, Human
ggaagagaaaaaa

SEQ ID NO: 2471033 - RNA, 17 nt, Human
ggaagagaggaguucaa

SEQ ID NO: 2471034 - RNA, 20 nt, Human
ggaagagaggaguucaauga

SEQ ID NO: 2471035 - RNA, 19 nt, Human
ggaagagaggaguucaaug

SEQ ID NO: 2471036 - RNA, 18 nt, Human
ggaagagaggaguucaau

SEQ ID NO: 2471037 - RNA, 21 nt, Human
ggaagagaggaguucaaugau

SEQ ID NO: 2471038 - RNA, 17 nt, Human
ggaagacuuuggaaaga

SEQ ID NO: 2471039 - RNA, 13 nt, Human
ggaagacuuugga

SEQ ID NO: 2471040 - RNA, 23 nt, Human
ggaagacagagaccuccugccuc

SEQ ID NO: 2471041 - RNA, 12 nt, Human
ggaagacagaga

SEQ ID NO: 2471042 - RNA, 22 nt, Human
ggaacuuggggaguuaagaccu

SEQ ID NO: 2471043 - RNA, 12 nt, Human
ggaagacuuugg

SEQ ID NO: 2471044 - RNA, 22 nt, Human
ggaagacauggggaggaaggac

SEQ ID NO: 2471045 - RNA, 14 nt, Human
ggaagacagcucuu

SEQ ID NO: 2471046 - RNA, 13 nt, Human
ggaagacagcucu

SEQ ID NO: 2471047 - RNA, 22 nt, Human
ggaagacaaugugaaaagaaaa

SEQ ID NO: 2471048 - RNA, 15 nt, Human
ggaacuucuaauaua

SEQ ID NO: 2471049 - RNA, 18 nt, Human
ggaacuguccagagagca

SEQ ID NO: 2471050 - RNA, 17 nt, Human
ggaacuguccagagagc

SEQ ID NO: 2471051 - RNA, 16 nt, Human
ggaacuguccagagag

SEQ ID NO: 2471052 - RNA, 22 nt, Human
ggaagcuagcuccccuccucuc

SEQ ID NO: 2471053 - RNA, 21 nt, Human
ggaagcuagcuccccuccucu

SEQ ID NO: 2471054 - RNA, 20 nt, Human
ggaagcuagcuccccuccuc

SEQ ID NO: 2471055 - RNA, 19 nt, Human
ggaagcuagcuccccuccu

SEQ ID NO: 2471056 - RNA, 17 nt, Human
ggaagcuagcuccccuc

SEQ ID NO: 2471057 - RNA, 16 nt, Human
ggaagcuagcuccccu

SEQ ID NO: 2471058 - RNA, 22 nt, Human
ggaagcuacagguuacaacaga

SEQ ID NO: 2471059 - RNA, 21 nt, Human
ggaagcuacagguuacaacag

SEQ ID NO: 2471060 - RNA, 23 nt, Human
ggaagcuacagguuacaacagau

SEQ ID NO: 2471061 - RNA, 15 nt, Human
ggaagccgcuggggc

SEQ ID NO: 2471062 - RNA, 15 nt, Human
ggaagcuacagguua

SEQ ID NO: 2471063 - RNA, 13 nt, Human
ggaagcuacaggu

SEQ ID NO: 2471064 - RNA, 16 nt, Human
ggaagcuaauuugcau

SEQ ID NO: 2471065 - RNA, 21 nt, Human
ggaagcgugaaggccgagaag

SEQ ID NO: 2471066 - RNA, 22 nt, Human
ggaagcgugaaggccgagaagc

SEQ ID NO: 2471067 - RNA, 22 nt, Human
ggaagcggagguugcagggagc

SEQ ID NO: 2471068 - RNA, 11 nt, Human
ggaagcccucc

SEQ ID NO: 2471069 - RNA, 12 nt, Human
ggaagcccuccu

SEQ ID NO: 2471070 - RNA, 15 nt, Human
ggaagcccuccuucc

SEQ ID NO: 2471071 - RNA, 16 nt, Human
ggaagcccuccuucca

SEQ ID NO: 2471072 - RNA, 17 nt, Human
ggaagcccuccuuccac

SEQ ID NO: 2471073 - RNA, 12 nt, Human
ggaagcccugga

SEQ ID NO: 2471074 - RNA, 11 nt, Human
ggaagcccugg

SEQ ID NO: 2471075 - RNA, 15 nt, Human
ggaagcccuggauuu

SEQ ID NO: 2471076 - RNA, 23 nt, Human
ggaagcccuggauuucagaaaga

SEQ ID NO: 2471077 - RNA, 13 nt, Human
ggaagcccccacc

SEQ ID NO: 2471078 - RNA, 21 nt, Human
ggaagcccccaccgugggcag

SEQ ID NO: 2471079 - RNA, 22 nt, Human
ggaagcccccaccgugggcagg

SEQ ID NO: 2471080 - RNA, 20 nt, Human
ggaaggaaacccagcucugg

SEQ ID NO: 2471081 - RNA, 19 nt, Human
ggaaggaaacccagcucug

SEQ ID NO: 2471082 - RNA, 18 nt, Human
ggaaggaacucuggcuuc

SEQ ID NO: 2471083 - RNA, 17 nt, Human
ggaaggaacucuggcuu

SEQ ID NO: 2471084 - RNA, 16 nt, Human
ggaaggaacucuggcu

SEQ ID NO: 2471085 - RNA, 19 nt, Human
ggaaggaaagaaagaagga

SEQ ID NO: 2471086 - RNA, 13 nt, Human
ggaaggacccuga

SEQ ID NO: 2471087 - RNA, 23 nt, Human
ggaaggaacucuggcuuccaggu

SEQ ID NO: 2471088 - RNA, 15 nt, Human
ggaaggagacucacc

SEQ ID NO: 2471089 - RNA, 20 nt, Human
ggaaggagacucaccucugc

SEQ ID NO: 2471090 - RNA, 13 nt, Human
ggaaguuuagaga

SEQ ID NO: 2471091 - RNA, 12 nt, Human
ggaaggagagaa

SEQ ID NO: 2471092 - RNA, 21 nt, Human
ggaaguguaacagcugagguc

SEQ ID NO: 2471093 - RNA, 18 nt, Human
ggaaguuucauauauugu

SEQ ID NO: 2471094 - RNA, 14 nt, Human
ggaaguuuucaaug

SEQ ID NO: 2471095 - RNA, 11 nt, Human
ggaaguuuuca

SEQ ID NO: 2471096 - RNA, 21 nt, Human
ggaagugugggucugugugug

SEQ ID NO: 2471097 - RNA, 22 nt, Human
ggaagugugggucugugugugu

SEQ ID NO: 2471098 - RNA, 12 nt, Human
ggaagugugggu

SEQ ID NO: 2471099 - RNA, 21 nt, Human
ggaaggagacucaccucugcc

SEQ ID NO: 2471100 - RNA, 22 nt, Human
ggaaggagacucaccucugccu

SEQ ID NO: 2471101 - RNA, 13 nt, Human
ggaaggagagccu

SEQ ID NO: 2471102 - RNA, 13 nt, Human
ggaagcugcuccg

SEQ ID NO: 2471103 - RNA, 15 nt, Human
ggaagcugcuccgug

SEQ ID NO: 2471104 - RNA, 17 nt, Human
ggaagcuguguccuugc

SEQ ID NO: 2471105 - RNA, 18 nt, Human
ggaagcuggccgaggguc

SEQ ID NO: 2471106 - RNA, 13 nt, Human
ggaagcugaggcg

SEQ ID NO: 2471107 - RNA, 17 nt, Human
ggaagcugcccugccca

SEQ ID NO: 2471108 - RNA, 18 nt, Human
ggaagcucugaagucaca

SEQ ID NO: 2471109 - RNA, 16 nt, Human
ggaaggaaacccagcu

SEQ ID NO: 2471110 - RNA, 21 nt, Human
ggaagcuguguccuugcaccu

SEQ ID NO: 2471111 - RNA, 13 nt, Human
ggaagcuuccagu

SEQ ID NO: 2471112 - RNA, 23 nt, Human
ggaagcuguguccuugcaccugc

SEQ ID NO: 2471113 - RNA, 19 nt, Human
ggaagcuucuuaaaugaga

SEQ ID NO: 2471114 - RNA, 20 nt, Human
ggaagcuuccaguccaaucu

SEQ ID NO: 2471115 - RNA, 23 nt, Human
ggaagcucagggccuggcucagg

SEQ ID NO: 2471116 - RNA, 15 nt, Human
ggaagcucagggccu

SEQ ID NO: 2471117 - RNA, 11 nt, Human
ggaagcuccgc

SEQ ID NO: 2471118 - RNA, 14 nt, Human
ggaagcuccacugu

SEQ ID NO: 2471119 - RNA, 23 nt, Human
ggaagcuccacugucacccucca

SEQ ID NO: 2471120 - RNA, 17 nt, Human
ggacacuaaccacgcug

SEQ ID NO: 2471121 - RNA, 22 nt, Human
ggacacggggcaguggcaaccu

SEQ ID NO: 2471122 - RNA, 19 nt, Human
ggacagcuccuucuguccu

SEQ ID NO: 2471123 - RNA, 22 nt, Human
ggacacuaaccacgcuggaccu

SEQ ID NO: 2471124 - RNA, 19 nt, Human
ggacagcuugagccgggcc

SEQ ID NO: 2471125 - RNA, 13 nt, Human
ggacagcuguccu

SEQ ID NO: 2471126 - RNA, 11 nt, Human
ggacagcuguc

SEQ ID NO: 2471127 - RNA, 20 nt, Human
ggacagcuccuucuguccua

SEQ ID NO: 2471128 - RNA, 18 nt, Human
ggacacagcucuucucca

SEQ ID NO: 2471129 - RNA, 15 nt, Human
ggacacagcucuucu

SEQ ID NO: 2471130 - RNA, 21 nt, Human
ggacacagcucuucuccaggc

SEQ ID NO: 2471131 - RNA, 16 nt, Human
ggacaccugcccugcc

SEQ ID NO: 2471132 - RNA, 20 nt, Human
ggacaaguggacucagggca

SEQ ID NO: 2471133 - RNA, 18 nt, Human
ggacaauacagaacccau

SEQ ID NO: 2471134 - RNA, 16 nt, Human
ggacaaucaguccccu

SEQ ID NO: 2471135 - RNA, 19 nt, Human
ggacaaggacuaggguccu

SEQ ID NO: 2471136 - RNA, 20 nt, Human
ggacaaggaggucugugcca

SEQ ID NO: 2471137 - RNA, 22 nt, Human
ggacaaggcuagaucaugaaga

SEQ ID NO: 2471138 - RNA, 14 nt, Human
ggacacagcucuuc

SEQ ID NO: 2471139 - RNA, 22 nt, Human
ggacaaucaguccccucccauc

SEQ ID NO: 2471140 - RNA, 20 nt, Human
ggacaaucaguccccuccca

SEQ ID NO: 2471141 - RNA, 18 nt, Human
ggacaaucaguccccucc

SEQ ID NO: 2471142 - RNA, 17 nt, Human
ggacaaucaguccccuc

SEQ ID NO: 2471143 - RNA, 21 nt, Human
ggacaaucaugaaauaugcau

SEQ ID NO: 2471144 - RNA, 19 nt, Human
ggacaaucaugaaauaugc

SEQ ID NO: 2471145 - RNA, 23 nt, Human
ggacaaggaugaucuaggaagac

SEQ ID NO: 2471146 - RNA, 22 nt, Human
ggacaaggaugaucuaggaaga

SEQ ID NO: 2471147 - RNA, 23 nt, Human
ggacaagccaacuuguaaauaca

SEQ ID NO: 2471148 - RNA, 21 nt, Human
ggacaagccaacuuguaaaua

SEQ ID NO: 2471149 - RNA, 20 nt, Human
ggacaagccaacuuguaaau

SEQ ID NO: 2471150 - RNA, 20 nt, Human
ggacaagcagagguggccag

SEQ ID NO: 2471151 - RNA, 13 nt, Human
ggacaagcagagg

SEQ ID NO: 2471152 - RNA, 13 nt, Human
ggacaagagcagg

SEQ ID NO: 2471153 - RNA, 15 nt, Human
ggacaacgaggaagc

SEQ ID NO: 2471154 - RNA, 17 nt, Human
ggacaacgaggaagccc

SEQ ID NO: 2471155 - RNA, 19 nt, Human
ggaaucuggagagcuagaa

SEQ ID NO: 2471156 - RNA, 13 nt, Human
ggaaucuggagag

SEQ ID NO: 2471157 - RNA, 16 nt, Human
ggacaacgaggaagcc

SEQ ID NO: 2471158 - RNA, 19 nt, Human
ggaaucgaggaaccagagc

SEQ ID NO: 2471159 - RNA, 20 nt, Human
ggaaucgaggaaccagagcc

SEQ ID NO: 2471160 - RNA, 21 nt, Human
ggaaucgaggaaccagagcca

SEQ ID NO: 2471161 - RNA, 20 nt, Human
ggaauccacucccaggcagc

SEQ ID NO: 2471162 - RNA, 19 nt, Human
ggaauccuguccucagcuu

SEQ ID NO: 2471163 - RNA, 14 nt, Human
ggaauccuguccuc

SEQ ID NO: 2471164 - RNA, 18 nt, Human
ggaaucaugucaggccug

SEQ ID NO: 2471165 - RNA, 15 nt, Human
ggaaucaugucaggc

SEQ ID NO: 2471166 - RNA, 14 nt, Human
ggaaucagcuucua

SEQ ID NO: 2471167 - RNA, 21 nt, Human
ggaaucaugucaggccugugu

SEQ ID NO: 2471168 - RNA, 19 nt, Human
ggaaucaugucaggccugu

SEQ ID NO: 2471169 - RNA, 13 nt, Human
ggaaucagcuucu

SEQ ID NO: 2471170 - RNA, 16 nt, Human
ggaaucagcaagaaga

SEQ ID NO: 2471171 - RNA, 23 nt, Human
ggaaucagacuucacacugcaag

SEQ ID NO: 2471172 - RNA, 18 nt, Human
ggaaucacucuuguggau

SEQ ID NO: 2471173 - RNA, 20 nt, Human
ggaaucacucuuguggaugu

SEQ ID NO: 2471174 - RNA, 21 nt, Human
ggaaucagacuucacacugca

SEQ ID NO: 2471175 - RNA, 19 nt, Human
ggaauccacucccaggcag

SEQ ID NO: 2471176 - RNA, 16 nt, Human
ggaauccacucccagg

SEQ ID NO: 2471177 - RNA, 14 nt, Human
ggaauccacuccca

SEQ ID NO: 2471178 - RNA, 24 nt, Human
ggaaucauuucuauuucuccucca

SEQ ID NO: 2471179 - RNA, 16 nt, Human
ggaauccagacccggc

SEQ ID NO: 2471180 - RNA, 18 nt, Human
ggaauaacauguaauuaa

SEQ ID NO: 2471181 - RNA, 13 nt, Human
ggaauaauaccua

SEQ ID NO: 2471182 - RNA, 20 nt, Human
ggaauaaggccuuaauaugu

SEQ ID NO: 2471183 - RNA, 23 nt, Human
ggaauaaauaugccucuccuuug

SEQ ID NO: 2471184 - RNA, 22 nt, Human
ggaauaaauaugccucuccuuu

SEQ ID NO: 2471185 - RNA, 13 nt, Human
ggaauaaauaugc

SEQ ID NO: 2471186 - RNA, 12 nt, Human
ggaauaaauaug

SEQ ID NO: 2471187 - RNA, 19 nt, Human
ggaauaaaauacuauuuuu

SEQ ID NO: 2471188 - RNA, 14 nt, Human
ggaauaaaauacua

SEQ ID NO: 2471189 - RNA, 12 nt, Human
ggaauaaaauac

SEQ ID NO: 2471190 - RNA, 18 nt, Human
ggaaguuuugcauuuaug

SEQ ID NO: 2471191 - RNA, 21 nt, Human
ggaaguuuuguggaggagcuc

SEQ ID NO: 2471192 - RNA, 15 nt, Human
cauauucaggaagcu

SEQ ID NO: 2471193 - RNA, 14 nt, Human
cauauucaggaagc

SEQ ID NO: 2471194 - RNA, 20 nt, Human
cauauucaggaagcucaggg

SEQ ID NO: 2471195 - RNA, 22 nt, Human
cauauucaggaagcucagggcc

SEQ ID NO: 2471196 - RNA, 20 nt, Human
cauaugccugggcagaagga

SEQ ID NO: 2471197 - RNA, 15 nt, Human
cauaugccugggcag

SEQ ID NO: 2471198 - RNA, 22 nt, Human
cauaugccugggcagaaggaag

SEQ ID NO: 2471199 - RNA, 20 nt, Human
cauagcuugauaaagggcca

SEQ ID NO: 2471200 - RNA, 23 nt, Human
cauagcaagauugcuuaaaauag

SEQ ID NO: 2471201 - RNA, 15 nt, Human
cauagcaagacacau

SEQ ID NO: 2471202 - RNA, 20 nt, Human
cauagcaagacacaucccua

SEQ ID NO: 2471203 - RNA, 14 nt, Human
cauagcaagacaca

SEQ ID NO: 2471204 - RNA, 22 nt, Human
cauagcagagaaugaaagggcc

SEQ ID NO: 2471205 - RNA, 19 nt, Human
cauagcagagaaugaaagg

SEQ ID NO: 2471206 - RNA, 17 nt, Human
cauagcuccuucucucu

SEQ ID NO: 2471207 - RNA, 20 nt, Human
cauagcuccugcuccacagc

SEQ ID NO: 2471208 - RNA, 15 nt, Human
cauagcuccugcucc

SEQ ID NO: 2471209 - RNA, 14 nt, Human
cauagcuccugcuc

SEQ ID NO: 2471210 - RNA, 14 nt, Human
cauagcacuucccc

SEQ ID NO: 2471211 - RNA, 13 nt, Human
cauagcacuuccc

SEQ ID NO: 2471212 - RNA, 20 nt, Human
cauagcuaucaagugugcuu

SEQ ID NO: 2471213 - RNA, 18 nt, Human
cauagcuccuucucucuu

SEQ ID NO: 2471214 - RNA, 15 nt, Human
cauagcugucuagag

SEQ ID NO: 2471215 - RNA, 14 nt, Human
cauagcugucuaga

SEQ ID NO: 2471216 - RNA, 13 nt, Human
cauagcuuccaug

SEQ ID NO: 2471217 - RNA, 22 nt, Human
cauagcuuacaagccagcugga

SEQ ID NO: 2471218 - RNA, 15 nt, Human
cauaauuuguacaua

SEQ ID NO: 2471219 - RNA, 16 nt, Human
cauaauucuuguauau

SEQ ID NO: 2471220 - RNA, 17 nt, Human
cauaauucuuguauauu

SEQ ID NO: 2471221 - RNA, 18 nt, Human
cauaauucuuguauauua

SEQ ID NO: 2471222 - RNA, 18 nt, Human
cauaauucuaagacuaau

SEQ ID NO: 2471223 - RNA, 13 nt, Human
cagugggagaaaa

SEQ ID NO: 2471224 - RNA, 15 nt, Human
cagugggagcugccu

SEQ ID NO: 2471225 - RNA, 20 nt, Human
cauacaccuaugucauuuca

SEQ ID NO: 2471226 - RNA, 14 nt, Human
cauacaccagcauu

SEQ ID NO: 2471227 - RNA, 18 nt, Human
cauacaccagcauuccuu

SEQ ID NO: 2471228 - RNA, 20 nt, Human
cauacaccagcauuccuuuu

SEQ ID NO: 2471229 - RNA, 23 nt, Human
cauacacuuauuggaacucugcu

SEQ ID NO: 2471230 - RNA, 15 nt, Human
cauacacuuccuucu

SEQ ID NO: 2471231 - RNA, 21 nt, Human
cauacacacacacacacagcc

SEQ ID NO: 2471232 - RNA, 22 nt, Human
cauacacacacacacacagcca

SEQ ID NO: 2471233 - RNA, 21 nt, Human
cauaauuuguacauauguaaa

SEQ ID NO: 2471234 - RNA, 23 nt, Human
cauaauuuguacauauguaaaau

SEQ ID NO: 2471235 - RNA, 13 nt, Human
cauacaccagcau

SEQ ID NO: 2471236 - RNA, 23 nt, Human
cauacacacacacacacagccac

SEQ ID NO: 2471237 - RNA, 16 nt, Human
caucugggggagugga

SEQ ID NO: 2471238 - RNA, 15 nt, Human
caucugggggagugg

SEQ ID NO: 2471239 - RNA, 13 nt, Human
caucugggcuccu

SEQ ID NO: 2471240 - RNA, 20 nt, Human
caucugggcuccuccagggu

SEQ ID NO: 2471241 - RNA, 11 nt, Human
caucugggcuc

SEQ ID NO: 2471242 - RNA, 16 nt, Human
caucugggcuccucca

SEQ ID NO: 2471243 - RNA, 17 nt, Human
caucugggcuccuccag

SEQ ID NO: 2471244 - RNA, 15 nt, Human
caucuggguccuugc

SEQ ID NO: 2471245 - RNA, 18 nt, Human
caucugggggaguggaau

SEQ ID NO: 2471246 - RNA, 17 nt, Human
caucugggggaguggaa

SEQ ID NO: 2471247 - RNA, 16 nt, Human
caucuggguagcugua

SEQ ID NO: 2471248 - RNA, 18 nt, Human
caucuggguagcuguaag

SEQ ID NO: 2471249 - RNA, 20 nt, Human
caucuggguagcuguaaggc

SEQ ID NO: 2471250 - RNA, 15 nt, Human
caucaggccaggccc

SEQ ID NO: 2471251 - RNA, 19 nt, Human
caucaggccaggcccucug

SEQ ID NO: 2471252 - RNA, 16 nt, Human
caucaggccaggcccu

SEQ ID NO: 2471253 - RNA, 14 nt, Human
caucaggccaggcc

SEQ ID NO: 2471254 - RNA, 19 nt, Human
cauccauggggcugauugu

SEQ ID NO: 2471255 - RNA, 16 nt, Human
cauccauguguggacu

SEQ ID NO: 2471256 - RNA, 17 nt, Human
cauccauguguggacuc

SEQ ID NO: 2471257 - RNA, 18 nt, Human
cauccauguguggacuca

SEQ ID NO: 2471258 - RNA, 19 nt, Human
cauccauguuuguaaaacu

SEQ ID NO: 2471259 - RNA, 18 nt, Human
cauccauguuuguaaaac

SEQ ID NO: 2471260 - RNA, 15 nt, Human
cauccauguuuguaa

SEQ ID NO: 2471261 - RNA, 17 nt, Human
caucccagccccaauga

SEQ ID NO: 2471262 - RNA, 14 nt, Human
cauccauuccucag

SEQ ID NO: 2471263 - RNA, 19 nt, Human
caucccaggacaccacacc

SEQ ID NO: 2471264 - RNA, 14 nt, Human
caucccagccuugg

SEQ ID NO: 2471265 - RNA, 13 nt, Human
caucccaggacac

SEQ ID NO: 2471266 - RNA, 12 nt, Human
caucugggaaag

SEQ ID NO: 2471267 - RNA, 15 nt, Human
caucugcucuccuuc

SEQ ID NO: 2471268 - RNA, 14 nt, Human
caucugcucuccuu

SEQ ID NO: 2471269 - RNA, 13 nt, Human
caucugcucuccu

SEQ ID NO: 2471270 - RNA, 15 nt, Human
caucugggauuccca

SEQ ID NO: 2471271 - RNA, 19 nt, Human
caucugggaguccccuuuu

SEQ ID NO: 2471272 - RNA, 16 nt, Human
caucugggauucccac

SEQ ID NO: 2471273 - RNA, 18 nt, Human
caucugggaguccccuuu

SEQ ID NO: 2471274 - RNA, 14 nt, Human
caucugggaaagac

SEQ ID NO: 2471275 - RNA, 21 nt, Human
caucugggaagauuucuaccu

SEQ ID NO: 2471276 - RNA, 19 nt, Human
caucugcgugacaauaaaa

SEQ ID NO: 2471277 - RNA, 18 nt, Human
caucugcgugacaauaaa

SEQ ID NO: 2471278 - RNA, 16 nt, Human
caucugcgugacaaua

SEQ ID NO: 2471279 - RNA, 23 nt, Human
caucugcgugacaauaaaacauu

SEQ ID NO: 2471280 - RNA, 22 nt, Human
caucugcgugacaauaaaacau

SEQ ID NO: 2471281 - RNA, 12 nt, Human
caucugcuaaua

SEQ ID NO: 2471282 - RNA, 20 nt, Human
caucugccuuaaaaccaaag

SEQ ID NO: 2471283 - RNA, 18 nt, Human
caucugccuuaaaaccaa

SEQ ID NO: 2471284 - RNA, 20 nt, Human
caucugccgugccuggaucc

SEQ ID NO: 2471285 - RNA, 19 nt, Human
caucugccccucccccaac

SEQ ID NO: 2471286 - RNA, 17 nt, Human
cauccuuccuucccacc

SEQ ID NO: 2471287 - RNA, 18 nt, Human
caucugccccucccccaa

SEQ ID NO: 2471288 - RNA, 16 nt, Human
cauccuuccuucccac

SEQ ID NO: 2471289 - RNA, 15 nt, Human
cauccuuccuuccca

SEQ ID NO: 2471290 - RNA, 14 nt, Human
cauccuuccuuccc

SEQ ID NO: 2471291 - RNA, 22 nt, Human
cauccuucccugucugccaggg

SEQ ID NO: 2471292 - RNA, 11 nt, Human
cauccuuaaag

SEQ ID NO: 2471293 - RNA, 22 nt, Human
cauccuucaagaacucugggcu

SEQ ID NO: 2471294 - RNA, 23 nt, Human
cauccuucaagaacucugggcug

SEQ ID NO: 2471295 - RNA, 18 nt, Human
cauccuuccucacaccag

SEQ ID NO: 2471296 - RNA, 21 nt, Human
cauccuucccugucugccagg

SEQ ID NO: 2471297 - RNA, 15 nt, Human
cauccuucccugucu

SEQ ID NO: 2471298 - RNA, 19 nt, Human
caucccauaugccugggca

SEQ ID NO: 2471299 - RNA, 23 nt, Human
caucccaggacaccacacccagc

SEQ ID NO: 2471300 - RNA, 22 nt, Human
caucccaggacaccacacccag

SEQ ID NO: 2471301 - RNA, 21 nt, Human
caucccaggacaccacaccca

SEQ ID NO: 2471302 - RNA, 19 nt, Human
caucccaggcuucacccug

SEQ ID NO: 2471303 - RNA, 13 nt, Human
caucccaggggac

SEQ ID NO: 2471304 - RNA, 14 nt, Human
caucccaggggacc

SEQ ID NO: 2471305 - RNA, 19 nt, Human
caucccaggggaccacacc

SEQ ID NO: 2471306 - RNA, 14 nt, Human
caucccccugcccu

SEQ ID NO: 2471307 - RNA, 13 nt, Human
caucccccugccc

SEQ ID NO: 2471308 - RNA, 12 nt, Human
caucccccugcc

SEQ ID NO: 2471309 - RNA, 11 nt, Human
caucccccugc

SEQ ID NO: 2471310 - RNA, 18 nt, Human
cauccccccucaccaggg

SEQ ID NO: 2471311 - RNA, 17 nt, Human
cauccccccucaccagg

SEQ ID NO: 2471312 - RNA, 14 nt, Human
cauccccccucacc

SEQ ID NO: 2471313 - RNA, 13 nt, Human
cauccccccucac

SEQ ID NO: 2471314 - RNA, 13 nt, Human
caucccaguggcc

SEQ ID NO: 2471315 - RNA, 20 nt, Human
caucccaguggccucaaccc

SEQ ID NO: 2471316 - RNA, 23 nt, Human
caucccaguggccucaacccucc

SEQ ID NO: 2471317 - RNA, 12 nt, Human
caucccaucauc

SEQ ID NO: 2471318 - RNA, 21 nt, Human
cauccccauccuccagcuucu

SEQ ID NO: 2471319 - RNA, 12 nt, Human
cauccccccuca

SEQ ID NO: 2471320 - RNA, 18 nt, Human
cauccccauccuccagcu

SEQ ID NO: 2471321 - RNA, 21 nt, Human
cauccuguguuucuagggaaa

SEQ ID NO: 2471322 - RNA, 22 nt, Human
cauccuguguuucuagggaaau

SEQ ID NO: 2471323 - RNA, 21 nt, Human
cauccuucaagaacucugggc

SEQ ID NO: 2471324 - RNA, 15 nt, Human
cauccuguguuucua

SEQ ID NO: 2471325 - RNA, 19 nt, Human
cauccccuggacugggagg

SEQ ID NO: 2471326 - RNA, 14 nt, Human
cauccccuguagag

SEQ ID NO: 2471327 - RNA, 19 nt, Human
caucccccugcccucgugg

SEQ ID NO: 2471328 - RNA, 19 nt, Human
cauccccgcagugugcacu

SEQ ID NO: 2471329 - RNA, 14 nt, Human
cauccccuggacug

SEQ ID NO: 2471330 - RNA, 22 nt, Human
cauggccacuugggucuucccu

SEQ ID NO: 2471331 - RNA, 18 nt, Human
cauggccaccuuuucagc

SEQ ID NO: 2471332 - RNA, 13 nt, Human
cauggccaggugg

SEQ ID NO: 2471333 - RNA, 14 nt, Human
cauggccagguggc

SEQ ID NO: 2471334 - RNA, 15 nt, Human
caugcugcccuguga

SEQ ID NO: 2471335 - RNA, 14 nt, Human
caugcugcccugug

SEQ ID NO: 2471336 - RNA, 19 nt, Human
cauggcaucaccuccacca

SEQ ID NO: 2471337 - RNA, 17 nt, Human
caugcucaucugcuggu

SEQ ID NO: 2471338 - RNA, 16 nt, Human
caugcucaucugcugg

SEQ ID NO: 2471339 - RNA, 20 nt, Human
caugcucagcccugacuggu

SEQ ID NO: 2471340 - RNA, 15 nt, Human
caugcucagcccuga

SEQ ID NO: 2471341 - RNA, 19 nt, Human
caugcucaucugcuggucc

SEQ ID NO: 2471342 - RNA, 18 nt, Human
caugcucaucugcugguc

SEQ ID NO: 2471343 - RNA, 23 nt, Human
caugcucagcccugacuggugcu

SEQ ID NO: 2471344 - RNA, 16 nt, Human
caugcacgugugugca

SEQ ID NO: 2471345 - RNA, 23 nt, Human
caugcuaucucugugugcacaaa

SEQ ID NO: 2471346 - RNA, 13 nt, Human
caugcugcccugu

SEQ ID NO: 2471347 - RNA, 12 nt, Human
caugcugcccug

SEQ ID NO: 2471348 - RNA, 13 nt, Human
caugcuccuggcc

SEQ ID NO: 2471349 - RNA, 12 nt, Human
caugacauguua

SEQ ID NO: 2471350 - RNA, 15 nt, Human
caugacauguuauau

SEQ ID NO: 2471351 - RNA, 20 nt, Human
caugaaguuuccuuggcugg

SEQ ID NO: 2471352 - RNA, 22 nt, Human
caugauuaaccacuucagcuga

SEQ ID NO: 2471353 - RNA, 23 nt, Human
caugauuaaccacuucagcugac

SEQ ID NO: 2471354 - RNA, 14 nt, Human
caugcacaccuccc

SEQ ID NO: 2471355 - RNA, 18 nt, Human
caugcaauuuauuaaaau

SEQ ID NO: 2471356 - RNA, 12 nt, Human
caugcacaaauu

SEQ ID NO: 2471357 - RNA, 24 nt, Human
caugauuaaccacuucagcugacu

SEQ ID NO: 2471358 - RNA, 22 nt, Human
caugaaggaugccaagaaguuu

SEQ ID NO: 2471359 - RNA, 22 nt, Human
caugaagcccaagugaaaucaa

SEQ ID NO: 2471360 - RNA, 15 nt, Human
caugaaguaauaugc

SEQ ID NO: 2471361 - RNA, 19 nt, Human
caugaaguaauaugcacac

SEQ ID NO: 2471362 - RNA, 22 nt, Human
caugaaguaauaugcacacauu

SEQ ID NO: 2471363 - RNA, 23 nt, Human
caugaaguaauaugcacacauuu

SEQ ID NO: 2471364 - RNA, 23 nt, Human
caugacacgaauauugcugaugg

SEQ ID NO: 2471365 - RNA, 19 nt, Human
caugaagucguugugaggg

SEQ ID NO: 2471366 - RNA, 20 nt, Human
caugaaguguguuuccuuca

SEQ ID NO: 2471367 - RNA, 18 nt, Human
caugaaguuuccuuggcu

SEQ ID NO: 2471368 - RNA, 21 nt, Human
caugacacgaauauugcugau

SEQ ID NO: 2471369 - RNA, 18 nt, Human
caugaagguuucugaaaa

SEQ ID NO: 2471370 - RNA, 16 nt, Human
caugaaggugucauac

SEQ ID NO: 2471371 - RNA, 15 nt, Human
caugaagguuucuga

SEQ ID NO: 2471372 - RNA, 22 nt, Human
caugucaacuucuggcuccuca

SEQ ID NO: 2471373 - RNA, 18 nt, Human
caugucaacuucuggcuc

SEQ ID NO: 2471374 - RNA, 20 nt, Human
cauguaucuaugcauuuucu

SEQ ID NO: 2471375 - RNA, 15 nt, Human
cauguaucaucugga

SEQ ID NO: 2471376 - RNA, 14 nt, Human
cauguaucuaccuc

SEQ ID NO: 2471377 - RNA, 21 nt, Human
cauguaucccaacuccuauaa

SEQ ID NO: 2471378 - RNA, 17 nt, Human
caugucagcaaaaagca

SEQ ID NO: 2471379 - RNA, 16 nt, Human
caugucagcaaaaagc

SEQ ID NO: 2471380 - RNA, 14 nt, Human
caugucagcaaaaa

SEQ ID NO: 2471381 - RNA, 16 nt, Human
caugucacuguggucc

SEQ ID NO: 2471382 - RNA, 15 nt, Human
caugucacugugguc

SEQ ID NO: 2471383 - RNA, 14 nt, Human
caugucacuguggu

SEQ ID NO: 2471384 - RNA, 13 nt, Human
caugucacugugg

SEQ ID NO: 2471385 - RNA, 23 nt, Human
caugucaccguggaccuuccugc

SEQ ID NO: 2471386 - RNA, 22 nt, Human
caugucaccguggaccuuccug

SEQ ID NO: 2471387 - RNA, 20 nt, Human
caugucaccguggaccuucc

SEQ ID NO: 2471388 - RNA, 20 nt, Human
caugucaccggauccugggu

SEQ ID NO: 2471389 - RNA, 18 nt, Human
cauguaguaucaaauauu

SEQ ID NO: 2471390 - RNA, 17 nt, Human
cauguaguaucaaauau

SEQ ID NO: 2471391 - RNA, 16 nt, Human
cauguaguaucaaaua

SEQ ID NO: 2471392 - RNA, 22 nt, Human
cauguaguaucaaauauuagau

SEQ ID NO: 2471393 - RNA, 21 nt, Human
cauguaguaucaaauauuaga

SEQ ID NO: 2471394 - RNA, 20 nt, Human
cauguaguaucaaauauuag

SEQ ID NO: 2471395 - RNA, 19 nt, Human
cauguaguaucaaauauua

SEQ ID NO: 2471396 - RNA, 20 nt, Human
cauguauaauauuuuuaauu

SEQ ID NO: 2471397 - RNA, 18 nt, Human
cauguauaauauuuuuaa

SEQ ID NO: 2471398 - RNA, 15 nt, Human
cauguauaauauuuu

SEQ ID NO: 2471399 - RNA, 20 nt, Human
cauguccaagaagcccagga

SEQ ID NO: 2471400 - RNA, 19 nt, Human
cauguccaagaagcccagg

SEQ ID NO: 2471401 - RNA, 21 nt, Human
caugucaggccugugugugaa

SEQ ID NO: 2471402 - RNA, 23 nt, Human
caugucagcaaaaagcaaaauca

SEQ ID NO: 2471403 - RNA, 22 nt, Human
caugucagcaaaaagcaaaauc

SEQ ID NO: 2471404 - RNA, 20 nt, Human
caugucagcaaaaagcaaaa

SEQ ID NO: 2471405 - RNA, 18 nt, Human
caugucagcaaaaagcaa

SEQ ID NO: 2471406 - RNA, 18 nt, Human
cauguccaagaagcccag

SEQ ID NO: 2471407 - RNA, 18 nt, Human
cauguugcacacccacuc

SEQ ID NO: 2471408 - RNA, 22 nt, Human
cauguugcacacccacucagcu

SEQ ID NO: 2471409 - RNA, 23 nt, Human
cauguugcacacccacucagcuc

SEQ ID NO: 2471410 - RNA, 20 nt, Human
cauguccccaaaccugcaag

SEQ ID NO: 2471411 - RNA, 16 nt, Human
caugucaggccugugu

SEQ ID NO: 2471412 - RNA, 18 nt, Human
caugucagcaucagcuca

SEQ ID NO: 2471413 - RNA, 19 nt, Human
cauguugagccaggccugg

SEQ ID NO: 2471414 - RNA, 13 nt, Human
cauguuggccagg

SEQ ID NO: 2471415 - RNA, 12 nt, Human
cauguuggccag

SEQ ID NO: 2471416 - RNA, 12 nt, Human
cauuaucucaaa

SEQ ID NO: 2471417 - RNA, 23 nt, Human
cauuaucuagauacuguaucaug

SEQ ID NO: 2471418 - RNA, 13 nt, Human
cauuaucucaaaa

SEQ ID NO: 2471419 - RNA, 16 nt, Human
cauuaugagaggcaau

SEQ ID NO: 2471420 - RNA, 17 nt, Human
cauuagggggaacucua

SEQ ID NO: 2471421 - RNA, 22 nt, Human
cauuaggugugacugaauuucu

SEQ ID NO: 2471422 - RNA, 15 nt, Human
cauguugcugaggag

SEQ ID NO: 2471423 - RNA, 14 nt, Human
cauguugcugagga

SEQ ID NO: 2471424 - RNA, 13 nt, Human
cauguugcugcca

SEQ ID NO: 2471425 - RNA, 16 nt, Human
cauguugcugaggagu

SEQ ID NO: 2471426 - RNA, 14 nt, Human
cauucucacuccua

SEQ ID NO: 2471427 - RNA, 14 nt, Human
cauucuauuguuaa

SEQ ID NO: 2471428 - RNA, 18 nt, Human
cauucuagguuugcaaga

SEQ ID NO: 2471429 - RNA, 18 nt, Human
cauucggcucccuggagc

SEQ ID NO: 2471430 - RNA, 15 nt, Human
cauucggcucccugg

SEQ ID NO: 2471431 - RNA, 19 nt, Human
cauucggcucccuggagcc

SEQ ID NO: 2471432 - RNA, 17 nt, Human
cauucucaagcccugca

SEQ ID NO: 2471433 - RNA, 16 nt, Human
cauucucaagcccugc

SEQ ID NO: 2471434 - RNA, 14 nt, Human
cauucucaagcccu

SEQ ID NO: 2471435 - RNA, 13 nt, Human
cauucucacuccu

SEQ ID NO: 2471436 - RNA, 13 nt, Human
cauucggcucccu

SEQ ID NO: 2471437 - RNA, 19 nt, Human
cauuccuucuuugauaaug

SEQ ID NO: 2471438 - RNA, 18 nt, Human
cauuccuucuuugauaau

SEQ ID NO: 2471439 - RNA, 16 nt, Human
cauuccuucuuugaua

SEQ ID NO: 2471440 - RNA, 15 nt, Human
cauuccuucuuugau

SEQ ID NO: 2471441 - RNA, 23 nt, Human
cauuccuucuuugauaauguuaa

SEQ ID NO: 2471442 - RNA, 13 nt, Human
cauuccuugccug

SEQ ID NO: 2471443 - RNA, 12 nt, Human
cauuccuguucc

SEQ ID NO: 2471444 - RNA, 14 nt, Human
cauuccuucuuuga

SEQ ID NO: 2471445 - RNA, 22 nt, Human
cauuaugagaggcaaugauugu

SEQ ID NO: 2471446 - RNA, 13 nt, Human
ccaaaugcagcuu

SEQ ID NO: 2471447 - RNA, 15 nt, Human
ccaaaugcagcuuua

SEQ ID NO: 2471448 - RNA, 18 nt, Human
ccaaaugcagcuuuaaaa

SEQ ID NO: 2471449 - RNA, 15 nt, Human
ccaaaugcuuuaaaa

SEQ ID NO: 2471450 - RNA, 22 nt, Human
ccaaaugcauggugcaguugac

SEQ ID NO: 2471451 - RNA, 17 nt, Human
ccaaaugcauggugcag

SEQ ID NO: 2471452 - RNA, 17 nt, Human
ccaaauaaugucucugu

SEQ ID NO: 2471453 - RNA, 16 nt, Human
ccaaauaaugucucug

SEQ ID NO: 2471454 - RNA, 15 nt, Human
ccaaauaaugucucu

SEQ ID NO: 2471455 - RNA, 15 nt, Human
ccaaauauguccugg

SEQ ID NO: 2471456 - RNA, 12 nt, Human
ccaaaugcagcu

SEQ ID NO: 2471457 - RNA, 13 nt, Human
ccaaauauguccu

SEQ ID NO: 2471458 - RNA, 17 nt, Human
ccaaauaagaaaccuaa

SEQ ID NO: 2471459 - RNA, 16 nt, Human
ccaaauaagaaaccua

SEQ ID NO: 2471460 - RNA, 15 nt, Human
ccaaauaagaaaccu

SEQ ID NO: 2471461 - RNA, 20 nt, Human
ccaaauaaaaacuaaauugu

SEQ ID NO: 2471462 - RNA, 16 nt, Human
ccaaauaaaaacuaaa

SEQ ID NO: 2471463 - RNA, 11 nt, Human
ccaaauaaaaa

SEQ ID NO: 2471464 - RNA, 22 nt, Human
ccaaagugguauagaaaugcug

SEQ ID NO: 2471465 - RNA, 17 nt, Human
ccaagcugggccccagc

SEQ ID NO: 2471466 - RNA, 16 nt, Human
ccaagcugggccccag

SEQ ID NO: 2471467 - RNA, 15 nt, Human
ccaagcugggcccca

SEQ ID NO: 2471468 - RNA, 13 nt, Human
ccaagcugggccc

SEQ ID NO: 2471469 - RNA, 12 nt, Human
ccaagcugggcc

SEQ ID NO: 2471470 - RNA, 11 nt, Human
ccaagcugggc

SEQ ID NO: 2471471 - RNA, 14 nt, Human
ccaagaagcccagg

SEQ ID NO: 2471472 - RNA, 19 nt, Human
ccaagcuggucccacucag

SEQ ID NO: 2471473 - RNA, 12 nt, Human
ccaagcuggucc

SEQ ID NO: 2471474 - RNA, 21 nt, Human
ccaagcugggccccagcccac

SEQ ID NO: 2471475 - RNA, 20 nt, Human
ccaagcugggccccagccca

SEQ ID NO: 2471476 - RNA, 19 nt, Human
ccaagcugggccccagccc

SEQ ID NO: 2471477 - RNA, 18 nt, Human
ccaagcugggccccagcc

SEQ ID NO: 2471478 - RNA, 16 nt, Human
ccaaggcaaggcaggu

SEQ ID NO: 2471479 - RNA, 15 nt, Human
ccaaggcaaggcagg

SEQ ID NO: 2471480 - RNA, 13 nt, Human
ccaaggcaaggca

SEQ ID NO: 2471481 - RNA, 22 nt, Human
ccaagcugggccccagcccacc

SEQ ID NO: 2471482 - RNA, 18 nt, Human
ccaaggaugccccguccc

SEQ ID NO: 2471483 - RNA, 15 nt, Human
ccaaggccaaaggaa

SEQ ID NO: 2471484 - RNA, 23 nt, Human
ccaaggcaaggcaggugccucca

SEQ ID NO: 2471485 - RNA, 22 nt, Human
ccaaggcaaggcaggugccucc

SEQ ID NO: 2471486 - RNA, 17 nt, Human
ccaaggcaaggcaggug

SEQ ID NO: 2471487 - RNA, 21 nt, Human
ccaaggcagaagcagcagggg

SEQ ID NO: 2471488 - RNA, 15 nt, Human
ccaacgucugugcca

SEQ ID NO: 2471489 - RNA, 13 nt, Human
ccaacgucugugc

SEQ ID NO: 2471490 - RNA, 22 nt, Human
ccaaauggaaaugggcagagca

SEQ ID NO: 2471491 - RNA, 22 nt, Human
ccaaaugcuuuaaaaacuauuu

SEQ ID NO: 2471492 - RNA, 21 nt, Human
ccaacggagagcgccugcccc

SEQ ID NO: 2471493 - RNA, 13 nt, Human
ccaagaagcccag

SEQ ID NO: 2471494 - RNA, 13 nt, Human
ccaagaaagcagg

SEQ ID NO: 2471495 - RNA, 18 nt, Human
ccaagaaacugagaccaa

SEQ ID NO: 2471496 - RNA, 14 nt, Human
ccaagaaacgucuu

SEQ ID NO: 2471497 - RNA, 22 nt, Human
ccaacggagagcgccugccccu

SEQ ID NO: 2471498 - RNA, 24 nt, Human
ccaacggcaagggaacaaguacuu

SEQ ID NO: 2471499 - RNA, 23 nt, Human
ccaaugaaaaaauguauaugcac

SEQ ID NO: 2471500 - RNA, 15 nt, Human
ccaaugaaaaaaugu

SEQ ID NO: 2471501 - RNA, 13 nt, Human
ccaauccugcccc

SEQ ID NO: 2471502 - RNA, 13 nt, Human
ccaauccuauguu

SEQ ID NO: 2471503 - RNA, 21 nt, Human
ccaauccccuccuugggcacu

SEQ ID NO: 2471504 - RNA, 14 nt, Human
ccaauccuauguuu

SEQ ID NO: 2471505 - RNA, 15 nt, Human
ccaauccucacuggg

SEQ ID NO: 2471506 - RNA, 18 nt, Human
ccaaucuaaccacaucaa

SEQ ID NO: 2471507 - RNA, 12 nt, Human
ccaauccugccc

SEQ ID NO: 2471508 - RNA, 17 nt, Human
ccaauccucacugggug

SEQ ID NO: 2471509 - RNA, 18 nt, Human
ccaauccucacugggugg

SEQ ID NO: 2471510 - RNA, 16 nt, Human
ccaaggccaaaggaag

SEQ ID NO: 2471511 - RNA, 17 nt, Human
ccaauccccuccuuggg

SEQ ID NO: 2471512 - RNA, 16 nt, Human
ccaauccccuccuugg

SEQ ID NO: 2471513 - RNA, 18 nt, Human
ccaaucccagcuaccuca

SEQ ID NO: 2471514 - RNA, 15 nt, Human
cauuuuuuaaaugca

SEQ ID NO: 2471515 - RNA, 16 nt, Human
cauuuuuuaaaugcac

SEQ ID NO: 2471516 - RNA, 19 nt, Human
cauuuuuuaaaugcaccug

SEQ ID NO: 2471517 - RNA, 17 nt, Human
cauuuuuuaaggaaaca

SEQ ID NO: 2471518 - RNA, 14 nt, Human
cauuugugaaauga

SEQ ID NO: 2471519 - RNA, 16 nt, Human
cauuugugaaaugaug

SEQ ID NO: 2471520 - RNA, 22 nt, Human
cauuugucuauucuccagcuga

SEQ ID NO: 2471521 - RNA, 17 nt, Human
cauuugucacacacuuu

SEQ ID NO: 2471522 - RNA, 14 nt, Human
cauuuggauugggg

SEQ ID NO: 2471523 - RNA, 23 nt, Human
cauuuggauuggggucccucuaa

SEQ ID NO: 2471524 - RNA, 23 nt, Human
cauuuggaguguuccccuuccac

SEQ ID NO: 2471525 - RNA, 15 nt, Human
cauuuggauuggaug

SEQ ID NO: 2471526 - RNA, 21 nt, Human
cauuuggagacacaacuauuu

SEQ ID NO: 2471527 - RNA, 15 nt, Human
cauuuggaauacuuu

SEQ ID NO: 2471528 - RNA, 17 nt, Human
cauuuggaauacuuuuu

SEQ ID NO: 2471529 - RNA, 18 nt, Human
cauuucauuccuaacaca

SEQ ID NO: 2471530 - RNA, 21 nt, Human
cauuucauuccuaacacagca

SEQ ID NO: 2471531 - RNA, 15 nt, Human
cauuucauuccuaac

SEQ ID NO: 2471532 - RNA, 20 nt, Human
cauuucaucuauuucugaga

SEQ ID NO: 2471533 - RNA, 14 nt, Human
cauuucaucuauuu

SEQ ID NO: 2471534 - RNA, 15 nt, Human
cauuucaucuauuuc

SEQ ID NO: 2471535 - RNA, 16 nt, Human
cauuucaucuauuucu

SEQ ID NO: 2471536 - RNA, 17 nt, Human
cauuucaucuauuucug

SEQ ID NO: 2471537 - RNA, 18 nt, Human
cauuucaucuauuucuga

SEQ ID NO: 2471538 - RNA, 13 nt, Human
cauuucaggaggg

SEQ ID NO: 2471539 - RNA, 22 nt, Human
cauuucaggagcagccucagaa

SEQ ID NO: 2471540 - RNA, 16 nt, Human
cauuucaggagcagcc

SEQ ID NO: 2471541 - RNA, 21 nt, Human
cauuuauggucaacacuuaag

SEQ ID NO: 2471542 - RNA, 15 nt, Human
cauuucaggagcagc

SEQ ID NO: 2471543 - RNA, 20 nt, Human
cauuuauggucaacacuuaa

SEQ ID NO: 2471544 - RNA, 14 nt, Human
cauuuauguuuauu

SEQ ID NO: 2471545 - RNA, 22 nt, Human
cauuuauauauugaauuaauau

SEQ ID NO: 2471546 - RNA, 15 nt, Human
cauuuauauauugaa

SEQ ID NO: 2471547 - RNA, 16 nt, Human
cauuuaugauuuaaua

SEQ ID NO: 2471548 - RNA, 21 nt, Human
cauuuaugauuuaauaaaaua

SEQ ID NO: 2471549 - RNA, 20 nt, Human
cauuuaugauuuaauaaaau

SEQ ID NO: 2471550 - RNA, 18 nt, Human
cauuuaugauuuaauaaa

SEQ ID NO: 2471551 - RNA, 17 nt, Human
cauuuaugauuuaauaa

SEQ ID NO: 2471552 - RNA, 23 nt, Human
cauuuaugauuuaauaaaauaau

SEQ ID NO: 2471553 - RNA, 15 nt, Human
cauuuauucugcuca

SEQ ID NO: 2471554 - RNA, 14 nt, Human
cauuuauucugcuc

SEQ ID NO: 2471555 - RNA, 22 nt, Human
cauugguucuuguauuaagaau

SEQ ID NO: 2471556 - RNA, 15 nt, Human
cauuggaagacccca

SEQ ID NO: 2471557 - RNA, 18 nt, Human
cauugguucuuguauuaa

SEQ ID NO: 2471558 - RNA, 16 nt, Human
cauuggaagaccccac

SEQ ID NO: 2471559 - RNA, 15 nt, Human
cauugguucuuguau

SEQ ID NO: 2471560 - RNA, 13 nt, Human
cauuuauauagau

SEQ ID NO: 2471561 - RNA, 15 nt, Human
cauuuauacucuuuu

SEQ ID NO: 2471562 - RNA, 11 nt, Human
cauuuauacuc

SEQ ID NO: 2471563 - RNA, 13 nt, Human
cauuuauauauug

SEQ ID NO: 2471564 - RNA, 12 nt, Human
cauuuauauauu

SEQ ID NO: 2471565 - RNA, 17 nt, Human
cauuuauacaaauuaga

SEQ ID NO: 2471566 - RNA, 18 nt, Human
cauuuauacaaauuagaa

SEQ ID NO: 2471567 - RNA, 19 nt, Human
cauuuauacaaauuagaaa

SEQ ID NO: 2471568 - RNA, 20 nt, Human
cauuuauacaaauuagaaaa

SEQ ID NO: 2471569 - RNA, 12 nt, Human
cauuuauacaaa

SEQ ID NO: 2471570 - RNA, 15 nt, Human
cauuuauacaaauua

SEQ ID NO: 2471571 - RNA, 21 nt, Human
cauuuauaauguuugcuauug

SEQ ID NO: 2471572 - RNA, 23 nt, Human
cauuuaguuugauuauucagugu

SEQ ID NO: 2471573 - RNA, 18 nt, Human
cauuuauaaagcuaaaau

SEQ ID NO: 2471574 - RNA, 21 nt, Human
cauuuauaaagcuaaaauaac

SEQ ID NO: 2471575 - RNA, 14 nt, Human
cauuuauaauguuu

SEQ ID NO: 2471576 - RNA, 17 nt, Human
cauuuauaauguuugcu

SEQ ID NO: 2471577 - RNA, 19 nt, Human
cauuguaaauaguauuuga

SEQ ID NO: 2471578 - RNA, 21 nt, Human
cauuguaaaccacaaggcugu

SEQ ID NO: 2471579 - RNA, 13 nt, Human
cauuguaaaccac

SEQ ID NO: 2471580 - RNA, 22 nt, Human
cauugcuugugccacacccucc

SEQ ID NO: 2471581 - RNA, 17 nt, Human
cauugcuuuacugucaa

SEQ ID NO: 2471582 - RNA, 12 nt, Human
cauugcuuucug

SEQ ID NO: 2471583 - RNA, 14 nt, Human
cauugcuuucugaa

SEQ ID NO: 2471584 - RNA, 22 nt, Human
cauugcuuugaagcaguugugu

SEQ ID NO: 2471585 - RNA, 18 nt, Human
cauugcuuugaagcaguu

SEQ ID NO: 2471586 - RNA, 16 nt, Human
cauugcuuugaagcag

SEQ ID NO: 2471587 - RNA, 15 nt, Human
cauugcuuucugaaa

SEQ ID NO: 2471588 - RNA, 23 nt, Human
cauugcuuugaagcaguuguguc

SEQ ID NO: 2471589 - RNA, 14 nt, Human
ccacuccucugacu

SEQ ID NO: 2471590 - RNA, 13 nt, Human
ccacuccucugac

SEQ ID NO: 2471591 - RNA, 20 nt, Human
ccacuccucugacucagggc

SEQ ID NO: 2471592 - RNA, 19 nt, Human
ccaccacggccacuggcca

SEQ ID NO: 2471593 - RNA, 16 nt, Human
ccaccacggccacugg

SEQ ID NO: 2471594 - RNA, 21 nt, Human
ccaccacgauguggcccuggc

SEQ ID NO: 2471595 - RNA, 17 nt, Human
ccaccacuaggacucug

SEQ ID NO: 2471596 - RNA, 20 nt, Human
ccaccacuaggacucugagg

SEQ ID NO: 2471597 - RNA, 20 nt, Human
ccaccaggcuggcgcagcca

SEQ ID NO: 2471598 - RNA, 19 nt, Human
ccaccaggcuggcgcagcc

SEQ ID NO: 2471599 - RNA, 18 nt, Human
ccaccaggcuggcgcagc

SEQ ID NO: 2471600 - RNA, 12 nt, Human
ccaccaggcugg

SEQ ID NO: 2471601 - RNA, 15 nt, Human
ccaccacuggccacc

SEQ ID NO: 2471602 - RNA, 14 nt, Human
ccaccacuggccac

SEQ ID NO: 2471603 - RNA, 22 nt, Human
ccaccaggcugcucagggcugg

SEQ ID NO: 2471604 - RNA, 18 nt, Human
ccaccagucugacuguuu

SEQ ID NO: 2471605 - RNA, 23 nt, Human
ccaccaggcuggcgcagccaagg

SEQ ID NO: 2471606 - RNA, 21 nt, Human
ccaccaggcuggcgcagccaa

SEQ ID NO: 2471607 - RNA, 15 nt, Human
ccaccacgcccggcu

SEQ ID NO: 2471608 - RNA, 17 nt, Human
ccaccaccucccucacc

SEQ ID NO: 2471609 - RNA, 19 nt, Human
ccaccacgauguggcccug

SEQ ID NO: 2471610 - RNA, 20 nt, Human
ccaccacgauguggcccugg

SEQ ID NO: 2471611 - RNA, 13 nt, Human
ccaccacccugag

SEQ ID NO: 2471612 - RNA, 24 nt, Human
ccaccaccccccacucugugccug

SEQ ID NO: 2471613 - RNA, 12 nt, Human
ccaccaccuagg

SEQ ID NO: 2471614 - RNA, 18 nt, Human
ccaccaccuaggccacuc

SEQ ID NO: 2471615 - RNA, 20 nt, Human
ccaccaccuaggccacuccu

SEQ ID NO: 2471616 - RNA, 21 nt, Human
ccaccaccuaggccacuccuc

SEQ ID NO: 2471617 - RNA, 12 nt, Human
ccaccaccuccc

SEQ ID NO: 2471618 - RNA, 22 nt, Human
ccaccaccuaggccacuccucc

SEQ ID NO: 2471619 - RNA, 12 nt, Human
ccacagccgcag

SEQ ID NO: 2471620 - RNA, 15 nt, Human
ccacagccgcagccu

SEQ ID NO: 2471621 - RNA, 20 nt, Human
ccaccaccccccacucugug

SEQ ID NO: 2471622 - RNA, 16 nt, Human
ccaccaccccccacuc

SEQ ID NO: 2471623 - RNA, 18 nt, Human
ccacagccgcagccuccc

SEQ ID NO: 2471624 - RNA, 23 nt, Human
ccacagcccugucagugcagccc

SEQ ID NO: 2471625 - RNA, 21 nt, Human
ccacagcccugucagugcagc

SEQ ID NO: 2471626 - RNA, 20 nt, Human
ccacagcccugucagugcag

SEQ ID NO: 2471627 - RNA, 13 nt, Human
ccacagccauccc

SEQ ID NO: 2471628 - RNA, 20 nt, Human
ccacagccaucccagccuug

SEQ ID NO: 2471629 - RNA, 18 nt, Human
ccacagagagucccacug

SEQ ID NO: 2471630 - RNA, 13 nt, Human
ccacagagagucc

SEQ ID NO: 2471631 - RNA, 14 nt, Human
ccacagagcgggga

SEQ ID NO: 2471632 - RNA, 19 nt, Human
ccacagagagucccacugc

SEQ ID NO: 2471633 - RNA, 19 nt, Human
ccacagcccacguccuguc

SEQ ID NO: 2471634 - RNA, 18 nt, Human
ccacagcccacguccugu

SEQ ID NO: 2471635 - RNA, 17 nt, Human
ccacagcccacguccug

SEQ ID NO: 2471636 - RNA, 14 nt, Human
ccacagcccacguc

SEQ ID NO: 2471637 - RNA, 21 nt, Human
ccacagcccacguccugucag

SEQ ID NO: 2471638 - RNA, 13 nt, Human
ccacagcccuguc

SEQ ID NO: 2471639 - RNA, 14 nt, Human
ccacagcccuguca

SEQ ID NO: 2471640 - RNA, 15 nt, Human
ccacagcccugucag

SEQ ID NO: 2471641 - RNA, 20 nt, Human
ccacagacacacacacgcac

SEQ ID NO: 2471642 - RNA, 15 nt, Human
ccacagacacacaca

SEQ ID NO: 2471643 - RNA, 14 nt, Human
ccacagacacacac

SEQ ID NO: 2471644 - RNA, 13 nt, Human
ccacagacacaca

SEQ ID NO: 2471645 - RNA, 21 nt, Human
ccacagacacacacacgcacg

SEQ ID NO: 2471646 - RNA, 22 nt, Human
ccacagagaaaguacuucucca

SEQ ID NO: 2471647 - RNA, 18 nt, Human
ccacagaagcuccaggua

SEQ ID NO: 2471648 - RNA, 15 nt, Human
ccacagacaagguag

SEQ ID NO: 2471649 - RNA, 12 nt, Human
ccacagacacac

SEQ ID NO: 2471650 - RNA, 11 nt, Human
ccacagacaca

SEQ ID NO: 2471651 - RNA, 21 nt, Human
ccacagacaagguagcccugg

SEQ ID NO: 2471652 - RNA, 16 nt, Human
ccacagaagcuccagg

SEQ ID NO: 2471653 - RNA, 22 nt, Human
ccacagaagccaggagcaaaug

SEQ ID NO: 2471654 - RNA, 21 nt, Human
ccacagaagccaggagcaaau

SEQ ID NO: 2471655 - RNA, 20 nt, Human
ccacagaagccaggagcaaa

SEQ ID NO: 2471656 - RNA, 18 nt, Human
ccacagaagccaggagca

SEQ ID NO: 2471657 - RNA, 21 nt, Human
ccacacuucaggcucuucucc

SEQ ID NO: 2471658 - RNA, 14 nt, Human
ccacacuggugacu

SEQ ID NO: 2471659 - RNA, 23 nt, Human
ccacacuggggugccgccugccc

SEQ ID NO: 2471660 - RNA, 22 nt, Human
ccacacuggggugccgccugcc

SEQ ID NO: 2471661 - RNA, 13 nt, Human
ccacacuggugac

SEQ ID NO: 2471662 - RNA, 20 nt, Human
ccacacuucaggcucuucuc

SEQ ID NO: 2471663 - RNA, 16 nt, Human
ccacacuucaggcucu

SEQ ID NO: 2471664 - RNA, 20 nt, Human
ccacacuggggugccgccug

SEQ ID NO: 2471665 - RNA, 19 nt, Human
ccacacuggggugccgccu

SEQ ID NO: 2471666 - RNA, 22 nt, Human
ccacacuggacuccggcccucc

SEQ ID NO: 2471667 - RNA, 21 nt, Human
ccacacuggacuccggcccuc

SEQ ID NO: 2471668 - RNA, 20 nt, Human
ccacgcccuccccuccccug

SEQ ID NO: 2471669 - RNA, 13 nt, Human
ccacgcacuccau

SEQ ID NO: 2471670 - RNA, 18 nt, Human
ccacgauguggcccuggc

SEQ ID NO: 2471671 - RNA, 16 nt, Human
ccacgagggucaggac

SEQ ID NO: 2471672 - RNA, 17 nt, Human
ccacgauguggcccugg

SEQ ID NO: 2471673 - RNA, 20 nt, Human
ccacgauguggcccuggccu

SEQ ID NO: 2471674 - RNA, 16 nt, Human
ccacgacugucuccau

SEQ ID NO: 2471675 - RNA, 21 nt, Human
ccaccuuguuggagccugcag

SEQ ID NO: 2471676 - RNA, 20 nt, Human
ccaccuuguuggagccugca

SEQ ID NO: 2471677 - RNA, 22 nt, Human
ccaccuuguuggagccugcagg

SEQ ID NO: 2471678 - RNA, 17 nt, Human
ccaccuuuauuaaaauc

SEQ ID NO: 2471679 - RNA, 19 nt, Human
ccaccuuguuggagccugc

SEQ ID NO: 2471680 - RNA, 18 nt, Human
ccaccuuguuggagccug

SEQ ID NO: 2471681 - RNA, 17 nt, Human
ccaccuuguuggagccu

SEQ ID NO: 2471682 - RNA, 18 nt, Human
ccaccucacuccuguuac

SEQ ID NO: 2471683 - RNA, 16 nt, Human
ccaccucacuccuguu

SEQ ID NO: 2471684 - RNA, 15 nt, Human
ccaccucacuccugu

SEQ ID NO: 2471685 - RNA, 19 nt, Human
ccaccuuggcugcagggag

SEQ ID NO: 2471686 - RNA, 18 nt, Human
ccaccuuggcugcaggga

SEQ ID NO: 2471687 - RNA, 22 nt, Human
ccacgcccuccccuccccugcu

SEQ ID NO: 2471688 - RNA, 21 nt, Human
ccacgcccuccccuccccugc

SEQ ID NO: 2471689 - RNA, 17 nt, Human
ccacgccuguaauccca

SEQ ID NO: 2471690 - RNA, 18 nt, Human
ccacgcuggaccuugaac

SEQ ID NO: 2471691 - RNA, 16 nt, Human
ccaccuuggcugcagg

SEQ ID NO: 2471692 - RNA, 15 nt, Human
ccaccuuggcugcag

SEQ ID NO: 2471693 - RNA, 14 nt, Human
ccaccuuggcugca

SEQ ID NO: 2471694 - RNA, 12 nt, Human
ccaccuuggcug

SEQ ID NO: 2471695 - RNA, 21 nt, Human
ccaccuagacuguaaaccucu

SEQ ID NO: 2471696 - RNA, 13 nt, Human
ccaccuagcagca

SEQ ID NO: 2471697 - RNA, 14 nt, Human
ccaccuagcagcac

SEQ ID NO: 2471698 - RNA, 23 nt, Human
ccaccuagcagcaccguucugug

SEQ ID NO: 2471699 - RNA, 16 nt, Human
ccaccuaggccacucc

SEQ ID NO: 2471700 - RNA, 17 nt, Human
ccaccuaggccacuccu

SEQ ID NO: 2471701 - RNA, 20 nt, Human
ccaccuaguggcuguccagu

SEQ ID NO: 2471702 - RNA, 19 nt, Human
ccaccuaguggcuguccag

SEQ ID NO: 2471703 - RNA, 18 nt, Human
ccaccuaguggcugucca

SEQ ID NO: 2471704 - RNA, 16 nt, Human
ccaccuaguggcuguc

SEQ ID NO: 2471705 - RNA, 18 nt, Human
ccaccuaggccacuccuc

SEQ ID NO: 2471706 - RNA, 20 nt, Human
ccaccuaggccacuccucca

SEQ ID NO: 2471707 - RNA, 15 nt, Human
ccaccuaguggcugu

SEQ ID NO: 2471708 - RNA, 22 nt, Human
ccaccuaggccacuccuccaaa

SEQ ID NO: 2471709 - RNA, 18 nt, Human
ccaccuaucucgugggag

SEQ ID NO: 2471710 - RNA, 23 nt, Human
ccaccuaguggcuguccagugcc

SEQ ID NO: 2471711 - RNA, 22 nt, Human
ccaccuaguggcuguccagugc

SEQ ID NO: 2471712 - RNA, 21 nt, Human
ccaccuaguggcuguccagug

SEQ ID NO: 2471713 - RNA, 21 nt, Human
ccaccuaucucgugggagagc

SEQ ID NO: 2471714 - RNA, 20 nt, Human
ccaccuaucucgugggagag

SEQ ID NO: 2471715 - RNA, 14 nt, Human
ccaccucaccccac

SEQ ID NO: 2471716 - RNA, 12 nt, Human
ccaccucacccc

SEQ ID NO: 2471717 - RNA, 22 nt, Human
ccaccaucuuugcagguugcuu

SEQ ID NO: 2471718 - RNA, 16 nt, Human
ccaccaugccaggcua

SEQ ID NO: 2471719 - RNA, 15 nt, Human
ccaccaugcccagcu

SEQ ID NO: 2471720 - RNA, 17 nt, Human
ccaccgccuccuacagc

SEQ ID NO: 2471721 - RNA, 14 nt, Human
ccaccgcuccccag

SEQ ID NO: 2471722 - RNA, 15 nt, Human
ccaccgcuccccagc

SEQ ID NO: 2471723 - RNA, 17 nt, Human
ccaccgcuccccagccc

SEQ ID NO: 2471724 - RNA, 19 nt, Human
ccaccgggcugggagcucu

SEQ ID NO: 2471725 - RNA, 21 nt, Human
ccaccgcugccuaaguggcug

SEQ ID NO: 2471726 - RNA, 21 nt, Human
ccaccgcuccccagcccaggg

SEQ ID NO: 2471727 - RNA, 13 nt, Human
ccaccgcugccua

SEQ ID NO: 2471728 - RNA, 14 nt, Human
ccaccgcugccuaa

SEQ ID NO: 2471729 - RNA, 15 nt, Human
ccaccgcugccuaag

SEQ ID NO: 2471730 - RNA, 15 nt, Human
ccaccauccugcagc

SEQ ID NO: 2471731 - RNA, 14 nt, Human
ccaccauccugcag

SEQ ID NO: 2471732 - RNA, 14 nt, Human
ccaccaccccagcu

SEQ ID NO: 2471733 - RNA, 18 nt, Human
ccaccaucaccagacagg

SEQ ID NO: 2471734 - RNA, 19 nt, Human
ccaccaucaugucuggcua

SEQ ID NO: 2471735 - RNA, 18 nt, Human
ccaccaucaugucuggcu

SEQ ID NO: 2471736 - RNA, 14 nt, Human
ccaccagucacugu

SEQ ID NO: 2471737 - RNA, 13 nt, Human
cagccaggccaca

SEQ ID NO: 2471738 - RNA, 12 nt, Human
cagccaggccac

SEQ ID NO: 2471739 - RNA, 22 nt, Human
cagccaggccacaagacccuug

SEQ ID NO: 2471740 - RNA, 16 nt, Human
cagccaggagcugggc

SEQ ID NO: 2471741 - RNA, 15 nt, Human
cagccaggagcuggg

SEQ ID NO: 2471742 - RNA, 22 nt, Human
cagccaggagcugggcagaagg

SEQ ID NO: 2471743 - RNA, 11 nt, Human
cagccaggagc

SEQ ID NO: 2471744 - RNA, 14 nt, Human
cagccaggagcugg

SEQ ID NO: 2471745 - RNA, 12 nt, Human
cagccaggagcu

SEQ ID NO: 2471746 - RNA, 19 nt, Human
cagccagcagccagcucuc

SEQ ID NO: 2471747 - RNA, 21 nt, Human
cagccagcagccagcucucag

SEQ ID NO: 2471748 - RNA, 22 nt, Human
cagcauauuuguauaguugcuu

SEQ ID NO: 2471749 - RNA, 18 nt, Human
cagcauauuuauagcaau

SEQ ID NO: 2471750 - RNA, 17 nt, Human
cagccagcagccagcuc

SEQ ID NO: 2471751 - RNA, 18 nt, Human
cagccagcagccagcucu

SEQ ID NO: 2471752 - RNA, 20 nt, Human
cagcaguugaaaagacucca

SEQ ID NO: 2471753 - RNA, 21 nt, Human
cagcaguugaaaagacuccaa

SEQ ID NO: 2471754 - RNA, 17 nt, Human
cagcaguugaaaagacu

SEQ ID NO: 2471755 - RNA, 23 nt, Human
cagcagugaaaacaagugcuggc

SEQ ID NO: 2471756 - RNA, 17 nt, Human
cagcagugaaaacaagu

SEQ ID NO: 2471757 - RNA, 15 nt, Human
cagcagugaaaacaa

SEQ ID NO: 2471758 - RNA, 14 nt, Human
cagcagugaaaaca

SEQ ID NO: 2471759 - RNA, 22 nt, Human
cagcauauucaggaagcucagg

SEQ ID NO: 2471760 - RNA, 19 nt, Human
cagcauauucaggaagcuc

SEQ ID NO: 2471761 - RNA, 23 nt, Human
cagcauauucaggaagcucaggg

SEQ ID NO: 2471762 - RNA, 22 nt, Human
cagcaguugaaaagacuccaaa

SEQ ID NO: 2471763 - RNA, 22 nt, Human
cagcagugaaaacaagugcugg

SEQ ID NO: 2471764 - RNA, 12 nt, Human
cagcauauuuau

SEQ ID NO: 2471765 - RNA, 14 nt, Human
cagcauauuuauag

SEQ ID NO: 2471766 - RNA, 22 nt, Human
cagcacagccucuuagaugcag

SEQ ID NO: 2471767 - RNA, 16 nt, Human
cagcacagagaccccc

SEQ ID NO: 2471768 - RNA, 20 nt, Human
cagcacagagagggggccac

SEQ ID NO: 2471769 - RNA, 17 nt, Human
cagcacagagagggggc

SEQ ID NO: 2471770 - RNA, 13 nt, Human
cagcacagagagg

SEQ ID NO: 2471771 - RNA, 18 nt, Human
cagcacacagggcaguga

SEQ ID NO: 2471772 - RNA, 19 nt, Human
cagcacacagggcagugag

SEQ ID NO: 2471773 - RNA, 14 nt, Human
cagcacagagaaga

SEQ ID NO: 2471774 - RNA, 17 nt, Human
cagcacagagaagacaa

SEQ ID NO: 2471775 - RNA, 16 nt, Human
cagcacagagaagaca

SEQ ID NO: 2471776 - RNA, 12 nt, Human
cagcacagagag

SEQ ID NO: 2471777 - RNA, 23 nt, Human
cagcaccccuuccauguggagaa

SEQ ID NO: 2471778 - RNA, 22 nt, Human
cagcaccccuuccauguggaga

SEQ ID NO: 2471779 - RNA, 19 nt, Human
cagcaccccuuccaugugg

SEQ ID NO: 2471780 - RNA, 21 nt, Human
cagcacagcaaggaggcuggc

SEQ ID NO: 2471781 - RNA, 19 nt, Human
cagcacagcaaggaggcug

SEQ ID NO: 2471782 - RNA, 13 nt, Human
cagcacagcaagg

SEQ ID NO: 2471783 - RNA, 13 nt, Human
cagcacagccaac

SEQ ID NO: 2471784 - RNA, 16 nt, Human
cagcacccgggcucag

SEQ ID NO: 2471785 - RNA, 12 nt, Human
cagcacccugca

SEQ ID NO: 2471786 - RNA, 16 nt, Human
cagcaccguucugugc

SEQ ID NO: 2471787 - RNA, 17 nt, Human
cagcaccguucugugca

SEQ ID NO: 2471788 - RNA, 18 nt, Human
cagcaccguucugugcac

SEQ ID NO: 2471789 - RNA, 15 nt, Human
cagcaccuacagugu

SEQ ID NO: 2471790 - RNA, 17 nt, Human
cagcaggugcugcuacc

SEQ ID NO: 2471791 - RNA, 15 nt, Human
cagcaggugcugcua

SEQ ID NO: 2471792 - RNA, 14 nt, Human
cagcaggugcugcu

SEQ ID NO: 2471793 - RNA, 11 nt, Human
cagcaggugcu

SEQ ID NO: 2471794 - RNA, 19 nt, Human
cagcaguaccuauaaagua

SEQ ID NO: 2471795 - RNA, 23 nt, Human
cagcaggugcugcuacccucccu

SEQ ID NO: 2471796 - RNA, 19 nt, Human
cagcaggugcugcuacccu

SEQ ID NO: 2471797 - RNA, 21 nt, Human
cagcagggucuuuucaucugg

SEQ ID NO: 2471798 - RNA, 20 nt, Human
cagcagggucuuuucaucug

SEQ ID NO: 2471799 - RNA, 22 nt, Human
cagcagggucuuuucaucuggg

SEQ ID NO: 2471800 - RNA, 21 nt, Human
cagcagguccccagcuuuggc

SEQ ID NO: 2471801 - RNA, 20 nt, Human
cagcaccuacaguguacagu

SEQ ID NO: 2471802 - RNA, 16 nt, Human
cagcaccccuuccaug

SEQ ID NO: 2471803 - RNA, 18 nt, Human
cagcagggucuuuucauc

SEQ ID NO: 2471804 - RNA, 20 nt, Human
cagaggggguggccucccaa

SEQ ID NO: 2471805 - RNA, 19 nt, Human
cagaggggguggccuccca

SEQ ID NO: 2471806 - RNA, 17 nt, Human
cagaggggguggccucc

SEQ ID NO: 2471807 - RNA, 18 nt, Human
cagaggggguggccuccc

SEQ ID NO: 2471808 - RNA, 14 nt, Human
cagaguauggagcu

SEQ ID NO: 2471809 - RNA, 21 nt, Human
cagaguaugaacaccugggcu

SEQ ID NO: 2471810 - RNA, 13 nt, Human
cagaguaugaaca

SEQ ID NO: 2471811 - RNA, 22 nt, Human
cagaggggcaggcccugcacug

SEQ ID NO: 2471812 - RNA, 20 nt, Human
cagagucagaaguuucugcc

SEQ ID NO: 2471813 - RNA, 20 nt, Human
cagaguauggagcucagaga

SEQ ID NO: 2471814 - RNA, 20 nt, Human
cagaguauuugaaaaaugua

SEQ ID NO: 2471815 - RNA, 21 nt, Human
cagagucacacgggggcagcu

SEQ ID NO: 2471816 - RNA, 13 nt, Human
cagagucagcaga

SEQ ID NO: 2471817 - RNA, 15 nt, Human
cagauauuuuuucag

SEQ ID NO: 2471818 - RNA, 14 nt, Human
cagagucagcagaa

SEQ ID NO: 2471819 - RNA, 11 nt, Human
cagauauuuau

SEQ ID NO: 2471820 - RNA, 12 nt, Human
cagauauuuaua

SEQ ID NO: 2471821 - RNA, 14 nt, Human
cagauauuuauauu

SEQ ID NO: 2471822 - RNA, 16 nt, Human
cagauauuuauauuuu

SEQ ID NO: 2471823 - RNA, 20 nt, Human
cagauauuuauauuuuuauu

SEQ ID NO: 2471824 - RNA, 21 nt, Human
cagauauuuauauuuuuauuu

SEQ ID NO: 2471825 - RNA, 22 nt, Human
cagauauuuauauuuuuauuuu

SEQ ID NO: 2471826 - RNA, 19 nt, Human
cagaaguuucugccgcagc

SEQ ID NO: 2471827 - RNA, 23 nt, Human
cagaaguuucugccgcagcccug

SEQ ID NO: 2471828 - RNA, 20 nt, Human
cagaaguuugagaucagccu

SEQ ID NO: 2471829 - RNA, 22 nt, Human
cagaaguuugagaucagccugg

SEQ ID NO: 2471830 - RNA, 23 nt, Human
cagaaguuugagaucagccuggg

SEQ ID NO: 2471831 - RNA, 18 nt, Human
cagagcugccaccugccu

SEQ ID NO: 2471832 - RNA, 16 nt, Human
cagagcugccaccugc

SEQ ID NO: 2471833 - RNA, 20 nt, Human
cagagcugggauguuucugu

SEQ ID NO: 2471834 - RNA, 22 nt, Human
cagagcuguggacuuuguucac

SEQ ID NO: 2471835 - RNA, 19 nt, Human
cagagcuguuuauggccuc

SEQ ID NO: 2471836 - RNA, 20 nt, Human
cagagcuguuuauggccuca

SEQ ID NO: 2471837 - RNA, 21 nt, Human
cagagcuguuuauggccucag

SEQ ID NO: 2471838 - RNA, 14 nt, Human
cagagcuucccuga

SEQ ID NO: 2471839 - RNA, 18 nt, Human
cagagcuucccugacuca

SEQ ID NO: 2471840 - RNA, 13 nt, Human
cagagcuucccug

SEQ ID NO: 2471841 - RNA, 22 nt, Human
cagagcuguuuauggccucagc

SEQ ID NO: 2471842 - RNA, 13 nt, Human
cagagcuggggcu

SEQ ID NO: 2471843 - RNA, 14 nt, Human
cagagcugggaggg

SEQ ID NO: 2471844 - RNA, 20 nt, Human
cagagcuggggcugagggau

SEQ ID NO: 2471845 - RNA, 22 nt, Human
cagagggccugcaagggaguga

SEQ ID NO: 2471846 - RNA, 23 nt, Human
cagaggggaaaccaguguagccu

SEQ ID NO: 2471847 - RNA, 20 nt, Human
cagaggggcaggcccugcac

SEQ ID NO: 2471848 - RNA, 19 nt, Human
cagaggggcaggcccugca

SEQ ID NO: 2471849 - RNA, 18 nt, Human
cagaggggcaggcccugc

SEQ ID NO: 2471850 - RNA, 16 nt, Human
cagaggggcaggcccu

SEQ ID NO: 2471851 - RNA, 20 nt, Human
cagcuccagcucaccagccc

SEQ ID NO: 2471852 - RNA, 18 nt, Human
cagcuccagcucaccagc

SEQ ID NO: 2471853 - RNA, 17 nt, Human
cagcuccagcucaccag

SEQ ID NO: 2471854 - RNA, 16 nt, Human
cagcuccagcucacca

SEQ ID NO: 2471855 - RNA, 21 nt, Human
cagcucccaaggcucugagca

SEQ ID NO: 2471856 - RNA, 21 nt, Human
cagcuccagguggcucugagg

SEQ ID NO: 2471857 - RNA, 17 nt, Human
cagcuccagguggcucu

SEQ ID NO: 2471858 - RNA, 19 nt, Human
cagcuccacucugacuggc

SEQ ID NO: 2471859 - RNA, 22 nt, Human
cagcuccagcucaccagcccca

SEQ ID NO: 2471860 - RNA, 13 nt, Human
cagcuccacccug

SEQ ID NO: 2471861 - RNA, 15 nt, Human
cagcuccacccuggc

SEQ ID NO: 2471862 - RNA, 14 nt, Human
cagcuccagcugcu

SEQ ID NO: 2471863 - RNA, 23 nt, Human
cagcuccacucugacuggcacag

SEQ ID NO: 2471864 - RNA, 14 nt, Human
cagcuccaaccugc

SEQ ID NO: 2471865 - RNA, 17 nt, Human
cagcuccaaccugcaaa

SEQ ID NO: 2471866 - RNA, 20 nt, Human
cagcuccaaccugcaaagau

SEQ ID NO: 2471867 - RNA, 15 nt, Human
cagcuccagcucacc

SEQ ID NO: 2471868 - RNA, 14 nt, Human
cagcuccagcucac

SEQ ID NO: 2471869 - RNA, 20 nt, Human
cagcuccaagaccuguuggu

SEQ ID NO: 2471870 - RNA, 18 nt, Human
cagcuccaagaccuguug

SEQ ID NO: 2471871 - RNA, 23 nt, Human
cagcuccaaccugcaaagaucug

SEQ ID NO: 2471872 - RNA, 13 nt, Human
cagcuccagcuca

SEQ ID NO: 2471873 - RNA, 23 nt, Human
caggaaaucaaauaugcaaagca

SEQ ID NO: 2471874 - RNA, 19 nt, Human
caggaaaggaaucauuucu

SEQ ID NO: 2471875 - RNA, 13 nt, Human
caggaaaugaaaa

SEQ ID NO: 2471876 - RNA, 20 nt, Human
caggaaaugaaaaugucuug

SEQ ID NO: 2471877 - RNA, 21 nt, Human
caggaaaugaaaaugucuugu

SEQ ID NO: 2471878 - RNA, 21 nt, Human
caggaacaaucgauggccuug

SEQ ID NO: 2471879 - RNA, 22 nt, Human
caggaacacccgacuccucaaa

SEQ ID NO: 2471880 - RNA, 12 nt, Human
caggaacagaag

SEQ ID NO: 2471881 - RNA, 15 nt, Human
caggaaaggcuccag

SEQ ID NO: 2471882 - RNA, 14 nt, Human
caggaaaggcucca

SEQ ID NO: 2471883 - RNA, 15 nt, Human
caggaaaggaaucau

SEQ ID NO: 2471884 - RNA, 18 nt, Human
caggaaaggcccagccac

SEQ ID NO: 2471885 - RNA, 19 nt, Human
caggaaagcucagcuacug

SEQ ID NO: 2471886 - RNA, 12 nt, Human
cagcuucaguug

SEQ ID NO: 2471887 - RNA, 18 nt, Human
cagcuucauuuccugugu

SEQ ID NO: 2471888 - RNA, 14 nt, Human
cagcuucagguuau

SEQ ID NO: 2471889 - RNA, 17 nt, Human
cagcuucagccaggagc

SEQ ID NO: 2471890 - RNA, 15 nt, Human
cagcuucagccagga

SEQ ID NO: 2471891 - RNA, 15 nt, Human
cagcuucauuuccug

SEQ ID NO: 2471892 - RNA, 18 nt, Human
cagcugugcucuggacag

SEQ ID NO: 2471893 - RNA, 17 nt, Human
cagcugugagccuuggc

SEQ ID NO: 2471894 - RNA, 16 nt, Human
cagcugugagccuugg

SEQ ID NO: 2471895 - RNA, 15 nt, Human
cagcugugagccuug

SEQ ID NO: 2471896 - RNA, 13 nt, Human
cagcugugagccu

SEQ ID NO: 2471897 - RNA, 20 nt, Human
cagcugugaacauggacucu

SEQ ID NO: 2471898 - RNA, 18 nt, Human
cagcugugaacauggacu

SEQ ID NO: 2471899 - RNA, 22 nt, Human
cagcugucccugucaccaagcu

SEQ ID NO: 2471900 - RNA, 16 nt, Human
cagcuguccucuucug

SEQ ID NO: 2471901 - RNA, 18 nt, Human
cagcugauuuuaacaaua

SEQ ID NO: 2471902 - RNA, 16 nt, Human
cagcugcaccugccag

SEQ ID NO: 2471903 - RNA, 21 nt, Human
cagcugauuuuaacaauaacu

SEQ ID NO: 2471904 - RNA, 17 nt, Human
cagcugcaccugccagc

SEQ ID NO: 2471905 - RNA, 18 nt, Human
cagcugcaccugccagcc

SEQ ID NO: 2471906 - RNA, 20 nt, Human
cagcugcaccugccagccug

SEQ ID NO: 2471907 - RNA, 21 nt, Human
cagcugcaccugccagccugg

SEQ ID NO: 2471908 - RNA, 20 nt, Human
cagcuccccucggagaagag

SEQ ID NO: 2471909 - RNA, 22 nt, Human
cagcucccccuguccccucagc

SEQ ID NO: 2471910 - RNA, 20 nt, Human
cagcugauuuuaacaauaac

SEQ ID NO: 2471911 - RNA, 17 nt, Human
cagcuccccucggagaa

SEQ ID NO: 2471912 - RNA, 18 nt, Human
cagcuccccucggagaag

SEQ ID NO: 2471913 - RNA, 16 nt, Human
cagcuccccucggaga

SEQ ID NO: 2471914 - RNA, 12 nt, Human
cagcucccaccc

SEQ ID NO: 2471915 - RNA, 14 nt, Human
cagcucccacccca

SEQ ID NO: 2471916 - RNA, 15 nt, Human
cagcucccaccccac

SEQ ID NO: 2471917 - RNA, 19 nt, Human
cagcucccaccccaccccc

SEQ ID NO: 2471918 - RNA, 21 nt, Human
cagcucccccuguccccucag

SEQ ID NO: 2471919 - RNA, 19 nt, Human
cagcucccccuguccccuc

SEQ ID NO: 2471920 - RNA, 12 nt, Human
cagcugccucuu

SEQ ID NO: 2471921 - RNA, 13 nt, Human
cagcugccucuuc

SEQ ID NO: 2471922 - RNA, 18 nt, Human
cagcugccgaccagagcc

SEQ ID NO: 2471923 - RNA, 17 nt, Human
cagcugccgaccagagc

SEQ ID NO: 2471924 - RNA, 13 nt, Human
cagcugccccggg

SEQ ID NO: 2471925 - RNA, 12 nt, Human
cagcugccccgg

SEQ ID NO: 2471926 - RNA, 15 nt, Human
cagcugccccagcca

SEQ ID NO: 2471927 - RNA, 16 nt, Human
cagcugccagagaagc

SEQ ID NO: 2471928 - RNA, 14 nt, Human
cagcugccagagaa

SEQ ID NO: 2471929 - RNA, 15 nt, Human
cagcugccagagaag

SEQ ID NO: 2471930 - RNA, 12 nt, Human
cagcugcacuga

SEQ ID NO: 2471931 - RNA, 22 nt, Human
cagcugcaccugccagccuggc

SEQ ID NO: 2471932 - RNA, 18 nt, Human
cagcugcacugaugcugc

SEQ ID NO: 2471933 - RNA, 15 nt, Human
cagcugcagagacag

SEQ ID NO: 2471934 - RNA, 13 nt, Human
cagcugccagaga

SEQ ID NO: 2471935 - RNA, 16 nt, Human
cagcugcagagacaga

SEQ ID NO: 2471936 - RNA, 16 nt, Human
cagccucuuucugucc

SEQ ID NO: 2471937 - RNA, 18 nt, Human
cagccucuuggccccaga

SEQ ID NO: 2471938 - RNA, 15 nt, Human
cagccucuuaaagcu

SEQ ID NO: 2471939 - RNA, 19 nt, Human
cagccucuuaaagcugccu

SEQ ID NO: 2471940 - RNA, 20 nt, Human
cagccucuuaaagcugccug

SEQ ID NO: 2471941 - RNA, 21 nt, Human
cagccucuuaaagcugccugu

SEQ ID NO: 2471942 - RNA, 13 nt, Human
cagccgggcccug

SEQ ID NO: 2471943 - RNA, 12 nt, Human
cagccgggcccu

SEQ ID NO: 2471944 - RNA, 24 nt, Human
cagccggccucucuggccucccac

SEQ ID NO: 2471945 - RNA, 23 nt, Human
cagccggccucucuggccuccca

SEQ ID NO: 2471946 - RNA, 22 nt, Human
cagccggccucucuggccuccc

SEQ ID NO: 2471947 - RNA, 20 nt, Human
cagccggccucucuggccuc

SEQ ID NO: 2471948 - RNA, 19 nt, Human
cagccggccucucuggccu

SEQ ID NO: 2471949 - RNA, 15 nt, Human
cagccgggcccugag

SEQ ID NO: 2471950 - RNA, 14 nt, Human
cagccucuguuccc

SEQ ID NO: 2471951 - RNA, 11 nt, Human
cagccucuuaa

SEQ ID NO: 2471952 - RNA, 19 nt, Human
cagccgauucaccugagca

SEQ ID NO: 2471953 - RNA, 16 nt, Human
cagccgcagccucccu

SEQ ID NO: 2471954 - RNA, 19 nt, Human
cagccgcagccucccucug

SEQ ID NO: 2471955 - RNA, 16 nt, Human
cagccgcugcccggcg

SEQ ID NO: 2471956 - RNA, 14 nt, Human
cagccgcuucugac

SEQ ID NO: 2471957 - RNA, 13 nt, Human
cagccggcacagg

SEQ ID NO: 2471958 - RNA, 22 nt, Human
cagccgcugcccggcgcccucu

SEQ ID NO: 2471959 - RNA, 18 nt, Human
cagccgcuucugacugcu

SEQ ID NO: 2471960 - RNA, 23 nt, Human
cagccggcacagggucugcucuu

SEQ ID NO: 2471961 - RNA, 18 nt, Human
cagccggcacagggucug

SEQ ID NO: 2471962 - RNA, 17 nt, Human
cagccggcacagggucu

SEQ ID NO: 2471963 - RNA, 15 nt, Human
cagccggcacagggu

SEQ ID NO: 2471964 - RNA, 18 nt, Human
cagccggccucucuggcc

SEQ ID NO: 2471965 - RNA, 17 nt, Human
cagccggccucucuggc

SEQ ID NO: 2471966 - RNA, 16 nt, Human
cagccggccucucugg

SEQ ID NO: 2471967 - RNA, 15 nt, Human
cagccggccucucug

SEQ ID NO: 2471968 - RNA, 14 nt, Human
cagccggccucucu

SEQ ID NO: 2471969 - RNA, 14 nt, Human
cagccggcacccac

SEQ ID NO: 2471970 - RNA, 20 nt, Human
cagcccuucuuuccacagaa

SEQ ID NO: 2471971 - RNA, 19 nt, Human
cagcccuucuuuccacaga

SEQ ID NO: 2471972 - RNA, 15 nt, Human
cagcccuucuuucca

SEQ ID NO: 2471973 - RNA, 23 nt, Human
cagccccugccccagcccaaguc

SEQ ID NO: 2471974 - RNA, 21 nt, Human
cagccgagauagccaaggcca

SEQ ID NO: 2471975 - RNA, 20 nt, Human
cagccgagauagccaaggcc

SEQ ID NO: 2471976 - RNA, 18 nt, Human
cagccgagccgggccugg

SEQ ID NO: 2471977 - RNA, 17 nt, Human
cagccgagccgggccug

SEQ ID NO: 2471978 - RNA, 14 nt, Human
cagccgagccgggc

SEQ ID NO: 2471979 - RNA, 12 nt, Human
cagccgagccgg

SEQ ID NO: 2471980 - RNA, 23 nt, Human
cagccgagcucguguauccuggg

SEQ ID NO: 2471981 - RNA, 22 nt, Human
cagccgagcucguguauccugg

SEQ ID NO: 2471982 - RNA, 14 nt, Human
cagccgagcucgug

SEQ ID NO: 2471983 - RNA, 19 nt, Human
cagccgagccgggccuggg

SEQ ID NO: 2471984 - RNA, 18 nt, Human
cagccgauucaccugagc

SEQ ID NO: 2471985 - RNA, 14 nt, Human
cagccccuggaugc

SEQ ID NO: 2471986 - RNA, 13 nt, Human
cagccccuggaug

SEQ ID NO: 2471987 - RNA, 12 nt, Human
cagccccuggau

SEQ ID NO: 2471988 - RNA, 21 nt, Human
cagccccuggaugcagccuca

SEQ ID NO: 2471989 - RNA, 19 nt, Human
cagccccuggaugcagccu

SEQ ID NO: 2471990 - RNA, 18 nt, Human
cagccccuggaugcagcc

SEQ ID NO: 2471991 - RNA, 17 nt, Human
cagccccuggaugcagc

SEQ ID NO: 2471992 - RNA, 21 nt, Human
cagcccuuagcagggaaacag

SEQ ID NO: 2471993 - RNA, 16 nt, Human
cagcccuuagcaggga

SEQ ID NO: 2471994 - RNA, 15 nt, Human
cagcccuuagcaggg

SEQ ID NO: 2471995 - RNA, 19 nt, Human
cagccugagcgacagugag

SEQ ID NO: 2471996 - RNA, 22 nt, Human
cagccugagcgacagugagacu

SEQ ID NO: 2471997 - RNA, 18 nt, Human
cagccugagcgacaguga

SEQ ID NO: 2471998 - RNA, 17 nt, Human
cagccucuuucuguccc

SEQ ID NO: 2471999 - RNA, 17 nt, Human
cagcggggacagcuccu

SEQ ID NO: 2472000 - RNA, 16 nt, Human
cagcggggacagcucc

SEQ ID NO: 2472001 - RNA, 16 nt, Human
cagccugagcaacucu

SEQ ID NO: 2472002 - RNA, 20 nt, Human
cagccugagcaacucuugau

SEQ ID NO: 2472003 - RNA, 14 nt, Human
cagcggggacagcu

SEQ ID NO: 2472004 - RNA, 15 nt, Human
cagcggggacagcuc

SEQ ID NO: 2472005 - RNA, 15 nt, Human
cagcgugcuuuaaaa

SEQ ID NO: 2472006 - RNA, 14 nt, Human
cagcguccugucca

SEQ ID NO: 2472007 - RNA, 15 nt, Human
cagcguccuguccac

SEQ ID NO: 2472008 - RNA, 16 nt, Human
cagcguccuccucugu

SEQ ID NO: 2472009 - RNA, 18 nt, Human
cagcguccuccucuguga

SEQ ID NO: 2472010 - RNA, 21 nt, Human
cagcgucccagucucuggcag

SEQ ID NO: 2472011 - RNA, 15 nt, Human
cagcguccuccucug

SEQ ID NO: 2472012 - RNA, 14 nt, Human
cagcgucccagucu

SEQ ID NO: 2472013 - RNA, 20 nt, Human
cagcggggccuggcgggaug

SEQ ID NO: 2472014 - RNA, 17 nt, Human
cagcguagccucuccgg

SEQ ID NO: 2472015 - RNA, 14 nt, Human
cagcgguggccucu

SEQ ID NO: 2472016 - RNA, 18 nt, Human
cagcgggggccagggaag

SEQ ID NO: 2472017 - RNA, 19 nt, Human
cagcggggcgaagcccagg

SEQ ID NO: 2472018 - RNA, 14 nt, Human
cagcggggcgaagc

SEQ ID NO: 2472019 - RNA, 23 nt, Human
cagcggggccuggcgggaugggc

SEQ ID NO: 2472020 - RNA, 21 nt, Human
cagccugagcaacucuugauu

SEQ ID NO: 2472021 - RNA, 15 nt, Human
cagcgguuuggggag

SEQ ID NO: 2472022 - RNA, 15 nt, Human
cagcgguggccucuu

SEQ ID NO: 2472023 - RNA, 15 nt, Human
cagcguacucaucau

SEQ ID NO: 2472024 - RNA, 15 nt, Human
cagucaccucaugga

SEQ ID NO: 2472025 - RNA, 22 nt, Human
cagucaccccggccaccugcgg

SEQ ID NO: 2472026 - RNA, 19 nt, Human
cagucaccccggccaccug

SEQ ID NO: 2472027 - RNA, 20 nt, Human
cagucaccccggccaccugc

SEQ ID NO: 2472028 - RNA, 15 nt, Human
cagucaaccugggca

SEQ ID NO: 2472029 - RNA, 16 nt, Human
cagucaaccugggcaa

SEQ ID NO: 2472030 - RNA, 22 nt, Human
cagucaaccugggcaaagccua

SEQ ID NO: 2472031 - RNA, 16 nt, Human
cagucaacaaacuauu

SEQ ID NO: 2472032 - RNA, 14 nt, Human
cagucaaccugggc

SEQ ID NO: 2472033 - RNA, 15 nt, Human
cagucaaaacagaga

SEQ ID NO: 2472034 - RNA, 19 nt, Human
caguauuuugguucuuagu

SEQ ID NO: 2472035 - RNA, 19 nt, Human
cagucaaaacagagaugug

SEQ ID NO: 2472036 - RNA, 19 nt, Human
caguauuuuggagaaauua

SEQ ID NO: 2472037 - RNA, 20 nt, Human
caguauuuuggagaaauuau

SEQ ID NO: 2472038 - RNA, 23 nt, Human
caguauuuuggagaaauuauuua

SEQ ID NO: 2472039 - RNA, 21 nt, Human
caguauuuuggagaaauuauu

SEQ ID NO: 2472040 - RNA, 18 nt, Human
cagguuugggaccccugg

SEQ ID NO: 2472041 - RNA, 21 nt, Human
caguauugaagcauuuuauaa

SEQ ID NO: 2472042 - RNA, 23 nt, Human
cagguuugggaccccuggugguu

SEQ ID NO: 2472043 - RNA, 22 nt, Human
cagguugggccauacuggccuc

SEQ ID NO: 2472044 - RNA, 21 nt, Human
cagguugggccauacuggccu

SEQ ID NO: 2472045 - RNA, 17 nt, Human
cagguugggccauacug

SEQ ID NO: 2472046 - RNA, 13 nt, Human
cagguugggccau

SEQ ID NO: 2472047 - RNA, 16 nt, Human
cagguuuaagcuguua

SEQ ID NO: 2472048 - RNA, 18 nt, Human
cagguuuaagcuguuacu

SEQ ID NO: 2472049 - RNA, 15 nt, Human
cagguuugggacccc

SEQ ID NO: 2472050 - RNA, 17 nt, Human
cagguuucuggucucua

SEQ ID NO: 2472051 - RNA, 20 nt, Human
cagguuucuggucucuaggc

SEQ ID NO: 2472052 - RNA, 21 nt, Human
cagucaaccugggcaaagccu

SEQ ID NO: 2472053 - RNA, 15 nt, Human
cagucaaggaguggc

SEQ ID NO: 2472054 - RNA, 18 nt, Human
caggguguggcccugcca

SEQ ID NO: 2472055 - RNA, 18 nt, Human
caggguggugcugggacu

SEQ ID NO: 2472056 - RNA, 17 nt, Human
caggguggugcugggac

SEQ ID NO: 2472057 - RNA, 19 nt, Human
caggguggugcugggacug

SEQ ID NO: 2472058 - RNA, 16 nt, Human
caggguggugcuggga

SEQ ID NO: 2472059 - RNA, 20 nt, Human
cagggugggauggaggagaa

SEQ ID NO: 2472060 - RNA, 14 nt, Human
cagggucugggcag

SEQ ID NO: 2472061 - RNA, 19 nt, Human
cagggucucugcugccgcc

SEQ ID NO: 2472062 - RNA, 23 nt, Human
cagggucugcucuuucucugcca

SEQ ID NO: 2472063 - RNA, 22 nt, Human
cagggucugcucuuucucugcc

SEQ ID NO: 2472064 - RNA, 21 nt, Human
cagggucugcucuuucucugc

SEQ ID NO: 2472065 - RNA, 16 nt, Human
cagggucugggcagga

SEQ ID NO: 2472066 - RNA, 13 nt, Human
cagggucuucccu

SEQ ID NO: 2472067 - RNA, 17 nt, Human
cagggucuucccuaccu

SEQ ID NO: 2472068 - RNA, 15 nt, Human
cagggucugggcagg

SEQ ID NO: 2472069 - RNA, 18 nt, Human
cagggugggauggaggag

SEQ ID NO: 2472070 - RNA, 19 nt, Human
caggguugaccccagagga

SEQ ID NO: 2472071 - RNA, 20 nt, Human
caggguugaccccagaggau

SEQ ID NO: 2472072 - RNA, 21 nt, Human
caggguugaucacacucuggg

SEQ ID NO: 2472073 - RNA, 18 nt, Human
caggguugaucacacucu

SEQ ID NO: 2472074 - RNA, 15 nt, Human
caggguucuccucuc

SEQ ID NO: 2472075 - RNA, 22 nt, Human
caggguucccccagcccugugg

SEQ ID NO: 2472076 - RNA, 17 nt, Human
caggguucuccucuccc

SEQ ID NO: 2472077 - RNA, 20 nt, Human
caggguucuccucuccccuc

SEQ ID NO: 2472078 - RNA, 21 nt, Human
caggguucuccucuccccucu

SEQ ID NO: 2472079 - RNA, 23 nt, Human
caggguguugggauacugcaggg

SEQ ID NO: 2472080 - RNA, 19 nt, Human
caggguguggcccugccau

SEQ ID NO: 2472081 - RNA, 13 nt, Human
cagggugugugcu

SEQ ID NO: 2472082 - RNA, 15 nt, Human
caggguuaagaagac

SEQ ID NO: 2472083 - RNA, 18 nt, Human
caggguucaaaaugucug

SEQ ID NO: 2472084 - RNA, 15 nt, Human
caggguucccccagc

SEQ ID NO: 2472085 - RNA, 17 nt, Human
caggguucccccagccc

SEQ ID NO: 2472086 - RNA, 18 nt, Human
caggguucccccagcccu

SEQ ID NO: 2472087 - RNA, 20 nt, Human
caggguucccccagcccugu

SEQ ID NO: 2472088 - RNA, 21 nt, Human
caggguucccccagcccugug

SEQ ID NO: 2472089 - RNA, 18 nt, Human
cagggucucacucugucg

SEQ ID NO: 2472090 - RNA, 17 nt, Human
cagggucucacucuguc

SEQ ID NO: 2472091 - RNA, 18 nt, Human
cagggucucugcugccgc

SEQ ID NO: 2472092 - RNA, 17 nt, Human
cagggucucugcugccg

SEQ ID NO: 2472093 - RNA, 16 nt, Human
cagggucucugcugcc

SEQ ID NO: 2472094 - RNA, 15 nt, Human
cagggucucugcugc

SEQ ID NO: 2472095 - RNA, 13 nt, Human
cagggucucugcu

SEQ ID NO: 2472096 - RNA, 23 nt, Human
cagggucucuagugcugugaaaa

SEQ ID NO: 2472097 - RNA, 20 nt, Human
cagggucugcucuuucucug

SEQ ID NO: 2472098 - RNA, 17 nt, Human
cagggucugcucuuucu

SEQ ID NO: 2472099 - RNA, 14 nt, Human
cagggucugcucuu

SEQ ID NO: 2472100 - RNA, 13 nt, Human
cagggucugcucu

SEQ ID NO: 2472101 - RNA, 21 nt, Human
cagggucucacucugucgccc

SEQ ID NO: 2472102 - RNA, 22 nt, Human
cagggucucacucugucgccca

SEQ ID NO: 2472103 - RNA, 19 nt, Human
cagguugcuuugcccuggu

SEQ ID NO: 2472104 - RNA, 18 nt, Human
cagguugcuuugcccugg

SEQ ID NO: 2472105 - RNA, 17 nt, Human
cagguugcuuugcccug

SEQ ID NO: 2472106 - RNA, 15 nt, Human
cagguugcuuugccc

SEQ ID NO: 2472107 - RNA, 22 nt, Human
cagguugcugguugcugugugg

SEQ ID NO: 2472108 - RNA, 21 nt, Human
cagguugcugguugcugugug

SEQ ID NO: 2472109 - RNA, 20 nt, Human
cagguugcugguugcugugu

SEQ ID NO: 2472110 - RNA, 19 nt, Human
cagguugcugguugcugug

SEQ ID NO: 2472111 - RNA, 21 nt, Human
caggugcuacacccuuuucca

SEQ ID NO: 2472112 - RNA, 22 nt, Human
cagguugggaaugaggcuugcu

SEQ ID NO: 2472113 - RNA, 20 nt, Human
cagguugggaaugaggcuug

SEQ ID NO: 2472114 - RNA, 14 nt, Human
cagguugguggggg

SEQ ID NO: 2472115 - RNA, 20 nt, Human
caggugcuaggaacacuccu

SEQ ID NO: 2472116 - RNA, 18 nt, Human
caggugcuaggaacacuc

SEQ ID NO: 2472117 - RNA, 14 nt, Human
caggugcgaaagga

SEQ ID NO: 2472118 - RNA, 23 nt, Human
caggugcagcccccacugccuuu

SEQ ID NO: 2472119 - RNA, 12 nt, Human
caggugcagugg

SEQ ID NO: 2472120 - RNA, 13 nt, Human
caggugcaguggc

SEQ ID NO: 2472121 - RNA, 20 nt, Human
caggugauccacccaccuca

SEQ ID NO: 2472122 - RNA, 23 nt, Human
caggugcacagacgucccuccac

SEQ ID NO: 2472123 - RNA, 15 nt, Human
caggugcacagacgu

SEQ ID NO: 2472124 - RNA, 18 nt, Human
caggugcagcccccacug

SEQ ID NO: 2472125 - RNA, 20 nt, Human
caggugcagcccccacugcc

SEQ ID NO: 2472126 - RNA, 17 nt, Human
caggugauccacccacc

SEQ ID NO: 2472127 - RNA, 16 nt, Human
caggugauccacccac

SEQ ID NO: 2472128 - RNA, 12 nt, Human
caggguuggccc

SEQ ID NO: 2472129 - RNA, 15 nt, Human
cagucucaggaaauc

SEQ ID NO: 2472130 - RNA, 18 nt, Human
cagucgucgcacagucuc

SEQ ID NO: 2472131 - RNA, 17 nt, Human
cagucgucgcacagucu

SEQ ID NO: 2472132 - RNA, 13 nt, Human
cagucgugccugu

SEQ ID NO: 2472133 - RNA, 20 nt, Human
cagucgucgcacagucucuc

SEQ ID NO: 2472134 - RNA, 20 nt, Human
cagucgcgcugccugugugg

SEQ ID NO: 2472135 - RNA, 18 nt, Human
cagucgcgcugccugugu

SEQ ID NO: 2472136 - RNA, 17 nt, Human
cagucgcgcugccugug

SEQ ID NO: 2472137 - RNA, 16 nt, Human
cagucgcgcugccugu

SEQ ID NO: 2472138 - RNA, 15 nt, Human
cagucgcgcugccug

SEQ ID NO: 2472139 - RNA, 14 nt, Human
cagucgcgcugccu

SEQ ID NO: 2472140 - RNA, 13 nt, Human
cagucgucgcaca

SEQ ID NO: 2472141 - RNA, 19 nt, Human
cagucgggggcuggccuag

SEQ ID NO: 2472142 - RNA, 18 nt, Human
cagucgggggcuggccua

SEQ ID NO: 2472143 - RNA, 17 nt, Human
cagucgggggcuggccu

SEQ ID NO: 2472144 - RNA, 16 nt, Human
cagucgggggcuggcc

SEQ ID NO: 2472145 - RNA, 14 nt, Human
cagucgggggcugg

SEQ ID NO: 2472146 - RNA, 13 nt, Human
cagucgggggcug

SEQ ID NO: 2472147 - RNA, 14 nt, Human
cagucucccucccu

SEQ ID NO: 2472148 - RNA, 18 nt, Human
cagucucaggagcauggg

SEQ ID NO: 2472149 - RNA, 19 nt, Human
cagucucaggagcaugggg

SEQ ID NO: 2472150 - RNA, 23 nt, Human
cagucucacugugggaaggccag

SEQ ID NO: 2472151 - RNA, 19 nt, Human
cagucucacugugggaagg

SEQ ID NO: 2472152 - RNA, 17 nt, Human
cagucucacccagacuc

SEQ ID NO: 2472153 - RNA, 13 nt, Human
cagucucaggagc

SEQ ID NO: 2472154 - RNA, 14 nt, Human
cagucucaggagca

SEQ ID NO: 2472155 - RNA, 16 nt, Human
cagucuccaccaggaa

SEQ ID NO: 2472156 - RNA, 17 nt, Human
cagucuccaccaggaac

SEQ ID NO: 2472157 - RNA, 11 nt, Human
cagucucccuu

SEQ ID NO: 2472158 - RNA, 22 nt, Human
cagucugaucgugacgcugaau

SEQ ID NO: 2472159 - RNA, 17 nt, Human
cagucucccuucuccca

SEQ ID NO: 2472160 - RNA, 22 nt, Human
cagucugaugagaacucugagc

SEQ ID NO: 2472161 - RNA, 15 nt, Human
cagucgauagagcug

SEQ ID NO: 2472162 - RNA, 16 nt, Human
cagucgauagagcugu

SEQ ID NO: 2472163 - RNA, 15 nt, Human
caguccuuccaccuc

SEQ ID NO: 2472164 - RNA, 14 nt, Human
cagugcaggcacag

SEQ ID NO: 2472165 - RNA, 15 nt, Human
cagugccaaaaacaa

SEQ ID NO: 2472166 - RNA, 21 nt, Human
cagugccagcaaugacaucuc

SEQ ID NO: 2472167 - RNA, 17 nt, Human
cagugccagcaaugaca

SEQ ID NO: 2472168 - RNA, 15 nt, Human
cagugccagcaauga

SEQ ID NO: 2472169 - RNA, 14 nt, Human
cagugccagcaaug

SEQ ID NO: 2472170 - RNA, 15 nt, Human
cagugccaagcacag

SEQ ID NO: 2472171 - RNA, 23 nt, Human
cagugccaagcacagugccugca

SEQ ID NO: 2472172 - RNA, 22 nt, Human
cagugccaauaaaauuuaggaa

SEQ ID NO: 2472173 - RNA, 19 nt, Human
cagugccaagcacagugcc

SEQ ID NO: 2472174 - RNA, 16 nt, Human
cagugggacagggcau

SEQ ID NO: 2472175 - RNA, 19 nt, Human
cagugggacagggcauggc

SEQ ID NO: 2472176 - RNA, 12 nt, Human
cagugcccacag

SEQ ID NO: 2472177 - RNA, 11 nt, Human
cagugggagcu

SEQ ID NO: 2472178 - RNA, 18 nt, Human
cagugggagccagggcug

SEQ ID NO: 2472179 - RNA, 17 nt, Human
cagugggagccagggcu

SEQ ID NO: 2472180 - RNA, 13 nt, Human
cagugggagccag

SEQ ID NO: 2472181 - RNA, 14 nt, Human
cagugggagaaaac

SEQ ID NO: 2472182 - RNA, 23 nt, Human
cagugcaugcugucccuuacgug

SEQ ID NO: 2472183 - RNA, 22 nt, Human
cagugcaugcugucccuuacgu

SEQ ID NO: 2472184 - RNA, 19 nt, Human
cagugcaugcugucccuua

SEQ ID NO: 2472185 - RNA, 16 nt, Human
cagugcagcccgugug

SEQ ID NO: 2472186 - RNA, 12 nt, Human
cagugcaggcac

SEQ ID NO: 2472187 - RNA, 22 nt, Human
cagugcagcccguguggccccu

SEQ ID NO: 2472188 - RNA, 20 nt, Human
cagucugauucccaagcucu

SEQ ID NO: 2472189 - RNA, 19 nt, Human
cagucugauucccaagcuc

SEQ ID NO: 2472190 - RNA, 22 nt, Human
cagugcaaugguauaaauuuca

SEQ ID NO: 2472191 - RNA, 24 nt, Human
cagugcaagagacucuggccucca

SEQ ID NO: 2472192 - RNA, 15 nt, Human
cagugcacccacucu

SEQ ID NO: 2472193 - RNA, 23 nt, Human
cagugcaagagacucuggccucc

SEQ ID NO: 2472194 - RNA, 22 nt, Human
cagugcaagagacucuggccuc

SEQ ID NO: 2472195 - RNA, 21 nt, Human
cagugcaagagacucuggccu

SEQ ID NO: 2472196 - RNA, 20 nt, Human
cagggaguguaguaaagccg

SEQ ID NO: 2472197 - RNA, 23 nt, Human
cagggaguccccuccccggcccu

SEQ ID NO: 2472198 - RNA, 22 nt, Human
cagggaguccccuccccggccc

SEQ ID NO: 2472199 - RNA, 13 nt, Human
cagggaguccccu

SEQ ID NO: 2472200 - RNA, 23 nt, Human
cagggagguuaagugacuugccc

SEQ ID NO: 2472201 - RNA, 14 nt, Human
cagggagggccugg

SEQ ID NO: 2472202 - RNA, 16 nt, Human
cagggagggccugggc

SEQ ID NO: 2472203 - RNA, 18 nt, Human
cagggaggugaccccagg

SEQ ID NO: 2472204 - RNA, 22 nt, Human
cagggaguccgaaagggacuug

SEQ ID NO: 2472205 - RNA, 17 nt, Human
cagggagguggcugggu

SEQ ID NO: 2472206 - RNA, 14 nt, Human
cagggagguggcug

SEQ ID NO: 2472207 - RNA, 16 nt, Human
cagggagguccgggag

SEQ ID NO: 2472208 - RNA, 12 nt, Human
caggccucccuc

SEQ ID NO: 2472209 - RNA, 20 nt, Human
caggcgauccaccugucuca

SEQ ID NO: 2472210 - RNA, 15 nt, Human
caggcgccccuuccc

SEQ ID NO: 2472211 - RNA, 20 nt, Human
caggccugccuguucccauu

SEQ ID NO: 2472212 - RNA, 18 nt, Human
caggccugccagacggca

SEQ ID NO: 2472213 - RNA, 18 nt, Human
caggccugagauuucauc

SEQ ID NO: 2472214 - RNA, 16 nt, Human
caggccugagauuuca

SEQ ID NO: 2472215 - RNA, 23 nt, Human
caggccugaaagaggcugaggcc

SEQ ID NO: 2472216 - RNA, 14 nt, Human
caggccugagauuu

SEQ ID NO: 2472217 - RNA, 21 nt, Human
caggccugagauuucaucugc

SEQ ID NO: 2472218 - RNA, 19 nt, Human
caggccugagauuucaucu

SEQ ID NO: 2472219 - RNA, 23 nt, Human
caggccugagauuucaucugcuc

SEQ ID NO: 2472220 - RNA, 12 nt, Human
caggccugccag

SEQ ID NO: 2472221 - RNA, 14 nt, Human
caggccugccagac

SEQ ID NO: 2472222 - RNA, 14 nt, Human
caggccucccuguu

SEQ ID NO: 2472223 - RNA, 13 nt, Human
caggccucccugu

SEQ ID NO: 2472224 - RNA, 22 nt, Human
caggccugaaagaggcugaggc

SEQ ID NO: 2472225 - RNA, 15 nt, Human
caggccugacucuca

SEQ ID NO: 2472226 - RNA, 22 nt, Human
caggccucccucucucuucugc

SEQ ID NO: 2472227 - RNA, 23 nt, Human
caggccucccucucucuucugcu

SEQ ID NO: 2472228 - RNA, 13 nt, Human
caggccucccucu

SEQ ID NO: 2472229 - RNA, 14 nt, Human
caggccucccucuc

SEQ ID NO: 2472230 - RNA, 15 nt, Human
caggccucccucucu

SEQ ID NO: 2472231 - RNA, 16 nt, Human
caggccucccucucuc

SEQ ID NO: 2472232 - RNA, 17 nt, Human
caggccucccucucucu

SEQ ID NO: 2472233 - RNA, 18 nt, Human
caggccucccucucucuu

SEQ ID NO: 2472234 - RNA, 19 nt, Human
caggccucccucucucuuc

SEQ ID NO: 2472235 - RNA, 17 nt, Human
cagggaggacgcucucu

SEQ ID NO: 2472236 - RNA, 18 nt, Human
cagggaggacgcucucug

SEQ ID NO: 2472237 - RNA, 19 nt, Human
caggcugggcuucaguggc

SEQ ID NO: 2472238 - RNA, 17 nt, Human
caggcugggcuucagug

SEQ ID NO: 2472239 - RNA, 12 nt, Human
cagggagggccu

SEQ ID NO: 2472240 - RNA, 13 nt, Human
cagggagggccug

SEQ ID NO: 2472241 - RNA, 21 nt, Human
caggcuggcgcagccaaggcc

SEQ ID NO: 2472242 - RNA, 22 nt, Human
cagggaggagguggcagcccug

SEQ ID NO: 2472243 - RNA, 20 nt, Human
caggcuggcgcagccaaggc

SEQ ID NO: 2472244 - RNA, 18 nt, Human
caggcuggcgcagccaag

SEQ ID NO: 2472245 - RNA, 15 nt, Human
cagggagcugggaca

SEQ ID NO: 2472246 - RNA, 17 nt, Human
cagggaggaagaagcuu

SEQ ID NO: 2472247 - RNA, 23 nt, Human
cagggaggagguggcagcccugu

SEQ ID NO: 2472248 - RNA, 15 nt, Human
caggcgggcucaagg

SEQ ID NO: 2472249 - RNA, 23 nt, Human
caggcgggagcgguggcccuguc

SEQ ID NO: 2472250 - RNA, 21 nt, Human
caggcgggagcgguggcccug

SEQ ID NO: 2472251 - RNA, 17 nt, Human
caggcgccggcgggcgg

SEQ ID NO: 2472252 - RNA, 17 nt, Human
caggcgccccuuccccc

SEQ ID NO: 2472253 - RNA, 18 nt, Human
caggcuggcccugcccug

SEQ ID NO: 2472254 - RNA, 19 nt, Human
caggcuggcccugcccugg

SEQ ID NO: 2472255 - RNA, 17 nt, Human
caggcuggcccugcccu

SEQ ID NO: 2472256 - RNA, 17 nt, Human
caggcggugggcaccca

SEQ ID NO: 2472257 - RNA, 15 nt, Human
caggcggugggcacc

SEQ ID NO: 2472258 - RNA, 15 nt, Human
caggcugggcuucag

SEQ ID NO: 2472259 - RNA, 17 nt, Human
caggcuggcgcagccaa

SEQ ID NO: 2472260 - RNA, 16 nt, Human
caggcuggcgcagcca

SEQ ID NO: 2472261 - RNA, 15 nt, Human
caggcuggcgcagcc

SEQ ID NO: 2472262 - RNA, 13 nt, Human
caggcuggcgcag

SEQ ID NO: 2472263 - RNA, 16 nt, Human
caggcugggcuucagu

SEQ ID NO: 2472264 - RNA, 15 nt, Human
caggcuggcgugcag

SEQ ID NO: 2472265 - RNA, 20 nt, Human
caggcuggcccugcccuggu

SEQ ID NO: 2472266 - RNA, 16 nt, Human
caggcgggcucaagga

SEQ ID NO: 2472267 - RNA, 21 nt, Human
caggcggugggcacccacccu

SEQ ID NO: 2472268 - RNA, 21 nt, Human
caggccagagggagugacaga

SEQ ID NO: 2472269 - RNA, 19 nt, Human
caggccagagggagugaca

SEQ ID NO: 2472270 - RNA, 13 nt, Human
caggcagcauuua

SEQ ID NO: 2472271 - RNA, 23 nt, Human
caggcagcagagacuugggacau

SEQ ID NO: 2472272 - RNA, 14 nt, Human
caggcagcagagac

SEQ ID NO: 2472273 - RNA, 12 nt, Human
caggcagcagag

SEQ ID NO: 2472274 - RNA, 11 nt, Human
caggcagcaga

SEQ ID NO: 2472275 - RNA, 15 nt, Human
caggcagcacagaga

SEQ ID NO: 2472276 - RNA, 23 nt, Human
caggccagagggagugacagagg

SEQ ID NO: 2472277 - RNA, 23 nt, Human
caggagggagggggaaggcaggg

SEQ ID NO: 2472278 - RNA, 16 nt, Human
caggagggcaagggcc

SEQ ID NO: 2472279 - RNA, 22 nt, Human
caggagggagcauagaaggcag

SEQ ID NO: 2472280 - RNA, 22 nt, Human
caggagggauuggccgcuuggc

SEQ ID NO: 2472281 - RNA, 18 nt, Human
caggagggcacuggagcu

SEQ ID NO: 2472282 - RNA, 16 nt, Human
caggagggcccuaccu

SEQ ID NO: 2472283 - RNA, 19 nt, Human
caggagggcaagggccaug

SEQ ID NO: 2472284 - RNA, 17 nt, Human
caggagggcaagggcca

SEQ ID NO: 2472285 - RNA, 12 nt, Human
caggagggcccu

SEQ ID NO: 2472286 - RNA, 20 nt, Human
caggagguggaggcugcagu

SEQ ID NO: 2472287 - RNA, 17 nt, Human
caggaggccagccuuga

SEQ ID NO: 2472288 - RNA, 15 nt, Human
caggagggaggggga

SEQ ID NO: 2472289 - RNA, 12 nt, Human
caggagggaggg

SEQ ID NO: 2472290 - RNA, 23 nt, Human
caggcacccaccaucaugucugg

SEQ ID NO: 2472291 - RNA, 22 nt, Human
caggcacccaccaucaugucug

SEQ ID NO: 2472292 - RNA, 18 nt, Human
caggcacccaccaucaug

SEQ ID NO: 2472293 - RNA, 15 nt, Human
caggagguggucugg

SEQ ID NO: 2472294 - RNA, 15 nt, Human
caggagguggagguu

SEQ ID NO: 2472295 - RNA, 19 nt, Human
caggagguggagguugcag

SEQ ID NO: 2472296 - RNA, 14 nt, Human
caggcagauccagg

SEQ ID NO: 2472297 - RNA, 17 nt, Human
caggcacccccuggaga

SEQ ID NO: 2472298 - RNA, 15 nt, Human
caggcagauccagga

SEQ ID NO: 2472299 - RNA, 17 nt, Human
caggcagauccaggacu

SEQ ID NO: 2472300 - RNA, 18 nt, Human
caggcagauccaggacua

SEQ ID NO: 2472301 - RNA, 16 nt, Human
caggcacccccuggag

SEQ ID NO: 2472302 - RNA, 15 nt, Human
caggcacccccugga

SEQ ID NO: 2472303 - RNA, 22 nt, Human
caggagguggcuauggccaccc

SEQ ID NO: 2472304 - RNA, 18 nt, Human
caggagguggcuauggcc

SEQ ID NO: 2472305 - RNA, 20 nt, Human
caggagguggagguugcagu

SEQ ID NO: 2472306 - RNA, 13 nt, Human
caggcagaucugu

SEQ ID NO: 2472307 - RNA, 15 nt, Human
caggcagaucugugc

SEQ ID NO: 2472308 - RNA, 16 nt, Human
caggcagaucugugcc

SEQ ID NO: 2472309 - RNA, 17 nt, Human
caggcagaucugugccc

SEQ ID NO: 2472310 - RNA, 18 nt, Human
caggcagaucugugcccc

SEQ ID NO: 2472311 - RNA, 19 nt, Human
caggcagaucugugcccca

SEQ ID NO: 2472312 - RNA, 21 nt, Human
caggcagaucugugccccaug

SEQ ID NO: 2472313 - RNA, 22 nt, Human
caggcagaucugugccccaugc

SEQ ID NO: 2472314 - RNA, 17 nt, Human
caggacccccuuccccu

SEQ ID NO: 2472315 - RNA, 16 nt, Human
caggacccccuucccc

SEQ ID NO: 2472316 - RNA, 15 nt, Human
caggacccccuuccc

SEQ ID NO: 2472317 - RNA, 14 nt, Human
caggacccccuucc

SEQ ID NO: 2472318 - RNA, 12 nt, Human
caggaccccuga

SEQ ID NO: 2472319 - RNA, 14 nt, Human
caggaccccugagu

SEQ ID NO: 2472320 - RNA, 13 nt, Human
caggacccugaag

SEQ ID NO: 2472321 - RNA, 13 nt, Human
caggaacagaagg

SEQ ID NO: 2472322 - RNA, 14 nt, Human
caggacccugaagg

SEQ ID NO: 2472323 - RNA, 15 nt, Human
caggacccugaaggg

SEQ ID NO: 2472324 - RNA, 12 nt, Human
caggagcucuuc

SEQ ID NO: 2472325 - RNA, 15 nt, Human
caggagcucuucagg

SEQ ID NO: 2472326 - RNA, 18 nt, Human
caggagcucuucaggccu

SEQ ID NO: 2472327 - RNA, 19 nt, Human
caggagcucuucaggccuc

SEQ ID NO: 2472328 - RNA, 20 nt, Human
caggagcucuucaggccucc

SEQ ID NO: 2472329 - RNA, 22 nt, Human
caggagcucuucaggccucccu

SEQ ID NO: 2472330 - RNA, 23 nt, Human
caggagcucuucaggccucccuc

SEQ ID NO: 2472331 - RNA, 22 nt, Human
caggagcugcccagaguugcug

SEQ ID NO: 2472332 - RNA, 13 nt, Human
caggagcugccca

SEQ ID NO: 2472333 - RNA, 14 nt, Human
caggagcugggauc

SEQ ID NO: 2472334 - RNA, 22 nt, Human
caggagcugggauccuaagggc

SEQ ID NO: 2472335 - RNA, 15 nt, Human
caggagcugggcaga

SEQ ID NO: 2472336 - RNA, 12 nt, Human
caggagcugggc

SEQ ID NO: 2472337 - RNA, 23 nt, Human
caggagcugggcagaaggccaag

SEQ ID NO: 2472338 - RNA, 16 nt, Human
caggaggccagccuug

SEQ ID NO: 2472339 - RNA, 15 nt, Human
caggaggccagccuu

SEQ ID NO: 2472340 - RNA, 14 nt, Human
caggaggccagccu

SEQ ID NO: 2472341 - RNA, 13 nt, Human
caggaggaagggg

SEQ ID NO: 2472342 - RNA, 17 nt, Human
caggagcuuuggaccua

SEQ ID NO: 2472343 - RNA, 22 nt, Human
auuguuguuugccauacuuugu

SEQ ID NO: 2472344 - RNA, 15 nt, Human
auuguuuaaaaucau

SEQ ID NO: 2472345 - RNA, 17 nt, Human
auuguuguuuguaugua

SEQ ID NO: 2472346 - RNA, 18 nt, Human
auuguuguuuguauguau

SEQ ID NO: 2472347 - RNA, 20 nt, Human
auuguuguuuguauguauaa

SEQ ID NO: 2472348 - RNA, 21 nt, Human
auuguuguuuguauguauaau

SEQ ID NO: 2472349 - RNA, 15 nt, Human
auugcuguguaucug

SEQ ID NO: 2472350 - RNA, 12 nt, Human
auugcuguguau

SEQ ID NO: 2472351 - RNA, 11 nt, Human
auugcugugcc

SEQ ID NO: 2472352 - RNA, 19 nt, Human
auugcugugaauuagcuca

SEQ ID NO: 2472353 - RNA, 21 nt, Human
auuguaacguugcugugggaa

SEQ ID NO: 2472354 - RNA, 20 nt, Human
auuguaacguugcuguggga

SEQ ID NO: 2472355 - RNA, 18 nt, Human
auuguaacguugcugugg

SEQ ID NO: 2472356 - RNA, 17 nt, Human
auuguaacguugcugug

SEQ ID NO: 2472357 - RNA, 16 nt, Human
auuguaacguugcugu

SEQ ID NO: 2472358 - RNA, 19 nt, Human
auuguaacagacauuguuu

SEQ ID NO: 2472359 - RNA, 15 nt, Human
auuguaacguugcug

SEQ ID NO: 2472360 - RNA, 18 nt, Human
auuguaacagacauuguu

SEQ ID NO: 2472361 - RNA, 17 nt, Human
auuguaacagacauugu

SEQ ID NO: 2472362 - RNA, 16 nt, Human
auuguaacagacauug

SEQ ID NO: 2472363 - RNA, 15 nt, Human
auuguaacagacauu

SEQ ID NO: 2472364 - RNA, 14 nt, Human
auuguaacagacau

SEQ ID NO: 2472365 - RNA, 23 nt, Human
auuguaaauugaaucaguauaaa

SEQ ID NO: 2472366 - RNA, 23 nt, Human
auugcuuugaagcaguuguguca

SEQ ID NO: 2472367 - RNA, 10 nt, Human
auugcuuuga

SEQ ID NO: 2472368 - RNA, 21 nt, Human
auugcuuugaagcaguugugu

SEQ ID NO: 2472369 - RNA, 13 nt, Human
auugcuuucugaa

SEQ ID NO: 2472370 - RNA, 15 nt, Human
auugcuuucugaaau

SEQ ID NO: 2472371 - RNA, 16 nt, Human
auugcuuucugaaauu

SEQ ID NO: 2472372 - RNA, 17 nt, Human
auugcuuucugaaauua

SEQ ID NO: 2472373 - RNA, 16 nt, Human
auugcuuuauaaauaa

SEQ ID NO: 2472374 - RNA, 15 nt, Human
auugcuuuauaaaua

SEQ ID NO: 2472375 - RNA, 13 nt, Human
auugcuuuauaaa

SEQ ID NO: 2472376 - RNA, 16 nt, Human
auugcuuuacugucaa

SEQ ID NO: 2472377 - RNA, 14 nt, Human
auugcuuuccacug

SEQ ID NO: 2472378 - RNA, 17 nt, Human
auugcuuuauaaauaaa

SEQ ID NO: 2472379 - RNA, 11 nt, Human
auugcuuucug

SEQ ID NO: 2472380 - RNA, 20 nt, Human
auugcuuacauuuuuacaau

SEQ ID NO: 2472381 - RNA, 19 nt, Human
auugcuuacauuuuuacaa

SEQ ID NO: 2472382 - RNA, 16 nt, Human
auugcuuacauuuuua

SEQ ID NO: 2472383 - RNA, 14 nt, Human
auugcuuacauuuu

SEQ ID NO: 2472384 - RNA, 13 nt, Human
auugcuuacauuu

SEQ ID NO: 2472385 - RNA, 21 nt, Human
auugcuguugucccucugcua

SEQ ID NO: 2472386 - RNA, 21 nt, Human
auugcuuacaagccuaagaau

SEQ ID NO: 2472387 - RNA, 17 nt, Human
auugcuguugucccucu

SEQ ID NO: 2472388 - RNA, 16 nt, Human
auugcuuaaaauagca

SEQ ID NO: 2472389 - RNA, 17 nt, Human
auugcuuaaaauagcaa

SEQ ID NO: 2472390 - RNA, 22 nt, Human
auugcuuacauuuuuacaauaa

SEQ ID NO: 2472391 - RNA, 21 nt, Human
auugcuuacauuuuuacaaua

SEQ ID NO: 2472392 - RNA, 15 nt, Human
auugcuugauacuuu

SEQ ID NO: 2472393 - RNA, 16 nt, Human
auugcuuguuggauuu

SEQ ID NO: 2472394 - RNA, 14 nt, Human
auugcuugcacaaa

SEQ ID NO: 2472395 - RNA, 19 nt, Human
auuguuguuugccauacuu

SEQ ID NO: 2472396 - RNA, 20 nt, Human
auuguuguuucuuucuagug

SEQ ID NO: 2472397 - RNA, 19 nt, Human
auuguuguuucuuucuagu

SEQ ID NO: 2472398 - RNA, 16 nt, Human
auuguuguuucuuucu

SEQ ID NO: 2472399 - RNA, 14 nt, Human
auuguuguuucuuu

SEQ ID NO: 2472400 - RNA, 12 nt, Human
auuguuguuucu

SEQ ID NO: 2472401 - RNA, 17 nt, Human
auuguuaauuuuuccua

SEQ ID NO: 2472402 - RNA, 22 nt, Human
auuguuaagucuaaauauuucc

SEQ ID NO: 2472403 - RNA, 21 nt, Human
auuguuaagucuaaauauuuc

SEQ ID NO: 2472404 - RNA, 17 nt, Human
auuguuaacucuugucu

SEQ ID NO: 2472405 - RNA, 23 nt, Human
auuguuaagucuaaauauuuccu

SEQ ID NO: 2472406 - RNA, 17 nt, Human
auuguguugugaauguu

SEQ ID NO: 2472407 - RNA, 15 nt, Human
auuguguucccauuu

SEQ ID NO: 2472408 - RNA, 13 nt, Human
auuguguuuguca

SEQ ID NO: 2472409 - RNA, 19 nt, Human
auuguguuugucauuagcc

SEQ ID NO: 2472410 - RNA, 18 nt, Human
auuguguuugucauuagc

SEQ ID NO: 2472411 - RNA, 16 nt, Human
auuguguuugucauua

SEQ ID NO: 2472412 - RNA, 15 nt, Human
auuguguuugucauu

SEQ ID NO: 2472413 - RNA, 22 nt, Human
auuguguuugucauuagccuga

SEQ ID NO: 2472414 - RNA, 13 nt, Human
auuguguuugugu

SEQ ID NO: 2472415 - RNA, 13 nt, Human
auuguuaaaauaa

SEQ ID NO: 2472416 - RNA, 15 nt, Human
auuguuaaaauaacu

SEQ ID NO: 2472417 - RNA, 12 nt, Human
auuguaagaaau

SEQ ID NO: 2472418 - RNA, 14 nt, Human
auuguaagaaauac

SEQ ID NO: 2472419 - RNA, 20 nt, Human
auuguaagaaauacuguaca

SEQ ID NO: 2472420 - RNA, 21 nt, Human
auuguaagaaauacuguacaa

SEQ ID NO: 2472421 - RNA, 13 nt, Human
auuguaacuguuc

SEQ ID NO: 2472422 - RNA, 15 nt, Human
auuguaacuguucuu

SEQ ID NO: 2472423 - RNA, 19 nt, Human
auuguaacuguucuugaau

SEQ ID NO: 2472424 - RNA, 15 nt, Human
auuguaacuuggaug

SEQ ID NO: 2472425 - RNA, 23 nt, Human
auuguaacuuggauguagccaug

SEQ ID NO: 2472426 - RNA, 20 nt, Human
auuguguucccauuucagcu

SEQ ID NO: 2472427 - RNA, 14 nt, Human
auuguguugugaau

SEQ ID NO: 2472428 - RNA, 16 nt, Human
auuguguguuauuuaa

SEQ ID NO: 2472429 - RNA, 18 nt, Human
auuguguguuauuuaaau

SEQ ID NO: 2472430 - RNA, 19 nt, Human
auuuaugcauggaaaccug

SEQ ID NO: 2472431 - RNA, 20 nt, Human
auuuaugccucuguauuuaa

SEQ ID NO: 2472432 - RNA, 12 nt, Human
auuucacuuaau

SEQ ID NO: 2472433 - RNA, 15 nt, Human
auuucacuuuagaug

SEQ ID NO: 2472434 - RNA, 17 nt, Human
auuucacuuaauaaugu

SEQ ID NO: 2472435 - RNA, 19 nt, Human
auuucacuuuagaugcuga

SEQ ID NO: 2472436 - RNA, 18 nt, Human
auuucacuuuagaugcug

SEQ ID NO: 2472437 - RNA, 16 nt, Human
auuuaugcauauuauu

SEQ ID NO: 2472438 - RNA, 15 nt, Human
auuuaugaguuuuug

SEQ ID NO: 2472439 - RNA, 18 nt, Human
auuuaugaguuuuugaua

SEQ ID NO: 2472440 - RNA, 15 nt, Human
auuuaugauuuaaua

SEQ ID NO: 2472441 - RNA, 13 nt, Human
auuuaugauuuaa

SEQ ID NO: 2472442 - RNA, 19 nt, Human
auuuaugaguuuuugauag

SEQ ID NO: 2472443 - RNA, 22 nt, Human
auuuaugcauauuauuuuaugu

SEQ ID NO: 2472444 - RNA, 19 nt, Human
auuuaugauuuaauaaaau

SEQ ID NO: 2472445 - RNA, 17 nt, Human
auuuaugauuuaauaaa

SEQ ID NO: 2472446 - RNA, 16 nt, Human
auuuaugauuuaauaa

SEQ ID NO: 2472447 - RNA, 12 nt, Human
auuuauggagga

SEQ ID NO: 2472448 - RNA, 23 nt, Human
auuuaugaauugaauuaucuugg

SEQ ID NO: 2472449 - RNA, 17 nt, Human
auuuaugagcucuucau

SEQ ID NO: 2472450 - RNA, 22 nt, Human
auuuaucuuuacuuuuaaacag

SEQ ID NO: 2472451 - RNA, 13 nt, Human
auuuaugaaaaga

SEQ ID NO: 2472452 - RNA, 22 nt, Human
auuuaucucuauuuaauauuua

SEQ ID NO: 2472453 - RNA, 20 nt, Human
auuuaucuguguuuuugaaa

SEQ ID NO: 2472454 - RNA, 19 nt, Human
auuuaucuugucucugggc

SEQ ID NO: 2472455 - RNA, 20 nt, Human
auuuaucugggauuaugguu

SEQ ID NO: 2472456 - RNA, 19 nt, Human
auuuaucucuauuuaauau

SEQ ID NO: 2472457 - RNA, 16 nt, Human
auuuaucucuauuuaa

SEQ ID NO: 2472458 - RNA, 16 nt, Human
auuuaucugugcaaau

SEQ ID NO: 2472459 - RNA, 16 nt, Human
auuuauauguacauga

SEQ ID NO: 2472460 - RNA, 17 nt, Human
auuuauauguacaugag

SEQ ID NO: 2472461 - RNA, 15 nt, Human
auuuauauguacaug

SEQ ID NO: 2472462 - RNA, 15 nt, Human
auuuauaaucacuuu

SEQ ID NO: 2472463 - RNA, 20 nt, Human
auuuauauauuuauaacuca

SEQ ID NO: 2472464 - RNA, 15 nt, Human
auuuauaucacaugu

SEQ ID NO: 2472465 - RNA, 17 nt, Human
auuuauaagcagauuua

SEQ ID NO: 2472466 - RNA, 16 nt, Human
auuuauaagguuuuaa

SEQ ID NO: 2472467 - RNA, 13 nt, Human
auuuauaaucacu

SEQ ID NO: 2472468 - RNA, 22 nt, Human
auuuauaaucacuuuuuuccac

SEQ ID NO: 2472469 - RNA, 19 nt, Human
auuuauauauuuauaacuc

SEQ ID NO: 2472470 - RNA, 14 nt, Human
auuuauaagcagau

SEQ ID NO: 2472471 - RNA, 22 nt, Human
auuuauaagcagauuuaacaau

SEQ ID NO: 2472472 - RNA, 22 nt, Human
auuuauaacucaucauaaaaua

SEQ ID NO: 2472473 - RNA, 23 nt, Human
auuuauaacucaucauaaaauaa

SEQ ID NO: 2472474 - RNA, 23 nt, Human
auuuaauaacauuaccuuacugu

SEQ ID NO: 2472475 - RNA, 14 nt, Human
auuuauaacucauc

SEQ ID NO: 2472476 - RNA, 15 nt, Human
auuuauaacucauca

SEQ ID NO: 2472477 - RNA, 16 nt, Human
auuuauaacucaucau

SEQ ID NO: 2472478 - RNA, 17 nt, Human
auuuauaacucaucaua

SEQ ID NO: 2472479 - RNA, 18 nt, Human
auuuauaacucaucauaa

SEQ ID NO: 2472480 - RNA, 19 nt, Human
auuuauaacucaucauaaa

SEQ ID NO: 2472481 - RNA, 20 nt, Human
auuuauaacucaucauaaaa

SEQ ID NO: 2472482 - RNA, 21 nt, Human
auuuauaacucaucauaaaau

SEQ ID NO: 2472483 - RNA, 16 nt, Human
auuuaaugaaagacug

SEQ ID NO: 2472484 - RNA, 15 nt, Human
auuuaaugaaagacu

SEQ ID NO: 2472485 - RNA, 20 nt, Human
auuuaaugaaagacuguaca

SEQ ID NO: 2472486 - RNA, 21 nt, Human
auuuaaugaaagacuguacaa

SEQ ID NO: 2472487 - RNA, 19 nt, Human
auuuaauaacauuaccuua

SEQ ID NO: 2472488 - RNA, 18 nt, Human
auuuaauaacauuaccuu

SEQ ID NO: 2472489 - RNA, 17 nt, Human
auuuaauaacauuaccu

SEQ ID NO: 2472490 - RNA, 15 nt, Human
auuuaauaacauuac

SEQ ID NO: 2472491 - RNA, 15 nt, Human
auuuaauaauauacu

SEQ ID NO: 2472492 - RNA, 13 nt, Human
auuuaauaauaua

SEQ ID NO: 2472493 - RNA, 18 nt, Human
auuuaauaauauacuugu

SEQ ID NO: 2472494 - RNA, 16 nt, Human
auuuaauaauauacuu

SEQ ID NO: 2472495 - RNA, 19 nt, Human
auuuaauaauauacuugug

SEQ ID NO: 2472496 - RNA, 15 nt, Human
auuuaauaaucugua

SEQ ID NO: 2472497 - RNA, 16 nt, Human
auuuaauaaaugugcc

SEQ ID NO: 2472498 - RNA, 16 nt, Human
auuuaauaacaauugu

SEQ ID NO: 2472499 - RNA, 14 nt, Human
auuuaauaacauua

SEQ ID NO: 2472500 - RNA, 12 nt, Human
auuuaauaacau

SEQ ID NO: 2472501 - RNA, 13 nt, Human
auuuaauaacauu

SEQ ID NO: 2472502 - RNA, 13 nt, Human
auuucugugggag

SEQ ID NO: 2472503 - RNA, 16 nt, Human
auuucugugggagaau

SEQ ID NO: 2472504 - RNA, 23 nt, Human
auuucuauucaagguggccaaau

SEQ ID NO: 2472505 - RNA, 17 nt, Human
auuucuaugagaaaaga

SEQ ID NO: 2472506 - RNA, 12 nt, Human
auuucuauuuau

SEQ ID NO: 2472507 - RNA, 14 nt, Human
auuucuaugagaaa

SEQ ID NO: 2472508 - RNA, 16 nt, Human
auuucuauuuauuuac

SEQ ID NO: 2472509 - RNA, 13 nt, Human
auuucuauuuauu

SEQ ID NO: 2472510 - RNA, 15 nt, Human
auuucuauuucuccu

SEQ ID NO: 2472511 - RNA, 17 nt, Human
auuucuauuuauuuacu

SEQ ID NO: 2472512 - RNA, 22 nt, Human
auuucugcugaauuuucacaug

SEQ ID NO: 2472513 - RNA, 16 nt, Human
auuucugcugaauuuu

SEQ ID NO: 2472514 - RNA, 14 nt, Human
auuucugcugaauu

SEQ ID NO: 2472515 - RNA, 17 nt, Human
auuucugccuuccuugc

SEQ ID NO: 2472516 - RNA, 16 nt, Human
auuucugccuuccuug

SEQ ID NO: 2472517 - RNA, 20 nt, Human
auuucugcugaauuuucaca

SEQ ID NO: 2472518 - RNA, 18 nt, Human
auuucuauuucuccucca

SEQ ID NO: 2472519 - RNA, 20 nt, Human
auuucuauuucuccuccaug

SEQ ID NO: 2472520 - RNA, 18 nt, Human
auuucugcauauguugaa

SEQ ID NO: 2472521 - RNA, 22 nt, Human
auuucugcauauguugaauacu

SEQ ID NO: 2472522 - RNA, 23 nt, Human
auuucugcauauguugaauacuu

SEQ ID NO: 2472523 - RNA, 15 nt, Human
auuucugccuuccuu

SEQ ID NO: 2472524 - RNA, 14 nt, Human
auuucuaugaaaua

SEQ ID NO: 2472525 - RNA, 16 nt, Human
auuucauaugcuguau

SEQ ID NO: 2472526 - RNA, 18 nt, Human
auuucauaaacaacuuaa

SEQ ID NO: 2472527 - RNA, 20 nt, Human
auuucauaccuaucaucuua

SEQ ID NO: 2472528 - RNA, 12 nt, Human
auuucagacucc

SEQ ID NO: 2472529 - RNA, 13 nt, Human
auuccuccugcuc

SEQ ID NO: 2472530 - RNA, 14 nt, Human
auuccuccugcuca

SEQ ID NO: 2472531 - RNA, 15 nt, Human
auuccuccugcucau

SEQ ID NO: 2472532 - RNA, 16 nt, Human
auuccuccugcucaua

SEQ ID NO: 2472533 - RNA, 15 nt, Human
auuccuccaccugcc

SEQ ID NO: 2472534 - RNA, 20 nt, Human
auuccuccugcucauauugu

SEQ ID NO: 2472535 - RNA, 12 nt, Human
auuccuccuggg

SEQ ID NO: 2472536 - RNA, 15 nt, Human
auuccugcauuugug

SEQ ID NO: 2472537 - RNA, 17 nt, Human
auuccugcagccuggag

SEQ ID NO: 2472538 - RNA, 22 nt, Human
auuccuccugggccccucaucu

SEQ ID NO: 2472539 - RNA, 19 nt, Human
auuccugcagccuggaggc

SEQ ID NO: 2472540 - RNA, 18 nt, Human
auuccugcauuugugaaa

SEQ ID NO: 2472541 - RNA, 20 nt, Human
auuccuauugugauuugacu

SEQ ID NO: 2472542 - RNA, 19 nt, Human
auuccuauugugauuugac

SEQ ID NO: 2472543 - RNA, 18 nt, Human
auuccuauugugauuuga

SEQ ID NO: 2472544 - RNA, 17 nt, Human
auuccuauugugauuug

SEQ ID NO: 2472545 - RNA, 23 nt, Human
auuccuauugugauuugacuguu

SEQ ID NO: 2472546 - RNA, 21 nt, Human
auuccuauugugauuugacug

SEQ ID NO: 2472547 - RNA, 17 nt, Human
auuccucaacguauugu

SEQ ID NO: 2472548 - RNA, 14 nt, Human
auuccucagggaca

SEQ ID NO: 2472549 - RNA, 17 nt, Human
auuccugggaaauauuc

SEQ ID NO: 2472550 - RNA, 22 nt, Human
auuccugggaaauauucccuag

SEQ ID NO: 2472551 - RNA, 15 nt, Human
auuccugccugucuc

SEQ ID NO: 2472552 - RNA, 18 nt, Human
auuccuggaaaccacagu

SEQ ID NO: 2472553 - RNA, 17 nt, Human
auuccugccugucuccu

SEQ ID NO: 2472554 - RNA, 20 nt, Human
auuccugguacccagccauc

SEQ ID NO: 2472555 - RNA, 18 nt, Human
auuccugguacccagcca

SEQ ID NO: 2472556 - RNA, 15 nt, Human
auuccugguacccag

SEQ ID NO: 2472557 - RNA, 15 nt, Human
auuccugggcacagu

SEQ ID NO: 2472558 - RNA, 10 nt, Human
auuccugggc

SEQ ID NO: 2472559 - RNA, 13 nt, Human
auuccugggcaca

SEQ ID NO: 2472560 - RNA, 18 nt, Human
auuccuguauguugucca

SEQ ID NO: 2472561 - RNA, 17 nt, Human
auuccuguauguugucc

SEQ ID NO: 2472562 - RNA, 16 nt, Human
auuccuguauguuguc

SEQ ID NO: 2472563 - RNA, 13 nt, Human
auuccuguauguu

SEQ ID NO: 2472564 - RNA, 23 nt, Human
auuccuguagcaucuucuggagu

SEQ ID NO: 2472565 - RNA, 18 nt, Human
auuccuguagcaucuucu

SEQ ID NO: 2472566 - RNA, 17 nt, Human
auuccuguagcaucuuc

SEQ ID NO: 2472567 - RNA, 16 nt, Human
auuccuguagcaucuu

SEQ ID NO: 2472568 - RNA, 16 nt, Human
auuccuuaaauaaacu

SEQ ID NO: 2472569 - RNA, 22 nt, Human
auuccuguggauguaaagugau

SEQ ID NO: 2472570 - RNA, 20 nt, Human
auuccuuagcuuagaccuca

SEQ ID NO: 2472571 - RNA, 21 nt, Human
auuccuuagcuuagaccucag

SEQ ID NO: 2472572 - RNA, 12 nt, Human
auuccuuccugu

SEQ ID NO: 2472573 - RNA, 14 nt, Human
auuccuuccuguuc

SEQ ID NO: 2472574 - RNA, 16 nt, Human
auuccuuccuguucug

SEQ ID NO: 2472575 - RNA, 21 nt, Human
auuccuucuuugauaauguua

SEQ ID NO: 2472576 - RNA, 20 nt, Human
auuccuucuuugauaauguu

SEQ ID NO: 2472577 - RNA, 17 nt, Human
auuccuucuuugauaau

SEQ ID NO: 2472578 - RNA, 16 nt, Human
auuccuucuuugauaa

SEQ ID NO: 2472579 - RNA, 15 nt, Human
auuccuucuuugaua

SEQ ID NO: 2472580 - RNA, 14 nt, Human
auuccuucuuugau

SEQ ID NO: 2472581 - RNA, 17 nt, Human
auuccuuccuguucuga

SEQ ID NO: 2472582 - RNA, 18 nt, Human
auuccuuccuguucugaa

SEQ ID NO: 2472583 - RNA, 22 nt, Human
auuccuucagggugaugccagg

SEQ ID NO: 2472584 - RNA, 15 nt, Human
auuccuucaggguga

SEQ ID NO: 2472585 - RNA, 14 nt, Human
auuccuucagggug

SEQ ID NO: 2472586 - RNA, 24 nt, Human
auuccuuagcuuagaccucagccu

SEQ ID NO: 2472587 - RNA, 22 nt, Human
auuccuuagcuuagaccucagc

SEQ ID NO: 2472588 - RNA, 23 nt, Human
auuccuuagcuuagaccucagcc

SEQ ID NO: 2472589 - RNA, 22 nt, Human
auucuucuguacgucugacagg

SEQ ID NO: 2472590 - RNA, 20 nt, Human
auucuucugcuucagccucc

SEQ ID NO: 2472591 - RNA, 18 nt, Human
auucucugucucauccau

SEQ ID NO: 2472592 - RNA, 19 nt, Human
auucucugucucauccauc

SEQ ID NO: 2472593 - RNA, 19 nt, Human
auucuucugcuucagccuc

SEQ ID NO: 2472594 - RNA, 13 nt, Human
auucucugucuca

SEQ ID NO: 2472595 - RNA, 14 nt, Human
auucucugucucau

SEQ ID NO: 2472596 - RNA, 16 nt, Human
auucucugucucaucc

SEQ ID NO: 2472597 - RNA, 17 nt, Human
auucucugucucaucca

SEQ ID NO: 2472598 - RNA, 12 nt, Human
auucucugucuc

SEQ ID NO: 2472599 - RNA, 13 nt, Human
auucucugagcug

SEQ ID NO: 2472600 - RNA, 17 nt, Human
auucucugagcugugca

SEQ ID NO: 2472601 - RNA, 18 nt, Human
auucucugagcugugcag

SEQ ID NO: 2472602 - RNA, 21 nt, Human
auuccuuggcaugccuuccag

SEQ ID NO: 2472603 - RNA, 21 nt, Human
auucuccuuguguuacuaagu

SEQ ID NO: 2472604 - RNA, 22 nt, Human
auucuccuuguguuacuaaguu

SEQ ID NO: 2472605 - RNA, 17 nt, Human
auucucuaguuugauua

SEQ ID NO: 2472606 - RNA, 18 nt, Human
auucucuaguuugauuaa

SEQ ID NO: 2472607 - RNA, 18 nt, Human
auucuccuuguguuacua

SEQ ID NO: 2472608 - RNA, 19 nt, Human
auucuccuuguguuacuaa

SEQ ID NO: 2472609 - RNA, 23 nt, Human
auuccuucuuugauaauguuaaa

SEQ ID NO: 2472610 - RNA, 22 nt, Human
auuccuucuuugauaauguuaa

SEQ ID NO: 2472611 - RNA, 20 nt, Human
auuccuuggcaugccuucca

SEQ ID NO: 2472612 - RNA, 12 nt, Human
auuccuugugaa

SEQ ID NO: 2472613 - RNA, 17 nt, Human
auucuccuuguguuacu

SEQ ID NO: 2472614 - RNA, 15 nt, Human
auucuugcaaaguau

SEQ ID NO: 2472615 - RNA, 16 nt, Human
auucuugcaaaguauc

SEQ ID NO: 2472616 - RNA, 14 nt, Human
auucuugcaaagua

SEQ ID NO: 2472617 - RNA, 20 nt, Human
auuaugaauuacauuuguau

SEQ ID NO: 2472618 - RNA, 19 nt, Human
auuaugaauuacauuugua

SEQ ID NO: 2472619 - RNA, 22 nt, Human
auuaugaauuacauuuguauaa

SEQ ID NO: 2472620 - RNA, 22 nt, Human
auuaguaccauaguaccauuua

SEQ ID NO: 2472621 - RNA, 19 nt, Human
auuaguacugcucuuguuu

SEQ ID NO: 2472622 - RNA, 16 nt, Human
auuaguaacauguguu

SEQ ID NO: 2472623 - RNA, 17 nt, Human
auuaguaacauguguua

SEQ ID NO: 2472624 - RNA, 20 nt, Human
auuaguacuccccuccuuga

SEQ ID NO: 2472625 - RNA, 16 nt, Human
auuagggagaaaauuc

SEQ ID NO: 2472626 - RNA, 15 nt, Human
auuagguuuuguaca

SEQ ID NO: 2472627 - RNA, 16 nt, Human
auuaguaaaugcuuau

SEQ ID NO: 2472628 - RNA, 13 nt, Human
auuaguaacaugu

SEQ ID NO: 2472629 - RNA, 21 nt, Human
auuagguuuuguacaauugaa

SEQ ID NO: 2472630 - RNA, 14 nt, Human
auuaguaaagaaau

SEQ ID NO: 2472631 - RNA, 19 nt, Human
auuaaaugcccagccccuu

SEQ ID NO: 2472632 - RNA, 17 nt, Human
auuaaaugcccagcccc

SEQ ID NO: 2472633 - RNA, 19 nt, Human
auuaggauuugccccuucc

SEQ ID NO: 2472634 - RNA, 18 nt, Human
auuaaauuaggaauaaau

SEQ ID NO: 2472635 - RNA, 16 nt, Human
auuaggauuucaugau

SEQ ID NO: 2472636 - RNA, 14 nt, Human
auuaggauuucaug

SEQ ID NO: 2472637 - RNA, 23 nt, Human
auuaggacaaucaguccccuccc

SEQ ID NO: 2472638 - RNA, 13 nt, Human
auuaaauuaggaa

SEQ ID NO: 2472639 - RNA, 22 nt, Human
auuauguaaaauguuuuagcaa

SEQ ID NO: 2472640 - RNA, 18 nt, Human
auuaugggaaucaagauu

SEQ ID NO: 2472641 - RNA, 17 nt, Human
auuaugggaaucaagau

SEQ ID NO: 2472642 - RNA, 22 nt, Human
auuaugcccaguuucugccucu

SEQ ID NO: 2472643 - RNA, 20 nt, Human
auuaugcccaguuucugccu

SEQ ID NO: 2472644 - RNA, 19 nt, Human
auuaugccuuuuuugauca

SEQ ID NO: 2472645 - RNA, 12 nt, Human
auuaugcuucuu

SEQ ID NO: 2472646 - RNA, 15 nt, Human
auuaugcuucuugga

SEQ ID NO: 2472647 - RNA, 16 nt, Human
auuauggaagauuuua

SEQ ID NO: 2472648 - RNA, 17 nt, Human
auuauggaagauuuuaa

SEQ ID NO: 2472649 - RNA, 20 nt, Human
auuauggaagauuuuaaauu

SEQ ID NO: 2472650 - RNA, 18 nt, Human
auucaacagguuuuccug

SEQ ID NO: 2472651 - RNA, 22 nt, Human
auucaacacucccuucccauga

SEQ ID NO: 2472652 - RNA, 16 nt, Human
auucaaccacuguaaa

SEQ ID NO: 2472653 - RNA, 20 nt, Human
auucaauaaaguauuuaauu

SEQ ID NO: 2472654 - RNA, 18 nt, Human
auucaauaaaguauuuaa

SEQ ID NO: 2472655 - RNA, 22 nt, Human
auucaaccacuguaaaaugaaa

SEQ ID NO: 2472656 - RNA, 19 nt, Human
auucaaccacuguaaaaug

SEQ ID NO: 2472657 - RNA, 22 nt, Human
auucaauaaaguauuuaauuag

SEQ ID NO: 2472658 - RNA, 21 nt, Human
auucaauaaaguauuuaauua

SEQ ID NO: 2472659 - RNA, 13 nt, Human
auucaauaaauug

SEQ ID NO: 2472660 - RNA, 13 nt, Human
auucaauaagcau

SEQ ID NO: 2472661 - RNA, 16 nt, Human
auucaauauccuuugc

SEQ ID NO: 2472662 - RNA, 22 nt, Human
auucaaucgacuggguuuaugu

SEQ ID NO: 2472663 - RNA, 17 nt, Human
auucaaucuguaaacug

SEQ ID NO: 2472664 - RNA, 18 nt, Human
auucaaucuguaaacugu

SEQ ID NO: 2472665 - RNA, 15 nt, Human
auucaaucuguaaac

SEQ ID NO: 2472666 - RNA, 16 nt, Human
auucaaucuguaaacu

SEQ ID NO: 2472667 - RNA, 14 nt, Human
auucaaucuguaaa

SEQ ID NO: 2472668 - RNA, 19 nt, Human
auucaauauccuuugccuc

SEQ ID NO: 2472669 - RNA, 22 nt, Human
caaagucaugcaaaggcuggga

SEQ ID NO: 2472670 - RNA, 14 nt, Human
caaaguccuuuuuu

SEQ ID NO: 2472671 - RNA, 17 nt, Human
caaaguccuuuuuuucc

SEQ ID NO: 2472672 - RNA, 17 nt, Human
caaagucuaaaguuuac

SEQ ID NO: 2472673 - RNA, 16 nt, Human
caaagucuaaaguuua

SEQ ID NO: 2472674 - RNA, 15 nt, Human
caaagucuaaaguuu

SEQ ID NO: 2472675 - RNA, 13 nt, Human
caaagucuaaagu

SEQ ID NO: 2472676 - RNA, 19 nt, Human
caaaguccuuuuuuuccau

SEQ ID NO: 2472677 - RNA, 23 nt, Human
caaaguccuuuuuuuccaucuuu

SEQ ID NO: 2472678 - RNA, 21 nt, Human
caaaucuuaacuugaaggagu

SEQ ID NO: 2472679 - RNA, 20 nt, Human
caaagucuaaaguuuacagu

SEQ ID NO: 2472680 - RNA, 13 nt, Human
caaaucuggaagc

SEQ ID NO: 2472681 - RNA, 19 nt, Human
caaagucuaaaguuuacag

SEQ ID NO: 2472682 - RNA, 12 nt, Human
caaaucuugaaa

SEQ ID NO: 2472683 - RNA, 19 nt, Human
caaaucuugaaauuaagaa

SEQ ID NO: 2472684 - RNA, 13 nt, Human
caaaucuugaaau

SEQ ID NO: 2472685 - RNA, 22 nt, Human
caaaugaauguugucuguuugu

SEQ ID NO: 2472686 - RNA, 19 nt, Human
caaaucuuuuagucauuau

SEQ ID NO: 2472687 - RNA, 17 nt, Human
caaaugacccaaagacc

SEQ ID NO: 2472688 - RNA, 19 nt, Human
caaaugaaugaccuuguug

SEQ ID NO: 2472689 - RNA, 18 nt, Human
caaaugacccaaagacca

SEQ ID NO: 2472690 - RNA, 22 nt, Human
caaaugaccagcagauucaaau

SEQ ID NO: 2472691 - RNA, 12 nt, Human
caaaugagccau

SEQ ID NO: 2472692 - RNA, 20 nt, Human
caaaugagaucuaagccuuu

SEQ ID NO: 2472693 - RNA, 18 nt, Human
caaaugcccaagggaaag

SEQ ID NO: 2472694 - RNA, 18 nt, Human
caaaugcauggugcaguu

SEQ ID NO: 2472695 - RNA, 19 nt, Human
caaaugcccaagggaaaga

SEQ ID NO: 2472696 - RNA, 23 nt, Human
caaaugcuguaacuuucugaaau

SEQ ID NO: 2472697 - RNA, 21 nt, Human
caaaugcugacccaugcaaua

SEQ ID NO: 2472698 - RNA, 18 nt, Human
caaaugcugcgcccuucc

SEQ ID NO: 2472699 - RNA, 19 nt, Human
caaaugcugcgcccuuccc

SEQ ID NO: 2472700 - RNA, 20 nt, Human
caaaugcugcgcccuucccc

SEQ ID NO: 2472701 - RNA, 21 nt, Human
caaaugcugcgcccuucccca

SEQ ID NO: 2472702 - RNA, 14 nt, Human
caacaaagaacacu

SEQ ID NO: 2472703 - RNA, 16 nt, Human
caacaaagcuguugau

SEQ ID NO: 2472704 - RNA, 17 nt, Human
caacaaagcacaguguu

SEQ ID NO: 2472705 - RNA, 19 nt, Human
caacaaagccaacagucaa

SEQ ID NO: 2472706 - RNA, 19 nt, Human
caacaaaggguuuuaaugu

SEQ ID NO: 2472707 - RNA, 12 nt, Human
caacaaagcugu

SEQ ID NO: 2472708 - RNA, 20 nt, Human
caacaaaggguuuuaaugua

SEQ ID NO: 2472709 - RNA, 21 nt, Human
caacaaauuagguuuuguaca

SEQ ID NO: 2472710 - RNA, 19 nt, Human
caacaaauuagguuuugua

SEQ ID NO: 2472711 - RNA, 19 nt, Human
caaaguaucccuacuguaa

SEQ ID NO: 2472712 - RNA, 21 nt, Human
caaaguaucccuacuguaauu

SEQ ID NO: 2472713 - RNA, 21 nt, Human
caaagucaugcaaaggcuggg

SEQ ID NO: 2472714 - RNA, 20 nt, Human
caaagucaugcaaaggcugg

SEQ ID NO: 2472715 - RNA, 14 nt, Human
caaagguaaaucag

SEQ ID NO: 2472716 - RNA, 22 nt, Human
caaagguaaaucagacuaugaa

SEQ ID NO: 2472717 - RNA, 16 nt, Human
caaaggguuuuaaugu

SEQ ID NO: 2472718 - RNA, 23 nt, Human
caaagggugaagcuauuuaucug

SEQ ID NO: 2472719 - RNA, 22 nt, Human
caaaguagaagucuuagaugua

SEQ ID NO: 2472720 - RNA, 19 nt, Human
caaaggguuuuaauguaga

SEQ ID NO: 2472721 - RNA, 18 nt, Human
caaaggguuuuaauguag

SEQ ID NO: 2472722 - RNA, 19 nt, Human
caaaguaucaggacgagaa

SEQ ID NO: 2472723 - RNA, 21 nt, Human
caaagcagugcaugcuguccc

SEQ ID NO: 2472724 - RNA, 18 nt, Human
caaagcagugcaugcugu

SEQ ID NO: 2472725 - RNA, 14 nt, Human
caaagauauuuugc

SEQ ID NO: 2472726 - RNA, 16 nt, Human
caaagauauuuugcuu

SEQ ID NO: 2472727 - RNA, 22 nt, Human
caaagcagugcaugcugucccu

SEQ ID NO: 2472728 - RNA, 23 nt, Human
caaagauauauacacaggauccu

SEQ ID NO: 2472729 - RNA, 20 nt, Human
caaagggugaagcuauuuau

SEQ ID NO: 2472730 - RNA, 21 nt, Human
caaagggugaagcuauuuauc

SEQ ID NO: 2472731 - RNA, 19 nt, Human
caaagggugaagcuauuua

SEQ ID NO: 2472732 - RNA, 20 nt, Human
caacacaagcuggaagcaca

SEQ ID NO: 2472733 - RNA, 13 nt, Human
caacaccaagcac

SEQ ID NO: 2472734 - RNA, 21 nt, Human
caacacacagauuugagcuca

SEQ ID NO: 2472735 - RNA, 22 nt, Human
caacacacagauuugagcucag

SEQ ID NO: 2472736 - RNA, 11 nt, Human
caacacacaga

SEQ ID NO: 2472737 - RNA, 14 nt, Human
caacacacacacuc

SEQ ID NO: 2472738 - RNA, 18 nt, Human
caacaaccucaacugccu

SEQ ID NO: 2472739 - RNA, 17 nt, Human
caacacaagcuggaagc

SEQ ID NO: 2472740 - RNA, 19 nt, Human
caacaaccucaacugccua

SEQ ID NO: 2472741 - RNA, 22 nt, Human
caacaacauguauaauauuuuu

SEQ ID NO: 2472742 - RNA, 21 nt, Human
caacaacauguauaauauuuu

SEQ ID NO: 2472743 - RNA, 22 nt, Human
caagaugcuggaugucugccaa

SEQ ID NO: 2472744 - RNA, 15 nt, Human
caagaugucagacug

SEQ ID NO: 2472745 - RNA, 16 nt, Human
caagaugucagacugg

SEQ ID NO: 2472746 - RNA, 17 nt, Human
caagaugucagacuggc

SEQ ID NO: 2472747 - RNA, 17 nt, Human
caagaccacguuucuaa

SEQ ID NO: 2472748 - RNA, 18 nt, Human
caagaccacguuucuaaa

SEQ ID NO: 2472749 - RNA, 19 nt, Human
caagacccaaaaggcagaa

SEQ ID NO: 2472750 - RNA, 21 nt, Human
caagaauuuccuguuggauuu

SEQ ID NO: 2472751 - RNA, 23 nt, Human
caacucagucccuaaaaacacag

SEQ ID NO: 2472752 - RNA, 14 nt, Human
caacuccuggaagc

SEQ ID NO: 2472753 - RNA, 17 nt, Human
caacuccuggaagcugu

SEQ ID NO: 2472754 - RNA, 14 nt, Human
caacucuccuccag

SEQ ID NO: 2472755 - RNA, 19 nt, Human
caacucgcuuuaggucagc

SEQ ID NO: 2472756 - RNA, 14 nt, Human
caacucgcuuuagg

SEQ ID NO: 2472757 - RNA, 14 nt, Human
caacuccugucuaa

SEQ ID NO: 2472758 - RNA, 21 nt, Human
caacuccuggaagcugugucc

SEQ ID NO: 2472759 - RNA, 14 nt, Human
caagaaugcugaaa

SEQ ID NO: 2472760 - RNA, 13 nt, Human
caagaaugcugaa

SEQ ID NO: 2472761 - RNA, 16 nt, Human
caagaaugcugaaacc

SEQ ID NO: 2472762 - RNA, 15 nt, Human
caagaaugcugaaac

SEQ ID NO: 2472763 - RNA, 17 nt, Human
caagaaugcugaaacca

SEQ ID NO: 2472764 - RNA, 24 nt, Human
caacucuccccugaccugugagcc

SEQ ID NO: 2472765 - RNA, 13 nt, Human
caacucuagcugg

SEQ ID NO: 2472766 - RNA, 18 nt, Human
caacucuccccugaccug

SEQ ID NO: 2472767 - RNA, 22 nt, Human
caagaauugaagcaggacuaaa

SEQ ID NO: 2472768 - RNA, 21 nt, Human
caagaauggggaucacagaga

SEQ ID NO: 2472769 - RNA, 21 nt, Human
caagaauuggaagcugcccug

SEQ ID NO: 2472770 - RNA, 12 nt, Human
caacucagacua

SEQ ID NO: 2472771 - RNA, 17 nt, Human
caacucaccccagcccc

SEQ ID NO: 2472772 - RNA, 17 nt, Human
caacuagacauucuguc

SEQ ID NO: 2472773 - RNA, 16 nt, Human
caacuagacauucugu

SEQ ID NO: 2472774 - RNA, 21 nt, Human
caacuagacauucugucgccu

SEQ ID NO: 2472775 - RNA, 15 nt, Human
caacuagacauucug

SEQ ID NO: 2472776 - RNA, 18 nt, Human
caacucaccccagcccca

SEQ ID NO: 2472777 - RNA, 18 nt, Human
caacuaauuuuuguauuu

SEQ ID NO: 2472778 - RNA, 12 nt, Human
caaccccugugg

SEQ ID NO: 2472779 - RNA, 14 nt, Human
caaccccuguggag

SEQ ID NO: 2472780 - RNA, 22 nt, Human
caacuaacaagaaacucacccc

SEQ ID NO: 2472781 - RNA, 20 nt, Human
caaccccccagcacugagga

SEQ ID NO: 2472782 - RNA, 19 nt, Human
caaccccccagcacugagg

SEQ ID NO: 2472783 - RNA, 16 nt, Human
caaccccugaggaaga

SEQ ID NO: 2472784 - RNA, 13 nt, Human
caaccccugagga

SEQ ID NO: 2472785 - RNA, 12 nt, Human
caaccccugagg

SEQ ID NO: 2472786 - RNA, 10 nt, Human
caaccccuga

SEQ ID NO: 2472787 - RNA, 18 nt, Human
caaccccccagcacugag

SEQ ID NO: 2472788 - RNA, 16 nt, Human
caaccccccagcacug

SEQ ID NO: 2472789 - RNA, 15 nt, Human
caaccccccagcacu

SEQ ID NO: 2472790 - RNA, 14 nt, Human
caaccccccagcac

SEQ ID NO: 2472791 - RNA, 16 nt, Human
caacccccauuucuau

SEQ ID NO: 2472792 - RNA, 16 nt, Human
caaccccccaccugcc

SEQ ID NO: 2472793 - RNA, 17 nt, Human
caaccccccaccugcca

SEQ ID NO: 2472794 - RNA, 15 nt, Human
caaccagcuaagaaa

SEQ ID NO: 2472795 - RNA, 22 nt, Human
caaccagcuaagaaaagauuuu

SEQ ID NO: 2472796 - RNA, 22 nt, Human
caaccagcaucccuugaccagg

SEQ ID NO: 2472797 - RNA, 23 nt, Human
caaccaugaguggcauggccacc

SEQ ID NO: 2472798 - RNA, 23 nt, Human
caaccaugagaccacuguuauca

SEQ ID NO: 2472799 - RNA, 13 nt, Human
caaccaucgcuuu

SEQ ID NO: 2472800 - RNA, 18 nt, Human
caaccaugagaccacugu

SEQ ID NO: 2472801 - RNA, 17 nt, Human
caaccagcuaagaaaag

SEQ ID NO: 2472802 - RNA, 16 nt, Human
auuuuuaagugcugca

SEQ ID NO: 2472803 - RNA, 18 nt, Human
auuuuuaagugcugcauu

SEQ ID NO: 2472804 - RNA, 19 nt, Human
auuuuuaagugcugcauuu

SEQ ID NO: 2472805 - RNA, 18 nt, Human
auuuuuaauauauacuau

SEQ ID NO: 2472806 - RNA, 14 nt, Human
auuuuuagacagag

SEQ ID NO: 2472807 - RNA, 15 nt, Human
auuuuuacugccacu

SEQ ID NO: 2472808 - RNA, 19 nt, Human
auuuuuaauauauacuaug

SEQ ID NO: 2472809 - RNA, 14 nt, Human
auuuuuaaucauga

SEQ ID NO: 2472810 - RNA, 16 nt, Human
auuuuuaguaaagaca

SEQ ID NO: 2472811 - RNA, 14 nt, Human
auuuuuacugccac

SEQ ID NO: 2472812 - RNA, 15 nt, Human
auuuuuaaucaugaa

SEQ ID NO: 2472813 - RNA, 21 nt, Human
auuuuuagauaguuagaaccu

SEQ ID NO: 2472814 - RNA, 21 nt, Human
auuuucugguagauagaaaua

SEQ ID NO: 2472815 - RNA, 16 nt, Human
auuuucugugccugaa

SEQ ID NO: 2472816 - RNA, 18 nt, Human
auuuucugugccugaaua

SEQ ID NO: 2472817 - RNA, 20 nt, Human
auuuucugugccugaauauu

SEQ ID NO: 2472818 - RNA, 15 nt, Human
auuuuauaugcuuac

SEQ ID NO: 2472819 - RNA, 16 nt, Human
auuuuauaugcuuacu

SEQ ID NO: 2472820 - RNA, 18 nt, Human
auuuuaugcuuuaaacau

SEQ ID NO: 2472821 - RNA, 19 nt, Human
auuuuauggcucacuauga

SEQ ID NO: 2472822 - RNA, 19 nt, Human
auuuuaugcuuuaaacauu

SEQ ID NO: 2472823 - RNA, 22 nt, Human
auuuuauguuaagggaagaauu

SEQ ID NO: 2472824 - RNA, 18 nt, Human
auuuuagcuacuauauau

SEQ ID NO: 2472825 - RNA, 21 nt, Human
auuuuaggaaaugaaugugug

SEQ ID NO: 2472826 - RNA, 15 nt, Human
auuuuagcugcagaa

SEQ ID NO: 2472827 - RNA, 16 nt, Human
auuuuagcugcagaac

SEQ ID NO: 2472828 - RNA, 21 nt, Human
auuuuagccuucucuguucau

SEQ ID NO: 2472829 - RNA, 21 nt, Human
auuuuauaucaauuuaaaaaa

SEQ ID NO: 2472830 - RNA, 16 nt, Human
auuuuagguguugauu

SEQ ID NO: 2472831 - RNA, 15 nt, Human
auuuuagguguugau

SEQ ID NO: 2472832 - RNA, 21 nt, Human
auuuuaggcagggauuugagg

SEQ ID NO: 2472833 - RNA, 17 nt, Human
auuuuaggcagggauuu

SEQ ID NO: 2472834 - RNA, 16 nt, Human
auuuuaggaaaugaau

SEQ ID NO: 2472835 - RNA, 18 nt, Human
auuuugaaucaauaauau

SEQ ID NO: 2472836 - RNA, 17 nt, Human
auuuugaaucaauaaua

SEQ ID NO: 2472837 - RNA, 15 nt, Human
auuuugaaucaauaa

SEQ ID NO: 2472838 - RNA, 14 nt, Human
auuuugaaucaaua

SEQ ID NO: 2472839 - RNA, 13 nt, Human
auuuugaaucaau

SEQ ID NO: 2472840 - RNA, 12 nt, Human
auuuugaaucaa

SEQ ID NO: 2472841 - RNA, 11 nt, Human
auuuugaauca

SEQ ID NO: 2472842 - RNA, 20 nt, Human
auuuugaauaaauaaaugua

SEQ ID NO: 2472843 - RNA, 19 nt, Human
auuuucugugggcaggccu

SEQ ID NO: 2472844 - RNA, 23 nt, Human
auuuucuguguuuugcuguacca

SEQ ID NO: 2472845 - RNA, 11 nt, Human
auuuucugugg

SEQ ID NO: 2472846 - RNA, 21 nt, Human
auuuucugugccugaauauuu

SEQ ID NO: 2472847 - RNA, 19 nt, Human
auuuucuuaucuucugcaa

SEQ ID NO: 2472848 - RNA, 11 nt, Human
auuuucuguug

SEQ ID NO: 2472849 - RNA, 14 nt, Human
auuuucuucaugca

SEQ ID NO: 2472850 - RNA, 18 nt, Human
auuuucuucaugcaauga

SEQ ID NO: 2472851 - RNA, 17 nt, Human
caaagauaucucaucuc

SEQ ID NO: 2472852 - RNA, 20 nt, Human
caaagauaaucucucagcuu

SEQ ID NO: 2472853 - RNA, 16 nt, Human
caaagauaaucucuca

SEQ ID NO: 2472854 - RNA, 20 nt, Human
auuuuuauaucagccugagu

SEQ ID NO: 2472855 - RNA, 18 nt, Human
auuuuuauaucagccuga

SEQ ID NO: 2472856 - RNA, 15 nt, Human
auuuuuauauuugaa

SEQ ID NO: 2472857 - RNA, 16 nt, Human
auuuuuuucugauugu

SEQ ID NO: 2472858 - RNA, 15 nt, Human
auuuuuauauuuagu

SEQ ID NO: 2472859 - RNA, 22 nt, Human
auuuuuauaucuauauguacuu

SEQ ID NO: 2472860 - RNA, 18 nt, Human
auuuuuuuuuccuucagu

SEQ ID NO: 2472861 - RNA, 23 nt, Human
auuuuuuuguagaugaaaaagca

SEQ ID NO: 2472862 - RNA, 20 nt, Human
auuuuuuugcaagugaaggu

SEQ ID NO: 2472863 - RNA, 17 nt, Human
auuuuuuugcaagugaa

SEQ ID NO: 2472864 - RNA, 14 nt, Human
auuuuuuugcaagu

SEQ ID NO: 2472865 - RNA, 21 nt, Human
auuuuuuucugauuguaacgu

SEQ ID NO: 2472866 - RNA, 16 nt, Human
auuuuuuugagacaga

SEQ ID NO: 2472867 - RNA, 16 nt, Human
caaaagaagcccccag

SEQ ID NO: 2472868 - RNA, 17 nt, Human
caaaagaagcccccagc

SEQ ID NO: 2472869 - RNA, 13 nt, Human
caaaagaagcccc

SEQ ID NO: 2472870 - RNA, 22 nt, Human
auuuuuuuuuccuucagugccu

SEQ ID NO: 2472871 - RNA, 20 nt, Human
auuuuuuuuuccuucagugc

SEQ ID NO: 2472872 - RNA, 15 nt, Human
caaaagacaauucuu

SEQ ID NO: 2472873 - RNA, 13 nt, Human
caaaagacaauuc

SEQ ID NO: 2472874 - RNA, 12 nt, Human
caaaagacaauu

SEQ ID NO: 2472875 - RNA, 22 nt, Human
caaaagacaauucuuuauacaa

SEQ ID NO: 2472876 - RNA, 21 nt, Human
caaaagacaauucuuuauaca

SEQ ID NO: 2472877 - RNA, 23 nt, Human
caaaagacaauucuuuauacaac

SEQ ID NO: 2472878 - RNA, 19 nt, Human
caaaagcugggcagguugg

SEQ ID NO: 2472879 - RNA, 18 nt, Human
caaaagaagcccccagcu

SEQ ID NO: 2472880 - RNA, 19 nt, Human
caaaagaagcccccagcua

SEQ ID NO: 2472881 - RNA, 19 nt, Human
caaaagaaucagaaacagg

SEQ ID NO: 2472882 - RNA, 15 nt, Human
caaaagaaucagaaa

SEQ ID NO: 2472883 - RNA, 14 nt, Human
caaaccaaauaaaa

SEQ ID NO: 2472884 - RNA, 15 nt, Human
caaaccaaauaaaaa

SEQ ID NO: 2472885 - RNA, 18 nt, Human
caaacccccuuugugcug

SEQ ID NO: 2472886 - RNA, 17 nt, Human
caaacccccuuugugcu

SEQ ID NO: 2472887 - RNA, 21 nt, Human
caaaccccgaccaccugccca

SEQ ID NO: 2472888 - RNA, 17 nt, Human
caaaccccacccuaguu

SEQ ID NO: 2472889 - RNA, 16 nt, Human
caaacccccuuugugc

SEQ ID NO: 2472890 - RNA, 18 nt, Human
caaaccccgaccaccugc

SEQ ID NO: 2472891 - RNA, 13 nt, Human
caaacccaugagg

SEQ ID NO: 2472892 - RNA, 21 nt, Human
caaaaggauaaugaauacuuu

SEQ ID NO: 2472893 - RNA, 15 nt, Human
caaacagucucagga

SEQ ID NO: 2472894 - RNA, 13 nt, Human
caaaagcuuuuua

SEQ ID NO: 2472895 - RNA, 13 nt, Human
caaaaggaagucu

SEQ ID NO: 2472896 - RNA, 16 nt, Human
caaacagucucaggaa

SEQ ID NO: 2472897 - RNA, 17 nt, Human
caaacagucucaggaaa

SEQ ID NO: 2472898 - RNA, 17 nt, Human
caaacauauauaacaau

SEQ ID NO: 2472899 - RNA, 20 nt, Human
caaacaugugguuaaugcca

SEQ ID NO: 2472900 - RNA, 12 nt, Human
cagaacagugau

SEQ ID NO: 2472901 - RNA, 17 nt, Human
cagaacagugauuacca

SEQ ID NO: 2472902 - RNA, 11 nt, Human
cagaacaguga

SEQ ID NO: 2472903 - RNA, 24 nt, Human
cagaacagcuucagguuaucgaaa

SEQ ID NO: 2472904 - RNA, 19 nt, Human
cagaacagcuucagguuau

SEQ ID NO: 2472905 - RNA, 18 nt, Human
cagaacagcuucagguua

SEQ ID NO: 2472906 - RNA, 17 nt, Human
cagaacagcuucagguu

SEQ ID NO: 2472907 - RNA, 16 nt, Human
cagaaguuucugccgc

SEQ ID NO: 2472908 - RNA, 14 nt, Human
cagaaguuucugcc

SEQ ID NO: 2472909 - RNA, 18 nt, Human
cagaacagugauuaccag

SEQ ID NO: 2472910 - RNA, 19 nt, Human
cagaaguuucucagcuccc

SEQ ID NO: 2472911 - RNA, 15 nt, Human
cagaaguuucucagc

SEQ ID NO: 2472912 - RNA, 16 nt, Human
cagaaaugcugccugc

SEQ ID NO: 2472913 - RNA, 14 nt, Human
cagaaaugcugccu

SEQ ID NO: 2472914 - RNA, 23 nt, Human
cagaaaugagaucaggcucugcc

SEQ ID NO: 2472915 - RNA, 20 nt, Human
cagaaaugagaucaggcucu

SEQ ID NO: 2472916 - RNA, 21 nt, Human
cagaaaugcugccugccuguc

SEQ ID NO: 2472917 - RNA, 20 nt, Human
cagaaaugcugccugccugu

SEQ ID NO: 2472918 - RNA, 19 nt, Human
cagaaaugcugccugccug

SEQ ID NO: 2472919 - RNA, 17 nt, Human
cagaaaugcugccugcc

SEQ ID NO: 2472920 - RNA, 20 nt, Human
cagaaaucaguaauauuuau

SEQ ID NO: 2472921 - RNA, 14 nt, Human
cagaaauccaucua

SEQ ID NO: 2472922 - RNA, 19 nt, Human
cagaaaucuagaagacugu

SEQ ID NO: 2472923 - RNA, 19 nt, Human
cagaaauacauauuuccaa

SEQ ID NO: 2472924 - RNA, 22 nt, Human
cagaaauaccaaaauuauuuca

SEQ ID NO: 2472925 - RNA, 23 nt, Human
cagaaauaccaaaauuauuucag

SEQ ID NO: 2472926 - RNA, 15 nt, Human
cagaaauaugugguu

SEQ ID NO: 2472927 - RNA, 16 nt, Human
cagaacagcuucaggu

SEQ ID NO: 2472928 - RNA, 15 nt, Human
cagaacagcuucagg

SEQ ID NO: 2472929 - RNA, 13 nt, Human
cagaacagcuuca

SEQ ID NO: 2472930 - RNA, 12 nt, Human
cagaacagcuuc

SEQ ID NO: 2472931 - RNA, 21 nt, Human
cagaaaugucuaaaugcugaa

SEQ ID NO: 2472932 - RNA, 12 nt, Human
cagaacagccgc

SEQ ID NO: 2472933 - RNA, 17 nt, Human
cagaacagccgcuccug

SEQ ID NO: 2472934 - RNA, 20 nt, Human
cagaacagccgcuccugucu

SEQ ID NO: 2472935 - RNA, 16 nt, Human
cagaaauguacagcaa

SEQ ID NO: 2472936 - RNA, 14 nt, Human
cagaaaugucuaaa

SEQ ID NO: 2472937 - RNA, 11 nt, Human
cagaaaugucu

SEQ ID NO: 2472938 - RNA, 23 nt, Human
cagaaaugcugccugccugucug

SEQ ID NO: 2472939 - RNA, 23 nt, Human
cagaaauguacaacuuuuuaccu

SEQ ID NO: 2472940 - RNA, 17 nt, Human
cagaaagggcaacaaua

SEQ ID NO: 2472941 - RNA, 12 nt, Human
cagaaaggagac

SEQ ID NO: 2472942 - RNA, 23 nt, Human
cagaaauacagauuuugauagca

SEQ ID NO: 2472943 - RNA, 16 nt, Human
cagaaauacauauuuc

SEQ ID NO: 2472944 - RNA, 13 nt, Human
cagaaauacauau

SEQ ID NO: 2472945 - RNA, 20 nt, Human
cagaaauacagauuuugaua

SEQ ID NO: 2472946 - RNA, 15 nt, Human
cagaaauacagauuu

SEQ ID NO: 2472947 - RNA, 23 nt, Human
cagaaaguggugcucaguuguag

SEQ ID NO: 2472948 - RNA, 16 nt, Human
cagaaagugugcuuua

SEQ ID NO: 2472949 - RNA, 17 nt, Human
cagaaagugugcuuuau

SEQ ID NO: 2472950 - RNA, 22 nt, Human
cagaaagugugcuuuaugcuga

SEQ ID NO: 2472951 - RNA, 23 nt, Human
cagaaagugugcuuuaugcugaa

SEQ ID NO: 2472952 - RNA, 20 nt, Human
cagaaauaaaguuggugaca

SEQ ID NO: 2472953 - RNA, 22 nt, Human
cagaaaguggugcucaguugua

SEQ ID NO: 2472954 - RNA, 21 nt, Human
cagaaaguggugcucaguugu

SEQ ID NO: 2472955 - RNA, 19 nt, Human
cagaaaguggugcucaguu

SEQ ID NO: 2472956 - RNA, 18 nt, Human
cagaaaguggugcucagu

SEQ ID NO: 2472957 - RNA, 22 nt, Human
cagaaaguggccaugccacccu

SEQ ID NO: 2472958 - RNA, 17 nt, Human
cagaaaguggugcucag

SEQ ID NO: 2472959 - RNA, 23 nt, Human
cagaaaguggccaugccacccug

SEQ ID NO: 2472960 - RNA, 21 nt, Human
cagaaagguucugcccgggaa

SEQ ID NO: 2472961 - RNA, 17 nt, Human
cagaaagguucugcccg

SEQ ID NO: 2472962 - RNA, 16 nt, Human
cagaaagguucugccc

SEQ ID NO: 2472963 - RNA, 15 nt, Human
cagaaagguucugcc

SEQ ID NO: 2472964 - RNA, 22 nt, Human
cagaaagggcaacaauaaaaua

SEQ ID NO: 2472965 - RNA, 20 nt, Human
cagaaagguuuucuucuuuu

SEQ ID NO: 2472966 - RNA, 22 nt, Human
cacuuuaauucucaugugaucc

SEQ ID NO: 2472967 - RNA, 20 nt, Human
cacuuuaauucucaugugau

SEQ ID NO: 2472968 - RNA, 20 nt, Human
cacuuuaauuaccaaccugu

SEQ ID NO: 2472969 - RNA, 22 nt, Human
cacuuuacaauguucaucccau

SEQ ID NO: 2472970 - RNA, 21 nt, Human
cacuuuacaauguucauccca

SEQ ID NO: 2472971 - RNA, 16 nt, Human
cacuuuagaugcugau

SEQ ID NO: 2472972 - RNA, 15 nt, Human
cacuuuagaugcuga

SEQ ID NO: 2472973 - RNA, 14 nt, Human
cacuuuagaugcug

SEQ ID NO: 2472974 - RNA, 21 nt, Human
cacuuuagaugcugaugauuu

SEQ ID NO: 2472975 - RNA, 15 nt, Human
cacuuuagggcugua

SEQ ID NO: 2472976 - RNA, 17 nt, Human
cacuuuagggcuguaaa

SEQ ID NO: 2472977 - RNA, 18 nt, Human
cacuuuagggcuguaaaa

SEQ ID NO: 2472978 - RNA, 23 nt, Human
cacuuuagggcuguaaaaugcau

SEQ ID NO: 2472979 - RNA, 19 nt, Human
cacuuucuacaaugugaac

SEQ ID NO: 2472980 - RNA, 23 nt, Human
cacuuucuacaaugugaacuuua

SEQ ID NO: 2472981 - RNA, 13 nt, Human
cacuuucuagcca

SEQ ID NO: 2472982 - RNA, 17 nt, Human
cacuuucuagccagagg

SEQ ID NO: 2472983 - RNA, 16 nt, Human
cacuuucuagccagag

SEQ ID NO: 2472984 - RNA, 22 nt, Human
cacuuguggguuuuuguuuugu

SEQ ID NO: 2472985 - RNA, 13 nt, Human
cacuugugugugg

SEQ ID NO: 2472986 - RNA, 13 nt, Human
cacuuaagacugu

SEQ ID NO: 2472987 - RNA, 13 nt, Human
cacuuaacagaug

SEQ ID NO: 2472988 - RNA, 22 nt, Human
cacuuaacaagcucccaggccg

SEQ ID NO: 2472989 - RNA, 17 nt, Human
cacuuaaggcacucugu

SEQ ID NO: 2472990 - RNA, 22 nt, Human
cacuuaagagaauauuuuaagu

SEQ ID NO: 2472991 - RNA, 20 nt, Human
cacuuaagagaauauuuuaa

SEQ ID NO: 2472992 - RNA, 17 nt, Human
cacuuaagagaauauuu

SEQ ID NO: 2472993 - RNA, 15 nt, Human
cacuuaagagaauau

SEQ ID NO: 2472994 - RNA, 13 nt, Human
cacuuaagagaau

SEQ ID NO: 2472995 - RNA, 21 nt, Human
cacuuaagacuguguauucua

SEQ ID NO: 2472996 - RNA, 23 nt, Human
cacuugugugugggcugugagug

SEQ ID NO: 2472997 - RNA, 14 nt, Human
cacuuguuguuuua

SEQ ID NO: 2472998 - RNA, 21 nt, Human
cacuugugugugggcugugag

SEQ ID NO: 2472999 - RNA, 22 nt, Human
cacuugugugugggcugugagu

SEQ ID NO: 2473000 - RNA, 19 nt, Human
cacuuguugauuaauggaa

SEQ ID NO: 2473001 - RNA, 14 nt, Human
cacuuguguguggg

SEQ ID NO: 2473002 - RNA, 15 nt, Human
cacuugugugugggc

SEQ ID NO: 2473003 - RNA, 17 nt, Human
cacuugugugugggcug

SEQ ID NO: 2473004 - RNA, 19 nt, Human
cacuugugugugggcugug

SEQ ID NO: 2473005 - RNA, 17 nt, Human
cacuuguguuuugcaag

SEQ ID NO: 2473006 - RNA, 18 nt, Human
cacuuguguuaugaagca

SEQ ID NO: 2473007 - RNA, 16 nt, Human
cacugccauaaaacau

SEQ ID NO: 2473008 - RNA, 21 nt, Human
cacugccaggccagccuccga

SEQ ID NO: 2473009 - RNA, 20 nt, Human
cacugccaggccagccuccg

SEQ ID NO: 2473010 - RNA, 19 nt, Human
cacugccaggccagccucc

SEQ ID NO: 2473011 - RNA, 18 nt, Human
cacugccaggccagccuc

SEQ ID NO: 2473012 - RNA, 17 nt, Human
cacugccaggccagccu

SEQ ID NO: 2473013 - RNA, 16 nt, Human
cacugccaggccagcc

SEQ ID NO: 2473014 - RNA, 14 nt, Human
cacugccaggccag

SEQ ID NO: 2473015 - RNA, 13 nt, Human
cacugccaggcca

SEQ ID NO: 2473016 - RNA, 20 nt, Human
cacugcaggcaucacagcua

SEQ ID NO: 2473017 - RNA, 12 nt, Human
cacugcaggcac

SEQ ID NO: 2473018 - RNA, 20 nt, Human
cacugccaucuuaguuugga

SEQ ID NO: 2473019 - RNA, 16 nt, Human
cacugccaucuuaguu

SEQ ID NO: 2473020 - RNA, 21 nt, Human
cacugccauaaaacauuaaga

SEQ ID NO: 2473021 - RNA, 17 nt, Human
cacugccauaaaacauu

SEQ ID NO: 2473022 - RNA, 14 nt, Human
cacugccauauacu

SEQ ID NO: 2473023 - RNA, 17 nt, Human
cacugccaugccagcuu

SEQ ID NO: 2473024 - RNA, 23 nt, Human
cacugcagccucaaccuccuggg

SEQ ID NO: 2473025 - RNA, 22 nt, Human
cacugcagccucaaccuccugg

SEQ ID NO: 2473026 - RNA, 21 nt, Human
cacugcagccucaaccuccug

SEQ ID NO: 2473027 - RNA, 20 nt, Human
cacugcagccucaaccuccu

SEQ ID NO: 2473028 - RNA, 14 nt, Human
cacugcagccucaa

SEQ ID NO: 2473029 - RNA, 19 nt, Human
cacugcagccucaaccucc

SEQ ID NO: 2473030 - RNA, 20 nt, Human
cacugguauuccugccucca

SEQ ID NO: 2473031 - RNA, 23 nt, Human
cacuguugcccaggcuggcgugc

SEQ ID NO: 2473032 - RNA, 19 nt, Human
cacuguugcccaggcuggc

SEQ ID NO: 2473033 - RNA, 18 nt, Human
cacuguugcccaggcugg

SEQ ID NO: 2473034 - RNA, 19 nt, Human
cacugguauuccugccucc

SEQ ID NO: 2473035 - RNA, 15 nt, Human
cacuuaaaaaugguu

SEQ ID NO: 2473036 - RNA, 14 nt, Human
cacuuaaaaaaugu

SEQ ID NO: 2473037 - RNA, 16 nt, Human
cacuuaaaaaaugucc

SEQ ID NO: 2473038 - RNA, 18 nt, Human
cacuggggugccgccugc

SEQ ID NO: 2473039 - RNA, 15 nt, Human
cacuggggugccgcc

SEQ ID NO: 2473040 - RNA, 13 nt, Human
cacuggggugccg

SEQ ID NO: 2473041 - RNA, 22 nt, Human
cacugggaugagccgcugugag

SEQ ID NO: 2473042 - RNA, 20 nt, Human
cacugggguccuggggccuc

SEQ ID NO: 2473043 - RNA, 21 nt, Human
cacuggggugccgccugcccg

SEQ ID NO: 2473044 - RNA, 20 nt, Human
cacuggggugccgccugccc

SEQ ID NO: 2473045 - RNA, 22 nt, Human
cacugggugcccaagcucagaa

SEQ ID NO: 2473046 - RNA, 15 nt, Human
cacugggugggguga

SEQ ID NO: 2473047 - RNA, 18 nt, Human
cacuggguggggugagga

SEQ ID NO: 2473048 - RNA, 19 nt, Human
cacuggguggggugaggac

SEQ ID NO: 2473049 - RNA, 21 nt, Human
cacuggguggggugaggacca

SEQ ID NO: 2473050 - RNA, 23 nt, Human
cacuggguggggugaggaccacu

SEQ ID NO: 2473051 - RNA, 17 nt, Human
cacugguauuccugccu

SEQ ID NO: 2473052 - RNA, 16 nt, Human
cacugguauuccugcc

SEQ ID NO: 2473053 - RNA, 20 nt, Human
cacugguagaccaaaauaaa

SEQ ID NO: 2473054 - RNA, 15 nt, Human
cacuggguugacuuu

SEQ ID NO: 2473055 - RNA, 13 nt, Human
cacugggcuucua

SEQ ID NO: 2473056 - RNA, 23 nt, Human
cacugggaugagccgcugugagc

SEQ ID NO: 2473057 - RNA, 20 nt, Human
cacugggaugagccgcugug

SEQ ID NO: 2473058 - RNA, 19 nt, Human
cacugggagaaaugaaaaa

SEQ ID NO: 2473059 - RNA, 16 nt, Human
cacugggagaggugcc

SEQ ID NO: 2473060 - RNA, 19 nt, Human
cacugccaugcagggccuc

SEQ ID NO: 2473061 - RNA, 17 nt, Human
cacugccaugcagggcc

SEQ ID NO: 2473062 - RNA, 22 nt, Human
cacugccaucuuaguuuggauu

SEQ ID NO: 2473063 - RNA, 23 nt, Human
cacugggagaggugccagcaacu

SEQ ID NO: 2473064 - RNA, 20 nt, Human
cacugggagaggugccagca

SEQ ID NO: 2473065 - RNA, 20 nt, Human
cacucuguuauuuagacuca

SEQ ID NO: 2473066 - RNA, 22 nt, Human
cacucuuauugcccacgcugga

SEQ ID NO: 2473067 - RNA, 21 nt, Human
cacucuuauugcccacgcugg

SEQ ID NO: 2473068 - RNA, 20 nt, Human
cacucuuauugcccacgcug

SEQ ID NO: 2473069 - RNA, 16 nt, Human
cacucuuaagcuuccg

SEQ ID NO: 2473070 - RNA, 13 nt, Human
cacggccaggcca

SEQ ID NO: 2473071 - RNA, 12 nt, Human
cacggccaggcc

SEQ ID NO: 2473072 - RNA, 17 nt, Human
cacggccaggccagagg

SEQ ID NO: 2473073 - RNA, 19 nt, Human
cacggccgcuccaggggug

SEQ ID NO: 2473074 - RNA, 17 nt, Human
cacggccgcuccagggg

SEQ ID NO: 2473075 - RNA, 16 nt, Human
cacggccgcuccaggg

SEQ ID NO: 2473076 - RNA, 15 nt, Human
cacggccgcuccagg

SEQ ID NO: 2473077 - RNA, 14 nt, Human
cacggccacuggcc

SEQ ID NO: 2473078 - RNA, 14 nt, Human
cacggccgcuccag

SEQ ID NO: 2473079 - RNA, 14 nt, Human
cacggcucacugca

SEQ ID NO: 2473080 - RNA, 15 nt, Human
cacggcucacugcag

SEQ ID NO: 2473081 - RNA, 15 nt, Human
cacuacaccuggcug

SEQ ID NO: 2473082 - RNA, 23 nt, Human
cacuacaccuggcugagguuccu

SEQ ID NO: 2473083 - RNA, 16 nt, Human
cacuacacuccagccu

SEQ ID NO: 2473084 - RNA, 17 nt, Human
cacuacacuccagccug

SEQ ID NO: 2473085 - RNA, 18 nt, Human
cacuacacuccagccuga

SEQ ID NO: 2473086 - RNA, 19 nt, Human
cacuacacuccagccugag

SEQ ID NO: 2473087 - RNA, 13 nt, Human
cacggccacauca

SEQ ID NO: 2473088 - RNA, 19 nt, Human
cacggccacaucaaagagg

SEQ ID NO: 2473089 - RNA, 21 nt, Human
cacggcaggacaacgaggaag

SEQ ID NO: 2473090 - RNA, 17 nt, Human
cacggccaacaaagcug

SEQ ID NO: 2473091 - RNA, 15 nt, Human
cacggccaacaaagc

SEQ ID NO: 2473092 - RNA, 22 nt, Human
cacggcaggacaacgaggaagc

SEQ ID NO: 2473093 - RNA, 23 nt, Human
cacggcaggacaacgaggaagcc

SEQ ID NO: 2473094 - RNA, 16 nt, Human
cacuacauucuguuaa

SEQ ID NO: 2473095 - RNA, 17 nt, Human
cacuacauucuguuaau

SEQ ID NO: 2473096 - RNA, 21 nt, Human
cacuacaugcagcccaugccc

SEQ ID NO: 2473097 - RNA, 23 nt, Human
cacuacaugcagcccaugcccac

SEQ ID NO: 2473098 - RNA, 20 nt, Human
cacuacacuccagccugagc

SEQ ID NO: 2473099 - RNA, 21 nt, Human
cacuacacuccagccugagca

SEQ ID NO: 2473100 - RNA, 17 nt, Human
cacuacauaaacugacu

SEQ ID NO: 2473101 - RNA, 14 nt, Human
cacuacauaaacug

SEQ ID NO: 2473102 - RNA, 15 nt, Human
cacuacaugcagccc

SEQ ID NO: 2473103 - RNA, 21 nt, Human
cacuacauucuguuaaucauu

SEQ ID NO: 2473104 - RNA, 19 nt, Human
cacuacaugugguuuauag

SEQ ID NO: 2473105 - RNA, 19 nt, Human
cacuacauaaacugacuuu

SEQ ID NO: 2473106 - RNA, 20 nt, Human
cacuacaugugguuuauaga

SEQ ID NO: 2473107 - RNA, 21 nt, Human
cacuaccacgccaagcuaauu

SEQ ID NO: 2473108 - RNA, 12 nt, Human
cacuccagccug

SEQ ID NO: 2473109 - RNA, 13 nt, Human
cacuccagccuga

SEQ ID NO: 2473110 - RNA, 13 nt, Human
cacuccagccugg

SEQ ID NO: 2473111 - RNA, 14 nt, Human
cacuccagccuggg

SEQ ID NO: 2473112 - RNA, 23 nt, Human
cacuccagccugagcgacaguga

SEQ ID NO: 2473113 - RNA, 14 nt, Human
cacuccagccugag

SEQ ID NO: 2473114 - RNA, 15 nt, Human
cacuccagccugagc

SEQ ID NO: 2473115 - RNA, 21 nt, Human
cacuccagccugagcaacaga

SEQ ID NO: 2473116 - RNA, 16 nt, Human
cacucugugcccaugg

SEQ ID NO: 2473117 - RNA, 14 nt, Human
cacucugugcccau

SEQ ID NO: 2473118 - RNA, 13 nt, Human
cacucugugccca

SEQ ID NO: 2473119 - RNA, 12 nt, Human
cacucugugccc

SEQ ID NO: 2473120 - RNA, 20 nt, Human
cacucugucgcccagucugg

SEQ ID NO: 2473121 - RNA, 21 nt, Human
cacuccagccugggcgacaga

SEQ ID NO: 2473122 - RNA, 15 nt, Human
cacuccagccugggc

SEQ ID NO: 2473123 - RNA, 16 nt, Human
cacuccagccugggcg

SEQ ID NO: 2473124 - RNA, 21 nt, Human
cacucugugcccaugggcacu

SEQ ID NO: 2473125 - RNA, 18 nt, Human
cacucugugcccaugggc

SEQ ID NO: 2473126 - RNA, 13 nt, Human
cacucuguuauuu

SEQ ID NO: 2473127 - RNA, 17 nt, Human
cacucuguuauuuagac

SEQ ID NO: 2473128 - RNA, 12 nt, Human
caccuacugagu

SEQ ID NO: 2473129 - RNA, 16 nt, Human
caccucaccccacuua

SEQ ID NO: 2473130 - RNA, 14 nt, Human
caccucaccccacu

SEQ ID NO: 2473131 - RNA, 11 nt, Human
caccucacccc

SEQ ID NO: 2473132 - RNA, 21 nt, Human
caccucacugaaaacaucugg

SEQ ID NO: 2473133 - RNA, 15 nt, Human
caccucacuccuguu

SEQ ID NO: 2473134 - RNA, 14 nt, Human
caccucacuccugu

SEQ ID NO: 2473135 - RNA, 13 nt, Human
caccucacuccug

SEQ ID NO: 2473136 - RNA, 12 nt, Human
caccucagccuc

SEQ ID NO: 2473137 - RNA, 22 nt, Human
caccucagaguauggagcucag

SEQ ID NO: 2473138 - RNA, 19 nt, Human
caccucagaguauggagcu

SEQ ID NO: 2473139 - RNA, 20 nt, Human
caccucagagacauacaccu

SEQ ID NO: 2473140 - RNA, 19 nt, Human
caccucagaggcuguucuu

SEQ ID NO: 2473141 - RNA, 22 nt, Human
caccuacuuuucuuuccucaga

SEQ ID NO: 2473142 - RNA, 14 nt, Human
caccuagcagcacc

SEQ ID NO: 2473143 - RNA, 16 nt, Human
caccuagaauuggcug

SEQ ID NO: 2473144 - RNA, 16 nt, Human
caccuagcuuuauucu

SEQ ID NO: 2473145 - RNA, 16 nt, Human
caccuaggccacuccu

SEQ ID NO: 2473146 - RNA, 17 nt, Human
caccuaggccacuccuc

SEQ ID NO: 2473147 - RNA, 18 nt, Human
caccuaggccacuccucc

SEQ ID NO: 2473148 - RNA, 19 nt, Human
caccuaggccacuccucca

SEQ ID NO: 2473149 - RNA, 16 nt, Human
caccuuggcugcaggg

SEQ ID NO: 2473150 - RNA, 15 nt, Human
caccuuggcugcagg

SEQ ID NO: 2473151 - RNA, 23 nt, Human
caccuuuauucuggcagaggagg

SEQ ID NO: 2473152 - RNA, 21 nt, Human
caccugcccccugguggacag

SEQ ID NO: 2473153 - RNA, 13 nt, Human
caccugcccccuu

SEQ ID NO: 2473154 - RNA, 18 nt, Human
caccuuggcugcagggag

SEQ ID NO: 2473155 - RNA, 13 nt, Human
caccugcccaacc

SEQ ID NO: 2473156 - RNA, 19 nt, Human
caccugcccaaccugcucu

SEQ ID NO: 2473157 - RNA, 18 nt, Human
caccugcccaaccugcuc

SEQ ID NO: 2473158 - RNA, 15 nt, Human
caccugccccaacuc

SEQ ID NO: 2473159 - RNA, 16 nt, Human
caccugccccaacucu

SEQ ID NO: 2473160 - RNA, 14 nt, Human
caccugcccccugg

SEQ ID NO: 2473161 - RNA, 15 nt, Human
caccugcccccuggu

SEQ ID NO: 2473162 - RNA, 11 nt, Human
caccucagccu

SEQ ID NO: 2473163 - RNA, 13 nt, Human
caccugcccagau

SEQ ID NO: 2473164 - RNA, 22 nt, Human
caccugccauuugcacccuccg

SEQ ID NO: 2473165 - RNA, 18 nt, Human
caccugcccaucacaggg

SEQ ID NO: 2473166 - RNA, 22 nt, Human
caccugcccaucacaggguugg

SEQ ID NO: 2473167 - RNA, 16 nt, Human
cacgaaauguuauuuu

SEQ ID NO: 2473168 - RNA, 15 nt, Human
cacgaaauguuauuu

SEQ ID NO: 2473169 - RNA, 17 nt, Human
caccuuuuuuaaggaaa

SEQ ID NO: 2473170 - RNA, 13 nt, Human
cacgaaauguuau

SEQ ID NO: 2473171 - RNA, 21 nt, Human
caccuuuuucauacaaggccc

SEQ ID NO: 2473172 - RNA, 19 nt, Human
caccuuuuucauacaaggc

SEQ ID NO: 2473173 - RNA, 20 nt, Human
caccuuuucagcgauguaug

SEQ ID NO: 2473174 - RNA, 20 nt, Human
caccuuuugggaauguuuua

SEQ ID NO: 2473175 - RNA, 18 nt, Human
caccuuuuaacucaccuc

SEQ ID NO: 2473176 - RNA, 14 nt, Human
caccuuucccaucu

SEQ ID NO: 2473177 - RNA, 22 nt, Human
caccuuucagauaacuguuauu

SEQ ID NO: 2473178 - RNA, 21 nt, Human
caccuuucagauaacuguuau

SEQ ID NO: 2473179 - RNA, 20 nt, Human
caccuugggaugaugccuca

SEQ ID NO: 2473180 - RNA, 14 nt, Human
caccuuuauucugg

SEQ ID NO: 2473181 - RNA, 19 nt, Human
caccuugggaugaugccuc

SEQ ID NO: 2473182 - RNA, 22 nt, Human
caccuuucauaaucuuugcuuu

SEQ ID NO: 2473183 - RNA, 16 nt, Human
caccuuucuccuuugu

SEQ ID NO: 2473184 - RNA, 23 nt, Human
caccuuugugggguuuuuggaga

SEQ ID NO: 2473185 - RNA, 13 nt, Human
caauaaaauagca

SEQ ID NO: 2473186 - RNA, 13 nt, Human
caauaaaaucaug

SEQ ID NO: 2473187 - RNA, 20 nt, Human
caauaaaaucuugaaaaugc

SEQ ID NO: 2473188 - RNA, 14 nt, Human
caauaaaaucaugu

SEQ ID NO: 2473189 - RNA, 15 nt, Human
caauaaaaucaugua

SEQ ID NO: 2473190 - RNA, 20 nt, Human
caauaaaaucauguacauuu

SEQ ID NO: 2473191 - RNA, 15 nt, Human
caauaaaaugugauu

SEQ ID NO: 2473192 - RNA, 16 nt, Human
caauaaaaugugauuu

SEQ ID NO: 2473193 - RNA, 20 nt, Human
caauaaaaugugauuuuucu

SEQ ID NO: 2473194 - RNA, 21 nt, Human
caauaaaaugugauuuuucug

SEQ ID NO: 2473195 - RNA, 22 nt, Human
caauaaaaugugauuuuucuga

SEQ ID NO: 2473196 - RNA, 23 nt, Human
caauaaaauccauacauuugugu

SEQ ID NO: 2473197 - RNA, 20 nt, Human
caauaaaauccauacauuug

SEQ ID NO: 2473198 - RNA, 14 nt, Human
caauaaaacauuaa

SEQ ID NO: 2473199 - RNA, 20 nt, Human
caauaaaaauguuuaacggu

SEQ ID NO: 2473200 - RNA, 15 nt, Human
caauaaaacauuaau

SEQ ID NO: 2473201 - RNA, 20 nt, Human
caauaaaagcaauuccaacc

SEQ ID NO: 2473202 - RNA, 17 nt, Human
caauaaaaauguuuaac

SEQ ID NO: 2473203 - RNA, 22 nt, Human
caauaaaagcaauuccaaccuu

SEQ ID NO: 2473204 - RNA, 17 nt, Human
caaguuuguaucaggug

SEQ ID NO: 2473205 - RNA, 22 nt, Human
caaguuuuaggacaaacagcuc

SEQ ID NO: 2473206 - RNA, 23 nt, Human
caaguuucuagcuagaaauauga

SEQ ID NO: 2473207 - RNA, 22 nt, Human
caaguuucuagcuagaaauaug

SEQ ID NO: 2473208 - RNA, 20 nt, Human
caaguuuacucaacccucuc

SEQ ID NO: 2473209 - RNA, 23 nt, Human
caaguuguuugagaaauuaagua

SEQ ID NO: 2473210 - RNA, 13 nt, Human
caagucauggcug

SEQ ID NO: 2473211 - RNA, 17 nt, Human
caaguuguuugagaaau

SEQ ID NO: 2473212 - RNA, 21 nt, Human
caaguuguuugagaaauuaag

SEQ ID NO: 2473213 - RNA, 13 nt, Human
caaguuguuugag

SEQ ID NO: 2473214 - RNA, 16 nt, Human
caaguuguuucauuga

SEQ ID NO: 2473215 - RNA, 14 nt, Human
caaggccuucuccu

SEQ ID NO: 2473216 - RNA, 18 nt, Human
caaggccuuucugugugu

SEQ ID NO: 2473217 - RNA, 15 nt, Human
caaggccuuucugug

SEQ ID NO: 2473218 - RNA, 13 nt, Human
caaggcggccccu

SEQ ID NO: 2473219 - RNA, 15 nt, Human
caaggcucugagcaa

SEQ ID NO: 2473220 - RNA, 22 nt, Human
caaggcguccgcgcgccagcac

SEQ ID NO: 2473221 - RNA, 19 nt, Human
caaggcguccgcgcgccag

SEQ ID NO: 2473222 - RNA, 19 nt, Human
caaggcuagaucaugaaga

SEQ ID NO: 2473223 - RNA, 16 nt, Human
caaggcggccccuccc

SEQ ID NO: 2473224 - RNA, 15 nt, Human
caaggcggccccucc

SEQ ID NO: 2473225 - RNA, 14 nt, Human
caaggcggccccuc

SEQ ID NO: 2473226 - RNA, 19 nt, Human
caaggcgggagcaucucuu

SEQ ID NO: 2473227 - RNA, 20 nt, Human
caagucauagguuaauauuu

SEQ ID NO: 2473228 - RNA, 23 nt, Human
caagucaguccaggaugcuaaca

SEQ ID NO: 2473229 - RNA, 14 nt, Human
caagucauggcugu

SEQ ID NO: 2473230 - RNA, 12 nt, Human
caagucauggcu

SEQ ID NO: 2473231 - RNA, 16 nt, Human
caagucaugugcauuu

SEQ ID NO: 2473232 - RNA, 13 nt, Human
caagucaugugca

SEQ ID NO: 2473233 - RNA, 19 nt, Human
caagucaggcccuuauuuu

SEQ ID NO: 2473234 - RNA, 20 nt, Human
caagucagcuuugccuucca

SEQ ID NO: 2473235 - RNA, 23 nt, Human
caagucagaggauggccaguguc

SEQ ID NO: 2473236 - RNA, 22 nt, Human
caagucagaggauggccagugu

SEQ ID NO: 2473237 - RNA, 19 nt, Human
caagucagcuuugccuucc

SEQ ID NO: 2473238 - RNA, 21 nt, Human
caagucagaggauggccagug

SEQ ID NO: 2473239 - RNA, 19 nt, Human
caagucagaggauggccag

SEQ ID NO: 2473240 - RNA, 15 nt, Human
caagucagaggaugg

SEQ ID NO: 2473241 - RNA, 14 nt, Human
caagucagaggaug

SEQ ID NO: 2473242 - RNA, 16 nt, Human
caaggcgugaggaugg

SEQ ID NO: 2473243 - RNA, 18 nt, Human
caaggcugaccaagagag

SEQ ID NO: 2473244 - RNA, 14 nt, Human
caagucacucccaa

SEQ ID NO: 2473245 - RNA, 19 nt, Human
caaggcugaccaagagaga

SEQ ID NO: 2473246 - RNA, 20 nt, Human
caaggccaaaggaagcacau

SEQ ID NO: 2473247 - RNA, 19 nt, Human
caaggccaaaggaagcaca

SEQ ID NO: 2473248 - RNA, 21 nt, Human
caaggccaaaggaagcacaug

SEQ ID NO: 2473249 - RNA, 14 nt, Human
caaggccagagugg

SEQ ID NO: 2473250 - RNA, 19 nt, Human
caaggccgaagcucuggcu

SEQ ID NO: 2473251 - RNA, 17 nt, Human
caaggccgaagcucugg

SEQ ID NO: 2473252 - RNA, 16 nt, Human
caaggccgaagcucug

SEQ ID NO: 2473253 - RNA, 21 nt, Human
caaggccgaagcucuggcuga

SEQ ID NO: 2473254 - RNA, 20 nt, Human
caaggccgaagcucuggcug

SEQ ID NO: 2473255 - RNA, 23 nt, Human
caaggccgaagcucuggcugaac

SEQ ID NO: 2473256 - RNA, 19 nt, Human
caaggccgcuguucaccca

SEQ ID NO: 2473257 - RNA, 18 nt, Human
caaggccucccacaguga

SEQ ID NO: 2473258 - RNA, 17 nt, Human
caaggccucccacagug

SEQ ID NO: 2473259 - RNA, 16 nt, Human
caaggccucccacagu

SEQ ID NO: 2473260 - RNA, 15 nt, Human
caaggccucccacag

SEQ ID NO: 2473261 - RNA, 14 nt, Human
caaggccucccaca

SEQ ID NO: 2473262 - RNA, 13 nt, Human
caaggccucccac

SEQ ID NO: 2473263 - RNA, 20 nt, Human
caaggccgcuguucacccac

SEQ ID NO: 2473264 - RNA, 22 nt, Human
caaggccgcuguucacccacag

SEQ ID NO: 2473265 - RNA, 18 nt, Human
caagauuuuaaagacaug

SEQ ID NO: 2473266 - RNA, 16 nt, Human
caaggcaaggcuguca

SEQ ID NO: 2473267 - RNA, 17 nt, Human
caaggcaaggcugucaa

SEQ ID NO: 2473268 - RNA, 18 nt, Human
caaggcaaggcugucaau

SEQ ID NO: 2473269 - RNA, 19 nt, Human
caaggcaccugcagguugg

SEQ ID NO: 2473270 - RNA, 15 nt, Human
caaggcaccugcagg

SEQ ID NO: 2473271 - RNA, 17 nt, Human
caagauuuuccacaaga

SEQ ID NO: 2473272 - RNA, 13 nt, Human
caaggcaccugca

SEQ ID NO: 2473273 - RNA, 19 nt, Human
caagauguccuccuuguuc

SEQ ID NO: 2473274 - RNA, 21 nt, Human
caagauguccuccuuguucua

SEQ ID NO: 2473275 - RNA, 17 nt, Human
caagauucugaaacauu

SEQ ID NO: 2473276 - RNA, 13 nt, Human
caagauugcuuaa

SEQ ID NO: 2473277 - RNA, 21 nt, Human
caagauugcuuaaaauagcaa

SEQ ID NO: 2473278 - RNA, 16 nt, Human
caagauugcuuaaaau

SEQ ID NO: 2473279 - RNA, 18 nt, Human
caagauugcuuaaaauag

SEQ ID NO: 2473280 - RNA, 12 nt, Human
caagauuucaga

SEQ ID NO: 2473281 - RNA, 21 nt, Human
cacaagcuccaagcucccagg

SEQ ID NO: 2473282 - RNA, 20 nt, Human
cacaagcuccaagcucccag

SEQ ID NO: 2473283 - RNA, 14 nt, Human
cacaagauucccag

SEQ ID NO: 2473284 - RNA, 19 nt, Human
cacaagcuccaagcuccca

SEQ ID NO: 2473285 - RNA, 18 nt, Human
cacaagcuccaagcuccc

SEQ ID NO: 2473286 - RNA, 15 nt, Human
caauuucuccccagg

SEQ ID NO: 2473287 - RNA, 20 nt, Human
caauuucuguguugccaagc

SEQ ID NO: 2473288 - RNA, 17 nt, Human
cacaagagcccaggccu

SEQ ID NO: 2473289 - RNA, 20 nt, Human
cacaagagcccaggccuccu

SEQ ID NO: 2473290 - RNA, 14 nt, Human
caauuucuccccag

SEQ ID NO: 2473291 - RNA, 13 nt, Human
caauuucucccca

SEQ ID NO: 2473292 - RNA, 12 nt, Human
caauuucucccc

SEQ ID NO: 2473293 - RNA, 15 nt, Human
caauuucuguguugc

SEQ ID NO: 2473294 - RNA, 22 nt, Human
caauuucuguccuucagaugga

SEQ ID NO: 2473295 - RNA, 20 nt, Human
caauuucuacaaaauccuga

SEQ ID NO: 2473296 - RNA, 16 nt, Human
caauuucuacuuugaa

SEQ ID NO: 2473297 - RNA, 20 nt, Human
caauuucuacuuugaaguca

SEQ ID NO: 2473298 - RNA, 21 nt, Human
caauuucuacuuugaagucau

SEQ ID NO: 2473299 - RNA, 19 nt, Human
cacaagagcccaggccucc

SEQ ID NO: 2473300 - RNA, 18 nt, Human
cacaagagcccaggccuc

SEQ ID NO: 2473301 - RNA, 19 nt, Human
caauugacugucacuguuc

SEQ ID NO: 2473302 - RNA, 19 nt, Human
caauugauuuuaaaccaua

SEQ ID NO: 2473303 - RNA, 14 nt, Human
caauugcaucuccc

SEQ ID NO: 2473304 - RNA, 15 nt, Human
caauugcaucuccca

SEQ ID NO: 2473305 - RNA, 17 nt, Human
caauugcaucucccaga

SEQ ID NO: 2473306 - RNA, 20 nt, Human
caauuuccuuuauauuuagu

SEQ ID NO: 2473307 - RNA, 19 nt, Human
caauuuccuuuauauuuag

SEQ ID NO: 2473308 - RNA, 21 nt, Human
caauuuccuuuauauuuagug

SEQ ID NO: 2473309 - RNA, 15 nt, Human
caauuuccuuuauau

SEQ ID NO: 2473310 - RNA, 16 nt, Human
caauuuccuuuauauu

SEQ ID NO: 2473311 - RNA, 17 nt, Human
caauuuccaagagcuga

SEQ ID NO: 2473312 - RNA, 15 nt, Human
caauugaauggucag

SEQ ID NO: 2473313 - RNA, 21 nt, Human
caauugaauuaaauuaggaau

SEQ ID NO: 2473314 - RNA, 21 nt, Human
caauugaacuuaaauaaaugu

SEQ ID NO: 2473315 - RNA, 21 nt, Human
caaugggaaauacuacuccug

SEQ ID NO: 2473316 - RNA, 15 nt, Human
caauggcuuuuuaaa

SEQ ID NO: 2473317 - RNA, 18 nt, Human
caauggcuuacuccagga

SEQ ID NO: 2473318 - RNA, 15 nt, Human
caaugggagcucaug

SEQ ID NO: 2473319 - RNA, 23 nt, Human
caauggcuaauucccagagugug

SEQ ID NO: 2473320 - RNA, 19 nt, Human
caauggcuaauucccagag

SEQ ID NO: 2473321 - RNA, 18 nt, Human
caauggcuaauucccaga

SEQ ID NO: 2473322 - RNA, 17 nt, Human
caauggcuaauucccag

SEQ ID NO: 2473323 - RNA, 22 nt, Human
caauggcugcugaagcugccug

SEQ ID NO: 2473324 - RNA, 14 nt, Human
caauggcugcugaa

SEQ ID NO: 2473325 - RNA, 22 nt, Human
caauggcuauauggcaagaaag

SEQ ID NO: 2473326 - RNA, 20 nt, Human
caauccuaauuucuccuccc

SEQ ID NO: 2473327 - RNA, 16 nt, Human
caauggcagccuuggc

SEQ ID NO: 2473328 - RNA, 16 nt, Human
caauggcuaauuccca

SEQ ID NO: 2473329 - RNA, 21 nt, Human
caauggcgcagugccucuggu

SEQ ID NO: 2473330 - RNA, 20 nt, Human
caauggcgcagugccucugg

SEQ ID NO: 2473331 - RNA, 19 nt, Human
caauggcgcagugccucug

SEQ ID NO: 2473332 - RNA, 19 nt, Human
caauccuaauuucuccucc

SEQ ID NO: 2473333 - RNA, 18 nt, Human
caauggcgcagugccucu

SEQ ID NO: 2473334 - RNA, 16 nt, Human
caauggcgcagugccu

SEQ ID NO: 2473335 - RNA, 21 nt, Human
caaugcuggcuguuggcuggg

SEQ ID NO: 2473336 - RNA, 20 nt, Human
caaugcuggcuguuggcugg

SEQ ID NO: 2473337 - RNA, 13 nt, Human
caaugcuggcugu

SEQ ID NO: 2473338 - RNA, 20 nt, Human
caaucccuuuauuacccccu

SEQ ID NO: 2473339 - RNA, 17 nt, Human
caauccuaacacauuau

SEQ ID NO: 2473340 - RNA, 22 nt, Human
caauccuaacacauuaucggga

SEQ ID NO: 2473341 - RNA, 20 nt, Human
caauccccuccuugggcacu

SEQ ID NO: 2473342 - RNA, 16 nt, Human
caauccccuccuuggg

SEQ ID NO: 2473343 - RNA, 14 nt, Human
caauccccuccuug

SEQ ID NO: 2473344 - RNA, 12 nt, Human
caauccccuccu

SEQ ID NO: 2473345 - RNA, 22 nt, Human
caauccauguuaguuuuuacuu

SEQ ID NO: 2473346 - RNA, 15 nt, Human
caauccccucauuca

SEQ ID NO: 2473347 - RNA, 21 nt, Human
caauccccucauucaggaaaa

SEQ ID NO: 2473348 - RNA, 22 nt, Human
caauccccucauucaggaaaac

SEQ ID NO: 2473349 - RNA, 23 nt, Human
caaucccaccaacccucagagcc

SEQ ID NO: 2473350 - RNA, 12 nt, Human
caaucccagcua

SEQ ID NO: 2473351 - RNA, 17 nt, Human
caaucccagcuaccuca

SEQ ID NO: 2473352 - RNA, 22 nt, Human
caaucccaccaacccucagagc

SEQ ID NO: 2473353 - RNA, 17 nt, Human
caaucccaccaacccuc

SEQ ID NO: 2473354 - RNA, 16 nt, Human
caaucccaccaacccu

SEQ ID NO: 2473355 - RNA, 17 nt, Human
caauccauguaagguau

SEQ ID NO: 2473356 - RNA, 21 nt, Human
caauccauguuaguuuuuacu

SEQ ID NO: 2473357 - RNA, 23 nt, Human
caauccauguuaguuuuuacuuu

SEQ ID NO: 2473358 - RNA, 23 nt, Human
caaucauuguacaguuuguuuac

SEQ ID NO: 2473359 - RNA, 21 nt, Human
caaucauuguacaguuuguuu

SEQ ID NO: 2473360 - RNA, 20 nt, Human
caaucauuguacaguuuguu

SEQ ID NO: 2473361 - RNA, 17 nt, Human
caaucauuuuaauuauu

SEQ ID NO: 2473362 - RNA, 22 nt, Human
caaucauuguacaguuuguuua

SEQ ID NO: 2473363 - RNA, 15 nt, Human
caauccauguaaggu

SEQ ID NO: 2473364 - RNA, 15 nt, Human
caauccaagagucug

SEQ ID NO: 2473365 - RNA, 21 nt, Human
caaucaguccccucccaucug

SEQ ID NO: 2473366 - RNA, 20 nt, Human
caaucaguccccucccaucu

SEQ ID NO: 2473367 - RNA, 17 nt, Human
caaucaguccccuccca

SEQ ID NO: 2473368 - RNA, 16 nt, Human
caaucaguccccuccc

SEQ ID NO: 2473369 - RNA, 15 nt, Human
caaucaguccccucc

SEQ ID NO: 2473370 - RNA, 14 nt, Human
caaucaguccccuc

SEQ ID NO: 2473371 - RNA, 19 nt, Human
caaucaguauaauucugua

SEQ ID NO: 2473372 - RNA, 16 nt, Human
caaucaguauaauucu

SEQ ID NO: 2473373 - RNA, 15 nt, Human
caaucaguauaauuc

SEQ ID NO: 2473374 - RNA, 15 nt, Human
caaucauuguacagu

SEQ ID NO: 2473375 - RNA, 14 nt, Human
caaucauuguacag

SEQ ID NO: 2473376 - RNA, 13 nt, Human
caaucauuguaca

SEQ ID NO: 2473377 - RNA, 21 nt, Human
caaucauugcugaaaauggua

SEQ ID NO: 2473378 - RNA, 18 nt, Human
caaucauugcugaaaaug

SEQ ID NO: 2473379 - RNA, 16 nt, Human
caaucauugcugaaaa

SEQ ID NO: 2473380 - RNA, 15 nt, Human
caaucauugcugaaa

SEQ ID NO: 2473381 - RNA, 20 nt, Human
caaucaucugugugaaaaug

SEQ ID NO: 2473382 - RNA, 19 nt, Human
caaucaucugugugaaaau

SEQ ID NO: 2473383 - RNA, 17 nt, Human
caaucaucugugugaaa

SEQ ID NO: 2473384 - RNA, 17 nt, Human
caaucaugaaauaugca

SEQ ID NO: 2473385 - RNA, 22 nt, Human
caaucaguccccucccaucugg

SEQ ID NO: 2473386 - RNA, 15 nt, Human
caaucaucuguguga

SEQ ID NO: 2473387 - RNA, 22 nt, Human
cacaucuaagccugaaggggcg

SEQ ID NO: 2473388 - RNA, 16 nt, Human
cacaucugugucuugu

SEQ ID NO: 2473389 - RNA, 17 nt, Human
cacaucugugucuuguu

SEQ ID NO: 2473390 - RNA, 18 nt, Human
cacaucugugucuuguuu

SEQ ID NO: 2473391 - RNA, 23 nt, Human
cacaucugugucuuguuuggaau

SEQ ID NO: 2473392 - RNA, 17 nt, Human
cacauuuuauuuuauua

SEQ ID NO: 2473393 - RNA, 12 nt, Human
cacaucuguguc

SEQ ID NO: 2473394 - RNA, 12 nt, Human
cacaucugccuu

SEQ ID NO: 2473395 - RNA, 11 nt, Human
cacaucucugc

SEQ ID NO: 2473396 - RNA, 13 nt, Human
cacaucugcauuu

SEQ ID NO: 2473397 - RNA, 21 nt, Human
cacaucugcauuuucacccca

SEQ ID NO: 2473398 - RNA, 13 nt, Human
cacaucucuaucu

SEQ ID NO: 2473399 - RNA, 22 nt, Human
cacaucuccuccauacucagga

SEQ ID NO: 2473400 - RNA, 19 nt, Human
cacauuuuauuuuauuaug

SEQ ID NO: 2473401 - RNA, 20 nt, Human
cacauuuuauuuuauuaugc

SEQ ID NO: 2473402 - RNA, 21 nt, Human
cacauuuuauuuuauuaugca

SEQ ID NO: 2473403 - RNA, 12 nt, Human
caccaaaauaag

SEQ ID NO: 2473404 - RNA, 17 nt, Human
caccaaaauaagaaaag

SEQ ID NO: 2473405 - RNA, 12 nt, Human
cacaucuucccu

SEQ ID NO: 2473406 - RNA, 15 nt, Human
caccaaaguauuuuu

SEQ ID NO: 2473407 - RNA, 13 nt, Human
caccaaaggccag

SEQ ID NO: 2473408 - RNA, 16 nt, Human
caccaaacauacuaga

SEQ ID NO: 2473409 - RNA, 13 nt, Human
cacaucugccuua

SEQ ID NO: 2473410 - RNA, 18 nt, Human
caccaaaauaagaaaaga

SEQ ID NO: 2473411 - RNA, 19 nt, Human
caccaaaauaagaaaagau

SEQ ID NO: 2473412 - RNA, 15 nt, Human
caccaacaccacggu

SEQ ID NO: 2473413 - RNA, 17 nt, Human
caccaacaucccauugc

SEQ ID NO: 2473414 - RNA, 22 nt, Human
caccaacaucccauugcccugg

SEQ ID NO: 2473415 - RNA, 14 nt, Human
caccaacaucccau

SEQ ID NO: 2473416 - RNA, 16 nt, Human
caccaacgucugugcc

SEQ ID NO: 2473417 - RNA, 21 nt, Human
caccaacccagccgcugcccg

SEQ ID NO: 2473418 - RNA, 20 nt, Human
caccaacccagccgcugccc

SEQ ID NO: 2473419 - RNA, 19 nt, Human
caccaacccaucagaagga

SEQ ID NO: 2473420 - RNA, 19 nt, Human
caccagccaggcucugugc

SEQ ID NO: 2473421 - RNA, 18 nt, Human
caccagccaggcucugug

SEQ ID NO: 2473422 - RNA, 16 nt, Human
caccagccaggcucug

SEQ ID NO: 2473423 - RNA, 15 nt, Human
caccagccaggcucu

SEQ ID NO: 2473424 - RNA, 14 nt, Human
caccagccaggcuc

SEQ ID NO: 2473425 - RNA, 13 nt, Human
caccagccaggcu

SEQ ID NO: 2473426 - RNA, 14 nt, Human
caccaacgucugug

SEQ ID NO: 2473427 - RNA, 13 nt, Human
caccaacccucag

SEQ ID NO: 2473428 - RNA, 17 nt, Human
caccaacccagccgcug

SEQ ID NO: 2473429 - RNA, 14 nt, Human
caccaacccagccg

SEQ ID NO: 2473430 - RNA, 13 nt, Human
caccaacccagcc

SEQ ID NO: 2473431 - RNA, 23 nt, Human
caccaacaucccauugcccuggu

SEQ ID NO: 2473432 - RNA, 19 nt, Human
caccccaaagcuuuccugc

SEQ ID NO: 2473433 - RNA, 15 nt, Human
cacccauuuucacau

SEQ ID NO: 2473434 - RNA, 18 nt, Human
cacccauguuucucuggc

SEQ ID NO: 2473435 - RNA, 17 nt, Human
cacccauguuucucugg

SEQ ID NO: 2473436 - RNA, 13 nt, Human
cacccaugugcca

SEQ ID NO: 2473437 - RNA, 18 nt, Human
caccccaaagcuuuccug

SEQ ID NO: 2473438 - RNA, 13 nt, Human
caccccacccccu

SEQ ID NO: 2473439 - RNA, 11 nt, Human
caccccacacu

SEQ ID NO: 2473440 - RNA, 12 nt, Human
caccccacacuu

SEQ ID NO: 2473441 - RNA, 20 nt, Human
cacccaugggcucugacaga

SEQ ID NO: 2473442 - RNA, 19 nt, Human
cacccaugggcucugacag

SEQ ID NO: 2473443 - RNA, 18 nt, Human
cacccaugggcucugaca

SEQ ID NO: 2473444 - RNA, 13 nt, Human
cacccaugggcuc

SEQ ID NO: 2473445 - RNA, 15 nt, Human
cacccaugaaucaaa

SEQ ID NO: 2473446 - RNA, 19 nt, Human
cacccaugaaucaaagaca

SEQ ID NO: 2473447 - RNA, 14 nt, Human
cacccagcucagca

SEQ ID NO: 2473448 - RNA, 22 nt, Human
cacccaugaagacaggacagug

SEQ ID NO: 2473449 - RNA, 14 nt, Human
cacccagccucagu

SEQ ID NO: 2473450 - RNA, 13 nt, Human
cacccagccucag

SEQ ID NO: 2473451 - RNA, 12 nt, Human
cacccagccuca

SEQ ID NO: 2473452 - RNA, 11 nt, Human
cacccagccuc

SEQ ID NO: 2473453 - RNA, 19 nt, Human
cacccagccucaguccucc

SEQ ID NO: 2473454 - RNA, 15 nt, Human
cacccagccucaguc

SEQ ID NO: 2473455 - RNA, 22 nt, Human
cacccagccucaguccuccccu

SEQ ID NO: 2473456 - RNA, 16 nt, Human
cacccaggagccccga

SEQ ID NO: 2473457 - RNA, 13 nt, Human
cacccaccucccu

SEQ ID NO: 2473458 - RNA, 14 nt, Human
cacccaccucccug

SEQ ID NO: 2473459 - RNA, 15 nt, Human
cacccaccucccugc

SEQ ID NO: 2473460 - RNA, 16 nt, Human
cacccaccucccugcc

SEQ ID NO: 2473461 - RNA, 18 nt, Human
cacccaccucccugccuc

SEQ ID NO: 2473462 - RNA, 21 nt, Human
cacccaccucccugccuccag

SEQ ID NO: 2473463 - RNA, 18 nt, Human
cacccaccucagccuccc

SEQ ID NO: 2473464 - RNA, 22 nt, Human
cacccagcccuggucucagcag

SEQ ID NO: 2473465 - RNA, 19 nt, Human
cacccagcccuggucucag

SEQ ID NO: 2473466 - RNA, 18 nt, Human
cacccagcccuggucuca

SEQ ID NO: 2473467 - RNA, 16 nt, Human
cacccagcccuggucu

SEQ ID NO: 2473468 - RNA, 14 nt, Human
cacccagcccuggu

SEQ ID NO: 2473469 - RNA, 13 nt, Human
cacccagcccugg

SEQ ID NO: 2473470 - RNA, 12 nt, Human
cacccagcccug

SEQ ID NO: 2473471 - RNA, 13 nt, Human
cacccacucagcu

SEQ ID NO: 2473472 - RNA, 14 nt, Human
cacccacucagcuc

SEQ ID NO: 2473473 - RNA, 22 nt, Human
cacccagcccauucucucuccu

SEQ ID NO: 2473474 - RNA, 23 nt, Human
cacccaccucccugccuccagga

SEQ ID NO: 2473475 - RNA, 23 nt, Human
cacccagcccauucucucuccug

SEQ ID NO: 2473476 - RNA, 16 nt, Human
caccagccccagugcc

SEQ ID NO: 2473477 - RNA, 15 nt, Human
caccaggcugugggc

SEQ ID NO: 2473478 - RNA, 16 nt, Human
caccaggcugugggcc

SEQ ID NO: 2473479 - RNA, 17 nt, Human
caccaggcugugggccu

SEQ ID NO: 2473480 - RNA, 21 nt, Human
caccagccaggcucugugcug

SEQ ID NO: 2473481 - RNA, 20 nt, Human
caccagccaggcucugugcu

SEQ ID NO: 2473482 - RNA, 13 nt, Human
caccagccccagu

SEQ ID NO: 2473483 - RNA, 17 nt, Human
cacccaccucagccucc

SEQ ID NO: 2473484 - RNA, 16 nt, Human
caccagggaugguacu

SEQ ID NO: 2473485 - RNA, 18 nt, Human
caccaggcugugggccuc

SEQ ID NO: 2473486 - RNA, 18 nt, Human
caccagggaaggggacaa

SEQ ID NO: 2473487 - RNA, 21 nt, Human
caccagggaaggggacaagga

SEQ ID NO: 2473488 - RNA, 13 nt, Human
caccagggaaggg

SEQ ID NO: 2473489 - RNA, 20 nt, Human
caccaggcuugccugcaggc

SEQ ID NO: 2473490 - RNA, 17 nt, Human
cacagacccugcccugu

SEQ ID NO: 2473491 - RNA, 16 nt, Human
cacagacccugcccug

SEQ ID NO: 2473492 - RNA, 14 nt, Human
cacagacccugccc

SEQ ID NO: 2473493 - RNA, 17 nt, Human
cacagaaaugagaucag

SEQ ID NO: 2473494 - RNA, 18 nt, Human
cacagaaagccuaucaaa

SEQ ID NO: 2473495 - RNA, 19 nt, Human
cacagaagaggcugguucu

SEQ ID NO: 2473496 - RNA, 18 nt, Human
cacagacccugcccugug

SEQ ID NO: 2473497 - RNA, 15 nt, Human
cacagcuccucccac

SEQ ID NO: 2473498 - RNA, 10 nt, Human
cacagcuccu

SEQ ID NO: 2473499 - RNA, 22 nt, Human
cacagaaaugagaucaggcucu

SEQ ID NO: 2473500 - RNA, 14 nt, Human
cacagcucuguccu

SEQ ID NO: 2473501 - RNA, 11 nt, Human
cacagcucugu

SEQ ID NO: 2473502 - RNA, 19 nt, Human
cacagcucuguccugggag

SEQ ID NO: 2473503 - RNA, 18 nt, Human
cacagcucuguccuggga

SEQ ID NO: 2473504 - RNA, 16 nt, Human
cacagcucuguccugg

SEQ ID NO: 2473505 - RNA, 15 nt, Human
cacagcucuguccug

SEQ ID NO: 2473506 - RNA, 15 nt, Human
cacagcucuucucca

SEQ ID NO: 2473507 - RNA, 14 nt, Human
cacagcucuucucc

SEQ ID NO: 2473508 - RNA, 20 nt, Human
cacagcucuccggucucucu

SEQ ID NO: 2473509 - RNA, 21 nt, Human
cacagcucuccggucucucuc

SEQ ID NO: 2473510 - RNA, 17 nt, Human
cacagcucuucuccagg

SEQ ID NO: 2473511 - RNA, 12 nt, Human
cacacauuuuuu

SEQ ID NO: 2473512 - RNA, 16 nt, Human
cacacauuuuuuaaau

SEQ ID NO: 2473513 - RNA, 19 nt, Human
cacacauuuuuuaaaugca

SEQ ID NO: 2473514 - RNA, 20 nt, Human
cacacauuuuuuaaaugcac

SEQ ID NO: 2473515 - RNA, 10 nt, Human
cacacauuuu

SEQ ID NO: 2473516 - RNA, 11 nt, Human
cacacauuuuu

SEQ ID NO: 2473517 - RNA, 18 nt, Human
cacacauggcuaauuuuu

SEQ ID NO: 2473518 - RNA, 23 nt, Human
cacaccaagcugugccacccugg

SEQ ID NO: 2473519 - RNA, 22 nt, Human
cacaccaagcugugccacccug

SEQ ID NO: 2473520 - RNA, 20 nt, Human
cacaccaagcugugccaccc

SEQ ID NO: 2473521 - RNA, 18 nt, Human
cacaccaagcugugccac

SEQ ID NO: 2473522 - RNA, 17 nt, Human
cacaccaagcugugcca

SEQ ID NO: 2473523 - RNA, 16 nt, Human
cacaccaagcugugcc

SEQ ID NO: 2473524 - RNA, 18 nt, Human
cacaccaagcagcaacag

SEQ ID NO: 2473525 - RNA, 18 nt, Human
cacacauuuguguaaaca

SEQ ID NO: 2473526 - RNA, 18 nt, Human
cacacuuguuccagcucu

SEQ ID NO: 2473527 - RNA, 19 nt, Human
cacacuuguuccagcucuu

SEQ ID NO: 2473528 - RNA, 20 nt, Human
cacacuuguuccagcucuuu

SEQ ID NO: 2473529 - RNA, 12 nt, Human
cacagaaaauau

SEQ ID NO: 2473530 - RNA, 13 nt, Human
cacagaaaauaua

SEQ ID NO: 2473531 - RNA, 14 nt, Human
cacagaaaauauac

SEQ ID NO: 2473532 - RNA, 15 nt, Human
cacagaaaauauacu

SEQ ID NO: 2473533 - RNA, 17 nt, Human
cacacuuuuuaagaaau

SEQ ID NO: 2473534 - RNA, 13 nt, Human
cacagaacccuug

SEQ ID NO: 2473535 - RNA, 23 nt, Human
cacagaaagccuaucaaagaccu

SEQ ID NO: 2473536 - RNA, 18 nt, Human
cacagaaagacugagcuc

SEQ ID NO: 2473537 - RNA, 22 nt, Human
cacagaaagacugagcucaagg

SEQ ID NO: 2473538 - RNA, 12 nt, Human
cacagaaagccu

SEQ ID NO: 2473539 - RNA, 16 nt, Human
cacagaaaauauacug

SEQ ID NO: 2473540 - RNA, 17 nt, Human
cacagaaaauauacugu

SEQ ID NO: 2473541 - RNA, 18 nt, Human
cacagaaaauauacugua

SEQ ID NO: 2473542 - RNA, 19 nt, Human
cacagaaaauauacuguaa

SEQ ID NO: 2473543 - RNA, 12 nt, Human
cacagaaaccuu

SEQ ID NO: 2473544 - RNA, 15 nt, Human
cacagaaagacugag

SEQ ID NO: 2473545 - RNA, 20 nt, Human
cacagaaaauauacuguaaa

SEQ ID NO: 2473546 - RNA, 19 nt, Human
cacagaaaccucuacuaaa

SEQ ID NO: 2473547 - RNA, 21 nt, Human
cacagggacuugaaguuguua

SEQ ID NO: 2473548 - RNA, 17 nt, Human
cacagggacuugaaguu

SEQ ID NO: 2473549 - RNA, 16 nt, Human
cacagggacuugaagu

SEQ ID NO: 2473550 - RNA, 14 nt, Human
cacagggacuugaa

SEQ ID NO: 2473551 - RNA, 22 nt, Human
cacagggacugaaaaccucucc

SEQ ID NO: 2473552 - RNA, 15 nt, Human
cccauucugccugcc

SEQ ID NO: 2473553 - RNA, 14 nt, Human
cccauucugccugc

SEQ ID NO: 2473554 - RNA, 15 nt, Human
cccauuucucacuga

SEQ ID NO: 2473555 - RNA, 20 nt, Human
cccauuucuauuuauuuacu

SEQ ID NO: 2473556 - RNA, 19 nt, Human
cccauucugccugcccagg

SEQ ID NO: 2473557 - RNA, 15 nt, Human
cccauuugcuccuuu

SEQ ID NO: 2473558 - RNA, 13 nt, Human
ccccagaggcugg

SEQ ID NO: 2473559 - RNA, 22 nt, Human
cccauuuuggaaguuuucagga

SEQ ID NO: 2473560 - RNA, 19 nt, Human
cccauuuugcaaaauuucc

SEQ ID NO: 2473561 - RNA, 22 nt, Human
cccauuuugcaaaauuuccagu

SEQ ID NO: 2473562 - RNA, 20 nt, Human
cccauuuuuauaucgaucuc

SEQ ID NO: 2473563 - RNA, 14 nt, Human
cccauuuucugugg

SEQ ID NO: 2473564 - RNA, 20 nt, Human
cccauuuuagucacuuuuuu

SEQ ID NO: 2473565 - RNA, 18 nt, Human
cccauuuuagucacuuuu

SEQ ID NO: 2473566 - RNA, 14 nt, Human
cccauuuuagucac

SEQ ID NO: 2473567 - RNA, 17 nt, Human
cccauuuugagugacuc

SEQ ID NO: 2473568 - RNA, 18 nt, Human
cccauuuugagugacucg

SEQ ID NO: 2473569 - RNA, 12 nt, Human
cccauuuugcaa

SEQ ID NO: 2473570 - RNA, 19 nt, Human
ccccauggucagcccuagg

SEQ ID NO: 2473571 - RNA, 22 nt, Human
ccccaugggaagacgaggcccu

SEQ ID NO: 2473572 - RNA, 16 nt, Human
ccccauguguccuggu

SEQ ID NO: 2473573 - RNA, 14 nt, Human
ccccauguguccug

SEQ ID NO: 2473574 - RNA, 15 nt, Human
ccccaugucucucag

SEQ ID NO: 2473575 - RNA, 17 nt, Human
ccccaugucucucagaa

SEQ ID NO: 2473576 - RNA, 23 nt, Human
cccccuucugggcaucuguucug

SEQ ID NO: 2473577 - RNA, 22 nt, Human
cccccuucugggcaucuguucu

SEQ ID NO: 2473578 - RNA, 14 nt, Human
cccccuucugggca

SEQ ID NO: 2473579 - RNA, 12 nt, Human
cccccuucuggg

SEQ ID NO: 2473580 - RNA, 23 nt, Human
ccccauuagcuuucaauuccgua

SEQ ID NO: 2473581 - RNA, 17 nt, Human
ccccauuagcuuucaau

SEQ ID NO: 2473582 - RNA, 23 nt, Human
ccccauguguccugguucccguu

SEQ ID NO: 2473583 - RNA, 18 nt, Human
ccccauguguccugguuc

SEQ ID NO: 2473584 - RNA, 17 nt, Human
ccccauuagagucagcc

SEQ ID NO: 2473585 - RNA, 21 nt, Human
ccccaugcuggagccugugua

SEQ ID NO: 2473586 - RNA, 20 nt, Human
ccccaugcuggagccugugu

SEQ ID NO: 2473587 - RNA, 19 nt, Human
ccccaugcuggagccugug

SEQ ID NO: 2473588 - RNA, 18 nt, Human
ccccaugcuggagccugu

SEQ ID NO: 2473589 - RNA, 17 nt, Human
ccccaugcuggagccug

SEQ ID NO: 2473590 - RNA, 16 nt, Human
ccccaugcuggagccu

SEQ ID NO: 2473591 - RNA, 15 nt, Human
ccccaugcuggagcc

SEQ ID NO: 2473592 - RNA, 14 nt, Human
ccccaugcuggagc

SEQ ID NO: 2473593 - RNA, 15 nt, Human
ccccaugcuggaggu

SEQ ID NO: 2473594 - RNA, 23 nt, Human
ccccaugcuggagccuguguaac

SEQ ID NO: 2473595 - RNA, 22 nt, Human
ccccaugcuggagccuguguaa

SEQ ID NO: 2473596 - RNA, 14 nt, Human
ccccaugcuguuga

SEQ ID NO: 2473597 - RNA, 18 nt, Human
ccccaugccuguccagcc

SEQ ID NO: 2473598 - RNA, 19 nt, Human
ccccaugccuguccagccu

SEQ ID NO: 2473599 - RNA, 20 nt, Human
ccccaugccuguccagccug

SEQ ID NO: 2473600 - RNA, 21 nt, Human
ccccaugccuguccagccugg

SEQ ID NO: 2473601 - RNA, 22 nt, Human
ccccaugccuguccagccuggg

SEQ ID NO: 2473602 - RNA, 23 nt, Human
ccccaugccuguccagccugggc

SEQ ID NO: 2473603 - RNA, 12 nt, Human
ccccaugcugga

SEQ ID NO: 2473604 - RNA, 15 nt, Human
ccccagcccagggug

SEQ ID NO: 2473605 - RNA, 24 nt, Human
ccccaugccuguccagccugggca

SEQ ID NO: 2473606 - RNA, 20 nt, Human
ccccagauugcaacaggcug

SEQ ID NO: 2473607 - RNA, 19 nt, Human
ccccagcccacccuccugu

SEQ ID NO: 2473608 - RNA, 18 nt, Human
ccccagauaccagccccu

SEQ ID NO: 2473609 - RNA, 16 nt, Human
ccccagcccacccucc

SEQ ID NO: 2473610 - RNA, 22 nt, Human
ccccagcccacccuccugucuu

SEQ ID NO: 2473611 - RNA, 20 nt, Human
ccccagcccacccuccuguc

SEQ ID NO: 2473612 - RNA, 11 nt, Human
ccccagcccag

SEQ ID NO: 2473613 - RNA, 17 nt, Human
ccccagaggcuggguga

SEQ ID NO: 2473614 - RNA, 18 nt, Human
ccccagaucaccagcccg

SEQ ID NO: 2473615 - RNA, 15 nt, Human
ccccagauaccagcc

SEQ ID NO: 2473616 - RNA, 22 nt, Human
ccccagagugugggaagggaga

SEQ ID NO: 2473617 - RNA, 15 nt, Human
ccccagauugcaaca

SEQ ID NO: 2473618 - RNA, 12 nt, Human
ccccagcccaga

SEQ ID NO: 2473619 - RNA, 13 nt, Human
ccccagcccagag

SEQ ID NO: 2473620 - RNA, 15 nt, Human
ccccagcccagagac

SEQ ID NO: 2473621 - RNA, 16 nt, Human
ccccagcccagagaca

SEQ ID NO: 2473622 - RNA, 15 nt, Human
ccccagcccagggcu

SEQ ID NO: 2473623 - RNA, 14 nt, Human
ccccagcccagggc

SEQ ID NO: 2473624 - RNA, 12 nt, Human
ccccagcccagg

SEQ ID NO: 2473625 - RNA, 13 nt, Human
ccccagcccaggg

SEQ ID NO: 2473626 - RNA, 21 nt, Human
ccccagcccagggcuccugca

SEQ ID NO: 2473627 - RNA, 20 nt, Human
ccccagcccagggcuccugc

SEQ ID NO: 2473628 - RNA, 12 nt, Human
ccccaugccugu

SEQ ID NO: 2473629 - RNA, 21 nt, Human
ccccagcccaggguuccccca

SEQ ID NO: 2473630 - RNA, 13 nt, Human
ccccaugccuguc

SEQ ID NO: 2473631 - RNA, 15 nt, Human
ccccaugccugucca

SEQ ID NO: 2473632 - RNA, 17 nt, Human
ccccaugccuguccagc

SEQ ID NO: 2473633 - RNA, 17 nt, Human
cccccuuugugcugugg

SEQ ID NO: 2473634 - RNA, 16 nt, Human
cccccuuugugcugug

SEQ ID NO: 2473635 - RNA, 14 nt, Human
cccccuuugugcug

SEQ ID NO: 2473636 - RNA, 20 nt, Human
cccccuuugggcccagggac

SEQ ID NO: 2473637 - RNA, 19 nt, Human
cccccuuugggcccaggga

SEQ ID NO: 2473638 - RNA, 18 nt, Human
cccccuuugggcccaggg

SEQ ID NO: 2473639 - RNA, 17 nt, Human
cccccuuugggcccagg

SEQ ID NO: 2473640 - RNA, 16 nt, Human
cccccuuugggcccag

SEQ ID NO: 2473641 - RNA, 20 nt, Human
cccccuuuccuggacacuca

SEQ ID NO: 2473642 - RNA, 22 nt, Human
cccccuuucagaugucuucugc

SEQ ID NO: 2473643 - RNA, 12 nt, Human
cccccuuuccug

SEQ ID NO: 2473644 - RNA, 18 nt, Human
cccccuuucagaugucuu

SEQ ID NO: 2473645 - RNA, 17 nt, Human
cccccuuucagaugucu

SEQ ID NO: 2473646 - RNA, 15 nt, Human
cccccuugccacccc

SEQ ID NO: 2473647 - RNA, 14 nt, Human
cccccuugaguggg

SEQ ID NO: 2473648 - RNA, 18 nt, Human
cccccuugccagacaugu

SEQ ID NO: 2473649 - RNA, 20 nt, Human
ccccgagggaugaugccaca

SEQ ID NO: 2473650 - RNA, 19 nt, Human
ccccgagggaugaugccac

SEQ ID NO: 2473651 - RNA, 18 nt, Human
ccccgagggaugaugcca

SEQ ID NO: 2473652 - RNA, 18 nt, Human
cccccuuugugcuguggg

SEQ ID NO: 2473653 - RNA, 22 nt, Human
ccccgagggaugaugccacacc

SEQ ID NO: 2473654 - RNA, 21 nt, Human
ccccgagggaugaugccacac

SEQ ID NO: 2473655 - RNA, 14 nt, Human
ccccgcacugggcu

SEQ ID NO: 2473656 - RNA, 21 nt, Human
ccccgaguuuccccagacacc

SEQ ID NO: 2473657 - RNA, 14 nt, Human
ccccgcagacaccu

SEQ ID NO: 2473658 - RNA, 17 nt, Human
ccccgcagaccucccca

SEQ ID NO: 2473659 - RNA, 14 nt, Human
ccccgcagaccucc

SEQ ID NO: 2473660 - RNA, 13 nt, Human
ccccgcagaccuc

SEQ ID NO: 2473661 - RNA, 12 nt, Human
ccccgcagaccu

SEQ ID NO: 2473662 - RNA, 18 nt, Human
cccaggaaaggcuccagg

SEQ ID NO: 2473663 - RNA, 17 nt, Human
cccaggaaaggcuccag

SEQ ID NO: 2473664 - RNA, 22 nt, Human
cccagcugggcucugccacccu

SEQ ID NO: 2473665 - RNA, 20 nt, Human
cccagcugggcucugccacc

SEQ ID NO: 2473666 - RNA, 19 nt, Human
cccagcugggcucugccac

SEQ ID NO: 2473667 - RNA, 18 nt, Human
cccagcugggcucugcca

SEQ ID NO: 2473668 - RNA, 15 nt, Human
cccaggcugagccuc

SEQ ID NO: 2473669 - RNA, 16 nt, Human
cccaggcugagccuca

SEQ ID NO: 2473670 - RNA, 17 nt, Human
cccaggcugagccucag

SEQ ID NO: 2473671 - RNA, 24 nt, Human
cccagcugggcucugccacccuac

SEQ ID NO: 2473672 - RNA, 18 nt, Human
cccaggcugagccucagu

SEQ ID NO: 2473673 - RNA, 13 nt, Human
cccaggcuggagu

SEQ ID NO: 2473674 - RNA, 22 nt, Human
cccaggcuuagucacugagaca

SEQ ID NO: 2473675 - RNA, 20 nt, Human
cccauccccccucaccaggg

SEQ ID NO: 2473676 - RNA, 16 nt, Human
cccauccccccucacc

SEQ ID NO: 2473677 - RNA, 15 nt, Human
cccauccccccucac

SEQ ID NO: 2473678 - RNA, 14 nt, Human
cccauccccccuca

SEQ ID NO: 2473679 - RNA, 12 nt, Human
cccauccccccu

SEQ ID NO: 2473680 - RNA, 23 nt, Human
cccaucaguguacccccgcccag

SEQ ID NO: 2473681 - RNA, 21 nt, Human
cccaucaguguacccccgccc

SEQ ID NO: 2473682 - RNA, 20 nt, Human
cccaucaguguacccccgcc

SEQ ID NO: 2473683 - RNA, 15 nt, Human
cccaucccccugccc

SEQ ID NO: 2473684 - RNA, 14 nt, Human
cccaucccccugcc

SEQ ID NO: 2473685 - RNA, 12 nt, Human
cccaucccccug

SEQ ID NO: 2473686 - RNA, 22 nt, Human
cccauccccccucaccaggggc

SEQ ID NO: 2473687 - RNA, 17 nt, Human
cccaucccccugcccuc

SEQ ID NO: 2473688 - RNA, 16 nt, Human
cccaucccccugcccu

SEQ ID NO: 2473689 - RNA, 21 nt, Human
cccauccccuggacugggagg

SEQ ID NO: 2473690 - RNA, 16 nt, Human
cccauccccgcagugu

SEQ ID NO: 2473691 - RNA, 19 nt, Human
cccaucaggacucuuguga

SEQ ID NO: 2473692 - RNA, 17 nt, Human
cccaucaggacucuugu

SEQ ID NO: 2473693 - RNA, 22 nt, Human
cccaucagugcucccucacaug

SEQ ID NO: 2473694 - RNA, 13 nt, Human
cccaucaguguac

SEQ ID NO: 2473695 - RNA, 23 nt, Human
cccaucagugcucccucacaugu

SEQ ID NO: 2473696 - RNA, 18 nt, Human
cccaucagcuccagcugc

SEQ ID NO: 2473697 - RNA, 13 nt, Human
cccaucacuggag

SEQ ID NO: 2473698 - RNA, 15 nt, Human
cccaucacuggagca

SEQ ID NO: 2473699 - RNA, 20 nt, Human
cccaucacuggagcaccagg

SEQ ID NO: 2473700 - RNA, 14 nt, Human
cccaucagaaggag

SEQ ID NO: 2473701 - RNA, 15 nt, Human
cccagggagcggaaa

SEQ ID NO: 2473702 - RNA, 16 nt, Human
cccaucacgccugugc

SEQ ID NO: 2473703 - RNA, 21 nt, Human
cccaucacaggguugggccca

SEQ ID NO: 2473704 - RNA, 22 nt, Human
cccaucacaggguugggcccag

SEQ ID NO: 2473705 - RNA, 20 nt, Human
cccagggacaccagccaggc

SEQ ID NO: 2473706 - RNA, 19 nt, Human
cccagggacaccagccagg

SEQ ID NO: 2473707 - RNA, 21 nt, Human
cccagggacaccagccaggcu

SEQ ID NO: 2473708 - RNA, 17 nt, Human
cccagggaccgaaaagu

SEQ ID NO: 2473709 - RNA, 14 nt, Human
cccagggagaggcc

SEQ ID NO: 2473710 - RNA, 18 nt, Human
cccagggagaggccauga

SEQ ID NO: 2473711 - RNA, 18 nt, Human
cccagggacaccagccag

SEQ ID NO: 2473712 - RNA, 17 nt, Human
cccagggacaccagcca

SEQ ID NO: 2473713 - RNA, 15 nt, Human
cccagggacaccagc

SEQ ID NO: 2473714 - RNA, 14 nt, Human
cccagggacaccag

SEQ ID NO: 2473715 - RNA, 13 nt, Human
cccagggaagugc

SEQ ID NO: 2473716 - RNA, 15 nt, Human
cccagggaaguuuug

SEQ ID NO: 2473717 - RNA, 17 nt, Human
cccagcugggcucugcc

SEQ ID NO: 2473718 - RNA, 14 nt, Human
cccagcugggcucu

SEQ ID NO: 2473719 - RNA, 13 nt, Human
cccagcugggcuc

SEQ ID NO: 2473720 - RNA, 12 nt, Human
cccagcugggcu

SEQ ID NO: 2473721 - RNA, 22 nt, Human
cccagcugggaggcaagagggg

SEQ ID NO: 2473722 - RNA, 21 nt, Human
cccagcugggaggcaagaggg

SEQ ID NO: 2473723 - RNA, 20 nt, Human
cccagcugggaggcaagagg

SEQ ID NO: 2473724 - RNA, 18 nt, Human
cccagcugggaggcaaga

SEQ ID NO: 2473725 - RNA, 17 nt, Human
cccagcugggaggcaag

SEQ ID NO: 2473726 - RNA, 15 nt, Human
cccagcugggaggca

SEQ ID NO: 2473727 - RNA, 14 nt, Human
cccagcugggaggc

SEQ ID NO: 2473728 - RNA, 13 nt, Human
cccagcugggagg

SEQ ID NO: 2473729 - RNA, 12 nt, Human
cccagcugggag

SEQ ID NO: 2473730 - RNA, 11 nt, Human
cccagcuggga

SEQ ID NO: 2473731 - RNA, 20 nt, Human
cccagcuggcccgugacaga

SEQ ID NO: 2473732 - RNA, 11 nt, Human
cccagcuggcc

SEQ ID NO: 2473733 - RNA, 16 nt, Human
cccaggaaaggcucca

SEQ ID NO: 2473734 - RNA, 15 nt, Human
cccaggaaaggcucc

SEQ ID NO: 2473735 - RNA, 21 nt, Human
cccagccaucugcccaggggu

SEQ ID NO: 2473736 - RNA, 20 nt, Human
cccagccaucugcccagggg

SEQ ID NO: 2473737 - RNA, 18 nt, Human
cccagccaucugcccagg

SEQ ID NO: 2473738 - RNA, 17 nt, Human
cccagccaucugcccag

SEQ ID NO: 2473739 - RNA, 16 nt, Human
cccagccaucugccca

SEQ ID NO: 2473740 - RNA, 15 nt, Human
cccagccaucugccc

SEQ ID NO: 2473741 - RNA, 13 nt, Human
cccagccaucugc

SEQ ID NO: 2473742 - RNA, 23 nt, Human
cccagccaucugcccaggggugc

SEQ ID NO: 2473743 - RNA, 10 nt, Human
cccagccauu

SEQ ID NO: 2473744 - RNA, 14 nt, Human
cccagcugcucccc

SEQ ID NO: 2473745 - RNA, 22 nt, Human
cccagccaucugcccaggggug

SEQ ID NO: 2473746 - RNA, 18 nt, Human
cccagccauuaccaugga

SEQ ID NO: 2473747 - RNA, 15 nt, Human
cccagcugcuccccu

SEQ ID NO: 2473748 - RNA, 21 nt, Human
cccagcugcuccccucccucc

SEQ ID NO: 2473749 - RNA, 15 nt, Human
cccagcugcuugugu

SEQ ID NO: 2473750 - RNA, 13 nt, Human
cccagcacccagc

SEQ ID NO: 2473751 - RNA, 19 nt, Human
cccagcacccgggcucagg

SEQ ID NO: 2473752 - RNA, 12 nt, Human
cccagcacccgg

SEQ ID NO: 2473753 - RNA, 18 nt, Human
cccagcacaugaaaccuu

SEQ ID NO: 2473754 - RNA, 15 nt, Human
cccagcacccagcaa

SEQ ID NO: 2473755 - RNA, 21 nt, Human
cccagcacccgggcucaggga

SEQ ID NO: 2473756 - RNA, 22 nt, Human
cccagcacccgggcucagggac

SEQ ID NO: 2473757 - RNA, 16 nt, Human
cccagcacuaaagcag

SEQ ID NO: 2473758 - RNA, 13 nt, Human
cccagcacugagg

SEQ ID NO: 2473759 - RNA, 17 nt, Human
cccagcacuaaagcagu

SEQ ID NO: 2473760 - RNA, 21 nt, Human
cccagccaggccccaggcagg

SEQ ID NO: 2473761 - RNA, 19 nt, Human
cccagcacagcuugaccug

SEQ ID NO: 2473762 - RNA, 18 nt, Human
cccagcacagcuugaccu

SEQ ID NO: 2473763 - RNA, 17 nt, Human
cccacugcacccccucc

SEQ ID NO: 2473764 - RNA, 16 nt, Human
cccacugcacccccuc

SEQ ID NO: 2473765 - RNA, 16 nt, Human
cccacuggacucaccu

SEQ ID NO: 2473766 - RNA, 15 nt, Human
cccacuggcagcauc

SEQ ID NO: 2473767 - RNA, 21 nt, Human
cccacuggggaaauaacagcu

SEQ ID NO: 2473768 - RNA, 21 nt, Human
cccacugggguccagggagca

SEQ ID NO: 2473769 - RNA, 22 nt, Human
cccauccucuguacagagccca

SEQ ID NO: 2473770 - RNA, 21 nt, Human
cccauccucuguacagagccc

SEQ ID NO: 2473771 - RNA, 21 nt, Human
cccauccuaccaaugcaugca

SEQ ID NO: 2473772 - RNA, 20 nt, Human
cccauccuaccaaugcaugc

SEQ ID NO: 2473773 - RNA, 19 nt, Human
cccauccuaccaaugcaug

SEQ ID NO: 2473774 - RNA, 17 nt, Human
cccauccuaccaaugca

SEQ ID NO: 2473775 - RNA, 18 nt, Human
cccaucccugccugguca

SEQ ID NO: 2473776 - RNA, 17 nt, Human
cccaucccugccugguc

SEQ ID NO: 2473777 - RNA, 15 nt, Human
cccaucccugccugg

SEQ ID NO: 2473778 - RNA, 16 nt, Human
cccaucccuccccagu

SEQ ID NO: 2473779 - RNA, 15 nt, Human
cccaucccuccccag

SEQ ID NO: 2473780 - RNA, 14 nt, Human
cccaucccugccug

SEQ ID NO: 2473781 - RNA, 13 nt, Human
cccaucccugccu

SEQ ID NO: 2473782 - RNA, 12 nt, Human
cccaucccugcc

SEQ ID NO: 2473783 - RNA, 17 nt, Human
cccauccuggcccauca

SEQ ID NO: 2473784 - RNA, 16 nt, Human
cccauccuggcccauc

SEQ ID NO: 2473785 - RNA, 15 nt, Human
cccauccuggcccau

SEQ ID NO: 2473786 - RNA, 14 nt, Human
cccauccuggccca

SEQ ID NO: 2473787 - RNA, 18 nt, Human
cccauccuggcccaucag

SEQ ID NO: 2473788 - RNA, 14 nt, Human
cccauccuacccuc

SEQ ID NO: 2473789 - RNA, 13 nt, Human
cccauccuacccu

SEQ ID NO: 2473790 - RNA, 12 nt, Human
cccauccuaccc

SEQ ID NO: 2473791 - RNA, 13 nt, Human
cccauccuggccc

SEQ ID NO: 2473792 - RNA, 14 nt, Human
cccuccuccacucu

SEQ ID NO: 2473793 - RNA, 13 nt, Human
cccuccuccacuc

SEQ ID NO: 2473794 - RNA, 12 nt, Human
cccuccuccacu

SEQ ID NO: 2473795 - RNA, 16 nt, Human
cccuccucucugcccu

SEQ ID NO: 2473796 - RNA, 15 nt, Human
cccuccucucugccc

SEQ ID NO: 2473797 - RNA, 11 nt, Human
cccuccucugc

SEQ ID NO: 2473798 - RNA, 12 nt, Human
cccuccucugcc

SEQ ID NO: 2473799 - RNA, 15 nt, Human
cccuccugucuuccc

SEQ ID NO: 2473800 - RNA, 14 nt, Human
cccuccugucuucc

SEQ ID NO: 2473801 - RNA, 12 nt, Human
cccuccugucuu

SEQ ID NO: 2473802 - RNA, 13 nt, Human
cccuccuguaaau

SEQ ID NO: 2473803 - RNA, 18 nt, Human
cccuccugucuucccagg

SEQ ID NO: 2473804 - RNA, 16 nt, Human
cccuccugucuuccca

SEQ ID NO: 2473805 - RNA, 19 nt, Human
cccuccugggaucugcucg

SEQ ID NO: 2473806 - RNA, 17 nt, Human
cccuccugggaucugcu

SEQ ID NO: 2473807 - RNA, 11 nt, Human
cccuccuggga

SEQ ID NO: 2473808 - RNA, 12 nt, Human
cccuccugcugc

SEQ ID NO: 2473809 - RNA, 11 nt, Human
cccuccugcug

SEQ ID NO: 2473810 - RNA, 20 nt, Human
cccuccugccgacuccuggg

SEQ ID NO: 2473811 - RNA, 19 nt, Human
cccuccugccgacuccugg

SEQ ID NO: 2473812 - RNA, 13 nt, Human
cccuccugcugca

SEQ ID NO: 2473813 - RNA, 13 nt, Human
cccuccuggcucu

SEQ ID NO: 2473814 - RNA, 18 nt, Human
cccuccugccgacuccug

SEQ ID NO: 2473815 - RNA, 13 nt, Human
cccuccucugcca

SEQ ID NO: 2473816 - RNA, 16 nt, Human
cccuccucugccaccu

SEQ ID NO: 2473817 - RNA, 18 nt, Human
cccuccugaaacuuacac

SEQ ID NO: 2473818 - RNA, 21 nt, Human
cccuccucacuggccaucccu

SEQ ID NO: 2473819 - RNA, 19 nt, Human
cccuccucacuggccaucc

SEQ ID NO: 2473820 - RNA, 16 nt, Human
cccuccucacuggcca

SEQ ID NO: 2473821 - RNA, 15 nt, Human
cccuccucacuggcc

SEQ ID NO: 2473822 - RNA, 12 nt, Human
cccuccucacug

SEQ ID NO: 2473823 - RNA, 14 nt, Human
cccuccucacuggc

SEQ ID NO: 2473824 - RNA, 14 nt, Human
cccuccucaccccg

SEQ ID NO: 2473825 - RNA, 16 nt, Human
cccuccucaccucugg

SEQ ID NO: 2473826 - RNA, 17 nt, Human
cccuccucaccucugga

SEQ ID NO: 2473827 - RNA, 18 nt, Human
cccuccucaccucuggac

SEQ ID NO: 2473828 - RNA, 23 nt, Human
cccuccucaccucuggacuggcu

SEQ ID NO: 2473829 - RNA, 21 nt, Human
cccuccuaucaccuccccucc

SEQ ID NO: 2473830 - RNA, 13 nt, Human
cccuccucacccc

SEQ ID NO: 2473831 - RNA, 12 nt, Human
cccuccucaccu

SEQ ID NO: 2473832 - RNA, 13 nt, Human
cccuccucaccuc

SEQ ID NO: 2473833 - RNA, 14 nt, Human
ccccucugcccugc

SEQ ID NO: 2473834 - RNA, 15 nt, Human
ccccucugcccugcg

SEQ ID NO: 2473835 - RNA, 20 nt, Human
ccccucugcccugcggguca

SEQ ID NO: 2473836 - RNA, 23 nt, Human
ccccucugcccugcgggucacag

SEQ ID NO: 2473837 - RNA, 16 nt, Human
ccccucugcugcuguc

SEQ ID NO: 2473838 - RNA, 13 nt, Human
ccccugcacucca

SEQ ID NO: 2473839 - RNA, 21 nt, Human
ccccugcaaagcccagcuuga

SEQ ID NO: 2473840 - RNA, 18 nt, Human
ccccugcaaagcccagcu

SEQ ID NO: 2473841 - RNA, 20 nt, Human
ccccugcaaagcccagcuug

SEQ ID NO: 2473842 - RNA, 17 nt, Human
ccccugcaaagcccagc

SEQ ID NO: 2473843 - RNA, 17 nt, Human
ccccugaaacuuauuuu

SEQ ID NO: 2473844 - RNA, 16 nt, Human
ccccugaaacuuauuu

SEQ ID NO: 2473845 - RNA, 13 nt, Human
ccccugaaacuua

SEQ ID NO: 2473846 - RNA, 15 nt, Human
ccccugacaacacuc

SEQ ID NO: 2473847 - RNA, 16 nt, Human
ccccucuggcuccagc

SEQ ID NO: 2473848 - RNA, 18 nt, Human
ccccucuugccccaaccc

SEQ ID NO: 2473849 - RNA, 13 nt, Human
ccccucuggccag

SEQ ID NO: 2473850 - RNA, 22 nt, Human
ccccucuugccccaacccccag

SEQ ID NO: 2473851 - RNA, 16 nt, Human
ccccucuggccaggau

SEQ ID NO: 2473852 - RNA, 21 nt, Human
ccccugccaccucccugaccc

SEQ ID NO: 2473853 - RNA, 18 nt, Human
ccccugccaccucccuga

SEQ ID NO: 2473854 - RNA, 20 nt, Human
ccccugccaccaggccaccu

SEQ ID NO: 2473855 - RNA, 12 nt, Human
ccccugccacca

SEQ ID NO: 2473856 - RNA, 10 nt, Human
ccccugccag

SEQ ID NO: 2473857 - RNA, 16 nt, Human
ccccugccacccuggg

SEQ ID NO: 2473858 - RNA, 14 nt, Human
ccccugccacccug

SEQ ID NO: 2473859 - RNA, 19 nt, Human
ccccugcccccaggacugg

SEQ ID NO: 2473860 - RNA, 18 nt, Human
ccccugcccccaggacug

SEQ ID NO: 2473861 - RNA, 17 nt, Human
ccccugccccccagccu

SEQ ID NO: 2473862 - RNA, 23 nt, Human
ccccugcccccaggacugggcca

SEQ ID NO: 2473863 - RNA, 16 nt, Human
ccccugccccagccca

SEQ ID NO: 2473864 - RNA, 14 nt, Human
ccccugccccagcc

SEQ ID NO: 2473865 - RNA, 12 nt, Human
ccccugccccca

SEQ ID NO: 2473866 - RNA, 17 nt, Human
ccccugcccccaggacu

SEQ ID NO: 2473867 - RNA, 16 nt, Human
ccccugcccccaggac

SEQ ID NO: 2473868 - RNA, 14 nt, Human
ccccugccagggca

SEQ ID NO: 2473869 - RNA, 15 nt, Human
ccccugccagggcag

SEQ ID NO: 2473870 - RNA, 19 nt, Human
ccccugccagggcagggcc

SEQ ID NO: 2473871 - RNA, 23 nt, Human
ccccugccagggcagggccccag

SEQ ID NO: 2473872 - RNA, 13 nt, Human
ccccugccccagc

SEQ ID NO: 2473873 - RNA, 18 nt, Human
ccccugcccaucugggaa

SEQ ID NO: 2473874 - RNA, 14 nt, Human
ccccugcccaucug

SEQ ID NO: 2473875 - RNA, 14 nt, Human
ccccugccagugcc

SEQ ID NO: 2473876 - RNA, 15 nt, Human
ccccugccagugccu

SEQ ID NO: 2473877 - RNA, 16 nt, Human
ccccugccagugccuu

SEQ ID NO: 2473878 - RNA, 17 nt, Human
ccccugccagugccuua

SEQ ID NO: 2473879 - RNA, 22 nt, Human
cccggcccuaccagcgcccgcu

SEQ ID NO: 2473880 - RNA, 18 nt, Human
cccggccccggccccagc

SEQ ID NO: 2473881 - RNA, 21 nt, Human
cccggcccccuggucucuggu

SEQ ID NO: 2473882 - RNA, 13 nt, Human
cccggcccccugg

SEQ ID NO: 2473883 - RNA, 18 nt, Human
cccggccgccgcccugcu

SEQ ID NO: 2473884 - RNA, 22 nt, Human
cccggcccugggcucggaggcu

SEQ ID NO: 2473885 - RNA, 16 nt, Human
cccggccccugcuggu

SEQ ID NO: 2473886 - RNA, 12 nt, Human
cccggcccccug

SEQ ID NO: 2473887 - RNA, 16 nt, Human
cccggccccagccaga

SEQ ID NO: 2473888 - RNA, 15 nt, Human
cccggccccagccag

SEQ ID NO: 2473889 - RNA, 14 nt, Human
cccggccccagcca

SEQ ID NO: 2473890 - RNA, 13 nt, Human
cccggccccagcc

SEQ ID NO: 2473891 - RNA, 19 nt, Human
cccggccauguccuuagca

SEQ ID NO: 2473892 - RNA, 11 nt, Human
cccggccagcc

SEQ ID NO: 2473893 - RNA, 15 nt, Human
cccggccccugcugg

SEQ ID NO: 2473894 - RNA, 15 nt, Human
cccgggaagggggcu

SEQ ID NO: 2473895 - RNA, 20 nt, Human
cccggcuaauuuuuguauuu

SEQ ID NO: 2473896 - RNA, 15 nt, Human
cccggcgcccucugu

SEQ ID NO: 2473897 - RNA, 14 nt, Human
cccggcgcccucug

SEQ ID NO: 2473898 - RNA, 21 nt, Human
cccggccugcucccagcagcc

SEQ ID NO: 2473899 - RNA, 20 nt, Human
cccggccugcucccagcagc

SEQ ID NO: 2473900 - RNA, 18 nt, Human
cccggccugcucccagca

SEQ ID NO: 2473901 - RNA, 17 nt, Human
cccggccugcucccagc

SEQ ID NO: 2473902 - RNA, 18 nt, Human
cccggccucagcaccccu

SEQ ID NO: 2473903 - RNA, 20 nt, Human
cccggcgcccucuguccuga

SEQ ID NO: 2473904 - RNA, 18 nt, Human
cccggcgcccucuguccu

SEQ ID NO: 2473905 - RNA, 16 nt, Human
cccggcgcccucuguc

SEQ ID NO: 2473906 - RNA, 19 nt, Human
cccggcgcccucuguccug

SEQ ID NO: 2473907 - RNA, 14 nt, Human
cccggcgcgguggc

SEQ ID NO: 2473908 - RNA, 19 nt, Human
cccggcgcgguggcucacg

SEQ ID NO: 2473909 - RNA, 22 nt, Human
cccggcgcgguggcucacgccu

SEQ ID NO: 2473910 - RNA, 18 nt, Human
cccgaauagcugggacua

SEQ ID NO: 2473911 - RNA, 17 nt, Human
cccgaauagcugggacu

SEQ ID NO: 2473912 - RNA, 16 nt, Human
cccgaauagcugggac

SEQ ID NO: 2473913 - RNA, 13 nt, Human
ccccuucugaccc

SEQ ID NO: 2473914 - RNA, 19 nt, Human
ccccuucucuccuccccaa

SEQ ID NO: 2473915 - RNA, 15 nt, Human
ccccuucucuccucc

SEQ ID NO: 2473916 - RNA, 12 nt, Human
ccccuucucugc

SEQ ID NO: 2473917 - RNA, 13 nt, Human
ccccuucucugcu

SEQ ID NO: 2473918 - RNA, 14 nt, Human
ccccuucucugcuc

SEQ ID NO: 2473919 - RNA, 14 nt, Human
ccccuucugaccca

SEQ ID NO: 2473920 - RNA, 16 nt, Human
ccccuucucugcucca

SEQ ID NO: 2473921 - RNA, 22 nt, Human
ccccuucucugcuccaccacau

SEQ ID NO: 2473922 - RNA, 19 nt, Human
cccucaacaagggagagac

SEQ ID NO: 2473923 - RNA, 18 nt, Human
cccucaacaagggagaga

SEQ ID NO: 2473924 - RNA, 17 nt, Human
cccucaacaagggagag

SEQ ID NO: 2473925 - RNA, 20 nt, Human
cccucaaaugacccaaagac

SEQ ID NO: 2473926 - RNA, 16 nt, Human
cccucaaccucuucug

SEQ ID NO: 2473927 - RNA, 16 nt, Human
cccucaacucuccucc

SEQ ID NO: 2473928 - RNA, 16 nt, Human
cccucacccuggggcu

SEQ ID NO: 2473929 - RNA, 21 nt, Human
cccucaacaagggagagaccu

SEQ ID NO: 2473930 - RNA, 15 nt, Human
cccucacccuggggc

SEQ ID NO: 2473931 - RNA, 14 nt, Human
cccucaccuccucu

SEQ ID NO: 2473932 - RNA, 14 nt, Human
cccucaccugggca

SEQ ID NO: 2473933 - RNA, 15 nt, Human
cccucaccugggcac

SEQ ID NO: 2473934 - RNA, 21 nt, Human
cccgggaagggggcugggaca

SEQ ID NO: 2473935 - RNA, 18 nt, Human
cccgggaagggggcuggg

SEQ ID NO: 2473936 - RNA, 19 nt, Human
cccucaaaugacccaaaga

SEQ ID NO: 2473937 - RNA, 18 nt, Human
cccucaaaugacccaaag

SEQ ID NO: 2473938 - RNA, 17 nt, Human
cccggcuaauuuuugua

SEQ ID NO: 2473939 - RNA, 16 nt, Human
cccucaacaccucugc

SEQ ID NO: 2473940 - RNA, 12 nt, Human
cccucagcucca

SEQ ID NO: 2473941 - RNA, 13 nt, Human
cccucaggacugc

SEQ ID NO: 2473942 - RNA, 17 nt, Human
cccucaggacugcaaca

SEQ ID NO: 2473943 - RNA, 18 nt, Human
cccucaggcauaggccug

SEQ ID NO: 2473944 - RNA, 19 nt, Human
cccucaggcauaggccugg

SEQ ID NO: 2473945 - RNA, 20 nt, Human
cccucaggcauaggccuggg

SEQ ID NO: 2473946 - RNA, 21 nt, Human
cccucaggcauaggccugggu

SEQ ID NO: 2473947 - RNA, 22 nt, Human
cccucaggcauaggccugggug

SEQ ID NO: 2473948 - RNA, 12 nt, Human
cccucagggauc

SEQ ID NO: 2473949 - RNA, 23 nt, Human
cccucaggcauaggccugggugc

SEQ ID NO: 2473950 - RNA, 16 nt, Human
cccucagcaccccuuc

SEQ ID NO: 2473951 - RNA, 21 nt, Human
cccucaccuuggcaccagaca

SEQ ID NO: 2473952 - RNA, 23 nt, Human
cccucaccuuggcaccagacacc

SEQ ID NO: 2473953 - RNA, 21 nt, Human
cccucaccuugcaacacacag

SEQ ID NO: 2473954 - RNA, 20 nt, Human
cccucaccuuggcaccagac

SEQ ID NO: 2473955 - RNA, 18 nt, Human
cccucaccuugcaacaca

SEQ ID NO: 2473956 - RNA, 21 nt, Human
cccucaccuguagcagccagu

SEQ ID NO: 2473957 - RNA, 17 nt, Human
cccucaccugggcaccu

SEQ ID NO: 2473958 - RNA, 23 nt, Human
cccucaccugggcaccuggggag

SEQ ID NO: 2473959 - RNA, 23 nt, Human
cccucagccccucuugcccccca

SEQ ID NO: 2473960 - RNA, 17 nt, Human
cccucagccccucuugc

SEQ ID NO: 2473961 - RNA, 21 nt, Human
cccucagccccucuugccccc

SEQ ID NO: 2473962 - RNA, 20 nt, Human
cccucagccccaccccaggu

SEQ ID NO: 2473963 - RNA, 12 nt, Human
cccucagccccu

SEQ ID NO: 2473964 - RNA, 13 nt, Human
cccucagccccuc

SEQ ID NO: 2473965 - RNA, 14 nt, Human
cccucagccccucu

SEQ ID NO: 2473966 - RNA, 19 nt, Human
cccucagccccaccccagg

SEQ ID NO: 2473967 - RNA, 21 nt, Human
cccucagcaccccuuccaugu

SEQ ID NO: 2473968 - RNA, 19 nt, Human
cccucagcaccccuuccau

SEQ ID NO: 2473969 - RNA, 18 nt, Human
cccucagcaccccuucca

SEQ ID NO: 2473970 - RNA, 17 nt, Human
cccucagcaccccuucc

SEQ ID NO: 2473971 - RNA, 23 nt, Human
ccaggaucaugguguaauaagac

SEQ ID NO: 2473972 - RNA, 20 nt, Human
ccaggaucaugguguaauaa

SEQ ID NO: 2473973 - RNA, 17 nt, Human
ccaggaucaugguguaa

SEQ ID NO: 2473974 - RNA, 15 nt, Human
ccaggaucauggugu

SEQ ID NO: 2473975 - RNA, 21 nt, Human
ccaggaucagauugcauguga

SEQ ID NO: 2473976 - RNA, 14 nt, Human
ccaggaucauggug

SEQ ID NO: 2473977 - RNA, 19 nt, Human
ccaggaucagauugcaugu

SEQ ID NO: 2473978 - RNA, 17 nt, Human
ccaggauccagaagggg

SEQ ID NO: 2473979 - RNA, 20 nt, Human
ccaggaugagcaucccagga

SEQ ID NO: 2473980 - RNA, 21 nt, Human
ccaggauggaacacggccaca

SEQ ID NO: 2473981 - RNA, 23 nt, Human
ccaggauagugggcaccccacug

SEQ ID NO: 2473982 - RNA, 14 nt, Human
ccaggaucagauug

SEQ ID NO: 2473983 - RNA, 18 nt, Human
ccaggaucagauugcaug

SEQ ID NO: 2473984 - RNA, 17 nt, Human
ccaggcuggcgcagcca

SEQ ID NO: 2473985 - RNA, 16 nt, Human
ccaggcuggcgcagcc

SEQ ID NO: 2473986 - RNA, 15 nt, Human
ccaggcuggcgcagc

SEQ ID NO: 2473987 - RNA, 14 nt, Human
ccaggcuggcgcag

SEQ ID NO: 2473988 - RNA, 13 nt, Human
ccaggcuggcgca

SEQ ID NO: 2473989 - RNA, 23 nt, Human
ccaggcuggccagccccacagcc

SEQ ID NO: 2473990 - RNA, 22 nt, Human
ccaggcuggccagccccacagc

SEQ ID NO: 2473991 - RNA, 21 nt, Human
ccaggcuggccagccccacag

SEQ ID NO: 2473992 - RNA, 20 nt, Human
ccaggcuggccagccccaca

SEQ ID NO: 2473993 - RNA, 18 nt, Human
ccaggcuggccagcccca

SEQ ID NO: 2473994 - RNA, 17 nt, Human
ccaggcuggccagcccc

SEQ ID NO: 2473995 - RNA, 16 nt, Human
ccaggcuggccagccc

SEQ ID NO: 2473996 - RNA, 15 nt, Human
ccaggcuggccagcc

SEQ ID NO: 2473997 - RNA, 14 nt, Human
ccaggcuggccagc

SEQ ID NO: 2473998 - RNA, 13 nt, Human
ccaggcuggccag

SEQ ID NO: 2473999 - RNA, 22 nt, Human
ccaggcuggcgcagccaaggcc

SEQ ID NO: 2474000 - RNA, 21 nt, Human
ccaggcuggcgcagccaaggc

SEQ ID NO: 2474001 - RNA, 19 nt, Human
ccaggcuggcgcagccaag

SEQ ID NO: 2474002 - RNA, 18 nt, Human
ccaggcuggcgcagccaa

SEQ ID NO: 2474003 - RNA, 12 nt, Human
ccaggcuggcgu

SEQ ID NO: 2474004 - RNA, 19 nt, Human
ccaggggaaagaugagcuu

SEQ ID NO: 2474005 - RNA, 23 nt, Human
ccaggcuggcgcagccaaggccg

SEQ ID NO: 2474006 - RNA, 21 nt, Human
ccaggggaaaaucagccugcu

SEQ ID NO: 2474007 - RNA, 14 nt, Human
ccaggggagcccuc

SEQ ID NO: 2474008 - RNA, 13 nt, Human
ccaggggagcccu

SEQ ID NO: 2474009 - RNA, 16 nt, Human
ccaggggaguuguguc

SEQ ID NO: 2474010 - RNA, 18 nt, Human
ccaggggaguugugucug

SEQ ID NO: 2474011 - RNA, 18 nt, Human
ccaggggaccacaccucc

SEQ ID NO: 2474012 - RNA, 13 nt, Human
ccaggggaccaca

SEQ ID NO: 2474013 - RNA, 21 nt, Human
ccaggggagagggucuggaga

SEQ ID NO: 2474014 - RNA, 18 nt, Human
ccaggggagagggucugg

SEQ ID NO: 2474015 - RNA, 20 nt, Human
ccaggggagagggucuggag

SEQ ID NO: 2474016 - RNA, 12 nt, Human
ccaggcuggcca

SEQ ID NO: 2474017 - RNA, 14 nt, Human
ccaggcugcuggac

SEQ ID NO: 2474018 - RNA, 21 nt, Human
ccaggcugcucuugaacuccu

SEQ ID NO: 2474019 - RNA, 19 nt, Human
ccaggcugcucagggcugg

SEQ ID NO: 2474020 - RNA, 17 nt, Human
ccaggcugcucagggcu

SEQ ID NO: 2474021 - RNA, 14 nt, Human
ccaggcugccgugg

SEQ ID NO: 2474022 - RNA, 19 nt, Human
ccaggcugccaaggccaga

SEQ ID NO: 2474023 - RNA, 20 nt, Human
ccaggcugccaaggccagag

SEQ ID NO: 2474024 - RNA, 18 nt, Human
ccaggcugccguggggcc

SEQ ID NO: 2474025 - RNA, 15 nt, Human
ccaggcugccguggg

SEQ ID NO: 2474026 - RNA, 13 nt, Human
ccaggcugcucag

SEQ ID NO: 2474027 - RNA, 14 nt, Human
ccaggcaggucuug

SEQ ID NO: 2474028 - RNA, 12 nt, Human
ccaggcaggucu

SEQ ID NO: 2474029 - RNA, 23 nt, Human
ccaggcaggucuugaacuccugg

SEQ ID NO: 2474030 - RNA, 17 nt, Human
ccaggcaggugccugga

SEQ ID NO: 2474031 - RNA, 22 nt, Human
ccaggauggaggggugguccug

SEQ ID NO: 2474032 - RNA, 20 nt, Human
ccaggauggcccuucccacu

SEQ ID NO: 2474033 - RNA, 19 nt, Human
ccaggcagguagccagggg

SEQ ID NO: 2474034 - RNA, 17 nt, Human
ccaggaucccaggggcc

SEQ ID NO: 2474035 - RNA, 14 nt, Human
ccaggauggagggg

SEQ ID NO: 2474036 - RNA, 18 nt, Human
ccaguccuagcugcacag

SEQ ID NO: 2474037 - RNA, 14 nt, Human
ccaguccccuuugu

SEQ ID NO: 2474038 - RNA, 12 nt, Human
ccagucccuggg

SEQ ID NO: 2474039 - RNA, 13 nt, Human
ccagucccugggg

SEQ ID NO: 2474040 - RNA, 15 nt, Human
ccagucccuggggga

SEQ ID NO: 2474041 - RNA, 19 nt, Human
ccagucccugggggaagcc

SEQ ID NO: 2474042 - RNA, 22 nt, Human
ccagucccugggggaagcccug

SEQ ID NO: 2474043 - RNA, 23 nt, Human
ccagucccugggggaagcccugg

SEQ ID NO: 2474044 - RNA, 15 nt, Human
ccagucccugaggca

SEQ ID NO: 2474045 - RNA, 17 nt, Human
ccaguccccgugccccg

SEQ ID NO: 2474046 - RNA, 15 nt, Human
ccaguccccgugccc

SEQ ID NO: 2474047 - RNA, 22 nt, Human
ccaguccccgugccccgccucc

SEQ ID NO: 2474048 - RNA, 18 nt, Human
ccagucccccugccccag

SEQ ID NO: 2474049 - RNA, 17 nt, Human
ccaggggugcccccucc

SEQ ID NO: 2474050 - RNA, 16 nt, Human
ccaggggugcccccuc

SEQ ID NO: 2474051 - RNA, 15 nt, Human
ccaggggugcccccu

SEQ ID NO: 2474052 - RNA, 13 nt, Human
ccaggggugcccc

SEQ ID NO: 2474053 - RNA, 19 nt, Human
ccagucagguaguugcaau

SEQ ID NO: 2474054 - RNA, 18 nt, Human
ccaguccaaauguccucc

SEQ ID NO: 2474055 - RNA, 19 nt, Human
ccaguccaggcugccgugg

SEQ ID NO: 2474056 - RNA, 16 nt, Human
ccaguccaggcugccg

SEQ ID NO: 2474057 - RNA, 15 nt, Human
ccaguccaggcugcc

SEQ ID NO: 2474058 - RNA, 14 nt, Human
ccaguccaggcugc

SEQ ID NO: 2474059 - RNA, 22 nt, Human
ccaguccaaucucauggagaag

SEQ ID NO: 2474060 - RNA, 13 nt, Human
ccaguccaggcug

SEQ ID NO: 2474061 - RNA, 21 nt, Human
ccaguccaaucucauggagaa

SEQ ID NO: 2474062 - RNA, 14 nt, Human
ccaguccaaggaaa

SEQ ID NO: 2474063 - RNA, 21 nt, Human
ccaguccaaauguccuccaga

SEQ ID NO: 2474064 - RNA, 19 nt, Human
ccaggggucucccuggagu

SEQ ID NO: 2474065 - RNA, 18 nt, Human
ccaggggucucccuggag

SEQ ID NO: 2474066 - RNA, 17 nt, Human
ccaggggucucccugga

SEQ ID NO: 2474067 - RNA, 21 nt, Human
ccaggggugauuucagagagg

SEQ ID NO: 2474068 - RNA, 20 nt, Human
ccaggggugauuucagagag

SEQ ID NO: 2474069 - RNA, 19 nt, Human
ccaggggugauuucagaga

SEQ ID NO: 2474070 - RNA, 14 nt, Human
ccaggggucccagc

SEQ ID NO: 2474071 - RNA, 17 nt, Human
ccaggggucccagccac

SEQ ID NO: 2474072 - RNA, 16 nt, Human
ccaggggucucccugg

SEQ ID NO: 2474073 - RNA, 18 nt, Human
ccaggggucccagccacc

SEQ ID NO: 2474074 - RNA, 19 nt, Human
ccaggggggugaggagcug

SEQ ID NO: 2474075 - RNA, 20 nt, Human
ccaggggggugaggagcugg

SEQ ID NO: 2474076 - RNA, 17 nt, Human
ccaggggggugaggagc

SEQ ID NO: 2474077 - RNA, 23 nt, Human
ccagggggccagucccugaggca

SEQ ID NO: 2474078 - RNA, 21 nt, Human
ccaggggaggccugaggcuuc

SEQ ID NO: 2474079 - RNA, 22 nt, Human
ccagcuuugcccaacaccagcc

SEQ ID NO: 2474080 - RNA, 19 nt, Human
ccagcuuugcccaacacca

SEQ ID NO: 2474081 - RNA, 18 nt, Human
ccagcuuugcccaacacc

SEQ ID NO: 2474082 - RNA, 15 nt, Human
ccagcuuugcccaac

SEQ ID NO: 2474083 - RNA, 20 nt, Human
ccagcuuugcuaccaaagca

SEQ ID NO: 2474084 - RNA, 18 nt, Human
ccagcuuuuccucccuug

SEQ ID NO: 2474085 - RNA, 16 nt, Human
ccagcuuuuccucccu

SEQ ID NO: 2474086 - RNA, 23 nt, Human
ccagcuuuucccaaaagcccauu

SEQ ID NO: 2474087 - RNA, 13 nt, Human
ccagcuuuuccca

SEQ ID NO: 2474088 - RNA, 23 nt, Human
ccaggaaacuccacaucugccuu

SEQ ID NO: 2474089 - RNA, 22 nt, Human
ccaggaaacuccacaucugccu

SEQ ID NO: 2474090 - RNA, 21 nt, Human
ccaggaaacuccacaucugcc

SEQ ID NO: 2474091 - RNA, 20 nt, Human
ccaggaaacuccacaucugc

SEQ ID NO: 2474092 - RNA, 19 nt, Human
ccaggaaacuccacaucug

SEQ ID NO: 2474093 - RNA, 17 nt, Human
ccagccccauccucugu

SEQ ID NO: 2474094 - RNA, 15 nt, Human
ccagccccauccucu

SEQ ID NO: 2474095 - RNA, 13 nt, Human
ccagccccuagcc

SEQ ID NO: 2474096 - RNA, 17 nt, Human
ccagccccggggugagu

SEQ ID NO: 2474097 - RNA, 16 nt, Human
ccagccccaucaggac

SEQ ID NO: 2474098 - RNA, 17 nt, Human
ccagcagacauugucag

SEQ ID NO: 2474099 - RNA, 15 nt, Human
ccagcagacauuguc

SEQ ID NO: 2474100 - RNA, 14 nt, Human
ccagcagacauugu

SEQ ID NO: 2474101 - RNA, 13 nt, Human
ccagcagacauug

SEQ ID NO: 2474102 - RNA, 18 nt, Human
ccagccccauccucugua

SEQ ID NO: 2474103 - RNA, 18 nt, Human
ccagccccggcccugggc

SEQ ID NO: 2474104 - RNA, 13 nt, Human
ccagcagagcacc

SEQ ID NO: 2474105 - RNA, 12 nt, Human
ccagcagagcac

SEQ ID NO: 2474106 - RNA, 14 nt, Human
ccagcagagcaccu

SEQ ID NO: 2474107 - RNA, 17 nt, Human
ccagccccagugcccac

SEQ ID NO: 2474108 - RNA, 15 nt, Human
ccagcacuuguauau

SEQ ID NO: 2474109 - RNA, 21 nt, Human
ccagcacuuggagaggcugag

SEQ ID NO: 2474110 - RNA, 15 nt, Human
ccagcacuuggagag

SEQ ID NO: 2474111 - RNA, 23 nt, Human
ccacucgggaggcugagacagga

SEQ ID NO: 2474112 - RNA, 16 nt, Human
ccacucuacccuccca

SEQ ID NO: 2474113 - RNA, 15 nt, Human
ccagcacugucucag

SEQ ID NO: 2474114 - RNA, 20 nt, Human
ccacucgggaggcugagaca

SEQ ID NO: 2474115 - RNA, 18 nt, Human
ccacucgcuucccccaua

SEQ ID NO: 2474116 - RNA, 21 nt, Human
ccacucgcuucccccauagcc

SEQ ID NO: 2474117 - RNA, 15 nt, Human
ccacuccucuuauuu

SEQ ID NO: 2474118 - RNA, 14 nt, Human
ccacuccuguacac

SEQ ID NO: 2474119 - RNA, 15 nt, Human
ccacuccuguacacu

SEQ ID NO: 2474120 - RNA, 12 nt, Human
ccacuccuuccu

SEQ ID NO: 2474121 - RNA, 13 nt, Human
ccacuccuuccug

SEQ ID NO: 2474122 - RNA, 22 nt, Human
ccacuccuuccugccaccugcu

SEQ ID NO: 2474123 - RNA, 13 nt, Human
ccacucgcuuccc

SEQ ID NO: 2474124 - RNA, 16 nt, Human
ccacucgcuuccccca

SEQ ID NO: 2474125 - RNA, 23 nt, Human
ccagcacuuugggaggccaagga

SEQ ID NO: 2474126 - RNA, 19 nt, Human
ccagcacuuugggaggccu

SEQ ID NO: 2474127 - RNA, 21 nt, Human
ccagcacuuugggaggccaag

SEQ ID NO: 2474128 - RNA, 12 nt, Human
ccagcagacauu

SEQ ID NO: 2474129 - RNA, 21 nt, Human
ccagcacuuugggaggcugag

SEQ ID NO: 2474130 - RNA, 16 nt, Human
ccagcacuuguccagc

SEQ ID NO: 2474131 - RNA, 19 nt, Human
ccagcacuuguccagcuga

SEQ ID NO: 2474132 - RNA, 20 nt, Human
ccagcacuuguccagcugag

SEQ ID NO: 2474133 - RNA, 14 nt, Human
ccagcacuuuggga

SEQ ID NO: 2474134 - RNA, 15 nt, Human
ccagcacuuugggag

SEQ ID NO: 2474135 - RNA, 16 nt, Human
ccagcacuuugggagg

SEQ ID NO: 2474136 - RNA, 19 nt, Human
ccagcacuuugggaggcca

SEQ ID NO: 2474137 - RNA, 11 nt, Human
ccagcacuuug

SEQ ID NO: 2474138 - RNA, 17 nt, Human
ccagcacuuugggaggc

SEQ ID NO: 2474139 - RNA, 24 nt, Human
ccagccccuucugacccaugcugc

SEQ ID NO: 2474140 - RNA, 23 nt, Human
ccagccccuucugacccaugcug

SEQ ID NO: 2474141 - RNA, 23 nt, Human
ccagccccuagcccaggagagag

SEQ ID NO: 2474142 - RNA, 22 nt, Human
ccagccccuagcccaggagaga

SEQ ID NO: 2474143 - RNA, 19 nt, Human
ccagccccuagcccaggag

SEQ ID NO: 2474144 - RNA, 18 nt, Human
ccagccccuagcccagga

SEQ ID NO: 2474145 - RNA, 17 nt, Human
ccagccccuagcccagg

SEQ ID NO: 2474146 - RNA, 16 nt, Human
ccagccccuagcccag

SEQ ID NO: 2474147 - RNA, 15 nt, Human
ccagccccuagccca

SEQ ID NO: 2474148 - RNA, 14 nt, Human
ccagccccuagccc

SEQ ID NO: 2474149 - RNA, 11 nt, Human
ccagccccucc

SEQ ID NO: 2474150 - RNA, 12 nt, Human
ccagccccuccc

SEQ ID NO: 2474151 - RNA, 13 nt, Human
ccagccccuccca

SEQ ID NO: 2474152 - RNA, 14 nt, Human
ccagccccucccac

SEQ ID NO: 2474153 - RNA, 15 nt, Human
ccagccccucccacc

SEQ ID NO: 2474154 - RNA, 16 nt, Human
ccagccccucccacca

SEQ ID NO: 2474155 - RNA, 21 nt, Human
ccagccccucccaccacagca

SEQ ID NO: 2474156 - RNA, 17 nt, Human
ccagcuacuugggaagc

SEQ ID NO: 2474157 - RNA, 16 nt, Human
ccagcuacuugggaag

SEQ ID NO: 2474158 - RNA, 14 nt, Human
ccagcuacuuggga

SEQ ID NO: 2474159 - RNA, 22 nt, Human
ccagcccggccugcucccagca

SEQ ID NO: 2474160 - RNA, 20 nt, Human
ccagcccggccugcucccag

SEQ ID NO: 2474161 - RNA, 19 nt, Human
ccagcccggccugcuccca

SEQ ID NO: 2474162 - RNA, 17 nt, Human
ccagcuacuuccuccuc

SEQ ID NO: 2474163 - RNA, 15 nt, Human
ccagcuacuuccucc

SEQ ID NO: 2474164 - RNA, 17 nt, Human
ccagcccggcugguuuu

SEQ ID NO: 2474165 - RNA, 17 nt, Human
ccagcccggccugcucc

SEQ ID NO: 2474166 - RNA, 15 nt, Human
ccagcccggccugcu

SEQ ID NO: 2474167 - RNA, 14 nt, Human
ccagcccggccugc

SEQ ID NO: 2474168 - RNA, 13 nt, Human
ccagcccggccug

SEQ ID NO: 2474169 - RNA, 13 nt, Human
ccagccccucugg

SEQ ID NO: 2474170 - RNA, 14 nt, Human
ccagccccuugaga

SEQ ID NO: 2474171 - RNA, 20 nt, Human
ccagccccucccaccacagc

SEQ ID NO: 2474172 - RNA, 14 nt, Human
ccagcuccccaaga

SEQ ID NO: 2474173 - RNA, 23 nt, Human
ccagcuccccaagaaagccucag

SEQ ID NO: 2474174 - RNA, 15 nt, Human
ccagcucccccggga

SEQ ID NO: 2474175 - RNA, 12 nt, Human
ccagcuuucccu

SEQ ID NO: 2474176 - RNA, 14 nt, Human
ccagcuuucccugc

SEQ ID NO: 2474177 - RNA, 18 nt, Human
ccagcuuucccugccucu

SEQ ID NO: 2474178 - RNA, 14 nt, Human
ccagcucccucuau

SEQ ID NO: 2474179 - RNA, 21 nt, Human
ccagcucccccgggaggggcc

SEQ ID NO: 2474180 - RNA, 17 nt, Human
ccagcucccccgggagg

SEQ ID NO: 2474181 - RNA, 14 nt, Human
ccagcucccuagga

SEQ ID NO: 2474182 - RNA, 21 nt, Human
ccagcuauuuuuacuagaaca

SEQ ID NO: 2474183 - RNA, 19 nt, Human
ccagcuauuuuuacuagaa

SEQ ID NO: 2474184 - RNA, 14 nt, Human
ccagcuccaaccug

SEQ ID NO: 2474185 - RNA, 15 nt, Human
ccagcuccaaccugc

SEQ ID NO: 2474186 - RNA, 21 nt, Human
ccagcuccaagaccuguuggu

SEQ ID NO: 2474187 - RNA, 19 nt, Human
ccagcuccaagaccuguug

SEQ ID NO: 2474188 - RNA, 20 nt, Human
ccagcuccaaccugcaaaga

SEQ ID NO: 2474189 - RNA, 22 nt, Human
ccagcuccaaggggaaucagaa

SEQ ID NO: 2474190 - RNA, 14 nt, Human
ccagcuauaccugu

SEQ ID NO: 2474191 - RNA, 15 nt, Human
ccagcuauaccugug

SEQ ID NO: 2474192 - RNA, 16 nt, Human
ccagcuauaccugugc

SEQ ID NO: 2474193 - RNA, 18 nt, Human
ccagcuauaccugugccu

SEQ ID NO: 2474194 - RNA, 22 nt, Human
ccagcuauguuauauugaaaaa

SEQ ID NO: 2474195 - RNA, 19 nt, Human
ccagcuauaccugugccuc

SEQ ID NO: 2474196 - RNA, 17 nt, Human
ccagcuauuuuuacuag

SEQ ID NO: 2474197 - RNA, 22 nt, Human
ccagcuauugauauaaauaaaa

SEQ ID NO: 2474198 - RNA, 21 nt, Human
ccauaaugcuacugucucacu

SEQ ID NO: 2474199 - RNA, 19 nt, Human
ccauaauguauaaagaaca

SEQ ID NO: 2474200 - RNA, 20 nt, Human
ccauaauuaugacaguuaua

SEQ ID NO: 2474201 - RNA, 17 nt, Human
ccauaauuuucuucaug

SEQ ID NO: 2474202 - RNA, 21 nt, Human
ccauaauuuucuucaugcaau

SEQ ID NO: 2474203 - RNA, 21 nt, Human
ccauaaucuggacuccucugu

SEQ ID NO: 2474204 - RNA, 14 nt, Human
ccauaaucuggacu

SEQ ID NO: 2474205 - RNA, 19 nt, Human
ccauccagguucagcuugu

SEQ ID NO: 2474206 - RNA, 18 nt, Human
ccauccagguucagcuug

SEQ ID NO: 2474207 - RNA, 20 nt, Human
ccaguuggucccccuuccau

SEQ ID NO: 2474208 - RNA, 18 nt, Human
ccaguuggucccccuucc

SEQ ID NO: 2474209 - RNA, 22 nt, Human
ccauaagguuucguuucuguau

SEQ ID NO: 2474210 - RNA, 20 nt, Human
ccauaagguuucguuucugu

SEQ ID NO: 2474211 - RNA, 15 nt, Human
ccauaaggaauguag

SEQ ID NO: 2474212 - RNA, 17 nt, Human
ccauaagccuccauuua

SEQ ID NO: 2474213 - RNA, 17 nt, Human
ccaguugggagcacugg

SEQ ID NO: 2474214 - RNA, 18 nt, Human
ccaguugggagcacugga

SEQ ID NO: 2474215 - RNA, 19 nt, Human
ccaguugggagcacuggag

SEQ ID NO: 2474216 - RNA, 21 nt, Human
ccauaagccuccauuuaguuc

SEQ ID NO: 2474217 - RNA, 20 nt, Human
ccaucccauaugccugggca

SEQ ID NO: 2474218 - RNA, 19 nt, Human
ccaucccauaugccugggc

SEQ ID NO: 2474219 - RNA, 19 nt, Human
ccauccagugucucacagc

SEQ ID NO: 2474220 - RNA, 20 nt, Human
ccaucccaaacccuucagug

SEQ ID NO: 2474221 - RNA, 21 nt, Human
ccaucccauaugccugggcag

SEQ ID NO: 2474222 - RNA, 11 nt, Human
ccaucccauga

SEQ ID NO: 2474223 - RNA, 16 nt, Human
ccaucccuccccaguu

SEQ ID NO: 2474224 - RNA, 14 nt, Human
ccaucccguuuaga

SEQ ID NO: 2474225 - RNA, 16 nt, Human
ccaucccgaaaaucuc

SEQ ID NO: 2474226 - RNA, 19 nt, Human
ccaucccaugaacacacug

SEQ ID NO: 2474227 - RNA, 19 nt, Human
ccaucccgaaaaucucucg

SEQ ID NO: 2474228 - RNA, 17 nt, Human
ccaucccgacauggacc

SEQ ID NO: 2474229 - RNA, 22 nt, Human
ccaucccgacauggacccggag

SEQ ID NO: 2474230 - RNA, 13 nt, Human
ccaguuggucccc

SEQ ID NO: 2474231 - RNA, 23 nt, Human
ccaguuggguggaugccuggugg

SEQ ID NO: 2474232 - RNA, 15 nt, Human
ccaguugccaucugc

SEQ ID NO: 2474233 - RNA, 22 nt, Human
ccaguuggagcagaugccuccc

SEQ ID NO: 2474234 - RNA, 18 nt, Human
ccaguugaucaaugaaua

SEQ ID NO: 2474235 - RNA, 21 nt, Human
ccaguugcacuuggccucugg

SEQ ID NO: 2474236 - RNA, 14 nt, Human
ccaguugcacuugg

SEQ ID NO: 2474237 - RNA, 20 nt, Human
ccaguugcacuuggccucug

SEQ ID NO: 2474238 - RNA, 22 nt, Human
ccaguucugcuccucuccaggc

SEQ ID NO: 2474239 - RNA, 21 nt, Human
ccaguucugcuccucuccagg

SEQ ID NO: 2474240 - RNA, 20 nt, Human
ccaguucugcuccucuccag

SEQ ID NO: 2474241 - RNA, 19 nt, Human
ccaguucugcuccucucca

SEQ ID NO: 2474242 - RNA, 17 nt, Human
ccaguucugcuccucuc

SEQ ID NO: 2474243 - RNA, 16 nt, Human
ccaguucugcuccucu

SEQ ID NO: 2474244 - RNA, 15 nt, Human
ccaguucugcuccuc

SEQ ID NO: 2474245 - RNA, 14 nt, Human
ccaguucugcuccu

SEQ ID NO: 2474246 - RNA, 13 nt, Human
ccaguucugcucc

SEQ ID NO: 2474247 - RNA, 23 nt, Human
ccaguuccuuucaaugguuugca

SEQ ID NO: 2474248 - RNA, 15 nt, Human
ccauguccuuagcac

SEQ ID NO: 2474249 - RNA, 17 nt, Human
ccaugaguccuugaaaa

SEQ ID NO: 2474250 - RNA, 18 nt, Human
ccaugaguccccuguuug

SEQ ID NO: 2474251 - RNA, 21 nt, Human
ccaugaguggcauggccacca

SEQ ID NO: 2474252 - RNA, 20 nt, Human
ccaugaguggcauggccacc

SEQ ID NO: 2474253 - RNA, 21 nt, Human
ccaugaguuggggucuggcag

SEQ ID NO: 2474254 - RNA, 22 nt, Human
ccaugaguuggggucuggcagc

SEQ ID NO: 2474255 - RNA, 23 nt, Human
ccaugaguuggggucuggcagcc

SEQ ID NO: 2474256 - RNA, 16 nt, Human
ccaugaucccuguguu

SEQ ID NO: 2474257 - RNA, 14 nt, Human
ccaugaucccugug

SEQ ID NO: 2474258 - RNA, 17 nt, Human
ccaugaguuugcccugg

SEQ ID NO: 2474259 - RNA, 18 nt, Human
ccaugaguuugcccuggu

SEQ ID NO: 2474260 - RNA, 20 nt, Human
ccaugaggaacaaggcaagg

SEQ ID NO: 2474261 - RNA, 23 nt, Human
ccaugaggaacaaggcaaggcug

SEQ ID NO: 2474262 - RNA, 22 nt, Human
ccaucccucgugguccccaaca

SEQ ID NO: 2474263 - RNA, 18 nt, Human
ccaugaggaguugcuguu

SEQ ID NO: 2474264 - RNA, 20 nt, Human
ccaugaggaguugcuguuug

SEQ ID NO: 2474265 - RNA, 15 nt, Human
ccaugaggccucagu

SEQ ID NO: 2474266 - RNA, 17 nt, Human
ccaugucgccucugcau

SEQ ID NO: 2474267 - RNA, 16 nt, Human
ccaugucgccucugca

SEQ ID NO: 2474268 - RNA, 15 nt, Human
ccaugucgccucugc

SEQ ID NO: 2474269 - RNA, 12 nt, Human
ccaugucgccuc

SEQ ID NO: 2474270 - RNA, 22 nt, Human
ccauguagcccccuggccucug

SEQ ID NO: 2474271 - RNA, 23 nt, Human
ccauguagcccccuggccucugu

SEQ ID NO: 2474272 - RNA, 15 nt, Human
ccauguaucuaccuc

SEQ ID NO: 2474273 - RNA, 16 nt, Human
ccauguagcaggacug

SEQ ID NO: 2474274 - RNA, 19 nt, Human
ccauguagaagcugcaucu

SEQ ID NO: 2474275 - RNA, 18 nt, Human
ccauguagaagcugcauc

SEQ ID NO: 2474276 - RNA, 15 nt, Human
ccauguagaagcugc

SEQ ID NO: 2474277 - RNA, 14 nt, Human
ccauguagaagcug

SEQ ID NO: 2474278 - RNA, 14 nt, Human
ccauguagcccccu

SEQ ID NO: 2474279 - RNA, 20 nt, Human
ccauguagcccccuggccuc

SEQ ID NO: 2474280 - RNA, 15 nt, Human
ccauguagaaaauuu

SEQ ID NO: 2474281 - RNA, 16 nt, Human
ccauguagaaaauuug

SEQ ID NO: 2474282 - RNA, 13 nt, Human
ccauguacuguag

SEQ ID NO: 2474283 - RNA, 14 nt, Human
ccauguacuguagu

SEQ ID NO: 2474284 - RNA, 15 nt, Human
ccauguacuguaguu

SEQ ID NO: 2474285 - RNA, 22 nt, Human
ccauguacuguaguuuuucuuc

SEQ ID NO: 2474286 - RNA, 16 nt, Human
ccauguacaugaagaa

SEQ ID NO: 2474287 - RNA, 22 nt, Human
ccaugaucccuguguugucucu

SEQ ID NO: 2474288 - RNA, 17 nt, Human
ccaugaucccuguguug

SEQ ID NO: 2474289 - RNA, 19 nt, Human
ccauucuggaagugacuuu

SEQ ID NO: 2474290 - RNA, 14 nt, Human
ccauucuuccuagu

SEQ ID NO: 2474291 - RNA, 19 nt, Human
ccauucuuccuaguuuucu

SEQ ID NO: 2474292 - RNA, 22 nt, Human
ccauucuggauuuugucaagca

SEQ ID NO: 2474293 - RNA, 20 nt, Human
ccauucuuccuaguuuucuc

SEQ ID NO: 2474294 - RNA, 18 nt, Human
ccauugcacuccagccug

SEQ ID NO: 2474295 - RNA, 15 nt, Human
ccauugccaccagga

SEQ ID NO: 2474296 - RNA, 16 nt, Human
ccauugccaccaggag

SEQ ID NO: 2474297 - RNA, 17 nt, Human
ccauugccaccaggaga

SEQ ID NO: 2474298 - RNA, 21 nt, Human
ccauugccaccaggagaacca

SEQ ID NO: 2474299 - RNA, 15 nt, Human
ccauugccuccuccu

SEQ ID NO: 2474300 - RNA, 13 nt, Human
ccauugccuccuc

SEQ ID NO: 2474301 - RNA, 14 nt, Human
ccauugcccugguu

SEQ ID NO: 2474302 - RNA, 21 nt, Human
ccauuggcuauuuaaaacuug

SEQ ID NO: 2474303 - RNA, 17 nt, Human
ccauuucaauucucaaa

SEQ ID NO: 2474304 - RNA, 16 nt, Human
ccauuucaucuauuuc

SEQ ID NO: 2474305 - RNA, 17 nt, Human
ccauuucaucuauuucu

SEQ ID NO: 2474306 - RNA, 16 nt, Human
ccauuuauccaccucc

SEQ ID NO: 2474307 - RNA, 13 nt, Human
ccauuucagagag

SEQ ID NO: 2474308 - RNA, 20 nt, Human
ccauuggcuauuuaaaacuu

SEQ ID NO: 2474309 - RNA, 19 nt, Human
ccauuggcuauuuaaaacu

SEQ ID NO: 2474310 - RNA, 15 nt, Human
ccauuggaucucauu

SEQ ID NO: 2474311 - RNA, 23 nt, Human
ccauugccuccuccuucccaaag

SEQ ID NO: 2474312 - RNA, 16 nt, Human
cccaacucaccccagc

SEQ ID NO: 2474313 - RNA, 15 nt, Human
cccaacucaccccag

SEQ ID NO: 2474314 - RNA, 21 nt, Human
ccauuucauuugugccagaau

SEQ ID NO: 2474315 - RNA, 22 nt, Human
ccauuucauuugugccagaaug

SEQ ID NO: 2474316 - RNA, 17 nt, Human
ccauuucccaucugcac

SEQ ID NO: 2474317 - RNA, 16 nt, Human
ccauuucccaucugca

SEQ ID NO: 2474318 - RNA, 15 nt, Human
ccauuucccaucugc

SEQ ID NO: 2474319 - RNA, 14 nt, Human
ccauuucccaucug

SEQ ID NO: 2474320 - RNA, 13 nt, Human
ccauuucccaucu

SEQ ID NO: 2474321 - RNA, 21 nt, Human
ccauuucaucuauuucugaga

SEQ ID NO: 2474322 - RNA, 21 nt, Human
cccacucuaggggucaggcuc

SEQ ID NO: 2474323 - RNA, 13 nt, Human
cccacucucauuc

SEQ ID NO: 2474324 - RNA, 20 nt, Human
cccacucccuggcucucaga

SEQ ID NO: 2474325 - RNA, 21 nt, Human
cccacucucauuccccaggug

SEQ ID NO: 2474326 - RNA, 17 nt, Human
cccacucuccccacacu

SEQ ID NO: 2474327 - RNA, 14 nt, Human
cccacucucauucc

SEQ ID NO: 2474328 - RNA, 19 nt, Human
cccacucucauuccccagg

SEQ ID NO: 2474329 - RNA, 11 nt, Human
cccacucuccc

SEQ ID NO: 2474330 - RNA, 14 nt, Human
cccacucuccccac

SEQ ID NO: 2474331 - RNA, 15 nt, Human
cccacucuccccaca

SEQ ID NO: 2474332 - RNA, 22 nt, Human
cccacugcuuuuggucugugug

SEQ ID NO: 2474333 - RNA, 15 nt, Human
cccacugcacccccu

SEQ ID NO: 2474334 - RNA, 14 nt, Human
cccacugcaccccc

SEQ ID NO: 2474335 - RNA, 12 nt, Human
cccacugcaccc

SEQ ID NO: 2474336 - RNA, 16 nt, Human
cccacugcacacaccu

SEQ ID NO: 2474337 - RNA, 23 nt, Human
cccacugcuuuuggucuguguga

SEQ ID NO: 2474338 - RNA, 18 nt, Human
cccacugcaauccugucu

SEQ ID NO: 2474339 - RNA, 15 nt, Human
cccacugcaauccug

SEQ ID NO: 2474340 - RNA, 14 nt, Human
cccacugaccagaa

SEQ ID NO: 2474341 - RNA, 16 nt, Human
cccacugacagccucc

SEQ ID NO: 2474342 - RNA, 12 nt, Human
cccacucugugc

SEQ ID NO: 2474343 - RNA, 21 nt, Human
cccacucugcuuugacugagc

SEQ ID NO: 2474344 - RNA, 13 nt, Human
cccaccccacacu

SEQ ID NO: 2474345 - RNA, 14 nt, Human
cccaccccacacuu

SEQ ID NO: 2474346 - RNA, 15 nt, Human
cccaccccacccccu

SEQ ID NO: 2474347 - RNA, 17 nt, Human
cccaccccacccccacc

SEQ ID NO: 2474348 - RNA, 14 nt, Human
cccaccccagccua

SEQ ID NO: 2474349 - RNA, 12 nt, Human
cccaccccugcc

SEQ ID NO: 2474350 - RNA, 12 nt, Human
cccaccccuggg

SEQ ID NO: 2474351 - RNA, 13 nt, Human
cccaccccugugc

SEQ ID NO: 2474352 - RNA, 12 nt, Human
cccaccccugug

SEQ ID NO: 2474353 - RNA, 16 nt, Human
cccaccccugccccca

SEQ ID NO: 2474354 - RNA, 22 nt, Human
cccaccccugggggcucucaug

SEQ ID NO: 2474355 - RNA, 16 nt, Human
cccaccccugugcucc

SEQ ID NO: 2474356 - RNA, 15 nt, Human
cccaccccugugcuc

SEQ ID NO: 2474357 - RNA, 21 nt, Human
cccaccccugugcuccgugcc

SEQ ID NO: 2474358 - RNA, 12 nt, Human
cccaccccuucc

SEQ ID NO: 2474359 - RNA, 13 nt, Human
cccacucccugca

SEQ ID NO: 2474360 - RNA, 12 nt, Human
cccacucccugc

SEQ ID NO: 2474361 - RNA, 14 nt, Human
cccacccucccugg

SEQ ID NO: 2474362 - RNA, 22 nt, Human
cccacucccuggcucucagaag

SEQ ID NO: 2474363 - RNA, 21 nt, Human
cccacccucagcaccccuucc

SEQ ID NO: 2474364 - RNA, 18 nt, Human
cccacccucagcaccccu

SEQ ID NO: 2474365 - RNA, 17 nt, Human
cccacccucagcacccc

SEQ ID NO: 2474366 - RNA, 16 nt, Human
cccacccucagcaccc

SEQ ID NO: 2474367 - RNA, 14 nt, Human
cccacccucagcac

SEQ ID NO: 2474368 - RNA, 13 nt, Human
cccacccucagca

SEQ ID NO: 2474369 - RNA, 12 nt, Human
cccacccucagc

SEQ ID NO: 2474370 - RNA, 16 nt, Human
cccacccgaugcugcu

SEQ ID NO: 2474371 - RNA, 15 nt, Human
cccacccgaugcugc

SEQ ID NO: 2474372 - RNA, 14 nt, Human
cccacccgaugcug

SEQ ID NO: 2474373 - RNA, 14 nt, Human
cccaccccuugcuc

SEQ ID NO: 2474374 - RNA, 13 nt, Human
cccaccccuuccc

SEQ ID NO: 2474375 - RNA, 15 nt, Human
cccaccccuucccca

SEQ ID NO: 2474376 - RNA, 17 nt, Human
cccaccccuuccccacu

SEQ ID NO: 2474377 - RNA, 22 nt, Human
cccaccccuuccccacugccug

SEQ ID NO: 2474378 - RNA, 13 nt, Human
cccacccaggagg

SEQ ID NO: 2474379 - RNA, 21 nt, Human
cccacccagcacccagcaacu

SEQ ID NO: 2474380 - RNA, 12 nt, Human
cccacccaggag

SEQ ID NO: 2474381 - RNA, 12 nt, Human
cccaccccacac

SEQ ID NO: 2474382 - RNA, 19 nt, Human
cccaagcaaaaucauggaa

SEQ ID NO: 2474383 - RNA, 23 nt, Human
cccaagauucacaccugacucug

SEQ ID NO: 2474384 - RNA, 14 nt, Human
cccacccacaugug

SEQ ID NO: 2474385 - RNA, 15 nt, Human
cccacccacauguga

SEQ ID NO: 2474386 - RNA, 15 nt, Human
cccaagcucugcucc

SEQ ID NO: 2474387 - RNA, 20 nt, Human
cccaagauucacaccugacu

SEQ ID NO: 2474388 - RNA, 23 nt, Human
cccaagaggucaaggcugcagug

SEQ ID NO: 2474389 - RNA, 12 nt, Human
cccaagcucugc

SEQ ID NO: 2474390 - RNA, 14 nt, Human
cccaagcucugcuc

SEQ ID NO: 2474391 - RNA, 13 nt, Human
cccaagcucugcu

SEQ ID NO: 2474392 - RNA, 20 nt, Human
cccaacucaccccagcccca

SEQ ID NO: 2474393 - RNA, 17 nt, Human
cccaacucaccccagcc

SEQ ID NO: 2474394 - RNA, 13 nt, Human
cccaacuccagaa

SEQ ID NO: 2474395 - RNA, 20 nt, Human
cccaacuaauuuuuguauuu

SEQ ID NO: 2474396 - RNA, 12 nt, Human
cccaacuccugg

SEQ ID NO: 2474397 - RNA, 15 nt, Human
cccaacucuagcugg

SEQ ID NO: 2474398 - RNA, 16 nt, Human
cccaacucuagcuggg

SEQ ID NO: 2474399 - RNA, 21 nt, Human
cccaacucuagcugggggugg

SEQ ID NO: 2474400 - RNA, 15 nt, Human
cccaagaaugggagg

SEQ ID NO: 2474401 - RNA, 18 nt, Human
cccaagacagaugcccca

SEQ ID NO: 2474402 - RNA, 13 nt, Human
cccaacuccugga

SEQ ID NO: 2474403 - RNA, 15 nt, Human
cccaacuccuggaag

SEQ ID NO: 2474404 - RNA, 17 nt, Human
cccaacuccuggaagcu

SEQ ID NO: 2474405 - RNA, 23 nt, Human
cccaacuccuggaagcugugucc

SEQ ID NO: 2474406 - RNA, 17 nt, Human
cccaagagaugaagagu

SEQ ID NO: 2474407 - RNA, 15 nt, Human
cccaagagaugaaga

SEQ ID NO: 2474408 - RNA, 22 nt, Human
cccaagacuugguguccuuucc

SEQ ID NO: 2474409 - RNA, 19 nt, Human
cccaagacagaugccccag

SEQ ID NO: 2474410 - RNA, 20 nt, Human
cccaagacagaugccccaga

SEQ ID NO: 2474411 - RNA, 21 nt, Human
cccaagacagaugccccagag

SEQ ID NO: 2474412 - RNA, 19 nt, Human
ccuccuaucagaaguuucu

SEQ ID NO: 2474413 - RNA, 22 nt, Human
ccuccuauucaguucccagaau

SEQ ID NO: 2474414 - RNA, 20 nt, Human
ccuccuagggaaaaguucau

SEQ ID NO: 2474415 - RNA, 19 nt, Human
ccuccuaucaccuccccuc

SEQ ID NO: 2474416 - RNA, 13 nt, Human
ccuccucaccccc

SEQ ID NO: 2474417 - RNA, 14 nt, Human
ccuccucaccccca

SEQ ID NO: 2474418 - RNA, 16 nt, Human
ccuccucacccccagc

SEQ ID NO: 2474419 - RNA, 13 nt, Human
ccuccucaccccg

SEQ ID NO: 2474420 - RNA, 15 nt, Human
ccuccucaccccguc

SEQ ID NO: 2474421 - RNA, 23 nt, Human
ccuccuuugugaggaagccgcug

SEQ ID NO: 2474422 - RNA, 15 nt, Human
ccuccucaccucaug

SEQ ID NO: 2474423 - RNA, 14 nt, Human
ccuccucaccucau

SEQ ID NO: 2474424 - RNA, 13 nt, Human
ccuccucaccuca

SEQ ID NO: 2474425 - RNA, 12 nt, Human
ccuccucaccuc

SEQ ID NO: 2474426 - RNA, 18 nt, Human
ccuccuuuuuauguugcc

SEQ ID NO: 2474427 - RNA, 18 nt, Human
ccuccuuuugcuugaaac

SEQ ID NO: 2474428 - RNA, 16 nt, Human
ccucgaaacacagaaa

SEQ ID NO: 2474429 - RNA, 20 nt, Human
ccucgaaacacagaaaccuu

SEQ ID NO: 2474430 - RNA, 18 nt, Human
ccuccuuuucacaguucu

SEQ ID NO: 2474431 - RNA, 14 nt, Human
ccucgcaagcuggg

SEQ ID NO: 2474432 - RNA, 14 nt, Human
ccucgcagagaggc

SEQ ID NO: 2474433 - RNA, 19 nt, Human
ccucgcccaccgcaugccc

SEQ ID NO: 2474434 - RNA, 13 nt, Human
ccucgcccaccgc

SEQ ID NO: 2474435 - RNA, 21 nt, Human
ccucgcccaccgcaugccccc

SEQ ID NO: 2474436 - RNA, 12 nt, Human
ccucgcccaccg

SEQ ID NO: 2474437 - RNA, 12 nt, Human
ccucgcccuggg

SEQ ID NO: 2474438 - RNA, 13 nt, Human
ccucgcccugggu

SEQ ID NO: 2474439 - RNA, 17 nt, Human
ccucgcuggacucucag

SEQ ID NO: 2474440 - RNA, 13 nt, Human
ccucgcugcuucu

SEQ ID NO: 2474441 - RNA, 21 nt, Human
ccucgcuggggcagugcccuc

SEQ ID NO: 2474442 - RNA, 12 nt, Human
ccucggagaaga

SEQ ID NO: 2474443 - RNA, 14 nt, Human
ccucggagaagagc

SEQ ID NO: 2474444 - RNA, 19 nt, Human
ccucggacuuagcugggag

SEQ ID NO: 2474445 - RNA, 20 nt, Human
ccucggacuuagcugggaga

SEQ ID NO: 2474446 - RNA, 18 nt, Human
ccucgcuggacucucagu

SEQ ID NO: 2474447 - RNA, 12 nt, Human
ccucgcuuggac

SEQ ID NO: 2474448 - RNA, 19 nt, Human
ccucccuuggaaaccugcc

SEQ ID NO: 2474449 - RNA, 17 nt, Human
ccucccuucugcuacug

SEQ ID NO: 2474450 - RNA, 15 nt, Human
ccucccuucugcuac

SEQ ID NO: 2474451 - RNA, 16 nt, Human
ccucccuucugcuacu

SEQ ID NO: 2474452 - RNA, 22 nt, Human
ccucccuuccuuuucccugcuu

SEQ ID NO: 2474453 - RNA, 21 nt, Human
ccucccuuccuuuucccugcu

SEQ ID NO: 2474454 - RNA, 10 nt, Human
ccucccuucu

SEQ ID NO: 2474455 - RNA, 13 nt, Human
ccucccuucugcu

SEQ ID NO: 2474456 - RNA, 19 nt, Human
ccucccuuggguucugaua

SEQ ID NO: 2474457 - RNA, 23 nt, Human
ccucccuuggaaaccugcccugc

SEQ ID NO: 2474458 - RNA, 22 nt, Human
ccucccuuggaaaccugcccug

SEQ ID NO: 2474459 - RNA, 21 nt, Human
ccucccuuggaaaccugcccu

SEQ ID NO: 2474460 - RNA, 20 nt, Human
ccucccuuggggccuaugca

SEQ ID NO: 2474461 - RNA, 16 nt, Human
ccucccuucucuucac

SEQ ID NO: 2474462 - RNA, 17 nt, Human
ccucccuuccuuuuccc

SEQ ID NO: 2474463 - RNA, 16 nt, Human
ccucccuuccuuuucc

SEQ ID NO: 2474464 - RNA, 15 nt, Human
ccucccuuccuuuuc

SEQ ID NO: 2474465 - RNA, 13 nt, Human
ccucccuuccuuu

SEQ ID NO: 2474466 - RNA, 15 nt, Human
ccucccuuucucccc

SEQ ID NO: 2474467 - RNA, 14 nt, Human
ccucccuuucuccc

SEQ ID NO: 2474468 - RNA, 13 nt, Human
ccucccuuucucc

SEQ ID NO: 2474469 - RNA, 12 nt, Human
ccucccuuucuc

SEQ ID NO: 2474470 - RNA, 19 nt, Human
ccucccuuuuuccuugucc

SEQ ID NO: 2474471 - RNA, 18 nt, Human
ccucccuuuuuccuuguc

SEQ ID NO: 2474472 - RNA, 17 nt, Human
ccucccuuuuuccuugu

SEQ ID NO: 2474473 - RNA, 16 nt, Human
ccucccuuuuuccuug

SEQ ID NO: 2474474 - RNA, 22 nt, Human
ccuccgacagcccccucugccg

SEQ ID NO: 2474475 - RNA, 20 nt, Human
ccuccgacagcccccucugc

SEQ ID NO: 2474476 - RNA, 21 nt, Human
ccuccgagccggggaguuucu

SEQ ID NO: 2474477 - RNA, 19 nt, Human
ccuccgagagggagagaga

SEQ ID NO: 2474478 - RNA, 16 nt, Human
ccuccgagagggagag

SEQ ID NO: 2474479 - RNA, 14 nt, Human
ccuccgagagggag

SEQ ID NO: 2474480 - RNA, 16 nt, Human
ccuccgauccuuccuc

SEQ ID NO: 2474481 - RNA, 14 nt, Human
ccuccgaggccagu

SEQ ID NO: 2474482 - RNA, 15 nt, Human
ccuccgauccuuccu

SEQ ID NO: 2474483 - RNA, 13 nt, Human
ccuccgccucuug

SEQ ID NO: 2474484 - RNA, 22 nt, Human
ccuccggcgucagccuccagcc

SEQ ID NO: 2474485 - RNA, 20 nt, Human
ccuccggcgucagccuccag

SEQ ID NO: 2474486 - RNA, 19 nt, Human
ccuccggcgucagccucca

SEQ ID NO: 2474487 - RNA, 18 nt, Human
ccuccggcgucagccucc

SEQ ID NO: 2474488 - RNA, 17 nt, Human
ccuccggcgucagccuc

SEQ ID NO: 2474489 - RNA, 16 nt, Human
ccuccggccuccccuc

SEQ ID NO: 2474490 - RNA, 15 nt, Human
ccuccggccuccccu

SEQ ID NO: 2474491 - RNA, 12 nt, Human
ccuccggccucc

SEQ ID NO: 2474492 - RNA, 15 nt, Human
ccuccuagccaccca

SEQ ID NO: 2474493 - RNA, 22 nt, Human
ccuccuaccgaaaccuugccuu

SEQ ID NO: 2474494 - RNA, 19 nt, Human
ccuccuaccgaaaccuugc

SEQ ID NO: 2474495 - RNA, 18 nt, Human
ccuccuaucaccuccccu

SEQ ID NO: 2474496 - RNA, 14 nt, Human
ccuccgccucuugg

SEQ ID NO: 2474497 - RNA, 19 nt, Human
ccuccgccuucacuccggu

SEQ ID NO: 2474498 - RNA, 20 nt, Human
ccuccgcgugaucaaagcca

SEQ ID NO: 2474499 - RNA, 23 nt, Human
ccucaacucuccuccagagucag

SEQ ID NO: 2474500 - RNA, 21 nt, Human
ccucaacucuccuccagaguc

SEQ ID NO: 2474501 - RNA, 19 nt, Human
ccucaacucuccuccagag

SEQ ID NO: 2474502 - RNA, 15 nt, Human
ccucaaccuccuggg

SEQ ID NO: 2474503 - RNA, 17 nt, Human
ccucaaauuacuuugug

SEQ ID NO: 2474504 - RNA, 17 nt, Human
ccucaacaagggagaga

SEQ ID NO: 2474505 - RNA, 16 nt, Human
ccucaacaagggagag

SEQ ID NO: 2474506 - RNA, 15 nt, Human
ccucaacaagggaga

SEQ ID NO: 2474507 - RNA, 16 nt, Human
ccucaacaccucugca

SEQ ID NO: 2474508 - RNA, 19 nt, Human
ccucaacccucccucagcc

SEQ ID NO: 2474509 - RNA, 21 nt, Human
ccucaacccucccucagcccc

SEQ ID NO: 2474510 - RNA, 22 nt, Human
ccucaacccucccucagccccu

SEQ ID NO: 2474511 - RNA, 23 nt, Human
ccucaacccucccucagccccuc

SEQ ID NO: 2474512 - RNA, 18 nt, Human
ccucaacccucccucagc

SEQ ID NO: 2474513 - RNA, 16 nt, Human
ccucaacccucccuca

SEQ ID NO: 2474514 - RNA, 21 nt, Human
ccucaacaagggagagaccuc

SEQ ID NO: 2474515 - RNA, 18 nt, Human
ccucaacaagggagagac

SEQ ID NO: 2474516 - RNA, 22 nt, Human
ccucaacaagggagagaccuca

SEQ ID NO: 2474517 - RNA, 15 nt, Human
ccucaaaucguccag

SEQ ID NO: 2474518 - RNA, 16 nt, Human
ccucaaaugacccaaa

SEQ ID NO: 2474519 - RNA, 19 nt, Human
ccucaaaugacccaaagac

SEQ ID NO: 2474520 - RNA, 14 nt, Human
ccucaaagucugca

SEQ ID NO: 2474521 - RNA, 14 nt, Human
ccucaacugccuac

SEQ ID NO: 2474522 - RNA, 15 nt, Human
ccucaacugccuacu

SEQ ID NO: 2474523 - RNA, 21 nt, Human
ccucaaggccucccacaguga

SEQ ID NO: 2474524 - RNA, 20 nt, Human
ccucaaggccucccacagug

SEQ ID NO: 2474525 - RNA, 20 nt, Human
ccucaagugauucuccugcc

SEQ ID NO: 2474526 - RNA, 20 nt, Human
ccucaagucacucccaagcc

SEQ ID NO: 2474527 - RNA, 20 nt, Human
ccucaaggggccauccuguc

SEQ ID NO: 2474528 - RNA, 19 nt, Human
ccucaagggggacugucuu

SEQ ID NO: 2474529 - RNA, 11 nt, Human
ccucagcucug

SEQ ID NO: 2474530 - RNA, 14 nt, Human
ccucagcucuggga

SEQ ID NO: 2474531 - RNA, 13 nt, Human
ccucagcucuggg

SEQ ID NO: 2474532 - RNA, 12 nt, Human
ccucagcucugg

SEQ ID NO: 2474533 - RNA, 11 nt, Human
ccucagcucca

SEQ ID NO: 2474534 - RNA, 23 nt, Human
ccucaagugauucuccugccuca

SEQ ID NO: 2474535 - RNA, 22 nt, Human
ccucagccuugccagagaucca

SEQ ID NO: 2474536 - RNA, 23 nt, Human
ccucagccuuggauaaugcuguu

SEQ ID NO: 2474537 - RNA, 13 nt, Human
ccucauuccugaa

SEQ ID NO: 2474538 - RNA, 21 nt, Human
ccucauuccaccuucccaugc

SEQ ID NO: 2474539 - RNA, 13 nt, Human
ccucauucaggaa

SEQ ID NO: 2474540 - RNA, 21 nt, Human
ccucaggccaggugcaguggc

SEQ ID NO: 2474541 - RNA, 15 nt, Human
ccucauucaggaaaa

SEQ ID NO: 2474542 - RNA, 16 nt, Human
ccucauucaggaaaac

SEQ ID NO: 2474543 - RNA, 17 nt, Human
ccucauucaggaaaacu

SEQ ID NO: 2474544 - RNA, 22 nt, Human
ccucauucaggaaaacugacag

SEQ ID NO: 2474545 - RNA, 10 nt, Human
ccucaggccu

SEQ ID NO: 2474546 - RNA, 20 nt, Human
ccucagcucugggagaggau

SEQ ID NO: 2474547 - RNA, 13 nt, Human
ccucaggcaggaa

SEQ ID NO: 2474548 - RNA, 15 nt, Human
ccucaggcaggaagg

SEQ ID NO: 2474549 - RNA, 19 nt, Human
ccucaggcaggaagggcag

SEQ ID NO: 2474550 - RNA, 18 nt, Human
ccucaggcauaggccugg

SEQ ID NO: 2474551 - RNA, 22 nt, Human
ccucaggcauaggccugggugc

SEQ ID NO: 2474552 - RNA, 12 nt, Human
ccucaggcaggu

SEQ ID NO: 2474553 - RNA, 18 nt, Human
ccucaggcaggugggaug

SEQ ID NO: 2474554 - RNA, 18 nt, Human
ccucagcucugggagagg

SEQ ID NO: 2474555 - RNA, 17 nt, Human
ccucagcucugggagag

SEQ ID NO: 2474556 - RNA, 16 nt, Human
ccucagcucugggaga

SEQ ID NO: 2474557 - RNA, 15 nt, Human
ccucagcucugggag

SEQ ID NO: 2474558 - RNA, 13 nt, Human
ccucagcugccuc

SEQ ID NO: 2474559 - RNA, 14 nt, Human
ccucagcugccuca

SEQ ID NO: 2474560 - RNA, 15 nt, Human
ccucagcugccucac

SEQ ID NO: 2474561 - RNA, 16 nt, Human
ccucagcugccucacu

SEQ ID NO: 2474562 - RNA, 17 nt, Human
ccucagcugccucacuu

SEQ ID NO: 2474563 - RNA, 18 nt, Human
ccucagcugccucacuuc

SEQ ID NO: 2474564 - RNA, 16 nt, Human
ccucccagucaccuug

SEQ ID NO: 2474565 - RNA, 15 nt, Human
ccucccauccagggc

SEQ ID NO: 2474566 - RNA, 17 nt, Human
ccucccaucacccgcua

SEQ ID NO: 2474567 - RNA, 19 nt, Human
ccuccaagaccuucuccuu

SEQ ID NO: 2474568 - RNA, 17 nt, Human
ccuccaagaccuucucc

SEQ ID NO: 2474569 - RNA, 16 nt, Human
ccuccaagaccuucuc

SEQ ID NO: 2474570 - RNA, 16 nt, Human
ccucauuuaucccuca

SEQ ID NO: 2474571 - RNA, 19 nt, Human
ccucauuuaucccucaacc

SEQ ID NO: 2474572 - RNA, 22 nt, Human
ccucauuucaggagcagccuca

SEQ ID NO: 2474573 - RNA, 20 nt, Human
ccucauuuaucccucaaccc

SEQ ID NO: 2474574 - RNA, 12 nt, Human
ccucccaucacc

SEQ ID NO: 2474575 - RNA, 17 nt, Human
ccucccaguaccuccug

SEQ ID NO: 2474576 - RNA, 21 nt, Human
ccucccagggccagggcccug

SEQ ID NO: 2474577 - RNA, 20 nt, Human
ccuccaagaccuucuccuuc

SEQ ID NO: 2474578 - RNA, 19 nt, Human
ccucauugacaagaacuga

SEQ ID NO: 2474579 - RNA, 17 nt, Human
ccucauuugggguagcu

SEQ ID NO: 2474580 - RNA, 14 nt, Human
ccucccagggccag

SEQ ID NO: 2474581 - RNA, 17 nt, Human
ccuccaagaaucuaucu

SEQ ID NO: 2474582 - RNA, 20 nt, Human
ccucauuugggguagcuaga

SEQ ID NO: 2474583 - RNA, 15 nt, Human
ccucccaggcucuca

SEQ ID NO: 2474584 - RNA, 19 nt, Human
ccuagccuuagaagucaca

SEQ ID NO: 2474585 - RNA, 23 nt, Human
ccuagccugugccucugggacug

SEQ ID NO: 2474586 - RNA, 18 nt, Human
ccuagccuuauccucuga

SEQ ID NO: 2474587 - RNA, 22 nt, Human
ccuagccuuagaagucacacag

SEQ ID NO: 2474588 - RNA, 12 nt, Human
ccuaauaaagcu

SEQ ID NO: 2474589 - RNA, 18 nt, Human
ccuaauaaacauccuuca

SEQ ID NO: 2474590 - RNA, 22 nt, Human
ccgugacagacuccugaggaca

SEQ ID NO: 2474591 - RNA, 20 nt, Human
ccgugacagacuccugagga

SEQ ID NO: 2474592 - RNA, 18 nt, Human
ccgugacagacuccugag

SEQ ID NO: 2474593 - RNA, 18 nt, Human
ccgugaaaacggagcuga

SEQ ID NO: 2474594 - RNA, 17 nt, Human
ccgugaaaacggagcug

SEQ ID NO: 2474595 - RNA, 22 nt, Human
ccgucuuagaaguggaccagga

SEQ ID NO: 2474596 - RNA, 14 nt, Human
ccguccugccugug

SEQ ID NO: 2474597 - RNA, 13 nt, Human
ccgucugugaauu

SEQ ID NO: 2474598 - RNA, 14 nt, Human
ccgucuucagccua

SEQ ID NO: 2474599 - RNA, 15 nt, Human
ccgucuucagccuag

SEQ ID NO: 2474600 - RNA, 15 nt, Human
ccuagcccaggagag

SEQ ID NO: 2474601 - RNA, 13 nt, Human
ccuagcccaggag

SEQ ID NO: 2474602 - RNA, 11 nt, Human
ccuagcccagg

SEQ ID NO: 2474603 - RNA, 16 nt, Human
ccuagccauuccuggu

SEQ ID NO: 2474604 - RNA, 21 nt, Human
ccuagccauuccugguaccca

SEQ ID NO: 2474605 - RNA, 20 nt, Human
ccuagcccaggagagagaaa

SEQ ID NO: 2474606 - RNA, 19 nt, Human
ccuagcccaggagagagaa

SEQ ID NO: 2474607 - RNA, 18 nt, Human
ccuagcccaggagagaga

SEQ ID NO: 2474608 - RNA, 17 nt, Human
ccuagcccaggagagag

SEQ ID NO: 2474609 - RNA, 22 nt, Human
ccuagccccuuagcccccaccc

SEQ ID NO: 2474610 - RNA, 21 nt, Human
ccuagccccuuagcccccacc

SEQ ID NO: 2474611 - RNA, 15 nt, Human
ccuagccauuccugg

SEQ ID NO: 2474612 - RNA, 14 nt, Human
ccuagccauuccug

SEQ ID NO: 2474613 - RNA, 16 nt, Human
ccuagccacccaccac

SEQ ID NO: 2474614 - RNA, 12 nt, Human
ccuagccaccca

SEQ ID NO: 2474615 - RNA, 23 nt, Human
ccuaauuagagcagaugaccccu

SEQ ID NO: 2474616 - RNA, 21 nt, Human
ccuaaugcgcaggcuggcccu

SEQ ID NO: 2474617 - RNA, 20 nt, Human
ccuaaugcgcaggcuggccc

SEQ ID NO: 2474618 - RNA, 22 nt, Human
ccuaauaaacauccuucaagaa

SEQ ID NO: 2474619 - RNA, 12 nt, Human
ccuaaugcugca

SEQ ID NO: 2474620 - RNA, 19 nt, Human
ccuaaugcuccuuguuccu

SEQ ID NO: 2474621 - RNA, 16 nt, Human
ccuaaugcuccuuguu

SEQ ID NO: 2474622 - RNA, 21 nt, Human
ccuagcauacguacacauuuu

SEQ ID NO: 2474623 - RNA, 19 nt, Human
ccuaauguuuaugagccag

SEQ ID NO: 2474624 - RNA, 18 nt, Human
ccuaauguuuaugagcca

SEQ ID NO: 2474625 - RNA, 14 nt, Human
ccuaauuagagcag

SEQ ID NO: 2474626 - RNA, 20 nt, Human
ccggcacagggucugcucuu

SEQ ID NO: 2474627 - RNA, 19 nt, Human
ccggcacagggucugcucu

SEQ ID NO: 2474628 - RNA, 17 nt, Human
ccggccaccugcggugc

SEQ ID NO: 2474629 - RNA, 15 nt, Human
ccggcacuccaugcu

SEQ ID NO: 2474630 - RNA, 13 nt, Human
ccggcagaaggga

SEQ ID NO: 2474631 - RNA, 15 nt, Human
ccggccagccauguc

SEQ ID NO: 2474632 - RNA, 18 nt, Human
ccggccaccugcggugcu

SEQ ID NO: 2474633 - RNA, 15 nt, Human
ccggccccagccaga

SEQ ID NO: 2474634 - RNA, 14 nt, Human
ccggccccagccag

SEQ ID NO: 2474635 - RNA, 16 nt, Human
ccggccccagccagag

SEQ ID NO: 2474636 - RNA, 13 nt, Human
ccggccccagcca

SEQ ID NO: 2474637 - RNA, 12 nt, Human
ccggccccagcc

SEQ ID NO: 2474638 - RNA, 13 nt, Human
ccggccagguggg

SEQ ID NO: 2474639 - RNA, 15 nt, Human
ccggccaggugggcg

SEQ ID NO: 2474640 - RNA, 11 nt, Human
ccggccagccc

SEQ ID NO: 2474641 - RNA, 13 nt, Human
ccggccaggccac

SEQ ID NO: 2474642 - RNA, 14 nt, Human
ccguccucccgggc

SEQ ID NO: 2474643 - RNA, 24 nt, Human
ccguccucaccccuguccucacug

SEQ ID NO: 2474644 - RNA, 23 nt, Human
ccguccucaccccuguccucacu

SEQ ID NO: 2474645 - RNA, 20 nt, Human
ccguccucaccccuguccuc

SEQ ID NO: 2474646 - RNA, 19 nt, Human
ccguccucaccccuguccu

SEQ ID NO: 2474647 - RNA, 16 nt, Human
ccguccucaccccugu

SEQ ID NO: 2474648 - RNA, 14 nt, Human
ccguccucaccccu

SEQ ID NO: 2474649 - RNA, 11 nt, Human
ccguccucacc

SEQ ID NO: 2474650 - RNA, 15 nt, Human
ccguccugccugugg

SEQ ID NO: 2474651 - RNA, 19 nt, Human
ccguccucccgggcccucc

SEQ ID NO: 2474652 - RNA, 16 nt, Human
ccguccucccgggccc

SEQ ID NO: 2474653 - RNA, 13 nt, Human
ccguccugccugu

SEQ ID NO: 2474654 - RNA, 18 nt, Human
ccgucccauauccugccu

SEQ ID NO: 2474655 - RNA, 14 nt, Human
ccgucccccucugg

SEQ ID NO: 2474656 - RNA, 14 nt, Human
ccguccgcccugcu

SEQ ID NO: 2474657 - RNA, 13 nt, Human
ccguccgcccugc

SEQ ID NO: 2474658 - RNA, 17 nt, Human
ccguaccccacccucag

SEQ ID NO: 2474659 - RNA, 16 nt, Human
ccguaccccacccuca

SEQ ID NO: 2474660 - RNA, 15 nt, Human
ccguaccccacccuc

SEQ ID NO: 2474661 - RNA, 14 nt, Human
ccguaccccacccu

SEQ ID NO: 2474662 - RNA, 20 nt, Human
ccguaccccacccucagcac

SEQ ID NO: 2474663 - RNA, 18 nt, Human
ccguaccccacccucagc

SEQ ID NO: 2474664 - RNA, 18 nt, Human
ccguacaacguguccuca

SEQ ID NO: 2474665 - RNA, 13 nt, Human
ccguaccccaccc

SEQ ID NO: 2474666 - RNA, 12 nt, Human
ccguaccccacc

SEQ ID NO: 2474667 - RNA, 18 nt, Human
ccguacauucaauguuua

SEQ ID NO: 2474668 - RNA, 21 nt, Human
ccguaaacacgccugcaaacg

SEQ ID NO: 2474669 - RNA, 17 nt, Human
ccguaauaauuauuauu

SEQ ID NO: 2474670 - RNA, 15 nt, Human
ccguaacccaacucu

SEQ ID NO: 2474671 - RNA, 21 nt, Human
ccgguuucgaaguugaugcaa

SEQ ID NO: 2474672 - RNA, 20 nt, Human
ccgguucuuccagugguuug

SEQ ID NO: 2474673 - RNA, 20 nt, Human
ccgguuucgaaguugaugca

SEQ ID NO: 2474674 - RNA, 16 nt, Human
ccgguucuuccagugg

SEQ ID NO: 2474675 - RNA, 23 nt, Human
ccgcagcccugcagagggcacag

SEQ ID NO: 2474676 - RNA, 18 nt, Human
ccgcagcccugcagaggg

SEQ ID NO: 2474677 - RNA, 13 nt, Human
ccgcagagcuggc

SEQ ID NO: 2474678 - RNA, 14 nt, Human
ccgcagcagcuccc

SEQ ID NO: 2474679 - RNA, 15 nt, Human
ccgcagagcuggccg

SEQ ID NO: 2474680 - RNA, 14 nt, Human
ccgcagcccugcag

SEQ ID NO: 2474681 - RNA, 14 nt, Human
cccuccuuucacca

SEQ ID NO: 2474682 - RNA, 16 nt, Human
cccuccuuccuugacc

SEQ ID NO: 2474683 - RNA, 18 nt, Human
cccuccuuccuugaccag

SEQ ID NO: 2474684 - RNA, 17 nt, Human
cccuccuugccuccugu

SEQ ID NO: 2474685 - RNA, 18 nt, Human
cccuccuugccuccugug

SEQ ID NO: 2474686 - RNA, 13 nt, Human
cccuccuguugca

SEQ ID NO: 2474687 - RNA, 12 nt, Human
cccuccuucaga

SEQ ID NO: 2474688 - RNA, 19 nt, Human
cccuccuguugcacccagc

SEQ ID NO: 2474689 - RNA, 18 nt, Human
cccuccuguugcacccag

SEQ ID NO: 2474690 - RNA, 22 nt, Human
cccuccuguugcacccagcccu

SEQ ID NO: 2474691 - RNA, 11 nt, Human
cccuccuucca

SEQ ID NO: 2474692 - RNA, 15 nt, Human
cccugugauggggcc

SEQ ID NO: 2474693 - RNA, 23 nt, Human
cccugugaguacuacaguccucc

SEQ ID NO: 2474694 - RNA, 21 nt, Human
cccugugaguacuacaguccu

SEQ ID NO: 2474695 - RNA, 14 nt, Human
cccuccuugggcac

SEQ ID NO: 2474696 - RNA, 23 nt, Human
cccuccuugcucugcaggcaccu

SEQ ID NO: 2474697 - RNA, 20 nt, Human
cccuccuugcucugcaggca

SEQ ID NO: 2474698 - RNA, 19 nt, Human
cccuccuugcucugcaggc

SEQ ID NO: 2474699 - RNA, 18 nt, Human
cccuccuuguccacccac

SEQ ID NO: 2474700 - RNA, 16 nt, Human
cccuccuugggcacuu

SEQ ID NO: 2474701 - RNA, 12 nt, Human
cccuccuugucu

SEQ ID NO: 2474702 - RNA, 23 nt, Human
cccugugcugguguccugaccac

SEQ ID NO: 2474703 - RNA, 22 nt, Human
cccugugcugguguccugacca

SEQ ID NO: 2474704 - RNA, 21 nt, Human
cccugugcugguguccugacc

SEQ ID NO: 2474705 - RNA, 20 nt, Human
cccugugcugguguccugac

SEQ ID NO: 2474706 - RNA, 16 nt, Human
cccugugcuggugucc

SEQ ID NO: 2474707 - RNA, 15 nt, Human
cccugugcugguguc

SEQ ID NO: 2474708 - RNA, 14 nt, Human
cccugugcuggugu

SEQ ID NO: 2474709 - RNA, 13 nt, Human
cccugugcuggug

SEQ ID NO: 2474710 - RNA, 23 nt, Human
cccugugaguuuguacagucuug

SEQ ID NO: 2474711 - RNA, 23 nt, Human
cccugugagauuuugcuuuucca

SEQ ID NO: 2474712 - RNA, 24 nt, Human
cccugugacauggugccugagagg

SEQ ID NO: 2474713 - RNA, 22 nt, Human
cccugugacauggugccugaga

SEQ ID NO: 2474714 - RNA, 12 nt, Human
cccugugcuggu

SEQ ID NO: 2474715 - RNA, 22 nt, Human
cccugugcuccgugccuccacc

SEQ ID NO: 2474716 - RNA, 20 nt, Human
cccugugcuccgugccucca

SEQ ID NO: 2474717 - RNA, 18 nt, Human
cccugugcuccgugccuc

SEQ ID NO: 2474718 - RNA, 22 nt, Human
cccuguggaugagcccucagaa

SEQ ID NO: 2474719 - RNA, 23 nt, Human
cccuguggaugagcccucagaac

SEQ ID NO: 2474720 - RNA, 20 nt, Human
cccuguggaugagcccucag

SEQ ID NO: 2474721 - RNA, 21 nt, Human
cccuguggaugagcccucaga

SEQ ID NO: 2474722 - RNA, 14 nt, Human
cccuguggaaggga

SEQ ID NO: 2474723 - RNA, 18 nt, Human
cccuguggaagggacuag

SEQ ID NO: 2474724 - RNA, 16 nt, Human
cccuguggagacuggg

SEQ ID NO: 2474725 - RNA, 21 nt, Human
cccuguggaagggacuaggag

SEQ ID NO: 2474726 - RNA, 23 nt, Human
cccuucuaggguuauugcauuug

SEQ ID NO: 2474727 - RNA, 17 nt, Human
cccuguggagcccgcac

SEQ ID NO: 2474728 - RNA, 19 nt, Human
cccuucucaucacuccccu

SEQ ID NO: 2474729 - RNA, 15 nt, Human
cccuucucaucacuc

SEQ ID NO: 2474730 - RNA, 16 nt, Human
cccuucucagaaucua

SEQ ID NO: 2474731 - RNA, 15 nt, Human
cccuucucagaaucu

SEQ ID NO: 2474732 - RNA, 10 nt, Human
cccuucucca

SEQ ID NO: 2474733 - RNA, 23 nt, Human
cccuucucauuccaacagugagu

SEQ ID NO: 2474734 - RNA, 23 nt, Human
cccuucuccauccacaugggagc

SEQ ID NO: 2474735 - RNA, 21 nt, Human
cccuucuccaucucucuggcc

SEQ ID NO: 2474736 - RNA, 18 nt, Human
cccuucuccaucucucug

SEQ ID NO: 2474737 - RNA, 17 nt, Human
cccuucuccaucucucu

SEQ ID NO: 2474738 - RNA, 13 nt, Human
cccuucuccaucu

SEQ ID NO: 2474739 - RNA, 13 nt, Human
cccuucucccaca

SEQ ID NO: 2474740 - RNA, 19 nt, Human
ccgaagcucuggcugaacc

SEQ ID NO: 2474741 - RNA, 17 nt, Human
ccgaagcucuggcugaa

SEQ ID NO: 2474742 - RNA, 13 nt, Human
ccgacagagggaa

SEQ ID NO: 2474743 - RNA, 12 nt, Human
ccgacagccugg

SEQ ID NO: 2474744 - RNA, 14 nt, Human
ccgacagccuggca

SEQ ID NO: 2474745 - RNA, 13 nt, Human
ccgacagccuggc

SEQ ID NO: 2474746 - RNA, 18 nt, Human
ccgacagcccccucugcc

SEQ ID NO: 2474747 - RNA, 21 nt, Human
ccgaagcucuggcugaacccu

SEQ ID NO: 2474748 - RNA, 22 nt, Human
ccgacagccuggcacagggcag

SEQ ID NO: 2474749 - RNA, 15 nt, Human
ccgacagccuggcac

SEQ ID NO: 2474750 - RNA, 17 nt, Human
ccgaaaaauccucuucc

SEQ ID NO: 2474751 - RNA, 15 nt, Human
ccgaaaaauccucuu

SEQ ID NO: 2474752 - RNA, 15 nt, Human
ccgaacacccucgaa

SEQ ID NO: 2474753 - RNA, 23 nt, Human
ccgaacaucaccgacgcgucucc

SEQ ID NO: 2474754 - RNA, 13 nt, Human
ccgaaccuccucu

SEQ ID NO: 2474755 - RNA, 15 nt, Human
ccgaaccuccucugu

SEQ ID NO: 2474756 - RNA, 16 nt, Human
ccgaaccuccucugug

SEQ ID NO: 2474757 - RNA, 17 nt, Human
ccgaacuguuguauaaa

SEQ ID NO: 2474758 - RNA, 18 nt, Human
ccgaagaaggguccuucc

SEQ ID NO: 2474759 - RNA, 18 nt, Human
ccgaagccgccuguggac

SEQ ID NO: 2474760 - RNA, 16 nt, Human
ccgaagcucuggcuga

SEQ ID NO: 2474761 - RNA, 19 nt, Human
ccgaagaaggguccuuccc

SEQ ID NO: 2474762 - RNA, 20 nt, Human
ccgaagaaggguccuucccu

SEQ ID NO: 2474763 - RNA, 19 nt, Human
cccuucucuccagccccug

SEQ ID NO: 2474764 - RNA, 14 nt, Human
cccuucucuccagc

SEQ ID NO: 2474765 - RNA, 14 nt, Human
cccuucucccauga

SEQ ID NO: 2474766 - RNA, 19 nt, Human
cccuucucccaccccugcc

SEQ ID NO: 2474767 - RNA, 23 nt, Human
cccuucuccaucucucuggcccu

SEQ ID NO: 2474768 - RNA, 22 nt, Human
cccuucuccaucucucuggccc

SEQ ID NO: 2474769 - RNA, 14 nt, Human
cccuucucccacac

SEQ ID NO: 2474770 - RNA, 15 nt, Human
cccuucucccacacu

SEQ ID NO: 2474771 - RNA, 17 nt, Human
cccuucuccucuuguaa

SEQ ID NO: 2474772 - RNA, 22 nt, Human
cccuuuuuuggcugcugaaggc

SEQ ID NO: 2474773 - RNA, 21 nt, Human
cccuuuuuuggcugcugaagg

SEQ ID NO: 2474774 - RNA, 23 nt, Human
cccuuuuuuggcugcugaaggcu

SEQ ID NO: 2474775 - RNA, 15 nt, Human
cccuucucucaucuc

SEQ ID NO: 2474776 - RNA, 20 nt, Human
cccuucuccucuuguaaaua

SEQ ID NO: 2474777 - RNA, 18 nt, Human
cccuucuccucuuguaaa

SEQ ID NO: 2474778 - RNA, 18 nt, Human
ccugggcgcccuggaagc

SEQ ID NO: 2474779 - RNA, 17 nt, Human
ccugggcgcccuggaag

SEQ ID NO: 2474780 - RNA, 19 nt, Human
ccugggcgcccuggaagcc

SEQ ID NO: 2474781 - RNA, 16 nt, Human
ccugggcgcccuggaa

SEQ ID NO: 2474782 - RNA, 15 nt, Human
ccugggcgcccugga

SEQ ID NO: 2474783 - RNA, 13 nt, Human
ccugggcgcccug

SEQ ID NO: 2474784 - RNA, 12 nt, Human
ccugggcgcccu

SEQ ID NO: 2474785 - RNA, 13 nt, Human
ccuggccuguucu

SEQ ID NO: 2474786 - RNA, 19 nt, Human
ccuggccuguucuguuuug

SEQ ID NO: 2474787 - RNA, 19 nt, Human
ccuggccuggcacacauca

SEQ ID NO: 2474788 - RNA, 16 nt, Human
ccuggccuggcacaca

SEQ ID NO: 2474789 - RNA, 15 nt, Human
ccuggccuggcacac

SEQ ID NO: 2474790 - RNA, 14 nt, Human
ccuggccugugccu

SEQ ID NO: 2474791 - RNA, 11 nt, Human
ccuggccuguu

SEQ ID NO: 2474792 - RNA, 15 nt, Human
ccuggccuggcuucu

SEQ ID NO: 2474793 - RNA, 13 nt, Human
ccuggccugcugg

SEQ ID NO: 2474794 - RNA, 15 nt, Human
ccugggcucggaggc

SEQ ID NO: 2474795 - RNA, 14 nt, Human
ccugggcucggagg

SEQ ID NO: 2474796 - RNA, 15 nt, Human
ccugggcuacaagga

SEQ ID NO: 2474797 - RNA, 21 nt, Human
ccugggcucggaggcugcccc

SEQ ID NO: 2474798 - RNA, 19 nt, Human
ccugggcucggaggcugcc

SEQ ID NO: 2474799 - RNA, 18 nt, Human
ccugggcucggaggcugc

SEQ ID NO: 2474800 - RNA, 16 nt, Human
ccugggcucggaggcu

SEQ ID NO: 2474801 - RNA, 22 nt, Human
ccugggcucggaggcugccccc

SEQ ID NO: 2474802 - RNA, 12 nt, Human
ccugggcucugc

SEQ ID NO: 2474803 - RNA, 14 nt, Human
ccugggcucugugg

SEQ ID NO: 2474804 - RNA, 13 nt, Human
ccugggcucugug

SEQ ID NO: 2474805 - RNA, 12 nt, Human
ccugggcucugu

SEQ ID NO: 2474806 - RNA, 19 nt, Human
ccugggcucugggagcagc

SEQ ID NO: 2474807 - RNA, 18 nt, Human
ccugggcucugggagcag

SEQ ID NO: 2474808 - RNA, 17 nt, Human
ccugggcucugggagca

SEQ ID NO: 2474809 - RNA, 16 nt, Human
ccugggcucugggagc

SEQ ID NO: 2474810 - RNA, 13 nt, Human
ccugggcucuggg

SEQ ID NO: 2474811 - RNA, 14 nt, Human
ccugggcucugccc

SEQ ID NO: 2474812 - RNA, 20 nt, Human
ccugggcucugccccagcuc

SEQ ID NO: 2474813 - RNA, 22 nt, Human
ccugggcucugccccagcucug

SEQ ID NO: 2474814 - RNA, 24 nt, Human
ccugggcucugccccagcucuggc

SEQ ID NO: 2474815 - RNA, 17 nt, Human
ccugggcuuggccugcu

SEQ ID NO: 2474816 - RNA, 16 nt, Human
ccugggcuuggccugc

SEQ ID NO: 2474817 - RNA, 15 nt, Human
ccugggcuuggccug

SEQ ID NO: 2474818 - RNA, 14 nt, Human
ccugggcuuggccu

SEQ ID NO: 2474819 - RNA, 13 nt, Human
ccugggcuuggcc

SEQ ID NO: 2474820 - RNA, 23 nt, Human
ccugggcuguuggcacucacaga

SEQ ID NO: 2474821 - RNA, 22 nt, Human
ccugggcuguuggcacucacag

SEQ ID NO: 2474822 - RNA, 21 nt, Human
ccugggcuguuggcacucaca

SEQ ID NO: 2474823 - RNA, 21 nt, Human
ccugggcuuggccugcuguga

SEQ ID NO: 2474824 - RNA, 20 nt, Human
ccugggcuuggccugcugug

SEQ ID NO: 2474825 - RNA, 19 nt, Human
ccugggcuuggccugcugu

SEQ ID NO: 2474826 - RNA, 18 nt, Human
ccugggcuuggccugcug

SEQ ID NO: 2474827 - RNA, 18 nt, Human
ccuggggaaccugacccc

SEQ ID NO: 2474828 - RNA, 20 nt, Human
ccugggcuguuggcacucac

SEQ ID NO: 2474829 - RNA, 18 nt, Human
ccugggcuguuggcacuc

SEQ ID NO: 2474830 - RNA, 16 nt, Human
ccugggcuguuggcac

SEQ ID NO: 2474831 - RNA, 14 nt, Human
ccugggcuguuggc

SEQ ID NO: 2474832 - RNA, 14 nt, Human
ccugggcugugcua

SEQ ID NO: 2474833 - RNA, 13 nt, Human
ccugggcugugcu

SEQ ID NO: 2474834 - RNA, 20 nt, Human
ccugggcuggaaucaggaau

SEQ ID NO: 2474835 - RNA, 14 nt, Human
ccugggcuggaauc

SEQ ID NO: 2474836 - RNA, 19 nt, Human
ccugggcucugugggcugc

SEQ ID NO: 2474837 - RNA, 15 nt, Human
ccugggcucuguggg

SEQ ID NO: 2474838 - RNA, 22 nt, Human
ccugggcucugugggcugcacu

SEQ ID NO: 2474839 - RNA, 22 nt, Human
ccugggcugagagaaccucacg

SEQ ID NO: 2474840 - RNA, 14 nt, Human
ccuggggagccagg

SEQ ID NO: 2474841 - RNA, 18 nt, Human
ccuggggagugggacaga

SEQ ID NO: 2474842 - RNA, 19 nt, Human
ccuggggagugggacagag

SEQ ID NO: 2474843 - RNA, 22 nt, Human
ccuggggagugggacagagucu

SEQ ID NO: 2474844 - RNA, 23 nt, Human
ccuggggagugggacagagucug

SEQ ID NO: 2474845 - RNA, 15 nt, Human
ccuggggagaaagua

SEQ ID NO: 2474846 - RNA, 16 nt, Human
ccuggggcuccuuucu

SEQ ID NO: 2474847 - RNA, 15 nt, Human
ccuggggcuccuuuc

SEQ ID NO: 2474848 - RNA, 14 nt, Human
ccuggggcucccuu

SEQ ID NO: 2474849 - RNA, 13 nt, Human
ccuggggcucccu

SEQ ID NO: 2474850 - RNA, 21 nt, Human
ccuggggcuccuuucuccagc

SEQ ID NO: 2474851 - RNA, 20 nt, Human
ccuggggcuccuuucuccag

SEQ ID NO: 2474852 - RNA, 22 nt, Human
ccuggggcuccuuucuccagcc

SEQ ID NO: 2474853 - RNA, 24 nt, Human
ccuggggagugggacagagucugg

SEQ ID NO: 2474854 - RNA, 19 nt, Human
ccuggggcagucaccugcc

SEQ ID NO: 2474855 - RNA, 19 nt, Human
ccuggggcgggccccucau

SEQ ID NO: 2474856 - RNA, 17 nt, Human
ccuggggcgggccccuc

SEQ ID NO: 2474857 - RNA, 20 nt, Human
ccuggggcuaggcuggagcc

SEQ ID NO: 2474858 - RNA, 22 nt, Human
ccuggggcuaggcuggagccca

SEQ ID NO: 2474859 - RNA, 19 nt, Human
ccugguggcagugggagcu

SEQ ID NO: 2474860 - RNA, 18 nt, Human
ccugguggcagugggagc

SEQ ID NO: 2474861 - RNA, 15 nt, Human
ccuggggcugcuggc

SEQ ID NO: 2474862 - RNA, 15 nt, Human
ccuggggcuggccuc

SEQ ID NO: 2474863 - RNA, 16 nt, Human
ccuggggcuggccucc

SEQ ID NO: 2474864 - RNA, 17 nt, Human
ccuggggcuggccuccc

SEQ ID NO: 2474865 - RNA, 15 nt, Human
ccuggggcucugugc

SEQ ID NO: 2474866 - RNA, 18 nt, Human
ccuggggcucugugcagg

SEQ ID NO: 2474867 - RNA, 14 nt, Human
ccuggggcugcugg

SEQ ID NO: 2474868 - RNA, 23 nt, Human
ccugguggguccaggggccccuc

SEQ ID NO: 2474869 - RNA, 22 nt, Human
ccugguggguccaggggccccu

SEQ ID NO: 2474870 - RNA, 19 nt, Human
ccugguggguccaggggcc

SEQ ID NO: 2474871 - RNA, 18 nt, Human
ccugguggguccaggggc

SEQ ID NO: 2474872 - RNA, 17 nt, Human
ccuggggcugcuggccu

SEQ ID NO: 2474873 - RNA, 15 nt, Human
ccugguggcaguggg

SEQ ID NO: 2474874 - RNA, 20 nt, Human
ccugguggcagugggagcug

SEQ ID NO: 2474875 - RNA, 13 nt, Human
ccuggugguucac

SEQ ID NO: 2474876 - RNA, 22 nt, Human
ccuggugguucacucuuggagc

SEQ ID NO: 2474877 - RNA, 12 nt, Human
ccuggugguuca

SEQ ID NO: 2474878 - RNA, 19 nt, Human
ccugguguuucuagcacug

SEQ ID NO: 2474879 - RNA, 20 nt, Human
ccuggugugaagguccugcu

SEQ ID NO: 2474880 - RNA, 21 nt, Human
ccuggugguugcuguuuuccu

SEQ ID NO: 2474881 - RNA, 13 nt, Human
ccugguguggaag

SEQ ID NO: 2474882 - RNA, 18 nt, Human
ccugguuuccugcccugg

SEQ ID NO: 2474883 - RNA, 19 nt, Human
ccugguuuccugcccuggg

SEQ ID NO: 2474884 - RNA, 20 nt, Human
ccugguuuccugcccuggga

SEQ ID NO: 2474885 - RNA, 21 nt, Human
ccugguuuccugcccugggag

SEQ ID NO: 2474886 - RNA, 22 nt, Human
ccugguguuucuagcacuggcc

SEQ ID NO: 2474887 - RNA, 21 nt, Human
ccugguguuucuagcacuggc

SEQ ID NO: 2474888 - RNA, 13 nt, Human
ccugguucccguu

SEQ ID NO: 2474889 - RNA, 23 nt, Human
ccugguguuucuagcacuggccu

SEQ ID NO: 2474890 - RNA, 22 nt, Human
ccugguucccguuucuccaccu

SEQ ID NO: 2474891 - RNA, 20 nt, Human
ccugguuccggaauccuguc

SEQ ID NO: 2474892 - RNA, 16 nt, Human
ccugguuuccugcccu

SEQ ID NO: 2474893 - RNA, 21 nt, Human
ccugguuccggaauccugucc

SEQ ID NO: 2474894 - RNA, 18 nt, Human
ccuggccccucagggucc

SEQ ID NO: 2474895 - RNA, 16 nt, Human
ccuggccccucagggu

SEQ ID NO: 2474896 - RNA, 21 nt, Human
ccuggccccucagggucccug

SEQ ID NO: 2474897 - RNA, 20 nt, Human
ccuggccccucagggucccu

SEQ ID NO: 2474898 - RNA, 22 nt, Human
ccuggccucaagugauucuccu

SEQ ID NO: 2474899 - RNA, 21 nt, Human
ccuggccuccggcgucagccu

SEQ ID NO: 2474900 - RNA, 13 nt, Human
ccuggccuccggc

SEQ ID NO: 2474901 - RNA, 20 nt, Human
ccuggccuccccugccacca

SEQ ID NO: 2474902 - RNA, 19 nt, Human
ccuggccuccccugccacc

SEQ ID NO: 2474903 - RNA, 18 nt, Human
ccuggccuccccugccac

SEQ ID NO: 2474904 - RNA, 17 nt, Human
ccuggccuccccugcca

SEQ ID NO: 2474905 - RNA, 15 nt, Human
ccuggccuccccugc

SEQ ID NO: 2474906 - RNA, 23 nt, Human
ccuggccuccggcgucagccucc

SEQ ID NO: 2474907 - RNA, 22 nt, Human
ccuggccuccggcgucagccuc

SEQ ID NO: 2474908 - RNA, 24 nt, Human
ccuggccuccggcgucagccucca

SEQ ID NO: 2474909 - RNA, 13 nt, Human
ccuggccuggcac

SEQ ID NO: 2474910 - RNA, 12 nt, Human
ccuggccuggca

SEQ ID NO: 2474911 - RNA, 16 nt, Human
ccuggccugaggucuc

SEQ ID NO: 2474912 - RNA, 12 nt, Human
ccuggccugcug

SEQ ID NO: 2474913 - RNA, 15 nt, Human
ccuggcacacaucag

SEQ ID NO: 2474914 - RNA, 13 nt, Human
ccuggcacacauc

SEQ ID NO: 2474915 - RNA, 12 nt, Human
ccuggcacacau

SEQ ID NO: 2474916 - RNA, 19 nt, Human
ccuggcaauaguguguucu

SEQ ID NO: 2474917 - RNA, 21 nt, Human
ccuggcaauaguguguucuga

SEQ ID NO: 2474918 - RNA, 19 nt, Human
ccuggcaaagggagcagaa

SEQ ID NO: 2474919 - RNA, 23 nt, Human
ccuggcaaagggagcagaacuga

SEQ ID NO: 2474920 - RNA, 22 nt, Human
ccuggcaagcuagaaccuggag

SEQ ID NO: 2474921 - RNA, 21 nt, Human
ccuggcaagcuagaaccugga

SEQ ID NO: 2474922 - RNA, 23 nt, Human
ccuggcaagcuagaaccuggagg

SEQ ID NO: 2474923 - RNA, 12 nt, Human
ccuggcaauagu

SEQ ID NO: 2474924 - RNA, 15 nt, Human
ccuggauggggcugc

SEQ ID NO: 2474925 - RNA, 13 nt, Human
ccugcugcagggg

SEQ ID NO: 2474926 - RNA, 12 nt, Human
ccugcugcaggg

SEQ ID NO: 2474927 - RNA, 23 nt, Human
ccugcugcagaggggcaggcccu

SEQ ID NO: 2474928 - RNA, 22 nt, Human
ccugcugcagaggggcaggccc

SEQ ID NO: 2474929 - RNA, 18 nt, Human
ccugcugcagaggggcag

SEQ ID NO: 2474930 - RNA, 16 nt, Human
ccugcugcagaggggc

SEQ ID NO: 2474931 - RNA, 14 nt, Human
ccugcugcagaggg

SEQ ID NO: 2474932 - RNA, 23 nt, Human
ccugcugcaccaacccagccgcu

SEQ ID NO: 2474933 - RNA, 21 nt, Human
ccugcugcaccaacccagccg

SEQ ID NO: 2474934 - RNA, 20 nt, Human
ccugcugcaccaacccagcc

SEQ ID NO: 2474935 - RNA, 19 nt, Human
ccugcugcaccaacccagc

SEQ ID NO: 2474936 - RNA, 18 nt, Human
ccugcugcaccaacccag

SEQ ID NO: 2474937 - RNA, 17 nt, Human
ccugcugcaccaaccca

SEQ ID NO: 2474938 - RNA, 16 nt, Human
ccugcugcaccaaccc

SEQ ID NO: 2474939 - RNA, 12 nt, Human
ccugcugcacca

SEQ ID NO: 2474940 - RNA, 18 nt, Human
ccuggauggggcugcacc

SEQ ID NO: 2474941 - RNA, 17 nt, Human
ccuggauggggcugcac

SEQ ID NO: 2474942 - RNA, 23 nt, Human
ccuggauucauuuccugcccuuc

SEQ ID NO: 2474943 - RNA, 21 nt, Human
ccuggauucauuuccugcccu

SEQ ID NO: 2474944 - RNA, 20 nt, Human
ccuggauucauuuccugccc

SEQ ID NO: 2474945 - RNA, 19 nt, Human
ccuggauucauuuccugcc

SEQ ID NO: 2474946 - RNA, 18 nt, Human
ccuggauucauuuccugc

SEQ ID NO: 2474947 - RNA, 17 nt, Human
ccuggauucauuuccug

SEQ ID NO: 2474948 - RNA, 15 nt, Human
ccuggauucauuucc

SEQ ID NO: 2474949 - RNA, 14 nt, Human
ccuggauucauuuc

SEQ ID NO: 2474950 - RNA, 21 nt, Human
ccugucucuagccacuuuggu

SEQ ID NO: 2474951 - RNA, 21 nt, Human
ccugucuccuuugcaggcuca

SEQ ID NO: 2474952 - RNA, 22 nt, Human
ccugguuuuuaaauagaguuug

SEQ ID NO: 2474953 - RNA, 18 nt, Human
ccugguuuuuguagccuu

SEQ ID NO: 2474954 - RNA, 22 nt, Human
ccugguuuccugcccugggagg

SEQ ID NO: 2474955 - RNA, 22 nt, Human
ccugguuuuuguagccuuccuc

SEQ ID NO: 2474956 - RNA, 19 nt, Human
ccugguuuuuguagccuuc

SEQ ID NO: 2474957 - RNA, 12 nt, Human
ccuguaaaccug

SEQ ID NO: 2474958 - RNA, 23 nt, Human
ccuguaacacaagccacagaagc

SEQ ID NO: 2474959 - RNA, 21 nt, Human
ccuguaacacaagccacagaa

SEQ ID NO: 2474960 - RNA, 20 nt, Human
ccuguaacacaagccacaga

SEQ ID NO: 2474961 - RNA, 19 nt, Human
ccuguaacacaagccacag

SEQ ID NO: 2474962 - RNA, 18 nt, Human
ccuguaacacaagccaca

SEQ ID NO: 2474963 - RNA, 19 nt, Human
ccuguaaaaaaaaaaaagu

SEQ ID NO: 2474964 - RNA, 13 nt, Human
ccuguaaaccuga

SEQ ID NO: 2474965 - RNA, 19 nt, Human
ccuguaaaugguguacaua

SEQ ID NO: 2474966 - RNA, 23 nt, Human
ccuguaacauacuggccuggacu

SEQ ID NO: 2474967 - RNA, 19 nt, Human
ccuguaacauacuggccug

SEQ ID NO: 2474968 - RNA, 16 nt, Human
ccuguaaccucuucag

SEQ ID NO: 2474969 - RNA, 21 nt, Human
ccuguaaccucuucagaggcc

SEQ ID NO: 2474970 - RNA, 18 nt, Human
ccugucucauccccaggg

SEQ ID NO: 2474971 - RNA, 20 nt, Human
ccugucucauccccaggggu

SEQ ID NO: 2474972 - RNA, 17 nt, Human
ccugucucuacuaaaaa

SEQ ID NO: 2474973 - RNA, 22 nt, Human
ccuguaacacaagccacagaag

SEQ ID NO: 2474974 - RNA, 23 nt, Human
ccugucuccuuucaccccagggc

SEQ ID NO: 2474975 - RNA, 13 nt, Human
ccugucuccuuuc

SEQ ID NO: 2474976 - RNA, 18 nt, Human
ccugccaucauguuuaca

SEQ ID NO: 2474977 - RNA, 20 nt, Human
ccugccaucauguuuacaga

SEQ ID NO: 2474978 - RNA, 17 nt, Human
ccugcccaccuggccuc

SEQ ID NO: 2474979 - RNA, 15 nt, Human
ccugcccaccuggcc

SEQ ID NO: 2474980 - RNA, 15 nt, Human
ccugccaucuuccca

SEQ ID NO: 2474981 - RNA, 14 nt, Human
ccugccaucuuccc

SEQ ID NO: 2474982 - RNA, 23 nt, Human
ccugccagugccuuaccuccugc

SEQ ID NO: 2474983 - RNA, 17 nt, Human
ccugccaucuucccagc

SEQ ID NO: 2474984 - RNA, 16 nt, Human
ccugccaucuucccag

SEQ ID NO: 2474985 - RNA, 18 nt, Human
ccugccaucuucccagca

SEQ ID NO: 2474986 - RNA, 17 nt, Human
ccugccauuugcacccu

SEQ ID NO: 2474987 - RNA, 23 nt, Human
ccugccauuugcacccuccgccu

SEQ ID NO: 2474988 - RNA, 19 nt, Human
ccugcccaccuggccucug

SEQ ID NO: 2474989 - RNA, 18 nt, Human
ccugcccaccuggccucu

SEQ ID NO: 2474990 - RNA, 19 nt, Human
ccugcccaggccccugcca

SEQ ID NO: 2474991 - RNA, 14 nt, Human
ccugcccacacagg

SEQ ID NO: 2474992 - RNA, 18 nt, Human
ccugcccaggccccugcc

SEQ ID NO: 2474993 - RNA, 22 nt, Human
ccugcccaggccccugccaccc

SEQ ID NO: 2474994 - RNA, 21 nt, Human
ccugcccaggccccugccacc

SEQ ID NO: 2474995 - RNA, 15 nt, Human
ccugccucagccucc

SEQ ID NO: 2474996 - RNA, 16 nt, Human
ccugccucagccuccc

SEQ ID NO: 2474997 - RNA, 15 nt, Human
ccugccucucugcag

SEQ ID NO: 2474998 - RNA, 14 nt, Human
ccugccucucugca

SEQ ID NO: 2474999 - RNA, 18 nt, Human
ccugcugagucccaggcu

SEQ ID NO: 2475000 - RNA, 15 nt, Human
ccugcugagucccag

SEQ ID NO: 2475001 - RNA, 19 nt, Human
ccugcugagucccaggcug

SEQ ID NO: 2475002 - RNA, 20 nt, Human
ccugcugagucccaggcuga

SEQ ID NO: 2475003 - RNA, 13 nt, Human
ccugccucucugc

SEQ ID NO: 2475004 - RNA, 22 nt, Human
ccugcccacacagguucacgug

SEQ ID NO: 2475005 - RNA, 12 nt, Human
ccugccucagga

SEQ ID NO: 2475006 - RNA, 17 nt, Human
ccugccucagccucccg

SEQ ID NO: 2475007 - RNA, 23 nt, Human
ccugccucucaucaacugaauga

SEQ ID NO: 2475008 - RNA, 20 nt, Human
ccugccucucaucaacugaa

SEQ ID NO: 2475009 - RNA, 14 nt, Human
ccugccuccacccu

SEQ ID NO: 2475010 - RNA, 13 nt, Human
ccugccuccaccc

SEQ ID NO: 2475011 - RNA, 14 nt, Human
ccucuugccacugc

SEQ ID NO: 2475012 - RNA, 22 nt, Human
ccucuugccacugccucuuccu

SEQ ID NO: 2475013 - RNA, 15 nt, Human
ccucuugccccaacc

SEQ ID NO: 2475014 - RNA, 12 nt, Human
ccucuugcccca

SEQ ID NO: 2475015 - RNA, 23 nt, Human
ccucuugccacugccucuuccuc

SEQ ID NO: 2475016 - RNA, 23 nt, Human
ccucuugccccaacccccagcac

SEQ ID NO: 2475017 - RNA, 22 nt, Human
ccucuugccccaacccccagca

SEQ ID NO: 2475018 - RNA, 21 nt, Human
ccucuugccccaacccccagc

SEQ ID NO: 2475019 - RNA, 16 nt, Human
ccucuugccccaaccc

SEQ ID NO: 2475020 - RNA, 12 nt, Human
ccucuugccccc

SEQ ID NO: 2475021 - RNA, 16 nt, Human
ccucuugccccccacc

SEQ ID NO: 2475022 - RNA, 21 nt, Human
ccucuugccccccaccccagc

SEQ ID NO: 2475023 - RNA, 23 nt, Human
ccucuugccccccaccccagccu

SEQ ID NO: 2475024 - RNA, 12 nt, Human
ccucuugcucaa

SEQ ID NO: 2475025 - RNA, 16 nt, Human
ccucuugccuccugga

SEQ ID NO: 2475026 - RNA, 17 nt, Human
ccucuugcggucccuuc

SEQ ID NO: 2475027 - RNA, 16 nt, Human
ccucuuucccucccuu

SEQ ID NO: 2475028 - RNA, 15 nt, Human
ccugacccagucccc

SEQ ID NO: 2475029 - RNA, 21 nt, Human
ccugacccaggccgcagcucu

SEQ ID NO: 2475030 - RNA, 15 nt, Human
ccucuuuccucucuu

SEQ ID NO: 2475031 - RNA, 19 nt, Human
ccugacccaggccgcagcu

SEQ ID NO: 2475032 - RNA, 15 nt, Human
ccucuuugagugaag

SEQ ID NO: 2475033 - RNA, 23 nt, Human
ccucuuuccucucuuuguucuca

SEQ ID NO: 2475034 - RNA, 18 nt, Human
ccucuugcggucccuucu

SEQ ID NO: 2475035 - RNA, 19 nt, Human
ccucuuucccucccuuccu

SEQ ID NO: 2475036 - RNA, 14 nt, Human
ccucggcuccugcu

SEQ ID NO: 2475037 - RNA, 13 nt, Human
ccucggcuccugc

SEQ ID NO: 2475038 - RNA, 12 nt, Human
ccucggcuccug

SEQ ID NO: 2475039 - RNA, 16 nt, Human
ccucggccuggcuccu

SEQ ID NO: 2475040 - RNA, 22 nt, Human
ccucggccucccaaagugcugg

SEQ ID NO: 2475041 - RNA, 15 nt, Human
ccucggaucaccgag

SEQ ID NO: 2475042 - RNA, 17 nt, Human
ccucggaucaccgagag

SEQ ID NO: 2475043 - RNA, 13 nt, Human
ccucggagccuca

SEQ ID NO: 2475044 - RNA, 14 nt, Human
ccucggagccucau

SEQ ID NO: 2475045 - RNA, 16 nt, Human
ccucggagccucaucc

SEQ ID NO: 2475046 - RNA, 23 nt, Human
ccucggagccucauccgaggcag

SEQ ID NO: 2475047 - RNA, 13 nt, Human
ccugcaggcagcc

SEQ ID NO: 2475048 - RNA, 12 nt, Human
ccugcaggcagc

SEQ ID NO: 2475049 - RNA, 19 nt, Human
ccugcaggaccugccugua

SEQ ID NO: 2475050 - RNA, 20 nt, Human
ccugcaggaccugccuguag

SEQ ID NO: 2475051 - RNA, 14 nt, Human
ccugcaggcagcca

SEQ ID NO: 2475052 - RNA, 20 nt, Human
ccugaguuccuagccaccgc

SEQ ID NO: 2475053 - RNA, 21 nt, Human
ccugaguuccuagccaccgcc

SEQ ID NO: 2475054 - RNA, 20 nt, Human
ccugauaugauuuaaaacau

SEQ ID NO: 2475055 - RNA, 19 nt, Human
ccugauaugauuuaaaaca

SEQ ID NO: 2475056 - RNA, 21 nt, Human
ccugauauuucccuccccugg

SEQ ID NO: 2475057 - RNA, 15 nt, Human
ccugauauaaaugca

SEQ ID NO: 2475058 - RNA, 19 nt, Human
ccugauaacaaccuggaga

SEQ ID NO: 2475059 - RNA, 14 nt, Human
ccugauaugauuua

SEQ ID NO: 2475060 - RNA, 19 nt, Human
ccugauaaagaacaucugu

SEQ ID NO: 2475061 - RNA, 18 nt, Human
ccugauaacaaccuggag

SEQ ID NO: 2475062 - RNA, 17 nt, Human
ccugauaacaaccugga

SEQ ID NO: 2475063 - RNA, 17 nt, Human
ccugauaauaauugauc

SEQ ID NO: 2475064 - RNA, 16 nt, Human
ccugaccccugcucag

SEQ ID NO: 2475065 - RNA, 12 nt, Human
ccugacccgucu

SEQ ID NO: 2475066 - RNA, 14 nt, Human
ccugaccccugcuc

SEQ ID NO: 2475067 - RNA, 15 nt, Human
ccugaccccugcuca

SEQ ID NO: 2475068 - RNA, 18 nt, Human
ccugaccccucauagccc

SEQ ID NO: 2475069 - RNA, 17 nt, Human
ccugagaucucugcagg

SEQ ID NO: 2475070 - RNA, 18 nt, Human
ccugagaucucugcagga

SEQ ID NO: 2475071 - RNA, 22 nt, Human
ccugacccgucuaauauauaaa

SEQ ID NO: 2475072 - RNA, 14 nt, Human
ccugagauuuacac

SEQ ID NO: 2475073 - RNA, 17 nt, Human
ccugagauuucaucugc

SEQ ID NO: 2475074 - RNA, 16 nt, Human
ccugagauuucaucug

SEQ ID NO: 2475075 - RNA, 15 nt, Human
ccugagauuucaucu

SEQ ID NO: 2475076 - RNA, 11 nt, Human
ccugagauuuc

SEQ ID NO: 2475077 - RNA, 22 nt, Human
ccugagauuucaucugcucucc

SEQ ID NO: 2475078 - RNA, 18 nt, Human
ccugagauuucaucugcu

SEQ ID NO: 2475079 - RNA, 23 nt, Human
ccugagauuucaucugcucuccu

SEQ ID NO: 2475080 - RNA, 21 nt, Human
ccugagcaacagagugagacc

SEQ ID NO: 2475081 - RNA, 17 nt, Human
ccugaggcuguggucac

SEQ ID NO: 2475082 - RNA, 16 nt, Human
ccugaggcugugguca

SEQ ID NO: 2475083 - RNA, 15 nt, Human
ccugaggcugugguc

SEQ ID NO: 2475084 - RNA, 23 nt, Human
ccugagcaacagagugagacccu

SEQ ID NO: 2475085 - RNA, 23 nt, Human
ccugaggugggcccaggaccagc

SEQ ID NO: 2475086 - RNA, 21 nt, Human
ccugaggugggcccaggacca

SEQ ID NO: 2475087 - RNA, 19 nt, Human
ccugaggugggcccaggac

SEQ ID NO: 2475088 - RNA, 18 nt, Human
ccugaggugggcccagga

SEQ ID NO: 2475089 - RNA, 17 nt, Human
ccugaggugggcccagg

SEQ ID NO: 2475090 - RNA, 16 nt, Human
ccugaggugggcccag

SEQ ID NO: 2475091 - RNA, 15 nt, Human
ccugaggugggccca

SEQ ID NO: 2475092 - RNA, 20 nt, Human
ccugaggugugggggcugca

SEQ ID NO: 2475093 - RNA, 19 nt, Human
ccugaggugugggggcugc

SEQ ID NO: 2475094 - RNA, 17 nt, Human
ccugaggugugggggcu

SEQ ID NO: 2475095 - RNA, 15 nt, Human
ccugagguguggggg

SEQ ID NO: 2475096 - RNA, 19 nt, Human
ccugaguuccuagccaccg

SEQ ID NO: 2475097 - RNA, 16 nt, Human
ccugaggucucgcuga

SEQ ID NO: 2475098 - RNA, 22 nt, Human
ccugaggucaggaguucaagac

SEQ ID NO: 2475099 - RNA, 16 nt, Human
ccugaggguggagacu

SEQ ID NO: 2475100 - RNA, 15 nt, Human
ccugaggguggagac

SEQ ID NO: 2475101 - RNA, 13 nt, Human
ccugaggguggag

SEQ ID NO: 2475102 - RNA, 19 nt, Human
ccugaggucuggcugcuug

SEQ ID NO: 2475103 - RNA, 17 nt, Human
ccugaggucuggcugcu

SEQ ID NO: 2475104 - RNA, 15 nt, Human
ccugaggucuggcug

SEQ ID NO: 2475105 - RNA, 12 nt, Human
ccugaggucugg

SEQ ID NO: 2475106 - RNA, 21 nt, Human
ccugaggucuggcugcuugcc

SEQ ID NO: 2475107 - RNA, 20 nt, Human
ccugaggugaaagggagcua

SEQ ID NO: 2475108 - RNA, 13 nt, Human
ccugagggucccc

SEQ ID NO: 2475109 - RNA, 22 nt, Human
ccugagggccccucugcccagc

SEQ ID NO: 2475110 - RNA, 21 nt, Human
ccugagggccccucugcccag

SEQ ID NO: 2475111 - RNA, 19 nt, Human
ccugaggguccccaccugg

SEQ ID NO: 2475112 - RNA, 20 nt, Human
ccugagggccccucugccca

SEQ ID NO: 2475113 - RNA, 19 nt, Human
ccugagggccccucugccc

SEQ ID NO: 2475114 - RNA, 18 nt, Human
ccugagggccccucugcc

SEQ ID NO: 2475115 - RNA, 16 nt, Human
ccugagggccccucug

SEQ ID NO: 2475116 - RNA, 14 nt, Human
ccugagggccccuc

SEQ ID NO: 2475117 - RNA, 13 nt, Human
ccugagggccccu

SEQ ID NO: 2475118 - RNA, 23 nt, Human
ccugagggcagaaagguucugcc

SEQ ID NO: 2475119 - RNA, 20 nt, Human
ccugaggcuuuggauuugac

SEQ ID NO: 2475120 - RNA, 22 nt, Human
ccugaggcuuuggauuugacau

SEQ ID NO: 2475121 - RNA, 22 nt, Human
ccugagggcagaaagguucugc

SEQ ID NO: 2475122 - RNA, 18 nt, Human
cuauuuuuggcagucuga

SEQ ID NO: 2475123 - RNA, 21 nt, Human
cuauuuuuggcagucugaauu

SEQ ID NO: 2475124 - RNA, 18 nt, Human
cucaaaaaaagaaaaaga

SEQ ID NO: 2475125 - RNA, 22 nt, Human
cuauuuuuggcagucugaauuu

SEQ ID NO: 2475126 - RNA, 14 nt, Human
cuauuuuucccccu

SEQ ID NO: 2475127 - RNA, 18 nt, Human
cuauuuuuauuuauauuu

SEQ ID NO: 2475128 - RNA, 19 nt, Human
cuauuuuuacugccacucu

SEQ ID NO: 2475129 - RNA, 16 nt, Human
cuauuuuuauuuauau

SEQ ID NO: 2475130 - RNA, 17 nt, Human
cuauguugcccaggcag

SEQ ID NO: 2475131 - RNA, 16 nt, Human
cuauguugcccaggca

SEQ ID NO: 2475132 - RNA, 12 nt, Human
cuauuuuuacug

SEQ ID NO: 2475133 - RNA, 21 nt, Human
cuauuuuuacuagaacacaga

SEQ ID NO: 2475134 - RNA, 18 nt, Human
cuauuuuuacuagaacac

SEQ ID NO: 2475135 - RNA, 19 nt, Human
cuauuuuguaaacucaaaa

SEQ ID NO: 2475136 - RNA, 13 nt, Human
cuauguguaaggu

SEQ ID NO: 2475137 - RNA, 17 nt, Human
cuauuuuuacugccacu

SEQ ID NO: 2475138 - RNA, 16 nt, Human
cuauuuuuacugccac

SEQ ID NO: 2475139 - RNA, 15 nt, Human
cuauuuuuauuuaua

SEQ ID NO: 2475140 - RNA, 14 nt, Human
cuauuuuucagaau

SEQ ID NO: 2475141 - RNA, 13 nt, Human
cucaaaacugcac

SEQ ID NO: 2475142 - RNA, 19 nt, Human
cucaaacugaggaauuuca

SEQ ID NO: 2475143 - RNA, 17 nt, Human
cucaaaacugcacuguc

SEQ ID NO: 2475144 - RNA, 19 nt, Human
cucaaaacccaucugggcu

SEQ ID NO: 2475145 - RNA, 20 nt, Human
cucaaacuuuuccccugucc

SEQ ID NO: 2475146 - RNA, 22 nt, Human
cucaaaacccaucugggcuccu

SEQ ID NO: 2475147 - RNA, 22 nt, Human
cucaaacugaggaauuucaccu

SEQ ID NO: 2475148 - RNA, 17 nt, Human
cucaaacugccuuggcu

SEQ ID NO: 2475149 - RNA, 22 nt, Human
cucaaagacaauguuauuuucc

SEQ ID NO: 2475150 - RNA, 13 nt, Human
cucaaagucugca

SEQ ID NO: 2475151 - RNA, 14 nt, Human
cucaaagucugcaa

SEQ ID NO: 2475152 - RNA, 23 nt, Human
cucaaagugacuauucaguuuuc

SEQ ID NO: 2475153 - RNA, 19 nt, Human
cucaaaguuuugaaaagcu

SEQ ID NO: 2475154 - RNA, 18 nt, Human
cucaaaguuuugaaaagc

SEQ ID NO: 2475155 - RNA, 17 nt, Human
cucaaaguuuugaaaag

SEQ ID NO: 2475156 - RNA, 15 nt, Human
cucaaaguuuugaaa

SEQ ID NO: 2475157 - RNA, 14 nt, Human
cucaaaguuuugaa

SEQ ID NO: 2475158 - RNA, 12 nt, Human
cucaaaguuuug

SEQ ID NO: 2475159 - RNA, 15 nt, Human
cucaaagucugcaac

SEQ ID NO: 2475160 - RNA, 18 nt, Human
cucaaagagggagugcau

SEQ ID NO: 2475161 - RNA, 11 nt, Human
cucaaaggcac

SEQ ID NO: 2475162 - RNA, 20 nt, Human
cuaucucccccagccccauc

SEQ ID NO: 2475163 - RNA, 17 nt, Human
cuaucucugugugcaca

SEQ ID NO: 2475164 - RNA, 17 nt, Human
cuaucucgugggagagc

SEQ ID NO: 2475165 - RNA, 21 nt, Human
cuaucugaaccauuaaagucg

SEQ ID NO: 2475166 - RNA, 21 nt, Human
cuaucucugugugcacaaaua

SEQ ID NO: 2475167 - RNA, 18 nt, Human
cuaucugcuuaugcaguu

SEQ ID NO: 2475168 - RNA, 19 nt, Human
cuauguaucaaugaguaac

SEQ ID NO: 2475169 - RNA, 11 nt, Human
cuaugugauuu

SEQ ID NO: 2475170 - RNA, 16 nt, Human
cuaugugauuuuaacu

SEQ ID NO: 2475171 - RNA, 18 nt, Human
cuaugugauuuuaacucu

SEQ ID NO: 2475172 - RNA, 19 nt, Human
cuaugugauuuuaacucug

SEQ ID NO: 2475173 - RNA, 17 nt, Human
cuaugugagcacaaagg

SEQ ID NO: 2475174 - RNA, 23 nt, Human
cuaugucauuugcuggagcucug

SEQ ID NO: 2475175 - RNA, 16 nt, Human
cuaugucauuucauuu

SEQ ID NO: 2475176 - RNA, 18 nt, Human
cuaugucauuucauuucc

SEQ ID NO: 2475177 - RNA, 22 nt, Human
cuauguauuugcaguucaccug

SEQ ID NO: 2475178 - RNA, 16 nt, Human
cuauguaucaaugagu

SEQ ID NO: 2475179 - RNA, 14 nt, Human
cuauguauggaaua

SEQ ID NO: 2475180 - RNA, 13 nt, Human
cuauguauuugca

SEQ ID NO: 2475181 - RNA, 22 nt, Human
cuauguauggaauacaguguua

SEQ ID NO: 2475182 - RNA, 14 nt, Human
cuauguugcccagg

SEQ ID NO: 2475183 - RNA, 17 nt, Human
cuauguggcuguaucuu

SEQ ID NO: 2475184 - RNA, 15 nt, Human
cuauguugcccaggc

SEQ ID NO: 2475185 - RNA, 22 nt, Human
cuauguguagggcgggaggaug

SEQ ID NO: 2475186 - RNA, 20 nt, Human
cuaugugauuuuaacucugu

SEQ ID NO: 2475187 - RNA, 21 nt, Human
cuaugugauuuuaacucuguc

SEQ ID NO: 2475188 - RNA, 22 nt, Human
cuaugugauuuuaacucugucu

SEQ ID NO: 2475189 - RNA, 22 nt, Human
cucacacaggacccccuucccc

SEQ ID NO: 2475190 - RNA, 21 nt, Human
cucacacaggacccccuuccc

SEQ ID NO: 2475191 - RNA, 21 nt, Human
cucacacaugagcaucaggcc

SEQ ID NO: 2475192 - RNA, 14 nt, Human
cucacacaugagca

SEQ ID NO: 2475193 - RNA, 14 nt, Human
cucaaauaaaauaa

SEQ ID NO: 2475194 - RNA, 23 nt, Human
cucaaaguuuugaaaagcuauua

SEQ ID NO: 2475195 - RNA, 21 nt, Human
cucaaaguuuugaaaagcuau

SEQ ID NO: 2475196 - RNA, 13 nt, Human
cucaaauaaaaua

SEQ ID NO: 2475197 - RNA, 12 nt, Human
cucaaauaacua

SEQ ID NO: 2475198 - RNA, 14 nt, Human
cucacaaaggaugc

SEQ ID NO: 2475199 - RNA, 19 nt, Human
cucacaacauggugucugg

SEQ ID NO: 2475200 - RNA, 17 nt, Human
cucacaaccugaaccua

SEQ ID NO: 2475201 - RNA, 16 nt, Human
cucacaaccugaaccu

SEQ ID NO: 2475202 - RNA, 13 nt, Human
cucacacaggacc

SEQ ID NO: 2475203 - RNA, 22 nt, Human
cucacacagccaggugccuugg

SEQ ID NO: 2475204 - RNA, 20 nt, Human
cucacacagccaggugccuu

SEQ ID NO: 2475205 - RNA, 19 nt, Human
cucacacagccaggugccu

SEQ ID NO: 2475206 - RNA, 16 nt, Human
cucacacagccaggug

SEQ ID NO: 2475207 - RNA, 15 nt, Human
cucacacagccaggu

SEQ ID NO: 2475208 - RNA, 14 nt, Human
cucacacagccagg

SEQ ID NO: 2475209 - RNA, 22 nt, Human
cucacaauaaaaauggcucaga

SEQ ID NO: 2475210 - RNA, 21 nt, Human
cucacaauaaaaauggcucag

SEQ ID NO: 2475211 - RNA, 12 nt, Human
cucacacagcca

SEQ ID NO: 2475212 - RNA, 19 nt, Human
cucacaagaagaccagacu

SEQ ID NO: 2475213 - RNA, 17 nt, Human
cucacaagaagaccaga

SEQ ID NO: 2475214 - RNA, 15 nt, Human
cucacaagaagacca

SEQ ID NO: 2475215 - RNA, 20 nt, Human
cucacaaccugaaccuagga

SEQ ID NO: 2475216 - RNA, 15 nt, Human
cucacccugccuuau

SEQ ID NO: 2475217 - RNA, 14 nt, Human
cucacccugccuua

SEQ ID NO: 2475218 - RNA, 20 nt, Human
cucacccugagccccuuccu

SEQ ID NO: 2475219 - RNA, 19 nt, Human
cucacccugagccccuucc

SEQ ID NO: 2475220 - RNA, 13 nt, Human
cucacccugccuu

SEQ ID NO: 2475221 - RNA, 15 nt, Human
cucacccugcuacac

SEQ ID NO: 2475222 - RNA, 21 nt, Human
cucacccugccuuaucuugca

SEQ ID NO: 2475223 - RNA, 14 nt, Human
cucacccuggggcu

SEQ ID NO: 2475224 - RNA, 14 nt, Human
cucacccugagccc

SEQ ID NO: 2475225 - RNA, 14 nt, Human
cucacccgaggcug

SEQ ID NO: 2475226 - RNA, 17 nt, Human
cucaccucucccuugga

SEQ ID NO: 2475227 - RNA, 16 nt, Human
cucaccucucccuugg

SEQ ID NO: 2475228 - RNA, 15 nt, Human
cucaccucucccuug

SEQ ID NO: 2475229 - RNA, 14 nt, Human
cucaccucucccuu

SEQ ID NO: 2475230 - RNA, 13 nt, Human
cucaccucucccu

SEQ ID NO: 2475231 - RNA, 17 nt, Human
cucaccucaugcccacc

SEQ ID NO: 2475232 - RNA, 15 nt, Human
cucaccucaugccca

SEQ ID NO: 2475233 - RNA, 16 nt, Human
cucaccucccccaucu

SEQ ID NO: 2475234 - RNA, 21 nt, Human
cucaccgcagucgucgcacag

SEQ ID NO: 2475235 - RNA, 15 nt, Human
cucaccgcagucguc

SEQ ID NO: 2475236 - RNA, 21 nt, Human
cucaccguggcuaagaguguc

SEQ ID NO: 2475237 - RNA, 23 nt, Human
cucaccuaauguuuaugagccag

SEQ ID NO: 2475238 - RNA, 17 nt, Human
cucaccuaacucauacu

SEQ ID NO: 2475239 - RNA, 14 nt, Human
cucaccucaugccc

SEQ ID NO: 2475240 - RNA, 16 nt, Human
cucaccugccccucaa

SEQ ID NO: 2475241 - RNA, 14 nt, Human
cucaccugccccuc

SEQ ID NO: 2475242 - RNA, 18 nt, Human
cucaccugccccucaacu

SEQ ID NO: 2475243 - RNA, 15 nt, Human
cucaccugcuggccc

SEQ ID NO: 2475244 - RNA, 16 nt, Human
cucaccugcuggcccc

SEQ ID NO: 2475245 - RNA, 18 nt, Human
cucaccugcuggccccuc

SEQ ID NO: 2475246 - RNA, 19 nt, Human
cucaccugcuggccccuca

SEQ ID NO: 2475247 - RNA, 13 nt, Human
cucaccugccccu

SEQ ID NO: 2475248 - RNA, 19 nt, Human
cucaccugagucacccuac

SEQ ID NO: 2475249 - RNA, 22 nt, Human
cucaccucuggacuggcuagag

SEQ ID NO: 2475250 - RNA, 15 nt, Human
cucaccucuggacug

SEQ ID NO: 2475251 - RNA, 21 nt, Human
cucaccucuggacuggcuaga

SEQ ID NO: 2475252 - RNA, 13 nt, Human
cucaccucugccu

SEQ ID NO: 2475253 - RNA, 14 nt, Human
cucaccucugccuc

SEQ ID NO: 2475254 - RNA, 15 nt, Human
cucaccucugccuca

SEQ ID NO: 2475255 - RNA, 16 nt, Human
cucaccucugccucaa

SEQ ID NO: 2475256 - RNA, 18 nt, Human
cucaccucugccucaaug

SEQ ID NO: 2475257 - RNA, 19 nt, Human
cucaccucugccucaaugu

SEQ ID NO: 2475258 - RNA, 14 nt, Human
cucaccucuggacu

SEQ ID NO: 2475259 - RNA, 23 nt, Human
cucaccucaugcccacccccugc

SEQ ID NO: 2475260 - RNA, 12 nt, Human
cucaccucugcc

SEQ ID NO: 2475261 - RNA, 16 nt, Human
cucaccucuaaaacag

SEQ ID NO: 2475262 - RNA, 21 nt, Human
cucacuuggugauauguccua

SEQ ID NO: 2475263 - RNA, 20 nt, Human
cucacuuccauacagcucua

SEQ ID NO: 2475264 - RNA, 15 nt, Human
cucacuugcccacac

SEQ ID NO: 2475265 - RNA, 18 nt, Human
cucacuuccauacagcuc

SEQ ID NO: 2475266 - RNA, 20 nt, Human
cucacuucugggcuucaucu

SEQ ID NO: 2475267 - RNA, 19 nt, Human
cucaccuuggcaccagaca

SEQ ID NO: 2475268 - RNA, 22 nt, Human
cucaccuugcaacacacagaca

SEQ ID NO: 2475269 - RNA, 21 nt, Human
cucacuuaucccaagagaaug

SEQ ID NO: 2475270 - RNA, 14 nt, Human
cucacuucacccug

SEQ ID NO: 2475271 - RNA, 20 nt, Human
cucacuuuccuccugaggcu

SEQ ID NO: 2475272 - RNA, 14 nt, Human
cucacuuuucucca

SEQ ID NO: 2475273 - RNA, 16 nt, Human
cucaccuuggcaccag

SEQ ID NO: 2475274 - RNA, 17 nt, Human
cucaccuuggcaccaga

SEQ ID NO: 2475275 - RNA, 19 nt, Human
cucaccuugcaacacacag

SEQ ID NO: 2475276 - RNA, 20 nt, Human
cucaccuugcaacacacaga

SEQ ID NO: 2475277 - RNA, 21 nt, Human
cucaccuugcaacacacagac

SEQ ID NO: 2475278 - RNA, 22 nt, Human
cucaccuguugcuuacaauuuu

SEQ ID NO: 2475279 - RNA, 21 nt, Human
cucaccuguugcuuacaauuu

SEQ ID NO: 2475280 - RNA, 20 nt, Human
cucaccuguugcuuacaauu

SEQ ID NO: 2475281 - RNA, 17 nt, Human
cucaccuguugcuuaca

SEQ ID NO: 2475282 - RNA, 18 nt, Human
cucaccuugcaacacaca

SEQ ID NO: 2475283 - RNA, 19 nt, Human
cucaccugggcaccugggg

SEQ ID NO: 2475284 - RNA, 21 nt, Human
cucaccugcuggccccucacc

SEQ ID NO: 2475285 - RNA, 20 nt, Human
cucaccugggcaccugggga

SEQ ID NO: 2475286 - RNA, 21 nt, Human
cucaccugggcaccuggggag

SEQ ID NO: 2475287 - RNA, 11 nt, Human
cucaccugggg

SEQ ID NO: 2475288 - RNA, 20 nt, Human
cucaccuggggcugcuggcc

SEQ ID NO: 2475289 - RNA, 17 nt, Human
cucaccuggggcugcug

SEQ ID NO: 2475290 - RNA, 21 nt, Human
cucaccuggggcugcuggccu

SEQ ID NO: 2475291 - RNA, 12 nt, Human
cucaccuggggu

SEQ ID NO: 2475292 - RNA, 15 nt, Human
cucaccuguugcuua

SEQ ID NO: 2475293 - RNA, 13 nt, Human
cucaccuguugcu

SEQ ID NO: 2475294 - RNA, 14 nt, Human
cucaccuguacucu

SEQ ID NO: 2475295 - RNA, 21 nt, Human
cucaccuggggugugggaggc

SEQ ID NO: 2475296 - RNA, 23 nt, Human
cucagaaaacaaggaugaauuaa

SEQ ID NO: 2475297 - RNA, 19 nt, Human
cucagaaaacaaggaugaa

SEQ ID NO: 2475298 - RNA, 19 nt, Human
cucagaaggcaaaugacuu

SEQ ID NO: 2475299 - RNA, 21 nt, Human
cucagaaacacuggggcuggc

SEQ ID NO: 2475300 - RNA, 19 nt, Human
cucagaaacacuggggcug

SEQ ID NO: 2475301 - RNA, 18 nt, Human
cucagaaacacuggggcu

SEQ ID NO: 2475302 - RNA, 15 nt, Human
cucacuuuucuccau

SEQ ID NO: 2475303 - RNA, 16 nt, Human
cucagaaguuucuucu

SEQ ID NO: 2475304 - RNA, 19 nt, Human
cucagaaguuucuucuuua

SEQ ID NO: 2475305 - RNA, 20 nt, Human
cucagaaucuacccaaagga

SEQ ID NO: 2475306 - RNA, 11 nt, Human
cucagaaucua

SEQ ID NO: 2475307 - RNA, 23 nt, Human
cucagaauccaagugaacacuag

SEQ ID NO: 2475308 - RNA, 12 nt, Human
cucagaauauug

SEQ ID NO: 2475309 - RNA, 16 nt, Human
cucagaagguauuccu

SEQ ID NO: 2475310 - RNA, 19 nt, Human
cucagaagguauuccuuuu

SEQ ID NO: 2475311 - RNA, 14 nt, Human
cucagaagggaggc

SEQ ID NO: 2475312 - RNA, 20 nt, Human
cucagaaggcucuucugacu

SEQ ID NO: 2475313 - RNA, 20 nt, Human
cucagaagggaggcuggggu

SEQ ID NO: 2475314 - RNA, 13 nt, Human
cucagaagguauu

SEQ ID NO: 2475315 - RNA, 15 nt, Human
cucagaaggcucuuc

SEQ ID NO: 2475316 - RNA, 14 nt, Human
cucagaaggcucuu

SEQ ID NO: 2475317 - RNA, 20 nt, Human
cucagaaggcaaaugacuuu

SEQ ID NO: 2475318 - RNA, 13 nt, Human
cucagaagggagg

SEQ ID NO: 2475319 - RNA, 17 nt, Human
cuacucacagucucuuu

SEQ ID NO: 2475320 - RNA, 18 nt, Human
cuacucacagucucuuua

SEQ ID NO: 2475321 - RNA, 20 nt, Human
cuacuagggaaaugccuuug

SEQ ID NO: 2475322 - RNA, 14 nt, Human
cuacuauauaugug

SEQ ID NO: 2475323 - RNA, 15 nt, Human
cuacuagaugucuuu

SEQ ID NO: 2475324 - RNA, 21 nt, Human
cuacuacaucgcccuccacau

SEQ ID NO: 2475325 - RNA, 18 nt, Human
cuacuaugccagaugccu

SEQ ID NO: 2475326 - RNA, 16 nt, Human
cuacucaagaggcuga

SEQ ID NO: 2475327 - RNA, 20 nt, Human
cuacucaagaggcugaggca

SEQ ID NO: 2475328 - RNA, 15 nt, Human
cuacucacagucucu

SEQ ID NO: 2475329 - RNA, 23 nt, Human
cuaccugaggggccucuuauggg

SEQ ID NO: 2475330 - RNA, 19 nt, Human
cuaccugaggggccucuua

SEQ ID NO: 2475331 - RNA, 16 nt, Human
cuaccugaggggccuc

SEQ ID NO: 2475332 - RNA, 15 nt, Human
cuaccugaggggccu

SEQ ID NO: 2475333 - RNA, 12 nt, Human
cuaccuucugua

SEQ ID NO: 2475334 - RNA, 18 nt, Human
cuaccuuccaguuccuca

SEQ ID NO: 2475335 - RNA, 20 nt, Human
cuaccugauuggugcaaccc

SEQ ID NO: 2475336 - RNA, 19 nt, Human
cuaccuuccagucaggaug

SEQ ID NO: 2475337 - RNA, 18 nt, Human
cuaccuucauuucaggag

SEQ ID NO: 2475338 - RNA, 15 nt, Human
cuaccuucuguaguu

SEQ ID NO: 2475339 - RNA, 14 nt, Human
cuaccuucuguagu

SEQ ID NO: 2475340 - RNA, 13 nt, Human
cuaccuucuguag

SEQ ID NO: 2475341 - RNA, 14 nt, Human
cuaccuugaaaaua

SEQ ID NO: 2475342 - RNA, 19 nt, Human
cuaccuugaaaauaagaau

SEQ ID NO: 2475343 - RNA, 16 nt, Human
cuaccuugggggaacc

SEQ ID NO: 2475344 - RNA, 23 nt, Human
cuaccuugaggucuuuugacaug

SEQ ID NO: 2475345 - RNA, 21 nt, Human
cuaccuugguucccccacuga

SEQ ID NO: 2475346 - RNA, 14 nt, Human
cuaccuugugaccc

SEQ ID NO: 2475347 - RNA, 22 nt, Human
cuaccuugaggucuuuugacau

SEQ ID NO: 2475348 - RNA, 22 nt, Human
cuacuagagucugaacagcugu

SEQ ID NO: 2475349 - RNA, 17 nt, Human
cuacuaauuccacaccu

SEQ ID NO: 2475350 - RNA, 16 nt, Human
cuacuacaucgcccuc

SEQ ID NO: 2475351 - RNA, 18 nt, Human
cuacuacaucgcccucca

SEQ ID NO: 2475352 - RNA, 12 nt, Human
cuacuaauucca

SEQ ID NO: 2475353 - RNA, 15 nt, Human
cuacuaauuccacac

SEQ ID NO: 2475354 - RNA, 13 nt, Human
cuacuaaugaugu

SEQ ID NO: 2475355 - RNA, 14 nt, Human
cuacuaaugauguu

SEQ ID NO: 2475356 - RNA, 19 nt, Human
cuaccuugugacccagcac

SEQ ID NO: 2475357 - RNA, 14 nt, Human
cuacuaaaaaugca

SEQ ID NO: 2475358 - RNA, 15 nt, Human
cuacuaaaaaugcaa

SEQ ID NO: 2475359 - RNA, 23 nt, Human
cuacuaacaaucagcuccuuccu

SEQ ID NO: 2475360 - RNA, 16 nt, Human
cuauaaaguaaagcua

SEQ ID NO: 2475361 - RNA, 17 nt, Human
cuauaaacaauuacaug

SEQ ID NO: 2475362 - RNA, 23 nt, Human
cuauaaagaagaacuugcaugga

SEQ ID NO: 2475363 - RNA, 15 nt, Human
cuaguuugauuaaau

SEQ ID NO: 2475364 - RNA, 15 nt, Human
cuaguucuguagaaa

SEQ ID NO: 2475365 - RNA, 20 nt, Human
cuaguuugauuaaauucuug

SEQ ID NO: 2475366 - RNA, 20 nt, Human
cuaguuuucuccucccagga

SEQ ID NO: 2475367 - RNA, 16 nt, Human
cuauaaacaauuacau

SEQ ID NO: 2475368 - RNA, 13 nt, Human
cuauaaaacaggu

SEQ ID NO: 2475369 - RNA, 14 nt, Human
cuaguucuguagaa

SEQ ID NO: 2475370 - RNA, 17 nt, Human
cuaguuugauuaaauuc

SEQ ID NO: 2475371 - RNA, 19 nt, Human
cuaguuugauuaaauucuu

SEQ ID NO: 2475372 - RNA, 13 nt, Human
cuaggguccuggg

SEQ ID NO: 2475373 - RNA, 14 nt, Human
cuaggguccugggg

SEQ ID NO: 2475374 - RNA, 15 nt, Human
cuaggguccugggga

SEQ ID NO: 2475375 - RNA, 13 nt, Human
cuaggguggcccu

SEQ ID NO: 2475376 - RNA, 17 nt, Human
cuaggguggcccuugca

SEQ ID NO: 2475377 - RNA, 15 nt, Human
cuaggcucagagaug

SEQ ID NO: 2475378 - RNA, 13 nt, Human
cuaggcucagaga

SEQ ID NO: 2475379 - RNA, 12 nt, Human
cuaggcucagag

SEQ ID NO: 2475380 - RNA, 20 nt, Human
cuaggcuacaauuuucuccc

SEQ ID NO: 2475381 - RNA, 22 nt, Human
cuaggcucagagaugugcaccc

SEQ ID NO: 2475382 - RNA, 13 nt, Human
cuaggcuccaccc

SEQ ID NO: 2475383 - RNA, 20 nt, Human
cuaggcucagagaugugcac

SEQ ID NO: 2475384 - RNA, 14 nt, Human
cuagggaagauaau

SEQ ID NO: 2475385 - RNA, 14 nt, Human
cuagggggaaguga

SEQ ID NO: 2475386 - RNA, 23 nt, Human
cuagggggagccccuucugcuca

SEQ ID NO: 2475387 - RNA, 18 nt, Human
cuaggggucaggcuccau

SEQ ID NO: 2475388 - RNA, 16 nt, Human
cuaggggucaggcucc

SEQ ID NO: 2475389 - RNA, 23 nt, Human
cuaggggucuuguuaagugcagu

SEQ ID NO: 2475390 - RNA, 21 nt, Human
cuaggggucagggaccaagga

SEQ ID NO: 2475391 - RNA, 15 nt, Human
cuagggagagacccu

SEQ ID NO: 2475392 - RNA, 14 nt, Human
cuagggaggaccuu

SEQ ID NO: 2475393 - RNA, 21 nt, Human
cuagggaggaccuuaucugug

SEQ ID NO: 2475394 - RNA, 23 nt, Human
cuagggaggaccuuaucugugcg

SEQ ID NO: 2475395 - RNA, 17 nt, Human
cuagggaaacuucccgu

SEQ ID NO: 2475396 - RNA, 16 nt, Human
cuagggaaacuucccg

SEQ ID NO: 2475397 - RNA, 14 nt, Human
cuagggaagggugg

SEQ ID NO: 2475398 - RNA, 16 nt, Human
cuagggaccccuccuc

SEQ ID NO: 2475399 - RNA, 15 nt, Human
cuagggaccccuccu

SEQ ID NO: 2475400 - RNA, 20 nt, Human
cuagggaaaugaucaguuuu

SEQ ID NO: 2475401 - RNA, 20 nt, Human
cuagggaccccuccucccuu

SEQ ID NO: 2475402 - RNA, 17 nt, Human
cuagggaccccuccucc

SEQ ID NO: 2475403 - RNA, 14 nt, Human
cuagggagagaccc

SEQ ID NO: 2475404 - RNA, 16 nt, Human
cuagacauucugucgc

SEQ ID NO: 2475405 - RNA, 15 nt, Human
cuagacauucugucg

SEQ ID NO: 2475406 - RNA, 14 nt, Human
cuagacauucuguc

SEQ ID NO: 2475407 - RNA, 13 nt, Human
cuagacacugcca

SEQ ID NO: 2475408 - RNA, 16 nt, Human
cuagcauacguacaca

SEQ ID NO: 2475409 - RNA, 18 nt, Human
cuagcauacguacacauu

SEQ ID NO: 2475410 - RNA, 19 nt, Human
cuagcauacguacacauuu

SEQ ID NO: 2475411 - RNA, 20 nt, Human
cuagcauacguacacauuuu

SEQ ID NO: 2475412 - RNA, 20 nt, Human
cuagaauucuagugcugcug

SEQ ID NO: 2475413 - RNA, 19 nt, Human
cuagaauucuagugcugcu

SEQ ID NO: 2475414 - RNA, 18 nt, Human
cuagaauucuagugcugc

SEQ ID NO: 2475415 - RNA, 16 nt, Human
cuagaauucuagugcu

SEQ ID NO: 2475416 - RNA, 15 nt, Human
cuagaauucuagugc

SEQ ID NO: 2475417 - RNA, 22 nt, Human
cuagaauucccucucucugacu

SEQ ID NO: 2475418 - RNA, 20 nt, Human
cuagaauucccucucucuga

SEQ ID NO: 2475419 - RNA, 16 nt, Human
cuagaauucccucucu

SEQ ID NO: 2475420 - RNA, 13 nt, Human
cuagaauuuauuc

SEQ ID NO: 2475421 - RNA, 12 nt, Human
cuagaauuuauu

SEQ ID NO: 2475422 - RNA, 21 nt, Human
cuagaauuuaucacacuucug

SEQ ID NO: 2475423 - RNA, 20 nt, Human
cuagaaguuacugaaugcac

SEQ ID NO: 2475424 - RNA, 19 nt, Human
cuagaaguuacugaaugca

SEQ ID NO: 2475425 - RNA, 18 nt, Human
cuagaaguuacugaaugc

SEQ ID NO: 2475426 - RNA, 17 nt, Human
cuagaaguuacugaaug

SEQ ID NO: 2475427 - RNA, 16 nt, Human
cuagaaguuacugaau

SEQ ID NO: 2475428 - RNA, 20 nt, Human
cuagaaucuggagagcuaga

SEQ ID NO: 2475429 - RNA, 20 nt, Human
cuagaauauccuacuucucc

SEQ ID NO: 2475430 - RNA, 19 nt, Human
cuagaauauccuacuucuc

SEQ ID NO: 2475431 - RNA, 21 nt, Human
cuagaauauccuacuucucca

SEQ ID NO: 2475432 - RNA, 22 nt, Human
cuagaaucagccuaggggucag

SEQ ID NO: 2475433 - RNA, 15 nt, Human
cuagccauuccuggu

SEQ ID NO: 2475434 - RNA, 20 nt, Human
cuagccagcacuuguauaua

SEQ ID NO: 2475435 - RNA, 14 nt, Human
cuagccauuccugg

SEQ ID NO: 2475436 - RNA, 13 nt, Human
cuagcccaggaga

SEQ ID NO: 2475437 - RNA, 21 nt, Human
cuagccauuccugguacccag

SEQ ID NO: 2475438 - RNA, 20 nt, Human
cuagccauuccugguaccca

SEQ ID NO: 2475439 - RNA, 17 nt, Human
cuagccauuccugguac

SEQ ID NO: 2475440 - RNA, 18 nt, Human
cuagcccaaugaaaugaa

SEQ ID NO: 2475441 - RNA, 17 nt, Human
cuagccagaggagagag

SEQ ID NO: 2475442 - RNA, 19 nt, Human
cuagccagaggagagagga

SEQ ID NO: 2475443 - RNA, 22 nt, Human
cuaggcccccacuugccucuuc

SEQ ID NO: 2475444 - RNA, 20 nt, Human
cuaggcccccacuugccucu

SEQ ID NO: 2475445 - RNA, 17 nt, Human
cuaggcccccacuugcc

SEQ ID NO: 2475446 - RNA, 19 nt, Human
cuaggcccccacuugccuc

SEQ ID NO: 2475447 - RNA, 13 nt, Human
cuaggccucagcc

SEQ ID NO: 2475448 - RNA, 23 nt, Human
cuaggcccccacuugccucuucc

SEQ ID NO: 2475449 - RNA, 12 nt, Human
cuaggccgggcg

SEQ ID NO: 2475450 - RNA, 13 nt, Human
cuaggccuggcca

SEQ ID NO: 2475451 - RNA, 15 nt, Human
cuaggccucagccag

SEQ ID NO: 2475452 - RNA, 16 nt, Human
cuaggccucagccaga

SEQ ID NO: 2475453 - RNA, 17 nt, Human
cuaggccucagccagag

SEQ ID NO: 2475454 - RNA, 18 nt, Human
cuaggccucagccagaga

SEQ ID NO: 2475455 - RNA, 19 nt, Human
cuaggccuggccagaugca

SEQ ID NO: 2475456 - RNA, 18 nt, Human
cuaggccuggccagaugc

SEQ ID NO: 2475457 - RNA, 15 nt, Human
cuaggccuggccaga

SEQ ID NO: 2475458 - RNA, 14 nt, Human
cuaggccuggccag

SEQ ID NO: 2475459 - RNA, 12 nt, Human
cuaggccugggg

SEQ ID NO: 2475460 - RNA, 13 nt, Human
cuaggccugggga

SEQ ID NO: 2475461 - RNA, 18 nt, Human
cuaggcgagugccaggac

SEQ ID NO: 2475462 - RNA, 17 nt, Human
cuaggcgagugccagga

SEQ ID NO: 2475463 - RNA, 16 nt, Human
cuaggcgagugccagg

SEQ ID NO: 2475464 - RNA, 20 nt, Human
cuaggcgagugccaggacuc

SEQ ID NO: 2475465 - RNA, 19 nt, Human
cuaggcgagugccaggacu

SEQ ID NO: 2475466 - RNA, 18 nt, Human
cuaggcuacaauuuucuc

SEQ ID NO: 2475467 - RNA, 15 nt, Human
cuaggcgagugccag

SEQ ID NO: 2475468 - RNA, 19 nt, Human
cuaggccucagccagagaa

SEQ ID NO: 2475469 - RNA, 21 nt, Human
cgauacaccgggccuggagaa

SEQ ID NO: 2475470 - RNA, 20 nt, Human
cgauacaccgggccuggaga

SEQ ID NO: 2475471 - RNA, 18 nt, Human
cgauacaccgggccugga

SEQ ID NO: 2475472 - RNA, 17 nt, Human
cgaguuuggucccuggg

SEQ ID NO: 2475473 - RNA, 14 nt, Human
cgaguuuccccaga

SEQ ID NO: 2475474 - RNA, 22 nt, Human
cgaguuguggaaagccucugcu

SEQ ID NO: 2475475 - RNA, 19 nt, Human
cgaguagcugagauuauag

SEQ ID NO: 2475476 - RNA, 22 nt, Human
cgagguggaucacagaggcuuc

SEQ ID NO: 2475477 - RNA, 23 nt, Human
cgagguggaucacagaggcuucu

SEQ ID NO: 2475478 - RNA, 20 nt, Human
cgagguagaguuugaaggag

SEQ ID NO: 2475479 - RNA, 16 nt, Human
cgagguaugaggucua

SEQ ID NO: 2475480 - RNA, 15 nt, Human
cgaggucaacagaga

SEQ ID NO: 2475481 - RNA, 16 nt, Human
cgaggucaacagagaa

SEQ ID NO: 2475482 - RNA, 17 nt, Human
cgaggucaacagagaag

SEQ ID NO: 2475483 - RNA, 23 nt, Human
cgaggucaacagagaaggcagga

SEQ ID NO: 2475484 - RNA, 21 nt, Human
cgaggucaacagagaaggcag

SEQ ID NO: 2475485 - RNA, 20 nt, Human
cgagguggaucacagaggcu

SEQ ID NO: 2475486 - RNA, 15 nt, Human
cgcugggcugagccc

SEQ ID NO: 2475487 - RNA, 14 nt, Human
cgcugggcugagcc

SEQ ID NO: 2475488 - RNA, 17 nt, Human
cgcugggcugagccccu

SEQ ID NO: 2475489 - RNA, 20 nt, Human
cgcuggggccaguugguccc

SEQ ID NO: 2475490 - RNA, 20 nt, Human
cgcugcugcugcugcgcccu

SEQ ID NO: 2475491 - RNA, 15 nt, Human
cgcugcugcugcugc

SEQ ID NO: 2475492 - RNA, 20 nt, Human
cgcugcugcgcccugggcuc

SEQ ID NO: 2475493 - RNA, 19 nt, Human
cgcugcugcgcccugggcu

SEQ ID NO: 2475494 - RNA, 20 nt, Human
cgcuggacucucagucucug

SEQ ID NO: 2475495 - RNA, 18 nt, Human
cgcuggccgggaccccga

SEQ ID NO: 2475496 - RNA, 23 nt, Human
cgcuggccgggaccccgagccug

SEQ ID NO: 2475497 - RNA, 17 nt, Human
cgcuggggccaguuggu

SEQ ID NO: 2475498 - RNA, 17 nt, Human
cgcugccccuggcagcc

SEQ ID NO: 2475499 - RNA, 16 nt, Human
cgcugccccuggcagc

SEQ ID NO: 2475500 - RNA, 13 nt, Human
cgcugccccuggc

SEQ ID NO: 2475501 - RNA, 21 nt, Human
cgccuuagcauguuugcugaa

SEQ ID NO: 2475502 - RNA, 21 nt, Human
cgccuguucccccgccgcuuu

SEQ ID NO: 2475503 - RNA, 22 nt, Human
cgccuuagcacuaccacuccug

SEQ ID NO: 2475504 - RNA, 23 nt, Human
cgccuuagguacuuauuccagau

SEQ ID NO: 2475505 - RNA, 22 nt, Human
cgccuucacuccggugugccug

SEQ ID NO: 2475506 - RNA, 23 nt, Human
cgcuggaccuugaacuggguacu

SEQ ID NO: 2475507 - RNA, 19 nt, Human
cgcuggaccuugaacuggg

SEQ ID NO: 2475508 - RNA, 18 nt, Human
cgcugccccuggcagccc

SEQ ID NO: 2475509 - RNA, 18 nt, Human
cgcugcugcgcccugggc

SEQ ID NO: 2475510 - RNA, 22 nt, Human
cgauacugcgacuuucugccug

SEQ ID NO: 2475511 - RNA, 20 nt, Human
cgauacugcgacuuucugcc

SEQ ID NO: 2475512 - RNA, 15 nt, Human
cgauaaucagagaaa

SEQ ID NO: 2475513 - RNA, 16 nt, Human
cgaguuuggucccugg

SEQ ID NO: 2475514 - RNA, 19 nt, Human
cgauacugcgacuuucugc

SEQ ID NO: 2475515 - RNA, 15 nt, Human
cgcauaggaccuuuc

SEQ ID NO: 2475516 - RNA, 23 nt, Human
cgauacugcgacuuucugccugg

SEQ ID NO: 2475517 - RNA, 18 nt, Human
cgcaucaaaagacaauuc

SEQ ID NO: 2475518 - RNA, 15 nt, Human
cgcaucaaaagacaa

SEQ ID NO: 2475519 - RNA, 14 nt, Human
cgcaucaaaagaca

SEQ ID NO: 2475520 - RNA, 22 nt, Human
cgcaucaaaagacaauucuuua

SEQ ID NO: 2475521 - RNA, 19 nt, Human
cgcaucaaaagacaauucu

SEQ ID NO: 2475522 - RNA, 13 nt, Human
cgcaucagacaga

SEQ ID NO: 2475523 - RNA, 12 nt, Human
cgcaucauaugc

SEQ ID NO: 2475524 - RNA, 16 nt, Human
cgccuuaaggauguuc

SEQ ID NO: 2475525 - RNA, 20 nt, Human
cgccuguaguccuagccacu

SEQ ID NO: 2475526 - RNA, 19 nt, Human
cgccuguucccccgccgcu

SEQ ID NO: 2475527 - RNA, 15 nt, Human
cgccuguucccccgc

SEQ ID NO: 2475528 - RNA, 13 nt, Human
cgccuguuccccc

SEQ ID NO: 2475529 - RNA, 18 nt, Human
cgccuguagucccagcca

SEQ ID NO: 2475530 - RNA, 15 nt, Human
cgcaucuucuccauc

SEQ ID NO: 2475531 - RNA, 16 nt, Human
cgcaucuucuccaucu

SEQ ID NO: 2475532 - RNA, 21 nt, Human
cgcaucuucuccaucuggcag

SEQ ID NO: 2475533 - RNA, 20 nt, Human
cgccuguagucccagcuacu

SEQ ID NO: 2475534 - RNA, 17 nt, Human
cgccuguaguccuagcc

SEQ ID NO: 2475535 - RNA, 13 nt, Human
cgcaucuucucca

SEQ ID NO: 2475536 - RNA, 14 nt, Human
cgcaucuucuccau

SEQ ID NO: 2475537 - RNA, 19 nt, Human
cgcauccuagucucuauca

SEQ ID NO: 2475538 - RNA, 16 nt, Human
cgcauccuagucucua

SEQ ID NO: 2475539 - RNA, 15 nt, Human
cgcauccuagucucu

SEQ ID NO: 2475540 - RNA, 16 nt, Human
cguaauuuugccaaau

SEQ ID NO: 2475541 - RNA, 18 nt, Human
cggugggccuugcugggg

SEQ ID NO: 2475542 - RNA, 13 nt, Human
cggugggccuugc

SEQ ID NO: 2475543 - RNA, 19 nt, Human
cggugggccuuguccccug

SEQ ID NO: 2475544 - RNA, 19 nt, Human
cggugggccuugcugggga

SEQ ID NO: 2475545 - RNA, 17 nt, Human
cggugguaccaggucuc

SEQ ID NO: 2475546 - RNA, 21 nt, Human
cggugguaccaggucuccucc

SEQ ID NO: 2475547 - RNA, 15 nt, Human
cggugugcaccaggg

SEQ ID NO: 2475548 - RNA, 16 nt, Human
cggugugcaccagggu

SEQ ID NO: 2475549 - RNA, 15 nt, Human
cggugugccugcagc

SEQ ID NO: 2475550 - RNA, 17 nt, Human
cggugugccugcagccc

SEQ ID NO: 2475551 - RNA, 20 nt, Human
cggugugccugcagccccgc

SEQ ID NO: 2475552 - RNA, 23 nt, Human
cggagaagagcuguucacagcca

SEQ ID NO: 2475553 - RNA, 24 nt, Human
cggagaagagcuguucacagccag

SEQ ID NO: 2475554 - RNA, 15 nt, Human
cggagacggaguccc

SEQ ID NO: 2475555 - RNA, 18 nt, Human
cggagaaccuugugccug

SEQ ID NO: 2475556 - RNA, 12 nt, Human
cggagacagggu

SEQ ID NO: 2475557 - RNA, 15 nt, Human
cggagacagugaucu

SEQ ID NO: 2475558 - RNA, 19 nt, Human
cggugggcauuugugaggc

SEQ ID NO: 2475559 - RNA, 13 nt, Human
cguacacauuuua

SEQ ID NO: 2475560 - RNA, 16 nt, Human
cguacacauuuuauuu

SEQ ID NO: 2475561 - RNA, 17 nt, Human
cguaauaauuauuauua

SEQ ID NO: 2475562 - RNA, 13 nt, Human
cguaaugcuuaga

SEQ ID NO: 2475563 - RNA, 16 nt, Human
cguaauuaaaagaauu

SEQ ID NO: 2475564 - RNA, 21 nt, Human
cguaaugcuuagagaauguuc

SEQ ID NO: 2475565 - RNA, 14 nt, Human
cguaauaauuauua

SEQ ID NO: 2475566 - RNA, 12 nt, Human
cgguucuuccag

SEQ ID NO: 2475567 - RNA, 20 nt, Human
cgguuaugaaauucaccccc

SEQ ID NO: 2475568 - RNA, 13 nt, Human
cgguucaccagcc

SEQ ID NO: 2475569 - RNA, 14 nt, Human
cgguucaccagccu

SEQ ID NO: 2475570 - RNA, 15 nt, Human
cgguucaccagccuc

SEQ ID NO: 2475571 - RNA, 16 nt, Human
cgguucaccagccucu

SEQ ID NO: 2475572 - RNA, 15 nt, Human
cgguuuauauaagcu

SEQ ID NO: 2475573 - RNA, 19 nt, Human
cgguuccacgucccccugg

SEQ ID NO: 2475574 - RNA, 18 nt, Human
cgguuccacgucccccug

SEQ ID NO: 2475575 - RNA, 20 nt, Human
cgguuccacgucccccuggg

SEQ ID NO: 2475576 - RNA, 20 nt, Human
cuaacugcuacaaauacucu

SEQ ID NO: 2475577 - RNA, 14 nt, Human
cuaacuccagugaa

SEQ ID NO: 2475578 - RNA, 15 nt, Human
cuaacucaccuaacu

SEQ ID NO: 2475579 - RNA, 21 nt, Human
cuaacuagagcagcccuggag

SEQ ID NO: 2475580 - RNA, 17 nt, Human
cuaacucauacugugcu

SEQ ID NO: 2475581 - RNA, 19 nt, Human
cuaacucagaaacaucagu

SEQ ID NO: 2475582 - RNA, 14 nt, Human
cuaacuggacuggu

SEQ ID NO: 2475583 - RNA, 20 nt, Human
cuaacucauacugugcugga

SEQ ID NO: 2475584 - RNA, 13 nt, Human
cuaacuggaagca

SEQ ID NO: 2475585 - RNA, 15 nt, Human
cuaaaggcuaccuuu

SEQ ID NO: 2475586 - RNA, 16 nt, Human
cuaaaggcuaccuuug

SEQ ID NO: 2475587 - RNA, 15 nt, Human
cuaaagcugccagcc

SEQ ID NO: 2475588 - RNA, 18 nt, Human
cuaaagagagaauguaga

SEQ ID NO: 2475589 - RNA, 21 nt, Human
cguguuuuauuccuguauguu

SEQ ID NO: 2475590 - RNA, 19 nt, Human
cuaaagaaaaagucaucca

SEQ ID NO: 2475591 - RNA, 18 nt, Human
cuaaagaaaaagucaucc

SEQ ID NO: 2475592 - RNA, 21 nt, Human
cuaaagaagguuucagaaaga

SEQ ID NO: 2475593 - RNA, 14 nt, Human
cuaaagcugccagc

SEQ ID NO: 2475594 - RNA, 21 nt, Human
cuaaagaaagauuacuuagag

SEQ ID NO: 2475595 - RNA, 16 nt, Human
cuaaagagagaaugua

SEQ ID NO: 2475596 - RNA, 19 nt, Human
cuaaaguguguuguugcuu

SEQ ID NO: 2475597 - RNA, 20 nt, Human
cuaacuagagcagcccugga

SEQ ID NO: 2475598 - RNA, 19 nt, Human
cuaaaguuuacaguaaaua

SEQ ID NO: 2475599 - RNA, 18 nt, Human
cuaaaguuuacaguaaau

SEQ ID NO: 2475600 - RNA, 14 nt, Human
cuaaaguuuacagu

SEQ ID NO: 2475601 - RNA, 13 nt, Human
cuaaaguuuacag

SEQ ID NO: 2475602 - RNA, 17 nt, Human
cuaaaggcuaccuuugu

SEQ ID NO: 2475603 - RNA, 19 nt, Human
cuaaaggcuaccuuuguau

SEQ ID NO: 2475604 - RNA, 22 nt, Human
cuaaaguguauuuuuuuacuaa

SEQ ID NO: 2475605 - RNA, 13 nt, Human
cuaaaggccucuu

SEQ ID NO: 2475606 - RNA, 16 nt, Human
cguguauccuggggcu

SEQ ID NO: 2475607 - RNA, 15 nt, Human
cguguauccuggggc

SEQ ID NO: 2475608 - RNA, 14 nt, Human
cguguauccugggg

SEQ ID NO: 2475609 - RNA, 17 nt, Human
cguguccccggccucag

SEQ ID NO: 2475610 - RNA, 16 nt, Human
cguguccccggccuca

SEQ ID NO: 2475611 - RNA, 16 nt, Human
cgugucaccugugcuu

SEQ ID NO: 2475612 - RNA, 22 nt, Human
cguguccccuauccuacuuccc

SEQ ID NO: 2475613 - RNA, 20 nt, Human
cguguuucugacucugagcu

SEQ ID NO: 2475614 - RNA, 11 nt, Human
cguguuugcac

SEQ ID NO: 2475615 - RNA, 15 nt, Human
cgugucccucucgga

SEQ ID NO: 2475616 - RNA, 17 nt, Human
cguguccgacucuucug

SEQ ID NO: 2475617 - RNA, 15 nt, Human
cgugucgugggugug

SEQ ID NO: 2475618 - RNA, 14 nt, Human
cguuaccaggcagg

SEQ ID NO: 2475619 - RNA, 20 nt, Human
cguuaagggaaggaacucug

SEQ ID NO: 2475620 - RNA, 13 nt, Human
cguuaaaauacca

SEQ ID NO: 2475621 - RNA, 12 nt, Human
cguguuuguguu

SEQ ID NO: 2475622 - RNA, 20 nt, Human
cuccuuuagcaggugguccu

SEQ ID NO: 2475623 - RNA, 14 nt, Human
cuccuuuagcaggu

SEQ ID NO: 2475624 - RNA, 19 nt, Human
cuccuuucaccccagggcc

SEQ ID NO: 2475625 - RNA, 22 nt, Human
cuccuuuagcgcccaguugggu

SEQ ID NO: 2475626 - RNA, 16 nt, Human
cuccuuucucuucucu

SEQ ID NO: 2475627 - RNA, 21 nt, Human
cuccuuucuccagccagcaau

SEQ ID NO: 2475628 - RNA, 19 nt, Human
cuccuuucuccagccagca

SEQ ID NO: 2475629 - RNA, 18 nt, Human
cuccuuucuccagccagc

SEQ ID NO: 2475630 - RNA, 17 nt, Human
cuccuuucuccagccag

SEQ ID NO: 2475631 - RNA, 14 nt, Human
cuccuuucuccagc

SEQ ID NO: 2475632 - RNA, 17 nt, Human
cuccuuuagcgcccagu

SEQ ID NO: 2475633 - RNA, 16 nt, Human
cuccuuuagcgcccag

SEQ ID NO: 2475634 - RNA, 15 nt, Human
cuccuagcagagaga

SEQ ID NO: 2475635 - RNA, 23 nt, Human
cuccuagagggaggggccuaggc

SEQ ID NO: 2475636 - RNA, 16 nt, Human
cuccuagccacccacc

SEQ ID NO: 2475637 - RNA, 22 nt, Human
cuccuagccugugccucuggga

SEQ ID NO: 2475638 - RNA, 24 nt, Human
cuccuuuucacaguucucuccuuc

SEQ ID NO: 2475639 - RNA, 23 nt, Human
cuccuuugcugaggccuccagcu

SEQ ID NO: 2475640 - RNA, 22 nt, Human
cuccuuugcacugagggccaca

SEQ ID NO: 2475641 - RNA, 16 nt, Human
cuccuuugcaggcuca

SEQ ID NO: 2475642 - RNA, 21 nt, Human
cuccuuugcacugagggccac

SEQ ID NO: 2475643 - RNA, 20 nt, Human
cuccuuugcacugagggcca

SEQ ID NO: 2475644 - RNA, 18 nt, Human
cuccuuugcacugagggc

SEQ ID NO: 2475645 - RNA, 16 nt, Human
cuccuuugcacugagg

SEQ ID NO: 2475646 - RNA, 23 nt, Human
cuccuuugugaggaagccgcugg

SEQ ID NO: 2475647 - RNA, 15 nt, Human
cuccuuugcacugag

SEQ ID NO: 2475648 - RNA, 14 nt, Human
cuccuuugcacuga

SEQ ID NO: 2475649 - RNA, 21 nt, Human
cuccuuucuuuuucuucuucc

SEQ ID NO: 2475650 - RNA, 20 nt, Human
cuccuuucuuuuucuucuuc

SEQ ID NO: 2475651 - RNA, 19 nt, Human
cuccuuucuuuuucuucuu

SEQ ID NO: 2475652 - RNA, 13 nt, Human
cuccuuucuuuuu

SEQ ID NO: 2475653 - RNA, 14 nt, Human
cuccuuucuuucua

SEQ ID NO: 2475654 - RNA, 18 nt, Human
cuccuuuuucucccucug

SEQ ID NO: 2475655 - RNA, 15 nt, Human
cuccuuuuucucccu

SEQ ID NO: 2475656 - RNA, 14 nt, Human
cuccuuuuucuccc

SEQ ID NO: 2475657 - RNA, 18 nt, Human
cuccuuuuuauguugcca

SEQ ID NO: 2475658 - RNA, 21 nt, Human
cuccuuuuucucccucuggau

SEQ ID NO: 2475659 - RNA, 19 nt, Human
cuccuuuuucucccucugg

SEQ ID NO: 2475660 - RNA, 14 nt, Human
cucgaaacacagaa

SEQ ID NO: 2475661 - RNA, 15 nt, Human
cucgaaacacagaaa

SEQ ID NO: 2475662 - RNA, 19 nt, Human
cucgaaacacagaaaccuu

SEQ ID NO: 2475663 - RNA, 13 nt, Human
cucgaacuccuga

SEQ ID NO: 2475664 - RNA, 20 nt, Human
cucgaaacacagaaaccuuu

SEQ ID NO: 2475665 - RNA, 22 nt, Human
cucgaacauggaacucauuccu

SEQ ID NO: 2475666 - RNA, 23 nt, Human
cucgaacauggaacucauuccug

SEQ ID NO: 2475667 - RNA, 16 nt, Human
cucgaacuccugaccu

SEQ ID NO: 2475668 - RNA, 17 nt, Human
cucgaacuccugaccuu

SEQ ID NO: 2475669 - RNA, 22 nt, Human
cucgucaucauuuuuccuuccc

SEQ ID NO: 2475670 - RNA, 20 nt, Human
cucguauaugucucaggucc

SEQ ID NO: 2475671 - RNA, 12 nt, Human
cucguccucccc

SEQ ID NO: 2475672 - RNA, 14 nt, Human
cucguccucccccu

SEQ ID NO: 2475673 - RNA, 17 nt, Human
cucguggccagcccggc

SEQ ID NO: 2475674 - RNA, 16 nt, Human
cucguggccagcccgg

SEQ ID NO: 2475675 - RNA, 14 nt, Human
cucguggccagccc

SEQ ID NO: 2475676 - RNA, 13 nt, Human
cucguggccagcc

SEQ ID NO: 2475677 - RNA, 12 nt, Human
cucguggccagc

SEQ ID NO: 2475678 - RNA, 19 nt, Human
cucguggccagcccggcug

SEQ ID NO: 2475679 - RNA, 18 nt, Human
cucguggccagcccggcu

SEQ ID NO: 2475680 - RNA, 14 nt, Human
cucguggccuuccc

SEQ ID NO: 2475681 - RNA, 18 nt, Human
cucguggccuuccccagc

SEQ ID NO: 2475682 - RNA, 21 nt, Human
cucguggccuuccccagccuc

SEQ ID NO: 2475683 - RNA, 15 nt, Human
cucgugggagagcca

SEQ ID NO: 2475684 - RNA, 20 nt, Human
cucguggccuuccccagccu

SEQ ID NO: 2475685 - RNA, 14 nt, Human
cucguaacugguuu

SEQ ID NO: 2475686 - RNA, 14 nt, Human
cucguagccaucuc

SEQ ID NO: 2475687 - RNA, 18 nt, Human
cucguauaugucucaggu

SEQ ID NO: 2475688 - RNA, 13 nt, Human
cucgguuucucca

SEQ ID NO: 2475689 - RNA, 14 nt, Human
cucgguggacccag

SEQ ID NO: 2475690 - RNA, 11 nt, Human
cucggugccuu

SEQ ID NO: 2475691 - RNA, 23 nt, Human
cucgguguggagaagcggcuggc

SEQ ID NO: 2475692 - RNA, 24 nt, Human
cucgggcccaggccaucuuccagg

SEQ ID NO: 2475693 - RNA, 21 nt, Human
cucggguggcuagucagagag

SEQ ID NO: 2475694 - RNA, 23 nt, Human
cucgggcugagaacccugcgugg

SEQ ID NO: 2475695 - RNA, 17 nt, Human
cucgggcuccugugccc

SEQ ID NO: 2475696 - RNA, 15 nt, Human
cucgggcuccugugc

SEQ ID NO: 2475697 - RNA, 19 nt, Human
cucgggcgagucacugccu

SEQ ID NO: 2475698 - RNA, 21 nt, Human
cucgggcgagucacugccucu

SEQ ID NO: 2475699 - RNA, 14 nt, Human
cucgggcuccugug

SEQ ID NO: 2475700 - RNA, 22 nt, Human
cucgggcgagucacugccucuc

SEQ ID NO: 2475701 - RNA, 16 nt, Human
cucugcacaagcugca

SEQ ID NO: 2475702 - RNA, 22 nt, Human
cucugaaaucugaagaccucga

SEQ ID NO: 2475703 - RNA, 17 nt, Human
cucugaaaacggcccuc

SEQ ID NO: 2475704 - RNA, 17 nt, Human
cucugaaaccaguguua

SEQ ID NO: 2475705 - RNA, 15 nt, Human
cucugaaacccugga

SEQ ID NO: 2475706 - RNA, 18 nt, Human
cucucuuuuuggaggugc

SEQ ID NO: 2475707 - RNA, 21 nt, Human
cucucuuuguucucagcuccc

SEQ ID NO: 2475708 - RNA, 20 nt, Human
cucucuuuguucucagcucc

SEQ ID NO: 2475709 - RNA, 19 nt, Human
cucucuuuguucucagcuc

SEQ ID NO: 2475710 - RNA, 22 nt, Human
cucucuuuguucucagcucccc

SEQ ID NO: 2475711 - RNA, 20 nt, Human
cucucuuuuuggaggugcuu

SEQ ID NO: 2475712 - RNA, 19 nt, Human
cucucuuuuuggaggugcu

SEQ ID NO: 2475713 - RNA, 12 nt, Human
cucugaaaccag

SEQ ID NO: 2475714 - RNA, 16 nt, Human
cucugaaaucugaaga

SEQ ID NO: 2475715 - RNA, 19 nt, Human
cucucuggccuucggccuc

SEQ ID NO: 2475716 - RNA, 22 nt, Human
cucucuggccuucggccuccau

SEQ ID NO: 2475717 - RNA, 17 nt, Human
cucucuggccuucggcc

SEQ ID NO: 2475718 - RNA, 10 nt, Human
cucuccucug

SEQ ID NO: 2475719 - RNA, 20 nt, Human
cucucuugauuaagaucuca

SEQ ID NO: 2475720 - RNA, 20 nt, Human
cucuccucggcccccuccau

SEQ ID NO: 2475721 - RNA, 20 nt, Human
cucuccuccugcccaccugu

SEQ ID NO: 2475722 - RNA, 17 nt, Human
cucucuucugcuccacc

SEQ ID NO: 2475723 - RNA, 16 nt, Human
cucucuugcacccgcc

SEQ ID NO: 2475724 - RNA, 14 nt, Human
cucucuugcacccg

SEQ ID NO: 2475725 - RNA, 15 nt, Human
cucucuugguuuccu

SEQ ID NO: 2475726 - RNA, 13 nt, Human
cucucuugcaccc

SEQ ID NO: 2475727 - RNA, 15 nt, Human
cucuccucugccuca

SEQ ID NO: 2475728 - RNA, 18 nt, Human
cucucuucugcuccaccc

SEQ ID NO: 2475729 - RNA, 20 nt, Human
cucucuuuccuucuugccuu

SEQ ID NO: 2475730 - RNA, 17 nt, Human
cucucuuuccuucuugc

SEQ ID NO: 2475731 - RNA, 15 nt, Human
cucucuuuccuucuu

SEQ ID NO: 2475732 - RNA, 18 nt, Human
cucucuuuguucucagcu

SEQ ID NO: 2475733 - RNA, 15 nt, Human
cucucuuuguucuca

SEQ ID NO: 2475734 - RNA, 14 nt, Human
cucucuuuguucuc

SEQ ID NO: 2475735 - RNA, 18 nt, Human
cucucuuugggaauguuu

SEQ ID NO: 2475736 - RNA, 17 nt, Human
cucucuuugggaauguu

SEQ ID NO: 2475737 - RNA, 15 nt, Human
cucucuuugggaaug

SEQ ID NO: 2475738 - RNA, 20 nt, Human
cucuccuccuuuucacaguu

SEQ ID NO: 2475739 - RNA, 13 nt, Human
cucuccuccuuuu

SEQ ID NO: 2475740 - RNA, 16 nt, Human
cucuccgaccagacac

SEQ ID NO: 2475741 - RNA, 20 nt, Human
cucuccuccccaaggagaca

SEQ ID NO: 2475742 - RNA, 15 nt, Human
cucuccuccugccca

SEQ ID NO: 2475743 - RNA, 19 nt, Human
cucuccuccugcccaccug

SEQ ID NO: 2475744 - RNA, 13 nt, Human
cucucccuuggau

SEQ ID NO: 2475745 - RNA, 12 nt, Human
cucucccuggcc

SEQ ID NO: 2475746 - RNA, 13 nt, Human
cucucccuggccc

SEQ ID NO: 2475747 - RNA, 12 nt, Human
cucucccuguug

SEQ ID NO: 2475748 - RNA, 16 nt, Human
cucgugguaggacugu

SEQ ID NO: 2475749 - RNA, 15 nt, Human
cucgugguaggacug

SEQ ID NO: 2475750 - RNA, 19 nt, Human
cucccagcagcccuaagga

SEQ ID NO: 2475751 - RNA, 21 nt, Human
cucccagcaacacaagcugga

SEQ ID NO: 2475752 - RNA, 19 nt, Human
cucccagcccuauggaugu

SEQ ID NO: 2475753 - RNA, 18 nt, Human
cucccagcccuauggaug

SEQ ID NO: 2475754 - RNA, 21 nt, Human
cucccagcccuauggaugugg

SEQ ID NO: 2475755 - RNA, 16 nt, Human
cucccagcccuaugga

SEQ ID NO: 2475756 - RNA, 13 nt, Human
cucccaccucagc

SEQ ID NO: 2475757 - RNA, 17 nt, Human
cucccaccucagccucc

SEQ ID NO: 2475758 - RNA, 16 nt, Human
cucccaccucagccuc

SEQ ID NO: 2475759 - RNA, 15 nt, Human
cuccauaaccccacc

SEQ ID NO: 2475760 - RNA, 14 nt, Human
cuccauaaccccac

SEQ ID NO: 2475761 - RNA, 22 nt, Human
cuccauaaccccacccuugccc

SEQ ID NO: 2475762 - RNA, 14 nt, Human
cuccauacucagga

SEQ ID NO: 2475763 - RNA, 14 nt, Human
cucccaccucagcc

SEQ ID NO: 2475764 - RNA, 20 nt, Human
cuccaggugcacaagcucca

SEQ ID NO: 2475765 - RNA, 19 nt, Human
cuccaggugcacaagcucc

SEQ ID NO: 2475766 - RNA, 20 nt, Human
cuccagggaguccccucccc

SEQ ID NO: 2475767 - RNA, 18 nt, Human
cuccagggaguccccucc

SEQ ID NO: 2475768 - RNA, 17 nt, Human
cuccagggaguccccuc

SEQ ID NO: 2475769 - RNA, 14 nt, Human
cuccagggaguccc

SEQ ID NO: 2475770 - RNA, 18 nt, Human
cuccaggugcacaagcuc

SEQ ID NO: 2475771 - RNA, 22 nt, Human
cuccaggugcacaagcuccaag

SEQ ID NO: 2475772 - RNA, 15 nt, Human
cuccagugguugcug

SEQ ID NO: 2475773 - RNA, 23 nt, Human
cuccaguggggcaagauuuuccu

SEQ ID NO: 2475774 - RNA, 14 nt, Human
cuccagugccaaca

SEQ ID NO: 2475775 - RNA, 20 nt, Human
cuccaguggggcaagauuuu

SEQ ID NO: 2475776 - RNA, 18 nt, Human
cuccagugccagcaauga

SEQ ID NO: 2475777 - RNA, 21 nt, Human
cuccagggaguccccuccccg

SEQ ID NO: 2475778 - RNA, 19 nt, Human
cuccagugguugcuguuga

SEQ ID NO: 2475779 - RNA, 16 nt, Human
cuccagugguugcugu

SEQ ID NO: 2475780 - RNA, 17 nt, Human
cuccaguuuucaguuga

SEQ ID NO: 2475781 - RNA, 22 nt, Human
cuccaggcuguaucccaugagc

SEQ ID NO: 2475782 - RNA, 23 nt, Human
cuccaggcuguaucccaugagcc

SEQ ID NO: 2475783 - RNA, 17 nt, Human
cuccaggcugucuuuca

SEQ ID NO: 2475784 - RNA, 11 nt, Human
cuccagacaca

SEQ ID NO: 2475785 - RNA, 22 nt, Human
cuccagaauuucccaaagcagu

SEQ ID NO: 2475786 - RNA, 17 nt, Human
cucagacauuggcaccu

SEQ ID NO: 2475787 - RNA, 16 nt, Human
cuccagacacaugucc

SEQ ID NO: 2475788 - RNA, 22 nt, Human
cucagacaggaaagggaaggcc

SEQ ID NO: 2475789 - RNA, 20 nt, Human
cuccagacaaaccagaagca

SEQ ID NO: 2475790 - RNA, 16 nt, Human
cucagaaucucaaaua

SEQ ID NO: 2475791 - RNA, 17 nt, Human
cucagaaucucaaauaa

SEQ ID NO: 2475792 - RNA, 21 nt, Human
cuccagaauuucccaaagcag

SEQ ID NO: 2475793 - RNA, 13 nt, Human
cucagacauuggc

SEQ ID NO: 2475794 - RNA, 20 nt, Human
cucagacauguuuuccguga

SEQ ID NO: 2475795 - RNA, 19 nt, Human
cucagacauguuuuccgug

SEQ ID NO: 2475796 - RNA, 20 nt, Human
cuccgcuuucuacccagcga

SEQ ID NO: 2475797 - RNA, 21 nt, Human
cuccgcuuucuacccagcgag

SEQ ID NO: 2475798 - RNA, 15 nt, Human
cuccguauuucagac

SEQ ID NO: 2475799 - RNA, 13 nt, Human
cuccguauuucag

SEQ ID NO: 2475800 - RNA, 14 nt, Human
cuccguauuucaga

SEQ ID NO: 2475801 - RNA, 13 nt, Human
cuccggugugccu

SEQ ID NO: 2475802 - RNA, 18 nt, Human
cuccggugugccugcagc

SEQ ID NO: 2475803 - RNA, 19 nt, Human
cuccggugugccugcagcc

SEQ ID NO: 2475804 - RNA, 23 nt, Human
cuccggugugccugcagccccgc

SEQ ID NO: 2475805 - RNA, 23 nt, Human
cuccuagagacagaagcaggcug

SEQ ID NO: 2475806 - RNA, 18 nt, Human
cuccuagagacagaagca

SEQ ID NO: 2475807 - RNA, 17 nt, Human
cuccuagagacagaagc

SEQ ID NO: 2475808 - RNA, 21 nt, Human
cuccuagagaacgcagcccua

SEQ ID NO: 2475809 - RNA, 13 nt, Human
cuccuagagggag

SEQ ID NO: 2475810 - RNA, 15 nt, Human
cuccuagagggaggg

SEQ ID NO: 2475811 - RNA, 18 nt, Human
cuccuagagggaggggcc

SEQ ID NO: 2475812 - RNA, 19 nt, Human
cuccuagagggaggggccu

SEQ ID NO: 2475813 - RNA, 20 nt, Human
cuccuagagaacgcagcccu

SEQ ID NO: 2475814 - RNA, 18 nt, Human
cuccuagagaacgcagcc

SEQ ID NO: 2475815 - RNA, 15 nt, Human
cuccuagagaacgca

SEQ ID NO: 2475816 - RNA, 21 nt, Human
cuccuagacugacccugauca

SEQ ID NO: 2475817 - RNA, 22 nt, Human
cuccgcuuucuacccagcgagc

SEQ ID NO: 2475818 - RNA, 21 nt, Human
cuccggggagcgcccgcgccc

SEQ ID NO: 2475819 - RNA, 20 nt, Human
cuccgguaaaacaccggaga

SEQ ID NO: 2475820 - RNA, 18 nt, Human
cuccggggagcgcccgcg

SEQ ID NO: 2475821 - RNA, 14 nt, Human
cuccgggagagggg

SEQ ID NO: 2475822 - RNA, 15 nt, Human
cuccgggaccuggug

SEQ ID NO: 2475823 - RNA, 19 nt, Human
cucccucuuucccucccuu

SEQ ID NO: 2475824 - RNA, 15 nt, Human
cucccucuuucccuc

SEQ ID NO: 2475825 - RNA, 20 nt, Human
cucccucuucucaagugccu

SEQ ID NO: 2475826 - RNA, 15 nt, Human
cucccucuucucaag

SEQ ID NO: 2475827 - RNA, 14 nt, Human
cucccucuucucaa

SEQ ID NO: 2475828 - RNA, 18 nt, Human
cucccucuggcccugccu

SEQ ID NO: 2475829 - RNA, 19 nt, Human
cucccucuggcccugccuu

SEQ ID NO: 2475830 - RNA, 20 nt, Human
cucccucuggcccugccuuc

SEQ ID NO: 2475831 - RNA, 21 nt, Human
cucccucugaccugcaggcca

SEQ ID NO: 2475832 - RNA, 16 nt, Human
cucccucugaggcugu

SEQ ID NO: 2475833 - RNA, 17 nt, Human
cucccucuccugccuac

SEQ ID NO: 2475834 - RNA, 20 nt, Human
cucccucugaggcuguagga

SEQ ID NO: 2475835 - RNA, 17 nt, Human
cucccucugaggcugua

SEQ ID NO: 2475836 - RNA, 22 nt, Human
cucccucugccugaaccuucca

SEQ ID NO: 2475837 - RNA, 14 nt, Human
cucccucuggauca

SEQ ID NO: 2475838 - RNA, 13 nt, Human
cucccucuggauc

SEQ ID NO: 2475839 - RNA, 11 nt, Human
cucccucugga

SEQ ID NO: 2475840 - RNA, 16 nt, Human
cucccucuggaucaaa

SEQ ID NO: 2475841 - RNA, 14 nt, Human
cucccucuggcccu

SEQ ID NO: 2475842 - RNA, 15 nt, Human
cucccucuggcccug

SEQ ID NO: 2475843 - RNA, 17 nt, Human
cucccucuggcccugcc

SEQ ID NO: 2475844 - RNA, 18 nt, Human
cucccuccgauccuuccu

SEQ ID NO: 2475845 - RNA, 23 nt, Human
cucccuccccugcccugguccag

SEQ ID NO: 2475846 - RNA, 12 nt, Human
cucccucuccug

SEQ ID NO: 2475847 - RNA, 13 nt, Human
cucccucuccugc

SEQ ID NO: 2475848 - RNA, 14 nt, Human
cucccucuccugcc

SEQ ID NO: 2475849 - RNA, 15 nt, Human
cucccucuccugccu

SEQ ID NO: 2475850 - RNA, 15 nt, Human
cucccucucucuucu

SEQ ID NO: 2475851 - RNA, 16 nt, Human
cucccucucucuucug

SEQ ID NO: 2475852 - RNA, 17 nt, Human
cucccucucucuucugc

SEQ ID NO: 2475853 - RNA, 20 nt, Human
cucccucucucuucugcucc

SEQ ID NO: 2475854 - RNA, 21 nt, Human
cucccucucucuucugcucca

SEQ ID NO: 2475855 - RNA, 22 nt, Human
cucccucucucuucugcuccac

SEQ ID NO: 2475856 - RNA, 13 nt, Human
cucccucugaccu

SEQ ID NO: 2475857 - RNA, 14 nt, Human
cucccucugaccug

SEQ ID NO: 2475858 - RNA, 17 nt, Human
cucccucugaccugcag

SEQ ID NO: 2475859 - RNA, 18 nt, Human
cucccucugaccugcagg

SEQ ID NO: 2475860 - RNA, 14 nt, Human
cuccccaucccaug

SEQ ID NO: 2475861 - RNA, 21 nt, Human
cuccccaggguucaguccuca

SEQ ID NO: 2475862 - RNA, 11 nt, Human
cuccccaguuc

SEQ ID NO: 2475863 - RNA, 23 nt, Human
cuccccagguccagcucuggagg

SEQ ID NO: 2475864 - RNA, 21 nt, Human
cuccccagguccagcucugga

SEQ ID NO: 2475865 - RNA, 20 nt, Human
cuccccagguccagcucugg

SEQ ID NO: 2475866 - RNA, 19 nt, Human
cuccccagguccagcucug

SEQ ID NO: 2475867 - RNA, 18 nt, Human
cuccccagguccagcucu

SEQ ID NO: 2475868 - RNA, 11 nt, Human
cucccagccug

SEQ ID NO: 2475869 - RNA, 15 nt, Human
cucccagcucuagac

SEQ ID NO: 2475870 - RNA, 18 nt, Human
cucccagcucuagacaac

SEQ ID NO: 2475871 - RNA, 20 nt, Human
cucccagcucuagacaaccc

SEQ ID NO: 2475872 - RNA, 17 nt, Human
cuccccagguccagcuc

SEQ ID NO: 2475873 - RNA, 16 nt, Human
cuccccagguccagcu

SEQ ID NO: 2475874 - RNA, 11 nt, Human
cuccccagggg

SEQ ID NO: 2475875 - RNA, 21 nt, Human
cuccccaggggagagggucug

SEQ ID NO: 2475876 - RNA, 16 nt, Human
cucccucccucuuucc

SEQ ID NO: 2475877 - RNA, 18 nt, Human
cucccuccccugccauuu

SEQ ID NO: 2475878 - RNA, 16 nt, Human
cucccuccccugcccu

SEQ ID NO: 2475879 - RNA, 18 nt, Human
cucccuccccugcccugg

SEQ ID NO: 2475880 - RNA, 21 nt, Human
cucccuccccugcccuggucc

SEQ ID NO: 2475881 - RNA, 11 nt, Human
cucccuccccu

SEQ ID NO: 2475882 - RNA, 14 nt, Human
cucccuccccugcc

SEQ ID NO: 2475883 - RNA, 15 nt, Human
cucccuccccugcca

SEQ ID NO: 2475884 - RNA, 15 nt, Human
cuccccaucccaugu

SEQ ID NO: 2475885 - RNA, 18 nt, Human
cugaucucucgugauuga

SEQ ID NO: 2475886 - RNA, 17 nt, Human
cugaucucucgugauug

SEQ ID NO: 2475887 - RNA, 14 nt, Human
cugaucucucguga

SEQ ID NO: 2475888 - RNA, 16 nt, Human
cugaggugugggggcu

SEQ ID NO: 2475889 - RNA, 14 nt, Human
cugagguguggggg

SEQ ID NO: 2475890 - RNA, 13 nt, Human
cugaggugugggg

SEQ ID NO: 2475891 - RNA, 23 nt, Human
cugaggugggcccaggaccagcu

SEQ ID NO: 2475892 - RNA, 22 nt, Human
cugaggugggcccaggaccagc

SEQ ID NO: 2475893 - RNA, 20 nt, Human
cugaggugggcccaggacca

SEQ ID NO: 2475894 - RNA, 17 nt, Human
cugaggugggcccagga

SEQ ID NO: 2475895 - RNA, 16 nt, Human
cugaggugggcccagg

SEQ ID NO: 2475896 - RNA, 20 nt, Human
cugaggugugggggcugcag

SEQ ID NO: 2475897 - RNA, 19 nt, Human
cugaggugugggggcugca

SEQ ID NO: 2475898 - RNA, 18 nt, Human
cugaggugugggggcugc

SEQ ID NO: 2475899 - RNA, 17 nt, Human
cugaggugugggggcug

SEQ ID NO: 2475900 - RNA, 22 nt, Human
cugaggugugggggcugcagca

SEQ ID NO: 2475901 - RNA, 21 nt, Human
cugaggugugggggcugcagc

SEQ ID NO: 2475902 - RNA, 20 nt, Human
cugagguuccucugccugcc

SEQ ID NO: 2475903 - RNA, 19 nt, Human
cugagguuccucugccugc

SEQ ID NO: 2475904 - RNA, 18 nt, Human
cugagguuccucugccug

SEQ ID NO: 2475905 - RNA, 17 nt, Human
cugagguuccucugccu

SEQ ID NO: 2475906 - RNA, 16 nt, Human
cugagguuccucugcc

SEQ ID NO: 2475907 - RNA, 15 nt, Human
cugagguuccucugc

SEQ ID NO: 2475908 - RNA, 14 nt, Human
cugagguuccucug

SEQ ID NO: 2475909 - RNA, 21 nt, Human
cugaguaaaaaagcugugugc

SEQ ID NO: 2475910 - RNA, 23 nt, Human
cugagguuccucugccugccccg

SEQ ID NO: 2475911 - RNA, 21 nt, Human
cugagguuccucugccugccc

SEQ ID NO: 2475912 - RNA, 20 nt, Human
cugaguaagaaaugcugccc

SEQ ID NO: 2475913 - RNA, 22 nt, Human
cugaguaaucgcuuaaagaugu

SEQ ID NO: 2475914 - RNA, 16 nt, Human
cugaggaauuucaccu

SEQ ID NO: 2475915 - RNA, 21 nt, Human
cugaggggaggaucacuggag

SEQ ID NO: 2475916 - RNA, 23 nt, Human
cugaggaauccagacccggcugc

SEQ ID NO: 2475917 - RNA, 16 nt, Human
cugaggggcaucugcc

SEQ ID NO: 2475918 - RNA, 17 nt, Human
cugaggggcaucugccc

SEQ ID NO: 2475919 - RNA, 22 nt, Human
cugaggggaggaucacuggagc

SEQ ID NO: 2475920 - RNA, 23 nt, Human
cugaggggaggaucacuggagcc

SEQ ID NO: 2475921 - RNA, 14 nt, Human
cugaggggccucuu

SEQ ID NO: 2475922 - RNA, 20 nt, Human
cugaggggcaucugccccuc

SEQ ID NO: 2475923 - RNA, 18 nt, Human
cugaggggcaucugcccc

SEQ ID NO: 2475924 - RNA, 19 nt, Human
cugaggggcaucugccccu

SEQ ID NO: 2475925 - RNA, 20 nt, Human
cugaggguggagacuaagcc

SEQ ID NO: 2475926 - RNA, 19 nt, Human
cugaggguggagacuaagc

SEQ ID NO: 2475927 - RNA, 15 nt, Human
cugaggguggagacu

SEQ ID NO: 2475928 - RNA, 21 nt, Human
cugaggguccccaccugggac

SEQ ID NO: 2475929 - RNA, 20 nt, Human
cugaggguccccaccuggga

SEQ ID NO: 2475930 - RNA, 19 nt, Human
cugaggguccccaccuggg

SEQ ID NO: 2475931 - RNA, 18 nt, Human
cugaggguccccaccugg

SEQ ID NO: 2475932 - RNA, 15 nt, Human
cugaggguccccacc

SEQ ID NO: 2475933 - RNA, 22 nt, Human
cugaggggggccgugcccaggg

SEQ ID NO: 2475934 - RNA, 23 nt, Human
cugaggggggccgugcccagggg

SEQ ID NO: 2475935 - RNA, 21 nt, Human
cugaggggggccgugcccagg

SEQ ID NO: 2475936 - RNA, 20 nt, Human
cugaggggggccgugcccag

SEQ ID NO: 2475937 - RNA, 16 nt, Human
cugaggggggccgugc

SEQ ID NO: 2475938 - RNA, 13 nt, Human
cugaggugggagg

SEQ ID NO: 2475939 - RNA, 22 nt, Human
cugaggugggaggaucucuuga

SEQ ID NO: 2475940 - RNA, 21 nt, Human
cugaggugggagauguggaaa

SEQ ID NO: 2475941 - RNA, 15 nt, Human
cugaggugggcccag

SEQ ID NO: 2475942 - RNA, 14 nt, Human
cugaggugggccca

SEQ ID NO: 2475943 - RNA, 22 nt, Human
cugagcugggaugauuggaggg

SEQ ID NO: 2475944 - RNA, 13 nt, Human
cugagcugugcag

SEQ ID NO: 2475945 - RNA, 16 nt, Human
cugagcugcucugaau

SEQ ID NO: 2475946 - RNA, 16 nt, Human
cugagcugccauccag

SEQ ID NO: 2475947 - RNA, 12 nt, Human
cugagcugggau

SEQ ID NO: 2475948 - RNA, 15 nt, Human
cugagcugaggcagc

SEQ ID NO: 2475949 - RNA, 18 nt, Human
cugagcugaggcagcagu

SEQ ID NO: 2475950 - RNA, 13 nt, Human
cugagcugcucug

SEQ ID NO: 2475951 - RNA, 15 nt, Human
cugagcugccaucca

SEQ ID NO: 2475952 - RNA, 13 nt, Human
cugaccccugcuc

SEQ ID NO: 2475953 - RNA, 14 nt, Human
cugaccccugcuca

SEQ ID NO: 2475954 - RNA, 16 nt, Human
cugaccccugcucagu

SEQ ID NO: 2475955 - RNA, 19 nt, Human
cugacccugcuucaaauau

SEQ ID NO: 2475956 - RNA, 17 nt, Human
cugacccuccuguugca

SEQ ID NO: 2475957 - RNA, 14 nt, Human
cugacccuccuguu

SEQ ID NO: 2475958 - RNA, 13 nt, Human
cugacccuccugu

SEQ ID NO: 2475959 - RNA, 23 nt, Human
cugacccuccuguugcacccagc

SEQ ID NO: 2475960 - RNA, 22 nt, Human
cugacccuccuguugcacccag

SEQ ID NO: 2475961 - RNA, 18 nt, Human
cugacccucuccacccca

SEQ ID NO: 2475962 - RNA, 12 nt, Human
cugagcuuggaa

SEQ ID NO: 2475963 - RNA, 22 nt, Human
cugagcuugcagagaugaggcc

SEQ ID NO: 2475964 - RNA, 22 nt, Human
cugagcuucccccccaccacag

SEQ ID NO: 2475965 - RNA, 15 nt, Human
cugagcugugcaggu

SEQ ID NO: 2475966 - RNA, 16 nt, Human
cugagcuucucuguga

SEQ ID NO: 2475967 - RNA, 15 nt, Human
cugagcuucucugug

SEQ ID NO: 2475968 - RNA, 14 nt, Human
cugagcuuggaagc

SEQ ID NO: 2475969 - RNA, 20 nt, Human
cugagcuuggaagcuucugg

SEQ ID NO: 2475970 - RNA, 21 nt, Human
cugagcuuggaagcuucuggu

SEQ ID NO: 2475971 - RNA, 12 nt, Human
cugagcuuggcc

SEQ ID NO: 2475972 - RNA, 15 nt, Human
cugagcuuggccaga

SEQ ID NO: 2475973 - RNA, 16 nt, Human
cugagcuuggccagaa

SEQ ID NO: 2475974 - RNA, 17 nt, Human
cugagcuuggccagaag

SEQ ID NO: 2475975 - RNA, 22 nt, Human
cugaggaacccuuacaguagga

SEQ ID NO: 2475976 - RNA, 18 nt, Human
cugaggaagaacggggcu

SEQ ID NO: 2475977 - RNA, 15 nt, Human
cugaggaagaacggg

SEQ ID NO: 2475978 - RNA, 18 nt, Human
cugaggaagagggacugu

SEQ ID NO: 2475979 - RNA, 23 nt, Human
cugaggaagagggacuguucuuu

SEQ ID NO: 2475980 - RNA, 23 nt, Human
cugaggaagaacggggcucuucu

SEQ ID NO: 2475981 - RNA, 18 nt, Human
cugaggaagaugggggca

SEQ ID NO: 2475982 - RNA, 18 nt, Human
cugagcuuggccagaagg

SEQ ID NO: 2475983 - RNA, 20 nt, Human
cugaggaagcacagcagcau

SEQ ID NO: 2475984 - RNA, 23 nt, Human
cugaggaagaugggggcaagaag

SEQ ID NO: 2475985 - RNA, 19 nt, Human
cucugcacaagcugcaccc

SEQ ID NO: 2475986 - RNA, 17 nt, Human
cucugcacaagcugcac

SEQ ID NO: 2475987 - RNA, 18 nt, Human
cucugcacaagcugcacc

SEQ ID NO: 2475988 - RNA, 22 nt, Human
cugaaaauauaaccagccauug

SEQ ID NO: 2475989 - RNA, 18 nt, Human
cugaaaaugguauuuucc

SEQ ID NO: 2475990 - RNA, 20 nt, Human
cugaaaaucuaauauuaaaa

SEQ ID NO: 2475991 - RNA, 17 nt, Human
cugaaaaucuaauauua

SEQ ID NO: 2475992 - RNA, 16 nt, Human
cugaaaaucuaauauu

SEQ ID NO: 2475993 - RNA, 15 nt, Human
cugaaaaucuaauau

SEQ ID NO: 2475994 - RNA, 20 nt, Human
cugaaaaucgaguuuuuccu

SEQ ID NO: 2475995 - RNA, 13 nt, Human
cugaaagaggaau

SEQ ID NO: 2475996 - RNA, 17 nt, Human
cugaaagaggaaugaag

SEQ ID NO: 2475997 - RNA, 23 nt, Human
cugaaaaaucacauccuggccug

SEQ ID NO: 2475998 - RNA, 21 nt, Human
cugaaaaaucacauccuggcc

SEQ ID NO: 2475999 - RNA, 19 nt, Human
cugaaaaaucuaagugaua

SEQ ID NO: 2476000 - RNA, 22 nt, Human
cugaaaaaucuaagugauauaa

SEQ ID NO: 2476001 - RNA, 21 nt, Human
cugaaaaaugguaauuguugc

SEQ ID NO: 2476002 - RNA, 15 nt, Human
cugaaaauauaacca

SEQ ID NO: 2476003 - RNA, 13 nt, Human
cugaaaauauaac

SEQ ID NO: 2476004 - RNA, 19 nt, Human
cugaaaagacucaguguuc

SEQ ID NO: 2476005 - RNA, 17 nt, Human
cugaaaaaucacauccu

SEQ ID NO: 2476006 - RNA, 12 nt, Human
cugaaaaaucac

SEQ ID NO: 2476007 - RNA, 21 nt, Human
cugaaaaaacaccuagcuuua

SEQ ID NO: 2476008 - RNA, 20 nt, Human
cugaaaaaaaguuuacaagu

SEQ ID NO: 2476009 - RNA, 22 nt, Human
cugaaaaaacaccuagcuuuau

SEQ ID NO: 2476010 - RNA, 18 nt, Human
cugaaaaaaaguuuacaa

SEQ ID NO: 2476011 - RNA, 15 nt, Human
cugaaaaaaaguuua

SEQ ID NO: 2476012 - RNA, 14 nt, Human
cugaaaaaaaguuu

SEQ ID NO: 2476013 - RNA, 12 nt, Human
cucuugcacccg

SEQ ID NO: 2476014 - RNA, 23 nt, Human
cucuugcaauccacaaucugaca

SEQ ID NO: 2476015 - RNA, 20 nt, Human
cucuugcaauccacaaucug

SEQ ID NO: 2476016 - RNA, 13 nt, Human
cucuugauuuuca

SEQ ID NO: 2476017 - RNA, 24 nt, Human
cucuugauucauaaugacuuaagc

SEQ ID NO: 2476018 - RNA, 12 nt, Human
cucuugccccaa

SEQ ID NO: 2476019 - RNA, 22 nt, Human
cucuugccacugccucuuccuc

SEQ ID NO: 2476020 - RNA, 19 nt, Human
cucuugcacccgccucucc

SEQ ID NO: 2476021 - RNA, 15 nt, Human
cucuugcacccgccu

SEQ ID NO: 2476022 - RNA, 14 nt, Human
cucuugcacccgcc

SEQ ID NO: 2476023 - RNA, 13 nt, Human
cucuugcacccgc

SEQ ID NO: 2476024 - RNA, 21 nt, Human
cucuugcacccgccucucccg

SEQ ID NO: 2476025 - RNA, 20 nt, Human
cucuugcacccgccucuccc

SEQ ID NO: 2476026 - RNA, 14 nt, Human
cucuugcaggucuc

SEQ ID NO: 2476027 - RNA, 22 nt, Human
cucuugcccuucccugucccuc

SEQ ID NO: 2476028 - RNA, 21 nt, Human
cucuugcccuucccugucccu

SEQ ID NO: 2476029 - RNA, 20 nt, Human
cucuugcccuucccuguccc

SEQ ID NO: 2476030 - RNA, 14 nt, Human
cucuuuuuguuuuu

SEQ ID NO: 2476031 - RNA, 22 nt, Human
cucuugccccaacccccagcac

SEQ ID NO: 2476032 - RNA, 20 nt, Human
cucuugccccaacccccagc

SEQ ID NO: 2476033 - RNA, 19 nt, Human
cucuugccccaacccccag

SEQ ID NO: 2476034 - RNA, 14 nt, Human
cucuugccccaacc

SEQ ID NO: 2476035 - RNA, 23 nt, Human
cucuugccccaacccccagcacc

SEQ ID NO: 2476036 - RNA, 12 nt, Human
cucuugcccccc

SEQ ID NO: 2476037 - RNA, 13 nt, Human
cucuugcccccca

SEQ ID NO: 2476038 - RNA, 16 nt, Human
cucuugccccccaccc

SEQ ID NO: 2476039 - RNA, 19 nt, Human
cucuugcccuucccugucc

SEQ ID NO: 2476040 - RNA, 17 nt, Human
cucuugcccuucccugu

SEQ ID NO: 2476041 - RNA, 16 nt, Human
cucuugcccuucccug

SEQ ID NO: 2476042 - RNA, 15 nt, Human
cucuugcccuucccu

SEQ ID NO: 2476043 - RNA, 19 nt, Human
cucuugccccccaccccag

SEQ ID NO: 2476044 - RNA, 20 nt, Human
cucuugccccccaccccagc

SEQ ID NO: 2476045 - RNA, 14 nt, Human
cucuugcccuuccc

SEQ ID NO: 2476046 - RNA, 22 nt, Human
cucuugccccccaccccagccu

SEQ ID NO: 2476047 - RNA, 15 nt, Human
cucuugagccuggga

SEQ ID NO: 2476048 - RNA, 16 nt, Human
cucuugagccugggag

SEQ ID NO: 2476049 - RNA, 22 nt, Human
cucuugauucauaaugacuuaa

SEQ ID NO: 2476050 - RNA, 19 nt, Human
cucuugauaccccccucug

SEQ ID NO: 2476051 - RNA, 18 nt, Human
cucuugauaccccccucu

SEQ ID NO: 2476052 - RNA, 21 nt, Human
cucuugauaccccccucuguc

SEQ ID NO: 2476053 - RNA, 23 nt, Human
cucuugaguuugucgcucaugug

SEQ ID NO: 2476054 - RNA, 14 nt, Human
cucuugaggccagg

SEQ ID NO: 2476055 - RNA, 16 nt, Human
cucuugaggccaggag

SEQ ID NO: 2476056 - RNA, 17 nt, Human
cucuugaggccaggagu

SEQ ID NO: 2476057 - RNA, 14 nt, Human
cucuugagggagcu

SEQ ID NO: 2476058 - RNA, 15 nt, Human
cucuugagggagcuu

SEQ ID NO: 2476059 - RNA, 13 nt, Human
cucuugagccugg

SEQ ID NO: 2476060 - RNA, 14 nt, Human
cucuugagccuggg

SEQ ID NO: 2476061 - RNA, 20 nt, Human
cugaccccuccucacuggcc

SEQ ID NO: 2476062 - RNA, 17 nt, Human
cugaccccuccucacug

SEQ ID NO: 2476063 - RNA, 16 nt, Human
cugaccccuccucacu

SEQ ID NO: 2476064 - RNA, 15 nt, Human
cugaccccuccucac

SEQ ID NO: 2476065 - RNA, 14 nt, Human
cugaccccuccuca

SEQ ID NO: 2476066 - RNA, 12 nt, Human
cugaccccuccu

SEQ ID NO: 2476067 - RNA, 20 nt, Human
cugaccccucauagcccuca

SEQ ID NO: 2476068 - RNA, 21 nt, Human
cugaccccucauagcccucac

SEQ ID NO: 2476069 - RNA, 17 nt, Human
cugaccccucauagccc

SEQ ID NO: 2476070 - RNA, 23 nt, Human
cugacacacagcucuguccuggg

SEQ ID NO: 2476071 - RNA, 22 nt, Human
cugacacacagcucuguccugg

SEQ ID NO: 2476072 - RNA, 21 nt, Human
cugacacacagcucuguccug

SEQ ID NO: 2476073 - RNA, 20 nt, Human
cugacacacagcucuguccu

SEQ ID NO: 2476074 - RNA, 19 nt, Human
cugacacacagcucugucc

SEQ ID NO: 2476075 - RNA, 18 nt, Human
cugacacacagcucuguc

SEQ ID NO: 2476076 - RNA, 17 nt, Human
cugacacacagcucugu

SEQ ID NO: 2476077 - RNA, 16 nt, Human
cugacacacagcucug

SEQ ID NO: 2476078 - RNA, 15 nt, Human
cugacacacagcucu

SEQ ID NO: 2476079 - RNA, 13 nt, Human
cugacacacagcu

SEQ ID NO: 2476080 - RNA, 17 nt, Human
cugaagccagccuucuu

SEQ ID NO: 2476081 - RNA, 14 nt, Human
cugaagccagccuu

SEQ ID NO: 2476082 - RNA, 13 nt, Human
cugaagccagccu

SEQ ID NO: 2476083 - RNA, 16 nt, Human
cugaagccaaagccaa

SEQ ID NO: 2476084 - RNA, 23 nt, Human
cugaagcauguuucauguuuugu

SEQ ID NO: 2476085 - RNA, 20 nt, Human
cugaagcauguuucauguuu

SEQ ID NO: 2476086 - RNA, 18 nt, Human
cugaagcauguuucaugu

SEQ ID NO: 2476087 - RNA, 15 nt, Human
cugaagcauguuuca

SEQ ID NO: 2476088 - RNA, 14 nt, Human
cugaagccauuguc

SEQ ID NO: 2476089 - RNA, 13 nt, Human
cugacaaucaacu

SEQ ID NO: 2476090 - RNA, 21 nt, Human
cugacaaucaacucuaauagu

SEQ ID NO: 2476091 - RNA, 18 nt, Human
cugacacaaaaaguagau

SEQ ID NO: 2476092 - RNA, 22 nt, Human
cugaaagaggcugaggccugga

SEQ ID NO: 2476093 - RNA, 11 nt, Human
cugaaagccac

SEQ ID NO: 2476094 - RNA, 12 nt, Human
cugaaagccacg

SEQ ID NO: 2476095 - RNA, 14 nt, Human
cugaagcagaugca

SEQ ID NO: 2476096 - RNA, 14 nt, Human
cugaaaauguaugu

SEQ ID NO: 2476097 - RNA, 14 nt, Human
cugaaagaggcuga

SEQ ID NO: 2476098 - RNA, 14 nt, Human
cugaaagaggccaa

SEQ ID NO: 2476099 - RNA, 20 nt, Human
cugaagcagccucuccccag

SEQ ID NO: 2476100 - RNA, 16 nt, Human
cugaagcagccucucc

SEQ ID NO: 2476101 - RNA, 15 nt, Human
cugaagcagccucuc

SEQ ID NO: 2476102 - RNA, 14 nt, Human
cugaagcagccucu

SEQ ID NO: 2476103 - RNA, 19 nt, Human
cugaagcagguucccaagc

SEQ ID NO: 2476104 - RNA, 20 nt, Human
cugaagcagguucccaagcu

SEQ ID NO: 2476105 - RNA, 21 nt, Human
cugaagcagguucccaagcuc

SEQ ID NO: 2476106 - RNA, 13 nt, Human
cugaagcauguuu

SEQ ID NO: 2476107 - RNA, 22 nt, Human
cugaagcagaugcaaagaggca

SEQ ID NO: 2476108 - RNA, 19 nt, Human
cugacacaaaccugccugg

SEQ ID NO: 2476109 - RNA, 18 nt, Human
cugacacaaaccugccug

SEQ ID NO: 2476110 - RNA, 16 nt, Human
cugacacaaaccugcc

SEQ ID NO: 2476111 - RNA, 14 nt, Human
cugacacaaaccug

SEQ ID NO: 2476112 - RNA, 20 nt, Human
cugacacaaaccugccuggg

SEQ ID NO: 2476113 - RNA, 18 nt, Human
cugacacaggaugaaggc

SEQ ID NO: 2476114 - RNA, 14 nt, Human
cugacacccauguu

SEQ ID NO: 2476115 - RNA, 13 nt, Human
cugacacccaugu

SEQ ID NO: 2476116 - RNA, 21 nt, Human
cugacacccauguuucucugg

SEQ ID NO: 2476117 - RNA, 23 nt, Human
cugacacugcggggcuuggcuga

SEQ ID NO: 2476118 - RNA, 22 nt, Human
cugacacugguauuccugccuc

SEQ ID NO: 2476119 - RNA, 19 nt, Human
cugacacuuuaauuaccaa

SEQ ID NO: 2476120 - RNA, 14 nt, Human
cugacagaaagcag

SEQ ID NO: 2476121 - RNA, 21 nt, Human
cugacacugcggggcuuggcu

SEQ ID NO: 2476122 - RNA, 13 nt, Human
cugacacugcggg

SEQ ID NO: 2476123 - RNA, 17 nt, Human
cugacacucccuugggc

SEQ ID NO: 2476124 - RNA, 19 nt, Human
cugacaccuuugcaggcau

SEQ ID NO: 2476125 - RNA, 14 nt, Human
cugacacguccacc

SEQ ID NO: 2476126 - RNA, 17 nt, Human
cugacacguccacccca

SEQ ID NO: 2476127 - RNA, 14 nt, Human
cugacaccuuucau

SEQ ID NO: 2476128 - RNA, 16 nt, Human
gugagaggggaacaga

SEQ ID NO: 2476129 - RNA, 13 nt, Human
gugagagcugggu

SEQ ID NO: 2476130 - RNA, 18 nt, Human
gugagaaucccuggcaaa

SEQ ID NO: 2476131 - RNA, 22 nt, Human
gugagaauaagagagucauaaa

SEQ ID NO: 2476132 - RNA, 19 nt, Human
gugagacaguccagccugg

SEQ ID NO: 2476133 - RNA, 18 nt, Human
gugagacaguccagccug

SEQ ID NO: 2476134 - RNA, 23 nt, Human
gugagagggcaugcgcacaaggc

SEQ ID NO: 2476135 - RNA, 15 nt, Human
gugagcaauccugca

SEQ ID NO: 2476136 - RNA, 14 nt, Human
gugagcacagccua

SEQ ID NO: 2476137 - RNA, 13 nt, Human
gugagagugagcu

SEQ ID NO: 2476138 - RNA, 21 nt, Human
gugagcacuaaggugugcucu

SEQ ID NO: 2476139 - RNA, 19 nt, Human
gugagcagaaguggagcug

SEQ ID NO: 2476140 - RNA, 19 nt, Human
gugagcacucccaagucua

SEQ ID NO: 2476141 - RNA, 16 nt, Human
gugagcacucccaagu

SEQ ID NO: 2476142 - RNA, 21 nt, Human
gugagcacggccaacaaagcu

SEQ ID NO: 2476143 - RNA, 20 nt, Human
gugagcagaaguggagcugg

SEQ ID NO: 2476144 - RNA, 17 nt, Human
gugagcagacugguggg

SEQ ID NO: 2476145 - RNA, 17 nt, Human
gugaguacuacaguccu

SEQ ID NO: 2476146 - RNA, 15 nt, Human
gugagcaggcuguga

SEQ ID NO: 2476147 - RNA, 21 nt, Human
gugagguggaauuauuuuaaa

SEQ ID NO: 2476148 - RNA, 15 nt, Human
gugacccccagcucc

SEQ ID NO: 2476149 - RNA, 17 nt, Human
gugacccccagcuccgg

SEQ ID NO: 2476150 - RNA, 20 nt, Human
gugaccccuuuucagcuucu

SEQ ID NO: 2476151 - RNA, 19 nt, Human
gugaccccuuuucagcuuc

SEQ ID NO: 2476152 - RNA, 16 nt, Human
gugacccccagcuccg

SEQ ID NO: 2476153 - RNA, 23 nt, Human
gugaccccuuuucagcuucugcu

SEQ ID NO: 2476154 - RNA, 22 nt, Human
gugaccccuuuucagcuucugc

SEQ ID NO: 2476155 - RNA, 20 nt, Human
gugacuuuggcugcaugcga

SEQ ID NO: 2476156 - RNA, 12 nt, Human
gugaccccaggu

SEQ ID NO: 2476157 - RNA, 14 nt, Human
gugacccagguccu

SEQ ID NO: 2476158 - RNA, 15 nt, Human
gugacccagucagag

SEQ ID NO: 2476159 - RNA, 22 nt, Human
gugagaaaaagcuccuguccuc

SEQ ID NO: 2476160 - RNA, 17 nt, Human
gugagaaaaagcuccug

SEQ ID NO: 2476161 - RNA, 15 nt, Human
gugagaacuacucag

SEQ ID NO: 2476162 - RNA, 20 nt, Human
gugagaagugaaugcuggga

SEQ ID NO: 2476163 - RNA, 22 nt, Human
gugagaagugaaugcugggacu

SEQ ID NO: 2476164 - RNA, 21 nt, Human
gugagaagugaaugcugggac

SEQ ID NO: 2476165 - RNA, 14 nt, Human
gugagaauaagaga

SEQ ID NO: 2476166 - RNA, 17 nt, Human
gugagaauaggcagccc

SEQ ID NO: 2476167 - RNA, 12 nt, Human
gugagagcuggg

SEQ ID NO: 2476168 - RNA, 20 nt, Human
aacugaaaucauacuucuua

SEQ ID NO: 2476169 - RNA, 13 nt, Human
aacugaaaucaua

SEQ ID NO: 2476170 - RNA, 17 nt, Human
aacucugucuucaccug

SEQ ID NO: 2476171 - RNA, 20 nt, Human
aacucugucuucaccugauu

SEQ ID NO: 2476172 - RNA, 20 nt, Human
aacucuguguugugaauguc

SEQ ID NO: 2476173 - RNA, 23 nt, Human
aacucugucuucaccugauucaa

SEQ ID NO: 2476174 - RNA, 16 nt, Human
aacucuguggcauuau

SEQ ID NO: 2476175 - RNA, 21 nt, Human
aacucugggcugcuacccaga

SEQ ID NO: 2476176 - RNA, 22 nt, Human
aacucugggcugcuacccagaa

SEQ ID NO: 2476177 - RNA, 15 nt, Human
aacugaacauuccag

SEQ ID NO: 2476178 - RNA, 21 nt, Human
aacugcaggcccuggccuccc

SEQ ID NO: 2476179 - RNA, 20 nt, Human
aacugcaggcccuggccucc

SEQ ID NO: 2476180 - RNA, 19 nt, Human
aacugcaggcccuggccuc

SEQ ID NO: 2476181 - RNA, 18 nt, Human
aacugcaggcccuggccu

SEQ ID NO: 2476182 - RNA, 17 nt, Human
aacugcaggcccuggcc

SEQ ID NO: 2476183 - RNA, 16 nt, Human
aacugcaggcccuggc

SEQ ID NO: 2476184 - RNA, 14 nt, Human
aacugcaggcccug

SEQ ID NO: 2476185 - RNA, 20 nt, Human
aacucuggcuuccagguauc

SEQ ID NO: 2476186 - RNA, 18 nt, Human
aacucuggcuuccaggua

SEQ ID NO: 2476187 - RNA, 17 nt, Human
aacucuggcuuccaggu

SEQ ID NO: 2476188 - RNA, 16 nt, Human
aacucuggcuuccagg

SEQ ID NO: 2476189 - RNA, 22 nt, Human
aacucugcugucuaaccuguga

SEQ ID NO: 2476190 - RNA, 16 nt, Human
aacucugcuugauuuu

SEQ ID NO: 2476191 - RNA, 11 nt, Human
aacucugcugu

SEQ ID NO: 2476192 - RNA, 16 nt, Human
aacucugcauucuagu

SEQ ID NO: 2476193 - RNA, 14 nt, Human
aacucugccagcca

SEQ ID NO: 2476194 - RNA, 20 nt, Human
gugaguccuggcaugggaau

SEQ ID NO: 2476195 - RNA, 15 nt, Human
aacucugcacuacuc

SEQ ID NO: 2476196 - RNA, 19 nt, Human
gugaguacuacaguccucc

SEQ ID NO: 2476197 - RNA, 20 nt, Human
gugagguggguuuucuuccc

SEQ ID NO: 2476198 - RNA, 14 nt, Human
gugaguaagagcug

SEQ ID NO: 2476199 - RNA, 15 nt, Human
gugaguaagagcugg

SEQ ID NO: 2476200 - RNA, 16 nt, Human
gugaguaagagcuggu

SEQ ID NO: 2476201 - RNA, 17 nt, Human
gugaguccuggcauggg

SEQ ID NO: 2476202 - RNA, 15 nt, Human
gugaguccauucucc

SEQ ID NO: 2476203 - RNA, 21 nt, Human
gugaccagcaccaucucuccu

SEQ ID NO: 2476204 - RNA, 18 nt, Human
gugaccagcaccaucucu

SEQ ID NO: 2476205 - RNA, 18 nt, Human
gugaccauguuuuguuua

SEQ ID NO: 2476206 - RNA, 17 nt, Human
gugaccacucugucuug

SEQ ID NO: 2476207 - RNA, 17 nt, Human
gugaccaggcauccucc

SEQ ID NO: 2476208 - RNA, 14 nt, Human
gugaccagggguga

SEQ ID NO: 2476209 - RNA, 14 nt, Human
gugacccaaugauu

SEQ ID NO: 2476210 - RNA, 22 nt, Human
gugaccaacuagacauucuguc

SEQ ID NO: 2476211 - RNA, 19 nt, Human
gugaccaacuagacauucu

SEQ ID NO: 2476212 - RNA, 16 nt, Human
gugaccaaaauccccu

SEQ ID NO: 2476213 - RNA, 24 nt, Human
gugacauggugccugagaggcagg

SEQ ID NO: 2476214 - RNA, 23 nt, Human
gugacauggugccugagaggcag

SEQ ID NO: 2476215 - RNA, 13 nt, Human
gugacauguaaca

SEQ ID NO: 2476216 - RNA, 17 nt, Human
gugaccaaugaugguca

SEQ ID NO: 2476217 - RNA, 15 nt, Human
gugaccaaugucuug

SEQ ID NO: 2476218 - RNA, 16 nt, Human
gugaccaaugucuuga

SEQ ID NO: 2476219 - RNA, 23 nt, Human
gugaccaacuagacauucugucg

SEQ ID NO: 2476220 - RNA, 19 nt, Human
gugaccaaguuauaaauca

SEQ ID NO: 2476221 - RNA, 14 nt, Human
gugacaugucuuuu

SEQ ID NO: 2476222 - RNA, 22 nt, Human
gugacauggugccugagaggca

SEQ ID NO: 2476223 - RNA, 20 nt, Human
gugacauggugccugagagg

SEQ ID NO: 2476224 - RNA, 19 nt, Human
gugacauggugccugagag

SEQ ID NO: 2476225 - RNA, 16 nt, Human
gugacauggugccuga

SEQ ID NO: 2476226 - RNA, 15 nt, Human
gugacauggugccug

SEQ ID NO: 2476227 - RNA, 14 nt, Human
gugacaucucuuac

SEQ ID NO: 2476228 - RNA, 22 nt, Human
gugacaugcgggcugggcagcu

SEQ ID NO: 2476229 - RNA, 18 nt, Human
gugacaucaguggcaugg

SEQ ID NO: 2476230 - RNA, 21 nt, Human
gugacaugcgggcugggcagc

SEQ ID NO: 2476231 - RNA, 20 nt, Human
gugacaugcgggcugggcag

SEQ ID NO: 2476232 - RNA, 16 nt, Human
gugacaugcgggcugg

SEQ ID NO: 2476233 - RNA, 19 nt, Human
gugacagaggcagccccau

SEQ ID NO: 2476234 - RNA, 18 nt, Human
gugacagaggcagcccca

SEQ ID NO: 2476235 - RNA, 16 nt, Human
gugacagaggcagccc

SEQ ID NO: 2476236 - RNA, 18 nt, Human
gugaaguuagaauuccuu

SEQ ID NO: 2476237 - RNA, 17 nt, Human
gugaaguuagaauuccu

SEQ ID NO: 2476238 - RNA, 14 nt, Human
gugaaguuagaauu

SEQ ID NO: 2476239 - RNA, 16 nt, Human
gugaaguccuucaccu

SEQ ID NO: 2476240 - RNA, 16 nt, Human
aacuauauuuucuuua

SEQ ID NO: 2476241 - RNA, 13 nt, Human
aacuauauuuucu

SEQ ID NO: 2476242 - RNA, 18 nt, Human
aacuagacauucugucgc

SEQ ID NO: 2476243 - RNA, 16 nt, Human
aacuagacauucuguc

SEQ ID NO: 2476244 - RNA, 23 nt, Human
gugaagacaaugacuuacuguac

SEQ ID NO: 2476245 - RNA, 19 nt, Human
gugaagaggggcagcccuu

SEQ ID NO: 2476246 - RNA, 17 nt, Human
gugaagaggggcagccc

SEQ ID NO: 2476247 - RNA, 16 nt, Human
gugaagaggggcagcc

SEQ ID NO: 2476248 - RNA, 15 nt, Human
gugaagaggggcagc

SEQ ID NO: 2476249 - RNA, 14 nt, Human
gugaagaggggcag

SEQ ID NO: 2476250 - RNA, 13 nt, Human
gugaagaggggca

SEQ ID NO: 2476251 - RNA, 12 nt, Human
gugaagaggggc

SEQ ID NO: 2476252 - RNA, 19 nt, Human
gugaagagggagaagcaug

SEQ ID NO: 2476253 - RNA, 23 nt, Human
gugaagaaaagugaaugcucaag

SEQ ID NO: 2476254 - RNA, 23 nt, Human
aacuaucucauuuccaagcaagu

SEQ ID NO: 2476255 - RNA, 20 nt, Human
aacuaucucauuuccaagca

SEQ ID NO: 2476256 - RNA, 13 nt, Human
aacuauauuguuu

SEQ ID NO: 2476257 - RNA, 16 nt, Human
aacuagaauuugauua

SEQ ID NO: 2476258 - RNA, 15 nt, Human
aacuagaauuugauu

SEQ ID NO: 2476259 - RNA, 16 nt, Human
aacuagaaccuggagg

SEQ ID NO: 2476260 - RNA, 15 nt, Human
aacuacuguguuccu

SEQ ID NO: 2476261 - RNA, 18 nt, Human
gugaagcaccaagcucaa

SEQ ID NO: 2476262 - RNA, 17 nt, Human
gugaagcaccaagcuca

SEQ ID NO: 2476263 - RNA, 10 nt, Human
gugaagccaa

SEQ ID NO: 2476264 - RNA, 20 nt, Human
gugaagccaauucagacagg

SEQ ID NO: 2476265 - RNA, 22 nt, Human
gugaagccaauucagacaggca

SEQ ID NO: 2476266 - RNA, 15 nt, Human
gugaaggaauauaug

SEQ ID NO: 2476267 - RNA, 12 nt, Human
gugaaggacccu

SEQ ID NO: 2476268 - RNA, 13 nt, Human
gugaaggacccuu

SEQ ID NO: 2476269 - RNA, 20 nt, Human
gugaaggccgagaagcaaga

SEQ ID NO: 2476270 - RNA, 14 nt, Human
gugaagugaagaca

SEQ ID NO: 2476271 - RNA, 16 nt, Human
gugaagugaaugaaac

SEQ ID NO: 2476272 - RNA, 17 nt, Human
gugaaguauacuguauu

SEQ ID NO: 2476273 - RNA, 19 nt, Human
gugaaguauacuguauuuu

SEQ ID NO: 2476274 - RNA, 20 nt, Human
gugaagguccugcuauuacu

SEQ ID NO: 2476275 - RNA, 17 nt, Human
gugaagguccugcuauu

SEQ ID NO: 2476276 - RNA, 17 nt, Human
gugaaggcuucucucug

SEQ ID NO: 2476277 - RNA, 22 nt, Human
gugaaggcuucucucuguggga

SEQ ID NO: 2476278 - RNA, 14 nt, Human
gugaaggcuucucu

SEQ ID NO: 2476279 - RNA, 15 nt, Human
aaccuuuagggcagc

SEQ ID NO: 2476280 - RNA, 14 nt, Human
aaccuuuagggcag

SEQ ID NO: 2476281 - RNA, 17 nt, Human
aaccuuguuauuucuca

SEQ ID NO: 2476282 - RNA, 18 nt, Human
aaccuuucaaauuucaca

SEQ ID NO: 2476283 - RNA, 19 nt, Human
aaccuuuagggcagcuugc

SEQ ID NO: 2476284 - RNA, 16 nt, Human
aaccuuuagggcagcu

SEQ ID NO: 2476285 - RNA, 14 nt, Human
aaccuuucaaauuu

SEQ ID NO: 2476286 - RNA, 22 nt, Human
aaccuugguguaguugaacuga

SEQ ID NO: 2476287 - RNA, 23 nt, Human
aaccuuagauguucuaagucuuu

SEQ ID NO: 2476288 - RNA, 21 nt, Human
aaccuugugccuggcucagag

SEQ ID NO: 2476289 - RNA, 15 nt, Human
aaccuugugccuggc

SEQ ID NO: 2476290 - RNA, 18 nt, Human
aaccuuguuauuucucag

SEQ ID NO: 2476291 - RNA, 19 nt, Human
aaccuugucucuaugccag

SEQ ID NO: 2476292 - RNA, 23 nt, Human
aaccuugucucuaugccagcuca

SEQ ID NO: 2476293 - RNA, 23 nt, Human
aacguggcugcuucaaggauccu

SEQ ID NO: 2476294 - RNA, 19 nt, Human
aacguguugccuugaacca

SEQ ID NO: 2476295 - RNA, 18 nt, Human
aacguggggcagcacaga

SEQ ID NO: 2476296 - RNA, 17 nt, Human
aacguggggcagcacag

SEQ ID NO: 2476297 - RNA, 22 nt, Human
aacguggggcagcacagagagg

SEQ ID NO: 2476298 - RNA, 12 nt, Human
aacuaacacuau

SEQ ID NO: 2476299 - RNA, 23 nt, Human
aacuaagaaauaugcacaauagc

SEQ ID NO: 2476300 - RNA, 16 nt, Human
aacuaacacuauuuua

SEQ ID NO: 2476301 - RNA, 14 nt, Human
aacguugcuguggg

SEQ ID NO: 2476302 - RNA, 13 nt, Human
aacguugcugugg

SEQ ID NO: 2476303 - RNA, 14 nt, Human
aacguugcucccca

SEQ ID NO: 2476304 - RNA, 16 nt, Human
aacguugcugugggaa

SEQ ID NO: 2476305 - RNA, 16 nt, Human
aacuacuguguuccug

SEQ ID NO: 2476306 - RNA, 17 nt, Human
aacuacuguguuccugg

SEQ ID NO: 2476307 - RNA, 19 nt, Human
aacuaagcccccgcuguaa

SEQ ID NO: 2476308 - RNA, 17 nt, Human
aacuaagcccccgcugu

SEQ ID NO: 2476309 - RNA, 14 nt, Human
aacuaauaaaagca

SEQ ID NO: 2476310 - RNA, 15 nt, Human
aacuaauaaaagcau

SEQ ID NO: 2476311 - RNA, 17 nt, Human
aacuagaauuuauucaa

SEQ ID NO: 2476312 - RNA, 22 nt, Human
aacuagaauuuauucaauuccu

SEQ ID NO: 2476313 - RNA, 19 nt, Human
aacuagaauuuauucaauu

SEQ ID NO: 2476314 - RNA, 16 nt, Human
aacuagaaaucugcca

SEQ ID NO: 2476315 - RNA, 15 nt, Human
aaccugcccugccug

SEQ ID NO: 2476316 - RNA, 13 nt, Human
aaccugcccugcc

SEQ ID NO: 2476317 - RNA, 11 nt, Human
aaccugcccug

SEQ ID NO: 2476318 - RNA, 19 nt, Human
aaccugccagggagacaga

SEQ ID NO: 2476319 - RNA, 15 nt, Human
aaccugccagggaga

SEQ ID NO: 2476320 - RNA, 22 nt, Human
aaccugcaagggcuccccacug

SEQ ID NO: 2476321 - RNA, 21 nt, Human
aaccuguuaccuacuuugacu

SEQ ID NO: 2476322 - RNA, 13 nt, Human
aaccuguucugcu

SEQ ID NO: 2476323 - RNA, 17 nt, Human
aaccuguucugcuuucc

SEQ ID NO: 2476324 - RNA, 24 nt, Human
aaccuguuaccuacuuugacuuuu

SEQ ID NO: 2476325 - RNA, 21 nt, Human
aaccuguugauagcaagugaa

SEQ ID NO: 2476326 - RNA, 19 nt, Human
aaccuguuuaaauauuuca

SEQ ID NO: 2476327 - RNA, 19 nt, Human
aaccugauugugucucuug

SEQ ID NO: 2476328 - RNA, 17 nt, Human
aaccugaugcagucacg

SEQ ID NO: 2476329 - RNA, 15 nt, Human
aaccugaugcugacu

SEQ ID NO: 2476330 - RNA, 17 nt, Human
aaccugauguuaaaauu

SEQ ID NO: 2476331 - RNA, 19 nt, Human
aaccugcaagggcucccca

SEQ ID NO: 2476332 - RNA, 18 nt, Human
aaccugauguuaaaauuc

SEQ ID NO: 2476333 - RNA, 18 nt, Human
aaccugauugugucucuu

SEQ ID NO: 2476334 - RNA, 11 nt, Human
gucuuuucauc

SEQ ID NO: 2476335 - RNA, 24 nt, Human
gucuuuuaggacccuucccuugag

SEQ ID NO: 2476336 - RNA, 17 nt, Human
gucuucauuucauugua

SEQ ID NO: 2476337 - RNA, 16 nt, Human
gucuucauuucauugu

SEQ ID NO: 2476338 - RNA, 22 nt, Human
gucuucauuaagcccucuucca

SEQ ID NO: 2476339 - RNA, 21 nt, Human
gucuucauuaagcccucuucc

SEQ ID NO: 2476340 - RNA, 13 nt, Human
gucuuccauaaug

SEQ ID NO: 2476341 - RNA, 15 nt, Human
gucuuccauaaugua

SEQ ID NO: 2476342 - RNA, 16 nt, Human
gucuucaguaagccgu

SEQ ID NO: 2476343 - RNA, 22 nt, Human
gucuucagccucuuucuguccc

SEQ ID NO: 2476344 - RNA, 23 nt, Human
gucuucagccucuuucugucccu

SEQ ID NO: 2476345 - RNA, 23 nt, Human
gucuucauaccuacauguauuug

SEQ ID NO: 2476346 - RNA, 18 nt, Human
gucuucagggggccaggu

SEQ ID NO: 2476347 - RNA, 15 nt, Human
gucuuuguacagaca

SEQ ID NO: 2476348 - RNA, 15 nt, Human
gucuuccauuugcaa

SEQ ID NO: 2476349 - RNA, 12 nt, Human
gucuucccaggg

SEQ ID NO: 2476350 - RNA, 17 nt, Human
gucuuccauaauguaua

SEQ ID NO: 2476351 - RNA, 15 nt, Human
gucuucccaggguag

SEQ ID NO: 2476352 - RNA, 13 nt, Human
gucuucccagggu

SEQ ID NO: 2476353 - RNA, 21 nt, Human
gucuuuguaaugucaccaccu

SEQ ID NO: 2476354 - RNA, 16 nt, Human
gucuuuguacagacaa

SEQ ID NO: 2476355 - RNA, 22 nt, Human
gucuuuguaaugucaccaccuu

SEQ ID NO: 2476356 - RNA, 22 nt, Human
gucuggaucugggacccuuucc

SEQ ID NO: 2476357 - RNA, 11 nt, Human
gucugggcuga

SEQ ID NO: 2476358 - RNA, 16 nt, Human
gucugggguucagccc

SEQ ID NO: 2476359 - RNA, 17 nt, Human
gucugggguucagcccc

SEQ ID NO: 2476360 - RNA, 18 nt, Human
gucugggguucagccccu

SEQ ID NO: 2476361 - RNA, 20 nt, Human
gucugguggccccguuucug

SEQ ID NO: 2476362 - RNA, 13 nt, Human
gucugguggcccc

SEQ ID NO: 2476363 - RNA, 18 nt, Human
gucuggucuccucagccu

SEQ ID NO: 2476364 - RNA, 15 nt, Human
gucuggugaagcuca

SEQ ID NO: 2476365 - RNA, 20 nt, Human
gucugggguucagccccucc

SEQ ID NO: 2476366 - RNA, 23 nt, Human
gucugggguucagccccuccucu

SEQ ID NO: 2476367 - RNA, 14 nt, Human
gucuucagccucuu

SEQ ID NO: 2476368 - RNA, 23 nt, Human
gucuucagccuagccgaccucag

SEQ ID NO: 2476369 - RNA, 13 nt, Human
gucuucagccuag

SEQ ID NO: 2476370 - RNA, 15 nt, Human
gucuucagccuagcc

SEQ ID NO: 2476371 - RNA, 20 nt, Human
gucuucaccugauucaacua

SEQ ID NO: 2476372 - RNA, 13 nt, Human
gucugguuucuag

SEQ ID NO: 2476373 - RNA, 17 nt, Human
gucuucacagcucugug

SEQ ID NO: 2476374 - RNA, 15 nt, Human
gucuucacggcagga

SEQ ID NO: 2476375 - RNA, 12 nt, Human
gucuucagccua

SEQ ID NO: 2476376 - RNA, 13 nt, Human
gucuggugggagg

SEQ ID NO: 2476377 - RNA, 17 nt, Human
gucugguuucaccgagg

SEQ ID NO: 2476378 - RNA, 22 nt, Human
gucugguuucaccgaggacaug

SEQ ID NO: 2476379 - RNA, 16 nt, Human
gucuucacagcucugu

SEQ ID NO: 2476380 - RNA, 13 nt, Human
gucuucacaacag

SEQ ID NO: 2476381 - RNA, 23 nt, Human
gucugacaggcaaugcuggcugu

SEQ ID NO: 2476382 - RNA, 22 nt, Human
gucugacaggcaaugcuggcug

SEQ ID NO: 2476383 - RNA, 19 nt, Human
gucugaagucacugcacag

SEQ ID NO: 2476384 - RNA, 17 nt, Human
gucugaagucacugcac

SEQ ID NO: 2476385 - RNA, 21 nt, Human
gucugacaggcaaugcuggcu

SEQ ID NO: 2476386 - RNA, 18 nt, Human
gucuggaggggccccugc

SEQ ID NO: 2476387 - RNA, 23 nt, Human
gucuggaggggccccugcuucuc

SEQ ID NO: 2476388 - RNA, 21 nt, Human
gucuggaguugaucuggaacc

SEQ ID NO: 2476389 - RNA, 10 nt, Human
gucuggaggg

SEQ ID NO: 2476390 - RNA, 17 nt, Human
gucuggaggggccccug

SEQ ID NO: 2476391 - RNA, 16 nt, Human
gucugaagugguuguu

SEQ ID NO: 2476392 - RNA, 18 nt, Human
gucucuuuaaucuucagu

SEQ ID NO: 2476393 - RNA, 14 nt, Human
gucuggagaagcag

SEQ ID NO: 2476394 - RNA, 17 nt, Human
gucuggagaagcaguga

SEQ ID NO: 2476395 - RNA, 23 nt, Human
gucuggagaagcucccaggaaca

SEQ ID NO: 2476396 - RNA, 22 nt, Human
gucuggagaagcucccaggaac

SEQ ID NO: 2476397 - RNA, 21 nt, Human
gucuggagaagcucccaggaa

SEQ ID NO: 2476398 - RNA, 19 nt, Human
gucuggagaagcagugagc

SEQ ID NO: 2476399 - RNA, 23 nt, Human
gucucuuuaaugucacaggcagg

SEQ ID NO: 2476400 - RNA, 22 nt, Human
gucucuuuaaugucacaggcag

SEQ ID NO: 2476401 - RNA, 19 nt, Human
gucugaaggcuggguucug

SEQ ID NO: 2476402 - RNA, 14 nt, Human
gucugaaggcuggg

SEQ ID NO: 2476403 - RNA, 16 nt, Human
gucugaagucacugca

SEQ ID NO: 2476404 - RNA, 20 nt, Human
gucucuuuaaugucacaggc

SEQ ID NO: 2476405 - RNA, 19 nt, Human
gucucuuuaaugucacagg

SEQ ID NO: 2476406 - RNA, 18 nt, Human
gucucuuuaaugucacag

SEQ ID NO: 2476407 - RNA, 16 nt, Human
gucucuuguauuaaac

SEQ ID NO: 2476408 - RNA, 19 nt, Human
gucucuuguauuaaacucu

SEQ ID NO: 2476409 - RNA, 17 nt, Human
gucucuuuaaucuucag

SEQ ID NO: 2476410 - RNA, 19 nt, Human
aaccaugcaaaugcuauga

SEQ ID NO: 2476411 - RNA, 24 nt, Human
aaccaugaagagauuuuucaugau

SEQ ID NO: 2476412 - RNA, 22 nt, Human
aaccaugagaccacuguuauca

SEQ ID NO: 2476413 - RNA, 17 nt, Human
gucucuugguccugcug

SEQ ID NO: 2476414 - RNA, 17 nt, Human
aaccaugaagacaggau

SEQ ID NO: 2476415 - RNA, 16 nt, Human
aaccaugaagacagga

SEQ ID NO: 2476416 - RNA, 15 nt, Human
aaccaugaagacagg

SEQ ID NO: 2476417 - RNA, 20 nt, Human
aaccaucugucccugccuca

SEQ ID NO: 2476418 - RNA, 23 nt, Human
aaccaugaagagauuuuucauga

SEQ ID NO: 2476419 - RNA, 21 nt, Human
aaccaugaagagauuuuucau

SEQ ID NO: 2476420 - RNA, 19 nt, Human
aaccauccccuccguggca

SEQ ID NO: 2476421 - RNA, 22 nt, Human
aaccaucccugaugucugucug

SEQ ID NO: 2476422 - RNA, 19 nt, Human
gucucuugguccugcugca

SEQ ID NO: 2476423 - RNA, 18 nt, Human
gucucuugguccugcugc

SEQ ID NO: 2476424 - RNA, 20 nt, Human
gucucuugguccugcugcag

SEQ ID NO: 2476425 - RNA, 13 nt, Human
gucucuugguccu

SEQ ID NO: 2476426 - RNA, 13 nt, Human
gucucuuguaauc

SEQ ID NO: 2476427 - RNA, 23 nt, Human
aaccaugaguggcauggccacca

SEQ ID NO: 2476428 - RNA, 17 nt, Human
gucucaggcugguggga

SEQ ID NO: 2476429 - RNA, 13 nt, Human
gucucaggcuggu

SEQ ID NO: 2476430 - RNA, 15 nt, Human
gucucaggucccugc

SEQ ID NO: 2476431 - RNA, 13 nt, Human
gucucacagcccu

SEQ ID NO: 2476432 - RNA, 15 nt, Human
gucucacacuggcgu

SEQ ID NO: 2476433 - RNA, 17 nt, Human
gucucaaugcucauaac

SEQ ID NO: 2476434 - RNA, 19 nt, Human
gucucacaguguugcccag

SEQ ID NO: 2476435 - RNA, 23 nt, Human
gucucacaguguugcccaggcug

SEQ ID NO: 2476436 - RNA, 23 nt, Human
gucucaguccaugaagauguaga

SEQ ID NO: 2476437 - RNA, 16 nt, Human
gucucaggucccugca

SEQ ID NO: 2476438 - RNA, 23 nt, Human
gucuccacacacagcugggcugu

SEQ ID NO: 2476439 - RNA, 20 nt, Human
gucuccacacacagcugggc

SEQ ID NO: 2476440 - RNA, 22 nt, Human
gucuccaaccccccagcacuga

SEQ ID NO: 2476441 - RNA, 12 nt, Human
gucuccaccagg

SEQ ID NO: 2476442 - RNA, 15 nt, Human
gucuccaccaggaac

SEQ ID NO: 2476443 - RNA, 16 nt, Human
gucuccaccaggaacc

SEQ ID NO: 2476444 - RNA, 17 nt, Human
gucuccaccaggaaccu

SEQ ID NO: 2476445 - RNA, 19 nt, Human
gucuccaccaggaaccucu

SEQ ID NO: 2476446 - RNA, 20 nt, Human
gucuccaccaggaaccucuu

SEQ ID NO: 2476447 - RNA, 21 nt, Human
gucuccaccaggaaccucuuc

SEQ ID NO: 2476448 - RNA, 15 nt, Human
gucuccagaccccca

SEQ ID NO: 2476449 - RNA, 21 nt, Human
gucuccaaccccccagcacug

SEQ ID NO: 2476450 - RNA, 20 nt, Human
gucuccaaccccccagcacu

SEQ ID NO: 2476451 - RNA, 17 nt, Human
gucuccaaccccccagc

SEQ ID NO: 2476452 - RNA, 16 nt, Human
gucuccaaccccccag

SEQ ID NO: 2476453 - RNA, 22 nt, Human
gucucaggcuggugggaggggc

SEQ ID NO: 2476454 - RNA, 18 nt, Human
gucucaggcuggugggag

SEQ ID NO: 2476455 - RNA, 16 nt, Human
gucucaguccaccuga

SEQ ID NO: 2476456 - RNA, 11 nt, Human
gucucaugugu

SEQ ID NO: 2476457 - RNA, 20 nt, Human
gucucaaacuccugggcuca

SEQ ID NO: 2476458 - RNA, 21 nt, Human
gucuaugacuuauuuccuuca

SEQ ID NO: 2476459 - RNA, 16 nt, Human
gucucaaacuccuggg

SEQ ID NO: 2476460 - RNA, 17 nt, Human
gucucaagagggcacug

SEQ ID NO: 2476461 - RNA, 15 nt, Human
gucucaagagggcac

SEQ ID NO: 2476462 - RNA, 19 nt, Human
gucucaagggcuagcaucc

SEQ ID NO: 2476463 - RNA, 21 nt, Human
gucucaacccuuuugucugcc

SEQ ID NO: 2476464 - RNA, 14 nt, Human
gucucaaugcucau

SEQ ID NO: 2476465 - RNA, 12 nt, Human
gucucaaugcuc

SEQ ID NO: 2476466 - RNA, 22 nt, Human
gucucaagagggcacugguggc

SEQ ID NO: 2476467 - RNA, 20 nt, Human
gucucaagagggcacuggug

SEQ ID NO: 2476468 - RNA, 15 nt, Human
gucuauccacagaga

SEQ ID NO: 2476469 - RNA, 14 nt, Human
gucuauccacagag

SEQ ID NO: 2476470 - RNA, 13 nt, Human
gucuauccacaga

SEQ ID NO: 2476471 - RNA, 15 nt, Human
gucuaugggacucaa

SEQ ID NO: 2476472 - RNA, 14 nt, Human
gucuaugggacuca

SEQ ID NO: 2476473 - RNA, 22 nt, Human
gucucaaacucuugaccucagg

SEQ ID NO: 2476474 - RNA, 19 nt, Human
gucucaaaaaaagaaaaag

SEQ ID NO: 2476475 - RNA, 16 nt, Human
gucucaaacuccugac

SEQ ID NO: 2476476 - RNA, 23 nt, Human
aaccaaaguaaccuuuugcaccu

SEQ ID NO: 2476477 - RNA, 17 nt, Human
aaccaacuacaaccaag

SEQ ID NO: 2476478 - RNA, 14 nt, Human
aaccaagaagggcu

SEQ ID NO: 2476479 - RNA, 23 nt, Human
aaccaaaggugaaggaauauaug

SEQ ID NO: 2476480 - RNA, 21 nt, Human
aaccaaaggugaaggaauaua

SEQ ID NO: 2476481 - RNA, 20 nt, Human
aaccaaaggugaaggaauau

SEQ ID NO: 2476482 - RNA, 16 nt, Human
aaccaaaggugaagga

SEQ ID NO: 2476483 - RNA, 14 nt, Human
aaccaaaggugaag

SEQ ID NO: 2476484 - RNA, 10 nt, Human
aaccaaaggu

SEQ ID NO: 2476485 - RNA, 15 nt, Human
aaccaaaucuggaag

SEQ ID NO: 2476486 - RNA, 22 nt, Human
aaccaaaucacugaacuuugcu

SEQ ID NO: 2476487 - RNA, 16 nt, Human
aaccaaauauuccaga

SEQ ID NO: 2476488 - RNA, 16 nt, Human
aaccacagcugcugga

SEQ ID NO: 2476489 - RNA, 15 nt, Human
aaccacagcugcugg

SEQ ID NO: 2476490 - RNA, 14 nt, Human
aaccacagcugcug

SEQ ID NO: 2476491 - RNA, 13 nt, Human
aaccacagcugcu

SEQ ID NO: 2476492 - RNA, 18 nt, Human
aaccacagcugcuggaga

SEQ ID NO: 2476493 - RNA, 16 nt, Human
aaccacagcccuguca

SEQ ID NO: 2476494 - RNA, 12 nt, Human
aaccacagcccu

SEQ ID NO: 2476495 - RNA, 13 nt, Human
aaccacagcccug

SEQ ID NO: 2476496 - RNA, 14 nt, Human
aaccacagcccugu

SEQ ID NO: 2476497 - RNA, 15 nt, Human
aaccacagcccuguc

SEQ ID NO: 2476498 - RNA, 13 nt, Human
aaccacaucuugc

SEQ ID NO: 2476499 - RNA, 23 nt, Human
gucuccaggggcugcuuccuccu

SEQ ID NO: 2476500 - RNA, 22 nt, Human
gucuccaggggcugcuuccucc

SEQ ID NO: 2476501 - RNA, 18 nt, Human
gucuccagugguugcugu

SEQ ID NO: 2476502 - RNA, 21 nt, Human
gucuccaguauccacuuugca

SEQ ID NO: 2476503 - RNA, 13 nt, Human
gucuccauguuug

SEQ ID NO: 2476504 - RNA, 21 nt, Human
gucuccaggggcugcuuccuc

SEQ ID NO: 2476505 - RNA, 20 nt, Human
gucuccaggggcugcuuccu

SEQ ID NO: 2476506 - RNA, 19 nt, Human
gucuccaggggcugcuucc

SEQ ID NO: 2476507 - RNA, 16 nt, Human
gucuccaggggcugcu

SEQ ID NO: 2476508 - RNA, 22 nt, Human
gucuccagccccuucucagaau

SEQ ID NO: 2476509 - RNA, 15 nt, Human
gucuccaggggcugc

SEQ ID NO: 2476510 - RNA, 17 nt, Human
gucuccagacccccacc

SEQ ID NO: 2476511 - RNA, 20 nt, Human
gucuccagacccccaccccu

SEQ ID NO: 2476512 - RNA, 20 nt, Human
gucuccagccccuucucaga

SEQ ID NO: 2476513 - RNA, 13 nt, Human
aacauuuuaaaug

SEQ ID NO: 2476514 - RNA, 20 nt, Human
aacauuuuaaauaaaagaaa

SEQ ID NO: 2476515 - RNA, 19 nt, Human
aacauuuuaaauaaaagaa

SEQ ID NO: 2476516 - RNA, 15 nt, Human
aacauuuuaaauaaa

SEQ ID NO: 2476517 - RNA, 17 nt, Human
aacauuuuaaauggaca

SEQ ID NO: 2476518 - RNA, 15 nt, Human
aacauuuuaaaugga

SEQ ID NO: 2476519 - RNA, 18 nt, Human
aacauuuuaaauggacag

SEQ ID NO: 2476520 - RNA, 14 nt, Human
aacauuuuaauuca

SEQ ID NO: 2476521 - RNA, 20 nt, Human
gucuccagugguugcuguug

SEQ ID NO: 2476522 - RNA, 19 nt, Human
gucuccagugguugcuguu

SEQ ID NO: 2476523 - RNA, 14 nt, Human
gucuccauggcccu

SEQ ID NO: 2476524 - RNA, 22 nt, Human
aacauuuguucuauagcuuuuc

SEQ ID NO: 2476525 - RNA, 16 nt, Human
aacauuuugucauaua

SEQ ID NO: 2476526 - RNA, 13 nt, Human
aacauuuucacac

SEQ ID NO: 2476527 - RNA, 15 nt, Human
aacauuuuacccaca

SEQ ID NO: 2476528 - RNA, 17 nt, Human
aacauuuuacccacaca

SEQ ID NO: 2476529 - RNA, 19 nt, Human
aacauuaccuuacugugga

SEQ ID NO: 2476530 - RNA, 17 nt, Human
aacauuaccuuacugug

SEQ ID NO: 2476531 - RNA, 19 nt, Human
guccugauggucagcuccc

SEQ ID NO: 2476532 - RNA, 18 nt, Human
guccugauggucagcucc

SEQ ID NO: 2476533 - RNA, 17 nt, Human
guccugauggucagcuc

SEQ ID NO: 2476534 - RNA, 15 nt, Human
guccugauggucagc

SEQ ID NO: 2476535 - RNA, 17 nt, Human
guccugaucagagccgu

SEQ ID NO: 2476536 - RNA, 21 nt, Human
aacauuaagauugaggccugc

SEQ ID NO: 2476537 - RNA, 19 nt, Human
aacauuaagaaaaucauau

SEQ ID NO: 2476538 - RNA, 18 nt, Human
aacauuaagaaaaucaua

SEQ ID NO: 2476539 - RNA, 16 nt, Human
aacauuaagaaaauca

SEQ ID NO: 2476540 - RNA, 16 nt, Human
aacauuaccuuacugu

SEQ ID NO: 2476541 - RNA, 22 nt, Human
aacauuacagggaaugccugag

SEQ ID NO: 2476542 - RNA, 20 nt, Human
aacauuacagggaaugccug

SEQ ID NO: 2476543 - RNA, 14 nt, Human
aacauuaagaaaau

SEQ ID NO: 2476544 - RNA, 13 nt, Human
aacauuaagaaaa

SEQ ID NO: 2476545 - RNA, 23 nt, Human
aacauuaaaacaauauuguuucu

SEQ ID NO: 2476546 - RNA, 21 nt, Human
aacauuaaaacaauauuguuu

SEQ ID NO: 2476547 - RNA, 16 nt, Human
guccugcugcaguugc

SEQ ID NO: 2476548 - RNA, 13 nt, Human
guccugcugcagu

SEQ ID NO: 2476549 - RNA, 22 nt, Human
guccugccuguggcgccgucuc

SEQ ID NO: 2476550 - RNA, 15 nt, Human
guccugccuguggcg

SEQ ID NO: 2476551 - RNA, 23 nt, Human
guccugauggucagcucccuucu

SEQ ID NO: 2476552 - RNA, 20 nt, Human
guccugauggucagcucccu

SEQ ID NO: 2476553 - RNA, 19 nt, Human
guccugcuccacaguguug

SEQ ID NO: 2476554 - RNA, 17 nt, Human
guccugcuccacagugu

SEQ ID NO: 2476555 - RNA, 16 nt, Human
guccugcuccacagug

SEQ ID NO: 2476556 - RNA, 14 nt, Human
guccugcuccacag

SEQ ID NO: 2476557 - RNA, 19 nt, Human
guccugcgucgaagcuuug

SEQ ID NO: 2476558 - RNA, 16 nt, Human
guccuuuauguggaaa

SEQ ID NO: 2476559 - RNA, 13 nt, Human
guccuuuaugugg

SEQ ID NO: 2476560 - RNA, 14 nt, Human
guccuuuaguaccu

SEQ ID NO: 2476561 - RNA, 21 nt, Human
guccuuuacacucaggcuuuc

SEQ ID NO: 2476562 - RNA, 14 nt, Human
guccuugcuuggcu

SEQ ID NO: 2476563 - RNA, 22 nt, Human
guccuugcugguuuucuggaug

SEQ ID NO: 2476564 - RNA, 22 nt, Human
guccuuggugugacccucugaa

SEQ ID NO: 2476565 - RNA, 17 nt, Human
guccuuggaaguuucau

SEQ ID NO: 2476566 - RNA, 14 nt, Human
guccuuggugugac

SEQ ID NO: 2476567 - RNA, 17 nt, Human
guccugcugcaguugcc

SEQ ID NO: 2476568 - RNA, 12 nt, Human
guccuugcacac

SEQ ID NO: 2476569 - RNA, 16 nt, Human
guccuugcaccccuca

SEQ ID NO: 2476570 - RNA, 22 nt, Human
guccuugcacacuccccugcac

SEQ ID NO: 2476571 - RNA, 19 nt, Human
guccuugcaccccucacuc

SEQ ID NO: 2476572 - RNA, 18 nt, Human
guccuugcaccccucacu

SEQ ID NO: 2476573 - RNA, 14 nt, Human
guccuugcaccugc

SEQ ID NO: 2476574 - RNA, 15 nt, Human
guccuugcaccugca

SEQ ID NO: 2476575 - RNA, 16 nt, Human
guccuugcaccugcau

SEQ ID NO: 2476576 - RNA, 17 nt, Human
guccuugcaccugcauc

SEQ ID NO: 2476577 - RNA, 12 nt, Human
guccuugcccuu

SEQ ID NO: 2476578 - RNA, 18 nt, Human
guccuugcaccugcaucc

SEQ ID NO: 2476579 - RNA, 14 nt, Human
gucgcccagucugg

SEQ ID NO: 2476580 - RNA, 13 nt, Human
gucgcccagucug

SEQ ID NO: 2476581 - RNA, 20 nt, Human
gucgcccaggcuggagugca

SEQ ID NO: 2476582 - RNA, 15 nt, Human
gucgcccaggcugga

SEQ ID NO: 2476583 - RNA, 14 nt, Human
gucgcccaggcugg

SEQ ID NO: 2476584 - RNA, 12 nt, Human
gucgcccaggag

SEQ ID NO: 2476585 - RNA, 13 nt, Human
gucgcccaggaga

SEQ ID NO: 2476586 - RNA, 16 nt, Human
guccuuuuuuuccauc

SEQ ID NO: 2476587 - RNA, 19 nt, Human
guccuuuuuuuccaucuuu

SEQ ID NO: 2476588 - RNA, 17 nt, Human
gucgaauuaauagcuuu

SEQ ID NO: 2476589 - RNA, 22 nt, Human
guccuuuuguaccaugguguga

SEQ ID NO: 2476590 - RNA, 21 nt, Human
guccuuuauguggaaaacaga

SEQ ID NO: 2476591 - RNA, 20 nt, Human
guccuuuauguggaaaacag

SEQ ID NO: 2476592 - RNA, 17 nt, Human
guccuuuuguaccaugg

SEQ ID NO: 2476593 - RNA, 14 nt, Human
gucgaggacaggga

SEQ ID NO: 2476594 - RNA, 12 nt, Human
gucgagacacuu

SEQ ID NO: 2476595 - RNA, 23 nt, Human
gucgagcuggaugucccaccucu

SEQ ID NO: 2476596 - RNA, 16 nt, Human
gucgaauuuuuauuau

SEQ ID NO: 2476597 - RNA, 19 nt, Human
gucuacucuuaagccaucu

SEQ ID NO: 2476598 - RNA, 18 nt, Human
gucuacucuuaagccauc

SEQ ID NO: 2476599 - RNA, 17 nt, Human
gucuacucuuaagccau

SEQ ID NO: 2476600 - RNA, 20 nt, Human
gucuacucauuccccggggc

SEQ ID NO: 2476601 - RNA, 21 nt, Human
gucuagaaguuguuugucauc

SEQ ID NO: 2476602 - RNA, 23 nt, Human
gucuacucuuaagccaucuuggu

SEQ ID NO: 2476603 - RNA, 17 nt, Human
gucuagaaguuguuugu

SEQ ID NO: 2476604 - RNA, 13 nt, Human
gucuagagaggga

SEQ ID NO: 2476605 - RNA, 14 nt, Human
gucuagagagggag

SEQ ID NO: 2476606 - RNA, 15 nt, Human
gucuagagagggagg

SEQ ID NO: 2476607 - RNA, 16 nt, Human
gucuagagagggaggc

SEQ ID NO: 2476608 - RNA, 21 nt, Human
gucuagagagggaggcaagcc

SEQ ID NO: 2476609 - RNA, 15 nt, Human
gucuagauggcuccu

SEQ ID NO: 2476610 - RNA, 16 nt, Human
gucuagauggcuccuc

SEQ ID NO: 2476611 - RNA, 17 nt, Human
gucuagauggcuccucu

SEQ ID NO: 2476612 - RNA, 18 nt, Human
gucuagauggcuccucuc

SEQ ID NO: 2476613 - RNA, 20 nt, Human
gucuauaaucccagcacuuu

SEQ ID NO: 2476614 - RNA, 21 nt, Human
gucuauaaucccagcacuuug

SEQ ID NO: 2476615 - RNA, 14 nt, Human
gucuauauguuugu

SEQ ID NO: 2476616 - RNA, 17 nt, Human
gucuauaugaaaaacaa

SEQ ID NO: 2476617 - RNA, 14 nt, Human
gucgcccuggacug

SEQ ID NO: 2476618 - RNA, 23 nt, Human
gucgcccagucuggaaugcagug

SEQ ID NO: 2476619 - RNA, 20 nt, Human
gucuaccugaggggccucuu

SEQ ID NO: 2476620 - RNA, 18 nt, Human
gucgcccuggacugugug

SEQ ID NO: 2476621 - RNA, 15 nt, Human
gucgcccucccaggc

SEQ ID NO: 2476622 - RNA, 16 nt, Human
aacagauucacacugu

SEQ ID NO: 2476623 - RNA, 15 nt, Human
aacagauucacacug

SEQ ID NO: 2476624 - RNA, 24 nt, Human
aacagauguuucuuuuguauguaa

SEQ ID NO: 2476625 - RNA, 17 nt, Human
aacagauguuucuuuug

SEQ ID NO: 2476626 - RNA, 20 nt, Human
aacagauguuucuuuuguau

SEQ ID NO: 2476627 - RNA, 18 nt, Human
aacagauucacacugucu

SEQ ID NO: 2476628 - RNA, 12 nt, Human
aacaggucuccu

SEQ ID NO: 2476629 - RNA, 13 nt, Human
aacaggucuccuc

SEQ ID NO: 2476630 - RNA, 15 nt, Human
aacaggucuccucuu

SEQ ID NO: 2476631 - RNA, 17 nt, Human
aacaggucuccucuuaa

SEQ ID NO: 2476632 - RNA, 18 nt, Human
aacaggucuccucuuaaa

SEQ ID NO: 2476633 - RNA, 19 nt, Human
aacaggucuccucuuaaaa

SEQ ID NO: 2476634 - RNA, 23 nt, Human
aacagguggcaggaccaggacua

SEQ ID NO: 2476635 - RNA, 22 nt, Human
aacagguggcaggaccaggacu

SEQ ID NO: 2476636 - RNA, 21 nt, Human
aacagguggcaggaccaggac

SEQ ID NO: 2476637 - RNA, 19 nt, Human
aacagguggcaggaccagg

SEQ ID NO: 2476638 - RNA, 14 nt, Human
aacagguggagaaa

SEQ ID NO: 2476639 - RNA, 16 nt, Human
aacagguggcaggacc

SEQ ID NO: 2476640 - RNA, 20 nt, Human
aacaggucuccucuuaaaaa

SEQ ID NO: 2476641 - RNA, 17 nt, Human
aacagucucaggaaauc

SEQ ID NO: 2476642 - RNA, 21 nt, Human
aacagguuauuuuaguuucug

SEQ ID NO: 2476643 - RNA, 20 nt, Human
aacagguuauuuuaguuucu

SEQ ID NO: 2476644 - RNA, 16 nt, Human
aacagguuauuuuagu

SEQ ID NO: 2476645 - RNA, 19 nt, Human
aacagguuuuccugaagaa

SEQ ID NO: 2476646 - RNA, 19 nt, Human
aacagucucaggaaaucaa

SEQ ID NO: 2476647 - RNA, 12 nt, Human
aacagucugauc

SEQ ID NO: 2476648 - RNA, 22 nt, Human
aacagguuauuuuaguuucugu

SEQ ID NO: 2476649 - RNA, 16 nt, Human
aacagguuuuauaauu

SEQ ID NO: 2476650 - RNA, 23 nt, Human
aacagucugaucgugacgcugaa

SEQ ID NO: 2476651 - RNA, 17 nt, Human
aacagucuucaggcaaa

SEQ ID NO: 2476652 - RNA, 19 nt, Human
aacagauuauuaccuuaca

SEQ ID NO: 2476653 - RNA, 14 nt, Human
aacagaugcuuuuc

SEQ ID NO: 2476654 - RNA, 23 nt, Human
aacagaugcaaugugcuacugau

SEQ ID NO: 2476655 - RNA, 21 nt, Human
aacagaugcaaugugcuacug

SEQ ID NO: 2476656 - RNA, 22 nt, Human
aacagaugcaaugugcuacuga

SEQ ID NO: 2476657 - RNA, 19 nt, Human
aacagagugagacccuguc

SEQ ID NO: 2476658 - RNA, 17 nt, Human
aacagaggccauggcag

SEQ ID NO: 2476659 - RNA, 21 nt, Human
aacagaggccauggcagaaua

SEQ ID NO: 2476660 - RNA, 20 nt, Human
aacagaggaagaauuuguua

SEQ ID NO: 2476661 - RNA, 13 nt, Human
aacagagauguga

SEQ ID NO: 2476662 - RNA, 19 nt, Human
aacagagacaggcccaaga

SEQ ID NO: 2476663 - RNA, 15 nt, Human
aacagagaaggcagg

SEQ ID NO: 2476664 - RNA, 16 nt, Human
aacagagaaggcagga

SEQ ID NO: 2476665 - RNA, 16 nt, Human
guccuaccaauagauu

SEQ ID NO: 2476666 - RNA, 13 nt, Human
aacagagaaggca

SEQ ID NO: 2476667 - RNA, 20 nt, Human
aacagacuggaagcacagcu

SEQ ID NO: 2476668 - RNA, 13 nt, Human
guccuacccaccc

SEQ ID NO: 2476669 - RNA, 16 nt, Human
aacauauauaacaaug

SEQ ID NO: 2476670 - RNA, 22 nt, Human
aacauagaaauugccugacgaa

SEQ ID NO: 2476671 - RNA, 14 nt, Human
aacaucaacaucuu

SEQ ID NO: 2476672 - RNA, 17 nt, Human
aacauaugaaaauacaa

SEQ ID NO: 2476673 - RNA, 22 nt, Human
aacauguuuuucuucucccuca

SEQ ID NO: 2476674 - RNA, 11 nt, Human
aacauguuucc

SEQ ID NO: 2476675 - RNA, 13 nt, Human
aacauguuccuga

SEQ ID NO: 2476676 - RNA, 17 nt, Human
aacauguuacugaccag

SEQ ID NO: 2476677 - RNA, 14 nt, Human
aacauauuguugaa

SEQ ID NO: 2476678 - RNA, 13 nt, Human
aacauauuuguua

SEQ ID NO: 2476679 - RNA, 20 nt, Human
aacauauuuguuaaauauuu

SEQ ID NO: 2476680 - RNA, 22 nt, Human
aacauauuuguuaaauauuuac

SEQ ID NO: 2476681 - RNA, 16 nt, Human
aacauguuacugacca

SEQ ID NO: 2476682 - RNA, 20 nt, Human
aacauguuuacuuuucaggg

SEQ ID NO: 2476683 - RNA, 20 nt, Human
aacauacucccaucugugaa

SEQ ID NO: 2476684 - RNA, 12 nt, Human
aacauaauuaaa

SEQ ID NO: 2476685 - RNA, 22 nt, Human
aacauaaucuucugccuucuca

SEQ ID NO: 2476686 - RNA, 17 nt, Human
aacauacuggcugguga

SEQ ID NO: 2476687 - RNA, 16 nt, Human
aacauacucccaucug

SEQ ID NO: 2476688 - RNA, 18 nt, Human
aacauacucccaucugug

SEQ ID NO: 2476689 - RNA, 18 nt, Human
aacauaaauaaaaugacc

SEQ ID NO: 2476690 - RNA, 21 nt, Human
aacagugagccugaauuuugu

SEQ ID NO: 2476691 - RNA, 13 nt, Human
aacagugagccug

SEQ ID NO: 2476692 - RNA, 20 nt, Human
aacauaaucuucugccuucu

SEQ ID NO: 2476693 - RNA, 21 nt, Human
aacauaaccauuacagggagc

SEQ ID NO: 2476694 - RNA, 16 nt, Human
guccccgcacugggcu

SEQ ID NO: 2476695 - RNA, 15 nt, Human
guccccgcacugggc

SEQ ID NO: 2476696 - RNA, 13 nt, Human
gucccccucuguc

SEQ ID NO: 2476697 - RNA, 19 nt, Human
gucccccucuguccaggca

SEQ ID NO: 2476698 - RNA, 13 nt, Human
gucccccugacaa

SEQ ID NO: 2476699 - RNA, 15 nt, Human
guccccucccaucug

SEQ ID NO: 2476700 - RNA, 14 nt, Human
guccccucccaucu

SEQ ID NO: 2476701 - RNA, 12 nt, Human
guccccucccau

SEQ ID NO: 2476702 - RNA, 11 nt, Human
guccccuucuc

SEQ ID NO: 2476703 - RNA, 13 nt, Human
guccccuuccauc

SEQ ID NO: 2476704 - RNA, 23 nt, Human
guccccuguuuguuucugaaagg

SEQ ID NO: 2476705 - RNA, 15 nt, Human
guccccgugccccgc

SEQ ID NO: 2476706 - RNA, 22 nt, Human
guccccgugccccgccuccccg

SEQ ID NO: 2476707 - RNA, 21 nt, Human
gucccccucuguccaggcacu

SEQ ID NO: 2476708 - RNA, 14 nt, Human
guccccucagcucc

SEQ ID NO: 2476709 - RNA, 13 nt, Human
guccccucagcuc

SEQ ID NO: 2476710 - RNA, 12 nt, Human
guccccucaccu

SEQ ID NO: 2476711 - RNA, 18 nt, Human
guccccucagcuccagac

SEQ ID NO: 2476712 - RNA, 15 nt, Human
guccccucagcucca

SEQ ID NO: 2476713 - RNA, 22 nt, Human
guccccuuuucuuuucuacccu

SEQ ID NO: 2476714 - RNA, 22 nt, Human
guccccuuuguauuccuuaaau

SEQ ID NO: 2476715 - RNA, 20 nt, Human
guccccuucucucaucucuu

SEQ ID NO: 2476716 - RNA, 19 nt, Human
guccccuucucucaucucu

SEQ ID NO: 2476717 - RNA, 18 nt, Human
guccccuucucucaucuc

SEQ ID NO: 2476718 - RNA, 17 nt, Human
guccccuucucucaucu

SEQ ID NO: 2476719 - RNA, 14 nt, Human
guccccuucucuca

SEQ ID NO: 2476720 - RNA, 13 nt, Human
guccccuucucuc

SEQ ID NO: 2476721 - RNA, 12 nt, Human
guccccuucucu

SEQ ID NO: 2476722 - RNA, 13 nt, Human
gucccuuuuccuu

SEQ ID NO: 2476723 - RNA, 21 nt, Human
guccgaaagggacuuggaagc

SEQ ID NO: 2476724 - RNA, 22 nt, Human
guccgaaagggacuuggaagcu

SEQ ID NO: 2476725 - RNA, 23 nt, Human
guccccuuuucuuuucuacccua

SEQ ID NO: 2476726 - RNA, 19 nt, Human
guccuaaggacacacuaau

SEQ ID NO: 2476727 - RNA, 14 nt, Human
guccuaagaaagag

SEQ ID NO: 2476728 - RNA, 16 nt, Human
guccuaacugguauag

SEQ ID NO: 2476729 - RNA, 22 nt, Human
guccuaagaaagaggagugcuu

SEQ ID NO: 2476730 - RNA, 13 nt, Human
guccuaaaacacc

SEQ ID NO: 2476731 - RNA, 14 nt, Human
guccguuuacucca

SEQ ID NO: 2476732 - RNA, 22 nt, Human
gucccuuucuuggccaguuauc

SEQ ID NO: 2476733 - RNA, 17 nt, Human
gucccuuucuuggccag

SEQ ID NO: 2476734 - RNA, 21 nt, Human
guccauggaaugcuugaaaaa

SEQ ID NO: 2476735 - RNA, 20 nt, Human
guccauggaaugcuugaaaa

SEQ ID NO: 2476736 - RNA, 13 nt, Human
guccaugggcaga

SEQ ID NO: 2476737 - RNA, 14 nt, Human
guccaugggcagag

SEQ ID NO: 2476738 - RNA, 16 nt, Human
guccaugggcagagcc

SEQ ID NO: 2476739 - RNA, 18 nt, Human
guccaugggcagagccca

SEQ ID NO: 2476740 - RNA, 23 nt, Human
guccaugggcagagcccaaggga

SEQ ID NO: 2476741 - RNA, 14 nt, Human
guccaugugugugc

SEQ ID NO: 2476742 - RNA, 19 nt, Human
guccaugugguucuucaaa

SEQ ID NO: 2476743 - RNA, 13 nt, Human
guccaugugugug

SEQ ID NO: 2476744 - RNA, 18 nt, Human
gucccaccuuggcugcag

SEQ ID NO: 2476745 - RNA, 17 nt, Human
gucccaccuuggcugca

SEQ ID NO: 2476746 - RNA, 12 nt, Human
gucccccucugg

SEQ ID NO: 2476747 - RNA, 14 nt, Human
gucccccucuggcu

SEQ ID NO: 2476748 - RNA, 18 nt, Human
guccauugacauguacag

SEQ ID NO: 2476749 - RNA, 17 nt, Human
guccauugacauguaca

SEQ ID NO: 2476750 - RNA, 19 nt, Human
guccauugacauguacaga

SEQ ID NO: 2476751 - RNA, 15 nt, Human
guccauugacaugua

SEQ ID NO: 2476752 - RNA, 14 nt, Human
guccauugacaugu

SEQ ID NO: 2476753 - RNA, 15 nt, Human
guccauucucccagg

SEQ ID NO: 2476754 - RNA, 13 nt, Human
guccauucuccca

SEQ ID NO: 2476755 - RNA, 22 nt, Human
guccccccacccucauucuacu

SEQ ID NO: 2476756 - RNA, 19 nt, Human
gucccaccuuggcugcagg

SEQ ID NO: 2476757 - RNA, 22 nt, Human
guagcucuaggagggcuggcaa

SEQ ID NO: 2476758 - RNA, 14 nt, Human
guagcuagaggaac

SEQ ID NO: 2476759 - RNA, 15 nt, Human
guagcuagaggaacc

SEQ ID NO: 2476760 - RNA, 11 nt, Human
guagcucaggu

SEQ ID NO: 2476761 - RNA, 16 nt, Human
guagcuauaucuauau

SEQ ID NO: 2476762 - RNA, 13 nt, Human
guagcuauaucua

SEQ ID NO: 2476763 - RNA, 17 nt, Human
guagcuagaggaaccaa

SEQ ID NO: 2476764 - RNA, 18 nt, Human
guccauggaaugcuugaa

SEQ ID NO: 2476765 - RNA, 15 nt, Human
guccauggaaugcuu

SEQ ID NO: 2476766 - RNA, 14 nt, Human
guccauggaaugcu

SEQ ID NO: 2476767 - RNA, 14 nt, Human
guagcucagguggg

SEQ ID NO: 2476768 - RNA, 12 nt, Human
guagcucaggug

SEQ ID NO: 2476769 - RNA, 23 nt, Human
guagcuccucaacucaccuaaug

SEQ ID NO: 2476770 - RNA, 22 nt, Human
guagccuggauauuauucuugu

SEQ ID NO: 2476771 - RNA, 12 nt, Human
guagccugugca

SEQ ID NO: 2476772 - RNA, 21 nt, Human
guagccucgccgucugugaau

SEQ ID NO: 2476773 - RNA, 15 nt, Human
guagccuugcccgga

SEQ ID NO: 2476774 - RNA, 23 nt, Human
guagccuugcccggauucuggga

SEQ ID NO: 2476775 - RNA, 14 nt, Human
guagccuuccucca

SEQ ID NO: 2476776 - RNA, 13 nt, Human
aagcaaaauguga

SEQ ID NO: 2476777 - RNA, 19 nt, Human
aagauguagauuuauuuca

SEQ ID NO: 2476778 - RNA, 22 nt, Human
aagauguagauuuauuucauca

SEQ ID NO: 2476779 - RNA, 15 nt, Human
aagaugcaauguaga

SEQ ID NO: 2476780 - RNA, 17 nt, Human
aagaugaucuacucaga

SEQ ID NO: 2476781 - RNA, 16 nt, Human
aagauguagauuuauu

SEQ ID NO: 2476782 - RNA, 22 nt, Human
aagauguagaggagaaacugga

SEQ ID NO: 2476783 - RNA, 22 nt, Human
aagaugacauugcuaagaugcu

SEQ ID NO: 2476784 - RNA, 21 nt, Human
aagaugacauugcuaagaugc

SEQ ID NO: 2476785 - RNA, 23 nt, Human
aagaugacauugcuaagaugcuc

SEQ ID NO: 2476786 - RNA, 17 nt, Human
aagaugagagaacugga

SEQ ID NO: 2476787 - RNA, 18 nt, Human
aagaugagagaacuggag

SEQ ID NO: 2476788 - RNA, 19 nt, Human
aagauguagaggagaaacu

SEQ ID NO: 2476789 - RNA, 18 nt, Human
aagaugaucuacucagaa

SEQ ID NO: 2476790 - RNA, 14 nt, Human
aagaugaucauuug

SEQ ID NO: 2476791 - RNA, 15 nt, Human
aagaugaucagaccu

SEQ ID NO: 2476792 - RNA, 15 nt, Human
aagaugcaaggacca

SEQ ID NO: 2476793 - RNA, 20 nt, Human
aagaugcaaggaccaggacu

SEQ ID NO: 2476794 - RNA, 13 nt, Human
aagcaaaugugaa

SEQ ID NO: 2476795 - RNA, 12 nt, Human
aagcaaaugucu

SEQ ID NO: 2476796 - RNA, 14 nt, Human
aagcaaaugugaau

SEQ ID NO: 2476797 - RNA, 16 nt, Human
aagcaagauuucagau

SEQ ID NO: 2476798 - RNA, 15 nt, Human
aagcaagauuucaga

SEQ ID NO: 2476799 - RNA, 19 nt, Human
aagcaaaauuuuuucucua

SEQ ID NO: 2476800 - RNA, 12 nt, Human
aagcaaacacau

SEQ ID NO: 2476801 - RNA, 13 nt, Human
aagcaaacacauu

SEQ ID NO: 2476802 - RNA, 17 nt, Human
aagcaaaucagaaacuu

SEQ ID NO: 2476803 - RNA, 14 nt, Human
aagcaaacacauua

SEQ ID NO: 2476804 - RNA, 21 nt, Human
aagaucacuuguuguuuuacu

SEQ ID NO: 2476805 - RNA, 19 nt, Human
aagaucacuuguuguuuua

SEQ ID NO: 2476806 - RNA, 15 nt, Human
aagaucacuuucuca

SEQ ID NO: 2476807 - RNA, 17 nt, Human
aagaucacuuucucagu

SEQ ID NO: 2476808 - RNA, 23 nt, Human
aagaucacuuucucaguuuucau

SEQ ID NO: 2476809 - RNA, 17 nt, Human
aagaucacgcuccccgc

SEQ ID NO: 2476810 - RNA, 22 nt, Human
aagaucaaaauaaaaagugaca

SEQ ID NO: 2476811 - RNA, 16 nt, Human
aagaucacgcuccccg

SEQ ID NO: 2476812 - RNA, 19 nt, Human
aagaucacgcuccccgccu

SEQ ID NO: 2476813 - RNA, 22 nt, Human
aagauccuaaaacaaaagcuca

SEQ ID NO: 2476814 - RNA, 16 nt, Human
aagauccccucaggac

SEQ ID NO: 2476815 - RNA, 15 nt, Human
aagauccccucagga

SEQ ID NO: 2476816 - RNA, 16 nt, Human
aagaucauguacccca

SEQ ID NO: 2476817 - RNA, 17 nt, Human
aagaucauauacgugaa

SEQ ID NO: 2476818 - RNA, 20 nt, Human
aagaugacauugcuaagaug

SEQ ID NO: 2476819 - RNA, 17 nt, Human
aagaugacauugcuaag

SEQ ID NO: 2476820 - RNA, 16 nt, Human
aagaugacauugcuaa

SEQ ID NO: 2476821 - RNA, 15 nt, Human
aagaugacauugcua

SEQ ID NO: 2476822 - RNA, 23 nt, Human
aagauccuaccccaauuccuugu

SEQ ID NO: 2476823 - RNA, 21 nt, Human
aagauccugucuuuaaggaaa

SEQ ID NO: 2476824 - RNA, 17 nt, Human
aagauauuuugcuuugu

SEQ ID NO: 2476825 - RNA, 20 nt, Human
aagauauuuugcuuugugau

SEQ ID NO: 2476826 - RNA, 22 nt, Human
aagauauuuugcuuugugauuu

SEQ ID NO: 2476827 - RNA, 21 nt, Human
aagaucaaaauaaaaagugac

SEQ ID NO: 2476828 - RNA, 17 nt, Human
aagaucaaaauaaaaag

SEQ ID NO: 2476829 - RNA, 15 nt, Human
aagaucaaaauaaaa

SEQ ID NO: 2476830 - RNA, 15 nt, Human
aagauauuuugcuuu

SEQ ID NO: 2476831 - RNA, 19 nt, Human
aagaguaggaagacuuugg

SEQ ID NO: 2476832 - RNA, 18 nt, Human
aagaguaggaagacuuug

SEQ ID NO: 2476833 - RNA, 16 nt, Human
aagaguaggaagacuu

SEQ ID NO: 2476834 - RNA, 19 nt, Human
gugguguuuccuggcacug

SEQ ID NO: 2476835 - RNA, 18 nt, Human
gugguuauggagagggug

SEQ ID NO: 2476836 - RNA, 20 nt, Human
gugguucacucuuggagccu

SEQ ID NO: 2476837 - RNA, 21 nt, Human
gugguucacucuuggagccug

SEQ ID NO: 2476838 - RNA, 23 nt, Human
gugguuaaugccauggacagaag

SEQ ID NO: 2476839 - RNA, 22 nt, Human
gugguuauuucucaacaaagca

SEQ ID NO: 2476840 - RNA, 14 nt, Human
gugguuauuucuca

SEQ ID NO: 2476841 - RNA, 20 nt, Human
gugucccaaaaagaaaggag

SEQ ID NO: 2476842 - RNA, 19 nt, Human
gugucuugcaauggcagcc

SEQ ID NO: 2476843 - RNA, 21 nt, Human
guguccaugcgcucagggcca

SEQ ID NO: 2476844 - RNA, 20 nt, Human
guguccaugcgcucagggcc

SEQ ID NO: 2476845 - RNA, 19 nt, Human
guguccaugcgcucagggc

SEQ ID NO: 2476846 - RNA, 18 nt, Human
guguccaugcgcucaggg

SEQ ID NO: 2476847 - RNA, 23 nt, Human
guguccauugacauguacagaga

SEQ ID NO: 2476848 - RNA, 20 nt, Human
guguccauugacauguacag

SEQ ID NO: 2476849 - RNA, 19 nt, Human
guguccauugacauguaca

SEQ ID NO: 2476850 - RNA, 14 nt, Human
guguccaugugugu

SEQ ID NO: 2476851 - RNA, 15 nt, Human
guguccaugugugug

SEQ ID NO: 2476852 - RNA, 16 nt, Human
guguccauugacaugu

SEQ ID NO: 2476853 - RNA, 16 nt, Human
guguccaugugugugc

SEQ ID NO: 2476854 - RNA, 16 nt, Human
aagcaaguauuagaau

SEQ ID NO: 2476855 - RNA, 13 nt, Human
guguccaccuggc

SEQ ID NO: 2476856 - RNA, 18 nt, Human
guguccacgacugucucc

SEQ ID NO: 2476857 - RNA, 13 nt, Human
aagaugacauugc

SEQ ID NO: 2476858 - RNA, 23 nt, Human
gugucuugggcagagcuggcucu

SEQ ID NO: 2476859 - RNA, 20 nt, Human
gugucuugggcagagcuggc

SEQ ID NO: 2476860 - RNA, 17 nt, Human
gugucuugggcagagcu

SEQ ID NO: 2476861 - RNA, 16 nt, Human
gugucuugggcagagc

SEQ ID NO: 2476862 - RNA, 21 nt, Human
gugucuugcaauggcagccuu

SEQ ID NO: 2476863 - RNA, 12 nt, Human
gugugaggccag

SEQ ID NO: 2476864 - RNA, 21 nt, Human
guguccauugacauguacaga

SEQ ID NO: 2476865 - RNA, 14 nt, Human
gugugaggccaggg

SEQ ID NO: 2476866 - RNA, 15 nt, Human
gugugaggccagggc

SEQ ID NO: 2476867 - RNA, 17 nt, Human
gugugaguaagagcugg

SEQ ID NO: 2476868 - RNA, 17 nt, Human
gugugaggccagggcag

SEQ ID NO: 2476869 - RNA, 19 nt, Human
guguggugcagugugaaaa

SEQ ID NO: 2476870 - RNA, 15 nt, Human
gugugguguuuccug

SEQ ID NO: 2476871 - RNA, 18 nt, Human
gugugagucaccaagccc

SEQ ID NO: 2476872 - RNA, 13 nt, Human
gugugagucacca

SEQ ID NO: 2476873 - RNA, 14 nt, Human
guguguguaugugg

SEQ ID NO: 2476874 - RNA, 19 nt, Human
guguguguaugcgugugug

SEQ ID NO: 2476875 - RNA, 14 nt, Human
gugugugugcgugu

SEQ ID NO: 2476876 - RNA, 9 nt, Human
gugugugug

SEQ ID NO: 2476877 - RNA, 13 nt, Human
gugugugugaaug

SEQ ID NO: 2476878 - RNA, 17 nt, Human
guguguguauguuugca

SEQ ID NO: 2476879 - RNA, 12 nt, Human
guguguguaugu

SEQ ID NO: 2476880 - RNA, 17 nt, Human
guguguguugugugugg

SEQ ID NO: 2476881 - RNA, 15 nt, Human
gugugugugugugug

SEQ ID NO: 2476882 - RNA, 14 nt, Human
gugugugugugugc

SEQ ID NO: 2476883 - RNA, 14 nt, Human
gugugugugugugu

SEQ ID NO: 2476884 - RNA, 15 nt, Human
gugugugugcguguu

SEQ ID NO: 2476885 - RNA, 14 nt, Human
guguguguguccuu

SEQ ID NO: 2476886 - RNA, 12 nt, Human
gugugugugugu

SEQ ID NO: 2476887 - RNA, 13 nt, Human
gugugugugugcg

SEQ ID NO: 2476888 - RNA, 13 nt, Human
gugugugugugug

SEQ ID NO: 2476889 - RNA, 13 nt, Human
guguguguaugug

SEQ ID NO: 2476890 - RNA, 21 nt, Human
guguguggguggauauaaaua

SEQ ID NO: 2476891 - RNA, 19 nt, Human
gugugguguuuccuggcac

SEQ ID NO: 2476892 - RNA, 13 nt, Human
guguggugcagug

SEQ ID NO: 2476893 - RNA, 14 nt, Human
guguggugcagugu

SEQ ID NO: 2476894 - RNA, 23 nt, Human
gugugguggguucuuuggaagga

SEQ ID NO: 2476895 - RNA, 18 nt, Human
guguggugcagugugaaa

SEQ ID NO: 2476896 - RNA, 21 nt, Human
gugugguuugguguguucccg

SEQ ID NO: 2476897 - RNA, 18 nt, Human
guguuuaaagagagguua

SEQ ID NO: 2476898 - RNA, 11 nt, Human
guguuuaaaua

SEQ ID NO: 2476899 - RNA, 13 nt, Human
guguuuaagacau

SEQ ID NO: 2476900 - RNA, 14 nt, Human
guguuuaagacauu

SEQ ID NO: 2476901 - RNA, 19 nt, Human
guguugagccuuuucccuc

SEQ ID NO: 2476902 - RNA, 17 nt, Human
guguugaaaauguucag

SEQ ID NO: 2476903 - RNA, 14 nt, Human
guguguuauuuaaa

SEQ ID NO: 2476904 - RNA, 13 nt, Human
guguucugugaua

SEQ ID NO: 2476905 - RNA, 18 nt, Human
guguguuccaacugcccc

SEQ ID NO: 2476906 - RNA, 15 nt, Human
guguguuccaacugc

SEQ ID NO: 2476907 - RNA, 18 nt, Human
guguguucugauuagaaa

SEQ ID NO: 2476908 - RNA, 16 nt, Human
guguugaaaauguuca

SEQ ID NO: 2476909 - RNA, 16 nt, Human
aagacuccaaagaaau

SEQ ID NO: 2476910 - RNA, 17 nt, Human
aagacuccaaagaaaug

SEQ ID NO: 2476911 - RNA, 14 nt, Human
aagacuccaaagaa

SEQ ID NO: 2476912 - RNA, 17 nt, Human
aagacucauucuucugu

SEQ ID NO: 2476913 - RNA, 23 nt, Human
aagacuggcuuuuauuaaugcac

SEQ ID NO: 2476914 - RNA, 11 nt, Human
aagacuggcuu

SEQ ID NO: 2476915 - RNA, 21 nt, Human
aagacuggaagguggggacag

SEQ ID NO: 2476916 - RNA, 20 nt, Human
aagacuggaagcuaauuugc

SEQ ID NO: 2476917 - RNA, 22 nt, Human
aagacuggaagcuaauuugcau

SEQ ID NO: 2476918 - RNA, 23 nt, Human
aagacuggaagcuaauuugcauu

SEQ ID NO: 2476919 - RNA, 17 nt, Human
aagacucauucccuaga

SEQ ID NO: 2476920 - RNA, 23 nt, Human
aagacucaagugggaacgacugg

SEQ ID NO: 2476921 - RNA, 14 nt, Human
aagacucaguguuc

SEQ ID NO: 2476922 - RNA, 21 nt, Human
aagacucaagugggaacgacu

SEQ ID NO: 2476923 - RNA, 14 nt, Human
aagacuauucaaac

SEQ ID NO: 2476924 - RNA, 23 nt, Human
aagacgcugugcugcccugccca

SEQ ID NO: 2476925 - RNA, 20 nt, Human
aagacgcugugcugcccugc

SEQ ID NO: 2476926 - RNA, 22 nt, Human
aagacgcugugcugcccugccc

SEQ ID NO: 2476927 - RNA, 21 nt, Human
aagacgcugugcugcccugcc

SEQ ID NO: 2476928 - RNA, 22 nt, Human
aagaccccacccaagcuuggca

SEQ ID NO: 2476929 - RNA, 16 nt, Human
aagaccccacccaagc

SEQ ID NO: 2476930 - RNA, 23 nt, Human
aagaccccuuaccacugcucuga

SEQ ID NO: 2476931 - RNA, 12 nt, Human
aagaccagucca

SEQ ID NO: 2476932 - RNA, 13 nt, Human
aagaccauuuuuc

SEQ ID NO: 2476933 - RNA, 13 nt, Human
aagaccccaccca

SEQ ID NO: 2476934 - RNA, 16 nt, Human
aagacuguaaugaauc

SEQ ID NO: 2476935 - RNA, 13 nt, Human
aagacuguaauga

SEQ ID NO: 2476936 - RNA, 22 nt, Human
aagacuggcuuuuauuaaugca

SEQ ID NO: 2476937 - RNA, 16 nt, Human
aagacuguacaaagua

SEQ ID NO: 2476938 - RNA, 20 nt, Human
aagagaugaugaaaauauuu

SEQ ID NO: 2476939 - RNA, 17 nt, Human
aagagaugggcuuguuu

SEQ ID NO: 2476940 - RNA, 17 nt, Human
aagagauggccugagaa

SEQ ID NO: 2476941 - RNA, 13 nt, Human
aagagaugaagag

SEQ ID NO: 2476942 - RNA, 16 nt, Human
aagagauugugguuuc

SEQ ID NO: 2476943 - RNA, 19 nt, Human
aagagauugugguuucauu

SEQ ID NO: 2476944 - RNA, 14 nt, Human
aagagcccaggccu

SEQ ID NO: 2476945 - RNA, 12 nt, Human
aagagcccaggc

SEQ ID NO: 2476946 - RNA, 16 nt, Human
aagagcccaggccucc

SEQ ID NO: 2476947 - RNA, 18 nt, Human
aagagaugggcuuguuuu

SEQ ID NO: 2476948 - RNA, 20 nt, Human
aagagaugggcuuguuuucu

SEQ ID NO: 2476949 - RNA, 15 nt, Human
aagagauuccugagc

SEQ ID NO: 2476950 - RNA, 19 nt, Human
aagagcuguucacagccag

SEQ ID NO: 2476951 - RNA, 21 nt, Human
guggccccacccugggcccug

SEQ ID NO: 2476952 - RNA, 16 nt, Human
aagagcuguccuggua

SEQ ID NO: 2476953 - RNA, 23 nt, Human
guggccccacccugggcccuggg

SEQ ID NO: 2476954 - RNA, 13 nt, Human
aagagcugcccuc

SEQ ID NO: 2476955 - RNA, 14 nt, Human
guggccccagccug

SEQ ID NO: 2476956 - RNA, 13 nt, Human
guggccccagccu

SEQ ID NO: 2476957 - RNA, 12 nt, Human
guggccccagcc

SEQ ID NO: 2476958 - RNA, 22 nt, Human
guggccccagccuggcccagcu

SEQ ID NO: 2476959 - RNA, 21 nt, Human
guggccccagccuggcccagc

SEQ ID NO: 2476960 - RNA, 20 nt, Human
guggccccagccuggcccag

SEQ ID NO: 2476961 - RNA, 19 nt, Human
guggccccagccuggccca

SEQ ID NO: 2476962 - RNA, 18 nt, Human
guggccccagccuggccc

SEQ ID NO: 2476963 - RNA, 17 nt, Human
guggccccagccuggcc

SEQ ID NO: 2476964 - RNA, 16 nt, Human
guggccccagccuggc

SEQ ID NO: 2476965 - RNA, 15 nt, Human
guggccccagccugg

SEQ ID NO: 2476966 - RNA, 17 nt, Human
guggccccguuucuggu

SEQ ID NO: 2476967 - RNA, 16 nt, Human
guggccccguuucugg

SEQ ID NO: 2476968 - RNA, 16 nt, Human
guggcccgacagccug

SEQ ID NO: 2476969 - RNA, 21 nt, Human
aagagccauguagaagcugca

SEQ ID NO: 2476970 - RNA, 16 nt, Human
aagagcuagcgcugcc

SEQ ID NO: 2476971 - RNA, 19 nt, Human
aagagcuagcgcugccgca

SEQ ID NO: 2476972 - RNA, 20 nt, Human
aagagcuagcgcugccgcac

SEQ ID NO: 2476973 - RNA, 18 nt, Human
aagagcuguucacagcca

SEQ ID NO: 2476974 - RNA, 18 nt, Human
aagagcugaggcaauucu

SEQ ID NO: 2476975 - RNA, 11 nt, Human
aagagcugagg

SEQ ID NO: 2476976 - RNA, 18 nt, Human
gugggauccuccaggugc

SEQ ID NO: 2476977 - RNA, 15 nt, Human
gugggauccuccagg

SEQ ID NO: 2476978 - RNA, 16 nt, Human
gugggagcgugggagg

SEQ ID NO: 2476979 - RNA, 18 nt, Human
gugggaucugccccuccc

SEQ ID NO: 2476980 - RNA, 14 nt, Human
gugggauggaggag

SEQ ID NO: 2476981 - RNA, 19 nt, Human
gugggaucugccccucccu

SEQ ID NO: 2476982 - RNA, 16 nt, Human
gugggauggaggagaa

SEQ ID NO: 2476983 - RNA, 23 nt, Human
gugggauguucagcacugucccu

SEQ ID NO: 2476984 - RNA, 17 nt, Human
gugggauggaggagaag

SEQ ID NO: 2476985 - RNA, 12 nt, Human
gugggagcugag

SEQ ID NO: 2476986 - RNA, 22 nt, Human
gugggagcaggagauugagaag

SEQ ID NO: 2476987 - RNA, 15 nt, Human
gugggagcaggagau

SEQ ID NO: 2476988 - RNA, 14 nt, Human
gugggagcaggaga

SEQ ID NO: 2476989 - RNA, 13 nt, Human
gugggagcaggag

SEQ ID NO: 2476990 - RNA, 12 nt, Human
gugggagcagga

SEQ ID NO: 2476991 - RNA, 19 nt, Human
gugggagcagcgguuuggg

SEQ ID NO: 2476992 - RNA, 13 nt, Human
gugggagagccca

SEQ ID NO: 2476993 - RNA, 14 nt, Human
gugggagagcccag

SEQ ID NO: 2476994 - RNA, 13 nt, Human
gugggagaggucu

SEQ ID NO: 2476995 - RNA, 15 nt, Human
gugggagagcccagc

SEQ ID NO: 2476996 - RNA, 20 nt, Human
gugggaacgagaggggaaga

SEQ ID NO: 2476997 - RNA, 18 nt, Human
gugggaacgagaggggaa

SEQ ID NO: 2476998 - RNA, 23 nt, Human
gugggaacgacugggcacugcca

SEQ ID NO: 2476999 - RNA, 12 nt, Human
gugggaaaacac

SEQ ID NO: 2477000 - RNA, 21 nt, Human
gugggaacgagaggggaagag

SEQ ID NO: 2477001 - RNA, 17 nt, Human
gugggaacgugacugcc

SEQ ID NO: 2477002 - RNA, 14 nt, Human
guggccucccaacu

SEQ ID NO: 2477003 - RNA, 13 nt, Human
guggccucccaac

SEQ ID NO: 2477004 - RNA, 17 nt, Human
guggcccgacagccugg

SEQ ID NO: 2477005 - RNA, 23 nt, Human
guggccccguuucugguggucug

SEQ ID NO: 2477006 - RNA, 20 nt, Human
guggccucaacccucccuca

SEQ ID NO: 2477007 - RNA, 21 nt, Human
guggccucaacccucccucag

SEQ ID NO: 2477008 - RNA, 13 nt, Human
guggccucagaau

SEQ ID NO: 2477009 - RNA, 11 nt, Human
guggccucaga

SEQ ID NO: 2477010 - RNA, 12 nt, Human
guggccucagaa

SEQ ID NO: 2477011 - RNA, 15 nt, Human
guggccucccaacuc

SEQ ID NO: 2477012 - RNA, 21 nt, Human
guggcuucccgcucagcccuc

SEQ ID NO: 2477013 - RNA, 14 nt, Human
guggcuucuuaauc

SEQ ID NO: 2477014 - RNA, 18 nt, Human
guggcuuucagccucugg

SEQ ID NO: 2477015 - RNA, 16 nt, Human
guggcuuugcauuuua

SEQ ID NO: 2477016 - RNA, 22 nt, Human
guggcuugagaaauauggacac

SEQ ID NO: 2477017 - RNA, 16 nt, Human
guggcuuucagccucu

SEQ ID NO: 2477018 - RNA, 20 nt, Human
guggcuuuuuuccuccugug

SEQ ID NO: 2477019 - RNA, 23 nt, Human
guggcuuugcauuuuaaaaauga

SEQ ID NO: 2477020 - RNA, 22 nt, Human
guggcuuugcauuuuaaaaaug

SEQ ID NO: 2477021 - RNA, 18 nt, Human
guggcuuugcauuuuaaa

SEQ ID NO: 2477022 - RNA, 17 nt, Human
gugggaacgacugggca

SEQ ID NO: 2477023 - RNA, 23 nt, Human
gugggaaagauuacuuuuucuuu

SEQ ID NO: 2477024 - RNA, 22 nt, Human
gugguggagccaguaaacagag

SEQ ID NO: 2477025 - RNA, 12 nt, Human
gugguggagcca

SEQ ID NO: 2477026 - RNA, 19 nt, Human
gugguggaagaggggacag

SEQ ID NO: 2477027 - RNA, 20 nt, Human
gugguggaucuguccaagga

SEQ ID NO: 2477028 - RNA, 14 nt, Human
gugguggagccagu

SEQ ID NO: 2477029 - RNA, 16 nt, Human
gugguggcacaggccc

SEQ ID NO: 2477030 - RNA, 21 nt, Human
gugggucccacuuccccuccu

SEQ ID NO: 2477031 - RNA, 20 nt, Human
gugggucccacuuccccucc

SEQ ID NO: 2477032 - RNA, 18 nt, Human
guggugcucaguuguaga

SEQ ID NO: 2477033 - RNA, 14 nt, Human
guggugcugggacu

SEQ ID NO: 2477034 - RNA, 15 nt, Human
guggugcugacaaag

SEQ ID NO: 2477035 - RNA, 18 nt, Human
gugguggaagaggggaca

SEQ ID NO: 2477036 - RNA, 18 nt, Human
gugguggcgggcgccugu

SEQ ID NO: 2477037 - RNA, 18 nt, Human
gugguggcccacgccugu

SEQ ID NO: 2477038 - RNA, 18 nt, Human
gugguggcucaugccugu

SEQ ID NO: 2477039 - RNA, 18 nt, Human
gugguggcucacgccugu

SEQ ID NO: 2477040 - RNA, 21 nt, Human
gugguggcagggccuagcugc

SEQ ID NO: 2477041 - RNA, 17 nt, Human
gugguggcagggccuag

SEQ ID NO: 2477042 - RNA, 15 nt, Human
gugguggcagggccu

SEQ ID NO: 2477043 - RNA, 23 nt, Human
gugguggcagggccuagcugcua

SEQ ID NO: 2477044 - RNA, 23 nt, Human
gugguggcauacgccuguagucc

SEQ ID NO: 2477045 - RNA, 16 nt, Human
gugguguuuccuggca

SEQ ID NO: 2477046 - RNA, 15 nt, Human
gugguguuuccuggc

SEQ ID NO: 2477047 - RNA, 22 nt, Human
gugguguggagaagccacaggc

SEQ ID NO: 2477048 - RNA, 14 nt, Human
gugguguggagaag

SEQ ID NO: 2477049 - RNA, 23 nt, Human
guggugugucccccucuguccag

SEQ ID NO: 2477050 - RNA, 20 nt, Human
gugguguuuccugcaggcca

SEQ ID NO: 2477051 - RNA, 15 nt, Human
gugggggucugugug

SEQ ID NO: 2477052 - RNA, 16 nt, Human
gugggggucugugugu

SEQ ID NO: 2477053 - RNA, 14 nt, Human
gugggggucugugu

SEQ ID NO: 2477054 - RNA, 19 nt, Human
guggggguagagcugaucc

SEQ ID NO: 2477055 - RNA, 18 nt, Human
guggggggggugcugggc

SEQ ID NO: 2477056 - RNA, 24 nt, Human
gugggauguucagcacugucccuu

SEQ ID NO: 2477057 - RNA, 15 nt, Human
guggguauaaaagau

SEQ ID NO: 2477058 - RNA, 13 nt, Human
guggguauaaaag

SEQ ID NO: 2477059 - RNA, 21 nt, Human
guggguagguuggacuggaaa

SEQ ID NO: 2477060 - RNA, 15 nt, Human
guggggguggaggcu

SEQ ID NO: 2477061 - RNA, 12 nt, Human
guggguauaaaa

SEQ ID NO: 2477062 - RNA, 14 nt, Human
guggguagacacac

SEQ ID NO: 2477063 - RNA, 23 nt, Human
gugggggugcagaugagguugcu

SEQ ID NO: 2477064 - RNA, 22 nt, Human
guggggguggaauaaaauacua

SEQ ID NO: 2477065 - RNA, 20 nt, Human
guggguagaucacgagauca

SEQ ID NO: 2477066 - RNA, 23 nt, Human
guggguccaggggccccuccagc

SEQ ID NO: 2477067 - RNA, 20 nt, Human
guggguccaggggccccucc

SEQ ID NO: 2477068 - RNA, 18 nt, Human
guggguccaugggcagag

SEQ ID NO: 2477069 - RNA, 20 nt, Human
guggguccaugggcagagcc

SEQ ID NO: 2477070 - RNA, 22 nt, Human
guggguccaugggcagagccca

SEQ ID NO: 2477071 - RNA, 19 nt, Human
guggguccaggggccccuc

SEQ ID NO: 2477072 - RNA, 16 nt, Human
guggguccaggggccc

SEQ ID NO: 2477073 - RNA, 16 nt, Human
guggguauaaaagaug

SEQ ID NO: 2477074 - RNA, 14 nt, Human
gugggucaaggaau

SEQ ID NO: 2477075 - RNA, 18 nt, Human
gugcacgcaguggccuuc

SEQ ID NO: 2477076 - RNA, 23 nt, Human
aacugcauuaccgcguuguaaaa

SEQ ID NO: 2477077 - RNA, 17 nt, Human
gugcacacaccagagcc

SEQ ID NO: 2477078 - RNA, 18 nt, Human
gugcacguacacacacau

SEQ ID NO: 2477079 - RNA, 15 nt, Human
gugcacguggagagc

SEQ ID NO: 2477080 - RNA, 16 nt, Human
gugcacguggagagcu

SEQ ID NO: 2477081 - RNA, 18 nt, Human
gugcacguggagagcugg

SEQ ID NO: 2477082 - RNA, 14 nt, Human
gugcacacaccaga

SEQ ID NO: 2477083 - RNA, 12 nt, Human
gugcacacacca

SEQ ID NO: 2477084 - RNA, 23 nt, Human
aacugcaggcccuggccuccccu

SEQ ID NO: 2477085 - RNA, 14 nt, Human
aacugcagggaaaa

SEQ ID NO: 2477086 - RNA, 23 nt, Human
aacugcagggaaaauuauuugca

SEQ ID NO: 2477087 - RNA, 14 nt, Human
aacugcaugcugcu

SEQ ID NO: 2477088 - RNA, 22 nt, Human
aacugcauuaccgcguuguaaa

SEQ ID NO: 2477089 - RNA, 16 nt, Human
aacugcaugcugcugg

SEQ ID NO: 2477090 - RNA, 21 nt, Human
aacugcauuaccgcguuguaa

SEQ ID NO: 2477091 - RNA, 21 nt, Human
gugcauuugaggucuguucuu

SEQ ID NO: 2477092 - RNA, 22 nt, Human
gugcauuugaggucuguucuuu

SEQ ID NO: 2477093 - RNA, 20 nt, Human
gugcauuugaggucuguucu

SEQ ID NO: 2477094 - RNA, 21 nt, Human
gugcacguggcauguggccug

SEQ ID NO: 2477095 - RNA, 21 nt, Human
gugcacguggagagcuggugc

SEQ ID NO: 2477096 - RNA, 15 nt, Human
gugcauuuggugguu

SEQ ID NO: 2477097 - RNA, 23 nt, Human
gugccaacacucaagaagcaggc

SEQ ID NO: 2477098 - RNA, 22 nt, Human
gugccaacacucaagaagcagg

SEQ ID NO: 2477099 - RNA, 18 nt, Human
gugcacguggcauguggc

SEQ ID NO: 2477100 - RNA, 21 nt, Human
gugccaacaguguuaggccug

SEQ ID NO: 2477101 - RNA, 14 nt, Human
gugccaagcacagu

SEQ ID NO: 2477102 - RNA, 16 nt, Human
gugccaagcacagugc

SEQ ID NO: 2477103 - RNA, 14 nt, Human
gugccaagcagagg

SEQ ID NO: 2477104 - RNA, 17 nt, Human
gugccaagcacagugcc

SEQ ID NO: 2477105 - RNA, 18 nt, Human
gugccaagcacagugccu

SEQ ID NO: 2477106 - RNA, 19 nt, Human
gugccaagcacagugccug

SEQ ID NO: 2477107 - RNA, 23 nt, Human
gugccugccugggaguuuuguau

SEQ ID NO: 2477108 - RNA, 11 nt, Human
gugccugcagc

SEQ ID NO: 2477109 - RNA, 16 nt, Human
gugccuggccacgccc

SEQ ID NO: 2477110 - RNA, 22 nt, Human
gugccuggacauuugccuugcu

SEQ ID NO: 2477111 - RNA, 14 nt, Human
gugccuggcucaga

SEQ ID NO: 2477112 - RNA, 12 nt, Human
gugccuggcuca

SEQ ID NO: 2477113 - RNA, 19 nt, Human
gugccuggccuggcacaca

SEQ ID NO: 2477114 - RNA, 15 nt, Human
gugccuggccuggca

SEQ ID NO: 2477115 - RNA, 12 nt, Human
gugccuggccug

SEQ ID NO: 2477116 - RNA, 18 nt, Human
gugccuggcucagagcca

SEQ ID NO: 2477117 - RNA, 16 nt, Human
gugccuggcucagagc

SEQ ID NO: 2477118 - RNA, 15 nt, Human
gugccugggaaugua

SEQ ID NO: 2477119 - RNA, 20 nt, Human
gugccuggcucagagccagu

SEQ ID NO: 2477120 - RNA, 16 nt, Human
gugccugggaauguau

SEQ ID NO: 2477121 - RNA, 17 nt, Human
gugccugggaauguauu

SEQ ID NO: 2477122 - RNA, 19 nt, Human
gugccaauauguauuguaa

SEQ ID NO: 2477123 - RNA, 17 nt, Human
gugccaauauguauugu

SEQ ID NO: 2477124 - RNA, 15 nt, Human
gugccaauauguauu

SEQ ID NO: 2477125 - RNA, 14 nt, Human
gugccucugggacu

SEQ ID NO: 2477126 - RNA, 15 nt, Human
gugccucugggacug

SEQ ID NO: 2477127 - RNA, 17 nt, Human
gugccugagaggcaggc

SEQ ID NO: 2477128 - RNA, 16 nt, Human
gugccugagaggcagg

SEQ ID NO: 2477129 - RNA, 15 nt, Human
gugccugagaggcag

SEQ ID NO: 2477130 - RNA, 14 nt, Human
gugccugagaggca

SEQ ID NO: 2477131 - RNA, 21 nt, Human
gugccaauauguauuguaaac

SEQ ID NO: 2477132 - RNA, 20 nt, Human
gugccaauauguauuguaaa

SEQ ID NO: 2477133 - RNA, 22 nt, Human
gugccaauggaaccuccuuucu

SEQ ID NO: 2477134 - RNA, 22 nt, Human
gugccugauucggcugucucag

SEQ ID NO: 2477135 - RNA, 21 nt, Human
gugccugauucggcugucuca

SEQ ID NO: 2477136 - RNA, 19 nt, Human
gugccugauucggcugucu

SEQ ID NO: 2477137 - RNA, 18 nt, Human
gugccugauucggcuguc

SEQ ID NO: 2477138 - RNA, 23 nt, Human
gugccugauccagccucuccccu

SEQ ID NO: 2477139 - RNA, 20 nt, Human
gugccugauccagccucucc

SEQ ID NO: 2477140 - RNA, 18 nt, Human
gugccugagaggcaggca

SEQ ID NO: 2477141 - RNA, 12 nt, Human
gugccugagagu

SEQ ID NO: 2477142 - RNA, 20 nt, Human
aacuuguaauuuuuuuaauu

SEQ ID NO: 2477143 - RNA, 15 nt, Human
aacuuguaaaugugg

SEQ ID NO: 2477144 - RNA, 15 nt, Human
aacuuguaaauacac

SEQ ID NO: 2477145 - RNA, 15 nt, Human
aacuuguaaaugcug

SEQ ID NO: 2477146 - RNA, 18 nt, Human
aacuuguaaaugcuguca

SEQ ID NO: 2477147 - RNA, 23 nt, Human
aacuugguucccauuugcuccuu

SEQ ID NO: 2477148 - RNA, 14 nt, Human
aacuuguaaauaca

SEQ ID NO: 2477149 - RNA, 14 nt, Human
aacuuggcgcugcc

SEQ ID NO: 2477150 - RNA, 15 nt, Human
aacuuggauuuuuga

SEQ ID NO: 2477151 - RNA, 12 nt, Human
aacuuggagccg

SEQ ID NO: 2477152 - RNA, 23 nt, Human
aacuuggaauuuguaaccucagc

SEQ ID NO: 2477153 - RNA, 15 nt, Human
aacuuggagccccag

SEQ ID NO: 2477154 - RNA, 22 nt, Human
gugccuggguggacauggcccc

SEQ ID NO: 2477155 - RNA, 17 nt, Human
gugccuggguggggcug

SEQ ID NO: 2477156 - RNA, 23 nt, Human
aacuuggaaaaauccagaaagaa

SEQ ID NO: 2477157 - RNA, 14 nt, Human
aacuuggaaauagu

SEQ ID NO: 2477158 - RNA, 22 nt, Human
aagaaaaaggaugcacagaguu

SEQ ID NO: 2477159 - RNA, 20 nt, Human
aagaaaaagucauccaaucu

SEQ ID NO: 2477160 - RNA, 19 nt, Human
aagaaaaaggaugcacaga

SEQ ID NO: 2477161 - RNA, 20 nt, Human
aagaaaaaggaugcacagag

SEQ ID NO: 2477162 - RNA, 18 nt, Human
aacuuguuacuaaagaaa

SEQ ID NO: 2477163 - RNA, 20 nt, Human
aacuugucuuuuucuggacu

SEQ ID NO: 2477164 - RNA, 17 nt, Human
aacuuguauuaaagaca

SEQ ID NO: 2477165 - RNA, 18 nt, Human
aagaaaacaucuauucuc

SEQ ID NO: 2477166 - RNA, 14 nt, Human
aagaaaaaucaugu

SEQ ID NO: 2477167 - RNA, 13 nt, Human
aagaaaaaucaug

SEQ ID NO: 2477168 - RNA, 11 nt, Human
aagaaaagaua

SEQ ID NO: 2477169 - RNA, 16 nt, Human
aagaaaagagcuuucu

SEQ ID NO: 2477170 - RNA, 23 nt, Human
aagaaaagagauauuuuaaaaug

SEQ ID NO: 2477171 - RNA, 14 nt, Human
aagaaaacccaccc

SEQ ID NO: 2477172 - RNA, 12 nt, Human
aagaaaagauuu

SEQ ID NO: 2477173 - RNA, 22 nt, Human
aagaaaagauuuuaaucaaguu

SEQ ID NO: 2477174 - RNA, 22 nt, Human
aagaaaaguagguuuacauuca

SEQ ID NO: 2477175 - RNA, 19 nt, Human
aagaaaagugaaugcucaa

SEQ ID NO: 2477176 - RNA, 15 nt, Human
aagaaaagauaaaga

SEQ ID NO: 2477177 - RNA, 15 nt, Human
aagaaaagugggcca

SEQ ID NO: 2477178 - RNA, 18 nt, Human
aagaaaauaaaaaaaaga

SEQ ID NO: 2477179 - RNA, 21 nt, Human
aagaaaauaaaaaaaagaaaa

SEQ ID NO: 2477180 - RNA, 13 nt, Human
aagaaaauaaaaa

SEQ ID NO: 2477181 - RNA, 16 nt, Human
aagaaaagugguuguu

SEQ ID NO: 2477182 - RNA, 16 nt, Human
aagaaaagugggccag

SEQ ID NO: 2477183 - RNA, 22 nt, Human
aagaaaauaaaaaaaagaaaaa

SEQ ID NO: 2477184 - RNA, 23 nt, Human
aagaaaauaaaaaaaagaaaaaa

SEQ ID NO: 2477185 - RNA, 19 nt, Human
aagaaaauacauaagacca

SEQ ID NO: 2477186 - RNA, 22 nt, Human
aagaaaguugcacggcugcuga

SEQ ID NO: 2477187 - RNA, 20 nt, Human
aagaaaguugcacggcugcu

SEQ ID NO: 2477188 - RNA, 23 nt, Human
aagaaauaaaaggaagccaaaga

SEQ ID NO: 2477189 - RNA, 21 nt, Human
aagaaauaaaaggaagccaaa

SEQ ID NO: 2477190 - RNA, 16 nt, Human
aagaaaauugcugugc

SEQ ID NO: 2477191 - RNA, 16 nt, Human
aagaaaggguguuuuu

SEQ ID NO: 2477192 - RNA, 13 nt, Human
aagaaaauaucac

SEQ ID NO: 2477193 - RNA, 13 nt, Human
aagaaaauauuuu

SEQ ID NO: 2477194 - RNA, 11 nt, Human
aagaaaauauu

SEQ ID NO: 2477195 - RNA, 13 nt, Human
aagaaaauaugca

SEQ ID NO: 2477196 - RNA, 20 nt, Human
aagaaaaucauauugcuucu

SEQ ID NO: 2477197 - RNA, 17 nt, Human
aagaaaaucauauugcu

SEQ ID NO: 2477198 - RNA, 22 nt, Human
aagaaaaucuauuuuguaacuu

SEQ ID NO: 2477199 - RNA, 15 nt, Human
aagaaaauauuuugu

SEQ ID NO: 2477200 - RNA, 14 nt, Human
aagaaaauauuuug

SEQ ID NO: 2477201 - RNA, 13 nt, Human
aagaaaaucacuu

SEQ ID NO: 2477202 - RNA, 15 nt, Human
aagaaaaucauauug

SEQ ID NO: 2477203 - RNA, 20 nt, Human
aagaaaauauuuugucuaaa

SEQ ID NO: 2477204 - RNA, 23 nt, Human
aagaaaaucagauggagcaugaa

SEQ ID NO: 2477205 - RNA, 17 nt, Human
aagaagcccaggaaagg

SEQ ID NO: 2477206 - RNA, 16 nt, Human
aagaagcccaggaaag

SEQ ID NO: 2477207 - RNA, 22 nt, Human
aagaagcaccaaucaugaauua

SEQ ID NO: 2477208 - RNA, 19 nt, Human
aagaagcaggcuacacuga

SEQ ID NO: 2477209 - RNA, 14 nt, Human
aagaagcaggcuac

SEQ ID NO: 2477210 - RNA, 12 nt, Human
aagaagcaggcu

SEQ ID NO: 2477211 - RNA, 19 nt, Human
aagaagccacagaccuagg

SEQ ID NO: 2477212 - RNA, 15 nt, Human
aagaagcccccagcu

SEQ ID NO: 2477213 - RNA, 16 nt, Human
aagaagcccccagcua

SEQ ID NO: 2477214 - RNA, 19 nt, Human
aagaagcccccagcuaaga

SEQ ID NO: 2477215 - RNA, 14 nt, Human
aagaagcucucucc

SEQ ID NO: 2477216 - RNA, 15 nt, Human
aagaagcucucuccu

SEQ ID NO: 2477217 - RNA, 17 nt, Human
aagaagccgggaacaga

SEQ ID NO: 2477218 - RNA, 14 nt, Human
aagaagcuguugua

SEQ ID NO: 2477219 - RNA, 19 nt, Human
aagaaggcagcagguggca

SEQ ID NO: 2477220 - RNA, 24 nt, Human
guggacacagcucuucuccaggcu

SEQ ID NO: 2477221 - RNA, 17 nt, Human
guggacacagcucuucu

SEQ ID NO: 2477222 - RNA, 15 nt, Human
guggacacagcucuu

SEQ ID NO: 2477223 - RNA, 14 nt, Human
guggacacagcucu

SEQ ID NO: 2477224 - RNA, 14 nt, Human
guggacuaaaagau

SEQ ID NO: 2477225 - RNA, 23 nt, Human
guggacuaaaagauauaagugcu

SEQ ID NO: 2477226 - RNA, 15 nt, Human
guggacuaaaagaua

SEQ ID NO: 2477227 - RNA, 21 nt, Human
guggacaccaggagucccugg

SEQ ID NO: 2477228 - RNA, 22 nt, Human
guggacaccaggagucccuggu

SEQ ID NO: 2477229 - RNA, 20 nt, Human
guggaaggcaucagucccua

SEQ ID NO: 2477230 - RNA, 15 nt, Human
guggacaccaggagu

SEQ ID NO: 2477231 - RNA, 18 nt, Human
guggaagaagggagaaga

SEQ ID NO: 2477232 - RNA, 16 nt, Human
guggaagaagggagaa

SEQ ID NO: 2477233 - RNA, 15 nt, Human
guggaagaagggaga

SEQ ID NO: 2477234 - RNA, 17 nt, Human
guggaagaagagggaga

SEQ ID NO: 2477235 - RNA, 14 nt, Human
guggaagagggcug

SEQ ID NO: 2477236 - RNA, 17 nt, Human
guggaagaggggacagg

SEQ ID NO: 2477237 - RNA, 16 nt, Human
guggaagaggggacag

SEQ ID NO: 2477238 - RNA, 15 nt, Human
guggaagaggggaca

SEQ ID NO: 2477239 - RNA, 20 nt, Human
guggaagaagggagaagaaa

SEQ ID NO: 2477240 - RNA, 17 nt, Human
guggaagagggcugcaa

SEQ ID NO: 2477241 - RNA, 20 nt, Human
guggaauuauuuuaaaagau

SEQ ID NO: 2477242 - RNA, 18 nt, Human
guggaagcccuccuucca

SEQ ID NO: 2477243 - RNA, 16 nt, Human
guggaagcccuccuuc

SEQ ID NO: 2477244 - RNA, 17 nt, Human
guggaagcccuccuucc

SEQ ID NO: 2477245 - RNA, 20 nt, Human
guggaagaggggacaggucc

SEQ ID NO: 2477246 - RNA, 13 nt, Human
guggaagcccucc

SEQ ID NO: 2477247 - RNA, 14 nt, Human
guggaagcccuccu

SEQ ID NO: 2477248 - RNA, 16 nt, Human
guggaagaagagggag

SEQ ID NO: 2477249 - RNA, 23 nt, Human
gugcuguggccagggugagagcu

SEQ ID NO: 2477250 - RNA, 16 nt, Human
gugcuguggccugggc

SEQ ID NO: 2477251 - RNA, 17 nt, Human
gugcuguggccugggca

SEQ ID NO: 2477252 - RNA, 18 nt, Human
gugcuguggccaggguga

SEQ ID NO: 2477253 - RNA, 17 nt, Human
gugcuguggccagggug

SEQ ID NO: 2477254 - RNA, 16 nt, Human
gugcuguggccagggu

SEQ ID NO: 2477255 - RNA, 15 nt, Human
gugcuguggccaggg

SEQ ID NO: 2477256 - RNA, 14 nt, Human
gugcuguggccagg

SEQ ID NO: 2477257 - RNA, 14 nt, Human
gugcuguggaagca

SEQ ID NO: 2477258 - RNA, 11 nt, Human
gugcuguggcc

SEQ ID NO: 2477259 - RNA, 13 nt, Human
gugcuguggaagc

SEQ ID NO: 2477260 - RNA, 16 nt, Human
gugcugugcccaaguu

SEQ ID NO: 2477261 - RNA, 15 nt, Human
gugcugugcccaagu

SEQ ID NO: 2477262 - RNA, 20 nt, Human
gugcugucugaucugugcuu

SEQ ID NO: 2477263 - RNA, 12 nt, Human
gugcugugaaaa

SEQ ID NO: 2477264 - RNA, 17 nt, Human
gugcuguauaaaaucag

SEQ ID NO: 2477265 - RNA, 16 nt, Human
gugcuguauaaaauca

SEQ ID NO: 2477266 - RNA, 21 nt, Human
gugcuguauaaaaucagccaa

SEQ ID NO: 2477267 - RNA, 18 nt, Human
gugcuguccucagguggc

SEQ ID NO: 2477268 - RNA, 19 nt, Human
gugcuggauggagcccagg

SEQ ID NO: 2477269 - RNA, 18 nt, Human
gugcuggauggagcccag

SEQ ID NO: 2477270 - RNA, 18 nt, Human
gugcuggcaccaccaggc

SEQ ID NO: 2477271 - RNA, 15 nt, Human
gugcuggcaaccacu

SEQ ID NO: 2477272 - RNA, 16 nt, Human
gugcugggccccugcc

SEQ ID NO: 2477273 - RNA, 24 nt, Human
gugcuggaggugggagcaggagau

SEQ ID NO: 2477274 - RNA, 21 nt, Human
gugcuggaggugggagcagga

SEQ ID NO: 2477275 - RNA, 19 nt, Human
gugcuggaggugggagcag

SEQ ID NO: 2477276 - RNA, 17 nt, Human
gugcuggaggugggagc

SEQ ID NO: 2477277 - RNA, 16 nt, Human
gugcuggaggugggag

SEQ ID NO: 2477278 - RNA, 16 nt, Human
gugcuggaggacugag

SEQ ID NO: 2477279 - RNA, 14 nt, Human
gugcuggaggacug

SEQ ID NO: 2477280 - RNA, 19 nt, Human
gugcuggagccacuaacua

SEQ ID NO: 2477281 - RNA, 18 nt, Human
gugcuggagccacuaacu

SEQ ID NO: 2477282 - RNA, 15 nt, Human
gugcuggagccacua

SEQ ID NO: 2477283 - RNA, 12 nt, Human
gugcuggagcca

SEQ ID NO: 2477284 - RNA, 15 nt, Human
gugcugguguccuga

SEQ ID NO: 2477285 - RNA, 13 nt, Human
gugcugguguccu

SEQ ID NO: 2477286 - RNA, 23 nt, Human
gugcugguguccugaccacccuc

SEQ ID NO: 2477287 - RNA, 20 nt, Human
gugcugguguccugaccacc

SEQ ID NO: 2477288 - RNA, 19 nt, Human
gugcugguguccugaccac

SEQ ID NO: 2477289 - RNA, 16 nt, Human
gugcugguguccugac

SEQ ID NO: 2477290 - RNA, 15 nt, Human
gugcuguauaaaauc

SEQ ID NO: 2477291 - RNA, 13 nt, Human
gugcuguauaaaa

SEQ ID NO: 2477292 - RNA, 20 nt, Human
gugcuggauggagcccaggc

SEQ ID NO: 2477293 - RNA, 19 nt, Human
gugcugggccccugccucu

SEQ ID NO: 2477294 - RNA, 20 nt, Human
gugcugcccugcccaccugg

SEQ ID NO: 2477295 - RNA, 19 nt, Human
gugcugcccugcccaccug

SEQ ID NO: 2477296 - RNA, 21 nt, Human
gugcugcccugcccaccuggc

SEQ ID NO: 2477297 - RNA, 18 nt, Human
gugcuggaauucuaacaa

SEQ ID NO: 2477298 - RNA, 16 nt, Human
gugcugcuucccucug

SEQ ID NO: 2477299 - RNA, 13 nt, Human
gugcugcuucccu

SEQ ID NO: 2477300 - RNA, 15 nt, Human
gugcugcugcugcug

SEQ ID NO: 2477301 - RNA, 17 nt, Human
aagaagggagaagaaag

SEQ ID NO: 2477302 - RNA, 15 nt, Human
aagaagggagaagaa

SEQ ID NO: 2477303 - RNA, 14 nt, Human
aagaagggagaaga

SEQ ID NO: 2477304 - RNA, 22 nt, Human
aagaagggcuagaaccuggagg

SEQ ID NO: 2477305 - RNA, 13 nt, Human
aagaagggaugga

SEQ ID NO: 2477306 - RNA, 23 nt, Human
aagaagguuucagaaagaagugg

SEQ ID NO: 2477307 - RNA, 17 nt, Human
aagaaggguccuucccu

SEQ ID NO: 2477308 - RNA, 21 nt, Human
aagaaggguccuucccucucc

SEQ ID NO: 2477309 - RNA, 24 nt, Human
aagaaggguccuucccucucccca

SEQ ID NO: 2477310 - RNA, 18 nt, Human
gugcugcccugcccaccu

SEQ ID NO: 2477311 - RNA, 18 nt, Human
aagaagguuuguguuuuu

SEQ ID NO: 2477312 - RNA, 21 nt, Human
aagaagguuaccaagaagccu

SEQ ID NO: 2477313 - RNA, 15 nt, Human
aagaaguaggcauga

SEQ ID NO: 2477314 - RNA, 13 nt, Human
aagaauauucagg

SEQ ID NO: 2477315 - RNA, 11 nt, Human
aagaauauuug

SEQ ID NO: 2477316 - RNA, 17 nt, Human
guggcagcugcggucca

SEQ ID NO: 2477317 - RNA, 19 nt, Human
guggcagagcuuggacugg

SEQ ID NO: 2477318 - RNA, 13 nt, Human
aagaauauuuuaa

SEQ ID NO: 2477319 - RNA, 21 nt, Human
aagaaucacaauaauuuucua

SEQ ID NO: 2477320 - RNA, 15 nt, Human
aagaauauuugaaug

SEQ ID NO: 2477321 - RNA, 15 nt, Human
aagaauguuuauagc

SEQ ID NO: 2477322 - RNA, 16 nt, Human
aagaauugaacccagg

SEQ ID NO: 2477323 - RNA, 18 nt, Human
aagaauugaacccaggag

SEQ ID NO: 2477324 - RNA, 20 nt, Human
aagaauuucuugguaagaag

SEQ ID NO: 2477325 - RNA, 22 nt, Human
aagaauuucuugguaagaagcc

SEQ ID NO: 2477326 - RNA, 23 nt, Human
aagaauuucuugguaagaagccg

SEQ ID NO: 2477327 - RNA, 16 nt, Human
aagaauuauuuugaug

SEQ ID NO: 2477328 - RNA, 19 nt, Human
aagaauucaaacuggggcc

SEQ ID NO: 2477329 - RNA, 18 nt, Human
aagaauuuuaaaaaugaa

SEQ ID NO: 2477330 - RNA, 17 nt, Human
aagaauuuuaaaaauga

SEQ ID NO: 2477331 - RNA, 16 nt, Human
aagaauuuuaaaaaug

SEQ ID NO: 2477332 - RNA, 15 nt, Human
aagaauuuuaaaaau

SEQ ID NO: 2477333 - RNA, 14 nt, Human
aagaauuuuaaaaa

SEQ ID NO: 2477334 - RNA, 13 nt, Human
aagaauuuuaaaa

SEQ ID NO: 2477335 - RNA, 20 nt, Human
aagaauuuucagaccccagc

SEQ ID NO: 2477336 - RNA, 13 nt, Human
aagaauuuuuaaa

SEQ ID NO: 2477337 - RNA, 20 nt, Human
aagaauuuuaaaaaugaauc

SEQ ID NO: 2477338 - RNA, 19 nt, Human
aagaauuuuaaaaaugaau

SEQ ID NO: 2477339 - RNA, 22 nt, Human
aagaauuuucagaccccagcgg

SEQ ID NO: 2477340 - RNA, 13 nt, Human
aagacccaaaagg

SEQ ID NO: 2477341 - RNA, 23 nt, Human
aagaccagagauaguggggagac

SEQ ID NO: 2477342 - RNA, 22 nt, Human
guggcagcucaccucucccuug

SEQ ID NO: 2477343 - RNA, 14 nt, Human
guggcagcugcggu

SEQ ID NO: 2477344 - RNA, 23 nt, Human
guggcagagcuuggacuggaugc

SEQ ID NO: 2477345 - RNA, 15 nt, Human
guggcagagcuugga

SEQ ID NO: 2477346 - RNA, 19 nt, Human
guggcacuuuuucauuugc

SEQ ID NO: 2477347 - RNA, 20 nt, Human
guggcagauaaucagccucu

SEQ ID NO: 2477348 - RNA, 21 nt, Human
guggcagauaaucagccucuu

SEQ ID NO: 2477349 - RNA, 23 nt, Human
guggcagauaaucagccucuuaa

SEQ ID NO: 2477350 - RNA, 16 nt, Human
guggcacaggcccccu

SEQ ID NO: 2477351 - RNA, 13 nt, Human
guggcaccagcag

SEQ ID NO: 2477352 - RNA, 14 nt, Human
guggcaccagcagc

SEQ ID NO: 2477353 - RNA, 21 nt, Human
guggauuuaacagaaauguac

SEQ ID NO: 2477354 - RNA, 23 nt, Human
guggacucuuugguggcuuugca

SEQ ID NO: 2477355 - RNA, 18 nt, Human
guggacucuuugguggcu

SEQ ID NO: 2477356 - RNA, 17 nt, Human
guggacucuuugguggc

SEQ ID NO: 2477357 - RNA, 13 nt, Human
guggacuggaagg

SEQ ID NO: 2477358 - RNA, 14 nt, Human
guggacucagggca

SEQ ID NO: 2477359 - RNA, 15 nt, Human
guggacucagggcag

SEQ ID NO: 2477360 - RNA, 16 nt, Human
guggacucagggcagc

SEQ ID NO: 2477361 - RNA, 21 nt, Human
guggacucagggcagcgccag

SEQ ID NO: 2477362 - RNA, 21 nt, Human
guggacuccagacucucugug

SEQ ID NO: 2477363 - RNA, 17 nt, Human
guggacucugcacaugu

SEQ ID NO: 2477364 - RNA, 14 nt, Human
guggacucugcaca

SEQ ID NO: 2477365 - RNA, 14 nt, Human
guggacuccagacu

SEQ ID NO: 2477366 - RNA, 20 nt, Human
guggauuuaacagaaaugua

SEQ ID NO: 2477367 - RNA, 16 nt, Human
guggacuggccccugg

SEQ ID NO: 2477368 - RNA, 15 nt, Human
guggacuggccccug

SEQ ID NO: 2477369 - RNA, 21 nt, Human
guggauuuugguuuuguuccc

SEQ ID NO: 2477370 - RNA, 23 nt, Human
guggauuuaacagaaauguacag

SEQ ID NO: 2477371 - RNA, 15 nt, Human
guggcaaggcugugc

SEQ ID NO: 2477372 - RNA, 13 nt, Human
guggcaaggcugu

SEQ ID NO: 2477373 - RNA, 12 nt, Human
guggcacaggcc

SEQ ID NO: 2477374 - RNA, 16 nt, Human
guggcaaggcugugcu

SEQ ID NO: 2477375 - RNA, 22 nt, Human
guggcacacaccuguaguccca

SEQ ID NO: 2477376 - RNA, 22 nt, Human
guggcaaagccuucauugccuu

SEQ ID NO: 2477377 - RNA, 21 nt, Human
guggcaagcugugacuucucc

SEQ ID NO: 2477378 - RNA, 20 nt, Human
uaaaucuccaaaauaaaacu

SEQ ID NO: 2477379 - RNA, 21 nt, Human
uaaaucuccaaaauaaaacuu

SEQ ID NO: 2477380 - RNA, 18 nt, Human
uaaaugagcuauguauua

SEQ ID NO: 2477381 - RNA, 16 nt, Human
uaaaugagcuauguau

SEQ ID NO: 2477382 - RNA, 12 nt, Human
uaaaugaauguu

SEQ ID NO: 2477383 - RNA, 19 nt, Human
uaaaucuaguauacauugu

SEQ ID NO: 2477384 - RNA, 13 nt, Human
uaaaugaauguuu

SEQ ID NO: 2477385 - RNA, 15 nt, Human
uaaauguugacaugg

SEQ ID NO: 2477386 - RNA, 17 nt, Human
uaaaugauuucauucaa

SEQ ID NO: 2477387 - RNA, 17 nt, Human
uaaaugauucuuaguga

SEQ ID NO: 2477388 - RNA, 21 nt, Human
uaaaugauguggugccugagg

SEQ ID NO: 2477389 - RNA, 17 nt, Human
uaaaugaggggccucag

SEQ ID NO: 2477390 - RNA, 22 nt, Human
uaaauuaacuuuuauaaacuuu

SEQ ID NO: 2477391 - RNA, 15 nt, Human
uaaauuaagacaugc

SEQ ID NO: 2477392 - RNA, 12 nt, Human
uaaauuaagaca

SEQ ID NO: 2477393 - RNA, 20 nt, Human
uaaauguuuuucuauguagu

SEQ ID NO: 2477394 - RNA, 18 nt, Human
uaaauguuuuucuaugua

SEQ ID NO: 2477395 - RNA, 20 nt, Human
uaaauguuuuuuuuuaaaga

SEQ ID NO: 2477396 - RNA, 19 nt, Human
uaaauuacaauugucauuu

SEQ ID NO: 2477397 - RNA, 13 nt, Human
uaaauuaaucuuu

SEQ ID NO: 2477398 - RNA, 13 nt, Human
uaaauuaagacau

SEQ ID NO: 2477399 - RNA, 14 nt, Human
uaaauuaggaauaa

SEQ ID NO: 2477400 - RNA, 17 nt, Human
uaaauuaggaauaaaua

SEQ ID NO: 2477401 - RNA, 18 nt, Human
uaaauuaguauuuauuua

SEQ ID NO: 2477402 - RNA, 21 nt, Human
uaaauuaggaauaaauaaaaa

SEQ ID NO: 2477403 - RNA, 22 nt, Human
uaaauuaggaauaaauaaaaau

SEQ ID NO: 2477404 - RNA, 18 nt, Human
uaacaagaaacucacccc

SEQ ID NO: 2477405 - RNA, 16 nt, Human
uaacaagaucuuucag

SEQ ID NO: 2477406 - RNA, 17 nt, Human
uaacaagaucuuucagg

SEQ ID NO: 2477407 - RNA, 18 nt, Human
uaacaagaucuuucagga

SEQ ID NO: 2477408 - RNA, 14 nt, Human
uaacaagaaacuca

SEQ ID NO: 2477409 - RNA, 13 nt, Human
uaacaacuaggga

SEQ ID NO: 2477410 - RNA, 14 nt, Human
uaacaaccuggaga

SEQ ID NO: 2477411 - RNA, 22 nt, Human
uaacaacuaugauuuggaaaau

SEQ ID NO: 2477412 - RNA, 21 nt, Human
uaacaacuaugauuuggaaaa

SEQ ID NO: 2477413 - RNA, 16 nt, Human
uaacaacuaugauuug

SEQ ID NO: 2477414 - RNA, 17 nt, Human
uaacaaugcuguauuuu

SEQ ID NO: 2477415 - RNA, 15 nt, Human
uaacaaugcuguauu

SEQ ID NO: 2477416 - RNA, 16 nt, Human
uaacaagguccaagau

SEQ ID NO: 2477417 - RNA, 15 nt, Human
uaacaagcucccagg

SEQ ID NO: 2477418 - RNA, 13 nt, Human
uaacaagccaccc

SEQ ID NO: 2477419 - RNA, 18 nt, Human
uaaauuuuacccuuuaga

SEQ ID NO: 2477420 - RNA, 16 nt, Human
uaaauuuuacccuuua

SEQ ID NO: 2477421 - RNA, 15 nt, Human
uaaauuuuaauuuau

SEQ ID NO: 2477422 - RNA, 16 nt, Human
uaaauuuugaguucua

SEQ ID NO: 2477423 - RNA, 16 nt, Human
uaaauuuuuuuccuua

SEQ ID NO: 2477424 - RNA, 19 nt, Human
uaaauuuuuuuuguuucau

SEQ ID NO: 2477425 - RNA, 23 nt, Human
uaacaaaaaaauauauuuaauga

SEQ ID NO: 2477426 - RNA, 20 nt, Human
uaacaaaaaaauauauuuaa

SEQ ID NO: 2477427 - RNA, 22 nt, Human
uaacaaaacacucggcauuuca

SEQ ID NO: 2477428 - RNA, 18 nt, Human
uaacaaaaacuacacaua

SEQ ID NO: 2477429 - RNA, 12 nt, Human
uaacaaauuaug

SEQ ID NO: 2477430 - RNA, 15 nt, Human
uaaauauaauucugu

SEQ ID NO: 2477431 - RNA, 13 nt, Human
uaaauauaauucu

SEQ ID NO: 2477432 - RNA, 19 nt, Human
uaaauauaauucuguaaau

SEQ ID NO: 2477433 - RNA, 18 nt, Human
uaaauauaauucuguaaa

SEQ ID NO: 2477434 - RNA, 16 nt, Human
uaaauauaauucugua

SEQ ID NO: 2477435 - RNA, 18 nt, Human
uaaauaguauuugagagu

SEQ ID NO: 2477436 - RNA, 19 nt, Human
uaaaucuccaaaauaaaac

SEQ ID NO: 2477437 - RNA, 18 nt, Human
uaaaucuaguauacauug

SEQ ID NO: 2477438 - RNA, 15 nt, Human
uaaaucuagacucaa

SEQ ID NO: 2477439 - RNA, 19 nt, Human
uaaauccuuuuucuuuaua

SEQ ID NO: 2477440 - RNA, 17 nt, Human
uaaauccuuuacuguua

SEQ ID NO: 2477441 - RNA, 23 nt, Human
uaaaucccauucauaacuuucau

SEQ ID NO: 2477442 - RNA, 19 nt, Human
uaaaucgcuuuugauaauc

SEQ ID NO: 2477443 - RNA, 18 nt, Human
uaaaucgcuuuugauaau

SEQ ID NO: 2477444 - RNA, 15 nt, Human
uaaaucccauucaua

SEQ ID NO: 2477445 - RNA, 17 nt, Human
uaaauccuuuuucuuua

SEQ ID NO: 2477446 - RNA, 17 nt, Human
uaaauacaaaacuucca

SEQ ID NO: 2477447 - RNA, 18 nt, Human
uaaauacacaacacacac

SEQ ID NO: 2477448 - RNA, 19 nt, Human
uaaauacacauagcaugua

SEQ ID NO: 2477449 - RNA, 23 nt, Human
uaaauacaccaccucacuccugu

SEQ ID NO: 2477450 - RNA, 15 nt, Human
uaaauagcuauaucc

SEQ ID NO: 2477451 - RNA, 16 nt, Human
uaaauagcuauaucca

SEQ ID NO: 2477452 - RNA, 17 nt, Human
uaaauagcuauauccau

SEQ ID NO: 2477453 - RNA, 18 nt, Human
uaaauagcuauauccaug

SEQ ID NO: 2477454 - RNA, 15 nt, Human
uaaauacagacacua

SEQ ID NO: 2477455 - RNA, 14 nt, Human
uaaauacagacacu

SEQ ID NO: 2477456 - RNA, 16 nt, Human
uaaauacagacacuaa

SEQ ID NO: 2477457 - RNA, 14 nt, Human
uaaauagcuauauc

SEQ ID NO: 2477458 - RNA, 20 nt, Human
uaaauaguaaaaauaaaauu

SEQ ID NO: 2477459 - RNA, 19 nt, Human
uaaauaguaaaaauaaaau

SEQ ID NO: 2477460 - RNA, 21 nt, Human
uaaauaggagaggaugagagc

SEQ ID NO: 2477461 - RNA, 16 nt, Human
uaaauaggagaggaug

SEQ ID NO: 2477462 - RNA, 22 nt, Human
uaaauagcuauauccauguacu

SEQ ID NO: 2477463 - RNA, 19 nt, Human
uaaauagcuauauccaugu

SEQ ID NO: 2477464 - RNA, 20 nt, Human
uaaauagcuauauccaugua

SEQ ID NO: 2477465 - RNA, 14 nt, Human
aauacacacucaaa

SEQ ID NO: 2477466 - RNA, 15 nt, Human
aauacaccacuacau

SEQ ID NO: 2477467 - RNA, 17 nt, Human
aauacacaaguaaacau

SEQ ID NO: 2477468 - RNA, 15 nt, Human
aauacacaaguaaac

SEQ ID NO: 2477469 - RNA, 21 nt, Human
aauacaccaccucacuccugu

SEQ ID NO: 2477470 - RNA, 20 nt, Human
aauacaccaccucacuccug

SEQ ID NO: 2477471 - RNA, 23 nt, Human
aauacacauagcauguaauggua

SEQ ID NO: 2477472 - RNA, 20 nt, Human
aauaauuaugaguuugcuua

SEQ ID NO: 2477473 - RNA, 18 nt, Human
aauaauuauccagaguuu

SEQ ID NO: 2477474 - RNA, 14 nt, Human
aauacaauaaguua

SEQ ID NO: 2477475 - RNA, 16 nt, Human
aauacaccacuacauu

SEQ ID NO: 2477476 - RNA, 18 nt, Human
aauacaccacuacauucu

SEQ ID NO: 2477477 - RNA, 20 nt, Human
aauacaccacuacauucugu

SEQ ID NO: 2477478 - RNA, 22 nt, Human
uaaauaaaugaaguauuucuca

SEQ ID NO: 2477479 - RNA, 22 nt, Human
uaaauaaauguaucuuauucac

SEQ ID NO: 2477480 - RNA, 22 nt, Human
aauacaccaccucacuccuguu

SEQ ID NO: 2477481 - RNA, 16 nt, Human
uaaauaaaugucauua

SEQ ID NO: 2477482 - RNA, 20 nt, Human
uaaauaaauuguauauucac

SEQ ID NO: 2477483 - RNA, 19 nt, Human
uaaauaaauuguauauuca

SEQ ID NO: 2477484 - RNA, 18 nt, Human
uaaauaaauuguauauuc

SEQ ID NO: 2477485 - RNA, 17 nt, Human
uaaauaaauuguauauu

SEQ ID NO: 2477486 - RNA, 16 nt, Human
uaaauaaauuguauau

SEQ ID NO: 2477487 - RNA, 15 nt, Human
uaaauaaauuguaua

SEQ ID NO: 2477488 - RNA, 14 nt, Human
uaaauaaauuguau

SEQ ID NO: 2477489 - RNA, 12 nt, Human
uaaauaaauugu

SEQ ID NO: 2477490 - RNA, 18 nt, Human
uaaauaaaugucauuaaa

SEQ ID NO: 2477491 - RNA, 15 nt, Human
uaaauaaauuguuug

SEQ ID NO: 2477492 - RNA, 13 nt, Human
uaaauaaauuguu

SEQ ID NO: 2477493 - RNA, 20 nt, Human
uaaauaaauuguuugaccau

SEQ ID NO: 2477494 - RNA, 22 nt, Human
uaaauaaauuguauauucacuu

SEQ ID NO: 2477495 - RNA, 21 nt, Human
uaaauaaauuguauauucacu

SEQ ID NO: 2477496 - RNA, 15 nt, Human
aauaacaauaaaaga

SEQ ID NO: 2477497 - RNA, 18 nt, Human
aauaaauuugguucuaau

SEQ ID NO: 2477498 - RNA, 21 nt, Human
aauaaauuugguucuaauaga

SEQ ID NO: 2477499 - RNA, 14 nt, Human
aauaaauucagaua

SEQ ID NO: 2477500 - RNA, 16 nt, Human
aauaacaagucgauga

SEQ ID NO: 2477501 - RNA, 12 nt, Human
aauaacauguaa

SEQ ID NO: 2477502 - RNA, 19 nt, Human
aauaacauguaauuaagua

SEQ ID NO: 2477503 - RNA, 22 nt, Human
aauaacauguaauuaaguacua

SEQ ID NO: 2477504 - RNA, 12 nt, Human
aauaaaugugcc

SEQ ID NO: 2477505 - RNA, 21 nt, Human
aauaaaugugccuucauuuuu

SEQ ID NO: 2477506 - RNA, 12 nt, Human
aauaaauuauuu

SEQ ID NO: 2477507 - RNA, 20 nt, Human
aauaaaugugaaauucuguc

SEQ ID NO: 2477508 - RNA, 18 nt, Human
aauaaauuaaaacaugca

SEQ ID NO: 2477509 - RNA, 17 nt, Human
aauaaauuauuuauuau

SEQ ID NO: 2477510 - RNA, 19 nt, Human
aauaaauauauauaaaccu

SEQ ID NO: 2477511 - RNA, 16 nt, Human
aauaaauauauauaaa

SEQ ID NO: 2477512 - RNA, 15 nt, Human
aauaaauauauauaa

SEQ ID NO: 2477513 - RNA, 14 nt, Human
aauaaauauauaua

SEQ ID NO: 2477514 - RNA, 16 nt, Human
aauaaauauauauauc

SEQ ID NO: 2477515 - RNA, 15 nt, Human
aauaaauauauauau

SEQ ID NO: 2477516 - RNA, 13 nt, Human
aauaaauauauau

SEQ ID NO: 2477517 - RNA, 12 nt, Human
aauaaauauaua

SEQ ID NO: 2477518 - RNA, 11 nt, Human
aauaaauauau

SEQ ID NO: 2477519 - RNA, 20 nt, Human
aauaaauaccucuuagcuga

SEQ ID NO: 2477520 - RNA, 19 nt, Human
aauaaauagcuauauccau

SEQ ID NO: 2477521 - RNA, 21 nt, Human
aauaaauagcuauauccaugu

SEQ ID NO: 2477522 - RNA, 18 nt, Human
aauaaaguaucaugcauu

SEQ ID NO: 2477523 - RNA, 17 nt, Human
aauaaaguaucaugcau

SEQ ID NO: 2477524 - RNA, 16 nt, Human
aauaaaguaucaugca

SEQ ID NO: 2477525 - RNA, 19 nt, Human
aauaaaguuugcuuagaaa

SEQ ID NO: 2477526 - RNA, 14 nt, Human
aauaaauaaaugca

SEQ ID NO: 2477527 - RNA, 12 nt, Human
aauaaauaaaug

SEQ ID NO: 2477528 - RNA, 13 nt, Human
aauaagcuaaaga

SEQ ID NO: 2477529 - RNA, 17 nt, Human
aauaagcaucaaacucu

SEQ ID NO: 2477530 - RNA, 14 nt, Human
aauaagcuaaagag

SEQ ID NO: 2477531 - RNA, 19 nt, Human
aauaacuacuguguuccug

SEQ ID NO: 2477532 - RNA, 17 nt, Human
aauaacuacuguguucc

SEQ ID NO: 2477533 - RNA, 18 nt, Human
aauaacuacuguguuccu

SEQ ID NO: 2477534 - RNA, 13 nt, Human
aauaacuacugug

SEQ ID NO: 2477535 - RNA, 14 nt, Human
aauaacuacugugu

SEQ ID NO: 2477536 - RNA, 15 nt, Human
aauaacuacuguguu

SEQ ID NO: 2477537 - RNA, 16 nt, Human
aauaacuacuguguuc

SEQ ID NO: 2477538 - RNA, 19 nt, Human
aauaacuaguguugcuugg

SEQ ID NO: 2477539 - RNA, 15 nt, Human
aauaacagugcauau

SEQ ID NO: 2477540 - RNA, 20 nt, Human
aauaacauaauuuguacaua

SEQ ID NO: 2477541 - RNA, 15 nt, Human
aauaacuaaaaggua

SEQ ID NO: 2477542 - RNA, 16 nt, Human
aauaaggucaaugcca

SEQ ID NO: 2477543 - RNA, 14 nt, Human
aauaagguugaaca

SEQ ID NO: 2477544 - RNA, 17 nt, Human
aauaaggccuuaauaug

SEQ ID NO: 2477545 - RNA, 18 nt, Human
uaaagugauuaaacgugc

SEQ ID NO: 2477546 - RNA, 16 nt, Human
uaaagugauuaaacgu

SEQ ID NO: 2477547 - RNA, 22 nt, Human
uaaagugauuaaacgugcagac

SEQ ID NO: 2477548 - RNA, 11 nt, Human
uaaagugauua

SEQ ID NO: 2477549 - RNA, 19 nt, Human
uaaagucgagcuuuucuaa

SEQ ID NO: 2477550 - RNA, 16 nt, Human
uaaagugauauuuccc

SEQ ID NO: 2477551 - RNA, 20 nt, Human
uaaagugagcucuaugggca

SEQ ID NO: 2477552 - RNA, 15 nt, Human
uaaagugauauuucc

SEQ ID NO: 2477553 - RNA, 16 nt, Human
uaaagugauaauuucu

SEQ ID NO: 2477554 - RNA, 13 nt, Human
uaaagucaggggu

SEQ ID NO: 2477555 - RNA, 19 nt, Human
uaaaggcuucucucucacc

SEQ ID NO: 2477556 - RNA, 17 nt, Human
uaaaggcuucucucuca

SEQ ID NO: 2477557 - RNA, 21 nt, Human
uaaagggaaaggauucaugug

SEQ ID NO: 2477558 - RNA, 17 nt, Human
uaaagucagguccaauu

SEQ ID NO: 2477559 - RNA, 20 nt, Human
uaaagucgagcuuuucuaaa

SEQ ID NO: 2477560 - RNA, 18 nt, Human
uaaagucagguccaauuu

SEQ ID NO: 2477561 - RNA, 13 nt, Human
uaaagucccaggu

SEQ ID NO: 2477562 - RNA, 15 nt, Human
uaaaguguauuuuuu

SEQ ID NO: 2477563 - RNA, 19 nt, Human
uaaaguguauuuuuuuacu

SEQ ID NO: 2477564 - RNA, 14 nt, Human
uaaaguguauuuuu

SEQ ID NO: 2477565 - RNA, 22 nt, Human
uaaaguggguuauucuggaguu

SEQ ID NO: 2477566 - RNA, 21 nt, Human
uaaaguggguuauucuggagu

SEQ ID NO: 2477567 - RNA, 16 nt, Human
uaaaguguaaauccuu

SEQ ID NO: 2477568 - RNA, 22 nt, Human
uaaaguguaaauccuuuuucuu

SEQ ID NO: 2477569 - RNA, 13 nt, Human
aauaaaaaaugga

SEQ ID NO: 2477570 - RNA, 17 nt, Human
aauaaaaaaaagaaaaa

SEQ ID NO: 2477571 - RNA, 18 nt, Human
aauaaaaaaaagaaaaaa

SEQ ID NO: 2477572 - RNA, 15 nt, Human
aauaaaaaaaagaaa

SEQ ID NO: 2477573 - RNA, 12 nt, Human
aauaaaaauaau

SEQ ID NO: 2477574 - RNA, 22 nt, Human
aauaaaaauauuguguugugaa

SEQ ID NO: 2477575 - RNA, 15 nt, Human
aauaaaaauaaauuc

SEQ ID NO: 2477576 - RNA, 16 nt, Human
aauaaaaauaaauuug

SEQ ID NO: 2477577 - RNA, 12 nt, Human
aauaaaaacaaa

SEQ ID NO: 2477578 - RNA, 22 nt, Human
aauaaaaaccaagaagaugucu

SEQ ID NO: 2477579 - RNA, 14 nt, Human
aauaaaaaccaaga

SEQ ID NO: 2477580 - RNA, 19 nt, Human
aauaaaaacugacuccuua

SEQ ID NO: 2477581 - RNA, 21 nt, Human
aauaaaaacugacuccuuaga

SEQ ID NO: 2477582 - RNA, 20 nt, Human
aauaaaaggaagccaaagag

SEQ ID NO: 2477583 - RNA, 21 nt, Human
aauaaaaggaagccaaagagu

SEQ ID NO: 2477584 - RNA, 16 nt, Human
aauaaaagugaccuuu

SEQ ID NO: 2477585 - RNA, 17 nt, Human
aauaaaaggaaaagcaa

SEQ ID NO: 2477586 - RNA, 14 nt, Human
aauaaaaggaaaag

SEQ ID NO: 2477587 - RNA, 13 nt, Human
aauaaaaggaaaa

SEQ ID NO: 2477588 - RNA, 12 nt, Human
aauaaaaggaaa

SEQ ID NO: 2477589 - RNA, 18 nt, Human
aauaaaagcagcaucugc

SEQ ID NO: 2477590 - RNA, 21 nt, Human
aauaaaagcagcaucugcuaa

SEQ ID NO: 2477591 - RNA, 16 nt, Human
aauaaaagauauaaau

SEQ ID NO: 2477592 - RNA, 14 nt, Human
aauaaaaauguuua

SEQ ID NO: 2477593 - RNA, 15 nt, Human
aauaaaaauguuuaa

SEQ ID NO: 2477594 - RNA, 13 nt, Human
aauaaaaauggau

SEQ ID NO: 2477595 - RNA, 22 nt, Human
aauaaaauccauacauuugugu

SEQ ID NO: 2477596 - RNA, 16 nt, Human
aauaaaaucuugaaaa

SEQ ID NO: 2477597 - RNA, 17 nt, Human
aauaaaauaauucuaaa

SEQ ID NO: 2477598 - RNA, 16 nt, Human
aauaaaauaauucuaa

SEQ ID NO: 2477599 - RNA, 14 nt, Human
aauaaaauaaaaau

SEQ ID NO: 2477600 - RNA, 15 nt, Human
aauaaaauaauucua

SEQ ID NO: 2477601 - RNA, 16 nt, Human
aauaaaguacaagagc

SEQ ID NO: 2477602 - RNA, 15 nt, Human
aauaaaguaucaugc

SEQ ID NO: 2477603 - RNA, 11 nt, Human
aauaaaguauc

SEQ ID NO: 2477604 - RNA, 15 nt, Human
aauaaaguauauaua

SEQ ID NO: 2477605 - RNA, 14 nt, Human
aauaaaguaauuau

SEQ ID NO: 2477606 - RNA, 18 nt, Human
aauaaaggaugugauugu

SEQ ID NO: 2477607 - RNA, 11 nt, Human
aauaaaaucau

SEQ ID NO: 2477608 - RNA, 18 nt, Human
aauaaaaucauguacauu

SEQ ID NO: 2477609 - RNA, 18 nt, Human
uaaagaaagagagaaaau

SEQ ID NO: 2477610 - RNA, 19 nt, Human
uaaagaaagagagaaaaua

SEQ ID NO: 2477611 - RNA, 20 nt, Human
uaaagaaagagagaaaauaa

SEQ ID NO: 2477612 - RNA, 21 nt, Human
uaaagaaagagagaaaauaaa

SEQ ID NO: 2477613 - RNA, 11 nt, Human
uaaagaaagau

SEQ ID NO: 2477614 - RNA, 22 nt, Human
uaaagaaagagagaaaauaaaa

SEQ ID NO: 2477615 - RNA, 23 nt, Human
uaaagaaagagagaaaauaaaaa

SEQ ID NO: 2477616 - RNA, 21 nt, Human
uaaagaaagucgaauuaauag

SEQ ID NO: 2477617 - RNA, 17 nt, Human
uaaagaaagucgaauua

SEQ ID NO: 2477618 - RNA, 11 nt, Human
uaaagaaaguc

SEQ ID NO: 2477619 - RNA, 15 nt, Human
uaaacucuguugcaa

SEQ ID NO: 2477620 - RNA, 20 nt, Human
uaaacucuucacaaaaucug

SEQ ID NO: 2477621 - RNA, 21 nt, Human
uaaacucucuuugggaauguu

SEQ ID NO: 2477622 - RNA, 18 nt, Human
uaaacucucuuugggaau

SEQ ID NO: 2477623 - RNA, 10 nt, Human
uaaacugcau

SEQ ID NO: 2477624 - RNA, 16 nt, Human
uaaacugacuuuaucc

SEQ ID NO: 2477625 - RNA, 15 nt, Human
uaaacugacuuuauc

SEQ ID NO: 2477626 - RNA, 14 nt, Human
uaaacugacuuuau

SEQ ID NO: 2477627 - RNA, 12 nt, Human
uaaacugccccc

SEQ ID NO: 2477628 - RNA, 16 nt, Human
uaaagaaagagagaaa

SEQ ID NO: 2477629 - RNA, 17 nt, Human
uaaagaaagagagaaaa

SEQ ID NO: 2477630 - RNA, 15 nt, Human
uaaagaaagagagaa

SEQ ID NO: 2477631 - RNA, 16 nt, Human
uaaacugcauuagaaa

SEQ ID NO: 2477632 - RNA, 14 nt, Human
uaaacucaaaauau

SEQ ID NO: 2477633 - RNA, 16 nt, Human
uaaacucaaaauauuu

SEQ ID NO: 2477634 - RNA, 19 nt, Human
uaaacucaaaauauuugua

SEQ ID NO: 2477635 - RNA, 21 nt, Human
uaaacucaaaauauuuguaca

SEQ ID NO: 2477636 - RNA, 20 nt, Human
uaaacucagggacagagcca

SEQ ID NO: 2477637 - RNA, 19 nt, Human
uaaacucagggacagagcc

SEQ ID NO: 2477638 - RNA, 11 nt, Human
uaaacucaggg

SEQ ID NO: 2477639 - RNA, 20 nt, Human
uaaacucaaaacuuaacaua

SEQ ID NO: 2477640 - RNA, 22 nt, Human
uaaacucaaaauauuuguacau

SEQ ID NO: 2477641 - RNA, 23 nt, Human
uaaacucaaaauauuuguacaua

SEQ ID NO: 2477642 - RNA, 22 nt, Human
uaaacucuaaacauuaaucaau

SEQ ID NO: 2477643 - RNA, 15 nt, Human
uaaacucuaaacauu

SEQ ID NO: 2477644 - RNA, 14 nt, Human
uaaacucuaaacau

SEQ ID NO: 2477645 - RNA, 15 nt, Human
uaaacuccuguccuu

SEQ ID NO: 2477646 - RNA, 14 nt, Human
uaaacuccuguccu

SEQ ID NO: 2477647 - RNA, 14 nt, Human
uaaacucauuuaua

SEQ ID NO: 2477648 - RNA, 19 nt, Human
uaaacuagcauaucugccu

SEQ ID NO: 2477649 - RNA, 17 nt, Human
uaaacuagcauaucugc

SEQ ID NO: 2477650 - RNA, 22 nt, Human
uaaacuagcauaucugccuuua

SEQ ID NO: 2477651 - RNA, 21 nt, Human
uaaacuagcauaucugccuuu

SEQ ID NO: 2477652 - RNA, 23 nt, Human
uaaacuagcauaucugccuuuau

SEQ ID NO: 2477653 - RNA, 14 nt, Human
uaaacuauauuuuc

SEQ ID NO: 2477654 - RNA, 13 nt, Human
uaaacuaucaguu

SEQ ID NO: 2477655 - RNA, 20 nt, Human
uaaacuaucuuggugaauuu

SEQ ID NO: 2477656 - RNA, 21 nt, Human
uaaacuaucuuggugaauuuu

SEQ ID NO: 2477657 - RNA, 14 nt, Human
uaaacuaucuuuuu

SEQ ID NO: 2477658 - RNA, 17 nt, Human
uaaacuaucaguuuguc

SEQ ID NO: 2477659 - RNA, 22 nt, Human
uaaacuaucuuggugaauuuuu

SEQ ID NO: 2477660 - RNA, 19 nt, Human
uaaacucaaaacuuaacau

SEQ ID NO: 2477661 - RNA, 15 nt, Human
uaaacucaaaacuua

SEQ ID NO: 2477662 - RNA, 15 nt, Human
uaaacuauuugucuu

SEQ ID NO: 2477663 - RNA, 18 nt, Human
uaaacgauuuaauucucu

SEQ ID NO: 2477664 - RNA, 22 nt, Human
uaaacgauuuaauucucuugaa

SEQ ID NO: 2477665 - RNA, 18 nt, Human
uaaaccucuaauuuauuu

SEQ ID NO: 2477666 - RNA, 15 nt, Human
uaaaccuuaaguaag

SEQ ID NO: 2477667 - RNA, 16 nt, Human
uaaaccuuaguacuga

SEQ ID NO: 2477668 - RNA, 18 nt, Human
uaaacggauuauuuuuuc

SEQ ID NO: 2477669 - RNA, 17 nt, Human
uaaacggauuauuuuuu

SEQ ID NO: 2477670 - RNA, 16 nt, Human
uaaacggauuauuuuu

SEQ ID NO: 2477671 - RNA, 15 nt, Human
uaaacggauuauuuu

SEQ ID NO: 2477672 - RNA, 14 nt, Human
uaaacggauuauuu

SEQ ID NO: 2477673 - RNA, 13 nt, Human
uaaacggauuauu

SEQ ID NO: 2477674 - RNA, 22 nt, Human
uaaacggauuauuuuuucagac

SEQ ID NO: 2477675 - RNA, 21 nt, Human
uaaacggauuauuuuuucaga

SEQ ID NO: 2477676 - RNA, 20 nt, Human
uaaacggauuauuuuuucag

SEQ ID NO: 2477677 - RNA, 19 nt, Human
uaaacggauuauuuuuuca

SEQ ID NO: 2477678 - RNA, 15 nt, Human
uaaacggauuccaaa

SEQ ID NO: 2477679 - RNA, 17 nt, Human
uaaacgugcagacuaug

SEQ ID NO: 2477680 - RNA, 22 nt, Human
uaaacgugaugaucagcuguuu

SEQ ID NO: 2477681 - RNA, 15 nt, Human
uaaacguaugcaugu

SEQ ID NO: 2477682 - RNA, 23 nt, Human
uaaacggauuauuuuuucagacc

SEQ ID NO: 2477683 - RNA, 20 nt, Human
uaaacguaugcaugugaaga

SEQ ID NO: 2477684 - RNA, 17 nt, Human
uaaacgugaugaucagc

SEQ ID NO: 2477685 - RNA, 19 nt, Human
uaaaccucaaaaugucuaa

SEQ ID NO: 2477686 - RNA, 18 nt, Human
uaaaccucaaaaugucua

SEQ ID NO: 2477687 - RNA, 13 nt, Human
uaaaccuaaaaaa

SEQ ID NO: 2477688 - RNA, 16 nt, Human
uaaaccuaaaaaagau

SEQ ID NO: 2477689 - RNA, 15 nt, Human
uaaaccuaaaaaaga

SEQ ID NO: 2477690 - RNA, 18 nt, Human
uaaaccuaaaaaagauau

SEQ ID NO: 2477691 - RNA, 16 nt, Human
uaaaccgccaaggcug

SEQ ID NO: 2477692 - RNA, 18 nt, Human
uaaaccgccaaggcuggg

SEQ ID NO: 2477693 - RNA, 19 nt, Human
uaaacccaguaguggugac

SEQ ID NO: 2477694 - RNA, 23 nt, Human
uaaacccauuuuagucacuuuuu

SEQ ID NO: 2477695 - RNA, 14 nt, Human
uaaacccauuuuag

SEQ ID NO: 2477696 - RNA, 21 nt, Human
uaaagaagcaauaaagaagag

SEQ ID NO: 2477697 - RNA, 13 nt, Human
uaaagaagcaaua

SEQ ID NO: 2477698 - RNA, 18 nt, Human
uaaagaagauguuuaacu

SEQ ID NO: 2477699 - RNA, 13 nt, Human
uaaagaagauguu

SEQ ID NO: 2477700 - RNA, 15 nt, Human
uaaagaacauaaaua

SEQ ID NO: 2477701 - RNA, 19 nt, Human
uaaagaacacccuauauuu

SEQ ID NO: 2477702 - RNA, 17 nt, Human
uaaagaaauugcaauaa

SEQ ID NO: 2477703 - RNA, 16 nt, Human
uaaagaaauugcaaua

SEQ ID NO: 2477704 - RNA, 11 nt, Human
uaaagacaaag

SEQ ID NO: 2477705 - RNA, 15 nt, Human
uaaagacaaagacaa

SEQ ID NO: 2477706 - RNA, 15 nt, Human
uaaagaauaauaugc

SEQ ID NO: 2477707 - RNA, 14 nt, Human
uaaagaagguuuca

SEQ ID NO: 2477708 - RNA, 16 nt, Human
uaaagacuuuuaugau

SEQ ID NO: 2477709 - RNA, 14 nt, Human
uaaagacuggcuuu

SEQ ID NO: 2477710 - RNA, 15 nt, Human
uaaagagaccuaccu

SEQ ID NO: 2477711 - RNA, 15 nt, Human
uaaagacuggcuuuu

SEQ ID NO: 2477712 - RNA, 20 nt, Human
uaaagacuggcuuuuauuaa

SEQ ID NO: 2477713 - RNA, 15 nt, Human
uaaagacaccuacug

SEQ ID NO: 2477714 - RNA, 19 nt, Human
uaaagacaaagacaaauuc

SEQ ID NO: 2477715 - RNA, 20 nt, Human
uaaagacaaagacaaauucu

SEQ ID NO: 2477716 - RNA, 22 nt, Human
uaaagacaaagacaaauucugu

SEQ ID NO: 2477717 - RNA, 9 nt, Human
uaaagacag

SEQ ID NO: 2477718 - RNA, 19 nt, Human
uaaagacaggguuucacca

SEQ ID NO: 2477719 - RNA, 21 nt, Human
uaaagacagggaagagcagaa

SEQ ID NO: 2477720 - RNA, 15 nt, Human
uaaagacagaggcag

SEQ ID NO: 2477721 - RNA, 10 nt, Human
uaaagacaga

SEQ ID NO: 2477722 - RNA, 15 nt, Human
uaaagauguuaaaaa

SEQ ID NO: 2477723 - RNA, 22 nt, Human
uaaagauuuaucaaaucaguca

SEQ ID NO: 2477724 - RNA, 15 nt, Human
uaaagauuuaucaaa

SEQ ID NO: 2477725 - RNA, 14 nt, Human
uaaagauuucuuga

SEQ ID NO: 2477726 - RNA, 19 nt, Human
uaaaggcuaccuuuguauu

SEQ ID NO: 2477727 - RNA, 20 nt, Human
uaaagcaacugucuauuucu

SEQ ID NO: 2477728 - RNA, 16 nt, Human
uaaagcaacugucuau

SEQ ID NO: 2477729 - RNA, 21 nt, Human
uaaaggcuaccuuuguauucu

SEQ ID NO: 2477730 - RNA, 15 nt, Human
uaaaggcuucucucu

SEQ ID NO: 2477731 - RNA, 14 nt, Human
uaaaggcuucucuc

SEQ ID NO: 2477732 - RNA, 22 nt, Human
uaaaggcucgauuuuguaucug

SEQ ID NO: 2477733 - RNA, 19 nt, Human
uaaaggcucgauuuuguau

SEQ ID NO: 2477734 - RNA, 18 nt, Human
uaaaggcucgauuuugua

SEQ ID NO: 2477735 - RNA, 17 nt, Human
uaaaggcucgauuuugu

SEQ ID NO: 2477736 - RNA, 21 nt, Human
uaaagcaacugucuauuucug

SEQ ID NO: 2477737 - RNA, 20 nt, Human
uaaaggcuauacuugucuug

SEQ ID NO: 2477738 - RNA, 18 nt, Human
uaaagauauuuuuaucuu

SEQ ID NO: 2477739 - RNA, 21 nt, Human
uaaagauauuuuuaucuuuau

SEQ ID NO: 2477740 - RNA, 22 nt, Human
uaaagauauuuuuaucuuuaua

SEQ ID NO: 2477741 - RNA, 23 nt, Human
uaaagauacagaacucuuucaaa

SEQ ID NO: 2477742 - RNA, 12 nt, Human
uaaagaguucuu

SEQ ID NO: 2477743 - RNA, 11 nt, Human
uaaagaugauc

SEQ ID NO: 2477744 - RNA, 21 nt, Human
uaaagaugaucuacucagaaa

SEQ ID NO: 2477745 - RNA, 13 nt, Human
uaaagaugaucua

SEQ ID NO: 2477746 - RNA, 21 nt, Human
uaaagaugcaaggaccaggac

SEQ ID NO: 2477747 - RNA, 22 nt, Human
uaaagaugcaaggaccaggacu

SEQ ID NO: 2477748 - RNA, 13 nt, Human
uaaagauggaaaa

SEQ ID NO: 2477749 - RNA, 22 nt, Human
uaaagagaccuaccucagguug

SEQ ID NO: 2477750 - RNA, 20 nt, Human
uaaagagaccuaccucaggu

SEQ ID NO: 2477751 - RNA, 19 nt, Human
uaaagagaccuaccucagg

SEQ ID NO: 2477752 - RNA, 13 nt, Human
uaaagagagguua

SEQ ID NO: 2477753 - RNA, 12 nt, Human
uaaagagagaau

SEQ ID NO: 2477754 - RNA, 17 nt, Human
uaaagagcccuugccuc

SEQ ID NO: 2477755 - RNA, 16 nt, Human
uaaagagcccuugccu

SEQ ID NO: 2477756 - RNA, 15 nt, Human
uaaagagcccuugcc

SEQ ID NO: 2477757 - RNA, 18 nt, Human
uaaagagauucacacaca

SEQ ID NO: 2477758 - RNA, 21 nt, Human
uaaagagcccuugccucccca

SEQ ID NO: 2477759 - RNA, 19 nt, Human
uaaagagcccuugccuccc

SEQ ID NO: 2477760 - RNA, 17 nt, Human
uaaagaggcugaaagag

SEQ ID NO: 2477761 - RNA, 20 nt, Human
uaaagaggcugaaagaggcc

SEQ ID NO: 2477762 - RNA, 18 nt, Human
uaaagaguuaguuugagu

SEQ ID NO: 2477763 - RNA, 18 nt, Human
aaguuacuagguaacuuc

SEQ ID NO: 2477764 - RNA, 19 nt, Human
aaguuacuagguaacuuca

SEQ ID NO: 2477765 - RNA, 20 nt, Human
aaguuacuagguaacuucau

SEQ ID NO: 2477766 - RNA, 21 nt, Human
aaguuacuagguaacuucaua

SEQ ID NO: 2477767 - RNA, 15 nt, Human
aaguuacugaaugca

SEQ ID NO: 2477768 - RNA, 14 nt, Human
aaguuacugaaugc

SEQ ID NO: 2477769 - RNA, 12 nt, Human
aaguuacugaau

SEQ ID NO: 2477770 - RNA, 22 nt, Human
aaguuacuucacuuuaauucuc

SEQ ID NO: 2477771 - RNA, 12 nt, Human
aaguuacuuugu

SEQ ID NO: 2477772 - RNA, 23 nt, Human
aaguuacuucacuuuaauucuca

SEQ ID NO: 2477773 - RNA, 15 nt, Human
aaguuacuuauucua

SEQ ID NO: 2477774 - RNA, 16 nt, Human
aaguuacuuauucuag

SEQ ID NO: 2477775 - RNA, 14 nt, Human
aaguuagaauuccu

SEQ ID NO: 2477776 - RNA, 14 nt, Human
aaguuauuaauauu

SEQ ID NO: 2477777 - RNA, 19 nt, Human
aaguuacuuugucagaggc

SEQ ID NO: 2477778 - RNA, 19 nt, Human
aaguuauuaauauuuuaau

SEQ ID NO: 2477779 - RNA, 12 nt, Human
aaguuaaauaaa

SEQ ID NO: 2477780 - RNA, 14 nt, Human
aaguuaaauaaauc

SEQ ID NO: 2477781 - RNA, 18 nt, Human
aaguuaaacauugaagua

SEQ ID NO: 2477782 - RNA, 17 nt, Human
aaguuaaagugaauaac

SEQ ID NO: 2477783 - RNA, 14 nt, Human
aaguuacacauuuu

SEQ ID NO: 2477784 - RNA, 17 nt, Human
aaguuacacauuuuuca

SEQ ID NO: 2477785 - RNA, 17 nt, Human
guuuuuuuuuaaagacu

SEQ ID NO: 2477786 - RNA, 20 nt, Human
guuuuuuuuuauacacugua

SEQ ID NO: 2477787 - RNA, 14 nt, Human
guuuuuuuucuucu

SEQ ID NO: 2477788 - RNA, 19 nt, Human
guuuuuuuuuccuguccuu

SEQ ID NO: 2477789 - RNA, 23 nt, Human
guuuuuuuuuauacacuguaaug

SEQ ID NO: 2477790 - RNA, 20 nt, Human
guuuuuuuuuccuguccuuc

SEQ ID NO: 2477791 - RNA, 15 nt, Human
aaguguuagauagaa

SEQ ID NO: 2477792 - RNA, 23 nt, Human
aaguguuuuguucuuucuggagu

SEQ ID NO: 2477793 - RNA, 23 nt, Human
aaguguuucuguuauuaacaaac

SEQ ID NO: 2477794 - RNA, 21 nt, Human
aaguguuucuguuauuaacaa

SEQ ID NO: 2477795 - RNA, 21 nt, Human
aaguguuuauuuuucauauug

SEQ ID NO: 2477796 - RNA, 14 nt, Human
aaguguuucuguua

SEQ ID NO: 2477797 - RNA, 17 nt, Human
aaguguuguaaauauuu

SEQ ID NO: 2477798 - RNA, 23 nt, Human
aaguguuggcuaaugaagggaaa

SEQ ID NO: 2477799 - RNA, 19 nt, Human
aaguguuuauuuuucauau

SEQ ID NO: 2477800 - RNA, 16 nt, Human
aaguguuuauuuuuca

SEQ ID NO: 2477801 - RNA, 15 nt, Human
aaguguuuauuuuuc

SEQ ID NO: 2477802 - RNA, 22 nt, Human
aaguguuguaaauauuuaugua

SEQ ID NO: 2477803 - RNA, 18 nt, Human
aaguguuguaaauauuua

SEQ ID NO: 2477804 - RNA, 20 nt, Human
aaguguuguaaauauuuaug

SEQ ID NO: 2477805 - RNA, 19 nt, Human
aaguuuacaguaaauaaau

SEQ ID NO: 2477806 - RNA, 18 nt, Human
aaguuuacaguaaauaaa

SEQ ID NO: 2477807 - RNA, 12 nt, Human
aaguuuacagua

SEQ ID NO: 2477808 - RNA, 23 nt, Human
aaguuuacaaguguauaucagaa

SEQ ID NO: 2477809 - RNA, 18 nt, Human
aaguuuacauuguaaaua

SEQ ID NO: 2477810 - RNA, 21 nt, Human
aaguuuacaaguguauaucag

SEQ ID NO: 2477811 - RNA, 18 nt, Human
aaguuuacaaguguauau

SEQ ID NO: 2477812 - RNA, 20 nt, Human
aaguuuaauggugccuucau

SEQ ID NO: 2477813 - RNA, 18 nt, Human
aaguuuacaaucaaagga

SEQ ID NO: 2477814 - RNA, 19 nt, Human
aaguuuacaaucaaaggaa

SEQ ID NO: 2477815 - RNA, 21 nt, Human
aaguuuacaguaaauaaauug

SEQ ID NO: 2477816 - RNA, 20 nt, Human
aaguuuacaguaaauaaauu

SEQ ID NO: 2477817 - RNA, 19 nt, Human
aaguuuacauuguaaauag

SEQ ID NO: 2477818 - RNA, 19 nt, Human
aaguuuacucaacccucuc

SEQ ID NO: 2477819 - RNA, 11 nt, Human
aaguuuagaga

SEQ ID NO: 2477820 - RNA, 22 nt, Human
aaguuuacaguaaauaaauugu

SEQ ID NO: 2477821 - RNA, 14 nt, Human
aaguuuaauugacu

SEQ ID NO: 2477822 - RNA, 17 nt, Human
aaguucugcagauaaac

SEQ ID NO: 2477823 - RNA, 15 nt, Human
aaguucugacuugac

SEQ ID NO: 2477824 - RNA, 15 nt, Human
aaguucugaguguuu

SEQ ID NO: 2477825 - RNA, 18 nt, Human
aaguucuagagaagaggc

SEQ ID NO: 2477826 - RNA, 17 nt, Human
aaguuauugcaguuuau

SEQ ID NO: 2477827 - RNA, 15 nt, Human
aaguuauugcaguuu

SEQ ID NO: 2477828 - RNA, 14 nt, Human
aaguuauugcaguu

SEQ ID NO: 2477829 - RNA, 14 nt, Human
aaguuauugacaaa

SEQ ID NO: 2477830 - RNA, 18 nt, Human
aaguuauugacaaacucu

SEQ ID NO: 2477831 - RNA, 21 nt, Human
aaguucuagagaagaggcugg

SEQ ID NO: 2477832 - RNA, 17 nt, Human
aaguucuagagaagagg

SEQ ID NO: 2477833 - RNA, 23 nt, Human
aaguucauauuccauauuuauuc

SEQ ID NO: 2477834 - RNA, 22 nt, Human
aaguucauauuccauauuuauu

SEQ ID NO: 2477835 - RNA, 21 nt, Human
aaguucauauuccauauuuau

SEQ ID NO: 2477836 - RNA, 15 nt, Human
aaguucauauuccau

SEQ ID NO: 2477837 - RNA, 14 nt, Human
aaguucauaggguc

SEQ ID NO: 2477838 - RNA, 21 nt, Human
uaaaauuuuuuuagaaagcau

SEQ ID NO: 2477839 - RNA, 20 nt, Human
uaaaauuuuuuuagaaagca

SEQ ID NO: 2477840 - RNA, 16 nt, Human
uaaaauuuuuuuucau

SEQ ID NO: 2477841 - RNA, 17 nt, Human
uaaaauuuuuuuucaug

SEQ ID NO: 2477842 - RNA, 19 nt, Human
uaaaauuuuuuuucauguu

SEQ ID NO: 2477843 - RNA, 20 nt, Human
uaaaauuuuuuuucauguuu

SEQ ID NO: 2477844 - RNA, 23 nt, Human
uaaacaaaauagaagcuguagua

SEQ ID NO: 2477845 - RNA, 18 nt, Human
uaaacaaaauagaagcug

SEQ ID NO: 2477846 - RNA, 23 nt, Human
uaaaauuuuuuuucauguuuuaa

SEQ ID NO: 2477847 - RNA, 19 nt, Human
uaaaauuuuuuuagaaagc

SEQ ID NO: 2477848 - RNA, 18 nt, Human
uaaaauuuuuuuagaaag

SEQ ID NO: 2477849 - RNA, 17 nt, Human
uaaaauuuuuuuagaaa

SEQ ID NO: 2477850 - RNA, 16 nt, Human
uaaaauuuuuuuagaa

SEQ ID NO: 2477851 - RNA, 19 nt, Human
uaaaauuuuuaaucuuuaa

SEQ ID NO: 2477852 - RNA, 18 nt, Human
uaaaccauaaaaagcuga

SEQ ID NO: 2477853 - RNA, 17 nt, Human
uaaaccauaaaaagcug

SEQ ID NO: 2477854 - RNA, 19 nt, Human
uaaaccauaaaaagcugac

SEQ ID NO: 2477855 - RNA, 21 nt, Human
uaaaccagguuuagacaguau

SEQ ID NO: 2477856 - RNA, 21 nt, Human
uaaaccacaaggcuguugcau

SEQ ID NO: 2477857 - RNA, 22 nt, Human
uaaaccaccagugcccaaaguc

SEQ ID NO: 2477858 - RNA, 14 nt, Human
uaaacaaaguuacu

SEQ ID NO: 2477859 - RNA, 15 nt, Human
uaaacaaaguuacua

SEQ ID NO: 2477860 - RNA, 17 nt, Human
uaaacaaaguuacuagg

SEQ ID NO: 2477861 - RNA, 19 nt, Human
uaaaccaaggcuagaacca

SEQ ID NO: 2477862 - RNA, 13 nt, Human
uaaacaaagguug

SEQ ID NO: 2477863 - RNA, 19 nt, Human
uaaaauuauagaugggaau

SEQ ID NO: 2477864 - RNA, 19 nt, Human
uaaaauuaaagcugaaaac

SEQ ID NO: 2477865 - RNA, 14 nt, Human
uaaaauuaaagcua

SEQ ID NO: 2477866 - RNA, 18 nt, Human
uaaaauuaaagcugaaaa

SEQ ID NO: 2477867 - RNA, 16 nt, Human
uaaaauuaaagcugaa

SEQ ID NO: 2477868 - RNA, 14 nt, Human
uaaaauuuguugca

SEQ ID NO: 2477869 - RNA, 14 nt, Human
uaaaauuauuccuu

SEQ ID NO: 2477870 - RNA, 15 nt, Human
uaaaauuuguugcau

SEQ ID NO: 2477871 - RNA, 17 nt, Human
uaaaauuuuuaaucuuu

SEQ ID NO: 2477872 - RNA, 17 nt, Human
uaaaauuuuaucucuua

SEQ ID NO: 2477873 - RNA, 16 nt, Human
aaguuuaugucuaaag

SEQ ID NO: 2477874 - RNA, 17 nt, Human
aaguuuaugucuaaaga

SEQ ID NO: 2477875 - RNA, 22 nt, Human
aaguuucaaugugauucuaaug

SEQ ID NO: 2477876 - RNA, 16 nt, Human
aaguuucaaugugauu

SEQ ID NO: 2477877 - RNA, 16 nt, Human
aaguuucaggugacau

SEQ ID NO: 2477878 - RNA, 15 nt, Human
aaguuucaggugaca

SEQ ID NO: 2477879 - RNA, 14 nt, Human
aaguuucaggugac

SEQ ID NO: 2477880 - RNA, 12 nt, Human
aaguuucaggug

SEQ ID NO: 2477881 - RNA, 21 nt, Human
aaguuucagagaccauugcaa

SEQ ID NO: 2477882 - RNA, 19 nt, Human
aaguuucaggauacaugug

SEQ ID NO: 2477883 - RNA, 20 nt, Human
aaguuucacugacuuagaac

SEQ ID NO: 2477884 - RNA, 12 nt, Human
aaguuugcaauu

SEQ ID NO: 2477885 - RNA, 16 nt, Human
aaguuugauuucauua

SEQ ID NO: 2477886 - RNA, 22 nt, Human
aaguuucaggugacaugugaaa

SEQ ID NO: 2477887 - RNA, 21 nt, Human
aaguuucaggugacaugugaa

SEQ ID NO: 2477888 - RNA, 19 nt, Human
aaguuucaggugacaugug

SEQ ID NO: 2477889 - RNA, 17 nt, Human
aaguuucaggugacaug

SEQ ID NO: 2477890 - RNA, 16 nt, Human
aaguuucaguugauuu

SEQ ID NO: 2477891 - RNA, 16 nt, Human
aaguuugcuuagaaaa

SEQ ID NO: 2477892 - RNA, 19 nt, Human
aaguuuggcaauaguuugc

SEQ ID NO: 2477893 - RNA, 15 nt, Human
aaguuugcuuagaaa

SEQ ID NO: 2477894 - RNA, 14 nt, Human
aaguuugcacugua

SEQ ID NO: 2477895 - RNA, 13 nt, Human
aaguuugcuuaga

SEQ ID NO: 2477896 - RNA, 21 nt, Human
aaguuugcacuguaugcugga

SEQ ID NO: 2477897 - RNA, 18 nt, Human
uaaaauguugaaaaguca

SEQ ID NO: 2477898 - RNA, 17 nt, Human
uaaaauguugaaaaguc

SEQ ID NO: 2477899 - RNA, 15 nt, Human
uaaaauguugaaaag

SEQ ID NO: 2477900 - RNA, 14 nt, Human
uaaaauguugaaaa

SEQ ID NO: 2477901 - RNA, 17 nt, Human
uaaaauguucacuuuug

SEQ ID NO: 2477902 - RNA, 22 nt, Human
uaaaauguucacuuuugacaaa

SEQ ID NO: 2477903 - RNA, 20 nt, Human
uaaaauguugaaaagucaaa

SEQ ID NO: 2477904 - RNA, 19 nt, Human
uaaaauguugaaaagucaa

SEQ ID NO: 2477905 - RNA, 14 nt, Human
uaaaauguugaaua

SEQ ID NO: 2477906 - RNA, 16 nt, Human
aaguuuugaaaagcua

SEQ ID NO: 2477907 - RNA, 15 nt, Human
aaguuuugaaaagcu

SEQ ID NO: 2477908 - RNA, 13 nt, Human
aaguuuugaaaag

SEQ ID NO: 2477909 - RNA, 12 nt, Human
aaguuuugaaaa

SEQ ID NO: 2477910 - RNA, 18 nt, Human
aaguuuugaaaagcuauu

SEQ ID NO: 2477911 - RNA, 14 nt, Human
uaaaauguuaaaac

SEQ ID NO: 2477912 - RNA, 15 nt, Human
aaguuuugcauuuau

SEQ ID NO: 2477913 - RNA, 14 nt, Human
aaguuuuaggacaa

SEQ ID NO: 2477914 - RNA, 21 nt, Human
aaguuuuaggacaaacagcuc

SEQ ID NO: 2477915 - RNA, 14 nt, Human
aaguuuguuuuuaa

SEQ ID NO: 2477916 - RNA, 23 nt, Human
aaguuuucagaaccucuucccca

SEQ ID NO: 2477917 - RNA, 15 nt, Human
aaguuuucaaugaug

SEQ ID NO: 2477918 - RNA, 11 nt, Human
aaguuuucagg

SEQ ID NO: 2477919 - RNA, 21 nt, Human
aaguuuucccuugaggaaaca

SEQ ID NO: 2477920 - RNA, 13 nt, Human
aaguuuuccugag

SEQ ID NO: 2477921 - RNA, 22 nt, Human
aaguuuucccuugaggaaacaa

SEQ ID NO: 2477922 - RNA, 19 nt, Human
guugagcagggauccuggu

SEQ ID NO: 2477923 - RNA, 18 nt, Human
guugagccagcagacauu

SEQ ID NO: 2477924 - RNA, 16 nt, Human
guugagccagcagaca

SEQ ID NO: 2477925 - RNA, 15 nt, Human
guugagccagcagac

SEQ ID NO: 2477926 - RNA, 22 nt, Human
guugagccagcagacauuguca

SEQ ID NO: 2477927 - RNA, 20 nt, Human
guugagccagcagacauugu

SEQ ID NO: 2477928 - RNA, 15 nt, Human
guugagccaggccug

SEQ ID NO: 2477929 - RNA, 23 nt, Human
guugagccaggccugggucugug

SEQ ID NO: 2477930 - RNA, 16 nt, Human
guugacaguucugaag

SEQ ID NO: 2477931 - RNA, 17 nt, Human
guugacaguucugaaga

SEQ ID NO: 2477932 - RNA, 18 nt, Human
guugacaguucauaugua

SEQ ID NO: 2477933 - RNA, 12 nt, Human
guugacagcagg

SEQ ID NO: 2477934 - RNA, 19 nt, Human
guugagccccaaguccuga

SEQ ID NO: 2477935 - RNA, 16 nt, Human
guugagccccaagucc

SEQ ID NO: 2477936 - RNA, 15 nt, Human
guugagccccaaguc

SEQ ID NO: 2477937 - RNA, 10 nt, Human
guugagcccc

SEQ ID NO: 2477938 - RNA, 14 nt, Human
guugagccuuuucc

SEQ ID NO: 2477939 - RNA, 15 nt, Human
guugagccccuggag

SEQ ID NO: 2477940 - RNA, 22 nt, Human
guugauagcacagacccugccc

SEQ ID NO: 2477941 - RNA, 20 nt, Human
guugagccccaaguccugaa

SEQ ID NO: 2477942 - RNA, 23 nt, Human
guugauagcacagacccugcccu

SEQ ID NO: 2477943 - RNA, 12 nt, Human
guugauaguuua

SEQ ID NO: 2477944 - RNA, 24 nt, Human
guugagcucucggaacugcaugcu

SEQ ID NO: 2477945 - RNA, 13 nt, Human
guugagcuguuuu

SEQ ID NO: 2477946 - RNA, 20 nt, Human
guugauauuucgaaagcugc

SEQ ID NO: 2477947 - RNA, 14 nt, Human
guugauauuucuau

SEQ ID NO: 2477948 - RNA, 20 nt, Human
guugaucacuggcaaugaaa

SEQ ID NO: 2477949 - RNA, 20 nt, Human
guugacaccucgccccugcu

SEQ ID NO: 2477950 - RNA, 15 nt, Human
guugacacaggucuu

SEQ ID NO: 2477951 - RNA, 19 nt, Human
guucuguuuacaucaguuu

SEQ ID NO: 2477952 - RNA, 16 nt, Human
guucuguuuacaucag

SEQ ID NO: 2477953 - RNA, 14 nt, Human
guucuguuuacauc

SEQ ID NO: 2477954 - RNA, 16 nt, Human
guucuguuuugccuga

SEQ ID NO: 2477955 - RNA, 23 nt, Human
guucugugucuuucacagcuccu

SEQ ID NO: 2477956 - RNA, 21 nt, Human
guucugugguuuuccccuccc

SEQ ID NO: 2477957 - RNA, 19 nt, Human
guucugugguuuuccccuc

SEQ ID NO: 2477958 - RNA, 22 nt, Human
guucugugucuuucacagcucc

SEQ ID NO: 2477959 - RNA, 13 nt, Human
guucugugucuuu

SEQ ID NO: 2477960 - RNA, 23 nt, Human
guucugugguuuuccccucccug

SEQ ID NO: 2477961 - RNA, 15 nt, Human
guucugugucugugu

SEQ ID NO: 2477962 - RNA, 18 nt, Human
guucucagcucccccugu

SEQ ID NO: 2477963 - RNA, 17 nt, Human
guucucagcucccccug

SEQ ID NO: 2477964 - RNA, 15 nt, Human
guucucagcuccccc

SEQ ID NO: 2477965 - RNA, 14 nt, Human
guucucagcucccc

SEQ ID NO: 2477966 - RNA, 19 nt, Human
guucucacuguucccucug

SEQ ID NO: 2477967 - RNA, 16 nt, Human
guucucacuguucccu

SEQ ID NO: 2477968 - RNA, 13 nt, Human
guucucagcuccc

SEQ ID NO: 2477969 - RNA, 17 nt, Human
guucucacacccaccgu

SEQ ID NO: 2477970 - RNA, 16 nt, Human
guucucacacccaccg

SEQ ID NO: 2477971 - RNA, 12 nt, Human
guucucacuguu

SEQ ID NO: 2477972 - RNA, 12 nt, Human
guucucacaccc

SEQ ID NO: 2477973 - RNA, 14 nt, Human
guucucagggcucc

SEQ ID NO: 2477974 - RNA, 13 nt, Human
guucucagggcuc

SEQ ID NO: 2477975 - RNA, 20 nt, Human
guucucagcucccccugucc

SEQ ID NO: 2477976 - RNA, 19 nt, Human
guucucagcucccccuguc

SEQ ID NO: 2477977 - RNA, 23 nt, Human
guucucagggcuccugccuucug

SEQ ID NO: 2477978 - RNA, 15 nt, Human
guucucagggcuccu

SEQ ID NO: 2477979 - RNA, 17 nt, Human
guucucagguguugcca

SEQ ID NO: 2477980 - RNA, 16 nt, Human
guucucaucuuucuug

SEQ ID NO: 2477981 - RNA, 11 nt, Human
guucucaucuu

SEQ ID NO: 2477982 - RNA, 15 nt, Human
guucuaguuugcauu

SEQ ID NO: 2477983 - RNA, 14 nt, Human
guucuaguuugcau

SEQ ID NO: 2477984 - RNA, 13 nt, Human
guuccccuuccac

SEQ ID NO: 2477985 - RNA, 14 nt, Human
guucuaguugcuug

SEQ ID NO: 2477986 - RNA, 18 nt, Human
guuccccuguucacucua

SEQ ID NO: 2477987 - RNA, 14 nt, Human
guucuaguuuucag

SEQ ID NO: 2477988 - RNA, 13 nt, Human
guucuaguuuuca

SEQ ID NO: 2477989 - RNA, 15 nt, Human
guucuauuuaaugga

SEQ ID NO: 2477990 - RNA, 18 nt, Human
guucuauuucagugccaa

SEQ ID NO: 2477991 - RNA, 15 nt, Human
guucuaguuuucagu

SEQ ID NO: 2477992 - RNA, 13 nt, Human
guucuauuuggaa

SEQ ID NO: 2477993 - RNA, 15 nt, Human
guucuauuuggaauu

SEQ ID NO: 2477994 - RNA, 14 nt, Human
guucuauuuggaau

SEQ ID NO: 2477995 - RNA, 18 nt, Human
guucuauuuggaauuuau

SEQ ID NO: 2477996 - RNA, 12 nt, Human
guucucugcccu

SEQ ID NO: 2477997 - RNA, 22 nt, Human
guucuguggaaaguguaaagca

SEQ ID NO: 2477998 - RNA, 21 nt, Human
guucuguggaaaguguaaagc

SEQ ID NO: 2477999 - RNA, 20 nt, Human
guucuguggaaaguguaaag

SEQ ID NO: 2478000 - RNA, 19 nt, Human
guucuguggaaaguguaaa

SEQ ID NO: 2478001 - RNA, 17 nt, Human
guucuguggaaagugua

SEQ ID NO: 2478002 - RNA, 16 nt, Human
guucuguggaaagugu

SEQ ID NO: 2478003 - RNA, 14 nt, Human
guucuguggaaagu

SEQ ID NO: 2478004 - RNA, 12 nt, Human
guucuguggaaa

SEQ ID NO: 2478005 - RNA, 11 nt, Human
guucuguggaa

SEQ ID NO: 2478006 - RNA, 11 nt, Human
guucugugcac

SEQ ID NO: 2478007 - RNA, 18 nt, Human
guucugucccuuggagcu

SEQ ID NO: 2478008 - RNA, 17 nt, Human
guucugucucauaugau

SEQ ID NO: 2478009 - RNA, 11 nt, Human
guucucugccc

SEQ ID NO: 2478010 - RNA, 16 nt, Human
guucucugaggacacu

SEQ ID NO: 2478011 - RNA, 19 nt, Human
guucuccguuagcuccugu

SEQ ID NO: 2478012 - RNA, 18 nt, Human
guucuccguuagcuccug

SEQ ID NO: 2478013 - RNA, 15 nt, Human
guguuuaguugcaga

SEQ ID NO: 2478014 - RNA, 22 nt, Human
guguuuaagacauuuuuggaag

SEQ ID NO: 2478015 - RNA, 16 nt, Human
guguuuaaauaaagua

SEQ ID NO: 2478016 - RNA, 16 nt, Human
guguuuaugugugugu

SEQ ID NO: 2478017 - RNA, 12 nt, Human
guguuuaugugu

SEQ ID NO: 2478018 - RNA, 11 nt, Human
aagcucccagg

SEQ ID NO: 2478019 - RNA, 16 nt, Human
aagcucccaggaacaa

SEQ ID NO: 2478020 - RNA, 14 nt, Human
aagcucccaggaac

SEQ ID NO: 2478021 - RNA, 13 nt, Human
aagcucccaggaa

SEQ ID NO: 2478022 - RNA, 21 nt, Human
aagcucccaagggauggugcc

SEQ ID NO: 2478023 - RNA, 19 nt, Human
aagcucccaagggauggug

SEQ ID NO: 2478024 - RNA, 17 nt, Human
aagcucccaagggaugg

SEQ ID NO: 2478025 - RNA, 13 nt, Human
guguuuauuguca

SEQ ID NO: 2478026 - RNA, 13 nt, Human
guguuuauuuaua

SEQ ID NO: 2478027 - RNA, 10 nt, Human
guguuuauuu

SEQ ID NO: 2478028 - RNA, 20 nt, Human
aagcuccaucuccacuccag

SEQ ID NO: 2478029 - RNA, 22 nt, Human
aagcucccaggcauuccccagg

SEQ ID NO: 2478030 - RNA, 12 nt, Human
aagcucccaggc

SEQ ID NO: 2478031 - RNA, 14 nt, Human
aagcucccaggccg

SEQ ID NO: 2478032 - RNA, 16 nt, Human
aagcuccuagcagaga

SEQ ID NO: 2478033 - RNA, 23 nt, Human
aagcucccaggcauuccccagga

SEQ ID NO: 2478034 - RNA, 16 nt, Human
aagcucuagugggaag

SEQ ID NO: 2478035 - RNA, 21 nt, Human
aagcuccuccucccugcaucu

SEQ ID NO: 2478036 - RNA, 18 nt, Human
aagcuccuagcagagaga

SEQ ID NO: 2478037 - RNA, 13 nt, Human
aagcuccuccucc

SEQ ID NO: 2478038 - RNA, 15 nt, Human
aagcuccuccucccu

SEQ ID NO: 2478039 - RNA, 16 nt, Human
aagcuccuccucccug

SEQ ID NO: 2478040 - RNA, 17 nt, Human
aagcuccuccucccugc

SEQ ID NO: 2478041 - RNA, 18 nt, Human
aagcuccuccucccugca

SEQ ID NO: 2478042 - RNA, 19 nt, Human
aagcuccuccucccugcau

SEQ ID NO: 2478043 - RNA, 22 nt, Human
aagcucucugcaucuacuccca

SEQ ID NO: 2478044 - RNA, 15 nt, Human
aagcucucugcaucu

SEQ ID NO: 2478045 - RNA, 15 nt, Human
aagcucuauuaagau

SEQ ID NO: 2478046 - RNA, 12 nt, Human
aagcucugaagu

SEQ ID NO: 2478047 - RNA, 16 nt, Human
aagcucugaagucaca

SEQ ID NO: 2478048 - RNA, 22 nt, Human
aagcucugaagucacaucacag

SEQ ID NO: 2478049 - RNA, 16 nt, Human
aaggaaaaaauaacaa

SEQ ID NO: 2478050 - RNA, 19 nt, Human
aaggaaaaaauaacaauga

SEQ ID NO: 2478051 - RNA, 22 nt, Human
guuccccuccuccacucucccc

SEQ ID NO: 2478052 - RNA, 13 nt, Human
guuccccucacug

SEQ ID NO: 2478053 - RNA, 21 nt, Human
guuccccuaguaagugccuuc

SEQ ID NO: 2478054 - RNA, 17 nt, Human
guuccccuguucacucu

SEQ ID NO: 2478055 - RNA, 15 nt, Human
guuccccuguucacu

SEQ ID NO: 2478056 - RNA, 16 nt, Human
aagcuuuuaugugaaa

SEQ ID NO: 2478057 - RNA, 13 nt, Human
aagcuuuuagaaa

SEQ ID NO: 2478058 - RNA, 14 nt, Human
aagcuuuuagaaau

SEQ ID NO: 2478059 - RNA, 18 nt, Human
aagcuuuuagaaauacug

SEQ ID NO: 2478060 - RNA, 23 nt, Human
guuccccuaguaagugccuucca

SEQ ID NO: 2478061 - RNA, 19 nt, Human
aaggaaaaaagagaaguau

SEQ ID NO: 2478062 - RNA, 22 nt, Human
aagcuguugaugguagguggca

SEQ ID NO: 2478063 - RNA, 13 nt, Human
aagcuguuguaca

SEQ ID NO: 2478064 - RNA, 12 nt, Human
aagcuguuguac

SEQ ID NO: 2478065 - RNA, 19 nt, Human
aagcuguuggccucugcaa

SEQ ID NO: 2478066 - RNA, 13 nt, Human
aagcucugcuccu

SEQ ID NO: 2478067 - RNA, 18 nt, Human
aagcuguuacugucuuca

SEQ ID NO: 2478068 - RNA, 22 nt, Human
aagcuuuccugccccaggccug

SEQ ID NO: 2478069 - RNA, 21 nt, Human
aagcuuuccugccccaggccu

SEQ ID NO: 2478070 - RNA, 18 nt, Human
aagcuuuccugccccagg

SEQ ID NO: 2478071 - RNA, 21 nt, Human
aagcuguuguacauuuaugau

SEQ ID NO: 2478072 - RNA, 16 nt, Human
aagcuuuccugcccca

SEQ ID NO: 2478073 - RNA, 20 nt, Human
aagcuguuguacauuuauga

SEQ ID NO: 2478074 - RNA, 18 nt, Human
aagcuguuguacauuuau

SEQ ID NO: 2478075 - RNA, 17 nt, Human
aagcuguuguacauuua

SEQ ID NO: 2478076 - RNA, 14 nt, Human
aagcuguuguacau

SEQ ID NO: 2478077 - RNA, 23 nt, Human
aagcuguuuccauagggugacac

SEQ ID NO: 2478078 - RNA, 15 nt, Human
aagcuguuuccauag

SEQ ID NO: 2478079 - RNA, 15 nt, Human
aagcuuucugucucc

SEQ ID NO: 2478080 - RNA, 17 nt, Human
aagcuuugccagcugcu

SEQ ID NO: 2478081 - RNA, 23 nt, Human
aagcuuugcuuaugguaauaaaa

SEQ ID NO: 2478082 - RNA, 23 nt, Human
aaggauaaaguugguaaaccuuu

SEQ ID NO: 2478083 - RNA, 13 nt, Human
aaggauaaugaau

SEQ ID NO: 2478084 - RNA, 21 nt, Human
aaggauaaaguugguaaaccu

SEQ ID NO: 2478085 - RNA, 23 nt, Human
aaggaggauuccauuuggcagag

SEQ ID NO: 2478086 - RNA, 17 nt, Human
aaggagccccauuccug

SEQ ID NO: 2478087 - RNA, 19 nt, Human
aaggagccccauuccuggg

SEQ ID NO: 2478088 - RNA, 20 nt, Human
aaggaggaagagaaaaaaua

SEQ ID NO: 2478089 - RNA, 20 nt, Human
aaggagcccuuaucugugcu

SEQ ID NO: 2478090 - RNA, 12 nt, Human
aaggauccugag

SEQ ID NO: 2478091 - RNA, 11 nt, Human
aaggauccuga

SEQ ID NO: 2478092 - RNA, 20 nt, Human
aaggauagaugcuggcccag

SEQ ID NO: 2478093 - RNA, 11 nt, Human
aaggauaaagu

SEQ ID NO: 2478094 - RNA, 22 nt, Human
aaggaucagaacagcagagguu

SEQ ID NO: 2478095 - RNA, 22 nt, Human
aaggauauuuacuacuuuugca

SEQ ID NO: 2478096 - RNA, 22 nt, Human
aaggauccugagccagauuuca

SEQ ID NO: 2478097 - RNA, 20 nt, Human
aaggauccugagccagauuu

SEQ ID NO: 2478098 - RNA, 16 nt, Human
aaggaucucucaggag

SEQ ID NO: 2478099 - RNA, 19 nt, Human
aaggauagaugcuggccca

SEQ ID NO: 2478100 - RNA, 21 nt, Human
aaggaucucucaggagcacag

SEQ ID NO: 2478101 - RNA, 20 nt, Human
aaggaucucucaggagcaca

SEQ ID NO: 2478102 - RNA, 22 nt, Human
aaggaucucucaggagcacagg

SEQ ID NO: 2478103 - RNA, 15 nt, Human
aaggaucuguuuuua

SEQ ID NO: 2478104 - RNA, 16 nt, Human
aaggaucuuuguggcc

SEQ ID NO: 2478105 - RNA, 21 nt, Human
aaggaucuguuuuuaaaaauc

SEQ ID NO: 2478106 - RNA, 23 nt, Human
aaggaucuguuuuuaaaaaucau

SEQ ID NO: 2478107 - RNA, 12 nt, Human
aaggaaaaugau

SEQ ID NO: 2478108 - RNA, 14 nt, Human
aaggaaaaugauac

SEQ ID NO: 2478109 - RNA, 15 nt, Human
guugaucuggaaccc

SEQ ID NO: 2478110 - RNA, 14 nt, Human
guugaucagaucug

SEQ ID NO: 2478111 - RNA, 16 nt, Human
guugaucuggaaccca

SEQ ID NO: 2478112 - RNA, 17 nt, Human
guugaucuggaacccag

SEQ ID NO: 2478113 - RNA, 18 nt, Human
aaggaaaccacagcugcu

SEQ ID NO: 2478114 - RNA, 17 nt, Human
aaggaaaccacagcugc

SEQ ID NO: 2478115 - RNA, 16 nt, Human
aaggaaaccacagcug

SEQ ID NO: 2478116 - RNA, 14 nt, Human
aaggaaaaugaucu

SEQ ID NO: 2478117 - RNA, 13 nt, Human
aaggaaaaugauc

SEQ ID NO: 2478118 - RNA, 19 nt, Human
guugaucuggaacccagac

SEQ ID NO: 2478119 - RNA, 15 nt, Human
aaggaaacccagcuc

SEQ ID NO: 2478120 - RNA, 17 nt, Human
aaggaagguggauggcc

SEQ ID NO: 2478121 - RNA, 12 nt, Human
aaggaaggugga

SEQ ID NO: 2478122 - RNA, 22 nt, Human
aaggaagggcauccuucugccu

SEQ ID NO: 2478123 - RNA, 21 nt, Human
aaggaaggcucuucuccccag

SEQ ID NO: 2478124 - RNA, 20 nt, Human
aaggaaggagacucaccucu

SEQ ID NO: 2478125 - RNA, 22 nt, Human
aaggaaggagacucaccucugc

SEQ ID NO: 2478126 - RNA, 16 nt, Human
aaggaaacccagcucu

SEQ ID NO: 2478127 - RNA, 18 nt, Human
aaggaagcuccacuguca

SEQ ID NO: 2478128 - RNA, 11 nt, Human
aaggaaggaaa

SEQ ID NO: 2478129 - RNA, 15 nt, Human
aaggaaaccagugca

SEQ ID NO: 2478130 - RNA, 20 nt, Human
aaggaaaccacagcugcugg

SEQ ID NO: 2478131 - RNA, 12 nt, Human
aaggaaggaaag

SEQ ID NO: 2478132 - RNA, 13 nt, Human
aaggaaggaaaga

SEQ ID NO: 2478133 - RNA, 16 nt, Human
aaggaaggaaagaaag

SEQ ID NO: 2478134 - RNA, 22 nt, Human
aaggagcaagucagaauagaaa

SEQ ID NO: 2478135 - RNA, 17 nt, Human
aaggagauuuacaacug

SEQ ID NO: 2478136 - RNA, 18 nt, Human
aaggagauuuuccuuccu

SEQ ID NO: 2478137 - RNA, 14 nt, Human
aaggagagccugcu

SEQ ID NO: 2478138 - RNA, 18 nt, Human
aaggagauuuacaacugg

SEQ ID NO: 2478139 - RNA, 18 nt, Human
aaggagagaaggggagga

SEQ ID NO: 2478140 - RNA, 16 nt, Human
aaggagagaaaguggg

SEQ ID NO: 2478141 - RNA, 13 nt, Human
aaggagagccugc

SEQ ID NO: 2478142 - RNA, 18 nt, Human
aaggaagguggauggccc

SEQ ID NO: 2478143 - RNA, 16 nt, Human
aaggaagguucuggug

SEQ ID NO: 2478144 - RNA, 17 nt, Human
aaggaagguuuucucca

SEQ ID NO: 2478145 - RNA, 16 nt, Human
aaggaagguuuucucc

SEQ ID NO: 2478146 - RNA, 12 nt, Human
aaggagacacaa

SEQ ID NO: 2478147 - RNA, 14 nt, Human
aaggagagaaagug

SEQ ID NO: 2478148 - RNA, 12 nt, Human
aaggagagaaag

SEQ ID NO: 2478149 - RNA, 11 nt, Human
aaggagagaaa

SEQ ID NO: 2478150 - RNA, 17 nt, Human
aaggagacucaccucug

SEQ ID NO: 2478151 - RNA, 20 nt, Human
aaggagacucaccucugccu

SEQ ID NO: 2478152 - RNA, 22 nt, Human
aaggagacucaccucugccuca

SEQ ID NO: 2478153 - RNA, 23 nt, Human
aaggagacucaccucugccucaa

SEQ ID NO: 2478154 - RNA, 16 nt, Human
aaggagacucaccucu

SEQ ID NO: 2478155 - RNA, 23 nt, Human
guugcugaugaacucuuaaucaa

SEQ ID NO: 2478156 - RNA, 23 nt, Human
guuggcugggggccucagugcca

SEQ ID NO: 2478157 - RNA, 13 nt, Human
guugcugaauagg

SEQ ID NO: 2478158 - RNA, 22 nt, Human
guugcucagucucccuuucccu

SEQ ID NO: 2478159 - RNA, 18 nt, Human
guugcuccgccucugcug

SEQ ID NO: 2478160 - RNA, 20 nt, Human
guugcuccgccucugcuggc

SEQ ID NO: 2478161 - RNA, 22 nt, Human
guugcuccgccucugcuggcac

SEQ ID NO: 2478162 - RNA, 22 nt, Human
guugcuaagccccagcaagcaa

SEQ ID NO: 2478163 - RNA, 17 nt, Human
guugcuaagccccagca

SEQ ID NO: 2478164 - RNA, 18 nt, Human
guugcucaaaaaaugagc

SEQ ID NO: 2478165 - RNA, 20 nt, Human
guugcucaaaucuauucaga

SEQ ID NO: 2478166 - RNA, 22 nt, Human
guugcuaagaagcgagcacuga

SEQ ID NO: 2478167 - RNA, 16 nt, Human
guugcccaggcuggcg

SEQ ID NO: 2478168 - RNA, 18 nt, Human
aaggcguggagcugccug

SEQ ID NO: 2478169 - RNA, 16 nt, Human
aaggcguggagcugcc

SEQ ID NO: 2478170 - RNA, 19 nt, Human
aaggcguggagcugccuga

SEQ ID NO: 2478171 - RNA, 16 nt, Human
aaggcuaaaacuuaac

SEQ ID NO: 2478172 - RNA, 15 nt, Human
guugcccaggcuggc

SEQ ID NO: 2478173 - RNA, 21 nt, Human
guugggaaugaggcuugcuga

SEQ ID NO: 2478174 - RNA, 19 nt, Human
guugggaaugaggcuugcu

SEQ ID NO: 2478175 - RNA, 14 nt, Human
guugggaagacaug

SEQ ID NO: 2478176 - RNA, 17 nt, Human
guugggaaugaggcuug

SEQ ID NO: 2478177 - RNA, 14 nt, Human
guugggagaauguc

SEQ ID NO: 2478178 - RNA, 21 nt, Human
guugggagaaugucaguaugu

SEQ ID NO: 2478179 - RNA, 17 nt, Human
guugggcuggugucacc

SEQ ID NO: 2478180 - RNA, 18 nt, Human
guugguuccaagcccugg

SEQ ID NO: 2478181 - RNA, 23 nt, Human
guugggguggguauaaaagaugg

SEQ ID NO: 2478182 - RNA, 19 nt, Human
guugguuccaagcccugga

SEQ ID NO: 2478183 - RNA, 16 nt, Human
guuggggucuggcagc

SEQ ID NO: 2478184 - RNA, 21 nt, Human
guugggguggguauaaaagau

SEQ ID NO: 2478185 - RNA, 24 nt, Human
aaggaugcacagaguuguuacauu

SEQ ID NO: 2478186 - RNA, 18 nt, Human
aaggaucuuuguggccaa

SEQ ID NO: 2478187 - RNA, 20 nt, Human
aaggaucuuuguggccaagg

SEQ ID NO: 2478188 - RNA, 20 nt, Human
aaggaugccaagaaguuuaa

SEQ ID NO: 2478189 - RNA, 22 nt, Human
aaggaugcacagaguuguuaca

SEQ ID NO: 2478190 - RNA, 14 nt, Human
aaggaugcccaaag

SEQ ID NO: 2478191 - RNA, 19 nt, Human
aaggaugcccaaagaugca

SEQ ID NO: 2478192 - RNA, 22 nt, Human
aaggaugccaagaaguuuaagg

SEQ ID NO: 2478193 - RNA, 15 nt, Human
aaggccccagagacu

SEQ ID NO: 2478194 - RNA, 14 nt, Human
aaggccccagagac

SEQ ID NO: 2478195 - RNA, 16 nt, Human
aaggccccgcccaggc

SEQ ID NO: 2478196 - RNA, 14 nt, Human
aaggccccgcccag

SEQ ID NO: 2478197 - RNA, 19 nt, Human
aaggccccgcccaggcuua

SEQ ID NO: 2478198 - RNA, 14 nt, Human
aaggcccccuacgc

SEQ ID NO: 2478199 - RNA, 15 nt, Human
aaggcuaccuuugua

SEQ ID NO: 2478200 - RNA, 14 nt, Human
guugcccaggcugg

SEQ ID NO: 2478201 - RNA, 13 nt, Human
aaggcuaccuuug

SEQ ID NO: 2478202 - RNA, 14 nt, Human
aaggcguggagcug

SEQ ID NO: 2478203 - RNA, 13 nt, Human
aaggcggccccuc

SEQ ID NO: 2478204 - RNA, 18 nt, Human
aaggcgggagcaucucuu

SEQ ID NO: 2478205 - RNA, 23 nt, Human
aaggcgaucccaucuugauaaga

SEQ ID NO: 2478206 - RNA, 14 nt, Human
aaggccuuucugug

SEQ ID NO: 2478207 - RNA, 17 nt, Human
aaggccuuuaaaauuuu

SEQ ID NO: 2478208 - RNA, 16 nt, Human
aaggccuuuaaaauuu

SEQ ID NO: 2478209 - RNA, 15 nt, Human
aaggccuuuaaaauu

SEQ ID NO: 2478210 - RNA, 15 nt, Human
aaggccuucuccucc

SEQ ID NO: 2478211 - RNA, 12 nt, Human
aaggccuucucc

SEQ ID NO: 2478212 - RNA, 11 nt, Human
aaggccuuuaa

SEQ ID NO: 2478213 - RNA, 15 nt, Human
aaggccuuaauaugu

SEQ ID NO: 2478214 - RNA, 16 nt, Human
aaggccucuuccuugc

SEQ ID NO: 2478215 - RNA, 17 nt, Human
aaggccuggcccacagc

SEQ ID NO: 2478216 - RNA, 18 nt, Human
aaguauucuuauuuaaug

SEQ ID NO: 2478217 - RNA, 19 nt, Human
aaguauucuuauuuaauga

SEQ ID NO: 2478218 - RNA, 21 nt, Human
aaguauucuguacucuuagau

SEQ ID NO: 2478219 - RNA, 16 nt, Human
aagucaaccugccuga

SEQ ID NO: 2478220 - RNA, 22 nt, Human
aagucaaccaauguagaaagcu

SEQ ID NO: 2478221 - RNA, 16 nt, Human
aagucaaccaauguag

SEQ ID NO: 2478222 - RNA, 17 nt, Human
aagucaauguuuucagu

SEQ ID NO: 2478223 - RNA, 19 nt, Human
aagucaaggguaggguggg

SEQ ID NO: 2478224 - RNA, 24 nt, Human
aagucacacaguauuacuucugcu

SEQ ID NO: 2478225 - RNA, 21 nt, Human
aagucaagugaaaaaggagga

SEQ ID NO: 2478226 - RNA, 17 nt, Human
aagucacucccaagccc

SEQ ID NO: 2478227 - RNA, 18 nt, Human
aagucaccggagcuuuca

SEQ ID NO: 2478228 - RNA, 23 nt, Human
aagucacucccaagcccccuccu

SEQ ID NO: 2478229 - RNA, 14 nt, Human
aagucaccggagcu

SEQ ID NO: 2478230 - RNA, 12 nt, Human
aagucacugcac

SEQ ID NO: 2478231 - RNA, 20 nt, Human
aagucagugcccaacuguua

SEQ ID NO: 2478232 - RNA, 21 nt, Human
aagucagugcccaacuguuau

SEQ ID NO: 2478233 - RNA, 23 nt, Human
aagucaguccaggaugcuaacau

SEQ ID NO: 2478234 - RNA, 18 nt, Human
aagucagugggaacguga

SEQ ID NO: 2478235 - RNA, 18 nt, Human
aagucaauguuuucaguu

SEQ ID NO: 2478236 - RNA, 13 nt, Human
aagucacacagug

SEQ ID NO: 2478237 - RNA, 16 nt, Human
aagucacaucacagga

SEQ ID NO: 2478238 - RNA, 17 nt, Human
aagucacaucacaggac

SEQ ID NO: 2478239 - RNA, 19 nt, Human
aagucacaucacaggacac

SEQ ID NO: 2478240 - RNA, 15 nt, Human
aaguauuauuuucca

SEQ ID NO: 2478241 - RNA, 16 nt, Human
aaguauguuuuagcau

SEQ ID NO: 2478242 - RNA, 21 nt, Human
aaguauguuagugcaaauugu

SEQ ID NO: 2478243 - RNA, 23 nt, Human
aaguauguuagugcaaauuguca

SEQ ID NO: 2478244 - RNA, 23 nt, Human
aaguacuucuccacccugcucuc

SEQ ID NO: 2478245 - RNA, 22 nt, Human
aaguacuucuccacccugcucu

SEQ ID NO: 2478246 - RNA, 15 nt, Human
aaguacuggagaaaa

SEQ ID NO: 2478247 - RNA, 21 nt, Human
aaguacuucuccacccugcuc

SEQ ID NO: 2478248 - RNA, 17 nt, Human
aaguacugcuguaaaua

SEQ ID NO: 2478249 - RNA, 20 nt, Human
aaguacugcuguaaauaaau

SEQ ID NO: 2478250 - RNA, 23 nt, Human
aaguacugcuguaaauaaaugcu

SEQ ID NO: 2478251 - RNA, 16 nt, Human
aaguacuauguaucaa

SEQ ID NO: 2478252 - RNA, 16 nt, Human
guuuucugagaaagac

SEQ ID NO: 2478253 - RNA, 17 nt, Human
guuuucugagaaagacu

SEQ ID NO: 2478254 - RNA, 22 nt, Human
guuuucugagaaagacuauuca

SEQ ID NO: 2478255 - RNA, 15 nt, Human
aaguacuauguauca

SEQ ID NO: 2478256 - RNA, 18 nt, Human
aagucuuagauguauaua

SEQ ID NO: 2478257 - RNA, 19 nt, Human
aagucuuagauguauauau

SEQ ID NO: 2478258 - RNA, 15 nt, Human
aagugaaugcuggga

SEQ ID NO: 2478259 - RNA, 22 nt, Human
aagugaagguuuacaauuuaca

SEQ ID NO: 2478260 - RNA, 17 nt, Human
aagucaugcaaaggcug

SEQ ID NO: 2478261 - RNA, 17 nt, Human
aagucuuagauguauau

SEQ ID NO: 2478262 - RNA, 15 nt, Human
aagucaugaagccca

SEQ ID NO: 2478263 - RNA, 17 nt, Human
aagucaugaagcccaag

SEQ ID NO: 2478264 - RNA, 23 nt, Human
aagucaugaagcccaagugaaau

SEQ ID NO: 2478265 - RNA, 15 nt, Human
aagucauccaaucua

SEQ ID NO: 2478266 - RNA, 11 nt, Human
aagucaugagc

SEQ ID NO: 2478267 - RNA, 20 nt, Human
aagugacagggaagcuacag

SEQ ID NO: 2478268 - RNA, 19 nt, Human
aagugacagggaagcuaca

SEQ ID NO: 2478269 - RNA, 16 nt, Human
aagugacagggaagcu

SEQ ID NO: 2478270 - RNA, 15 nt, Human
aagugacagggaagc

SEQ ID NO: 2478271 - RNA, 23 nt, Human
aagugacagggaagcuacagguu

SEQ ID NO: 2478272 - RNA, 22 nt, Human
aagugacagggaagcuacaggu

SEQ ID NO: 2478273 - RNA, 16 nt, Human
aagugacaaggcccca

SEQ ID NO: 2478274 - RNA, 18 nt, Human
aagugacaaggccccaga

SEQ ID NO: 2478275 - RNA, 19 nt, Human
aagugacaaggccccagag

SEQ ID NO: 2478276 - RNA, 12 nt, Human
aagugacaggga

SEQ ID NO: 2478277 - RNA, 24 nt, Human
aagugacacagcagcuucaccaga

SEQ ID NO: 2478278 - RNA, 20 nt, Human
aagugacaaggccccagaga

SEQ ID NO: 2478279 - RNA, 21 nt, Human
aagugacaaggccccagagac

SEQ ID NO: 2478280 - RNA, 14 nt, Human
aagugaauuuuucu

SEQ ID NO: 2478281 - RNA, 17 nt, Human
aagugaauuuuucucua

SEQ ID NO: 2478282 - RNA, 19 nt, Human
aagugaauuuuucucuaac

SEQ ID NO: 2478283 - RNA, 18 nt, Human
aagugaaugcucaaguuu

SEQ ID NO: 2478284 - RNA, 19 nt, Human
aagucaugcaaaggcuggg

SEQ ID NO: 2478285 - RNA, 14 nt, Human
aagugaauuugaau

SEQ ID NO: 2478286 - RNA, 16 nt, Human
aagugaauuugaauga

SEQ ID NO: 2478287 - RNA, 17 nt, Human
aagugaauuugaaugaa

SEQ ID NO: 2478288 - RNA, 19 nt, Human
aagugaauuugaaugaaaa

SEQ ID NO: 2478289 - RNA, 20 nt, Human
aagugaauuugaaugaaaaa

SEQ ID NO: 2478290 - RNA, 23 nt, Human
aagugaauuugaaugaaaaauuu

SEQ ID NO: 2478291 - RNA, 19 nt, Human
aagugacuuuggcugcaug

SEQ ID NO: 2478292 - RNA, 19 nt, Human
aagugacuuagcagaugcu

SEQ ID NO: 2478293 - RNA, 19 nt, Human
aagugacuguucaagagca

SEQ ID NO: 2478294 - RNA, 15 nt, Human
aagugagaagauggu

SEQ ID NO: 2478295 - RNA, 19 nt, Human
guuuuucuacuuuuaaaga

SEQ ID NO: 2478296 - RNA, 21 nt, Human
aagugacuuagcagaugcugg

SEQ ID NO: 2478297 - RNA, 18 nt, Human
aagugagaauaggcagcc

SEQ ID NO: 2478298 - RNA, 18 nt, Human
guuuuucuaggccugggg

SEQ ID NO: 2478299 - RNA, 17 nt, Human
guuuuucugccagggag

SEQ ID NO: 2478300 - RNA, 14 nt, Human
guuuuucugccagg

SEQ ID NO: 2478301 - RNA, 16 nt, Human
guuuuucuggguggcc

SEQ ID NO: 2478302 - RNA, 18 nt, Human
guuuuugauagcuuuauu

SEQ ID NO: 2478303 - RNA, 17 nt, Human
guuuuucugcuuuugaa

SEQ ID NO: 2478304 - RNA, 15 nt, Human
guuuuugcacauguu

SEQ ID NO: 2478305 - RNA, 18 nt, Human
guuuuugguuuuuaaaac

SEQ ID NO: 2478306 - RNA, 17 nt, Human
guuuuuguuuggagagc

SEQ ID NO: 2478307 - RNA, 23 nt, Human
guuuuuguucuuaauugcacucu

SEQ ID NO: 2478308 - RNA, 15 nt, Human
guuuuuguucaaagc

SEQ ID NO: 2478309 - RNA, 14 nt, Human
guuuuuguaaauua

SEQ ID NO: 2478310 - RNA, 16 nt, Human
guuuuuguaaagugug

SEQ ID NO: 2478311 - RNA, 15 nt, Human
guuuuuguaaagugu

SEQ ID NO: 2478312 - RNA, 14 nt, Human
guuuuuguacugua

SEQ ID NO: 2478313 - RNA, 21 nt, Human
guuuuuguaaauuaaucuuuu

SEQ ID NO: 2478314 - RNA, 16 nt, Human
guuuuugucuuaaaaa

SEQ ID NO: 2478315 - RNA, 10 nt, Human
guuuuuuggu

SEQ ID NO: 2478316 - RNA, 9 nt, Human
guuuuuugg

SEQ ID NO: 2478317 - RNA, 12 nt, Human
guuuuuugaaaa

SEQ ID NO: 2478318 - RNA, 14 nt, Human
guuuuuuccugagc

SEQ ID NO: 2478319 - RNA, 21 nt, Human
guuuuuuccugagcuuggcca

SEQ ID NO: 2478320 - RNA, 16 nt, Human
guuuuuuagaucaaau

SEQ ID NO: 2478321 - RNA, 21 nt, Human
guuuuuuaaaauauuuaucug

SEQ ID NO: 2478322 - RNA, 15 nt, Human
guuuuuuaugcuaau

SEQ ID NO: 2478323 - RNA, 19 nt, Human
guuuuuuagaucaaauacu

SEQ ID NO: 2478324 - RNA, 23 nt, Human
guuuuuuuuuaaaaaagaaacau

SEQ ID NO: 2478325 - RNA, 15 nt, Human
guuuuuuuuuaaaga

SEQ ID NO: 2478326 - RNA, 18 nt, Human
guuuuuuuuaaauaaaag

SEQ ID NO: 2478327 - RNA, 13 nt, Human
guuuuuuuucuaa

SEQ ID NO: 2478328 - RNA, 17 nt, Human
guuuuuuuucuaaaacu

SEQ ID NO: 2478329 - RNA, 20 nt, Human
guuuuuuuuaaauaaaagca

SEQ ID NO: 2478330 - RNA, 19 nt, Human
guuuuuuucuucuguauuu

SEQ ID NO: 2478331 - RNA, 19 nt, Human
guuuuuuuguauaguaaag

SEQ ID NO: 2478332 - RNA, 23 nt, Human
guuugcacguuaugguguuucuc

SEQ ID NO: 2478333 - RNA, 20 nt, Human
guuucuggucucuaggcugg

SEQ ID NO: 2478334 - RNA, 19 nt, Human
guuugcacuguaugcugga

SEQ ID NO: 2478335 - RNA, 20 nt, Human
guuugcacuguaugcuggac

SEQ ID NO: 2478336 - RNA, 14 nt, Human
guuugcauagguga

SEQ ID NO: 2478337 - RNA, 16 nt, Human
guuugcagaugacaaa

SEQ ID NO: 2478338 - RNA, 22 nt, Human
guuugcagaaaagcaccugccg

SEQ ID NO: 2478339 - RNA, 19 nt, Human
guuugcagaaaagcaccug

SEQ ID NO: 2478340 - RNA, 22 nt, Human
guuugcacuguaugcuggacgg

SEQ ID NO: 2478341 - RNA, 21 nt, Human
guuugcagaaaagcaccugcc

SEQ ID NO: 2478342 - RNA, 20 nt, Human
guuugcagagcuugaacaca

SEQ ID NO: 2478343 - RNA, 13 nt, Human
guuugcuaaguga

SEQ ID NO: 2478344 - RNA, 18 nt, Human
guuugccuucuacuuuua

SEQ ID NO: 2478345 - RNA, 18 nt, Human
guuugcuaucuuaauuuu

SEQ ID NO: 2478346 - RNA, 16 nt, Human
guuugcuaucuuaauu

SEQ ID NO: 2478347 - RNA, 14 nt, Human
guuugccugagggc

SEQ ID NO: 2478348 - RNA, 17 nt, Human
guuugccucugccucug

SEQ ID NO: 2478349 - RNA, 14 nt, Human
guuucucagcuccc

SEQ ID NO: 2478350 - RNA, 15 nt, Human
guuucucagcuccca

SEQ ID NO: 2478351 - RNA, 21 nt, Human
guuucucagauccuuguuuca

SEQ ID NO: 2478352 - RNA, 15 nt, Human
guuucuagggaaaug

SEQ ID NO: 2478353 - RNA, 18 nt, Human
guuucuagggaaaugaaa

SEQ ID NO: 2478354 - RNA, 19 nt, Human
guuucucagauccuuguuu

SEQ ID NO: 2478355 - RNA, 19 nt, Human
guuucucagcucccauuuc

SEQ ID NO: 2478356 - RNA, 18 nt, Human
guuucuccaaacugaagc

SEQ ID NO: 2478357 - RNA, 14 nt, Human
guuucucccccugg

SEQ ID NO: 2478358 - RNA, 15 nt, Human
guuucucccccuggg

SEQ ID NO: 2478359 - RNA, 17 nt, Human
guuucucccccugggcu

SEQ ID NO: 2478360 - RNA, 22 nt, Human
guuucucccccugggcucugcc

SEQ ID NO: 2478361 - RNA, 23 nt, Human
guuucucccccugggcucugccc

SEQ ID NO: 2478362 - RNA, 21 nt, Human
guuucugguggucuguuggca

SEQ ID NO: 2478363 - RNA, 18 nt, Human
guuucugguggucuguug

SEQ ID NO: 2478364 - RNA, 14 nt, Human
guuucuggucucua

SEQ ID NO: 2478365 - RNA, 16 nt, Human
guuucugccucugagg

SEQ ID NO: 2478366 - RNA, 18 nt, Human
guuucugccgcagcccug

SEQ ID NO: 2478367 - RNA, 22 nt, Human
guuucugccgcagcccugcaga

SEQ ID NO: 2478368 - RNA, 22 nt, Human
guuucucccucucacugucuga

SEQ ID NO: 2478369 - RNA, 20 nt, Human
guuucucccucucacugucu

SEQ ID NO: 2478370 - RNA, 12 nt, Human
guuucucugcug

SEQ ID NO: 2478371 - RNA, 13 nt, Human
guuucucugcugu

SEQ ID NO: 2478372 - RNA, 19 nt, Human
guuuggcaauaguuugcau

SEQ ID NO: 2478373 - RNA, 17 nt, Human
guuuggcaauaguuugc

SEQ ID NO: 2478374 - RNA, 15 nt, Human
guuuggcaauaguuu

SEQ ID NO: 2478375 - RNA, 20 nt, Human
guuuggauucuuauguagca

SEQ ID NO: 2478376 - RNA, 17 nt, Human
guuugcuauuagagcau

SEQ ID NO: 2478377 - RNA, 20 nt, Human
guuugcuaucuuaauuuugg

SEQ ID NO: 2478378 - RNA, 17 nt, Human
guuugcucaccuggggu

SEQ ID NO: 2478379 - RNA, 15 nt, Human
guuuggccaucucug

SEQ ID NO: 2478380 - RNA, 16 nt, Human
guuuggcgggccaagg

SEQ ID NO: 2478381 - RNA, 18 nt, Human
guuuggcgggccaaggac

SEQ ID NO: 2478382 - RNA, 21 nt, Human
guuuggcgggccaaggacugc

SEQ ID NO: 2478383 - RNA, 16 nt, Human
guuuuaagaggcaggg

SEQ ID NO: 2478384 - RNA, 18 nt, Human
guuuuaaggaugcuugua

SEQ ID NO: 2478385 - RNA, 19 nt, Human
guuuggcugugucuaaacu

SEQ ID NO: 2478386 - RNA, 18 nt, Human
guuuggcugugucuaaac

SEQ ID NO: 2478387 - RNA, 17 nt, Human
guuuggcugugucuaaa

SEQ ID NO: 2478388 - RNA, 15 nt, Human
guuuggcugugucua

SEQ ID NO: 2478389 - RNA, 21 nt, Human
guuuggcugugucuaaacugc

SEQ ID NO: 2478390 - RNA, 20 nt, Human
guuuggcugugucuaaacug

SEQ ID NO: 2478391 - RNA, 14 nt, Human
guuuuaagaggcag

SEQ ID NO: 2478392 - RNA, 14 nt, Human
guuuuacugugaaa

SEQ ID NO: 2478393 - RNA, 15 nt, Human
guuuuacugcagcuu

SEQ ID NO: 2478394 - RNA, 13 nt, Human
guuuuacuuuuaa

SEQ ID NO: 2478395 - RNA, 18 nt, Human
guuuuacuuuuaaacugu

SEQ ID NO: 2478396 - RNA, 21 nt, Human
guuuuacuuuuaaacugugua

SEQ ID NO: 2478397 - RNA, 16 nt, Human
guuuuacugcagcuuu

SEQ ID NO: 2478398 - RNA, 18 nt, Human
guuuuacugcagcuuugu

SEQ ID NO: 2478399 - RNA, 22 nt, Human
guuuuauaauuuugugaagcaa

SEQ ID NO: 2478400 - RNA, 15 nt, Human
guuuuauaauuuugu

SEQ ID NO: 2478401 - RNA, 15 nt, Human
guuuucugagaaaga

SEQ ID NO: 2478402 - RNA, 18 nt, Human
guuuuauacuguacuuaa

SEQ ID NO: 2478403 - RNA, 21 nt, Human
guuuuauacugaaggaaaaac

SEQ ID NO: 2478404 - RNA, 15 nt, Human
guuuuauacugaagg

SEQ ID NO: 2478405 - RNA, 23 nt, Human
guuuuauacuguacuuaauaaau

SEQ ID NO: 2478406 - RNA, 19 nt, Human
guuguaacuaggcucagag

SEQ ID NO: 2478407 - RNA, 18 nt, Human
guuguaacuaggcucaga

SEQ ID NO: 2478408 - RNA, 13 nt, Human
guuguaacuaggc

SEQ ID NO: 2478409 - RNA, 19 nt, Human
aaggcugagaggagagaga

SEQ ID NO: 2478410 - RNA, 21 nt, Human
guuguaacuaggcucagagau

SEQ ID NO: 2478411 - RNA, 19 nt, Human
aaggcugaccaagagagaa

SEQ ID NO: 2478412 - RNA, 16 nt, Human
guuguaaacaggaagc

SEQ ID NO: 2478413 - RNA, 22 nt, Human
guuguaaaauauagcuguacaa

SEQ ID NO: 2478414 - RNA, 14 nt, Human
guuguaaaauauag

SEQ ID NO: 2478415 - RNA, 13 nt, Human
guuguaaaauaua

SEQ ID NO: 2478416 - RNA, 15 nt, Human
guuguaaauauauaa

SEQ ID NO: 2478417 - RNA, 14 nt, Human
guuguaaauauaua

SEQ ID NO: 2478418 - RNA, 18 nt, Human
guuguaaauauauaaaua

SEQ ID NO: 2478419 - RNA, 16 nt, Human
guuguaaauauauaaa

SEQ ID NO: 2478420 - RNA, 14 nt, Human
guuguaaauauuua

SEQ ID NO: 2478421 - RNA, 20 nt, Human
guuguaaauauuuauguaaa

SEQ ID NO: 2478422 - RNA, 13 nt, Human
aagggcccagaga

SEQ ID NO: 2478423 - RNA, 15 nt, Human
aagggcccagagagg

SEQ ID NO: 2478424 - RNA, 18 nt, Human
aaggcuggagugcagugg

SEQ ID NO: 2478425 - RNA, 15 nt, Human
aaggcugcuuagaau

SEQ ID NO: 2478426 - RNA, 19 nt, Human
aaggcugcgucuggagggg

SEQ ID NO: 2478427 - RNA, 16 nt, Human
aaggcugcgucuggag

SEQ ID NO: 2478428 - RNA, 14 nt, Human
aaggcugcgucugg

SEQ ID NO: 2478429 - RNA, 23 nt, Human
aaggcugaggaaaggccagcugg

SEQ ID NO: 2478430 - RNA, 16 nt, Human
aaggcugaugucaauu

SEQ ID NO: 2478431 - RNA, 23 nt, Human
aaggcugaugccaaguuguuuga

SEQ ID NO: 2478432 - RNA, 17 nt, Human
aaggcugaggaaaggcc

SEQ ID NO: 2478433 - RNA, 17 nt, Human
aaggcugaccaagagag

SEQ ID NO: 2478434 - RNA, 19 nt, Human
aaggcugaggaaaggccag

SEQ ID NO: 2478435 - RNA, 20 nt, Human
aaggcugaggaaaggccagc

SEQ ID NO: 2478436 - RNA, 16 nt, Human
aaggguaucuggugac

SEQ ID NO: 2478437 - RNA, 19 nt, Human
aaggguaucaggugcugcc

SEQ ID NO: 2478438 - RNA, 14 nt, Human
aaggggcaguggug

SEQ ID NO: 2478439 - RNA, 17 nt, Human
aaggggcaguggugguu

SEQ ID NO: 2478440 - RNA, 17 nt, Human
aaggguaucaggugcug

SEQ ID NO: 2478441 - RNA, 13 nt, Human
aaggggagcccac

SEQ ID NO: 2478442 - RNA, 16 nt, Human
aaggggagcccacugu

SEQ ID NO: 2478443 - RNA, 13 nt, Human
aaggggaggaggg

SEQ ID NO: 2478444 - RNA, 22 nt, Human
aaggggauguauccaugggggc

SEQ ID NO: 2478445 - RNA, 15 nt, Human
aaggggaggagggcg

SEQ ID NO: 2478446 - RNA, 14 nt, Human
aaggggaggcagcc

SEQ ID NO: 2478447 - RNA, 16 nt, Human
aaggggaggcagccgg

SEQ ID NO: 2478448 - RNA, 20 nt, Human
aagggcccuucacugccuuu

SEQ ID NO: 2478449 - RNA, 16 nt, Human
aagggcccagauucua

SEQ ID NO: 2478450 - RNA, 16 nt, Human
aaggcuggcugggcau

SEQ ID NO: 2478451 - RNA, 21 nt, Human
aaguaaagcuaaaaugauuuu

SEQ ID NO: 2478452 - RNA, 12 nt, Human
aaguaaagcuaa

SEQ ID NO: 2478453 - RNA, 15 nt, Human
guuucuaccucccag

SEQ ID NO: 2478454 - RNA, 23 nt, Human
guuucuagcuagaaauaugauuu

SEQ ID NO: 2478455 - RNA, 18 nt, Human
guuucuagcuagaaauau

SEQ ID NO: 2478456 - RNA, 16 nt, Human
guuucuaccucccaga

SEQ ID NO: 2478457 - RNA, 18 nt, Human
guuucuagcacuggccug

SEQ ID NO: 2478458 - RNA, 17 nt, Human
aaguaaaaccacagcag

SEQ ID NO: 2478459 - RNA, 18 nt, Human
aaguaaaaccacagcagu

SEQ ID NO: 2478460 - RNA, 16 nt, Human
aaggguuuuaauguag

SEQ ID NO: 2478461 - RNA, 12 nt, Human
aaguaaaacuug

SEQ ID NO: 2478462 - RNA, 20 nt, Human
aaggguuuguggcugggggc

SEQ ID NO: 2478463 - RNA, 22 nt, Human
aaguaaaaacaaagaaauuaug

SEQ ID NO: 2478464 - RNA, 16 nt, Human
aagggugcugcuuccc

SEQ ID NO: 2478465 - RNA, 19 nt, Human
aagggugcugcuucccucu

SEQ ID NO: 2478466 - RNA, 14 nt, Human
aaggguuaagaaaa

SEQ ID NO: 2478467 - RNA, 14 nt, Human
aaggguuauauuuu

SEQ ID NO: 2478468 - RNA, 23 nt, Human
aagggugcugcuucccucugccu

SEQ ID NO: 2478469 - RNA, 13 nt, Human
aagggugucugag

SEQ ID NO: 2478470 - RNA, 20 nt, Human
aagggugcugcuucccucug

SEQ ID NO: 2478471 - RNA, 21 nt, Human
aagggugaugggaaagcauug

SEQ ID NO: 2478472 - RNA, 18 nt, Human
aaggggcagucuggaggg

SEQ ID NO: 2478473 - RNA, 19 nt, Human
aaggggcagucuggagggg

SEQ ID NO: 2478474 - RNA, 20 nt, Human
aaggggcagucuggaggggc

SEQ ID NO: 2478475 - RNA, 15 nt, Human
aaguaaaaccacagc

SEQ ID NO: 2478476 - RNA, 16 nt, Human
aaguaaaaccacagca

SEQ ID NO: 2478477 - RNA, 14 nt, Human
aaguaaaaccacag

SEQ ID NO: 2478478 - RNA, 17 nt, Human
aaggguuuguggcuggg

SEQ ID NO: 2478479 - RNA, 17 nt, Human
aaggguucuggcugccc

SEQ ID NO: 2478480 - RNA, 16 nt, Human
aaggguucccucaaga

SEQ ID NO: 2478481 - RNA, 15 nt, Human
uacauaaugcgugca

SEQ ID NO: 2478482 - RNA, 20 nt, Human
uacauaaucuguacaaugaa

SEQ ID NO: 2478483 - RNA, 15 nt, Human
uacauaaucuguaca

SEQ ID NO: 2478484 - RNA, 12 nt, Human
uacauaaucugu

SEQ ID NO: 2478485 - RNA, 19 nt, Human
uacauaaguaauucaagaa

SEQ ID NO: 2478486 - RNA, 15 nt, Human
uacauaaguuuagga

SEQ ID NO: 2478487 - RNA, 17 nt, Human
uacauaaguaauucaag

SEQ ID NO: 2478488 - RNA, 16 nt, Human
uacauaaguaauucaa

SEQ ID NO: 2478489 - RNA, 11 nt, Human
uacagugguuu

SEQ ID NO: 2478490 - RNA, 14 nt, Human
uacagucugucaug

SEQ ID NO: 2478491 - RNA, 15 nt, Human
uacagucugucauga

SEQ ID NO: 2478492 - RNA, 18 nt, Human
uacagucuuccauuugca

SEQ ID NO: 2478493 - RNA, 19 nt, Human
uacagucuuccauuugcaa

SEQ ID NO: 2478494 - RNA, 20 nt, Human
uacagucuuccauuugcaag

SEQ ID NO: 2478495 - RNA, 22 nt, Human
uacagucuuccauuugcaaggg

SEQ ID NO: 2478496 - RNA, 12 nt, Human
uacagucuugua

SEQ ID NO: 2478497 - RNA, 12 nt, Human
uacagugagcca

SEQ ID NO: 2478498 - RNA, 23 nt, Human
uacagugaaaauguaagcuguuu

SEQ ID NO: 2478499 - RNA, 22 nt, Human
uacagugaaaauguaagcuguu

SEQ ID NO: 2478500 - RNA, 21 nt, Human
uacagugaaaauguaagcugu

SEQ ID NO: 2478501 - RNA, 14 nt, Human
uacagugagccaag

SEQ ID NO: 2478502 - RNA, 20 nt, Human
uacagugaaaauguaagcug

SEQ ID NO: 2478503 - RNA, 15 nt, Human
uacagugaaaaugua

SEQ ID NO: 2478504 - RNA, 17 nt, Human
uacagucuugcagcagg

SEQ ID NO: 2478505 - RNA, 13 nt, Human
uacagucuuguau

SEQ ID NO: 2478506 - RNA, 15 nt, Human
uacaguccucccauc

SEQ ID NO: 2478507 - RNA, 12 nt, Human
uacaguccuccc

SEQ ID NO: 2478508 - RNA, 22 nt, Human
uacagcaacaauuuaugaauug

SEQ ID NO: 2478509 - RNA, 19 nt, Human
uacagcaacaauuuaugaa

SEQ ID NO: 2478510 - RNA, 20 nt, Human
uacagcaacaauuuaugaau

SEQ ID NO: 2478511 - RNA, 18 nt, Human
uacaguaucucagggccu

SEQ ID NO: 2478512 - RNA, 18 nt, Human
uacaguccucccaucuca

SEQ ID NO: 2478513 - RNA, 17 nt, Human
uacaguccucccaucuc

SEQ ID NO: 2478514 - RNA, 16 nt, Human
uacagucugucaugaa

SEQ ID NO: 2478515 - RNA, 13 nt, Human
uacagucugucau

SEQ ID NO: 2478516 - RNA, 14 nt, Human
aauguauuuuuccu

SEQ ID NO: 2478517 - RNA, 13 nt, Human
aaugucacaggca

SEQ ID NO: 2478518 - RNA, 22 nt, Human
aaugugaaacuggauuaaacuu

SEQ ID NO: 2478519 - RNA, 14 nt, Human
aaugucacaggcag

SEQ ID NO: 2478520 - RNA, 18 nt, Human
aauguaucauagaaaugu

SEQ ID NO: 2478521 - RNA, 19 nt, Human
aauguaucauagaaaugua

SEQ ID NO: 2478522 - RNA, 16 nt, Human
aauguaucauagaaau

SEQ ID NO: 2478523 - RNA, 15 nt, Human
aauguaucaggaaau

SEQ ID NO: 2478524 - RNA, 18 nt, Human
aauguaucaggaaauaua

SEQ ID NO: 2478525 - RNA, 22 nt, Human
aauguaucauagaaauguaacu

SEQ ID NO: 2478526 - RNA, 16 nt, Human
aauguaucuuauucac

SEQ ID NO: 2478527 - RNA, 13 nt, Human
aauguaucuuauu

SEQ ID NO: 2478528 - RNA, 16 nt, Human
aauguaugcuucauac

SEQ ID NO: 2478529 - RNA, 15 nt, Human
aauguaugcuucaua

SEQ ID NO: 2478530 - RNA, 18 nt, Human
aauguaucuuauucacau

SEQ ID NO: 2478531 - RNA, 17 nt, Human
aauguaucuuauucaca

SEQ ID NO: 2478532 - RNA, 22 nt, Human
uacauacccuggccgcccccug

SEQ ID NO: 2478533 - RNA, 14 nt, Human
uacauacaccagca

SEQ ID NO: 2478534 - RNA, 15 nt, Human
uacauacaccagcau

SEQ ID NO: 2478535 - RNA, 16 nt, Human
uacauacaccagcauu

SEQ ID NO: 2478536 - RNA, 20 nt, Human
uacauacaccagcauuccuu

SEQ ID NO: 2478537 - RNA, 13 nt, Human
uacauacugcugu

SEQ ID NO: 2478538 - RNA, 23 nt, Human
uacauacuuucauccugacucug

SEQ ID NO: 2478539 - RNA, 12 nt, Human
uacauacugcug

SEQ ID NO: 2478540 - RNA, 12 nt, Human
aauguagagggg

SEQ ID NO: 2478541 - RNA, 12 nt, Human
aauguagauuuu

SEQ ID NO: 2478542 - RNA, 13 nt, Human
aauguagccaugg

SEQ ID NO: 2478543 - RNA, 14 nt, Human
aauguagcugguuu

SEQ ID NO: 2478544 - RNA, 17 nt, Human
aauguagcugguuuccu

SEQ ID NO: 2478545 - RNA, 19 nt, Human
aauguaggcuuaguuugug

SEQ ID NO: 2478546 - RNA, 16 nt, Human
aauguaggcuuaguuu

SEQ ID NO: 2478547 - RNA, 21 nt, Human
aauguaggccaaauuuguagu

SEQ ID NO: 2478548 - RNA, 21 nt, Human
aauguagcugguuuccucauu

SEQ ID NO: 2478549 - RNA, 22 nt, Human
aauguaggcuuaguuugugugu

SEQ ID NO: 2478550 - RNA, 20 nt, Human
aauguagguaugaauaaguu

SEQ ID NO: 2478551 - RNA, 13 nt, Human
aauguaagacaaa

SEQ ID NO: 2478552 - RNA, 13 nt, Human
aauguaagcucua

SEQ ID NO: 2478553 - RNA, 15 nt, Human
aauguaagcucuacu

SEQ ID NO: 2478554 - RNA, 18 nt, Human
aaugguuuucuugugugu

SEQ ID NO: 2478555 - RNA, 17 nt, Human
aaugguuuucuugugug

SEQ ID NO: 2478556 - RNA, 22 nt, Human
aaugguuuucuuguguguuuau

SEQ ID NO: 2478557 - RNA, 23 nt, Human
aaugguuugaauauaaacacuau

SEQ ID NO: 2478558 - RNA, 17 nt, Human
aaugguuugaauauaaa

SEQ ID NO: 2478559 - RNA, 12 nt, Human
uacaauauuuaa

SEQ ID NO: 2478560 - RNA, 14 nt, Human
uacaauauuuaaaa

SEQ ID NO: 2478561 - RNA, 16 nt, Human
uacaauauuuaaaauu

SEQ ID NO: 2478562 - RNA, 20 nt, Human
uacaaucaaaggaaaauagu

SEQ ID NO: 2478563 - RNA, 13 nt, Human
uacaauaacauaa

SEQ ID NO: 2478564 - RNA, 21 nt, Human
uacaauaaaacuuugcugcca

SEQ ID NO: 2478565 - RNA, 13 nt, Human
uacaauaaauaau

SEQ ID NO: 2478566 - RNA, 16 nt, Human
uacaauaauucuauga

SEQ ID NO: 2478567 - RNA, 15 nt, Human
uacaauaaauaaucu

SEQ ID NO: 2478568 - RNA, 16 nt, Human
uacaauaaauaaucug

SEQ ID NO: 2478569 - RNA, 23 nt, Human
uacaaucauugcugaaaauggua

SEQ ID NO: 2478570 - RNA, 17 nt, Human
uacaaucauugcugaaa

SEQ ID NO: 2478571 - RNA, 22 nt, Human
uacaaucauugcugaaaauggu

SEQ ID NO: 2478572 - RNA, 23 nt, Human
aaugguuguauuagauguucucu

SEQ ID NO: 2478573 - RNA, 21 nt, Human
aaugguuguauuagauguucu

SEQ ID NO: 2478574 - RNA, 19 nt, Human
aaugguuguauuagauguu

SEQ ID NO: 2478575 - RNA, 18 nt, Human
aaugguuguauuagaugu

SEQ ID NO: 2478576 - RNA, 16 nt, Human
aaugguuuaaaugguc

SEQ ID NO: 2478577 - RNA, 24 nt, Human
aaugguuguauuagauguucucua

SEQ ID NO: 2478578 - RNA, 22 nt, Human
aaugguuuaacuucugccugug

SEQ ID NO: 2478579 - RNA, 13 nt, Human
aaugguuucaaag

SEQ ID NO: 2478580 - RNA, 17 nt, Human
aaugguuuaacuucugc

SEQ ID NO: 2478581 - RNA, 14 nt, Human
aaugguuugaauau

SEQ ID NO: 2478582 - RNA, 22 nt, Human
uacagagaacuaacacuauuuu

SEQ ID NO: 2478583 - RNA, 19 nt, Human
uacagagaacuaacacuau

SEQ ID NO: 2478584 - RNA, 23 nt, Human
uacagagaacuaacacuauuuua

SEQ ID NO: 2478585 - RNA, 14 nt, Human
uacagacuucucca

SEQ ID NO: 2478586 - RNA, 15 nt, Human
uacagacuucuccag

SEQ ID NO: 2478587 - RNA, 16 nt, Human
uacagacguaugcuua

SEQ ID NO: 2478588 - RNA, 17 nt, Human
uacagacguaugcuuau

SEQ ID NO: 2478589 - RNA, 18 nt, Human
uacagacguaugcuuauu

SEQ ID NO: 2478590 - RNA, 18 nt, Human
uacagauuuugauagcaa

SEQ ID NO: 2478591 - RNA, 17 nt, Human
uacagauuuugauagca

SEQ ID NO: 2478592 - RNA, 16 nt, Human
uacagauuuugauagc

SEQ ID NO: 2478593 - RNA, 15 nt, Human
uacagauuuugauag

SEQ ID NO: 2478594 - RNA, 22 nt, Human
uacagcaaggagauuuacaacu

SEQ ID NO: 2478595 - RNA, 22 nt, Human
uacagauuuugauagcaaagcg

SEQ ID NO: 2478596 - RNA, 21 nt, Human
uacagauuuugauagcaaagc

SEQ ID NO: 2478597 - RNA, 23 nt, Human
uacagauuuugauagcaaagcga

SEQ ID NO: 2478598 - RNA, 21 nt, Human
aauguacagcaaggagauuua

SEQ ID NO: 2478599 - RNA, 23 nt, Human
aauguacagcaaggagauuuaca

SEQ ID NO: 2478600 - RNA, 15 nt, Human
aauguacauuaauua

SEQ ID NO: 2478601 - RNA, 22 nt, Human
uacaccuaacucaccuaacuca

SEQ ID NO: 2478602 - RNA, 14 nt, Human
aauguaagcuguuu

SEQ ID NO: 2478603 - RNA, 17 nt, Human
aauguacaucuggccuu

SEQ ID NO: 2478604 - RNA, 14 nt, Human
uacaccuaugucau

SEQ ID NO: 2478605 - RNA, 17 nt, Human
uacaccuaugucauuuc

SEQ ID NO: 2478606 - RNA, 21 nt, Human
uacaccuaugucauuucauuu

SEQ ID NO: 2478607 - RNA, 22 nt, Human
uacaccuggcugagguuccucu

SEQ ID NO: 2478608 - RNA, 15 nt, Human
uacaccuggcugagg

SEQ ID NO: 2478609 - RNA, 14 nt, Human
uacaccuggcugag

SEQ ID NO: 2478610 - RNA, 13 nt, Human
uacaccuggcuga

SEQ ID NO: 2478611 - RNA, 12 nt, Human
uacaccuggcug

SEQ ID NO: 2478612 - RNA, 13 nt, Human
uacacggaaaacg

SEQ ID NO: 2478613 - RNA, 13 nt, Human
uacacgggacuga

SEQ ID NO: 2478614 - RNA, 20 nt, Human
uacaccuuucuccuuuguac

SEQ ID NO: 2478615 - RNA, 19 nt, Human
uacaccuuucuccuuugua

SEQ ID NO: 2478616 - RNA, 23 nt, Human
uacaccuggcugagguuccucug

SEQ ID NO: 2478617 - RNA, 18 nt, Human
uacaccuuucuccuuugu

SEQ ID NO: 2478618 - RNA, 16 nt, Human
aauuaaggcauaagaa

SEQ ID NO: 2478619 - RNA, 13 nt, Human
aauuaaguacuau

SEQ ID NO: 2478620 - RNA, 16 nt, Human
aauuaaggauuuuaug

SEQ ID NO: 2478621 - RNA, 20 nt, Human
aauuaaggauuuuaugcuuu

SEQ ID NO: 2478622 - RNA, 22 nt, Human
aauuaaggauuuuaugcuuuaa

SEQ ID NO: 2478623 - RNA, 17 nt, Human
uacauguacugauuacu

SEQ ID NO: 2478624 - RNA, 13 nt, Human
uacauguaguagu

SEQ ID NO: 2478625 - RNA, 19 nt, Human
uacauguaaaacauuaucu

SEQ ID NO: 2478626 - RNA, 16 nt, Human
uacaugguugugaccu

SEQ ID NO: 2478627 - RNA, 22 nt, Human
uacauguauuauuucauuaugu

SEQ ID NO: 2478628 - RNA, 12 nt, Human
uacauguauuau

SEQ ID NO: 2478629 - RNA, 15 nt, Human
uacauguauugcaca

SEQ ID NO: 2478630 - RNA, 12 nt, Human
uacauuaauguu

SEQ ID NO: 2478631 - RNA, 20 nt, Human
uacauuagcaguuugcuuug

SEQ ID NO: 2478632 - RNA, 19 nt, Human
uacauuagcaguuugcuuu

SEQ ID NO: 2478633 - RNA, 23 nt, Human
uacauuaauguuaauucagcacu

SEQ ID NO: 2478634 - RNA, 20 nt, Human
uacauuaauguuaauucagc

SEQ ID NO: 2478635 - RNA, 15 nt, Human
uacauuaauguuaau

SEQ ID NO: 2478636 - RNA, 15 nt, Human
uacauuaauuaucua

SEQ ID NO: 2478637 - RNA, 22 nt, Human
uacauuaauuauuauugcuguu

SEQ ID NO: 2478638 - RNA, 23 nt, Human
uacauuaauuauuauugcuguug

SEQ ID NO: 2478639 - RNA, 23 nt, Human
uacauugugggauguucagcacu

SEQ ID NO: 2478640 - RNA, 14 nt, Human
uacauuguucaauu

SEQ ID NO: 2478641 - RNA, 18 nt, Human
uacauugucauuuauaua

SEQ ID NO: 2478642 - RNA, 17 nt, Human
uacauugucauuuauau

SEQ ID NO: 2478643 - RNA, 19 nt, Human
uacauugucucuaaauugu

SEQ ID NO: 2478644 - RNA, 16 nt, Human
uacauugugaaacuuc

SEQ ID NO: 2478645 - RNA, 15 nt, Human
uacauuguucaauua

SEQ ID NO: 2478646 - RNA, 13 nt, Human
uacauuguugagc

SEQ ID NO: 2478647 - RNA, 23 nt, Human
uacauuguugagcuauugcuguu

SEQ ID NO: 2478648 - RNA, 19 nt, Human
uacauuguuugucugucuu

SEQ ID NO: 2478649 - RNA, 18 nt, Human
aauguugagaaucccaaa

SEQ ID NO: 2478650 - RNA, 18 nt, Human
aauguugacaugggacau

SEQ ID NO: 2478651 - RNA, 14 nt, Human
aauguugaauuuug

SEQ ID NO: 2478652 - RNA, 13 nt, Human
aaugugaaagcac

SEQ ID NO: 2478653 - RNA, 19 nt, Human
aaugugaacagcggcugga

SEQ ID NO: 2478654 - RNA, 15 nt, Human
aaugugaacuuuauu

SEQ ID NO: 2478655 - RNA, 16 nt, Human
aaugugaauaaaauua

SEQ ID NO: 2478656 - RNA, 17 nt, Human
aaugugaaguguuaaua

SEQ ID NO: 2478657 - RNA, 14 nt, Human
aaugugaaguguua

SEQ ID NO: 2478658 - RNA, 20 nt, Human
aaugugaacuuuauuaaaua

SEQ ID NO: 2478659 - RNA, 17 nt, Human
aaugugaccagggguga

SEQ ID NO: 2478660 - RNA, 15 nt, Human
aaugugaccaggggu

SEQ ID NO: 2478661 - RNA, 17 nt, Human
aaugugaaugggaaaag

SEQ ID NO: 2478662 - RNA, 17 nt, Human
aaugugaauaaaauuau

SEQ ID NO: 2478663 - RNA, 23 nt, Human
aaugugaaucagacccuacccca

SEQ ID NO: 2478664 - RNA, 18 nt, Human
aauuaacuuuuauaaacu

SEQ ID NO: 2478665 - RNA, 20 nt, Human
aauuaacuuuuauaaacuuu

SEQ ID NO: 2478666 - RNA, 22 nt, Human
aauuaacuuuuauaaacuuuac

SEQ ID NO: 2478667 - RNA, 19 nt, Human
aauuaacaugaauauuuag

SEQ ID NO: 2478668 - RNA, 18 nt, Human
aauuaaauuuugugucuc

SEQ ID NO: 2478669 - RNA, 17 nt, Human
aauuaaauuuugugucu

SEQ ID NO: 2478670 - RNA, 12 nt, Human
aauuaacacugc

SEQ ID NO: 2478671 - RNA, 17 nt, Human
uaccccccaaccccuga

SEQ ID NO: 2478672 - RNA, 16 nt, Human
uacccccaggguugag

SEQ ID NO: 2478673 - RNA, 15 nt, Human
uaccccaucauucau

SEQ ID NO: 2478674 - RNA, 16 nt, Human
uacccccgcccaggcu

SEQ ID NO: 2478675 - RNA, 12 nt, Human
uacccccgccca

SEQ ID NO: 2478676 - RNA, 15 nt, Human
uaccccccucugucu

SEQ ID NO: 2478677 - RNA, 20 nt, Human
uacccccgcccaggcuggcc

SEQ ID NO: 2478678 - RNA, 17 nt, Human
uacccccgcccaggcug

SEQ ID NO: 2478679 - RNA, 17 nt, Human
uacccccuucugggcau

SEQ ID NO: 2478680 - RNA, 23 nt, Human
uaccccacccucagcaccccuuc

SEQ ID NO: 2478681 - RNA, 22 nt, Human
uaccccacccucagcaccccuu

SEQ ID NO: 2478682 - RNA, 15 nt, Human
uaccccacccucagc

SEQ ID NO: 2478683 - RNA, 14 nt, Human
uaccccacccucag

SEQ ID NO: 2478684 - RNA, 13 nt, Human
uaccccacccuca

SEQ ID NO: 2478685 - RNA, 12 nt, Human
uaccccacccuc

SEQ ID NO: 2478686 - RNA, 17 nt, Human
uaccccaauuccuugua

SEQ ID NO: 2478687 - RNA, 22 nt, Human
uaccccaccacgauguggcccu

SEQ ID NO: 2478688 - RNA, 17 nt, Human
uaccauccccuguagag

SEQ ID NO: 2478689 - RNA, 16 nt, Human
uaccauauacagcuca

SEQ ID NO: 2478690 - RNA, 15 nt, Human
uaccauaauguauuu

SEQ ID NO: 2478691 - RNA, 22 nt, Human
uaccaugagaagagggccugug

SEQ ID NO: 2478692 - RNA, 20 nt, Human
uaccaugagaagagggccug

SEQ ID NO: 2478693 - RNA, 20 nt, Human
uaccaugaacagaaaacauu

SEQ ID NO: 2478694 - RNA, 14 nt, Human
uaccaugaacagaa

SEQ ID NO: 2478695 - RNA, 16 nt, Human
uaccccaauuccuugu

SEQ ID NO: 2478696 - RNA, 18 nt, Human
uaccaucagggacaggau

SEQ ID NO: 2478697 - RNA, 20 nt, Human
uaccauaguaccauuuauac

SEQ ID NO: 2478698 - RNA, 15 nt, Human
uaccaugaaacaaag

SEQ ID NO: 2478699 - RNA, 17 nt, Human
uaccacuuuuguucuug

SEQ ID NO: 2478700 - RNA, 21 nt, Human
uaccagacgguucaccagccu

SEQ ID NO: 2478701 - RNA, 23 nt, Human
uaccagacuguguauucauugaa

SEQ ID NO: 2478702 - RNA, 23 nt, Human
uaccagacgguucaccagccucu

SEQ ID NO: 2478703 - RNA, 15 nt, Human
uaccagacuguguau

SEQ ID NO: 2478704 - RNA, 22 nt, Human
uaccagacgguucaccagccuc

SEQ ID NO: 2478705 - RNA, 23 nt, Human
uacauuguuugucugucuucaua

SEQ ID NO: 2478706 - RNA, 20 nt, Human
uacauuuauaguuguaacua

SEQ ID NO: 2478707 - RNA, 19 nt, Human
uacauuuauaauguuugcu

SEQ ID NO: 2478708 - RNA, 14 nt, Human
uacauuuaugauuu

SEQ ID NO: 2478709 - RNA, 12 nt, Human
uacauuuaugau

SEQ ID NO: 2478710 - RNA, 16 nt, Human
uacauuuaugauuuaa

SEQ ID NO: 2478711 - RNA, 13 nt, Human
uacauuuaauaca

SEQ ID NO: 2478712 - RNA, 15 nt, Human
uacauuuaauacagc

SEQ ID NO: 2478713 - RNA, 16 nt, Human
uacccugagcugaggc

SEQ ID NO: 2478714 - RNA, 17 nt, Human
uacccugagcugaggca

SEQ ID NO: 2478715 - RNA, 18 nt, Human
uacccugagcugaggcag

SEQ ID NO: 2478716 - RNA, 20 nt, Human
uacccugcgauuuugccugu

SEQ ID NO: 2478717 - RNA, 22 nt, Human
uacccucuucauggauggggga

SEQ ID NO: 2478718 - RNA, 20 nt, Human
uacccuggcacuauaaugua

SEQ ID NO: 2478719 - RNA, 22 nt, Human
uacccuggcacuauaauguaag

SEQ ID NO: 2478720 - RNA, 22 nt, Human
uacccucuggagggguguggcu

SEQ ID NO: 2478721 - RNA, 14 nt, Human
uacccucuggaggg

SEQ ID NO: 2478722 - RNA, 12 nt, Human
uacccucuggag

SEQ ID NO: 2478723 - RNA, 21 nt, Human
uacccucucagcuccaggugg

SEQ ID NO: 2478724 - RNA, 20 nt, Human
uacccucucagcuccaggug

SEQ ID NO: 2478725 - RNA, 17 nt, Human
uacccucucagcuccag

SEQ ID NO: 2478726 - RNA, 16 nt, Human
uacccucucagcucca

SEQ ID NO: 2478727 - RNA, 15 nt, Human
uacccucucagcucc

SEQ ID NO: 2478728 - RNA, 23 nt, Human
uacccucgggcccaccuggccac

SEQ ID NO: 2478729 - RNA, 22 nt, Human
uacccucgggcccaccuggcca

SEQ ID NO: 2478730 - RNA, 13 nt, Human
uacccucucagcu

SEQ ID NO: 2478731 - RNA, 21 nt, Human
uacccucgggcccaccuggcc

SEQ ID NO: 2478732 - RNA, 20 nt, Human
uacccucgggcccaccuggc

SEQ ID NO: 2478733 - RNA, 18 nt, Human
uacccucgggcccaccug

SEQ ID NO: 2478734 - RNA, 17 nt, Human
uacccucgggcccaccu

SEQ ID NO: 2478735 - RNA, 15 nt, Human
uacccuccuguaaau

SEQ ID NO: 2478736 - RNA, 12 nt, Human
uacccuccucca

SEQ ID NO: 2478737 - RNA, 15 nt, Human
uacccucgggcccac

SEQ ID NO: 2478738 - RNA, 23 nt, Human
uacccucccugcuguccccucuu

SEQ ID NO: 2478739 - RNA, 22 nt, Human
uacccucccugcuguccccucu

SEQ ID NO: 2478740 - RNA, 18 nt, Human
uacccucccugcuguccc

SEQ ID NO: 2478741 - RNA, 17 nt, Human
uacccucccugcugucc

SEQ ID NO: 2478742 - RNA, 15 nt, Human
uacccuccuggcucu

SEQ ID NO: 2478743 - RNA, 12 nt, Human
uacccuccuggc

SEQ ID NO: 2478744 - RNA, 15 nt, Human
uacccucccugcugu

SEQ ID NO: 2478745 - RNA, 14 nt, Human
uacccucccugcug

SEQ ID NO: 2478746 - RNA, 12 nt, Human
uacccucccugc

SEQ ID NO: 2478747 - RNA, 11 nt, Human
uacccucccug

SEQ ID NO: 2478748 - RNA, 11 nt, Human
uacccuccccc

SEQ ID NO: 2478749 - RNA, 15 nt, Human
uacccucccaccccc

SEQ ID NO: 2478750 - RNA, 16 nt, Human
uacccucauguucuua

SEQ ID NO: 2478751 - RNA, 15 nt, Human
uacccucauguucuu

SEQ ID NO: 2478752 - RNA, 13 nt, Human
uacccucccaccc

SEQ ID NO: 2478753 - RNA, 14 nt, Human
uacccucccacccc

SEQ ID NO: 2478754 - RNA, 15 nt, Human
uaccccucccagcug

SEQ ID NO: 2478755 - RNA, 14 nt, Human
uaccccucccagcu

SEQ ID NO: 2478756 - RNA, 13 nt, Human
uaccccucccagc

SEQ ID NO: 2478757 - RNA, 10 nt, Human
uaccccuccc

SEQ ID NO: 2478758 - RNA, 23 nt, Human
uacccccuucugggcaucuguuc

SEQ ID NO: 2478759 - RNA, 22 nt, Human
uacccccgcccaggcuggccag

SEQ ID NO: 2478760 - RNA, 17 nt, Human
uaccccgcagacaccuu

SEQ ID NO: 2478761 - RNA, 13 nt, Human
uaccccugaucug

SEQ ID NO: 2478762 - RNA, 19 nt, Human
uaccccucccagcugacag

SEQ ID NO: 2478763 - RNA, 16 nt, Human
uaccccucccagcuga

SEQ ID NO: 2478764 - RNA, 20 nt, Human
uacccgggaagggggcuggg

SEQ ID NO: 2478765 - RNA, 19 nt, Human
uaccccuuagccucccuga

SEQ ID NO: 2478766 - RNA, 18 nt, Human
uaccccuuucuggcucuc

SEQ ID NO: 2478767 - RNA, 14 nt, Human
uacccgcagaguuc

SEQ ID NO: 2478768 - RNA, 17 nt, Human
uacaaaaacacagcaag

SEQ ID NO: 2478769 - RNA, 18 nt, Human
uacaaaaacacagcaagg

SEQ ID NO: 2478770 - RNA, 22 nt, Human
uaauuuuuuuaaccaaagguga

SEQ ID NO: 2478771 - RNA, 21 nt, Human
uaauuuuuuuaaccaaaggug

SEQ ID NO: 2478772 - RNA, 20 nt, Human
uaauuuuuuuaaccaaaggu

SEQ ID NO: 2478773 - RNA, 17 nt, Human
uaauuuuuuuaaccaaa

SEQ ID NO: 2478774 - RNA, 17 nt, Human
uaauuuuuuauucaagu

SEQ ID NO: 2478775 - RNA, 18 nt, Human
uaauuuuuuuauuguuua

SEQ ID NO: 2478776 - RNA, 17 nt, Human
uaauuuuuuuauuguuu

SEQ ID NO: 2478777 - RNA, 16 nt, Human
uaauuuuuuuauuguu

SEQ ID NO: 2478778 - RNA, 15 nt, Human
uaauuuuuuuauugu

SEQ ID NO: 2478779 - RNA, 14 nt, Human
uaauuuuuuuaauu

SEQ ID NO: 2478780 - RNA, 14 nt, Human
uaauuuuuuuauug

SEQ ID NO: 2478781 - RNA, 16 nt, Human
uacaaaaacauggccu

SEQ ID NO: 2478782 - RNA, 20 nt, Human
uaauuuuuuuauuguuuaaa

SEQ ID NO: 2478783 - RNA, 16 nt, Human
uaauuuuuuucaauau

SEQ ID NO: 2478784 - RNA, 18 nt, Human
uacaagccagcuggagaa

SEQ ID NO: 2478785 - RNA, 21 nt, Human
uacaagcauucugucuugaag

SEQ ID NO: 2478786 - RNA, 21 nt, Human
uacaagccauucuaaggaaau

SEQ ID NO: 2478787 - RNA, 15 nt, Human
uacaagcccccccuu

SEQ ID NO: 2478788 - RNA, 14 nt, Human
uacaagcccccccu

SEQ ID NO: 2478789 - RNA, 20 nt, Human
uacaagcgugagccacugca

SEQ ID NO: 2478790 - RNA, 19 nt, Human
uacaagcgugagccacugc

SEQ ID NO: 2478791 - RNA, 18 nt, Human
uacaagcgugagccacug

SEQ ID NO: 2478792 - RNA, 16 nt, Human
uacaagcgugagccac

SEQ ID NO: 2478793 - RNA, 15 nt, Human
uacaaguguauauca

SEQ ID NO: 2478794 - RNA, 14 nt, Human
uacaaguguauauc

SEQ ID NO: 2478795 - RNA, 13 nt, Human
uacaaguuagaaa

SEQ ID NO: 2478796 - RNA, 15 nt, Human
uacaaguuagaaaac

SEQ ID NO: 2478797 - RNA, 21 nt, Human
uacaaguguauaucagaaaag

SEQ ID NO: 2478798 - RNA, 20 nt, Human
uacaauaaaaucuugaaaau

SEQ ID NO: 2478799 - RNA, 21 nt, Human
uacaagcgugagccacugcac

SEQ ID NO: 2478800 - RNA, 13 nt, Human
uacaaguguauau

SEQ ID NO: 2478801 - RNA, 16 nt, Human
uacaagccugcacaau

SEQ ID NO: 2478802 - RNA, 19 nt, Human
uacaagcccccccuuccac

SEQ ID NO: 2478803 - RNA, 18 nt, Human
uaauuuaccugaagucuu

SEQ ID NO: 2478804 - RNA, 17 nt, Human
uaauuuaccugaagucu

SEQ ID NO: 2478805 - RNA, 14 nt, Human
uaauuucuccuccc

SEQ ID NO: 2478806 - RNA, 13 nt, Human
uaauuucuccucc

SEQ ID NO: 2478807 - RNA, 17 nt, Human
uaauuuccuggugugaa

SEQ ID NO: 2478808 - RNA, 15 nt, Human
uaauucagcucuuga

SEQ ID NO: 2478809 - RNA, 13 nt, Human
uaauucauguugc

SEQ ID NO: 2478810 - RNA, 14 nt, Human
uaauuuaaugcaug

SEQ ID NO: 2478811 - RNA, 19 nt, Human
uaauucaucccaacugucu

SEQ ID NO: 2478812 - RNA, 14 nt, Human
uaauucauguuucu

SEQ ID NO: 2478813 - RNA, 22 nt, Human
uaauuuacaaaaauauaaaaua

SEQ ID NO: 2478814 - RNA, 21 nt, Human
uaauuuacaaaaauauaaaau

SEQ ID NO: 2478815 - RNA, 19 nt, Human
uaauuuacaaaaauauaaa

SEQ ID NO: 2478816 - RNA, 21 nt, Human
uaauuuaaugcauguuaggaa

SEQ ID NO: 2478817 - RNA, 16 nt, Human
uaauuugcauuaaauu

SEQ ID NO: 2478818 - RNA, 17 nt, Human
uaauuugcauuaaauuc

SEQ ID NO: 2478819 - RNA, 22 nt, Human
uaauuugauaucacagucuaau

SEQ ID NO: 2478820 - RNA, 19 nt, Human
uaauuugauaucacagucu

SEQ ID NO: 2478821 - RNA, 12 nt, Human
uaauuugcauua

SEQ ID NO: 2478822 - RNA, 14 nt, Human
uaauuugauguuua

SEQ ID NO: 2478823 - RNA, 20 nt, Human
uaauuugcauuaaauucaca

SEQ ID NO: 2478824 - RNA, 12 nt, Human
uaauuugaucuu

SEQ ID NO: 2478825 - RNA, 19 nt, Human
uaauuuuuuagagagcugu

SEQ ID NO: 2478826 - RNA, 13 nt, Human
uaauuuuuuacua

SEQ ID NO: 2478827 - RNA, 21 nt, Human
uaauuuuuguauuuuuaguag

SEQ ID NO: 2478828 - RNA, 22 nt, Human
uaauuuuuguguuuuuaauaaa

SEQ ID NO: 2478829 - RNA, 22 nt, Human
uaauuugaaaacauaaucugca

SEQ ID NO: 2478830 - RNA, 23 nt, Human
uaauuucuuugccuguucaguua

SEQ ID NO: 2478831 - RNA, 18 nt, Human
uaauuucuuugccuguuc

SEQ ID NO: 2478832 - RNA, 17 nt, Human
uaauuucuuugccuguu

SEQ ID NO: 2478833 - RNA, 19 nt, Human
uaauuucuuacuaaacauu

SEQ ID NO: 2478834 - RNA, 19 nt, Human
uaauuucuccucccuuccu

SEQ ID NO: 2478835 - RNA, 16 nt, Human
uaauuucuuugccugu

SEQ ID NO: 2478836 - RNA, 12 nt, Human
uaauuucuuugc

SEQ ID NO: 2478837 - RNA, 18 nt, Human
uaauuugaggacaaccau

SEQ ID NO: 2478838 - RNA, 22 nt, Human
uaauuugaggacaaccauucca

SEQ ID NO: 2478839 - RNA, 15 nt, Human
uaauuugagagaaau

SEQ ID NO: 2478840 - RNA, 12 nt, Human
uaauuugauauc

SEQ ID NO: 2478841 - RNA, 22 nt, Human
uaauuugauaguauugugcaua

SEQ ID NO: 2478842 - RNA, 16 nt, Human
aaugcacuuuguucug

SEQ ID NO: 2478843 - RNA, 13 nt, Human
aaugcacuuuguu

SEQ ID NO: 2478844 - RNA, 20 nt, Human
aaugcacaaacagaggccgc

SEQ ID NO: 2478845 - RNA, 19 nt, Human
aaugcacaaacagaggccg

SEQ ID NO: 2478846 - RNA, 20 nt, Human
aaugcacuuuguucuggcuc

SEQ ID NO: 2478847 - RNA, 19 nt, Human
aaugcacuuuguucuggcu

SEQ ID NO: 2478848 - RNA, 20 nt, Human
uaauuauacccccugcaaag

SEQ ID NO: 2478849 - RNA, 21 nt, Human
uaauuagugcuaagugugaac

SEQ ID NO: 2478850 - RNA, 23 nt, Human
uaauuaguuccucauuagcauuu

SEQ ID NO: 2478851 - RNA, 22 nt, Human
uaauucagcacugauuucacaa

SEQ ID NO: 2478852 - RNA, 21 nt, Human
uaauucagcacugauuucaca

SEQ ID NO: 2478853 - RNA, 19 nt, Human
uaauucagcacugauuuca

SEQ ID NO: 2478854 - RNA, 18 nt, Human
uaauucaccaaaguauuu

SEQ ID NO: 2478855 - RNA, 18 nt, Human
uaauucagcacugauuuc

SEQ ID NO: 2478856 - RNA, 17 nt, Human
uaauucaccaaaguauu

SEQ ID NO: 2478857 - RNA, 16 nt, Human
uaauucaccaaaguau

SEQ ID NO: 2478858 - RNA, 16 nt, Human
uaauuaucuaaaguau

SEQ ID NO: 2478859 - RNA, 21 nt, Human
uaauuaucgggaacaguguuu

SEQ ID NO: 2478860 - RNA, 23 nt, Human
uaauuaucgggaacaguguuucc

SEQ ID NO: 2478861 - RNA, 21 nt, Human
uaauuaugccuuuuuugauca

SEQ ID NO: 2478862 - RNA, 21 nt, Human
uaauuaugacaguuauacugu

SEQ ID NO: 2478863 - RNA, 13 nt, Human
uaauuaugacagu

SEQ ID NO: 2478864 - RNA, 20 nt, Human
uaauuagugcuaagugugaa

SEQ ID NO: 2478865 - RNA, 17 nt, Human
uaauuaucggaagcagu

SEQ ID NO: 2478866 - RNA, 18 nt, Human
uaauuaucggaagcagug

SEQ ID NO: 2478867 - RNA, 19 nt, Human
uaauuaucggaagcagugc

SEQ ID NO: 2478868 - RNA, 21 nt, Human
uaauuaucggaagcagugccu

SEQ ID NO: 2478869 - RNA, 18 nt, Human
uaauuaucgggaacagug

SEQ ID NO: 2478870 - RNA, 19 nt, Human
uaauuaucgggaacagugu

SEQ ID NO: 2478871 - RNA, 20 nt, Human
uaauuaucgggaacaguguu

SEQ ID NO: 2478872 - RNA, 16 nt, Human
aaugcaaaccaucauu

SEQ ID NO: 2478873 - RNA, 14 nt, Human
aaugcaaaccauca

SEQ ID NO: 2478874 - RNA, 14 nt, Human
aaugaccuuucaau

SEQ ID NO: 2478875 - RNA, 13 nt, Human
aaugaccuuucaa

SEQ ID NO: 2478876 - RNA, 21 nt, Human
aaugaaugucagugugacuga

SEQ ID NO: 2478877 - RNA, 20 nt, Human
aaugaaugucagugugacug

SEQ ID NO: 2478878 - RNA, 18 nt, Human
aaugaauccuacacaccu

SEQ ID NO: 2478879 - RNA, 19 nt, Human
aaugaccaguaauugugaa

SEQ ID NO: 2478880 - RNA, 18 nt, Human
aaugaccaguaauuguga

SEQ ID NO: 2478881 - RNA, 16 nt, Human
aaugacccaaagacca

SEQ ID NO: 2478882 - RNA, 21 nt, Human
aaugaccaguaauugugaaaa

SEQ ID NO: 2478883 - RNA, 16 nt, Human
aaugaccucaagaugu

SEQ ID NO: 2478884 - RNA, 23 nt, Human
aaugcaaaccaucauugaaaucu

SEQ ID NO: 2478885 - RNA, 22 nt, Human
aaugcaaaccaucauugaaauc

SEQ ID NO: 2478886 - RNA, 18 nt, Human
aaugcacaaacagaggcc

SEQ ID NO: 2478887 - RNA, 17 nt, Human
aaugcaagcuaguggcu

SEQ ID NO: 2478888 - RNA, 16 nt, Human
aaugcaauauuaaugc

SEQ ID NO: 2478889 - RNA, 21 nt, Human
aaugcaagauuuuccacaaga

SEQ ID NO: 2478890 - RNA, 14 nt, Human
aaugcaauauguau

SEQ ID NO: 2478891 - RNA, 14 nt, Human
aaugcaacaugugu

SEQ ID NO: 2478892 - RNA, 16 nt, Human
aaugcaaauccuaugu

SEQ ID NO: 2478893 - RNA, 18 nt, Human
aaugcaacaacauguaua

SEQ ID NO: 2478894 - RNA, 15 nt, Human
aaugcaacaacaugu

SEQ ID NO: 2478895 - RNA, 18 nt, Human
uaaucagugugucuaaau

SEQ ID NO: 2478896 - RNA, 17 nt, Human
uaaucagugugucuaaa

SEQ ID NO: 2478897 - RNA, 19 nt, Human
uaaucagguccucagagaa

SEQ ID NO: 2478898 - RNA, 22 nt, Human
uaaucagguccucagagaauuu

SEQ ID NO: 2478899 - RNA, 15 nt, Human
uaaucagugucucac

SEQ ID NO: 2478900 - RNA, 11 nt, Human
uaaucaguguc

SEQ ID NO: 2478901 - RNA, 15 nt, Human
uaaucaggcugaggu

SEQ ID NO: 2478902 - RNA, 21 nt, Human
uaauauuuaaacagcaguguu

SEQ ID NO: 2478903 - RNA, 19 nt, Human
uaaucagggaggucauuuu

SEQ ID NO: 2478904 - RNA, 14 nt, Human
uaaucagccucuua

SEQ ID NO: 2478905 - RNA, 15 nt, Human
uaaucagccucuuaa

SEQ ID NO: 2478906 - RNA, 13 nt, Human
uaauauuuaaaca

SEQ ID NO: 2478907 - RNA, 16 nt, Human
uaauauucauuguaua

SEQ ID NO: 2478908 - RNA, 12 nt, Human
uaaucagccucu

SEQ ID NO: 2478909 - RNA, 13 nt, Human
uaaucagccucuu

SEQ ID NO: 2478910 - RNA, 21 nt, Human
uaauauugauaugcuuauaca

SEQ ID NO: 2478911 - RNA, 16 nt, Human
uaauauuguggugcca

SEQ ID NO: 2478912 - RNA, 14 nt, Human
uaauauugagaaag

SEQ ID NO: 2478913 - RNA, 19 nt, Human
uaauauugagaaagaaacu

SEQ ID NO: 2478914 - RNA, 21 nt, Human
uaauagaauauaauuaucgga

SEQ ID NO: 2478915 - RNA, 18 nt, Human
uaauauugacuuguauau

SEQ ID NO: 2478916 - RNA, 16 nt, Human
uaauauugacuuguau

SEQ ID NO: 2478917 - RNA, 16 nt, Human
uaauauuccucaguuc

SEQ ID NO: 2478918 - RNA, 13 nt, Human
uaaucuuucacag

SEQ ID NO: 2478919 - RNA, 17 nt, Human
uaaucuuuaauuuuaca

SEQ ID NO: 2478920 - RNA, 15 nt, Human
uaaucuucugccuuc

SEQ ID NO: 2478921 - RNA, 16 nt, Human
uaaucuugaauuguaa

SEQ ID NO: 2478922 - RNA, 14 nt, Human
uaaucuucugccuu

SEQ ID NO: 2478923 - RNA, 14 nt, Human
uaauccagaauaac

SEQ ID NO: 2478924 - RNA, 22 nt, Human
uaaucuugaauuguaacuguuc

SEQ ID NO: 2478925 - RNA, 13 nt, Human
uaauccagcugau

SEQ ID NO: 2478926 - RNA, 14 nt, Human
uaaucuugcucugc

SEQ ID NO: 2478927 - RNA, 15 nt, Human
uaaucuugcucugcu

SEQ ID NO: 2478928 - RNA, 20 nt, Human
uaaucuugcucugcuugaca

SEQ ID NO: 2478929 - RNA, 15 nt, Human
uaaucauugccuggu

SEQ ID NO: 2478930 - RNA, 14 nt, Human
uaaucauugccugg

SEQ ID NO: 2478931 - RNA, 22 nt, Human
uaaucauucuuauuucaugaaa

SEQ ID NO: 2478932 - RNA, 17 nt, Human
uaaucaugaauguguaa

SEQ ID NO: 2478933 - RNA, 16 nt, Human
uaaucaugaaugugua

SEQ ID NO: 2478934 - RNA, 20 nt, Human
uaaucauucuuauuucauga

SEQ ID NO: 2478935 - RNA, 13 nt, Human
uaaucaugaaugu

SEQ ID NO: 2478936 - RNA, 18 nt, Human
uaaucaugaaauuacuua

SEQ ID NO: 2478937 - RNA, 21 nt, Human
uaaucaugaaauuacuuauca

SEQ ID NO: 2478938 - RNA, 17 nt, Human
uaaucagugucucacac

SEQ ID NO: 2478939 - RNA, 16 nt, Human
uaaucagugucucaca

SEQ ID NO: 2478940 - RNA, 17 nt, Human
uaaucaugaaauuacuu

SEQ ID NO: 2478941 - RNA, 22 nt, Human
uaauccaagcaaaugugaauca

SEQ ID NO: 2478942 - RNA, 19 nt, Human
uaauccaauggguuuuucc

SEQ ID NO: 2478943 - RNA, 12 nt, Human
uaaucauuucuu

SEQ ID NO: 2478944 - RNA, 19 nt, Human
uaaucauuucuugggcccu

SEQ ID NO: 2478945 - RNA, 22 nt, Human
uaaucauuucuugggcccuccu

SEQ ID NO: 2478946 - RNA, 15 nt, Human
uaauaccucugugug

SEQ ID NO: 2478947 - RNA, 14 nt, Human
uaauaccucugugu

SEQ ID NO: 2478948 - RNA, 13 nt, Human
uaauaccucugug

SEQ ID NO: 2478949 - RNA, 22 nt, Human
uaauaccauuuuuuaaggaaac

SEQ ID NO: 2478950 - RNA, 13 nt, Human
uaauaccucccuu

SEQ ID NO: 2478951 - RNA, 16 nt, Human
uaauaccacagcuuuu

SEQ ID NO: 2478952 - RNA, 21 nt, Human
uaauacagcaacaauuuauga

SEQ ID NO: 2478953 - RNA, 22 nt, Human
uaauacagcaacaauuuaugaa

SEQ ID NO: 2478954 - RNA, 19 nt, Human
uaauacagcagugucauca

SEQ ID NO: 2478955 - RNA, 20 nt, Human
uaauacacuaauuccuuucu

SEQ ID NO: 2478956 - RNA, 23 nt, Human
uaauacagcagugucaucagaag

SEQ ID NO: 2478957 - RNA, 20 nt, Human
uaauacagccaaagauaauc

SEQ ID NO: 2478958 - RNA, 18 nt, Human
uaauacuugcuuuggaaa

SEQ ID NO: 2478959 - RNA, 20 nt, Human
uaauaccugggugauuacau

SEQ ID NO: 2478960 - RNA, 14 nt, Human
uaauacuguauuug

SEQ ID NO: 2478961 - RNA, 15 nt, Human
uaauaccugggugau

SEQ ID NO: 2478962 - RNA, 18 nt, Human
uaauaccucugugugcuc

SEQ ID NO: 2478963 - RNA, 18 nt, Human
uaauagaaaacugaaaau

SEQ ID NO: 2478964 - RNA, 16 nt, Human
uaauagaaaacugaaa

SEQ ID NO: 2478965 - RNA, 15 nt, Human
uaauagaaaacugaa

SEQ ID NO: 2478966 - RNA, 19 nt, Human
uaauagaaaacugaaaauc

SEQ ID NO: 2478967 - RNA, 12 nt, Human
uaauagaagaac

SEQ ID NO: 2478968 - RNA, 21 nt, Human
uaauagaagaacauccaagga

SEQ ID NO: 2478969 - RNA, 22 nt, Human
uaauacaccacuacauucuguu

SEQ ID NO: 2478970 - RNA, 21 nt, Human
uaauacaccacuacauucugu

SEQ ID NO: 2478971 - RNA, 23 nt, Human
uaauacaccacuacauucuguua

SEQ ID NO: 2478972 - RNA, 22 nt, Human
uaauacacuaauuccuuucuau

SEQ ID NO: 2478973 - RNA, 18 nt, Human
uaauacagcaacaauuua

SEQ ID NO: 2478974 - RNA, 19 nt, Human
aauacaguuugucacauga

SEQ ID NO: 2478975 - RNA, 19 nt, Human
uaacaaugcuguauuuuaa

SEQ ID NO: 2478976 - RNA, 20 nt, Human
aauacaguaucucagggccu

SEQ ID NO: 2478977 - RNA, 18 nt, Human
aauacaguacaggcagca

SEQ ID NO: 2478978 - RNA, 21 nt, Human
aauacaguacaggcagcacag

SEQ ID NO: 2478979 - RNA, 17 nt, Human
uaacaagcucccaggcc

SEQ ID NO: 2478980 - RNA, 15 nt, Human
aauacaguacaggca

SEQ ID NO: 2478981 - RNA, 16 nt, Human
aauacaguacaggcag

SEQ ID NO: 2478982 - RNA, 17 nt, Human
aauacaguacaggcagc

SEQ ID NO: 2478983 - RNA, 18 nt, Human
aauacaguuguuggccuc

SEQ ID NO: 2478984 - RNA, 21 nt, Human
aauacagucuuccauuugcaa

SEQ ID NO: 2478985 - RNA, 12 nt, Human
aauacaguguua

SEQ ID NO: 2478986 - RNA, 12 nt, Human
uaaugugaaacu

SEQ ID NO: 2478987 - RNA, 20 nt, Human
uaaugugaaacuggauuaaa

SEQ ID NO: 2478988 - RNA, 22 nt, Human
uaaugugaaacuggauuaaacu

SEQ ID NO: 2478989 - RNA, 23 nt, Human
uaaugugaaacuggauuaaacuu

SEQ ID NO: 2478990 - RNA, 17 nt, Human
uaauguaauaacuguga

SEQ ID NO: 2478991 - RNA, 15 nt, Human
uaaugucacaggcag

SEQ ID NO: 2478992 - RNA, 17 nt, Human
uaaugucacaggcaggu

SEQ ID NO: 2478993 - RNA, 16 nt, Human
uaaugucacaggcagg

SEQ ID NO: 2478994 - RNA, 19 nt, Human
uaaugaaauaucuguauuu

SEQ ID NO: 2478995 - RNA, 16 nt, Human
uaaugaagaaagugga

SEQ ID NO: 2478996 - RNA, 17 nt, Human
uaaugaagaaaguggaa

SEQ ID NO: 2478997 - RNA, 16 nt, Human
uaaugaaccgcugaau

SEQ ID NO: 2478998 - RNA, 14 nt, Human
uaaugaaauaucug

SEQ ID NO: 2478999 - RNA, 18 nt, Human
uaaugaaccgcugaauau

SEQ ID NO: 2479000 - RNA, 22 nt, Human
uaaugaagaaaguggaaaacaa

SEQ ID NO: 2479001 - RNA, 23 nt, Human
uaaugaagaaaguggaaaacaag

SEQ ID NO: 2479002 - RNA, 14 nt, Human
uaaugaaguuugaa

SEQ ID NO: 2479003 - RNA, 13 nt, Human
uaaugaaguuuga

SEQ ID NO: 2479004 - RNA, 14 nt, Human
uaaugaagcuuuau

SEQ ID NO: 2479005 - RNA, 22 nt, Human
uaaugaagggaaaggauauuuu

SEQ ID NO: 2479006 - RNA, 18 nt, Human
uaaugaaguuugaauguu

SEQ ID NO: 2479007 - RNA, 17 nt, Human
uaaugaaguuugaaugu

SEQ ID NO: 2479008 - RNA, 16 nt, Human
uaaugaaguuugaaug

SEQ ID NO: 2479009 - RNA, 15 nt, Human
uaaugaaguuugaau

SEQ ID NO: 2479010 - RNA, 15 nt, Human
uaauguaagacaaau

SEQ ID NO: 2479011 - RNA, 16 nt, Human
uaauguaagcucuacu

SEQ ID NO: 2479012 - RNA, 17 nt, Human
uaauguaagcucuacug

SEQ ID NO: 2479013 - RNA, 17 nt, Human
aaucuuuucacaaauaa

SEQ ID NO: 2479014 - RNA, 16 nt, Human
aaucuuuucacaaaua

SEQ ID NO: 2479015 - RNA, 15 nt, Human
aaucuuuucacaaau

SEQ ID NO: 2479016 - RNA, 14 nt, Human
aaucuuuucacaaa

SEQ ID NO: 2479017 - RNA, 18 nt, Human
aaucuuuucacaaauaaa

SEQ ID NO: 2479018 - RNA, 21 nt, Human
aaucuuuuuuagcauaaaauu

SEQ ID NO: 2479019 - RNA, 14 nt, Human
aaugaaaaaaugua

SEQ ID NO: 2479020 - RNA, 14 nt, Human
aaugaaaaauucuc

SEQ ID NO: 2479021 - RNA, 17 nt, Human
aaugaaaaauucucagu

SEQ ID NO: 2479022 - RNA, 17 nt, Human
aaugaaaaauuuaagca

SEQ ID NO: 2479023 - RNA, 18 nt, Human
aaugaaaaauuuaagcau

SEQ ID NO: 2479024 - RNA, 14 nt, Human
aaugaaugucagug

SEQ ID NO: 2479025 - RNA, 15 nt, Human
aaugaaugucagugu

SEQ ID NO: 2479026 - RNA, 15 nt, Human
aaugaaugaaugaau

SEQ ID NO: 2479027 - RNA, 14 nt, Human
aaugaaugaaacau

SEQ ID NO: 2479028 - RNA, 22 nt, Human
aaucuugacuacagucaggaaa

SEQ ID NO: 2479029 - RNA, 17 nt, Human
aaucuugaaauuaagaa

SEQ ID NO: 2479030 - RNA, 14 nt, Human
aaucuugaaauuaa

SEQ ID NO: 2479031 - RNA, 22 nt, Human
uaaugugcuguguaaaguuagu

SEQ ID NO: 2479032 - RNA, 21 nt, Human
uaaugugcuguguaaaguuag

SEQ ID NO: 2479033 - RNA, 20 nt, Human
uaaugugcuguguaaaguua

SEQ ID NO: 2479034 - RNA, 13 nt, Human
aaucuugaaaaug

SEQ ID NO: 2479035 - RNA, 23 nt, Human
aaucuuuuacaacugccucgaaa

SEQ ID NO: 2479036 - RNA, 13 nt, Human
aaucuugcucugc

SEQ ID NO: 2479037 - RNA, 19 nt, Human
aaucuugggggguuuuuac

SEQ ID NO: 2479038 - RNA, 19 nt, Human
uaaugugcuguguaaaguu

SEQ ID NO: 2479039 - RNA, 18 nt, Human
uaaugugcuguguaaagu

SEQ ID NO: 2479040 - RNA, 17 nt, Human
uaaugugcuguguaaag

SEQ ID NO: 2479041 - RNA, 16 nt, Human
uaaugugcuguguaaa

SEQ ID NO: 2479042 - RNA, 15 nt, Human
uaaugugcuguguaa

SEQ ID NO: 2479043 - RNA, 14 nt, Human
uaaugugcugugua

SEQ ID NO: 2479044 - RNA, 13 nt, Human
uaaugugcugugu

SEQ ID NO: 2479045 - RNA, 12 nt, Human
uaaugugcugug

SEQ ID NO: 2479046 - RNA, 23 nt, Human
aaucuucugaacuuggcgcugcc

SEQ ID NO: 2479047 - RNA, 13 nt, Human
uaaugugaagugu

SEQ ID NO: 2479048 - RNA, 13 nt, Human
uaaugugauauua

SEQ ID NO: 2479049 - RNA, 17 nt, Human
uaaugugccuaguucuu

SEQ ID NO: 2479050 - RNA, 21 nt, Human
uaaugugaaaaugguccagga

SEQ ID NO: 2479051 - RNA, 19 nt, Human
uaauguauuuuauuguaac

SEQ ID NO: 2479052 - RNA, 12 nt, Human
uaauguauuuua

SEQ ID NO: 2479053 - RNA, 13 nt, Human
acaagcugcaccc

SEQ ID NO: 2479054 - RNA, 14 nt, Human
acaagcuaaaauua

SEQ ID NO: 2479055 - RNA, 18 nt, Human
acaagcgugagccacugc

SEQ ID NO: 2479056 - RNA, 21 nt, Human
acaagcgugagccacugcacc

SEQ ID NO: 2479057 - RNA, 20 nt, Human
acaagcgugagccacugcac

SEQ ID NO: 2479058 - RNA, 21 nt, Human
acaagccaacuuguaaauaca

SEQ ID NO: 2479059 - RNA, 14 nt, Human
acaagccaacuugu

SEQ ID NO: 2479060 - RNA, 13 nt, Human
acaagccacagaa

SEQ ID NO: 2479061 - RNA, 12 nt, Human
acaagccacaga

SEQ ID NO: 2479062 - RNA, 18 nt, Human
acaagccacagaagccag

SEQ ID NO: 2479063 - RNA, 18 nt, Human
acaagccacgaaugaaug

SEQ ID NO: 2479064 - RNA, 12 nt, Human
acaagccacccc

SEQ ID NO: 2479065 - RNA, 14 nt, Human
acaagccccaggca

SEQ ID NO: 2479066 - RNA, 15 nt, Human
acaagccagcuggag

SEQ ID NO: 2479067 - RNA, 13 nt, Human
acaagccagcugg

SEQ ID NO: 2479068 - RNA, 17 nt, Human
acaagagcccaggccuc

SEQ ID NO: 2479069 - RNA, 18 nt, Human
acaagagcccaggccucc

SEQ ID NO: 2479070 - RNA, 19 nt, Human
acaagagcagccuguggca

SEQ ID NO: 2479071 - RNA, 20 nt, Human
acaagagcagccuguggcau

SEQ ID NO: 2479072 - RNA, 15 nt, Human
acaagagcacuacau

SEQ ID NO: 2479073 - RNA, 21 nt, Human
acaagagcacuacauucauuu

SEQ ID NO: 2479074 - RNA, 14 nt, Human
acaagagcagccug

SEQ ID NO: 2479075 - RNA, 15 nt, Human
acaagagcagccugu

SEQ ID NO: 2479076 - RNA, 16 nt, Human
acaagagcagccugug

SEQ ID NO: 2479077 - RNA, 18 nt, Human
acaagagcagccuguggc

SEQ ID NO: 2479078 - RNA, 18 nt, Human
acaagcacuaaacaaaga

SEQ ID NO: 2479079 - RNA, 21 nt, Human
acaagcauucugucuugaagg

SEQ ID NO: 2479080 - RNA, 11 nt, Human
acaagcagagg

SEQ ID NO: 2479081 - RNA, 22 nt, Human
acaagcaauuagacaagaacuu

SEQ ID NO: 2479082 - RNA, 13 nt, Human
acaagagcccagc

SEQ ID NO: 2479083 - RNA, 20 nt, Human
acaagagcccagcagggccu

SEQ ID NO: 2479084 - RNA, 15 nt, Human
acaagcaagcuccca

SEQ ID NO: 2479085 - RNA, 13 nt, Human
acaagcaagcucc

SEQ ID NO: 2479086 - RNA, 17 nt, Human
uagcauguuugcugaac

SEQ ID NO: 2479087 - RNA, 12 nt, Human
uagcauuaacua

SEQ ID NO: 2479088 - RNA, 16 nt, Human
uagcauguuugcugaa

SEQ ID NO: 2479089 - RNA, 13 nt, Human
uagcauguuugcu

SEQ ID NO: 2479090 - RNA, 20 nt, Human
uagcauguugagccaggccu

SEQ ID NO: 2479091 - RNA, 16 nt, Human
uagcauuaacuaaucu

SEQ ID NO: 2479092 - RNA, 12 nt, Human
uagcauuucuug

SEQ ID NO: 2479093 - RNA, 18 nt, Human
uagcauuucauucuucuc

SEQ ID NO: 2479094 - RNA, 17 nt, Human
uagcauuucauucuucu

SEQ ID NO: 2479095 - RNA, 16 nt, Human
uagcauuucauucuuc

SEQ ID NO: 2479096 - RNA, 15 nt, Human
uagcauuucauucuu

SEQ ID NO: 2479097 - RNA, 13 nt, Human
uagcauuucauuc

SEQ ID NO: 2479098 - RNA, 20 nt, Human
uagcauugugaacugacagg

SEQ ID NO: 2479099 - RNA, 22 nt, Human
uagcauuuaguccaaugucuuu

SEQ ID NO: 2479100 - RNA, 16 nt, Human
uagcauuucuugaugu

SEQ ID NO: 2479101 - RNA, 13 nt, Human
uagcauuucuuga

SEQ ID NO: 2479102 - RNA, 22 nt, Human
acaaauguguaucggaugcuuu

SEQ ID NO: 2479103 - RNA, 17 nt, Human
acaaauucauauucugu

SEQ ID NO: 2479104 - RNA, 17 nt, Human
acaaauuauuaaugaaa

SEQ ID NO: 2479105 - RNA, 22 nt, Human
acaaauuauguuacaucuguuu

SEQ ID NO: 2479106 - RNA, 22 nt, Human
acaaauuagaaaauguuauuua

SEQ ID NO: 2479107 - RNA, 20 nt, Human
acaaauuagguuuuguacaa

SEQ ID NO: 2479108 - RNA, 22 nt, Human
acaagaaaugaaagcagggacu

SEQ ID NO: 2479109 - RNA, 13 nt, Human
acaagaagaccag

SEQ ID NO: 2479110 - RNA, 14 nt, Human
acaagaagaagggc

SEQ ID NO: 2479111 - RNA, 18 nt, Human
acaagaaauuugauuucu

SEQ ID NO: 2479112 - RNA, 15 nt, Human
acaagaacugaaacc

SEQ ID NO: 2479113 - RNA, 20 nt, Human
acaagaagccacagaccuag

SEQ ID NO: 2479114 - RNA, 23 nt, Human
acaagaaggguuuuccacccugg

SEQ ID NO: 2479115 - RNA, 15 nt, Human
acaacaacaaaauga

SEQ ID NO: 2479116 - RNA, 18 nt, Human
acaaauucugucucugga

SEQ ID NO: 2479117 - RNA, 15 nt, Human
acaacaaccugguca

SEQ ID NO: 2479118 - RNA, 12 nt, Human
acaacacucaca

SEQ ID NO: 2479119 - RNA, 14 nt, Human
acaacacacacacu

SEQ ID NO: 2479120 - RNA, 13 nt, Human
acaacaagaguuu

SEQ ID NO: 2479121 - RNA, 13 nt, Human
uagcaccagggaa

SEQ ID NO: 2479122 - RNA, 14 nt, Human
uagcaccagggaag

SEQ ID NO: 2479123 - RNA, 15 nt, Human
uagauuuuguuuugc

SEQ ID NO: 2479124 - RNA, 21 nt, Human
uagcaugucgucaaagcugaa

SEQ ID NO: 2479125 - RNA, 18 nt, Human
uagcaugucgucaaagcu

SEQ ID NO: 2479126 - RNA, 16 nt, Human
uagcaccagggaaggg

SEQ ID NO: 2479127 - RNA, 18 nt, Human
uagcacaggggggccgcc

SEQ ID NO: 2479128 - RNA, 21 nt, Human
uagcauguguuugguucuggg

SEQ ID NO: 2479129 - RNA, 22 nt, Human
uagcauguguuugguucugggg

SEQ ID NO: 2479130 - RNA, 19 nt, Human
uagcacagacccugcccug

SEQ ID NO: 2479131 - RNA, 18 nt, Human
uagcacagacccugcccu

SEQ ID NO: 2479132 - RNA, 17 nt, Human
uagcacagacccugccc

SEQ ID NO: 2479133 - RNA, 16 nt, Human
uagcacagacccugcc

SEQ ID NO: 2479134 - RNA, 19 nt, Human
uagauuuucuuuaaaagaa

SEQ ID NO: 2479135 - RNA, 16 nt, Human
uagauuuucuuuaaaa

SEQ ID NO: 2479136 - RNA, 15 nt, Human
uagauuuucuuuaaa

SEQ ID NO: 2479137 - RNA, 14 nt, Human
uagauuuucuuuaa

SEQ ID NO: 2479138 - RNA, 12 nt, Human
uagauuuuccaa

SEQ ID NO: 2479139 - RNA, 13 nt, Human
uagauuuuccaaa

SEQ ID NO: 2479140 - RNA, 14 nt, Human
uagaucaugaagaa

SEQ ID NO: 2479141 - RNA, 22 nt, Human
uagauuuuagacccuauugcug

SEQ ID NO: 2479142 - RNA, 19 nt, Human
uagaugcaguucugaagaa

SEQ ID NO: 2479143 - RNA, 17 nt, Human
uagaugcaguucugaag

SEQ ID NO: 2479144 - RNA, 16 nt, Human
uagaugcaguucugaa

SEQ ID NO: 2479145 - RNA, 23 nt, Human
uagaucaaauacuuuaaaggaaa

SEQ ID NO: 2479146 - RNA, 17 nt, Human
uagaucaaauacuuuaa

SEQ ID NO: 2479147 - RNA, 14 nt, Human
uagaucaaauacuu

SEQ ID NO: 2479148 - RNA, 13 nt, Human
uagaucaaauacu

SEQ ID NO: 2479149 - RNA, 20 nt, Human
uagaggaaauaagaaaaauc

SEQ ID NO: 2479150 - RNA, 17 nt, Human
uagaucacgagaucaag

SEQ ID NO: 2479151 - RNA, 16 nt, Human
uagaucaccagaauaa

SEQ ID NO: 2479152 - RNA, 16 nt, Human
uagaucacgagaucaa

SEQ ID NO: 2479153 - RNA, 19 nt, Human
uagaggaaauaagaaaaau

SEQ ID NO: 2479154 - RNA, 22 nt, Human
uagaggaaaaaaaugacuaaaa

SEQ ID NO: 2479155 - RNA, 16 nt, Human
acaaaaagcauaaaaa

SEQ ID NO: 2479156 - RNA, 16 nt, Human
acaaaaagaacaaaaa

SEQ ID NO: 2479157 - RNA, 22 nt, Human
uagagcaggcguucagcucacu

SEQ ID NO: 2479158 - RNA, 20 nt, Human
uagagcaggcguucagcuca

SEQ ID NO: 2479159 - RNA, 11 nt, Human
uagagcaggcg

SEQ ID NO: 2479160 - RNA, 19 nt, Human
uagagcagcccuggaguca

SEQ ID NO: 2479161 - RNA, 14 nt, Human
uagagcagcccugg

SEQ ID NO: 2479162 - RNA, 19 nt, Human
uagagcagaugaccccucc

SEQ ID NO: 2479163 - RNA, 14 nt, Human
uagagccaggcaca

SEQ ID NO: 2479164 - RNA, 12 nt, Human
uagagccaggca

SEQ ID NO: 2479165 - RNA, 19 nt, Human
uagagcauugccauucccu

SEQ ID NO: 2479166 - RNA, 19 nt, Human
uagagccaggcacacacug

SEQ ID NO: 2479167 - RNA, 15 nt, Human
uagagccaggcacac

SEQ ID NO: 2479168 - RNA, 23 nt, Human
uagagcugacacaaaccugccug

SEQ ID NO: 2479169 - RNA, 16 nt, Human
uagagcauugccauuc

SEQ ID NO: 2479170 - RNA, 15 nt, Human
uagagcauugccauu

SEQ ID NO: 2479171 - RNA, 19 nt, Human
uagagcauugaauuggaga

SEQ ID NO: 2479172 - RNA, 22 nt, Human
uagagcaguuucuguccugcug

SEQ ID NO: 2479173 - RNA, 23 nt, Human
uagagcagggauuaaccucugca

SEQ ID NO: 2479174 - RNA, 17 nt, Human
uagagcaguuucugucc

SEQ ID NO: 2479175 - RNA, 18 nt, Human
uagagcugauccagagca

SEQ ID NO: 2479176 - RNA, 15 nt, Human
uagagcugauccaga

SEQ ID NO: 2479177 - RNA, 14 nt, Human
uagagcugauccag

SEQ ID NO: 2479178 - RNA, 15 nt, Human
uagagcuucuggcac

SEQ ID NO: 2479179 - RNA, 17 nt, Human
uagagcuuucaaguaca

SEQ ID NO: 2479180 - RNA, 19 nt, Human
uagagcugauccagagcac

SEQ ID NO: 2479181 - RNA, 20 nt, Human
uagagcuguauuaagccacu

SEQ ID NO: 2479182 - RNA, 17 nt, Human
uagaggaaaaaaaugac

SEQ ID NO: 2479183 - RNA, 18 nt, Human
uagaggaaaaaaaugacu

SEQ ID NO: 2479184 - RNA, 21 nt, Human
uacuucaaauccuugaagauu

SEQ ID NO: 2479185 - RNA, 23 nt, Human
uacuucaaaaguauuuuccugua

SEQ ID NO: 2479186 - RNA, 18 nt, Human
uacuucaaguuaaaguga

SEQ ID NO: 2479187 - RNA, 23 nt, Human
uacuucaaguuaaagugaauaac

SEQ ID NO: 2479188 - RNA, 22 nt, Human
uacuucaggggcacuucauuga

SEQ ID NO: 2479189 - RNA, 19 nt, Human
uacuucaggggcacuucau

SEQ ID NO: 2479190 - RNA, 19 nt, Human
uacuucacuuuaauucuca

SEQ ID NO: 2479191 - RNA, 16 nt, Human
uacuucacuuuaauuc

SEQ ID NO: 2479192 - RNA, 16 nt, Human
uacuucaugcugucua

SEQ ID NO: 2479193 - RNA, 22 nt, Human
uacuucacuuuaauucucaugu

SEQ ID NO: 2479194 - RNA, 15 nt, Human
uacuucacuuuaauu

SEQ ID NO: 2479195 - RNA, 19 nt, Human
uacuucacugucaggaaga

SEQ ID NO: 2479196 - RNA, 14 nt, Human
uacuucacugucag

SEQ ID NO: 2479197 - RNA, 21 nt, Human
uacuucaaguuaaagugaaua

SEQ ID NO: 2479198 - RNA, 15 nt, Human
uagaacucccuuuca

SEQ ID NO: 2479199 - RNA, 22 nt, Human
uagaacucaguuuuaacuagaa

SEQ ID NO: 2479200 - RNA, 19 nt, Human
uagaacucaguuuuaacua

SEQ ID NO: 2479201 - RNA, 13 nt, Human
uagaaccuggagg

SEQ ID NO: 2479202 - RNA, 22 nt, Human
uagaaccuggagagcuagaacc

SEQ ID NO: 2479203 - RNA, 13 nt, Human
uagaaccuggaga

SEQ ID NO: 2479204 - RNA, 23 nt, Human
uagaaccuggaagggcuagaacc

SEQ ID NO: 2479205 - RNA, 17 nt, Human
uagaaccuggagggcug

SEQ ID NO: 2479206 - RNA, 22 nt, Human
uagaaccuggagggcuagaacc

SEQ ID NO: 2479207 - RNA, 17 nt, Human
uagaaccuggaagggcu

SEQ ID NO: 2479208 - RNA, 16 nt, Human
uagaaccuggaagggc

SEQ ID NO: 2479209 - RNA, 22 nt, Human
uagaacuuggauguaccugccc

SEQ ID NO: 2479210 - RNA, 19 nt, Human
uagaacuuuaagcaacaag

SEQ ID NO: 2479211 - RNA, 15 nt, Human
uagaagacauuuaua

SEQ ID NO: 2479212 - RNA, 20 nt, Human
uagaacuguaugucagacau

SEQ ID NO: 2479213 - RNA, 16 nt, Human
uagaacuugacccccu

SEQ ID NO: 2479214 - RNA, 19 nt, Human
uagaacuguaugucagaca

SEQ ID NO: 2479215 - RNA, 22 nt, Human
uagaacuggagaggcuagaacc

SEQ ID NO: 2479216 - RNA, 19 nt, Human
uagaacucugaaaugaaga

SEQ ID NO: 2479217 - RNA, 23 nt, Human
uagaacucuccaucuuauuuuca

SEQ ID NO: 2479218 - RNA, 15 nt, Human
uagaagccaagggaa

SEQ ID NO: 2479219 - RNA, 12 nt, Human
uagaagccaagg

SEQ ID NO: 2479220 - RNA, 23 nt, Human
uagaagcauuccuucuuugauaa

SEQ ID NO: 2479221 - RNA, 22 nt, Human
uagaagcauuccuucuuugaua

SEQ ID NO: 2479222 - RNA, 21 nt, Human
uagaagcauuccuucuuugau

SEQ ID NO: 2479223 - RNA, 20 nt, Human
uagaagcauuccuucuuuga

SEQ ID NO: 2479224 - RNA, 14 nt, Human
uagaagcauuccuu

SEQ ID NO: 2479225 - RNA, 15 nt, Human
uagaagucacacagu

SEQ ID NO: 2479226 - RNA, 20 nt, Human
uagaagacucuaccagacug

SEQ ID NO: 2479227 - RNA, 21 nt, Human
uagaacuugcagcugauguug

SEQ ID NO: 2479228 - RNA, 23 nt, Human
uagaagauauuagucuuggggca

SEQ ID NO: 2479229 - RNA, 21 nt, Human
uagaagacucuaccagacugu

SEQ ID NO: 2479230 - RNA, 16 nt, Human
uagaagauccuacccc

SEQ ID NO: 2479231 - RNA, 18 nt, Human
uagaagauggcacuuaua

SEQ ID NO: 2479232 - RNA, 14 nt, Human
uagaagcuggagga

SEQ ID NO: 2479233 - RNA, 20 nt, Human
uagaagucuuagauguauau

SEQ ID NO: 2479234 - RNA, 18 nt, Human
uagaagucuuagauguau

SEQ ID NO: 2479235 - RNA, 19 nt, Human
uagaagucuuagauguaua

SEQ ID NO: 2479236 - RNA, 19 nt, Human
uagaagccaagggaaaggg

SEQ ID NO: 2479237 - RNA, 16 nt, Human
uagaagccaagggaaa

SEQ ID NO: 2479238 - RNA, 22 nt, Human
uagaagccccguuauaacuccu

SEQ ID NO: 2479239 - RNA, 16 nt, Human
uagaagucacacagua

SEQ ID NO: 2479240 - RNA, 16 nt, Human
uagaagucuuagaugu

SEQ ID NO: 2479241 - RNA, 17 nt, Human
uagaagucuuagaugua

SEQ ID NO: 2479242 - RNA, 23 nt, Human
uagaauuuauucaauuccucugg

SEQ ID NO: 2479243 - RNA, 19 nt, Human
uagacaaauauuuggaggg

SEQ ID NO: 2479244 - RNA, 15 nt, Human
uagacaacccugcaa

SEQ ID NO: 2479245 - RNA, 14 nt, Human
uagaauugcauuga

SEQ ID NO: 2479246 - RNA, 15 nt, Human
uagaauugcauugac

SEQ ID NO: 2479247 - RNA, 13 nt, Human
uagaauugcauug

SEQ ID NO: 2479248 - RNA, 22 nt, Human
uagaauuuauucaauuccucug

SEQ ID NO: 2479249 - RNA, 20 nt, Human
uagaauuuauucaauuccuc

SEQ ID NO: 2479250 - RNA, 19 nt, Human
uagaauuggcugaacucau

SEQ ID NO: 2479251 - RNA, 15 nt, Human
uagaauuuauucaau

SEQ ID NO: 2479252 - RNA, 21 nt, Human
uagacagagucucacuguugc

SEQ ID NO: 2479253 - RNA, 16 nt, Human
uagacaauuuauuaug

SEQ ID NO: 2479254 - RNA, 22 nt, Human
uagacaaguccagccuggcaag

SEQ ID NO: 2479255 - RNA, 14 nt, Human
uagacagucccugc

SEQ ID NO: 2479256 - RNA, 12 nt, Human
uagacagucccu

SEQ ID NO: 2479257 - RNA, 23 nt, Human
aauuuguaaguuucaggugacau

SEQ ID NO: 2479258 - RNA, 19 nt, Human
aauuuguaaguuucaggug

SEQ ID NO: 2479259 - RNA, 18 nt, Human
aauuuguaaguuucaggu

SEQ ID NO: 2479260 - RNA, 16 nt, Human
aauuuguaaguuucag

SEQ ID NO: 2479261 - RNA, 14 nt, Human
aauuuguaaguuuc

SEQ ID NO: 2479262 - RNA, 15 nt, Human
aauuuguaaguuuau

SEQ ID NO: 2479263 - RNA, 14 nt, Human
aauuuguaaguuua

SEQ ID NO: 2479264 - RNA, 13 nt, Human
aauuuguaaguuu

SEQ ID NO: 2479265 - RNA, 16 nt, Human
aauuuguaaccucagc

SEQ ID NO: 2479266 - RNA, 15 nt, Human
aauuuguaaccucag

SEQ ID NO: 2479267 - RNA, 24 nt, Human
aauuuguaaaaacagcauugcuuu

SEQ ID NO: 2479268 - RNA, 22 nt, Human
uagacaguaugagucaaugugc

SEQ ID NO: 2479269 - RNA, 15 nt, Human
aauuuguaauugcuu

SEQ ID NO: 2479270 - RNA, 19 nt, Human
aauuuguaauugcuuacau

SEQ ID NO: 2479271 - RNA, 20 nt, Human
aauuuguacauauguaaaau

SEQ ID NO: 2479272 - RNA, 19 nt, Human
aauuuguaucugaaggaga

SEQ ID NO: 2479273 - RNA, 18 nt, Human
aauuuguaucugaaggag

SEQ ID NO: 2479274 - RNA, 17 nt, Human
aauuuguaucugaagga

SEQ ID NO: 2479275 - RNA, 15 nt, Human
aauuuguaucugaag

SEQ ID NO: 2479276 - RNA, 14 nt, Human
aauuuguaucugaa

SEQ ID NO: 2479277 - RNA, 12 nt, Human
aauuuguaucug

SEQ ID NO: 2479278 - RNA, 17 nt, Human
aauuuuaaaaaugaauc

SEQ ID NO: 2479279 - RNA, 21 nt, Human
aauuuuaaaaaugaauccuac

SEQ ID NO: 2479280 - RNA, 14 nt, Human
aauuuuaaaaauga

SEQ ID NO: 2479281 - RNA, 18 nt, Human
aauuuguuugugcuucua

SEQ ID NO: 2479282 - RNA, 22 nt, Human
aauuuguaucugaaggagauuu

SEQ ID NO: 2479283 - RNA, 20 nt, Human
aauuuguaucugaaggagau

SEQ ID NO: 2479284 - RNA, 17 nt, Human
aauuuguuugugcuucu

SEQ ID NO: 2479285 - RNA, 19 nt, Human
aauuuuuauauuugaaaua

SEQ ID NO: 2479286 - RNA, 12 nt, Human
aauuuuaaauua

SEQ ID NO: 2479287 - RNA, 17 nt, Human
aauuuuaaacaaagguu

SEQ ID NO: 2479288 - RNA, 19 nt, Human
aauuuuaaccuaugauauu

SEQ ID NO: 2479289 - RNA, 18 nt, Human
aauuuuaaauaaaaguga

SEQ ID NO: 2479290 - RNA, 22 nt, Human
aauuuuaaauaaaagugaucaa

SEQ ID NO: 2479291 - RNA, 14 nt, Human
aauuuuaaacaaag

SEQ ID NO: 2479292 - RNA, 17 nt, Human
aauuuuaaauaaaagug

SEQ ID NO: 2479293 - RNA, 13 nt, Human
aauuuuuauucau

SEQ ID NO: 2479294 - RNA, 21 nt, Human
aauuuuuauuauuuguuuucc

SEQ ID NO: 2479295 - RNA, 16 nt, Human
aauuuuuauuauuugu

SEQ ID NO: 2479296 - RNA, 16 nt, Human
aauuuuuauucauaag

SEQ ID NO: 2479297 - RNA, 15 nt, Human
aauuuuuauucauaa

SEQ ID NO: 2479298 - RNA, 16 nt, Human
aauuuuuauuuuucua

SEQ ID NO: 2479299 - RNA, 15 nt, Human
aauuuuuauuuuucu

SEQ ID NO: 2479300 - RNA, 15 nt, Human
aauuuuucagaugcu

SEQ ID NO: 2479301 - RNA, 17 nt, Human
aauuuuuauuaaauuau

SEQ ID NO: 2479302 - RNA, 18 nt, Human
aauuuuuauuaaauuaug

SEQ ID NO: 2479303 - RNA, 19 nt, Human
aauuuuucagaugcuucug

SEQ ID NO: 2479304 - RNA, 20 nt, Human
aauuuuucauugauaugaaa

SEQ ID NO: 2479305 - RNA, 23 nt, Human
aauuuuucauugauaugaaaaau

SEQ ID NO: 2479306 - RNA, 12 nt, Human
aauuuuucugca

SEQ ID NO: 2479307 - RNA, 22 nt, Human
aauuuuucucuaacucagaaac

SEQ ID NO: 2479308 - RNA, 20 nt, Human
aauuuuucucuaacucagaa

SEQ ID NO: 2479309 - RNA, 23 nt, Human
aauuuuucugcacugagcagagu

SEQ ID NO: 2479310 - RNA, 16 nt, Human
aauuuuucugcacuga

SEQ ID NO: 2479311 - RNA, 14 nt, Human
aauuuuuguauuuu

SEQ ID NO: 2479312 - RNA, 19 nt, Human
aauuuuuucucuaggaaau

SEQ ID NO: 2479313 - RNA, 18 nt, Human
aauuuuuuaucaugcaug

SEQ ID NO: 2479314 - RNA, 20 nt, Human
aauuuuuuaucaugcauguc

SEQ ID NO: 2479315 - RNA, 18 nt, Human
aauuuuuuuauuguuuaa

SEQ ID NO: 2479316 - RNA, 16 nt, Human
aauuuuuuuauuguuu

SEQ ID NO: 2479317 - RNA, 15 nt, Human
aauuuuuuucaauau

SEQ ID NO: 2479318 - RNA, 19 nt, Human
aauuuuuuucaauauuuau

SEQ ID NO: 2479319 - RNA, 17 nt, Human
aauuuuuuuauuacuga

SEQ ID NO: 2479320 - RNA, 15 nt, Human
aauuuuuuuauuacu

SEQ ID NO: 2479321 - RNA, 17 nt, Human
acaaaaaaauauauuua

SEQ ID NO: 2479322 - RNA, 13 nt, Human
acaaaaaaauaua

SEQ ID NO: 2479323 - RNA, 17 nt, Human
acaaaaaaaaaguuuua

SEQ ID NO: 2479324 - RNA, 22 nt, Human
acaaaaaaaaaguuuuauuuuu

SEQ ID NO: 2479325 - RNA, 21 nt, Human
acaaaaaaaaaguuuuauuuu

SEQ ID NO: 2479326 - RNA, 19 nt, Human
acaaaaaaaaaguuuuauu

SEQ ID NO: 2479327 - RNA, 20 nt, Human
aauuuuuuuuuuuuaacuuu

SEQ ID NO: 2479328 - RNA, 17 nt, Human
aauuuuuuugagacaga

SEQ ID NO: 2479329 - RNA, 16 nt, Human
aauuuuuuucugcaac

SEQ ID NO: 2479330 - RNA, 19 nt, Human
aauuuuuuuauuguuuaaa

SEQ ID NO: 2479331 - RNA, 20 nt, Human
aauuuuuuuccuuaccuuuu

SEQ ID NO: 2479332 - RNA, 21 nt, Human
aauuuuuuucaucuucucugg

SEQ ID NO: 2479333 - RNA, 13 nt, Human
acaaaaacauggc

SEQ ID NO: 2479334 - RNA, 18 nt, Human
acaaaaaaaucugcagaa

SEQ ID NO: 2479335 - RNA, 16 nt, Human
acaaaaaaaucugcag

SEQ ID NO: 2479336 - RNA, 19 nt, Human
acaaaaaaaucugcagaag

SEQ ID NO: 2479337 - RNA, 15 nt, Human
acaaaaacagccuca

SEQ ID NO: 2479338 - RNA, 21 nt, Human
acaaaaacagccucacagaag

SEQ ID NO: 2479339 - RNA, 20 nt, Human
acaaaaaaauauauuuaaug

SEQ ID NO: 2479340 - RNA, 13 nt, Human
acaaaaaaaucug

SEQ ID NO: 2479341 - RNA, 16 nt, Human
acaaaaacacagcaag

SEQ ID NO: 2479342 - RNA, 13 nt, Human
aauuucuaaaucu

SEQ ID NO: 2479343 - RNA, 21 nt, Human
aauuucuaaaucuccaaaaua

SEQ ID NO: 2479344 - RNA, 21 nt, Human
aauuuaugaauugaauuaucu

SEQ ID NO: 2479345 - RNA, 23 nt, Human
aauuuaugaauugaauuaucuug

SEQ ID NO: 2479346 - RNA, 16 nt, Human
aauuuaugaguuuuug

SEQ ID NO: 2479347 - RNA, 14 nt, Human
aauuuaugugaugg

SEQ ID NO: 2479348 - RNA, 19 nt, Human
aauuuaugaguuuuugaua

SEQ ID NO: 2479349 - RNA, 20 nt, Human
aauuuaugaguuuuugauag

SEQ ID NO: 2479350 - RNA, 20 nt, Human
aauuucucccagucauuuaa

SEQ ID NO: 2479351 - RNA, 20 nt, Human
aauuucuccucccuuccuuu

SEQ ID NO: 2479352 - RNA, 14 nt, Human
aauuucuccucccu

SEQ ID NO: 2479353 - RNA, 12 nt, Human
aauuucuccucc

SEQ ID NO: 2479354 - RNA, 19 nt, Human
aauuucuccccagggugga

SEQ ID NO: 2479355 - RNA, 13 nt, Human
aauuucuccccag

SEQ ID NO: 2479356 - RNA, 12 nt, Human
aauuucucccca

SEQ ID NO: 2479357 - RNA, 11 nt, Human
aauuucucccc

SEQ ID NO: 2479358 - RNA, 15 nt, Human
aauuucuacuuugaa

SEQ ID NO: 2479359 - RNA, 16 nt, Human
aauuucuacuuugaag

SEQ ID NO: 2479360 - RNA, 17 nt, Human
aauuucuacuuugaagu

SEQ ID NO: 2479361 - RNA, 16 nt, Human
aauuucuaccauuuca

SEQ ID NO: 2479362 - RNA, 18 nt, Human
aauuucuaccauuucaga

SEQ ID NO: 2479363 - RNA, 22 nt, Human
aauuucuaaaaaacagaggcca

SEQ ID NO: 2479364 - RNA, 17 nt, Human
aauuuagaaauauaauu

SEQ ID NO: 2479365 - RNA, 18 nt, Human
aauuuagguuuuuauuag

SEQ ID NO: 2479366 - RNA, 20 nt, Human
aauuuagguuuuuauuagua

SEQ ID NO: 2479367 - RNA, 18 nt, Human
aauuuauccugaaauuuc

SEQ ID NO: 2479368 - RNA, 19 nt, Human
aauuuauccugaaauuuca

SEQ ID NO: 2479369 - RNA, 23 nt, Human
aauuuauccugaaauuucagauu

SEQ ID NO: 2479370 - RNA, 20 nt, Human
aauuuaucuugucucugggc

SEQ ID NO: 2479371 - RNA, 19 nt, Human
aauuuaucuugucucuggg

SEQ ID NO: 2479372 - RNA, 18 nt, Human
aauuuaucuugucucugg

SEQ ID NO: 2479373 - RNA, 20 nt, Human
aauuugaaacacuuugcaua

SEQ ID NO: 2479374 - RNA, 21 nt, Human
aauuucuguguugccaagcuc

SEQ ID NO: 2479375 - RNA, 14 nt, Human
aauuugaaauuuag

SEQ ID NO: 2479376 - RNA, 13 nt, Human
aauuucuguccuu

SEQ ID NO: 2479377 - RNA, 15 nt, Human
aauuugaaacacuuu

SEQ ID NO: 2479378 - RNA, 12 nt, Human
aauuugaaugaa

SEQ ID NO: 2479379 - RNA, 13 nt, Human
aauuugaaugaaa

SEQ ID NO: 2479380 - RNA, 14 nt, Human
aauuugaaugaaaa

SEQ ID NO: 2479381 - RNA, 15 nt, Human
aauuugaaugaaaaa

SEQ ID NO: 2479382 - RNA, 16 nt, Human
aauuugaaugaaaaau

SEQ ID NO: 2479383 - RNA, 18 nt, Human
aauuugagagaaauauga

SEQ ID NO: 2479384 - RNA, 20 nt, Human
aauuugagagaaauaugaag

SEQ ID NO: 2479385 - RNA, 13 nt, Human
aauuugaggacaa

SEQ ID NO: 2479386 - RNA, 17 nt, Human
aauuugagauacaaaca

SEQ ID NO: 2479387 - RNA, 19 nt, Human
uacuucaaauccuugaaga

SEQ ID NO: 2479388 - RNA, 14 nt, Human
uacuucaaauccuu

SEQ ID NO: 2479389 - RNA, 19 nt, Human
uacuucaaaaguauuuucc

SEQ ID NO: 2479390 - RNA, 16 nt, Human
uacuucaaaaguauuu

SEQ ID NO: 2479391 - RNA, 14 nt, Human
uacuucaaaaguau

SEQ ID NO: 2479392 - RNA, 12 nt, Human
uacuucaaaagu

SEQ ID NO: 2479393 - RNA, 20 nt, Human
uacuuauuuuugacaguguu

SEQ ID NO: 2479394 - RNA, 18 nt, Human
aauuugauaucacagucu

SEQ ID NO: 2479395 - RNA, 18 nt, Human
aauuugaucguuccaguu

SEQ ID NO: 2479396 - RNA, 13 nt, Human
aauuugagugcuc

SEQ ID NO: 2479397 - RNA, 20 nt, Human
aauuugauacauaugugaau

SEQ ID NO: 2479398 - RNA, 21 nt, Human
aauuugauacauaugugaaua

SEQ ID NO: 2479399 - RNA, 14 nt, Human
aauuugaggacaac

SEQ ID NO: 2479400 - RNA, 20 nt, Human
aauuugaguuggaucaucua

SEQ ID NO: 2479401 - RNA, 16 nt, Human
aauuugauaucacagu

SEQ ID NO: 2479402 - RNA, 14 nt, Human
aauuugauaucaca

SEQ ID NO: 2479403 - RNA, 21 nt, Human
aauuugauaguauugugcaua

SEQ ID NO: 2479404 - RNA, 16 nt, Human
aauuuacaaagugugu

SEQ ID NO: 2479405 - RNA, 15 nt, Human
aauuuacaaagugug

SEQ ID NO: 2479406 - RNA, 14 nt, Human
aauuuacauggcaa

SEQ ID NO: 2479407 - RNA, 19 nt, Human
aauuuacauacucugcuua

SEQ ID NO: 2479408 - RNA, 17 nt, Human
aauuuacaaagugugua

SEQ ID NO: 2479409 - RNA, 14 nt, Human
aauuuacaaagugu

SEQ ID NO: 2479410 - RNA, 13 nt, Human
aauuuacaaagug

SEQ ID NO: 2479411 - RNA, 21 nt, Human
aauuuacaaaaauauaaaaua

SEQ ID NO: 2479412 - RNA, 18 nt, Human
aauuuacaaaaauauaaa

SEQ ID NO: 2479413 - RNA, 16 nt, Human
aauuuacaaaaauaua

SEQ ID NO: 2479414 - RNA, 19 nt, Human
aauuuaauucauguuucuu

SEQ ID NO: 2479415 - RNA, 23 nt, Human
aauuuaauucauguuucuuaaau

SEQ ID NO: 2479416 - RNA, 21 nt, Human
aauuuaaaggguguacuuaua

SEQ ID NO: 2479417 - RNA, 19 nt, Human
aauuuaaaggguguacuua

SEQ ID NO: 2479418 - RNA, 22 nt, Human
aauuuaaaggguguacuuauau

SEQ ID NO: 2479419 - RNA, 23 nt, Human
aauuuaagugcguguguagaguu

SEQ ID NO: 2479420 - RNA, 14 nt, Human
aauuuaaauauaau

SEQ ID NO: 2479421 - RNA, 16 nt, Human
aauuuaagugcgugug

SEQ ID NO: 2479422 - RNA, 20 nt, Human
aauuuaagugcguguguaga

SEQ ID NO: 2479423 - RNA, 14 nt, Human
aauuuaaugcaugu

SEQ ID NO: 2479424 - RNA, 14 nt, Human
aauuuaauauagcu

SEQ ID NO: 2479425 - RNA, 21 nt, Human
aauuuaauuagggguugcuaa

SEQ ID NO: 2479426 - RNA, 18 nt, Human
aauuuaauucauguuucu

SEQ ID NO: 2479427 - RNA, 17 nt, Human
aauuuaaacccauuuua

SEQ ID NO: 2479428 - RNA, 19 nt, Human
aauuuaaacaggcccagca

SEQ ID NO: 2479429 - RNA, 20 nt, Human
aauuuaaacaggcccagcau

SEQ ID NO: 2479430 - RNA, 18 nt, Human
aauuuaaacaggcccagc

SEQ ID NO: 2479431 - RNA, 11 nt, Human
aauuuaaacag

SEQ ID NO: 2479432 - RNA, 19 nt, Human
aauuuaaacaccuccucau

SEQ ID NO: 2479433 - RNA, 15 nt, Human
aauuuaaacaccucc

SEQ ID NO: 2479434 - RNA, 10 nt, Human
aauuuaaaca

SEQ ID NO: 2479435 - RNA, 9 nt, Human
aauuuaaac

SEQ ID NO: 2479436 - RNA, 18 nt, Human
aauuuaaaggguguacuu

SEQ ID NO: 2479437 - RNA, 19 nt, Human
aauuuaaacccauuuuagu

SEQ ID NO: 2479438 - RNA, 18 nt, Human
aauuuaaacccauuuuag

SEQ ID NO: 2479439 - RNA, 12 nt, Human
aauuuaaagcaa

SEQ ID NO: 2479440 - RNA, 13 nt, Human
aauuuaaaagucu

SEQ ID NO: 2479441 - RNA, 14 nt, Human
aauuuaaaaaauaa

SEQ ID NO: 2479442 - RNA, 20 nt, Human
aauuguuuugcacuuuuuua

SEQ ID NO: 2479443 - RNA, 17 nt, Human
aauuguuuugcacuuuu

SEQ ID NO: 2479444 - RNA, 16 nt, Human
aauuguuuugcacuuu

SEQ ID NO: 2479445 - RNA, 13 nt, Human
aauuuaaaaaaua

SEQ ID NO: 2479446 - RNA, 16 nt, Human
aauuguuugucuuuaa

SEQ ID NO: 2479447 - RNA, 21 nt, Human
aauugcuuacauuuuuacaau

SEQ ID NO: 2479448 - RNA, 20 nt, Human
aauugcuuacauuuuuacaa

SEQ ID NO: 2479449 - RNA, 15 nt, Human
aauugcuuacauuuu

SEQ ID NO: 2479450 - RNA, 13 nt, Human
aauugcuguguau

SEQ ID NO: 2479451 - RNA, 18 nt, Human
aauugcuguguaucugau

SEQ ID NO: 2479452 - RNA, 22 nt, Human
aauugcugugccucccaaaauu

SEQ ID NO: 2479453 - RNA, 13 nt, Human
aauugcugugccu

SEQ ID NO: 2479454 - RNA, 12 nt, Human
aauugcugugcc

SEQ ID NO: 2479455 - RNA, 23 nt, Human
aauugugugaaagguacuucaaa

SEQ ID NO: 2479456 - RNA, 13 nt, Human
uacuguaagaaaa

SEQ ID NO: 2479457 - RNA, 21 nt, Human
uacuguaaagaaagagagaaa

SEQ ID NO: 2479458 - RNA, 23 nt, Human
uacuguaaagaaagagagaaaau

SEQ ID NO: 2479459 - RNA, 18 nt, Human
uacuguaacacuuuacaa

SEQ ID NO: 2479460 - RNA, 11 nt, Human
uacuguaacac

SEQ ID NO: 2479461 - RNA, 20 nt, Human
uacuguaaagagaccuaccu

SEQ ID NO: 2479462 - RNA, 23 nt, Human
aauugcuauguuuugacauuuuu

SEQ ID NO: 2479463 - RNA, 20 nt, Human
aauugcuccuaagcuucaaa

SEQ ID NO: 2479464 - RNA, 12 nt, Human
aauugcuccuug

SEQ ID NO: 2479465 - RNA, 19 nt, Human
aauuguuguuucuuucuag

SEQ ID NO: 2479466 - RNA, 18 nt, Human
aauuguuguuucuuucua

SEQ ID NO: 2479467 - RNA, 17 nt, Human
aauuguuguuucuuucu

SEQ ID NO: 2479468 - RNA, 15 nt, Human
aauuguuguuucuuu

SEQ ID NO: 2479469 - RNA, 13 nt, Human
aauuguuguuucu

SEQ ID NO: 2479470 - RNA, 12 nt, Human
aauuguuguuuc

SEQ ID NO: 2479471 - RNA, 23 nt, Human
aauuguugcuaaucuucuuaugc

SEQ ID NO: 2479472 - RNA, 23 nt, Human
aauugugugugaugugaagccaa

SEQ ID NO: 2479473 - RNA, 21 nt, Human
aauuguuguuucuuucuagug

SEQ ID NO: 2479474 - RNA, 20 nt, Human
aauuguuguuucuuucuagu

SEQ ID NO: 2479475 - RNA, 13 nt, Human
aauuguuguuugu

SEQ ID NO: 2479476 - RNA, 14 nt, Human
aauuguuguuugua

SEQ ID NO: 2479477 - RNA, 17 nt, Human
aauuguuguuuguaugu

SEQ ID NO: 2479478 - RNA, 19 nt, Human
aauuguuguuuguauguau

SEQ ID NO: 2479479 - RNA, 21 nt, Human
aauuguuguuuguauguauaa

SEQ ID NO: 2479480 - RNA, 22 nt, Human
aauuguuguuuguauguauaau

SEQ ID NO: 2479481 - RNA, 23 nt, Human
aauuguuguuuguauguauaauu

SEQ ID NO: 2479482 - RNA, 22 nt, Human
aauuguuuggggaugagaaagg

SEQ ID NO: 2479483 - RNA, 20 nt, Human
aauuguuuaaguguuguaaa

SEQ ID NO: 2479484 - RNA, 23 nt, Human
aauuguuguuucuuucuaguggu

SEQ ID NO: 2479485 - RNA, 15 nt, Human
aauuguuuaaguguu

SEQ ID NO: 2479486 - RNA, 20 nt, Human
aauuguuucaaaauaaaaac

SEQ ID NO: 2479487 - RNA, 16 nt, Human
aauugacccacaagaa

SEQ ID NO: 2479488 - RNA, 19 nt, Human
aauugacccacaagaaaug

SEQ ID NO: 2479489 - RNA, 15 nt, Human
uacguacacauuuua

SEQ ID NO: 2479490 - RNA, 14 nt, Human
uacguacacauuuu

SEQ ID NO: 2479491 - RNA, 13 nt, Human
aauugacccacaa

SEQ ID NO: 2479492 - RNA, 22 nt, Human
aauugaacuuaaauaaauguca

SEQ ID NO: 2479493 - RNA, 22 nt, Human
aauugaaaggcauucucugaag

SEQ ID NO: 2479494 - RNA, 17 nt, Human
aauugaaaggcauucuc

SEQ ID NO: 2479495 - RNA, 21 nt, Human
aauugaaaggcauucucugaa

SEQ ID NO: 2479496 - RNA, 21 nt, Human
aauugaacuuaaauaaauguc

SEQ ID NO: 2479497 - RNA, 18 nt, Human
aauucuuugaccuguugg

SEQ ID NO: 2479498 - RNA, 22 nt, Human
aauucuuugaccuguugggagu

SEQ ID NO: 2479499 - RNA, 13 nt, Human
aauucuuuauaca

SEQ ID NO: 2479500 - RNA, 15 nt, Human
aauucuuguauauua

SEQ ID NO: 2479501 - RNA, 16 nt, Human
aauucuuguauauuau

SEQ ID NO: 2479502 - RNA, 22 nt, Human
aauucuuuauacaacagugcua

SEQ ID NO: 2479503 - RNA, 21 nt, Human
aauucuuuauacaacagugcu

SEQ ID NO: 2479504 - RNA, 20 nt, Human
aauucuuuauacaacagugc

SEQ ID NO: 2479505 - RNA, 19 nt, Human
aauucuuuauacaacagug

SEQ ID NO: 2479506 - RNA, 14 nt, Human
aauucuuuauacaa

SEQ ID NO: 2479507 - RNA, 20 nt, Human
aauucuuguauauuauggaa

SEQ ID NO: 2479508 - RNA, 18 nt, Human
aauucuugguugaggaaa

SEQ ID NO: 2479509 - RNA, 19 nt, Human
aauucuugguugaggaaac

SEQ ID NO: 2479510 - RNA, 20 nt, Human
aauucuugguugaggaaaca

SEQ ID NO: 2479511 - RNA, 14 nt, Human
aauucuuguauauu

SEQ ID NO: 2479512 - RNA, 13 nt, Human
aauucuuggaaua

SEQ ID NO: 2479513 - RNA, 15 nt, Human
aauucuuggaauacu

SEQ ID NO: 2479514 - RNA, 23 nt, Human
aauucuucugaacucaaacugag

SEQ ID NO: 2479515 - RNA, 14 nt, Human
aauucuugcaaagu

SEQ ID NO: 2479516 - RNA, 20 nt, Human
aauucuugcaaaguaucccu

SEQ ID NO: 2479517 - RNA, 21 nt, Human
aauucuugccaaauauaaaua

SEQ ID NO: 2479518 - RNA, 21 nt, Human
aauucuugaaggaaaaugaua

SEQ ID NO: 2479519 - RNA, 16 nt, Human
aauucuugaaggaaaa

SEQ ID NO: 2479520 - RNA, 15 nt, Human
aauucuucugaacuc

SEQ ID NO: 2479521 - RNA, 18 nt, Human
aauucuucugaacucaaa

SEQ ID NO: 2479522 - RNA, 15 nt, Human
aauucuugaaggaaa

SEQ ID NO: 2479523 - RNA, 22 nt, Human
aauucuucuccacuuucuagcc

SEQ ID NO: 2479524 - RNA, 13 nt, Human
aauucuucugaac

SEQ ID NO: 2479525 - RNA, 21 nt, Human
aauucuucccuaucuuugcca

SEQ ID NO: 2479526 - RNA, 11 nt, Human
aauucuucccu

SEQ ID NO: 2479527 - RNA, 18 nt, Human
aauucuucagguggaaaa

SEQ ID NO: 2479528 - RNA, 19 nt, Human
uacccuuuuucuccagcug

SEQ ID NO: 2479529 - RNA, 18 nt, Human
uacccuuuuucuccagcu

SEQ ID NO: 2479530 - RNA, 17 nt, Human
uacccuuuuucuccagc

SEQ ID NO: 2479531 - RNA, 20 nt, Human
uacccuuuagacuguagccu

SEQ ID NO: 2479532 - RNA, 20 nt, Human
uacccuuggcucaauccucu

SEQ ID NO: 2479533 - RNA, 18 nt, Human
uacccuggccgcccccug

SEQ ID NO: 2479534 - RNA, 23 nt, Human
uacccugcgcccaguccuuccac

SEQ ID NO: 2479535 - RNA, 21 nt, Human
uacccugcgcccaguccuucc

SEQ ID NO: 2479536 - RNA, 15 nt, Human
aauucuuaugcuuau

SEQ ID NO: 2479537 - RNA, 15 nt, Human
aauucuuacauguuu

SEQ ID NO: 2479538 - RNA, 16 nt, Human
aauucuuaaguauguu

SEQ ID NO: 2479539 - RNA, 13 nt, Human
aauucuuacaugu

SEQ ID NO: 2479540 - RNA, 13 nt, Human
aauucuuaaauau

SEQ ID NO: 2479541 - RNA, 17 nt, Human
aauucuuacaaacaugu

SEQ ID NO: 2479542 - RNA, 17 nt, Human
uacuguaaagaaagaga

SEQ ID NO: 2479543 - RNA, 18 nt, Human
uacuguaaagaaagagag

SEQ ID NO: 2479544 - RNA, 19 nt, Human
uacuguaaagaaagagaga

SEQ ID NO: 2479545 - RNA, 20 nt, Human
uacuguaaagaaagagagaa

SEQ ID NO: 2479546 - RNA, 13 nt, Human
uacuguaaagaaa

SEQ ID NO: 2479547 - RNA, 16 nt, Human
uacuguaaagaaagag

SEQ ID NO: 2479548 - RNA, 12 nt, Human
uacuguaaagaa

SEQ ID NO: 2479549 - RNA, 23 nt, Human
uacugacacuuugccagaaagca

SEQ ID NO: 2479550 - RNA, 17 nt, Human
uacugaagguaaaauug

SEQ ID NO: 2479551 - RNA, 13 nt, Human
uacugacaugugg

SEQ ID NO: 2479552 - RNA, 19 nt, Human
uacuggugcagucauuaug

SEQ ID NO: 2479553 - RNA, 23 nt, Human
uacugaaggaaaaacacaagcaa

SEQ ID NO: 2479554 - RNA, 20 nt, Human
uacugaaggaaaaacacaag

SEQ ID NO: 2479555 - RNA, 19 nt, Human
uacugaaggaaaaacacaa

SEQ ID NO: 2479556 - RNA, 18 nt, Human
uacugaaggaaaaacaca

SEQ ID NO: 2479557 - RNA, 14 nt, Human
uacugaaggaaaaa

SEQ ID NO: 2479558 - RNA, 13 nt, Human
uacugaaggaaaa

SEQ ID NO: 2479559 - RNA, 12 nt, Human
uacugaaggaaa

SEQ ID NO: 2479560 - RNA, 22 nt, Human
uacugaagaugcagcaaaaugu

SEQ ID NO: 2479561 - RNA, 14 nt, Human
uacucuucuugaaa

SEQ ID NO: 2479562 - RNA, 17 nt, Human
uacucuucuugaaauuu

SEQ ID NO: 2479563 - RNA, 18 nt, Human
uacucuucuugaaauuuu

SEQ ID NO: 2479564 - RNA, 22 nt, Human
uacucaauugauaaacauuuaa

SEQ ID NO: 2479565 - RNA, 14 nt, Human
uacucaauggauuu

SEQ ID NO: 2479566 - RNA, 22 nt, Human
uacucaauguuacuaucugcuu

SEQ ID NO: 2479567 - RNA, 21 nt, Human
uacucugugucagguggggca

SEQ ID NO: 2479568 - RNA, 17 nt, Human
uacucuuaagccaucuu

SEQ ID NO: 2479569 - RNA, 16 nt, Human
uacucuuaagccaucu

SEQ ID NO: 2479570 - RNA, 15 nt, Human
uacucuuaagccauc

SEQ ID NO: 2479571 - RNA, 14 nt, Human
uacucuuaagccau

SEQ ID NO: 2479572 - RNA, 14 nt, Human
uacucuguuccuuc

SEQ ID NO: 2479573 - RNA, 19 nt, Human
uacucuguuccuucacauc

SEQ ID NO: 2479574 - RNA, 18 nt, Human
uacucuuauagacaacau

SEQ ID NO: 2479575 - RNA, 23 nt, Human
uacucuuaagccaucuugguaaa

SEQ ID NO: 2479576 - RNA, 22 nt, Human
uacucuuaagccaucuugguaa

SEQ ID NO: 2479577 - RNA, 21 nt, Human
uacucuuaagccaucuuggua

SEQ ID NO: 2479578 - RNA, 20 nt, Human
uacucuuaagccaucuuggu

SEQ ID NO: 2479579 - RNA, 20 nt, Human
uacucuuaaguuucucagcu

SEQ ID NO: 2479580 - RNA, 15 nt, Human
uacucuuaaguuucu

SEQ ID NO: 2479581 - RNA, 18 nt, Human
uacucuuaggaagagaaa

SEQ ID NO: 2479582 - RNA, 22 nt, Human
uacucuucaguuaagccuuugg

SEQ ID NO: 2479583 - RNA, 12 nt, Human
uacucuuccgaa

SEQ ID NO: 2479584 - RNA, 21 nt, Human
uacucuuaaguuucucagcuc

SEQ ID NO: 2479585 - RNA, 21 nt, Human
uacucuuaggaagagaaacca

SEQ ID NO: 2479586 - RNA, 16 nt, Human
uacuauaauuuaccug

SEQ ID NO: 2479587 - RNA, 14 nt, Human
uacuaguuacacau

SEQ ID NO: 2479588 - RNA, 19 nt, Human
uacuaguuacacaucuuca

SEQ ID NO: 2479589 - RNA, 21 nt, Human
uacuaguugugaccuuagugu

SEQ ID NO: 2479590 - RNA, 16 nt, Human
uacuauguaucaauga

SEQ ID NO: 2479591 - RNA, 22 nt, Human
uacuauucaguggcgagaaaua

SEQ ID NO: 2479592 - RNA, 11 nt, Human
uacuauuuaaa

SEQ ID NO: 2479593 - RNA, 14 nt, Human
uacucaacccucuc

SEQ ID NO: 2479594 - RNA, 23 nt, Human
uacucaacccucucaggugacca

SEQ ID NO: 2479595 - RNA, 15 nt, Human
uacucaagaggcuga

SEQ ID NO: 2479596 - RNA, 19 nt, Human
uacucaagaggcugaggca

SEQ ID NO: 2479597 - RNA, 15 nt, Human
uacucaagcccgcgg

SEQ ID NO: 2479598 - RNA, 19 nt, Human
uacuagguaacuucauauu

SEQ ID NO: 2479599 - RNA, 22 nt, Human
uacguuccuauugucauuaaag

SEQ ID NO: 2479600 - RNA, 18 nt, Human
uacguuccuauugucauu

SEQ ID NO: 2479601 - RNA, 15 nt, Human
uacuagguaacuuca

SEQ ID NO: 2479602 - RNA, 16 nt, Human
uacuagguaacuucau

SEQ ID NO: 2479603 - RNA, 15 nt, Human
uacguuccuauuguc

SEQ ID NO: 2479604 - RNA, 16 nt, Human
uacguuauuguugacu

SEQ ID NO: 2479605 - RNA, 15 nt, Human
uacguuauuguugac

SEQ ID NO: 2479606 - RNA, 13 nt, Human
uacguugugcauu

SEQ ID NO: 2479607 - RNA, 14 nt, Human
uacguugugcauuu

SEQ ID NO: 2479608 - RNA, 15 nt, Human
uacgugugauuuuuc

SEQ ID NO: 2479609 - RNA, 14 nt, Human
uacguuaccaggca

SEQ ID NO: 2479610 - RNA, 15 nt, Human
uacguguagcuauau

SEQ ID NO: 2479611 - RNA, 18 nt, Human
uacgucaaacaugaagug

SEQ ID NO: 2479612 - RNA, 14 nt, Human
uacgucugacaggc

SEQ ID NO: 2479613 - RNA, 16 nt, Human
uacguacaugugaggc

SEQ ID NO: 2479614 - RNA, 13 nt, Human
uacguaugagacg

SEQ ID NO: 2479615 - RNA, 17 nt, Human
acagucucaggaaauca

SEQ ID NO: 2479616 - RNA, 14 nt, Human
acagucucuuuaau

SEQ ID NO: 2479617 - RNA, 19 nt, Human
acagucucuuuaaucuuca

SEQ ID NO: 2479618 - RNA, 13 nt, Human
acagucugucaug

SEQ ID NO: 2479619 - RNA, 22 nt, Human
acagucugaucgugacgcugaa

SEQ ID NO: 2479620 - RNA, 20 nt, Human
acagucugaucgugacgcug

SEQ ID NO: 2479621 - RNA, 19 nt, Human
acagucugaucgugacgcu

SEQ ID NO: 2479622 - RNA, 20 nt, Human
acagucucuuuaaucuucag

SEQ ID NO: 2479623 - RNA, 14 nt, Human
acagucuuccauuu

SEQ ID NO: 2479624 - RNA, 19 nt, Human
acagucuuccauuugcaag

SEQ ID NO: 2479625 - RNA, 14 nt, Human
acagucuuguauua

SEQ ID NO: 2479626 - RNA, 20 nt, Human
acagugaaagaaaauaacaa

SEQ ID NO: 2479627 - RNA, 18 nt, Human
acagugaaaauguaagcu

SEQ ID NO: 2479628 - RNA, 14 nt, Human
acagugaaaaugua

SEQ ID NO: 2479629 - RNA, 15 nt, Human
acagucuugcagcag

SEQ ID NO: 2479630 - RNA, 22 nt, Human
acagucuuguauuaaguuguua

SEQ ID NO: 2479631 - RNA, 18 nt, Human
acagucuuguauuaaguu

SEQ ID NO: 2479632 - RNA, 15 nt, Human
acagucuuguauuaa

SEQ ID NO: 2479633 - RNA, 13 nt, Human
acagucucaggaa

SEQ ID NO: 2479634 - RNA, 14 nt, Human
acagucucaggaaa

SEQ ID NO: 2479635 - RNA, 15 nt, Human
acagucucaggaaau

SEQ ID NO: 2479636 - RNA, 16 nt, Human
acagucucaggaaauc

SEQ ID NO: 2479637 - RNA, 22 nt, Human
acaguccuuaccagcagagcac

SEQ ID NO: 2479638 - RNA, 21 nt, Human
acaguccuuaccagcagagca

SEQ ID NO: 2479639 - RNA, 23 nt, Human
acaguccucuccaccuaguggcu

SEQ ID NO: 2479640 - RNA, 23 nt, Human
acaguccugggagaaccucaggc

SEQ ID NO: 2479641 - RNA, 21 nt, Human
acaguccugggagaaccucag

SEQ ID NO: 2479642 - RNA, 22 nt, Human
acaguccugggagaaccucagg

SEQ ID NO: 2479643 - RNA, 13 nt, Human
acagucuaauuuu

SEQ ID NO: 2479644 - RNA, 14 nt, Human
acagucuaauuuuu

SEQ ID NO: 2479645 - RNA, 21 nt, Human
acagucuaauuuuuauucaua

SEQ ID NO: 2479646 - RNA, 18 nt, Human
acagucuaauuuuuauuc

SEQ ID NO: 2479647 - RNA, 22 nt, Human
acagucuaauuuuuauucauaa

SEQ ID NO: 2479648 - RNA, 19 nt, Human
acaguguugaaaauguuca

SEQ ID NO: 2479649 - RNA, 21 nt, Human
acaguguugaaaauguucaga

SEQ ID NO: 2479650 - RNA, 22 nt, Human
acaguguucuguuuaauacuca

SEQ ID NO: 2479651 - RNA, 9 nt, Human
acaguguuu

SEQ ID NO: 2479652 - RNA, 15 nt, Human
acaguguuucccaua

SEQ ID NO: 2479653 - RNA, 16 nt, Human
acaguguuucccauaa

SEQ ID NO: 2479654 - RNA, 18 nt, Human
acaguguuucccauaauu

SEQ ID NO: 2479655 - RNA, 22 nt, Human
acaguguuucccauaauuuucu

SEQ ID NO: 2479656 - RNA, 23 nt, Human
acaguguuaggccuggcacagug

SEQ ID NO: 2479657 - RNA, 22 nt, Human
acaguguuaggccuggcacagu

SEQ ID NO: 2479658 - RNA, 21 nt, Human
acaguguuaggccuggcacag

SEQ ID NO: 2479659 - RNA, 19 nt, Human
acaguguuaggccuggcac

SEQ ID NO: 2479660 - RNA, 11 nt, Human
acaguguuccg

SEQ ID NO: 2479661 - RNA, 17 nt, Human
acaguguucuguuuaau

SEQ ID NO: 2479662 - RNA, 16 nt, Human
acaguguucuguuuaa

SEQ ID NO: 2479663 - RNA, 15 nt, Human
acaguguucuguuua

SEQ ID NO: 2479664 - RNA, 14 nt, Human
acaguguucuguuu

SEQ ID NO: 2479665 - RNA, 16 nt, Human
acaguguuauuuucuu

SEQ ID NO: 2479666 - RNA, 20 nt, Human
acaguguuauuuucuuugaa

SEQ ID NO: 2479667 - RNA, 13 nt, Human
acaguguucuguu

SEQ ID NO: 2479668 - RNA, 22 nt, Human
acaguguuauuuucuuugaaau

SEQ ID NO: 2479669 - RNA, 15 nt, Human
acaguuaagagaaau

SEQ ID NO: 2479670 - RNA, 22 nt, Human
acaguguuuuuguaaagugugg

SEQ ID NO: 2479671 - RNA, 20 nt, Human
acaguguuuuuguaaagugu

SEQ ID NO: 2479672 - RNA, 18 nt, Human
acaguguuuuuguaaagu

SEQ ID NO: 2479673 - RNA, 16 nt, Human
acaguguuuuuguaaa

SEQ ID NO: 2479674 - RNA, 17 nt, Human
acaguguuugcaauggu

SEQ ID NO: 2479675 - RNA, 23 nt, Human
acaguguuucccauaauuuucuu

SEQ ID NO: 2479676 - RNA, 19 nt, Human
acaguguuucgacagcuga

SEQ ID NO: 2479677 - RNA, 21 nt, Human
acaguuaccucugccucagaa

SEQ ID NO: 2479678 - RNA, 16 nt, Human
acaguuaacuuucaga

SEQ ID NO: 2479679 - RNA, 13 nt, Human
acaguuaacuuuc

SEQ ID NO: 2479680 - RNA, 14 nt, Human
acaguuaacuuuca

SEQ ID NO: 2479681 - RNA, 21 nt, Human
acaguuaaaugagaacaugaa

SEQ ID NO: 2479682 - RNA, 14 nt, Human
acagugagacucug

SEQ ID NO: 2479683 - RNA, 18 nt, Human
acagugagacucugucuc

SEQ ID NO: 2479684 - RNA, 23 nt, Human
acagugacucgggcuccugugcc

SEQ ID NO: 2479685 - RNA, 20 nt, Human
acagugacucgggcuccugu

SEQ ID NO: 2479686 - RNA, 19 nt, Human
acagugacucgggcuccug

SEQ ID NO: 2479687 - RNA, 18 nt, Human
acagugacucgggcuccu

SEQ ID NO: 2479688 - RNA, 21 nt, Human
acagugaaaauguaagcuguu

SEQ ID NO: 2479689 - RNA, 14 nt, Human
acagugaagcaaau

SEQ ID NO: 2479690 - RNA, 17 nt, Human
acagugaaggcuguccu

SEQ ID NO: 2479691 - RNA, 13 nt, Human
acagugugaaguu

SEQ ID NO: 2479692 - RNA, 12 nt, Human
acagugugaagu

SEQ ID NO: 2479693 - RNA, 24 nt, Human
acagugucuguaucggagacagug

SEQ ID NO: 2479694 - RNA, 13 nt, Human
acagugagccaag

SEQ ID NO: 2479695 - RNA, 12 nt, Human
acagugagccaa

SEQ ID NO: 2479696 - RNA, 12 nt, Human
acagugagccug

SEQ ID NO: 2479697 - RNA, 14 nt, Human
acagugagccugaa

SEQ ID NO: 2479698 - RNA, 17 nt, Human
acaguguuaggccuggc

SEQ ID NO: 2479699 - RNA, 14 nt, Human
acaguguuaaauga

SEQ ID NO: 2479700 - RNA, 19 nt, Human
acagugugaaguuagaauu

SEQ ID NO: 2479701 - RNA, 18 nt, Human
acagugugaaguuagaau

SEQ ID NO: 2479702 - RNA, 16 nt, Human
acagugugaaguuaga

SEQ ID NO: 2479703 - RNA, 15 nt, Human
acagugugaaguuag

SEQ ID NO: 2479704 - RNA, 22 nt, Human
acagugugaaguuagaauuccu

SEQ ID NO: 2479705 - RNA, 15 nt, Human
acaguccucccaucu

SEQ ID NO: 2479706 - RNA, 14 nt, Human
acaguccucccauc

SEQ ID NO: 2479707 - RNA, 13 nt, Human
acaguccucccau

SEQ ID NO: 2479708 - RNA, 15 nt, Human
acagucccugccaau

SEQ ID NO: 2479709 - RNA, 20 nt, Human
acaguccuuaccagcagagc

SEQ ID NO: 2479710 - RNA, 18 nt, Human
acaguccuuaccagcaga

SEQ ID NO: 2479711 - RNA, 17 nt, Human
acaguccucccaucuca

SEQ ID NO: 2479712 - RNA, 19 nt, Human
acaguccuaacugguauag

SEQ ID NO: 2479713 - RNA, 12 nt, Human
acaguccuggga

SEQ ID NO: 2479714 - RNA, 18 nt, Human
acaguccuaacugguaua

SEQ ID NO: 2479715 - RNA, 18 nt, Human
acagucaaaacagagaug

SEQ ID NO: 2479716 - RNA, 19 nt, Human
acaguauuacuucugcuac

SEQ ID NO: 2479717 - RNA, 17 nt, Human
acaguauuacuucugcu

SEQ ID NO: 2479718 - RNA, 16 nt, Human
acaguauuacuucugc

SEQ ID NO: 2479719 - RNA, 15 nt, Human
acaguauuacuucug

SEQ ID NO: 2479720 - RNA, 17 nt, Human
acaguauuuugguucuu

SEQ ID NO: 2479721 - RNA, 13 nt, Human
acagucccugcca

SEQ ID NO: 2479722 - RNA, 12 nt, Human
acagucccugcc

SEQ ID NO: 2479723 - RNA, 16 nt, Human
acagucaaaacagaga

SEQ ID NO: 2479724 - RNA, 17 nt, Human
acagucaaaacagagau

SEQ ID NO: 2479725 - RNA, 17 nt, Human
acagucaaggaguggcu

SEQ ID NO: 2479726 - RNA, 23 nt, Human
acaguaaauaaauuguuugacca

SEQ ID NO: 2479727 - RNA, 15 nt, Human
acaguaaauaaauug

SEQ ID NO: 2479728 - RNA, 14 nt, Human
acaguaaauaaauu

SEQ ID NO: 2479729 - RNA, 13 nt, Human
acaguaaauaaau

SEQ ID NO: 2479730 - RNA, 19 nt, Human
acaguaacgcaggggaaac

SEQ ID NO: 2479731 - RNA, 17 nt, Human
acaguaacgcaggggaa

SEQ ID NO: 2479732 - RNA, 18 nt, Human
acaguaaauaaauuguuu

SEQ ID NO: 2479733 - RNA, 17 nt, Human
acaguaaauaaauuguu

SEQ ID NO: 2479734 - RNA, 12 nt, Human
acaguaaauaaa

SEQ ID NO: 2479735 - RNA, 12 nt, Human
acaguaaacauu

SEQ ID NO: 2479736 - RNA, 24 nt, Human
acagggcaugccccggccaccucu

SEQ ID NO: 2479737 - RNA, 23 nt, Human
acagggcaugccccggccaccuc

SEQ ID NO: 2479738 - RNA, 22 nt, Human
acagggcaugccccggccaccu

SEQ ID NO: 2479739 - RNA, 21 nt, Human
acagggcaucuccaggaaggc

SEQ ID NO: 2479740 - RNA, 21 nt, Human
acaguauggcagcuuuccuca

SEQ ID NO: 2479741 - RNA, 23 nt, Human
acaguaugagucaaugugcagug

SEQ ID NO: 2479742 - RNA, 21 nt, Human
acaguaugagucaaugugcag

SEQ ID NO: 2479743 - RNA, 17 nt, Human
acaguaugucccauagg

SEQ ID NO: 2479744 - RNA, 19 nt, Human
acaguaugagucaaugugc

SEQ ID NO: 2479745 - RNA, 23 nt, Human
acaguaucacugucuuuccuaga

SEQ ID NO: 2479746 - RNA, 10 nt, Human
acaguaacuu

SEQ ID NO: 2479747 - RNA, 21 nt, Human
acaguaucacugucuuuccua

SEQ ID NO: 2479748 - RNA, 17 nt, Human
acaggcugggcuucagu

SEQ ID NO: 2479749 - RNA, 14 nt, Human
acaggcugggcuuc

SEQ ID NO: 2479750 - RNA, 21 nt, Human
acaggcugggcuucaguggca

SEQ ID NO: 2479751 - RNA, 22 nt, Human
acagggcacaccgggcacucag

SEQ ID NO: 2479752 - RNA, 16 nt, Human
acagggcagagccggg

SEQ ID NO: 2479753 - RNA, 22 nt, Human
acagguuuuccugaagaauuga

SEQ ID NO: 2479754 - RNA, 17 nt, Human
acagggcaucuccagga

SEQ ID NO: 2479755 - RNA, 21 nt, Human
acagggcagcugggcccaacc

SEQ ID NO: 2479756 - RNA, 16 nt, Human
acagggcaucuccagg

SEQ ID NO: 2479757 - RNA, 18 nt, Human
acagggcagcugggccca

SEQ ID NO: 2479758 - RNA, 17 nt, Human
acagggcagcugggccc

SEQ ID NO: 2479759 - RNA, 16 nt, Human
acagggcagcugggcc

SEQ ID NO: 2479760 - RNA, 21 nt, Human
uauuaaacagauuuuuacaaa

SEQ ID NO: 2479761 - RNA, 20 nt, Human
uauuaaacagauuuuuacaa

SEQ ID NO: 2479762 - RNA, 12 nt, Human
uauuaaaacuca

SEQ ID NO: 2479763 - RNA, 23 nt, Human
uauuaaaaaucucaaauuucuaa

SEQ ID NO: 2479764 - RNA, 22 nt, Human
uauuaaaaauauggaacuucua

SEQ ID NO: 2479765 - RNA, 20 nt, Human
uauuaaaaauauggaacuuc

SEQ ID NO: 2479766 - RNA, 23 nt, Human
uauuaaacagauuuuuacaaaug

SEQ ID NO: 2479767 - RNA, 21 nt, Human
uauuaaacguaugcaugugaa

SEQ ID NO: 2479768 - RNA, 20 nt, Human
uauuaaacguaugcauguga

SEQ ID NO: 2479769 - RNA, 22 nt, Human
uauuaaacguaugcaugugaag

SEQ ID NO: 2479770 - RNA, 12 nt, Human
uauuaaagacag

SEQ ID NO: 2479771 - RNA, 18 nt, Human
uauuaaauacaaaacuuc

SEQ ID NO: 2479772 - RNA, 12 nt, Human
uauuaaauacag

SEQ ID NO: 2479773 - RNA, 19 nt, Human
uauuaaauacaaaacuucc

SEQ ID NO: 2479774 - RNA, 16 nt, Human
uauuaaauacaaaacu

SEQ ID NO: 2479775 - RNA, 12 nt, Human
uauuacaucuuu

SEQ ID NO: 2479776 - RNA, 16 nt, Human
uauuacauggcagugu

SEQ ID NO: 2479777 - RNA, 17 nt, Human
uauuacaucuuucacau

SEQ ID NO: 2479778 - RNA, 16 nt, Human
uauuaaaaaucucaaa

SEQ ID NO: 2479779 - RNA, 18 nt, Human
uauuaaaaaucucaaauu

SEQ ID NO: 2479780 - RNA, 20 nt, Human
uauuaaaaaucucaaauuuc

SEQ ID NO: 2479781 - RNA, 22 nt, Human
uauuaaaaaucucaaauuucua

SEQ ID NO: 2479782 - RNA, 19 nt, Human
uauguuuuaagaggcaggg

SEQ ID NO: 2479783 - RNA, 17 nt, Human
uauguuuuaagaggcag

SEQ ID NO: 2479784 - RNA, 23 nt, Human
uauguguguguguuguguguggg

SEQ ID NO: 2479785 - RNA, 14 nt, Human
uauguuuuagcaug

SEQ ID NO: 2479786 - RNA, 16 nt, Human
uauguuuuagcaugug

SEQ ID NO: 2479787 - RNA, 22 nt, Human
uauguuuguauaaugaaugaga

SEQ ID NO: 2479788 - RNA, 22 nt, Human
uauuaaaaauauaaaacugcgu

SEQ ID NO: 2479789 - RNA, 18 nt, Human
uauguuuuagcauguguu

SEQ ID NO: 2479790 - RNA, 14 nt, Human
uauguguguguguu

SEQ ID NO: 2479791 - RNA, 22 nt, Human
uauguguguguguugugugugg

SEQ ID NO: 2479792 - RNA, 11 nt, Human
uaugugugugu

SEQ ID NO: 2479793 - RNA, 12 nt, Human
uaugugugugua

SEQ ID NO: 2479794 - RNA, 13 nt, Human
uauguguguguau

SEQ ID NO: 2479795 - RNA, 19 nt, Human
uauguguguguaugcuacu

SEQ ID NO: 2479796 - RNA, 19 nt, Human
uauguguguguauguuugc

SEQ ID NO: 2479797 - RNA, 23 nt, Human
acagcuggguggcacugccaugc

SEQ ID NO: 2479798 - RNA, 20 nt, Human
acagcuggguggcacugcca

SEQ ID NO: 2479799 - RNA, 19 nt, Human
acagcuggguggcacugcc

SEQ ID NO: 2479800 - RNA, 18 nt, Human
acagcuggguggcacugc

SEQ ID NO: 2479801 - RNA, 12 nt, Human
uauguguguaua

SEQ ID NO: 2479802 - RNA, 19 nt, Human
uauguguguauauguaugu

SEQ ID NO: 2479803 - RNA, 12 nt, Human
uauguguguaug

SEQ ID NO: 2479804 - RNA, 21 nt, Human
uauguguguaugggugugugu

SEQ ID NO: 2479805 - RNA, 16 nt, Human
acagcuggguggcacu

SEQ ID NO: 2479806 - RNA, 13 nt, Human
acagcugggcugu

SEQ ID NO: 2479807 - RNA, 21 nt, Human
acagcugcuuucuguugucau

SEQ ID NO: 2479808 - RNA, 15 nt, Human
acagcugcuuucugu

SEQ ID NO: 2479809 - RNA, 13 nt, Human
acagcugcuuucu

SEQ ID NO: 2479810 - RNA, 11 nt, Human
acagcugcugg

SEQ ID NO: 2479811 - RNA, 13 nt, Human
acagcuggccucc

SEQ ID NO: 2479812 - RNA, 23 nt, Human
acagcugcuuucuguugucauug

SEQ ID NO: 2479813 - RNA, 14 nt, Human
acagcucccucugc

SEQ ID NO: 2479814 - RNA, 17 nt, Human
acagcucccucugccug

SEQ ID NO: 2479815 - RNA, 18 nt, Human
acagcucccaccccaccc

SEQ ID NO: 2479816 - RNA, 22 nt, Human
acagcucccaccccacccccuu

SEQ ID NO: 2479817 - RNA, 14 nt, Human
acagcuccucccac

SEQ ID NO: 2479818 - RNA, 12 nt, Human
acagcuccuccc

SEQ ID NO: 2479819 - RNA, 22 nt, Human
acagcugcuccuagagggaggg

SEQ ID NO: 2479820 - RNA, 23 nt, Human
acagcugcuccuagagggagggg

SEQ ID NO: 2479821 - RNA, 21 nt, Human
acagcugcuccuagagggagg

SEQ ID NO: 2479822 - RNA, 16 nt, Human
acagcucccucugccu

SEQ ID NO: 2479823 - RNA, 15 nt, Human
uauuagaugugauuu

SEQ ID NO: 2479824 - RNA, 14 nt, Human
uauuagaugugauu

SEQ ID NO: 2479825 - RNA, 13 nt, Human
uauuagaugugau

SEQ ID NO: 2479826 - RNA, 15 nt, Human
uauuagagugucuuu

SEQ ID NO: 2479827 - RNA, 18 nt, Human
uauuagagugucuuucca

SEQ ID NO: 2479828 - RNA, 16 nt, Human
uauuagagcauugaau

SEQ ID NO: 2479829 - RNA, 12 nt, Human
uauuagagaaga

SEQ ID NO: 2479830 - RNA, 19 nt, Human
uauuaccucugauaccuca

SEQ ID NO: 2479831 - RNA, 14 nt, Human
uauuaccucugaua

SEQ ID NO: 2479832 - RNA, 16 nt, Human
uauuaccacagacaua

SEQ ID NO: 2479833 - RNA, 21 nt, Human
uauuacccccuccuucagaca

SEQ ID NO: 2479834 - RNA, 15 nt, Human
uauuaccaugagaag

SEQ ID NO: 2479835 - RNA, 15 nt, Human
uauuagaauaccaca

SEQ ID NO: 2479836 - RNA, 22 nt, Human
uauuacccccuccuucagacac

SEQ ID NO: 2479837 - RNA, 13 nt, Human
uauuaccucugau

SEQ ID NO: 2479838 - RNA, 11 nt, Human
uauuaccucug

SEQ ID NO: 2479839 - RNA, 15 nt, Human
uauuagauguucucu

SEQ ID NO: 2479840 - RNA, 14 nt, Human
uauuagauguucuc

SEQ ID NO: 2479841 - RNA, 20 nt, Human
uauuagaugugauuuaauag

SEQ ID NO: 2479842 - RNA, 16 nt, Human
uauuagaugugauuua

SEQ ID NO: 2479843 - RNA, 12 nt, Human
uauuagauguuc

SEQ ID NO: 2479844 - RNA, 21 nt, Human
uauuagauguucucuaucauu

SEQ ID NO: 2479845 - RNA, 17 nt, Human
uauuagauguucucuau

SEQ ID NO: 2479846 - RNA, 22 nt, Human
uauuagauguucucuaucauuu

SEQ ID NO: 2479847 - RNA, 23 nt, Human
uauuagaugugauuuaauagugu

SEQ ID NO: 2479848 - RNA, 23 nt, Human
uauuagccaggaucaugguguaa

SEQ ID NO: 2479849 - RNA, 16 nt, Human
uauuagccagucuuua

SEQ ID NO: 2479850 - RNA, 21 nt, Human
uauuagccagguaaugugaau

SEQ ID NO: 2479851 - RNA, 19 nt, Human
uauuagccaggaucauggu

SEQ ID NO: 2479852 - RNA, 18 nt, Human
uauuagccaggaucaugg

SEQ ID NO: 2479853 - RNA, 17 nt, Human
uauuagccaggaucaug

SEQ ID NO: 2479854 - RNA, 13 nt, Human
uauuagccaggau

SEQ ID NO: 2479855 - RNA, 15 nt, Human
uauuagccacaaaau

SEQ ID NO: 2479856 - RNA, 23 nt, Human
uauuagccacaaaauugggaaag

SEQ ID NO: 2479857 - RNA, 16 nt, Human
uauuagugaugucauc

SEQ ID NO: 2479858 - RNA, 16 nt, Human
uauuaguguaugcuuu

SEQ ID NO: 2479859 - RNA, 13 nt, Human
uauuaguuaauau

SEQ ID NO: 2479860 - RNA, 14 nt, Human
uauuauaaauuaug

SEQ ID NO: 2479861 - RNA, 14 nt, Human
uauuaguuuugauu

SEQ ID NO: 2479862 - RNA, 14 nt, Human
uauucauaauuauu

SEQ ID NO: 2479863 - RNA, 16 nt, Human
uauucauaguuuaauu

SEQ ID NO: 2479864 - RNA, 23 nt, Human
uauucauagcagcuuauucacaa

SEQ ID NO: 2479865 - RNA, 21 nt, Human
uauucauauuuucuuucaaaa

SEQ ID NO: 2479866 - RNA, 22 nt, Human
uauucaggaagcucagggccug

SEQ ID NO: 2479867 - RNA, 18 nt, Human
uauucaggaagcucaggg

SEQ ID NO: 2479868 - RNA, 16 nt, Human
uauucaggagaguaga

SEQ ID NO: 2479869 - RNA, 12 nt, Human
uauucaggacuu

SEQ ID NO: 2479870 - RNA, 20 nt, Human
uauuauaaauuauguuuaua

SEQ ID NO: 2479871 - RNA, 16 nt, Human
uauuauaaauuauguu

SEQ ID NO: 2479872 - RNA, 15 nt, Human
uauuauaaauuaugu

SEQ ID NO: 2479873 - RNA, 18 nt, Human
uauuauaaauuauguuua

SEQ ID NO: 2479874 - RNA, 16 nt, Human
uauucaaguuauugua

SEQ ID NO: 2479875 - RNA, 20 nt, Human
uauucaaguuauuguacagc

SEQ ID NO: 2479876 - RNA, 19 nt, Human
uauucaacucauaagacuu

SEQ ID NO: 2479877 - RNA, 22 nt, Human
uauucagacaagcaacagguuu

SEQ ID NO: 2479878 - RNA, 18 nt, Human
uauucagacaagcaacag

SEQ ID NO: 2479879 - RNA, 14 nt, Human
uauucagacaagca

SEQ ID NO: 2479880 - RNA, 18 nt, Human
uauuguauuuauuccaua

SEQ ID NO: 2479881 - RNA, 15 nt, Human
uauuguauuuauucc

SEQ ID NO: 2479882 - RNA, 20 nt, Human
uauuguauuuauucaauaaa

SEQ ID NO: 2479883 - RNA, 18 nt, Human
uauuguauuuauucaaua

SEQ ID NO: 2479884 - RNA, 17 nt, Human
uauuguauuuauucaau

SEQ ID NO: 2479885 - RNA, 16 nt, Human
uauuguauuuauucaa

SEQ ID NO: 2479886 - RNA, 15 nt, Human
uauuguauuuauuca

SEQ ID NO: 2479887 - RNA, 10 nt, Human
uauuguauuu

SEQ ID NO: 2479888 - RNA, 17 nt, Human
uauugucaaagugguga

SEQ ID NO: 2479889 - RNA, 13 nt, Human
uauugucaaagug

SEQ ID NO: 2479890 - RNA, 18 nt, Human
uauuguauuacuagaaga

SEQ ID NO: 2479891 - RNA, 22 nt, Human
uauuguauaagauuagaaugaa

SEQ ID NO: 2479892 - RNA, 21 nt, Human
uauuguauaaacuaucaguuu

SEQ ID NO: 2479893 - RNA, 16 nt, Human
uauuguauaaacuauc

SEQ ID NO: 2479894 - RNA, 17 nt, Human
uauuguagcauuucuug

SEQ ID NO: 2479895 - RNA, 16 nt, Human
uauuguagcauuucuu

SEQ ID NO: 2479896 - RNA, 15 nt, Human
uauuguagcauuucu

SEQ ID NO: 2479897 - RNA, 17 nt, Human
uauuguaccuuuuaaca

SEQ ID NO: 2479898 - RNA, 12 nt, Human
uauuggccugga

SEQ ID NO: 2479899 - RNA, 13 nt, Human
uauuguaccuuuu

SEQ ID NO: 2479900 - RNA, 20 nt, Human
uauuguacagcuguuuaaga

SEQ ID NO: 2479901 - RNA, 14 nt, Human
uauuguaccucucu

SEQ ID NO: 2479902 - RNA, 13 nt, Human
uauuguaccucuc

SEQ ID NO: 2479903 - RNA, 11 nt, Human
uauuguaccuc

SEQ ID NO: 2479904 - RNA, 17 nt, Human
uauuguacaguuuuuau

SEQ ID NO: 2479905 - RNA, 15 nt, Human
uauuguacaguuuuu

SEQ ID NO: 2479906 - RNA, 14 nt, Human
uauuguacaguuuu

SEQ ID NO: 2479907 - RNA, 13 nt, Human
uauuguacaguuu

SEQ ID NO: 2479908 - RNA, 12 nt, Human
uauuguacaguu

SEQ ID NO: 2479909 - RNA, 13 nt, Human
uauuguacacuuu

SEQ ID NO: 2479910 - RNA, 12 nt, Human
uauuguacacuu

SEQ ID NO: 2479911 - RNA, 12 nt, Human
uauuguacagaa

SEQ ID NO: 2479912 - RNA, 11 nt, Human
uauuguacaga

SEQ ID NO: 2479913 - RNA, 20 nt, Human
uauuguacacuuuuuugggg

SEQ ID NO: 2479914 - RNA, 15 nt, Human
uauuguacacuuuuu

SEQ ID NO: 2479915 - RNA, 11 nt, Human
uauuguacagu

SEQ ID NO: 2479916 - RNA, 21 nt, Human
uauugugauuugacuguuuuu

SEQ ID NO: 2479917 - RNA, 20 nt, Human
uauugugauuugacuguuuu

SEQ ID NO: 2479918 - RNA, 19 nt, Human
uauugugauuugacuguuu

SEQ ID NO: 2479919 - RNA, 18 nt, Human
uauugugauuugacuguu

SEQ ID NO: 2479920 - RNA, 15 nt, Human
uauuuaacagcugaa

SEQ ID NO: 2479921 - RNA, 21 nt, Human
uauuuaacagcugaauuaucu

SEQ ID NO: 2479922 - RNA, 23 nt, Human
uauuuaacagcugaauuaucuau

SEQ ID NO: 2479923 - RNA, 13 nt, Human
uauuuaacuugag

SEQ ID NO: 2479924 - RNA, 21 nt, Human
uauuuaacugccuuguguaca

SEQ ID NO: 2479925 - RNA, 14 nt, Human
uauuuaacuugagg

SEQ ID NO: 2479926 - RNA, 20 nt, Human
uauuuaacuugagcuuuaaa

SEQ ID NO: 2479927 - RNA, 17 nt, Human
uauugucuagugaaacu

SEQ ID NO: 2479928 - RNA, 17 nt, Human
uauuguccauuguccaa

SEQ ID NO: 2479929 - RNA, 17 nt, Human
uauugucauuaaaggua

SEQ ID NO: 2479930 - RNA, 15 nt, Human
uauuguccauugucc

SEQ ID NO: 2479931 - RNA, 22 nt, Human
uauugucaguaucuguaucucu

SEQ ID NO: 2479932 - RNA, 16 nt, Human
uauugucagauauuuu

SEQ ID NO: 2479933 - RNA, 17 nt, Human
uauugugauuugacugu

SEQ ID NO: 2479934 - RNA, 22 nt, Human
uauugugauuucccguggcccc

SEQ ID NO: 2479935 - RNA, 21 nt, Human
uauugugaucuaucaauaguc

SEQ ID NO: 2479936 - RNA, 13 nt, Human
uauugugaucuau

SEQ ID NO: 2479937 - RNA, 15 nt, Human
uauugugaaguacau

SEQ ID NO: 2479938 - RNA, 17 nt, Human
uauugugaaguacauau

SEQ ID NO: 2479939 - RNA, 19 nt, Human
uauugugaaguacauauua

SEQ ID NO: 2479940 - RNA, 15 nt, Human
uauuuaaugaaagac

SEQ ID NO: 2479941 - RNA, 21 nt, Human
uauuuaaugaaagacuguaca

SEQ ID NO: 2479942 - RNA, 20 nt, Human
uauuuaagauaauuauaaua

SEQ ID NO: 2479943 - RNA, 17 nt, Human
uauuuaagauaauuaua

SEQ ID NO: 2479944 - RNA, 21 nt, Human
uauuuaacuugaggguaauaa

SEQ ID NO: 2479945 - RNA, 20 nt, Human
uauuuaagauaguuuugcca

SEQ ID NO: 2479946 - RNA, 14 nt, Human
uauuuaauaacauu

SEQ ID NO: 2479947 - RNA, 13 nt, Human
uauuuaauaacau

SEQ ID NO: 2479948 - RNA, 15 nt, Human
uauuuaauaacauua

SEQ ID NO: 2479949 - RNA, 17 nt, Human
uauuuaauaacaauugu

SEQ ID NO: 2479950 - RNA, 11 nt, Human
uauuuaauaac

SEQ ID NO: 2479951 - RNA, 10 nt, Human
uauuuaauaa

SEQ ID NO: 2479952 - RNA, 21 nt, Human
uauuuaagccucauauuuaaa

SEQ ID NO: 2479953 - RNA, 20 nt, Human
uauuuaagccucauauuuaa

SEQ ID NO: 2479954 - RNA, 18 nt, Human
uauuuaagccucauauuu

SEQ ID NO: 2479955 - RNA, 16 nt, Human
uauuuaagcuuauguc

SEQ ID NO: 2479956 - RNA, 20 nt, Human
uauuuagacaagagauggga

SEQ ID NO: 2479957 - RNA, 19 nt, Human
uauuuagacaagagauggg

SEQ ID NO: 2479958 - RNA, 15 nt, Human
uauuuagacaagaga

SEQ ID NO: 2479959 - RNA, 13 nt, Human
uauuuagacaaga

SEQ ID NO: 2479960 - RNA, 18 nt, Human
uauuuagauauaacacua

SEQ ID NO: 2479961 - RNA, 21 nt, Human
uauuuagacucaucuuacugu

SEQ ID NO: 2479962 - RNA, 20 nt, Human
uauuuagcaccagggaaggg

SEQ ID NO: 2479963 - RNA, 17 nt, Human
uauuuagauuguuaaaa

SEQ ID NO: 2479964 - RNA, 19 nt, Human
uauuuagauuguuaaaaua

SEQ ID NO: 2479965 - RNA, 18 nt, Human
uauuuacuucuuauacau

SEQ ID NO: 2479966 - RNA, 22 nt, Human
uauuuacugagcuucucuguga

SEQ ID NO: 2479967 - RNA, 21 nt, Human
uauuuacugagcuucucugug

SEQ ID NO: 2479968 - RNA, 23 nt, Human
uauuuacugagcuucucugugaa

SEQ ID NO: 2479969 - RNA, 15 nt, Human
uauuuacgcuuugau

SEQ ID NO: 2479970 - RNA, 19 nt, Human
uauuuacgcuuugauucau

SEQ ID NO: 2479971 - RNA, 19 nt, Human
uauuuacugagcuucucug

SEQ ID NO: 2479972 - RNA, 16 nt, Human
uauuuacugagcuucu

SEQ ID NO: 2479973 - RNA, 22 nt, Human
uauuuacgcuuugauucauagu

SEQ ID NO: 2479974 - RNA, 14 nt, Human
uauuuacugagcuu

SEQ ID NO: 2479975 - RNA, 14 nt, Human
uauuuacgcuuuga

SEQ ID NO: 2479976 - RNA, 21 nt, Human
uauuuacaugaauugcauuuu

SEQ ID NO: 2479977 - RNA, 17 nt, Human
uauuuacauaugaaauu

SEQ ID NO: 2479978 - RNA, 21 nt, Human
uauuuacauaugaaauuuaau

SEQ ID NO: 2479979 - RNA, 22 nt, Human
uauuuacagugaaaauguaagc

SEQ ID NO: 2479980 - RNA, 20 nt, Human
uauuuacagugaaaauguaa

SEQ ID NO: 2479981 - RNA, 14 nt, Human
uauuuacauaugaa

SEQ ID NO: 2479982 - RNA, 16 nt, Human
uauuuacauaugaaau

SEQ ID NO: 2479983 - RNA, 23 nt, Human
uauuuaauuuuuuugagacagag

SEQ ID NO: 2479984 - RNA, 14 nt, Human
uauuuaauucaugu

SEQ ID NO: 2479985 - RNA, 21 nt, Human
uauuuaauuagugcuaagugu

SEQ ID NO: 2479986 - RNA, 19 nt, Human
uauuuaauuagugcuaagu

SEQ ID NO: 2479987 - RNA, 18 nt, Human
uauuuaauuagugcuaag

SEQ ID NO: 2479988 - RNA, 17 nt, Human
uauuuaauuagugcuaa

SEQ ID NO: 2479989 - RNA, 16 nt, Human
uauuuaauuagugcua

SEQ ID NO: 2479990 - RNA, 19 nt, Human
uauuuaaugauaaguaaau

SEQ ID NO: 2479991 - RNA, 21 nt, Human
uauuuaaugccgauauacucu

SEQ ID NO: 2479992 - RNA, 15 nt, Human
uauuuaauguuaugu

SEQ ID NO: 2479993 - RNA, 16 nt, Human
uauuuauuuuaauaau

SEQ ID NO: 2479994 - RNA, 14 nt, Human
uauuuauuuuaaua

SEQ ID NO: 2479995 - RNA, 18 nt, Human
uauuuauuuuaauaaugu

SEQ ID NO: 2479996 - RNA, 14 nt, Human
uauuuauuuauuua

SEQ ID NO: 2479997 - RNA, 14 nt, Human
uauuucaaauugga

SEQ ID NO: 2479998 - RNA, 20 nt, Human
uauuucaaaauauacauuca

SEQ ID NO: 2479999 - RNA, 20 nt, Human
uauuuauuuuuuuuaaguau

SEQ ID NO: 2480000 - RNA, 17 nt, Human
uauuuauuuuccucccc

SEQ ID NO: 2480001 - RNA, 18 nt, Human
uauuuauuuuccucccca

SEQ ID NO: 2480002 - RNA, 20 nt, Human
uauuucacuuuagaugcuga

SEQ ID NO: 2480003 - RNA, 14 nt, Human
uauuucaagacauu

SEQ ID NO: 2480004 - RNA, 18 nt, Human
uauuucaaauuggagcuu

SEQ ID NO: 2480005 - RNA, 22 nt, Human
uauuucaauuuccaagagcuga

SEQ ID NO: 2480006 - RNA, 14 nt, Human
uauuuauuuaguau

SEQ ID NO: 2480007 - RNA, 21 nt, Human
uauuuauuuaauaacaauugu

SEQ ID NO: 2480008 - RNA, 13 nt, Human
uauuuauuuacug

SEQ ID NO: 2480009 - RNA, 17 nt, Human
uauuuauuuacugagcu

SEQ ID NO: 2480010 - RNA, 13 nt, Human
uauuuauuuaugg

SEQ ID NO: 2480011 - RNA, 14 nt, Human
uauuuauuuaugga

SEQ ID NO: 2480012 - RNA, 14 nt, Human
uauuuauuuaaauu

SEQ ID NO: 2480013 - RNA, 18 nt, Human
uauuuauuuaaaugucua

SEQ ID NO: 2480014 - RNA, 16 nt, Human
uauuuauuuaaauguc

SEQ ID NO: 2480015 - RNA, 19 nt, Human
uauuuauuuaaaagauuca

SEQ ID NO: 2480016 - RNA, 11 nt, Human
uauuuauuuac

SEQ ID NO: 2480017 - RNA, 12 nt, Human
uauuuauuuaau

SEQ ID NO: 2480018 - RNA, 16 nt, Human
uauuuauuuaagcuua

SEQ ID NO: 2480019 - RNA, 13 nt, Human
uauuuauuuaaau

SEQ ID NO: 2480020 - RNA, 17 nt, Human
uauuuagggaacugcuu

SEQ ID NO: 2480021 - RNA, 18 nt, Human
uauuuagggaacugcuug

SEQ ID NO: 2480022 - RNA, 17 nt, Human
uauuuaguuauaguuuc

SEQ ID NO: 2480023 - RNA, 15 nt, Human
uauuuaguuauaguu

SEQ ID NO: 2480024 - RNA, 17 nt, Human
uauuuaggcagauugaa

SEQ ID NO: 2480025 - RNA, 19 nt, Human
uauuuaguguucauaaaua

SEQ ID NO: 2480026 - RNA, 11 nt, Human
uauuuagcaug

SEQ ID NO: 2480027 - RNA, 22 nt, Human
uauuuagauuguuaaaauaacu

SEQ ID NO: 2480028 - RNA, 21 nt, Human
uauuuagcaugacaagcccca

SEQ ID NO: 2480029 - RNA, 13 nt, Human
uauugacacagaa

SEQ ID NO: 2480030 - RNA, 16 nt, Human
uauugacacagaaaau

SEQ ID NO: 2480031 - RNA, 18 nt, Human
uauugacacagaaaaugu

SEQ ID NO: 2480032 - RNA, 20 nt, Human
uauugacacagaaaauguug

SEQ ID NO: 2480033 - RNA, 23 nt, Human
uauugacacagaaaauguugaga

SEQ ID NO: 2480034 - RNA, 13 nt, Human
uauugacaauaau

SEQ ID NO: 2480035 - RNA, 17 nt, Human
uauugacaauaauuuca

SEQ ID NO: 2480036 - RNA, 18 nt, Human
uauugacaauaauuucag

SEQ ID NO: 2480037 - RNA, 14 nt, Human
uauugacaaacucu

SEQ ID NO: 2480038 - RNA, 15 nt, Human
uauugacaaacucuc

SEQ ID NO: 2480039 - RNA, 13 nt, Human
uauugaagcauuu

SEQ ID NO: 2480040 - RNA, 15 nt, Human
uauugaagcauuuua

SEQ ID NO: 2480041 - RNA, 16 nt, Human
uauugaagcauuuuau

SEQ ID NO: 2480042 - RNA, 17 nt, Human
uauugaagcauuuuaua

SEQ ID NO: 2480043 - RNA, 19 nt, Human
uauugaagcauuuuauaaa

SEQ ID NO: 2480044 - RNA, 21 nt, Human
uauugaauauaauauauuugu

SEQ ID NO: 2480045 - RNA, 20 nt, Human
uauugaauauaauauauuug

SEQ ID NO: 2480046 - RNA, 22 nt, Human
uauugaauauaauauauuugug

SEQ ID NO: 2480047 - RNA, 18 nt, Human
uauugaaucauguaguau

SEQ ID NO: 2480048 - RNA, 11 nt, Human
uauugaaucua

SEQ ID NO: 2480049 - RNA, 12 nt, Human
uauugaauguuu

SEQ ID NO: 2480050 - RNA, 22 nt, Human
uauugaaucauguaguaucaaa

SEQ ID NO: 2480051 - RNA, 17 nt, Human
uauugaaucuauuuaag

SEQ ID NO: 2480052 - RNA, 16 nt, Human
uauugaaucuauuuaa

SEQ ID NO: 2480053 - RNA, 14 nt, Human
uauugaacuuuuuu

SEQ ID NO: 2480054 - RNA, 13 nt, Human
uauugaacuuuuu

SEQ ID NO: 2480055 - RNA, 12 nt, Human
uauugaagcauu

SEQ ID NO: 2480056 - RNA, 20 nt, Human
uauugaaauuguacauauuu

SEQ ID NO: 2480057 - RNA, 18 nt, Human
uauugaacuuggaaagaa

SEQ ID NO: 2480058 - RNA, 22 nt, Human
uauucuucucuuccuuuuauca

SEQ ID NO: 2480059 - RNA, 24 nt, Human
uauucuuugauguuaacacauuuu

SEQ ID NO: 2480060 - RNA, 23 nt, Human
uauucuuugauguuaacacauuu

SEQ ID NO: 2480061 - RNA, 22 nt, Human
uauucuuugauguuaacacauu

SEQ ID NO: 2480062 - RNA, 21 nt, Human
uauucuuugauguuaacacau

SEQ ID NO: 2480063 - RNA, 20 nt, Human
uauucuuugauguuaacaca

SEQ ID NO: 2480064 - RNA, 18 nt, Human
uauucuuugauguuaaca

SEQ ID NO: 2480065 - RNA, 10 nt, Human
uauucuuuga

SEQ ID NO: 2480066 - RNA, 14 nt, Human
uauuggcugggagu

SEQ ID NO: 2480067 - RNA, 23 nt, Human
uauuggcuaaauugaaaccugga

SEQ ID NO: 2480068 - RNA, 14 nt, Human
uauuggccuggagg

SEQ ID NO: 2480069 - RNA, 14 nt, Human
uauugagucaaaug

SEQ ID NO: 2480070 - RNA, 15 nt, Human
uauugagaaagagca

SEQ ID NO: 2480071 - RNA, 18 nt, Human
uauugagaauuuuaaauu

SEQ ID NO: 2480072 - RNA, 19 nt, Human
uauugacuucaaugauagu

SEQ ID NO: 2480073 - RNA, 15 nt, Human
uauugacuuguauau

SEQ ID NO: 2480074 - RNA, 14 nt, Human
uauugacuuguaua

SEQ ID NO: 2480075 - RNA, 17 nt, Human
uauugacuuguauauuu

SEQ ID NO: 2480076 - RNA, 14 nt, Human
uauugacuuugucu

SEQ ID NO: 2480077 - RNA, 17 nt, Human
uauuggggucugacccc

SEQ ID NO: 2480078 - RNA, 16 nt, Human
uauuggggucugaccc

SEQ ID NO: 2480079 - RNA, 23 nt, Human
uauuggguagauauuuuuucuga

SEQ ID NO: 2480080 - RNA, 14 nt, Human
uauuggguucauua

SEQ ID NO: 2480081 - RNA, 16 nt, Human
uauuggguucauuauu

SEQ ID NO: 2480082 - RNA, 13 nt, Human
uauugguccagcu

SEQ ID NO: 2480083 - RNA, 22 nt, Human
uauugguccagcuugcucuuca

SEQ ID NO: 2480084 - RNA, 21 nt, Human
uauugguaacauccuuucuau

SEQ ID NO: 2480085 - RNA, 18 nt, Human
uauugguaacauccuuuc

SEQ ID NO: 2480086 - RNA, 22 nt, Human
uauugguaacauccuuucuauu

SEQ ID NO: 2480087 - RNA, 18 nt, Human
uauuggguucauuauugg

SEQ ID NO: 2480088 - RNA, 20 nt, Human
uauuggguucauuauuggaa

SEQ ID NO: 2480089 - RNA, 15 nt, Human
uauugguaacauccu

SEQ ID NO: 2480090 - RNA, 19 nt, Human
uauuguaacagacauuguu

SEQ ID NO: 2480091 - RNA, 18 nt, Human
uauuguaacagacauugu

SEQ ID NO: 2480092 - RNA, 17 nt, Human
uauuguaacagacauug

SEQ ID NO: 2480093 - RNA, 16 nt, Human
uauuguaacagacauu

SEQ ID NO: 2480094 - RNA, 15 nt, Human
uauuguaacagacau

SEQ ID NO: 2480095 - RNA, 15 nt, Human
uauuguaaauauguu

SEQ ID NO: 2480096 - RNA, 11 nt, Human
uauuguaagaa

SEQ ID NO: 2480097 - RNA, 17 nt, Human
uauuguaagaaauacug

SEQ ID NO: 2480098 - RNA, 19 nt, Human
uauuguaagaaauacugua

SEQ ID NO: 2480099 - RNA, 16 nt, Human
uauuguaaacaugugu

SEQ ID NO: 2480100 - RNA, 18 nt, Human
uauuguaaacauguguuu

SEQ ID NO: 2480101 - RNA, 17 nt, Human
uauuguaaacauguguu

SEQ ID NO: 2480102 - RNA, 14 nt, Human
uauuguaaauaugu

SEQ ID NO: 2480103 - RNA, 15 nt, Human
uauuguaaacaugug

SEQ ID NO: 2480104 - RNA, 16 nt, Human
acaguucaagaaagcu

SEQ ID NO: 2480105 - RNA, 21 nt, Human
acaguucaguggcagggcuca

SEQ ID NO: 2480106 - RNA, 20 nt, Human
acaguucaguggcagggcuc

SEQ ID NO: 2480107 - RNA, 13 nt, Human
acaguucaguggc

SEQ ID NO: 2480108 - RNA, 21 nt, Human
acaguucaguuccucuuugca

SEQ ID NO: 2480109 - RNA, 16 nt, Human
acaguucaguuccucu

SEQ ID NO: 2480110 - RNA, 12 nt, Human
acaguucaguuc

SEQ ID NO: 2480111 - RNA, 23 nt, Human
acaguucaguggcagggcucagg

SEQ ID NO: 2480112 - RNA, 15 nt, Human
acaguucauauguac

SEQ ID NO: 2480113 - RNA, 20 nt, Human
acaguucauguuugcuucau

SEQ ID NO: 2480114 - RNA, 12 nt, Human
acaguucaagaa

SEQ ID NO: 2480115 - RNA, 20 nt, Human
acaguucaagaaagcuucaa

SEQ ID NO: 2480116 - RNA, 20 nt, Human
acaguucaauucucauuugu

SEQ ID NO: 2480117 - RNA, 13 nt, Human
acaguuacucaga

SEQ ID NO: 2480118 - RNA, 20 nt, Human
acaguuacucagaauucucu

SEQ ID NO: 2480119 - RNA, 23 nt, Human
acaguuagcaaacuuuguauguc

SEQ ID NO: 2480120 - RNA, 22 nt, Human
acaguuaggguugaguuacuuc

SEQ ID NO: 2480121 - RNA, 19 nt, Human
acaguucggugagcuacaa

SEQ ID NO: 2480122 - RNA, 22 nt, Human
acaguucggugagcuacaaaug

SEQ ID NO: 2480123 - RNA, 23 nt, Human
acaguucggugagcuacaaaugc

SEQ ID NO: 2480124 - RNA, 16 nt, Human
acaguucucuccuucu

SEQ ID NO: 2480125 - RNA, 12 nt, Human
acaguuccucgc

SEQ ID NO: 2480126 - RNA, 14 nt, Human
acaguuccucgccc

SEQ ID NO: 2480127 - RNA, 15 nt, Human
acaguuccucgcccu

SEQ ID NO: 2480128 - RNA, 16 nt, Human
acaguuccucgcccug

SEQ ID NO: 2480129 - RNA, 12 nt, Human
uauucucugagc

SEQ ID NO: 2480130 - RNA, 19 nt, Human
acaguucuuugggccagac

SEQ ID NO: 2480131 - RNA, 18 nt, Human
uauucucuccuguaccuc

SEQ ID NO: 2480132 - RNA, 18 nt, Human
uauucucugagcugugca

SEQ ID NO: 2480133 - RNA, 19 nt, Human
uauucucugagcugugcag

SEQ ID NO: 2480134 - RNA, 20 nt, Human
uauucucuccuguaccucuu

SEQ ID NO: 2480135 - RNA, 24 nt, Human
uauucucuccuguaccucuugagc

SEQ ID NO: 2480136 - RNA, 20 nt, Human
acaguucuucgggaagagag

SEQ ID NO: 2480137 - RNA, 19 nt, Human
acaguucuucgggaagaga

SEQ ID NO: 2480138 - RNA, 15 nt, Human
acaguucuucgggaa

SEQ ID NO: 2480139 - RNA, 23 nt, Human
acaguucuugugugguuuggccc

SEQ ID NO: 2480140 - RNA, 17 nt, Human
acaguucuugugugguu

SEQ ID NO: 2480141 - RNA, 24 nt, Human
acaguucuucgggaagagaggagu

SEQ ID NO: 2480142 - RNA, 21 nt, Human
acaguucuucgggaagagagg

SEQ ID NO: 2480143 - RNA, 17 nt, Human
acaguucuuugggccag

SEQ ID NO: 2480144 - RNA, 18 nt, Human
acaguucuuugggccaga

SEQ ID NO: 2480145 - RNA, 17 nt, Human
acaguucucuccuucuu

SEQ ID NO: 2480146 - RNA, 15 nt, Human
acaguucugaagaau

SEQ ID NO: 2480147 - RNA, 13 nt, Human
acaguucugaaga

SEQ ID NO: 2480148 - RNA, 13 nt, Human
acaguuccuucag

SEQ ID NO: 2480149 - RNA, 18 nt, Human
acaguuccucgcccuggg

SEQ ID NO: 2480150 - RNA, 19 nt, Human
acaguuccucgcccugggu

SEQ ID NO: 2480151 - RNA, 22 nt, Human
uauucuguagauucuguggaac

SEQ ID NO: 2480152 - RNA, 19 nt, Human
uauucuguagauucugugg

SEQ ID NO: 2480153 - RNA, 21 nt, Human
uauucucuuaauuuuucuuaa

SEQ ID NO: 2480154 - RNA, 22 nt, Human
uauucugauuacacaaaacaaa

SEQ ID NO: 2480155 - RNA, 12 nt, Human
uauucuggaguu

SEQ ID NO: 2480156 - RNA, 14 nt, Human
uauucugauuccac

SEQ ID NO: 2480157 - RNA, 13 nt, Human
uauucuucucuuc

SEQ ID NO: 2480158 - RNA, 14 nt, Human
uauucuucauaaca

SEQ ID NO: 2480159 - RNA, 15 nt, Human
uauucuuauuuaaug

SEQ ID NO: 2480160 - RNA, 16 nt, Human
uauucuguuggccagu

SEQ ID NO: 2480161 - RNA, 22 nt, Human
uauucuuaagggaacuuccaca

SEQ ID NO: 2480162 - RNA, 19 nt, Human
uaucuagauacuguaucau

SEQ ID NO: 2480163 - RNA, 20 nt, Human
uaucuagcaaucacaacacu

SEQ ID NO: 2480164 - RNA, 16 nt, Human
uaucucccccagcccc

SEQ ID NO: 2480165 - RNA, 18 nt, Human
uaucucccccagccccau

SEQ ID NO: 2480166 - RNA, 17 nt, Human
uaucucccccagcccca

SEQ ID NO: 2480167 - RNA, 20 nt, Human
uaucuagugcagcugauuuu

SEQ ID NO: 2480168 - RNA, 23 nt, Human
uaucuagugcagcugauuuuaac

SEQ ID NO: 2480169 - RNA, 14 nt, Human
uaucuagugcagcu

SEQ ID NO: 2480170 - RNA, 19 nt, Human
uaucuagugcagcugauuu

SEQ ID NO: 2480171 - RNA, 18 nt, Human
uauccauuaucaugugua

SEQ ID NO: 2480172 - RNA, 17 nt, Human
uauccauuaucaugugu

SEQ ID NO: 2480173 - RNA, 16 nt, Human
uauccauuaucaugug

SEQ ID NO: 2480174 - RNA, 15 nt, Human
uauccauuaucaugu

SEQ ID NO: 2480175 - RNA, 19 nt, Human
uauccauuaucauguguaa

SEQ ID NO: 2480176 - RNA, 14 nt, Human
uauccauucuuucu

SEQ ID NO: 2480177 - RNA, 15 nt, Human
uauccauuucucaug

SEQ ID NO: 2480178 - RNA, 16 nt, Human
uauccauucuuucuga

SEQ ID NO: 2480179 - RNA, 14 nt, Human
uaucuacucuccuc

SEQ ID NO: 2480180 - RNA, 20 nt, Human
uaucuacucuccucaucucu

SEQ ID NO: 2480181 - RNA, 20 nt, Human
uaucuacugauaaagaaaga

SEQ ID NO: 2480182 - RNA, 21 nt, Human
uaucuacucuccucaucucua

SEQ ID NO: 2480183 - RNA, 15 nt, Human
uaucuagauacugua

SEQ ID NO: 2480184 - RNA, 16 nt, Human
uaucuagauacuguau

SEQ ID NO: 2480185 - RNA, 14 nt, Human
uaucagaagaccac

SEQ ID NO: 2480186 - RNA, 23 nt, Human
uaucagaagaccacaaaaauuga

SEQ ID NO: 2480187 - RNA, 22 nt, Human
uauccauauugagucaaauggu

SEQ ID NO: 2480188 - RNA, 10 nt, Human
uaucagaauu

SEQ ID NO: 2480189 - RNA, 18 nt, Human
uauccauggggaagggau

SEQ ID NO: 2480190 - RNA, 21 nt, Human
uaucagaagaccacaaaaauu

SEQ ID NO: 2480191 - RNA, 17 nt, Human
uauccaugggggcaggg

SEQ ID NO: 2480192 - RNA, 18 nt, Human
uauccaugggggcagggc

SEQ ID NO: 2480193 - RNA, 19 nt, Human
uauccaugggggcagggca

SEQ ID NO: 2480194 - RNA, 20 nt, Human
uauccaugggggcagggcau

SEQ ID NO: 2480195 - RNA, 13 nt, Human
uauccauguacug

SEQ ID NO: 2480196 - RNA, 14 nt, Human
uauccauguacugu

SEQ ID NO: 2480197 - RNA, 15 nt, Human
uauccauguacugua

SEQ ID NO: 2480198 - RNA, 16 nt, Human
uauccauguacuguag

SEQ ID NO: 2480199 - RNA, 22 nt, Human
uauccauguacuguaguuuuuc

SEQ ID NO: 2480200 - RNA, 14 nt, Human
uauccauuaucaug

SEQ ID NO: 2480201 - RNA, 18 nt, Human
uauccauguacuguaguu

SEQ ID NO: 2480202 - RNA, 21 nt, Human
acagagugagacucugucuca

SEQ ID NO: 2480203 - RNA, 18 nt, Human
acagagcuacacagggga

SEQ ID NO: 2480204 - RNA, 21 nt, Human
acagagcgagagucugucuca

SEQ ID NO: 2480205 - RNA, 22 nt, Human
acagaguggacuguucccugag

SEQ ID NO: 2480206 - RNA, 19 nt, Human
acagagugauagccuuccg

SEQ ID NO: 2480207 - RNA, 18 nt, Human
acagaguggucuuucugg

SEQ ID NO: 2480208 - RNA, 19 nt, Human
acagaguggucuuucugga

SEQ ID NO: 2480209 - RNA, 21 nt, Human
acagaguggucuuucuggaga

SEQ ID NO: 2480210 - RNA, 24 nt, Human
acagaguggucuuucuggagaggu

SEQ ID NO: 2480211 - RNA, 16 nt, Human
acagagcuacacaggg

SEQ ID NO: 2480212 - RNA, 23 nt, Human
acagagccuucugaggacauucc

SEQ ID NO: 2480213 - RNA, 21 nt, Human
acagagccucgggacaucaaa

SEQ ID NO: 2480214 - RNA, 20 nt, Human
acagagcccacgcccccacu

SEQ ID NO: 2480215 - RNA, 14 nt, Human
acagagaggagaaa

SEQ ID NO: 2480216 - RNA, 16 nt, Human
acagagaggagaaaca

SEQ ID NO: 2480217 - RNA, 20 nt, Human
acagagaggagaaacacauc

SEQ ID NO: 2480218 - RNA, 18 nt, Human
acagagaggagaaacaca

SEQ ID NO: 2480219 - RNA, 21 nt, Human
acagagagggggccaccuccc

SEQ ID NO: 2480220 - RNA, 15 nt, Human
acagagacaccugca

SEQ ID NO: 2480221 - RNA, 16 nt, Human
acagagacaccugcac

SEQ ID NO: 2480222 - RNA, 17 nt, Human
acagagacaccugcacc

SEQ ID NO: 2480223 - RNA, 21 nt, Human
acagagacaccugcaccuccc

SEQ ID NO: 2480224 - RNA, 15 nt, Human
acagagacaggccca

SEQ ID NO: 2480225 - RNA, 21 nt, Human
acagagacaggcccaagagau

SEQ ID NO: 2480226 - RNA, 16 nt, Human
acagagacauuccucc

SEQ ID NO: 2480227 - RNA, 23 nt, Human
acagagacaggcccaagagauga

SEQ ID NO: 2480228 - RNA, 14 nt, Human
acagagaccuccug

SEQ ID NO: 2480229 - RNA, 19 nt, Human
acagagacauuccuccgag

SEQ ID NO: 2480230 - RNA, 17 nt, Human
acagagacauuccuccg

SEQ ID NO: 2480231 - RNA, 16 nt, Human
acagagaggacuguag

SEQ ID NO: 2480232 - RNA, 15 nt, Human
acagagaggacgugg

SEQ ID NO: 2480233 - RNA, 22 nt, Human
acagacuggaagcacagcuuca

SEQ ID NO: 2480234 - RNA, 18 nt, Human
uaucuccucgcaagcugg

SEQ ID NO: 2480235 - RNA, 14 nt, Human
acagacuucugaaa

SEQ ID NO: 2480236 - RNA, 17 nt, Human
acagacuucuccagacc

SEQ ID NO: 2480237 - RNA, 13 nt, Human
acagacuucugaa

SEQ ID NO: 2480238 - RNA, 15 nt, Human
acagacuucuccaga

SEQ ID NO: 2480239 - RNA, 16 nt, Human
acagacuucuccagac

SEQ ID NO: 2480240 - RNA, 14 nt, Human
uauauuuacaaaug

SEQ ID NO: 2480241 - RNA, 21 nt, Human
uauauugguaacauccuuucu

SEQ ID NO: 2480242 - RNA, 19 nt, Human
uauauugguaacauccuuu

SEQ ID NO: 2480243 - RNA, 18 nt, Human
uauauugguaacauccuu

SEQ ID NO: 2480244 - RNA, 17 nt, Human
uauauugguaacauccu

SEQ ID NO: 2480245 - RNA, 23 nt, Human
uauauugauaacagcacugacua

SEQ ID NO: 2480246 - RNA, 22 nt, Human
uauauugauaacagcacugacu

SEQ ID NO: 2480247 - RNA, 23 nt, Human
acagacuccugaggacagcuguc

SEQ ID NO: 2480248 - RNA, 12 nt, Human
uauauugauaac

SEQ ID NO: 2480249 - RNA, 15 nt, Human
uauauuuacaaaugg

SEQ ID NO: 2480250 - RNA, 21 nt, Human
uaucaaguauuauaccuuuuu

SEQ ID NO: 2480251 - RNA, 18 nt, Human
uaucaaguauuauaccuu

SEQ ID NO: 2480252 - RNA, 24 nt, Human
uauauuuacagugaaaauguaagc

SEQ ID NO: 2480253 - RNA, 14 nt, Human
uaucaagugucuuc

SEQ ID NO: 2480254 - RNA, 18 nt, Human
uaucacccagaagaaaau

SEQ ID NO: 2480255 - RNA, 17 nt, Human
uaucaccagcugccucu

SEQ ID NO: 2480256 - RNA, 15 nt, Human
uaucaccagcugccu

SEQ ID NO: 2480257 - RNA, 18 nt, Human
uaucaccagagagggacu

SEQ ID NO: 2480258 - RNA, 15 nt, Human
uaucaccacaguaag

SEQ ID NO: 2480259 - RNA, 18 nt, Human
uaucacauguuuucucug

SEQ ID NO: 2480260 - RNA, 13 nt, Human
uaucacauuauuu

SEQ ID NO: 2480261 - RNA, 18 nt, Human
uaucacugacacaaaaag

SEQ ID NO: 2480262 - RNA, 20 nt, Human
uaucaccuccccuccuugcc

SEQ ID NO: 2480263 - RNA, 20 nt, Human
uaucaauagucaagaaaaau

SEQ ID NO: 2480264 - RNA, 15 nt, Human
uaucaauagucaaga

SEQ ID NO: 2480265 - RNA, 13 nt, Human
uaucaauagucaa

SEQ ID NO: 2480266 - RNA, 15 nt, Human
uaucaaucaguauaa

SEQ ID NO: 2480267 - RNA, 18 nt, Human
uaucaaucaguauaauuc

SEQ ID NO: 2480268 - RNA, 17 nt, Human
uaucaauccuuguucag

SEQ ID NO: 2480269 - RNA, 17 nt, Human
uaucacauguauguuuu

SEQ ID NO: 2480270 - RNA, 16 nt, Human
uaucacauguauguuu

SEQ ID NO: 2480271 - RNA, 12 nt, Human
uaucacauguau

SEQ ID NO: 2480272 - RNA, 20 nt, Human
uaucacagucuaauuuuuau

SEQ ID NO: 2480273 - RNA, 21 nt, Human
uaucacauguauguuuuggua

SEQ ID NO: 2480274 - RNA, 18 nt, Human
uaucacauguauguuuug

SEQ ID NO: 2480275 - RNA, 12 nt, Human
uaucacauguuu

SEQ ID NO: 2480276 - RNA, 13 nt, Human
uaucacacuucug

SEQ ID NO: 2480277 - RNA, 16 nt, Human
uaucacagucuaauuu

SEQ ID NO: 2480278 - RNA, 15 nt, Human
uaucacagucuaauu

SEQ ID NO: 2480279 - RNA, 17 nt, Human
uaucacacuucugugag

SEQ ID NO: 2480280 - RNA, 16 nt, Human
acagacccugcccugu

SEQ ID NO: 2480281 - RNA, 17 nt, Human
acagacccugcccugug

SEQ ID NO: 2480282 - RNA, 18 nt, Human
acagacacuaaguuauag

SEQ ID NO: 2480283 - RNA, 14 nt, Human
acagacacuggcau

SEQ ID NO: 2480284 - RNA, 21 nt, Human
acagacacucccacuuggcau

SEQ ID NO: 2480285 - RNA, 13 nt, Human
acagacagcccuc

SEQ ID NO: 2480286 - RNA, 23 nt, Human
acacuccuagagaacgcagcccu

SEQ ID NO: 2480287 - RNA, 20 nt, Human
acacuccuagagaacgcagc

SEQ ID NO: 2480288 - RNA, 14 nt, Human
acacuccuagagaa

SEQ ID NO: 2480289 - RNA, 23 nt, Human
acagacacaggcccggcuccagg

SEQ ID NO: 2480290 - RNA, 11 nt, Human
acacuccuuca

SEQ ID NO: 2480291 - RNA, 15 nt, Human
acacuccccgaaguc

SEQ ID NO: 2480292 - RNA, 16 nt, Human
acacuccaucagcuua

SEQ ID NO: 2480293 - RNA, 15 nt, Human
acacuccccugcacu

SEQ ID NO: 2480294 - RNA, 14 nt, Human
acacucccuugggc

SEQ ID NO: 2480295 - RNA, 16 nt, Human
acacuccuacaccuaa

SEQ ID NO: 2480296 - RNA, 17 nt, Human
acacuccccugcacugg

SEQ ID NO: 2480297 - RNA, 16 nt, Human
uauauugauccagaaa

SEQ ID NO: 2480298 - RNA, 14 nt, Human
acagacuggaagca

SEQ ID NO: 2480299 - RNA, 23 nt, Human
acagacugcgauuugucccaggu

SEQ ID NO: 2480300 - RNA, 20 nt, Human
acagacccugcccugugggc

SEQ ID NO: 2480301 - RNA, 18 nt, Human
acagacccugcccugugg

SEQ ID NO: 2480302 - RNA, 16 nt, Human
acagacagacacacac

SEQ ID NO: 2480303 - RNA, 17 nt, Human
acagacuauuuaacuug

SEQ ID NO: 2480304 - RNA, 20 nt, Human
acagacucaaaugcucagac

SEQ ID NO: 2480305 - RNA, 22 nt, Human
acagacucacaaccugaaccua

SEQ ID NO: 2480306 - RNA, 20 nt, Human
acagacucacaaccugaacc

SEQ ID NO: 2480307 - RNA, 17 nt, Human
acagacuccugaggaca

SEQ ID NO: 2480308 - RNA, 22 nt, Human
acagacucgauucauauugaau

SEQ ID NO: 2480309 - RNA, 17 nt, Human
acagcuaacauggaagu

SEQ ID NO: 2480310 - RNA, 20 nt, Human
acagcuaaucagcauucuca

SEQ ID NO: 2480311 - RNA, 22 nt, Human
acagccuguggcggugccuggg

SEQ ID NO: 2480312 - RNA, 21 nt, Human
acagcucaggaucucuuagca

SEQ ID NO: 2480313 - RNA, 21 nt, Human
acagcucaguucuagucucuc

SEQ ID NO: 2480314 - RNA, 23 nt, Human
acagcucaguucuagucucucug

SEQ ID NO: 2480315 - RNA, 17 nt, Human
acagcuccacccuggcc

SEQ ID NO: 2480316 - RNA, 13 nt, Human
acagcucccaccc

SEQ ID NO: 2480317 - RNA, 14 nt, Human
acagcucccacccc

SEQ ID NO: 2480318 - RNA, 15 nt, Human
acagcucccacccca

SEQ ID NO: 2480319 - RNA, 16 nt, Human
acagcucccaccccac

SEQ ID NO: 2480320 - RNA, 15 nt, Human
acagcuaacauggaa

SEQ ID NO: 2480321 - RNA, 14 nt, Human
acagcuaacaugga

SEQ ID NO: 2480322 - RNA, 22 nt, Human
uauggggagaaaagacaugaau

SEQ ID NO: 2480323 - RNA, 12 nt, Human
acagccuggcac

SEQ ID NO: 2480324 - RNA, 20 nt, Human
acagccuguggcggugccug

SEQ ID NO: 2480325 - RNA, 21 nt, Human
acagccuguggcggugccugg

SEQ ID NO: 2480326 - RNA, 15 nt, Human
acagccuggcacagg

SEQ ID NO: 2480327 - RNA, 19 nt, Human
uauggggauagaugugugg

SEQ ID NO: 2480328 - RNA, 14 nt, Human
acagccuggcacag

SEQ ID NO: 2480329 - RNA, 17 nt, Human
uauggggauagaugugu

SEQ ID NO: 2480330 - RNA, 18 nt, Human
uauggggauagaugugug

SEQ ID NO: 2480331 - RNA, 17 nt, Human
uaugggcauuguaguua

SEQ ID NO: 2480332 - RNA, 15 nt, Human
uaugggcaaaaaacu

SEQ ID NO: 2480333 - RNA, 16 nt, Human
uaugggagccccaggg

SEQ ID NO: 2480334 - RNA, 17 nt, Human
uauggcuauaggugcua

SEQ ID NO: 2480335 - RNA, 21 nt, Human
uauggcuagaauauccuacuu

SEQ ID NO: 2480336 - RNA, 17 nt, Human
uauggcuagaauauccu

SEQ ID NO: 2480337 - RNA, 17 nt, Human
uauggcucacuaugaau

SEQ ID NO: 2480338 - RNA, 22 nt, Human
uauggcuagaauauccuacuuc

SEQ ID NO: 2480339 - RNA, 16 nt, Human
uauggcuuuugugcau

SEQ ID NO: 2480340 - RNA, 17 nt, Human
uauggcuggccacugca

SEQ ID NO: 2480341 - RNA, 15 nt, Human
uaugggagccccagg

SEQ ID NO: 2480342 - RNA, 10 nt, Human
uaugggagag

SEQ ID NO: 2480343 - RNA, 22 nt, Human
uaugcugaguauguuaagcucu

SEQ ID NO: 2480344 - RNA, 16 nt, Human
uauggcuauaggugcu

SEQ ID NO: 2480345 - RNA, 14 nt, Human
uauggccuguggau

SEQ ID NO: 2480346 - RNA, 22 nt, Human
uauggccugugagcuaggaauu

SEQ ID NO: 2480347 - RNA, 19 nt, Human
uaugcugaaacagaauacu

SEQ ID NO: 2480348 - RNA, 19 nt, Human
uaugcucugcauguuacau

SEQ ID NO: 2480349 - RNA, 12 nt, Human
uauggccucagc

SEQ ID NO: 2480350 - RNA, 19 nt, Human
uauggccucagcugccuca

SEQ ID NO: 2480351 - RNA, 23 nt, Human
uauggccucagcugccucacuuc

SEQ ID NO: 2480352 - RNA, 22 nt, Human
uauggcccuggccuagcauacg

SEQ ID NO: 2480353 - RNA, 21 nt, Human
uaugaugacucccuuaaaaua

SEQ ID NO: 2480354 - RNA, 19 nt, Human
uaugaucucagguucuccu

SEQ ID NO: 2480355 - RNA, 21 nt, Human
uaugauggguguuuuuagcag

SEQ ID NO: 2480356 - RNA, 15 nt, Human
uaugaucccagcacu

SEQ ID NO: 2480357 - RNA, 15 nt, Human
uaugaucgcgccacu

SEQ ID NO: 2480358 - RNA, 14 nt, Human
uaugcucugcaugu

SEQ ID NO: 2480359 - RNA, 18 nt, Human
uaugcucugcauguuaca

SEQ ID NO: 2480360 - RNA, 22 nt, Human
uaugaugauacaagauuagaag

SEQ ID NO: 2480361 - RNA, 15 nt, Human
uaugaugcuguugcc

SEQ ID NO: 2480362 - RNA, 13 nt, Human
uaugauguauauu

SEQ ID NO: 2480363 - RNA, 18 nt, Human
uaugauguguugugauag

SEQ ID NO: 2480364 - RNA, 17 nt, Human
uaugauguguugugaua

SEQ ID NO: 2480365 - RNA, 15 nt, Human
uaugauguguuguga

SEQ ID NO: 2480366 - RNA, 18 nt, Human
uaugaugugggucaagga

SEQ ID NO: 2480367 - RNA, 14 nt, Human
uaugaucacggcuc

SEQ ID NO: 2480368 - RNA, 21 nt, Human
uaugaguuucauagcuaagaa

SEQ ID NO: 2480369 - RNA, 17 nt, Human
uaugaguuucauagcua

SEQ ID NO: 2480370 - RNA, 21 nt, Human
uaugaguuuuugauagcuuua

SEQ ID NO: 2480371 - RNA, 22 nt, Human
uaugaguuuuugauagcuuuau

SEQ ID NO: 2480372 - RNA, 23 nt, Human
uaugaguuuuugauagcuuuauu

SEQ ID NO: 2480373 - RNA, 17 nt, Human
uaugagucaaugugcag

SEQ ID NO: 2480374 - RNA, 16 nt, Human
uaugagucaaugugca

SEQ ID NO: 2480375 - RNA, 23 nt, Human
uaugagucaaugugcaguguagc

SEQ ID NO: 2480376 - RNA, 18 nt, Human
uaugaguuguuuucagac

SEQ ID NO: 2480377 - RNA, 22 nt, Human
uaugaguuguuuucagacucag

SEQ ID NO: 2480378 - RNA, 15 nt, Human
uaugagggaaaauga

SEQ ID NO: 2480379 - RNA, 19 nt, Human
uaugaggucuaggaacaua

SEQ ID NO: 2480380 - RNA, 15 nt, Human
uaugagucaaugugc

SEQ ID NO: 2480381 - RNA, 15 nt, Human
uaugaggucuaggaa

SEQ ID NO: 2480382 - RNA, 23 nt, Human
uaugaucacggcucacugcagcc

SEQ ID NO: 2480383 - RNA, 21 nt, Human
uaugaucacggcucacugcag

SEQ ID NO: 2480384 - RNA, 13 nt, Human
uaugaggcauuug

SEQ ID NO: 2480385 - RNA, 14 nt, Human
uaugaggaugcaga

SEQ ID NO: 2480386 - RNA, 22 nt, Human
uaugaggcaaccacaggcagca

SEQ ID NO: 2480387 - RNA, 21 nt, Human
uaugagcuuccuucugugaaa

SEQ ID NO: 2480388 - RNA, 20 nt, Human
uaucuuggacugacauuuag

SEQ ID NO: 2480389 - RNA, 17 nt, Human
uaugaggaauaauuauu

SEQ ID NO: 2480390 - RNA, 23 nt, Human
uaugaggacuugugucucugugc

SEQ ID NO: 2480391 - RNA, 17 nt, Human
uaugaggacuugugucu

SEQ ID NO: 2480392 - RNA, 16 nt, Human
uaugagcuuuauguaa

SEQ ID NO: 2480393 - RNA, 15 nt, Human
uaucuugaagacuuu

SEQ ID NO: 2480394 - RNA, 15 nt, Human
uaucuugaauaaugu

SEQ ID NO: 2480395 - RNA, 15 nt, Human
uaucuugcucuguaa

SEQ ID NO: 2480396 - RNA, 17 nt, Human
uaucuugcucuguaauc

SEQ ID NO: 2480397 - RNA, 18 nt, Human
uaugagcuuccuucugug

SEQ ID NO: 2480398 - RNA, 17 nt, Human
uaucuuggacugacauu

SEQ ID NO: 2480399 - RNA, 19 nt, Human
acagagugugcuggaggac

SEQ ID NO: 2480400 - RNA, 17 nt, Human
acagagugugcuggagg

SEQ ID NO: 2480401 - RNA, 18 nt, Human
acagaguuuucacucuua

SEQ ID NO: 2480402 - RNA, 13 nt, Human
acagauaagcaag

SEQ ID NO: 2480403 - RNA, 20 nt, Human
acagaguuuucacucuuauu

SEQ ID NO: 2480404 - RNA, 18 nt, Human
acagcagccccugcacaa

SEQ ID NO: 2480405 - RNA, 15 nt, Human
acagauaagcaagag

SEQ ID NO: 2480406 - RNA, 18 nt, Human
acagauaagcaagagaga

SEQ ID NO: 2480407 - RNA, 19 nt, Human
acagauaagcaagagagau

SEQ ID NO: 2480408 - RNA, 22 nt, Human
acagcagccuggggcuggccuc

SEQ ID NO: 2480409 - RNA, 14 nt, Human
acagcagcucaggc

SEQ ID NO: 2480410 - RNA, 18 nt, Human
acagcagcuucaccagag

SEQ ID NO: 2480411 - RNA, 17 nt, Human
acagcagcuucaccaga

SEQ ID NO: 2480412 - RNA, 16 nt, Human
acagcagcuucaccag

SEQ ID NO: 2480413 - RNA, 13 nt, Human
acagcagcuucac

SEQ ID NO: 2480414 - RNA, 22 nt, Human
acagcagcuucaccagagcauu

SEQ ID NO: 2480415 - RNA, 15 nt, Human
acagcagcucaggca

SEQ ID NO: 2480416 - RNA, 16 nt, Human
acagcagcucaggcac

SEQ ID NO: 2480417 - RNA, 12 nt, Human
acagcagcuuca

SEQ ID NO: 2480418 - RNA, 14 nt, Human
acagcagcugaaca

SEQ ID NO: 2480419 - RNA, 17 nt, Human
acagcagcucaggcaca

SEQ ID NO: 2480420 - RNA, 16 nt, Human
acagccucugaccccu

SEQ ID NO: 2480421 - RNA, 12 nt, Human
acagccucugac

SEQ ID NO: 2480422 - RNA, 23 nt, Human
acagccuccucugucugcccuuc

SEQ ID NO: 2480423 - RNA, 22 nt, Human
acagccuccucugucugcccuu

SEQ ID NO: 2480424 - RNA, 20 nt, Human
acagccuccucugucugccc

SEQ ID NO: 2480425 - RNA, 19 nt, Human
acagccuccucugucugcc

SEQ ID NO: 2480426 - RNA, 17 nt, Human
acagccuccucugucug

SEQ ID NO: 2480427 - RNA, 15 nt, Human
acagccuccucuguc

SEQ ID NO: 2480428 - RNA, 13 nt, Human
acagccuccucug

SEQ ID NO: 2480429 - RNA, 12 nt, Human
acagccuccucu

SEQ ID NO: 2480430 - RNA, 16 nt, Human
acagccccagagcagg

SEQ ID NO: 2480431 - RNA, 18 nt, Human
acagccuccccugccagg

SEQ ID NO: 2480432 - RNA, 19 nt, Human
acagccuccccugccaggg

SEQ ID NO: 2480433 - RNA, 21 nt, Human
acagccuccccugccagggca

SEQ ID NO: 2480434 - RNA, 22 nt, Human
acagccuccccugccagggcag

SEQ ID NO: 2480435 - RNA, 15 nt, Human
acagccuccccugcc

SEQ ID NO: 2480436 - RNA, 17 nt, Human
acagccuccccugccag

SEQ ID NO: 2480437 - RNA, 15 nt, Human
acagccucccacccc

SEQ ID NO: 2480438 - RNA, 16 nt, Human
acagccucccaccccc

SEQ ID NO: 2480439 - RNA, 17 nt, Human
acagccccagagcaggg

SEQ ID NO: 2480440 - RNA, 18 nt, Human
acagccucacuugaaugu

SEQ ID NO: 2480441 - RNA, 15 nt, Human
acagccccagagcag

SEQ ID NO: 2480442 - RNA, 14 nt, Human
acagccccagagca

SEQ ID NO: 2480443 - RNA, 13 nt, Human
acagccccagagc

SEQ ID NO: 2480444 - RNA, 15 nt, Human
acagccccacccugg

SEQ ID NO: 2480445 - RNA, 13 nt, Human
acagccccacccu

SEQ ID NO: 2480446 - RNA, 14 nt, Human
acagccccacccug

SEQ ID NO: 2480447 - RNA, 12 nt, Human
acagccccaccc

SEQ ID NO: 2480448 - RNA, 20 nt, Human
acagcccacguccugucagu

SEQ ID NO: 2480449 - RNA, 19 nt, Human
acagcccacguccugucag

SEQ ID NO: 2480450 - RNA, 17 nt, Human
acagcccacguccuguc

SEQ ID NO: 2480451 - RNA, 13 nt, Human
acagcccaccugg

SEQ ID NO: 2480452 - RNA, 16 nt, Human
acagcccacguccugu

SEQ ID NO: 2480453 - RNA, 15 nt, Human
acagcccacguccug

SEQ ID NO: 2480454 - RNA, 19 nt, Human
acagcccaaagaaggaaaa

SEQ ID NO: 2480455 - RNA, 20 nt, Human
acaccucagaggcuguucuu

SEQ ID NO: 2480456 - RNA, 18 nt, Human
acaccucaguucccuugg

SEQ ID NO: 2480457 - RNA, 21 nt, Human
acaccucaguucccuuggccu

SEQ ID NO: 2480458 - RNA, 22 nt, Human
acaccuagcuuuauucuucaga

SEQ ID NO: 2480459 - RNA, 17 nt, Human
acaccuaugucauuuca

SEQ ID NO: 2480460 - RNA, 20 nt, Human
acaccuaugucauuucauuu

SEQ ID NO: 2480461 - RNA, 18 nt, Human
acaccuagcuuuauucuu

SEQ ID NO: 2480462 - RNA, 21 nt, Human
acaccuagcuuuauucuucag

SEQ ID NO: 2480463 - RNA, 18 nt, Human
uauaacaaugcuguauuu

SEQ ID NO: 2480464 - RNA, 20 nt, Human
acaccuccacaguucagugg

SEQ ID NO: 2480465 - RNA, 21 nt, Human
acaccucagaggcuguucuug

SEQ ID NO: 2480466 - RNA, 12 nt, Human
acaccucccagg

SEQ ID NO: 2480467 - RNA, 22 nt, Human
acaccucaguucccuuggccuc

SEQ ID NO: 2480468 - RNA, 23 nt, Human
acaccucaguucccuuggccuca

SEQ ID NO: 2480469 - RNA, 20 nt, Human
uauaaccacaaagcacaguu

SEQ ID NO: 2480470 - RNA, 21 nt, Human
uauaacagguuauuuuaguuu

SEQ ID NO: 2480471 - RNA, 20 nt, Human
uauaacagguuauuuuaguu

SEQ ID NO: 2480472 - RNA, 15 nt, Human
uauaacagguuauuu

SEQ ID NO: 2480473 - RNA, 13 nt, Human
uauaacagguuau

SEQ ID NO: 2480474 - RNA, 12 nt, Human
uauaacagguua

SEQ ID NO: 2480475 - RNA, 14 nt, Human
acaccagccaggcu

SEQ ID NO: 2480476 - RNA, 16 nt, Human
uauaagcccacuguua

SEQ ID NO: 2480477 - RNA, 21 nt, Human
uauaauuuaccugaagucuuu

SEQ ID NO: 2480478 - RNA, 14 nt, Human
uauaauuuugugaa

SEQ ID NO: 2480479 - RNA, 17 nt, Human
uauaauuuuaugaaugu

SEQ ID NO: 2480480 - RNA, 22 nt, Human
uauaauuuuaugaaugucuuug

SEQ ID NO: 2480481 - RNA, 16 nt, Human
uauaagauuagaauga

SEQ ID NO: 2480482 - RNA, 16 nt, Human
uauaagaggcugauaa

SEQ ID NO: 2480483 - RNA, 19 nt, Human
uauaagaauaaaauguuga

SEQ ID NO: 2480484 - RNA, 20 nt, Human
uauaaccaguguuguggauu

SEQ ID NO: 2480485 - RNA, 16 nt, Human
uauaagaauaaaaugu

SEQ ID NO: 2480486 - RNA, 20 nt, Human
uauaagaagcuuucaguauu

SEQ ID NO: 2480487 - RNA, 15 nt, Human
uauagauuauaacuu

SEQ ID NO: 2480488 - RNA, 16 nt, Human
uauagauuauaacuug

SEQ ID NO: 2480489 - RNA, 19 nt, Human
uauaccaguauaauugagu

SEQ ID NO: 2480490 - RNA, 19 nt, Human
uauaccauggugaauuaau

SEQ ID NO: 2480491 - RNA, 22 nt, Human
uauacaguaacuuuauguguaa

SEQ ID NO: 2480492 - RNA, 14 nt, Human
uauacauuugauaa

SEQ ID NO: 2480493 - RNA, 17 nt, Human
uauacauucuuuaucuu

SEQ ID NO: 2480494 - RNA, 16 nt, Human
uauacauucuuuaucu

SEQ ID NO: 2480495 - RNA, 22 nt, Human
uauacauucuuuaucuugacau

SEQ ID NO: 2480496 - RNA, 17 nt, Human
uauaccagcaauauauc

SEQ ID NO: 2480497 - RNA, 13 nt, Human
uauacauaaacaa

SEQ ID NO: 2480498 - RNA, 14 nt, Human
uauacauaaacaag

SEQ ID NO: 2480499 - RNA, 14 nt, Human
uauacacuguaaug

SEQ ID NO: 2480500 - RNA, 11 nt, Human
uauacacauaa

SEQ ID NO: 2480501 - RNA, 21 nt, Human
uauacacuuacacuuuaugca

SEQ ID NO: 2480502 - RNA, 19 nt, Human
uauacaguaacuuuaugug

SEQ ID NO: 2480503 - RNA, 18 nt, Human
uauacaguaacuuuaugu

SEQ ID NO: 2480504 - RNA, 16 nt, Human
uauacaguaacuuuau

SEQ ID NO: 2480505 - RNA, 21 nt, Human
uauacaguaacuuuaugugua

SEQ ID NO: 2480506 - RNA, 20 nt, Human
uauacaguaacuuuaugugu

SEQ ID NO: 2480507 - RNA, 19 nt, Human
uauaauuuugugaagcaaa

SEQ ID NO: 2480508 - RNA, 21 nt, Human
uauacaacagugcuaaaaaug

SEQ ID NO: 2480509 - RNA, 20 nt, Human
uauacaacagugcuaaaaau

SEQ ID NO: 2480510 - RNA, 16 nt, Human
uauacaacagugcuaa

SEQ ID NO: 2480511 - RNA, 15 nt, Human
uauacaacagugcua

SEQ ID NO: 2480512 - RNA, 14 nt, Human
uauacaacagugcu

SEQ ID NO: 2480513 - RNA, 15 nt, Human
uauacaauaacauaa

SEQ ID NO: 2480514 - RNA, 22 nt, Human
uauacaacccuggcauuauguc

SEQ ID NO: 2480515 - RNA, 21 nt, Human
uauacaacccuggcauuaugu

SEQ ID NO: 2480516 - RNA, 12 nt, Human
uauacacacagc

SEQ ID NO: 2480517 - RNA, 22 nt, Human
uauauaucauauugguauucac

SEQ ID NO: 2480518 - RNA, 16 nt, Human
uauauauccucuguau

SEQ ID NO: 2480519 - RNA, 14 nt, Human
uauauauccucugu

SEQ ID NO: 2480520 - RNA, 19 nt, Human
uauaucacauguuuucucu

SEQ ID NO: 2480521 - RNA, 13 nt, Human
uauaucagaaaag

SEQ ID NO: 2480522 - RNA, 22 nt, Human
uauaucaacagauaguuguguu

SEQ ID NO: 2480523 - RNA, 18 nt, Human
uauaucagaaaagggaag

SEQ ID NO: 2480524 - RNA, 11 nt, Human
uauaucagccu

SEQ ID NO: 2480525 - RNA, 14 nt, Human
uauauauauaaaau

SEQ ID NO: 2480526 - RNA, 13 nt, Human
uauauauauauau

SEQ ID NO: 2480527 - RNA, 14 nt, Human
uauauauauaaaca

SEQ ID NO: 2480528 - RNA, 13 nt, Human
uauauauauaaaa

SEQ ID NO: 2480529 - RNA, 13 nt, Human
uauauaucaaaua

SEQ ID NO: 2480530 - RNA, 16 nt, Human
uauauccuuucuaaca

SEQ ID NO: 2480531 - RNA, 19 nt, Human
acacucauugaccugaggc

SEQ ID NO: 2480532 - RNA, 14 nt, Human
uauaucccagaaau

SEQ ID NO: 2480533 - RNA, 23 nt, Human
uauaucagccugagucuccugug

SEQ ID NO: 2480534 - RNA, 15 nt, Human
uauaucagccugagu

SEQ ID NO: 2480535 - RNA, 20 nt, Human
uauauccaaaagcuuuuuau

SEQ ID NO: 2480536 - RNA, 14 nt, Human
uauauccauguacu

SEQ ID NO: 2480537 - RNA, 15 nt, Human
uauauccauguacug

SEQ ID NO: 2480538 - RNA, 16 nt, Human
uauauccauguacugu

SEQ ID NO: 2480539 - RNA, 17 nt, Human
uauauccauguacugua

SEQ ID NO: 2480540 - RNA, 18 nt, Human
uauauccauguacuguag

SEQ ID NO: 2480541 - RNA, 19 nt, Human
uauauccauguacuguagu

SEQ ID NO: 2480542 - RNA, 23 nt, Human
acacucauugaccugaggcccuu

SEQ ID NO: 2480543 - RNA, 21 nt, Human
acacucauugaccugaggccc

SEQ ID NO: 2480544 - RNA, 15 nt, Human
acacuccaauuaagg

SEQ ID NO: 2480545 - RNA, 16 nt, Human
acacuccaauuaagga

SEQ ID NO: 2480546 - RNA, 14 nt, Human
acacuccaagauau

SEQ ID NO: 2480547 - RNA, 19 nt, Human
acacuccagugccagcaau

SEQ ID NO: 2480548 - RNA, 16 nt, Human
acacuccagugccagc

SEQ ID NO: 2480549 - RNA, 16 nt, Human
acacuccaagauaugg

SEQ ID NO: 2480550 - RNA, 21 nt, Human
acacuccagugccagcaauga

SEQ ID NO: 2480551 - RNA, 14 nt, Human
acacuccaucagcu

SEQ ID NO: 2480552 - RNA, 14 nt, Human
uauagauuugaccu

SEQ ID NO: 2480553 - RNA, 20 nt, Human
uauagccuaggugacagagu

SEQ ID NO: 2480554 - RNA, 13 nt, Human
uauacaacagugc

SEQ ID NO: 2480555 - RNA, 22 nt, Human
uauagcuauuacugucugguuu

SEQ ID NO: 2480556 - RNA, 14 nt, Human
uauagcuauuacug

SEQ ID NO: 2480557 - RNA, 11 nt, Human
uauagcuauua

SEQ ID NO: 2480558 - RNA, 16 nt, Human
uauagcuacaggaagc

SEQ ID NO: 2480559 - RNA, 22 nt, Human
uauagcuacaggaagcacccca

SEQ ID NO: 2480560 - RNA, 14 nt, Human
uauaggaauugacc

SEQ ID NO: 2480561 - RNA, 19 nt, Human
uauaggaauugacccacaa

SEQ ID NO: 2480562 - RNA, 13 nt, Human
uauaggaauugac

SEQ ID NO: 2480563 - RNA, 12 nt, Human
uauagcuauuuu

SEQ ID NO: 2480564 - RNA, 13 nt, Human
uauagcuauuuuu

SEQ ID NO: 2480565 - RNA, 18 nt, Human
uauauauaauucuguaca

SEQ ID NO: 2480566 - RNA, 13 nt, Human
uauauauaaauaa

SEQ ID NO: 2480567 - RNA, 16 nt, Human
uauauauaauucugua

SEQ ID NO: 2480568 - RNA, 14 nt, Human
uauauauaaauaaa

SEQ ID NO: 2480569 - RNA, 12 nt, Human
uauauauaaaua

SEQ ID NO: 2480570 - RNA, 12 nt, Human
uauauauaaacc

SEQ ID NO: 2480571 - RNA, 13 nt, Human
uauauauaaaaua

SEQ ID NO: 2480572 - RNA, 12 nt, Human
uauauauaaaau

SEQ ID NO: 2480573 - RNA, 16 nt, Human
uauauauaaaccuaaa

SEQ ID NO: 2480574 - RNA, 13 nt, Human
uauauauaaaccu

SEQ ID NO: 2480575 - RNA, 13 nt, Human
uauauauacagua

SEQ ID NO: 2480576 - RNA, 20 nt, Human
uauauauaauucuguacaua

SEQ ID NO: 2480577 - RNA, 19 nt, Human
uauauauaauucuguacau

SEQ ID NO: 2480578 - RNA, 12 nt, Human
uauauauagaau

SEQ ID NO: 2480579 - RNA, 13 nt, Human
uauauauagaauc

SEQ ID NO: 2480580 - RNA, 21 nt, Human
uauaggugcuacaaaaacaca

SEQ ID NO: 2480581 - RNA, 20 nt, Human
uauaggugcuacaaaaacac

SEQ ID NO: 2480582 - RNA, 23 nt, Human
uauaggugcuacaaaaacacagc

SEQ ID NO: 2480583 - RNA, 17 nt, Human
uauagguuuuguuugcu

SEQ ID NO: 2480584 - RNA, 10 nt, Human
uauauauaaa

SEQ ID NO: 2480585 - RNA, 16 nt, Human
uauagguuuuguuugc

SEQ ID NO: 2480586 - RNA, 22 nt, Human
uauagguugugcaaauuaacag

SEQ ID NO: 2480587 - RNA, 15 nt, Human
uauagguugugcaaa

SEQ ID NO: 2480588 - RNA, 18 nt, Human
uauagguuuuaaagaccu

SEQ ID NO: 2480589 - RNA, 18 nt, Human
uaguucuguagaaauggu

SEQ ID NO: 2480590 - RNA, 16 nt, Human
uaguucuguagaaaug

SEQ ID NO: 2480591 - RNA, 15 nt, Human
uaguucuguagaaau

SEQ ID NO: 2480592 - RNA, 14 nt, Human
uaguucuguagaaa

SEQ ID NO: 2480593 - RNA, 13 nt, Human
uaguucuguagaa

SEQ ID NO: 2480594 - RNA, 16 nt, Human
uaguuuuauaugcuuc

SEQ ID NO: 2480595 - RNA, 21 nt, Human
uaguuuuaucacauguauguu

SEQ ID NO: 2480596 - RNA, 20 nt, Human
uaguuuuaucacauguaugu

SEQ ID NO: 2480597 - RNA, 19 nt, Human
uaguuuuaucacauguaug

SEQ ID NO: 2480598 - RNA, 17 nt, Human
uaguuuuaucacaugua

SEQ ID NO: 2480599 - RNA, 16 nt, Human
uaguuccugcuacaac

SEQ ID NO: 2480600 - RNA, 15 nt, Human
uaguucguagcuuuc

SEQ ID NO: 2480601 - RNA, 19 nt, Human
uaguucucagcucuucuga

SEQ ID NO: 2480602 - RNA, 20 nt, Human
uaguucucacuguucccucu

SEQ ID NO: 2480603 - RNA, 18 nt, Human
uaguuacuguugugaccu

SEQ ID NO: 2480604 - RNA, 17 nt, Human
uaguuacuguugugacc

SEQ ID NO: 2480605 - RNA, 22 nt, Human
uaguuagccaauauuuuucuua

SEQ ID NO: 2480606 - RNA, 16 nt, Human
uagugacuuguguccc

SEQ ID NO: 2480607 - RNA, 15 nt, Human
uagugaucacagcag

SEQ ID NO: 2480608 - RNA, 14 nt, Human
uagugaucacagca

SEQ ID NO: 2480609 - RNA, 20 nt, Human
uagugaucacagcagcuucu

SEQ ID NO: 2480610 - RNA, 17 nt, Human
uagugaucugaacagaa

SEQ ID NO: 2480611 - RNA, 18 nt, Human
uagugaucugaacagaaa

SEQ ID NO: 2480612 - RNA, 20 nt, Human
uaguuccucauuagcauuuu

SEQ ID NO: 2480613 - RNA, 15 nt, Human
uaguuauaguuucag

SEQ ID NO: 2480614 - RNA, 12 nt, Human
uaguuccugcua

SEQ ID NO: 2480615 - RNA, 23 nt, Human
uaguucccugaaaacccagagag

SEQ ID NO: 2480616 - RNA, 16 nt, Human
uaguuaggaaauaaaa

SEQ ID NO: 2480617 - RNA, 18 nt, Human
uaguuaggaaauaaaacc

SEQ ID NO: 2480618 - RNA, 21 nt, Human
uaguuaggaaauaaaaccuuu

SEQ ID NO: 2480619 - RNA, 22 nt, Human
uaguuaggaaauaaaaccuuuc

SEQ ID NO: 2480620 - RNA, 15 nt, Human
uaguuaggauagcau

SEQ ID NO: 2480621 - RNA, 21 nt, Human
uaguuacuguugugaccugaa

SEQ ID NO: 2480622 - RNA, 23 nt, Human
uaguuaggaaauaaaaccuuuca

SEQ ID NO: 2480623 - RNA, 20 nt, Human
uaguuaggauagcauuuuug

SEQ ID NO: 2480624 - RNA, 15 nt, Human
uaguuaguagcaugu

SEQ ID NO: 2480625 - RNA, 16 nt, Human
uaguuaguagcauguu

SEQ ID NO: 2480626 - RNA, 21 nt, Human
uagucaggugccucaagagaa

SEQ ID NO: 2480627 - RNA, 23 nt, Human
uagucacugccugcagaggucug

SEQ ID NO: 2480628 - RNA, 17 nt, Human
acaaggaaggugguggg

SEQ ID NO: 2480629 - RNA, 21 nt, Human
acaaggaagucaaagcaagga

SEQ ID NO: 2480630 - RNA, 20 nt, Human
acaagcuuuuuuacacaaau

SEQ ID NO: 2480631 - RNA, 18 nt, Human
acaagcuggaagcacaug

SEQ ID NO: 2480632 - RNA, 16 nt, Human
acaagcuggaagcaca

SEQ ID NO: 2480633 - RNA, 19 nt, Human
acaagcugcacccucaggc

SEQ ID NO: 2480634 - RNA, 21 nt, Human
acaagcugcacccucaggcag

SEQ ID NO: 2480635 - RNA, 22 nt, Human
acaagcugcacccucaggcagg

SEQ ID NO: 2480636 - RNA, 23 nt, Human
acaagcugcacccucaggcaggu

SEQ ID NO: 2480637 - RNA, 17 nt, Human
uagucucugugcuuuga

SEQ ID NO: 2480638 - RNA, 14 nt, Human
uagucucugugcuu

SEQ ID NO: 2480639 - RNA, 23 nt, Human
uagucucucuggggccacacaga

SEQ ID NO: 2480640 - RNA, 21 nt, Human
uagucucuaucauuaaaguuc

SEQ ID NO: 2480641 - RNA, 20 nt, Human
uagucucuaucauuaaaguu

SEQ ID NO: 2480642 - RNA, 22 nt, Human
uagucuccuuugcacugagggc

SEQ ID NO: 2480643 - RNA, 21 nt, Human
uagucuccuuugcacugaggg

SEQ ID NO: 2480644 - RNA, 20 nt, Human
uagucuccuuugcacugagg

SEQ ID NO: 2480645 - RNA, 23 nt, Human
uagucugcaaaaugaggaaugua

SEQ ID NO: 2480646 - RNA, 21 nt, Human
uagucucuuguauuaaacucu

SEQ ID NO: 2480647 - RNA, 22 nt, Human
uagugagcagucaggaaagaga

SEQ ID NO: 2480648 - RNA, 20 nt, Human
uagugacccggaggccacau

SEQ ID NO: 2480649 - RNA, 18 nt, Human
uagugacccggaggccac

SEQ ID NO: 2480650 - RNA, 12 nt, Human
uagucugguuuc

SEQ ID NO: 2480651 - RNA, 13 nt, Human
uagucugguuucu

SEQ ID NO: 2480652 - RNA, 18 nt, Human
uagucugugugaagguga

SEQ ID NO: 2480653 - RNA, 19 nt, Human
uagucuccuuugcacugag

SEQ ID NO: 2480654 - RNA, 18 nt, Human
uagucuccuuugcacuga

SEQ ID NO: 2480655 - RNA, 17 nt, Human
uagucuccuuugcacug

SEQ ID NO: 2480656 - RNA, 21 nt, Human
uagucucauuacuuuugaagu

SEQ ID NO: 2480657 - RNA, 22 nt, Human
uagucucaguuugugugucuua

SEQ ID NO: 2480658 - RNA, 19 nt, Human
uagucucaguuuguguguc

SEQ ID NO: 2480659 - RNA, 18 nt, Human
uaguccaaugucuuuuua

SEQ ID NO: 2480660 - RNA, 11 nt, Human
uagucucaguu

SEQ ID NO: 2480661 - RNA, 22 nt, Human
uaguccaaugucuuuuuaagcu

SEQ ID NO: 2480662 - RNA, 13 nt, Human
uagucaugugacc

SEQ ID NO: 2480663 - RNA, 13 nt, Human
uagucacuuuuuu

SEQ ID NO: 2480664 - RNA, 17 nt, Human
uagucacuuauuucaua

SEQ ID NO: 2480665 - RNA, 20 nt, Human
uagucacuuuuuuuuuccaa

SEQ ID NO: 2480666 - RNA, 22 nt, Human
uauaaaauaauuuuuauauuug

SEQ ID NO: 2480667 - RNA, 21 nt, Human
uauaaaauaauuuuuauauuu

SEQ ID NO: 2480668 - RNA, 17 nt, Human
uauaaaagccuguuuaa

SEQ ID NO: 2480669 - RNA, 14 nt, Human
uauaaaagccuguu

SEQ ID NO: 2480670 - RNA, 23 nt, Human
uauaaaagauggggucuguaaaa

SEQ ID NO: 2480671 - RNA, 22 nt, Human
uauaaaagauggggucuguaaa

SEQ ID NO: 2480672 - RNA, 21 nt, Human
uauaaaagauggggucuguaa

SEQ ID NO: 2480673 - RNA, 20 nt, Human
uauaaaagauggggucugua

SEQ ID NO: 2480674 - RNA, 12 nt, Human
uauaaaagccug

SEQ ID NO: 2480675 - RNA, 17 nt, Human
uaguuuucaguuuguau

SEQ ID NO: 2480676 - RNA, 11 nt, Human
uauaaaagaug

SEQ ID NO: 2480677 - RNA, 23 nt, Human
uaguuuucauacacagccugggc

SEQ ID NO: 2480678 - RNA, 22 nt, Human
acacaucagcuugcccuguuaa

SEQ ID NO: 2480679 - RNA, 23 nt, Human
uauaaaauaauuuuuauauuuga

SEQ ID NO: 2480680 - RNA, 22 nt, Human
uauaaaauaaauauauauaaac

SEQ ID NO: 2480681 - RNA, 21 nt, Human
uauaaaauaaauauauauaaa

SEQ ID NO: 2480682 - RNA, 12 nt, Human
acacaucaguca

SEQ ID NO: 2480683 - RNA, 20 nt, Human
acacaucccuaaugugugcc

SEQ ID NO: 2480684 - RNA, 19 nt, Human
acacaugcaaggucauuuu

SEQ ID NO: 2480685 - RNA, 20 nt, Human
acacaugcaaggucauuuuu

SEQ ID NO: 2480686 - RNA, 18 nt, Human
acacaugcaaggucauuu

SEQ ID NO: 2480687 - RNA, 19 nt, Human
acacaucccuaaugugugc

SEQ ID NO: 2480688 - RNA, 17 nt, Human
acacaucccuaaugugu

SEQ ID NO: 2480689 - RNA, 12 nt, Human
acacaucuccuc

SEQ ID NO: 2480690 - RNA, 14 nt, Human
acacaucuccucca

SEQ ID NO: 2480691 - RNA, 15 nt, Human
acacaucuucaacag

SEQ ID NO: 2480692 - RNA, 21 nt, Human
acacaugcaaggucauuuuuu

SEQ ID NO: 2480693 - RNA, 17 nt, Human
acaccagccaggcucug

SEQ ID NO: 2480694 - RNA, 16 nt, Human
acaccagccaggcucu

SEQ ID NO: 2480695 - RNA, 13 nt, Human
acacaucuuuccu

SEQ ID NO: 2480696 - RNA, 13 nt, Human
acacaucuucccu

SEQ ID NO: 2480697 - RNA, 14 nt, Human
acacaucuucccua

SEQ ID NO: 2480698 - RNA, 15 nt, Human
acacaucuucccuag

SEQ ID NO: 2480699 - RNA, 12 nt, Human
acaccaggccgu

SEQ ID NO: 2480700 - RNA, 19 nt, Human
acaccaggagucccuggua

SEQ ID NO: 2480701 - RNA, 23 nt, Human
acaccagcuguucugucccuugg

SEQ ID NO: 2480702 - RNA, 15 nt, Human
acaccagcuguucug

SEQ ID NO: 2480703 - RNA, 17 nt, Human
acaccaggagucccugg

SEQ ID NO: 2480704 - RNA, 17 nt, Human
acaccagccccugcccc

SEQ ID NO: 2480705 - RNA, 15 nt, Human
acaccagccccugcc

SEQ ID NO: 2480706 - RNA, 13 nt, Human
acaccagccccug

SEQ ID NO: 2480707 - RNA, 22 nt, Human
acaccagccaggcucugugcug

SEQ ID NO: 2480708 - RNA, 22 nt, Human
acaccagccccugccccagccc

SEQ ID NO: 2480709 - RNA, 21 nt, Human
acaccagccccugccccagcc

SEQ ID NO: 2480710 - RNA, 19 nt, Human
acaccagccucgucuucau

SEQ ID NO: 2480711 - RNA, 20 nt, Human
acaccagccuuucucccagg

SEQ ID NO: 2480712 - RNA, 21 nt, Human
acacccagcccacuucugcca

SEQ ID NO: 2480713 - RNA, 20 nt, Human
acacccagcccacuucugcc

SEQ ID NO: 2480714 - RNA, 19 nt, Human
acacccagcccacuucugc

SEQ ID NO: 2480715 - RNA, 22 nt, Human
acaccaggccguccucccgggc

SEQ ID NO: 2480716 - RNA, 21 nt, Human
acaccaggccguccucccggg

SEQ ID NO: 2480717 - RNA, 12 nt, Human
acaccaggcugu

SEQ ID NO: 2480718 - RNA, 14 nt, Human
acaccaggcugugg

SEQ ID NO: 2480719 - RNA, 21 nt, Human
acaccaggcuugccugcaggc

SEQ ID NO: 2480720 - RNA, 18 nt, Human
acacccugugauggggcc

SEQ ID NO: 2480721 - RNA, 12 nt, Human
acacccugugau

SEQ ID NO: 2480722 - RNA, 11 nt, Human
acacccuguga

SEQ ID NO: 2480723 - RNA, 18 nt, Human
acaccaggcugugggccu

SEQ ID NO: 2480724 - RNA, 18 nt, Human
acaccuaccaaaaaauaa

SEQ ID NO: 2480725 - RNA, 22 nt, Human
acaccuaagggacauguuuuga

SEQ ID NO: 2480726 - RNA, 21 nt, Human
acaccuacucuaucagagaaa

SEQ ID NO: 2480727 - RNA, 15 nt, Human
acaccuagcaucuca

SEQ ID NO: 2480728 - RNA, 20 nt, Human
acaccguguaaaccaaagcc

SEQ ID NO: 2480729 - RNA, 19 nt, Human
acaccguguaaaccaaagc

SEQ ID NO: 2480730 - RNA, 18 nt, Human
acaccuaagggacauguu

SEQ ID NO: 2480731 - RNA, 14 nt, Human
acaccuaagggaca

SEQ ID NO: 2480732 - RNA, 15 nt, Human
acaccuaacucaccu

SEQ ID NO: 2480733 - RNA, 17 nt, Human
acaccguguaaaccaaa

SEQ ID NO: 2480734 - RNA, 19 nt, Human
acaccgggguggugggaac

SEQ ID NO: 2480735 - RNA, 22 nt, Human
acacccuguacuguucuguguc

SEQ ID NO: 2480736 - RNA, 16 nt, Human
acaccgggccuggaga

SEQ ID NO: 2480737 - RNA, 13 nt, Human
acacccuguacug

SEQ ID NO: 2480738 - RNA, 13 nt, Human
ucccucaucucuc

SEQ ID NO: 2480739 - RNA, 16 nt, Human
ucccucaucugucccu

SEQ ID NO: 2480740 - RNA, 16 nt, Human
ucccucagugcccuca

SEQ ID NO: 2480741 - RNA, 20 nt, Human
ucccucaccuuggcaccaga

SEQ ID NO: 2480742 - RNA, 22 nt, Human
ucccucauccucauacccaccc

SEQ ID NO: 2480743 - RNA, 22 nt, Human
ucccucacccugagccccuucc

SEQ ID NO: 2480744 - RNA, 15 nt, Human
ucccucaccuuggca

SEQ ID NO: 2480745 - RNA, 21 nt, Human
ucccucagucuggcccuuccu

SEQ ID NO: 2480746 - RNA, 18 nt, Human
acucaucuagguaaauua

SEQ ID NO: 2480747 - RNA, 16 nt, Human
acucaucuagguaaau

SEQ ID NO: 2480748 - RNA, 23 nt, Human
ucccucauuccaccuucccaugc

SEQ ID NO: 2480749 - RNA, 21 nt, Human
ucccucaucugucccuccggg

SEQ ID NO: 2480750 - RNA, 9 nt, Human
acucaucau

SEQ ID NO: 2480751 - RNA, 12 nt, Human
acucaucauaaa

SEQ ID NO: 2480752 - RNA, 13 nt, Human
acucaucauaaaa

SEQ ID NO: 2480753 - RNA, 14 nt, Human
acucaucauaaaau

SEQ ID NO: 2480754 - RNA, 15 nt, Human
acucaucauaaaaua

SEQ ID NO: 2480755 - RNA, 14 nt, Human
acucaugcugaaag

SEQ ID NO: 2480756 - RNA, 13 nt, Human
acucaugcugaaa

SEQ ID NO: 2480757 - RNA, 12 nt, Human
acucaugcugaa

SEQ ID NO: 2480758 - RNA, 15 nt, Human
acucaugaucuugug

SEQ ID NO: 2480759 - RNA, 21 nt, Human
acucaugaucuugugacauau

SEQ ID NO: 2480760 - RNA, 19 nt, Human
acucaucccuaaugcugca

SEQ ID NO: 2480761 - RNA, 14 nt, Human
acucaugagaaguu

SEQ ID NO: 2480762 - RNA, 16 nt, Human
acucaucauaaaauaa

SEQ ID NO: 2480763 - RNA, 17 nt, Human
acucaucauaaaauaaa

SEQ ID NO: 2480764 - RNA, 21 nt, Human
acucauugcugagccucugcu

SEQ ID NO: 2480765 - RNA, 22 nt, Human
acucauugcugagccucugcuc

SEQ ID NO: 2480766 - RNA, 23 nt, Human
acucauugcugagccucugcucc

SEQ ID NO: 2480767 - RNA, 21 nt, Human
acucauuuauaaagcuaaaau

SEQ ID NO: 2480768 - RNA, 16 nt, Human
acucauuuccuaugua

SEQ ID NO: 2480769 - RNA, 18 nt, Human
acucauugcugagccucu

SEQ ID NO: 2480770 - RNA, 20 nt, Human
acucauugcugagccucugc

SEQ ID NO: 2480771 - RNA, 15 nt, Human
acucauugcugagcc

SEQ ID NO: 2480772 - RNA, 16 nt, Human
acucaugcugaaagcc

SEQ ID NO: 2480773 - RNA, 18 nt, Human
acuccuacaccuaacuca

SEQ ID NO: 2480774 - RNA, 17 nt, Human
acuccuacaccuaacuc

SEQ ID NO: 2480775 - RNA, 16 nt, Human
acuccuacaccuaacu

SEQ ID NO: 2480776 - RNA, 23 nt, Human
acuccuagagaacgcagcccuag

SEQ ID NO: 2480777 - RNA, 22 nt, Human
acuccuagagaacgcagcccua

SEQ ID NO: 2480778 - RNA, 21 nt, Human
acuccuagagaacgcagcccu

SEQ ID NO: 2480779 - RNA, 20 nt, Human
acuccuagagaacgcagccc

SEQ ID NO: 2480780 - RNA, 14 nt, Human
acuccuaccuggua

SEQ ID NO: 2480781 - RNA, 14 nt, Human
acuccuaccucagc

SEQ ID NO: 2480782 - RNA, 15 nt, Human
acuccuaccucagcc

SEQ ID NO: 2480783 - RNA, 16 nt, Human
acuccuaccucagccu

SEQ ID NO: 2480784 - RNA, 17 nt, Human
acuccuaccucagccua

SEQ ID NO: 2480785 - RNA, 21 nt, Human
acuccugagaccccuggccuc

SEQ ID NO: 2480786 - RNA, 20 nt, Human
acuccugagaccccuggccu

SEQ ID NO: 2480787 - RNA, 18 nt, Human
acuccugagaccccuggc

SEQ ID NO: 2480788 - RNA, 17 nt, Human
acuccugagaccccugg

SEQ ID NO: 2480789 - RNA, 19 nt, Human
acuccugaggacagcuguc

SEQ ID NO: 2480790 - RNA, 17 nt, Human
acuccugaggacagcug

SEQ ID NO: 2480791 - RNA, 16 nt, Human
acuccugaggacagcu

SEQ ID NO: 2480792 - RNA, 23 nt, Human
acuccugagaccccuggccuccg

SEQ ID NO: 2480793 - RNA, 21 nt, Human
acuccugaggacagcuguccu

SEQ ID NO: 2480794 - RNA, 20 nt, Human
acuccugaggacagcugucc

SEQ ID NO: 2480795 - RNA, 13 nt, Human
acuccugcaaaau

SEQ ID NO: 2480796 - RNA, 15 nt, Human
acuccugcaaaauuu

SEQ ID NO: 2480797 - RNA, 20 nt, Human
acuccuaggcaggacaugcu

SEQ ID NO: 2480798 - RNA, 18 nt, Human
acuccuaggcaggacaug

SEQ ID NO: 2480799 - RNA, 16 nt, Human
acuccuaggcaggaca

SEQ ID NO: 2480800 - RNA, 13 nt, Human
acuccuaggcagg

SEQ ID NO: 2480801 - RNA, 16 nt, Human
acuccuaggaaaauac

SEQ ID NO: 2480802 - RNA, 15 nt, Human
acuccugaccucaag

SEQ ID NO: 2480803 - RNA, 20 nt, Human
acuccagcuggguuggaaaa

SEQ ID NO: 2480804 - RNA, 20 nt, Human
acuccagccugggcgacaga

SEQ ID NO: 2480805 - RNA, 20 nt, Human
acuccagccugggugacaga

SEQ ID NO: 2480806 - RNA, 21 nt, Human
acuccagccugggcaacacag

SEQ ID NO: 2480807 - RNA, 14 nt, Human
acuccaggagagga

SEQ ID NO: 2480808 - RNA, 13 nt, Human
acuccaggagagg

SEQ ID NO: 2480809 - RNA, 16 nt, Human
acuccacaucugccuu

SEQ ID NO: 2480810 - RNA, 15 nt, Human
acuccacaucugccu

SEQ ID NO: 2480811 - RNA, 14 nt, Human
acuccacaucugcc

SEQ ID NO: 2480812 - RNA, 13 nt, Human
acuccacaucugc

SEQ ID NO: 2480813 - RNA, 18 nt, Human
acuccagccugggcaaca

SEQ ID NO: 2480814 - RNA, 23 nt, Human
acuccagccugggcaacagagca

SEQ ID NO: 2480815 - RNA, 15 nt, Human
acuccagccugggcg

SEQ ID NO: 2480816 - RNA, 18 nt, Human
acuccagccugggcgaca

SEQ ID NO: 2480817 - RNA, 17 nt, Human
acuccaauuaaggauuu

SEQ ID NO: 2480818 - RNA, 21 nt, Human
acuccaauuaaggauuuuaug

SEQ ID NO: 2480819 - RNA, 19 nt, Human
acuccaagauauggacaca

SEQ ID NO: 2480820 - RNA, 20 nt, Human
acucauuuuaaaaaauggaa

SEQ ID NO: 2480821 - RNA, 18 nt, Human
acuccaacagaagaacug

SEQ ID NO: 2480822 - RNA, 19 nt, Human
acuccaacagaagaacugu

SEQ ID NO: 2480823 - RNA, 21 nt, Human
uccuagauggcagucacugaa

SEQ ID NO: 2480824 - RNA, 20 nt, Human
uccuagcacuuugggaggcc

SEQ ID NO: 2480825 - RNA, 14 nt, Human
uccuaggcauuugc

SEQ ID NO: 2480826 - RNA, 18 nt, Human
uccuagcacacacuuuug

SEQ ID NO: 2480827 - RNA, 19 nt, Human
uccuagcacacacuuuugg

SEQ ID NO: 2480828 - RNA, 17 nt, Human
uccuagcacacacuuuu

SEQ ID NO: 2480829 - RNA, 22 nt, Human
uccuagauggcagucacugaau

SEQ ID NO: 2480830 - RNA, 13 nt, Human
uccuagaugcucu

SEQ ID NO: 2480831 - RNA, 18 nt, Human
uccuagauggcagucacu

SEQ ID NO: 2480832 - RNA, 15 nt, Human
uccguuggccacucc

SEQ ID NO: 2480833 - RNA, 13 nt, Human
uccguuggccacu

SEQ ID NO: 2480834 - RNA, 22 nt, Human
uccguugggccccagccuucuu

SEQ ID NO: 2480835 - RNA, 17 nt, Human
uccuaaaacaccuggua

SEQ ID NO: 2480836 - RNA, 22 nt, Human
uccuaaaacaaaagcucaucca

SEQ ID NO: 2480837 - RNA, 15 nt, Human
uccuaaaacaaauag

SEQ ID NO: 2480838 - RNA, 23 nt, Human
uccuaaaauaagggcagagucac

SEQ ID NO: 2480839 - RNA, 14 nt, Human
uccuagaguagagu

SEQ ID NO: 2480840 - RNA, 22 nt, Human
uccuaaaauaagggcagaguca

SEQ ID NO: 2480841 - RNA, 17 nt, Human
uccuaaaauaagggcag

SEQ ID NO: 2480842 - RNA, 23 nt, Human
ucccuuugacgccaucccagccc

SEQ ID NO: 2480843 - RNA, 22 nt, Human
ucccuuugacgccaucccagcc

SEQ ID NO: 2480844 - RNA, 17 nt, Human
ucccuuugcccagaaag

SEQ ID NO: 2480845 - RNA, 14 nt, Human
uccguauuucagac

SEQ ID NO: 2480846 - RNA, 15 nt, Human
uccguauuucagacu

SEQ ID NO: 2480847 - RNA, 13 nt, Human
uccguauuucaga

SEQ ID NO: 2480848 - RNA, 18 nt, Human
uccgugaaaacggagcug

SEQ ID NO: 2480849 - RNA, 23 nt, Human
uccgucuaguuaacauuucaagg

SEQ ID NO: 2480850 - RNA, 22 nt, Human
uccgucuaagucaugagcugag

SEQ ID NO: 2480851 - RNA, 20 nt, Human
uccgucuaagucaugagcug

SEQ ID NO: 2480852 - RNA, 21 nt, Human
uccgugccuccaccaccacug

SEQ ID NO: 2480853 - RNA, 19 nt, Human
uccguuagcuccuguggcc

SEQ ID NO: 2480854 - RNA, 17 nt, Human
uccgugccuccaccacc

SEQ ID NO: 2480855 - RNA, 16 nt, Human
uccgugccuccaccac

SEQ ID NO: 2480856 - RNA, 20 nt, Human
uccgugagugaaccaucauu

SEQ ID NO: 2480857 - RNA, 18 nt, Human
ucccuuguucucuaaguu

SEQ ID NO: 2480858 - RNA, 14 nt, Human
ucccuuguucucua

SEQ ID NO: 2480859 - RNA, 13 nt, Human
ucccuuguucucu

SEQ ID NO: 2480860 - RNA, 15 nt, Human
ucccuugugugugug

SEQ ID NO: 2480861 - RNA, 16 nt, Human
ucccuugugcgugggu

SEQ ID NO: 2480862 - RNA, 13 nt, Human
ucccuugugugug

SEQ ID NO: 2480863 - RNA, 15 nt, Human
ucccuuucccuucuu

SEQ ID NO: 2480864 - RNA, 13 nt, Human
ucccuuucccuuc

SEQ ID NO: 2480865 - RNA, 21 nt, Human
ucccuuucacaaaauuuuauu

SEQ ID NO: 2480866 - RNA, 22 nt, Human
ucccuuuccaaaugcccagcuu

SEQ ID NO: 2480867 - RNA, 22 nt, Human
ucccuuacgugaguccuggcau

SEQ ID NO: 2480868 - RNA, 18 nt, Human
ucccuuacgugaguccug

SEQ ID NO: 2480869 - RNA, 19 nt, Human
ucccuugguggcaagagcc

SEQ ID NO: 2480870 - RNA, 21 nt, Human
ucccuucaaccauuccccaug

SEQ ID NO: 2480871 - RNA, 11 nt, Human
ucccuucaacc

SEQ ID NO: 2480872 - RNA, 15 nt, Human
ucccuguuccccaga

SEQ ID NO: 2480873 - RNA, 16 nt, Human
ucccuguuccccagag

SEQ ID NO: 2480874 - RNA, 18 nt, Human
ucccuguuccccagagaa

SEQ ID NO: 2480875 - RNA, 17 nt, Human
ucccuguguugucucua

SEQ ID NO: 2480876 - RNA, 22 nt, Human
ucccuguauuuucuuucucuac

SEQ ID NO: 2480877 - RNA, 14 nt, Human
ucccugucaccaag

SEQ ID NO: 2480878 - RNA, 15 nt, Human
ucccugucaccaagc

SEQ ID NO: 2480879 - RNA, 17 nt, Human
ucccuguuccccagaga

SEQ ID NO: 2480880 - RNA, 20 nt, Human
ucccuguugacgaagucucu

SEQ ID NO: 2480881 - RNA, 14 nt, Human
ucccuguugaagcu

SEQ ID NO: 2480882 - RNA, 11 nt, Human
ucccuguuuaa

SEQ ID NO: 2480883 - RNA, 21 nt, Human
ucccuguugacgaagucucuu

SEQ ID NO: 2480884 - RNA, 18 nt, Human
ucccuguuggucgguggg

SEQ ID NO: 2480885 - RNA, 18 nt, Human
ucccuguuuaauauuuaa

SEQ ID NO: 2480886 - RNA, 16 nt, Human
ucccuguuuaauauuu

SEQ ID NO: 2480887 - RNA, 15 nt, Human
ucccuguuuaauauu

SEQ ID NO: 2480888 - RNA, 14 nt, Human
ucccuguuuaauau

SEQ ID NO: 2480889 - RNA, 22 nt, Human
ucccuguuuaauauuuaaacag

SEQ ID NO: 2480890 - RNA, 21 nt, Human
ucccuguuuaauauuuaaaca

SEQ ID NO: 2480891 - RNA, 19 nt, Human
ucccuguuugaagccugcc

SEQ ID NO: 2480892 - RNA, 23 nt, Human
acuccugcacacgcuccuuccuc

SEQ ID NO: 2480893 - RNA, 23 nt, Human
ucccugguggcagcucaccucuc

SEQ ID NO: 2480894 - RNA, 17 nt, Human
ucccugguucugaugau

SEQ ID NO: 2480895 - RNA, 16 nt, Human
ucccugguucugauga

SEQ ID NO: 2480896 - RNA, 14 nt, Human
ucccuguaaccucu

SEQ ID NO: 2480897 - RNA, 12 nt, Human
ucccugguucug

SEQ ID NO: 2480898 - RNA, 18 nt, Human
acuccugcaaaauuuuau

SEQ ID NO: 2480899 - RNA, 18 nt, Human
ucccuguaaccucuucag

SEQ ID NO: 2480900 - RNA, 19 nt, Human
ucccuguaaccucuucaga

SEQ ID NO: 2480901 - RNA, 22 nt, Human
ucccuguaaccucuucagaggc

SEQ ID NO: 2480902 - RNA, 23 nt, Human
ucccuguaaccucuucagaggcc

SEQ ID NO: 2480903 - RNA, 20 nt, Human
ucccuguaauuguuguuugu

SEQ ID NO: 2480904 - RNA, 21 nt, Human
ucccuguaauuguuguuugua

SEQ ID NO: 2480905 - RNA, 21 nt, Human
ucccuguauuuucuuucucua

SEQ ID NO: 2480906 - RNA, 20 nt, Human
ucccuguauuuucuuucucu

SEQ ID NO: 2480907 - RNA, 21 nt, Human
acucugcuucucugacuucug

SEQ ID NO: 2480908 - RNA, 20 nt, Human
acucugcuucucugacuucu

SEQ ID NO: 2480909 - RNA, 18 nt, Human
acucugcuucucugacuu

SEQ ID NO: 2480910 - RNA, 17 nt, Human
acucugcuucucugacu

SEQ ID NO: 2480911 - RNA, 16 nt, Human
acucugcauucuagua

SEQ ID NO: 2480912 - RNA, 22 nt, Human
acucugcacaugucuuguacau

SEQ ID NO: 2480913 - RNA, 21 nt, Human
acucugcacaugucuuguaca

SEQ ID NO: 2480914 - RNA, 19 nt, Human
acucugcacaugucuugua

SEQ ID NO: 2480915 - RNA, 18 nt, Human
acucugcacaugucuugu

SEQ ID NO: 2480916 - RNA, 23 nt, Human
acucugcacuacuccucugcagu

SEQ ID NO: 2480917 - RNA, 19 nt, Human
acucugcacuacuccucug

SEQ ID NO: 2480918 - RNA, 15 nt, Human
acucugcacuacucc

SEQ ID NO: 2480919 - RNA, 14 nt, Human
acucugcacuacuc

SEQ ID NO: 2480920 - RNA, 21 nt, Human
acucuggagguuuguuuagaa

SEQ ID NO: 2480921 - RNA, 22 nt, Human
acucuuaucucagucaugcaua

SEQ ID NO: 2480922 - RNA, 13 nt, Human
acucuuaucucag

SEQ ID NO: 2480923 - RNA, 12 nt, Human
acucuuaucuca

SEQ ID NO: 2480924 - RNA, 22 nt, Human
acucugcuucucugacuucugc

SEQ ID NO: 2480925 - RNA, 15 nt, Human
acucugcuugauuuu

SEQ ID NO: 2480926 - RNA, 16 nt, Human
acucugcuugauuuuu

SEQ ID NO: 2480927 - RNA, 18 nt, Human
acucugcuugauuuuugc

SEQ ID NO: 2480928 - RNA, 23 nt, Human
acucugcuuugacugagcagacu

SEQ ID NO: 2480929 - RNA, 20 nt, Human
acucugcuuugacugagcag

SEQ ID NO: 2480930 - RNA, 22 nt, Human
acucugcuuugacugagcagac

SEQ ID NO: 2480931 - RNA, 13 nt, Human
acucugcuuguua

SEQ ID NO: 2480932 - RNA, 14 nt, Human
acucugcuuugacu

SEQ ID NO: 2480933 - RNA, 16 nt, Human
acucugcuucucugac

SEQ ID NO: 2480934 - RNA, 19 nt, Human
acucuccucugcugcuggc

SEQ ID NO: 2480935 - RNA, 18 nt, Human
acucuccucugcugcugg

SEQ ID NO: 2480936 - RNA, 17 nt, Human
acucugaaaucugaaga

SEQ ID NO: 2480937 - RNA, 14 nt, Human
acucugaaaucuga

SEQ ID NO: 2480938 - RNA, 14 nt, Human
acucucccccaccc

SEQ ID NO: 2480939 - RNA, 17 nt, Human
acucugcacaugucuug

SEQ ID NO: 2480940 - RNA, 13 nt, Human
acucugcacaugu

SEQ ID NO: 2480941 - RNA, 11 nt, Human
acucugcacau

SEQ ID NO: 2480942 - RNA, 14 nt, Human
acucugcacauacg

SEQ ID NO: 2480943 - RNA, 17 nt, Human
acucugaagccucuggg

SEQ ID NO: 2480944 - RNA, 16 nt, Human
acucugaagccucugg

SEQ ID NO: 2480945 - RNA, 15 nt, Human
acucugaagccucug

SEQ ID NO: 2480946 - RNA, 14 nt, Human
acucugaagccucu

SEQ ID NO: 2480947 - RNA, 9 nt, Human
acucugaac

SEQ ID NO: 2480948 - RNA, 16 nt, Human
acucugaaaugaagau

SEQ ID NO: 2480949 - RNA, 19 nt, Human
acucugaagccucugggaa

SEQ ID NO: 2480950 - RNA, 18 nt, Human
acucugaagccucuggga

SEQ ID NO: 2480951 - RNA, 12 nt, Human
acucugaagcug

SEQ ID NO: 2480952 - RNA, 23 nt, Human
acucugaagcugacgaacuucca

SEQ ID NO: 2480953 - RNA, 20 nt, Human
acucugaagggcaucaugca

SEQ ID NO: 2480954 - RNA, 21 nt, Human
acucugaagggcaucaugcau

SEQ ID NO: 2480955 - RNA, 19 nt, Human
acucgggcuccugugcccu

SEQ ID NO: 2480956 - RNA, 18 nt, Human
acucgggcuccugugccc

SEQ ID NO: 2480957 - RNA, 17 nt, Human
acucgggcuccugugcc

SEQ ID NO: 2480958 - RNA, 15 nt, Human
acucgggcuccugug

SEQ ID NO: 2480959 - RNA, 16 nt, Human
acucucauuccccagg

SEQ ID NO: 2480960 - RNA, 17 nt, Human
acucucauuccccaggu

SEQ ID NO: 2480961 - RNA, 21 nt, Human
acucucauuccccagguggcu

SEQ ID NO: 2480962 - RNA, 14 nt, Human
acucuccaaccugg

SEQ ID NO: 2480963 - RNA, 17 nt, Human
acucuccaaccuggaca

SEQ ID NO: 2480964 - RNA, 14 nt, Human
acucgggcuccugu

SEQ ID NO: 2480965 - RNA, 20 nt, Human
acucgggaggcugagacagg

SEQ ID NO: 2480966 - RNA, 22 nt, Human
acucgggaggcugagacaggag

SEQ ID NO: 2480967 - RNA, 23 nt, Human
acucgcuugugcagaaaacauug

SEQ ID NO: 2480968 - RNA, 17 nt, Human
acucgcuugugcagaaa

SEQ ID NO: 2480969 - RNA, 16 nt, Human
acucggcacccugcaa

SEQ ID NO: 2480970 - RNA, 15 nt, Human
acucgcuugugcaga

SEQ ID NO: 2480971 - RNA, 20 nt, Human
acucgcuucccccauagcca

SEQ ID NO: 2480972 - RNA, 17 nt, Human
acucuccucugcugcug

SEQ ID NO: 2480973 - RNA, 10 nt, Human
acucuccccc

SEQ ID NO: 2480974 - RNA, 14 nt, Human
acucuccccacacu

SEQ ID NO: 2480975 - RNA, 15 nt, Human
acucuccccacacua

SEQ ID NO: 2480976 - RNA, 13 nt, Human
acucuccaucuua

SEQ ID NO: 2480977 - RNA, 14 nt, Human
acucucccauggcu

SEQ ID NO: 2480978 - RNA, 19 nt, Human
acucuccaaccuggacaac

SEQ ID NO: 2480979 - RNA, 23 nt, Human
acucucccauggcuuaaugcuuc

SEQ ID NO: 2480980 - RNA, 15 nt, Human
acucucccauggcuu

SEQ ID NO: 2480981 - RNA, 10 nt, Human
acucucccca

SEQ ID NO: 2480982 - RNA, 11 nt, Human
acucuccccac

SEQ ID NO: 2480983 - RNA, 12 nt, Human
acucuccccaca

SEQ ID NO: 2480984 - RNA, 23 nt, Human
acucgcgacaaugcaaaccauca

SEQ ID NO: 2480985 - RNA, 20 nt, Human
acucgcgacaaugcaaacca

SEQ ID NO: 2480986 - RNA, 12 nt, Human
acucgcuucccc

SEQ ID NO: 2480987 - RNA, 15 nt, Human
acucgcuucccccau

SEQ ID NO: 2480988 - RNA, 19 nt, Human
uccuaggcauuugcugaau

SEQ ID NO: 2480989 - RNA, 20 nt, Human
uccuaggcuccaccccaucc

SEQ ID NO: 2480990 - RNA, 13 nt, Human
uccuaggccacac

SEQ ID NO: 2480991 - RNA, 18 nt, Human
acucgcgacaaugcaaac

SEQ ID NO: 2480992 - RNA, 22 nt, Human
uccuaggcuccaccccauccag

SEQ ID NO: 2480993 - RNA, 17 nt, Human
uccuagggccuggguuu

SEQ ID NO: 2480994 - RNA, 19 nt, Human
uccuagggaaggguggugg

SEQ ID NO: 2480995 - RNA, 20 nt, Human
uccuagggaaaaguucauag

SEQ ID NO: 2480996 - RNA, 19 nt, Human
uccucccucccucuuuccc

SEQ ID NO: 2480997 - RNA, 19 nt, Human
uccucccucugaggcugua

SEQ ID NO: 2480998 - RNA, 14 nt, Human
uccucccugcaucu

SEQ ID NO: 2480999 - RNA, 13 nt, Human
uccucuccacccu

SEQ ID NO: 2481000 - RNA, 18 nt, Human
uccucccucugaggcugu

SEQ ID NO: 2481001 - RNA, 13 nt, Human
uccucccuccugc

SEQ ID NO: 2481002 - RNA, 17 nt, Human
uccucccucccucuuuc

SEQ ID NO: 2481003 - RNA, 15 nt, Human
uccucccucccucuu

SEQ ID NO: 2481004 - RNA, 16 nt, Human
uccucuccacugccuu

SEQ ID NO: 2481005 - RNA, 15 nt, Human
uccucuccacugccu

SEQ ID NO: 2481006 - RNA, 12 nt, Human
uccucuccccag

SEQ ID NO: 2481007 - RNA, 14 nt, Human
uccucuccacugcc

SEQ ID NO: 2481008 - RNA, 13 nt, Human
uccucuccacugc

SEQ ID NO: 2481009 - RNA, 13 nt, Human
uccucuccaccua

SEQ ID NO: 2481010 - RNA, 16 nt, Human
uccucuccacccuccc

SEQ ID NO: 2481011 - RNA, 14 nt, Human
uccucuccacccuc

SEQ ID NO: 2481012 - RNA, 12 nt, Human
uccucuccacug

SEQ ID NO: 2481013 - RNA, 22 nt, Human
uccucauacccacccccaccca

SEQ ID NO: 2481014 - RNA, 16 nt, Human
uccuccccuccuccug

SEQ ID NO: 2481015 - RNA, 18 nt, Human
uccuccccuccuccugga

SEQ ID NO: 2481016 - RNA, 20 nt, Human
uccuccccuccuccuggacu

SEQ ID NO: 2481017 - RNA, 22 nt, Human
uccuccccuccuccuggacucc

SEQ ID NO: 2481018 - RNA, 13 nt, Human
uccuccccuuccc

SEQ ID NO: 2481019 - RNA, 14 nt, Human
uccuccccuucccu

SEQ ID NO: 2481020 - RNA, 15 nt, Human
uccuccccuucccug

SEQ ID NO: 2481021 - RNA, 17 nt, Human
uccuccccuucccugca

SEQ ID NO: 2481022 - RNA, 18 nt, Human
uccuccccuucccugcaa

SEQ ID NO: 2481023 - RNA, 18 nt, Human
uccucauacccaccccca

SEQ ID NO: 2481024 - RNA, 14 nt, Human
uccucauacccacc

SEQ ID NO: 2481025 - RNA, 20 nt, Human
uccucagccuccucaucugg

SEQ ID NO: 2481026 - RNA, 11 nt, Human
uccucagccuu

SEQ ID NO: 2481027 - RNA, 22 nt, Human
uccucagguggccaugccucag

SEQ ID NO: 2481028 - RNA, 16 nt, Human
uccucauaaaaagcaa

SEQ ID NO: 2481029 - RNA, 23 nt, Human
uccucauaaaaagcaaaacaaaa

SEQ ID NO: 2481030 - RNA, 20 nt, Human
uccucaguuuaauccuucua

SEQ ID NO: 2481031 - RNA, 23 nt, Human
uccucagguggccaugccucagc

SEQ ID NO: 2481032 - RNA, 17 nt, Human
uccucagagaauuucua

SEQ ID NO: 2481033 - RNA, 20 nt, Human
uccucagagaauuucuacca

SEQ ID NO: 2481034 - RNA, 19 nt, Human
uccucagaucauccagaag

SEQ ID NO: 2481035 - RNA, 20 nt, Human
uccucagaucuucugugggu

SEQ ID NO: 2481036 - RNA, 22 nt, Human
uccucacuuccauacagcucua

SEQ ID NO: 2481037 - RNA, 21 nt, Human
uccucacuuccauacagcucu

SEQ ID NO: 2481038 - RNA, 22 nt, Human
uccucacuggguggggugagga

SEQ ID NO: 2481039 - RNA, 13 nt, Human
uccucacccccag

SEQ ID NO: 2481040 - RNA, 16 nt, Human
uccucacccccagcuu

SEQ ID NO: 2481041 - RNA, 20 nt, Human
uccucacccccagcuuugcu

SEQ ID NO: 2481042 - RNA, 14 nt, Human
uccucaccacaugc

SEQ ID NO: 2481043 - RNA, 20 nt, Human
uccucaccccgucugggguu

SEQ ID NO: 2481044 - RNA, 15 nt, Human
uccucaccccugucc

SEQ ID NO: 2481045 - RNA, 14 nt, Human
uccucaccccuguc

SEQ ID NO: 2481046 - RNA, 13 nt, Human
uccucaccccugu

SEQ ID NO: 2481047 - RNA, 12 nt, Human
uccucaccccug

SEQ ID NO: 2481048 - RNA, 19 nt, Human
uccucaccccuguccucac

SEQ ID NO: 2481049 - RNA, 17 nt, Human
uccucaccccuguccuc

SEQ ID NO: 2481050 - RNA, 17 nt, Human
uccucacucccuuccca

SEQ ID NO: 2481051 - RNA, 19 nt, Human
uccucacucccuucccaua

SEQ ID NO: 2481052 - RNA, 21 nt, Human
uccucacugcucccugaagcc

SEQ ID NO: 2481053 - RNA, 20 nt, Human
uccucacugcucccugaagc

SEQ ID NO: 2481054 - RNA, 17 nt, Human
uccucacugcucccuga

SEQ ID NO: 2481055 - RNA, 15 nt, Human
uccucacugcucccu

SEQ ID NO: 2481056 - RNA, 16 nt, Human
uccucacucccuucua

SEQ ID NO: 2481057 - RNA, 13 nt, Human
uccucacugcucc

SEQ ID NO: 2481058 - RNA, 21 nt, Human
uccucacucccuucccauaag

SEQ ID NO: 2481059 - RNA, 18 nt, Human
uccucacuggccaucccu

SEQ ID NO: 2481060 - RNA, 17 nt, Human
uccucacuggccauccc

SEQ ID NO: 2481061 - RNA, 13 nt, Human
uccucacuggcca

SEQ ID NO: 2481062 - RNA, 23 nt, Human
uccucacugcucccugaagccag

SEQ ID NO: 2481063 - RNA, 22 nt, Human
uccucacuggccaucccucgug

SEQ ID NO: 2481064 - RNA, 13 nt, Human
uccucacugggug

SEQ ID NO: 2481065 - RNA, 14 nt, Human
uccucacugggugg

SEQ ID NO: 2481066 - RNA, 15 nt, Human
uccucacuggguggg

SEQ ID NO: 2481067 - RNA, 15 nt, Human
uccucaaacacugca

SEQ ID NO: 2481068 - RNA, 14 nt, Human
uccucaaacacugc

SEQ ID NO: 2481069 - RNA, 23 nt, Human
acucuuaucucagucaugcauaa

SEQ ID NO: 2481070 - RNA, 14 nt, Human
uccucaaacaacac

SEQ ID NO: 2481071 - RNA, 19 nt, Human
acucuuauugcccacgcug

SEQ ID NO: 2481072 - RNA, 16 nt, Human
acucuuauugcccacg

SEQ ID NO: 2481073 - RNA, 18 nt, Human
uccucaaggggccauccu

SEQ ID NO: 2481074 - RNA, 15 nt, Human
uccucaaggggccau

SEQ ID NO: 2481075 - RNA, 14 nt, Human
uccucaaggggcca

SEQ ID NO: 2481076 - RNA, 17 nt, Human
uccucaagaaauaaaag

SEQ ID NO: 2481077 - RNA, 23 nt, Human
uccucaagaaauaaaaggaagcc

SEQ ID NO: 2481078 - RNA, 16 nt, Human
uccucaaacacugcag

SEQ ID NO: 2481079 - RNA, 21 nt, Human
uccuagagggaggggccuagg

SEQ ID NO: 2481080 - RNA, 17 nt, Human
uccucaacacccaacug

SEQ ID NO: 2481081 - RNA, 23 nt, Human
uccucaacucaccuaauguuuau

SEQ ID NO: 2481082 - RNA, 18 nt, Human
uccucaaguccccaagau

SEQ ID NO: 2481083 - RNA, 21 nt, Human
uccucaaggggccauccuguc

SEQ ID NO: 2481084 - RNA, 12 nt, Human
uccucaauccag

SEQ ID NO: 2481085 - RNA, 13 nt, Human
uccucaauccagc

SEQ ID NO: 2481086 - RNA, 14 nt, Human
uccucaauccagcu

SEQ ID NO: 2481087 - RNA, 20 nt, Human
uccucacaucuuucacacuu

SEQ ID NO: 2481088 - RNA, 20 nt, Human
uccucacaacauggugucug

SEQ ID NO: 2481089 - RNA, 13 nt, Human
uccccuugcccag

SEQ ID NO: 2481090 - RNA, 15 nt, Human
uccccuugcccaggg

SEQ ID NO: 2481091 - RNA, 16 nt, Human
uccccuugcccagggc

SEQ ID NO: 2481092 - RNA, 21 nt, Human
uccccuuuucuuuucuacccu

SEQ ID NO: 2481093 - RNA, 20 nt, Human
uccccuuuucuuuucuaccc

SEQ ID NO: 2481094 - RNA, 16 nt, Human
ucccgaauagcuggga

SEQ ID NO: 2481095 - RNA, 15 nt, Human
ucccgaauagcuggg

SEQ ID NO: 2481096 - RNA, 16 nt, Human
uccccuucucucaucu

SEQ ID NO: 2481097 - RNA, 15 nt, Human
uccccuucucucauc

SEQ ID NO: 2481098 - RNA, 18 nt, Human
uccccuucucucaucucu

SEQ ID NO: 2481099 - RNA, 14 nt, Human
uccccuugagcuga

SEQ ID NO: 2481100 - RNA, 16 nt, Human
uccccuucugaaucag

SEQ ID NO: 2481101 - RNA, 15 nt, Human
uccccuugagcugag

SEQ ID NO: 2481102 - RNA, 16 nt, Human
uccccuugagcugaga

SEQ ID NO: 2481103 - RNA, 13 nt, Human
uccccuucucuca

SEQ ID NO: 2481104 - RNA, 16 nt, Human
uccccuccuccacucu

SEQ ID NO: 2481105 - RNA, 14 nt, Human
uccccuccuccacu

SEQ ID NO: 2481106 - RNA, 18 nt, Human
uccccuccucuccccuac

SEQ ID NO: 2481107 - RNA, 16 nt, Human
uccccuccucuccccu

SEQ ID NO: 2481108 - RNA, 14 nt, Human
uccccuccucuccc

SEQ ID NO: 2481109 - RNA, 14 nt, Human
uccccuccucacuc

SEQ ID NO: 2481110 - RNA, 22 nt, Human
uccccuccaaccuggggggcag

SEQ ID NO: 2481111 - RNA, 13 nt, Human
uccccuccaaccu

SEQ ID NO: 2481112 - RNA, 16 nt, Human
uccccucaggacugca

SEQ ID NO: 2481113 - RNA, 15 nt, Human
uccccucagcuccag

SEQ ID NO: 2481114 - RNA, 12 nt, Human
uccccuccaacc

SEQ ID NO: 2481115 - RNA, 14 nt, Human
uccccucccugggu

SEQ ID NO: 2481116 - RNA, 13 nt, Human
uccccucccuggg

SEQ ID NO: 2481117 - RNA, 12 nt, Human
uccccuccacug

SEQ ID NO: 2481118 - RNA, 21 nt, Human
uccccucccuggcucccauga

SEQ ID NO: 2481119 - RNA, 15 nt, Human
uccccuccacuguca

SEQ ID NO: 2481120 - RNA, 13 nt, Human
uccccucauucag

SEQ ID NO: 2481121 - RNA, 16 nt, Human
uccccuccaagguaug

SEQ ID NO: 2481122 - RNA, 22 nt, Human
uccccuccuaccccucccagcu

SEQ ID NO: 2481123 - RNA, 20 nt, Human
uccccuccuaccccucccag

SEQ ID NO: 2481124 - RNA, 12 nt, Human
uccccuccucca

SEQ ID NO: 2481125 - RNA, 19 nt, Human
uccccuccuaccccuccca

SEQ ID NO: 2481126 - RNA, 17 nt, Human
uccccuccuaccccucc

SEQ ID NO: 2481127 - RNA, 14 nt, Human
uccccuccuacccc

SEQ ID NO: 2481128 - RNA, 20 nt, Human
uccccuccgccaggcgagau

SEQ ID NO: 2481129 - RNA, 13 nt, Human
uccccuccuaccc

SEQ ID NO: 2481130 - RNA, 13 nt, Human
uccccucccuguc

SEQ ID NO: 2481131 - RNA, 16 nt, Human
uccccucccuggguuc

SEQ ID NO: 2481132 - RNA, 14 nt, Human
uccccucccuguca

SEQ ID NO: 2481133 - RNA, 17 nt, Human
uccccuccgccaggcga

SEQ ID NO: 2481134 - RNA, 20 nt, Human
uccccucacagccucugacc

SEQ ID NO: 2481135 - RNA, 19 nt, Human
uccccucacagccucugac

SEQ ID NO: 2481136 - RNA, 18 nt, Human
uccccucacagccucuga

SEQ ID NO: 2481137 - RNA, 17 nt, Human
uccccucacagccucug

SEQ ID NO: 2481138 - RNA, 17 nt, Human
uccccucaccuccucua

SEQ ID NO: 2481139 - RNA, 15 nt, Human
uccccucaccuccuc

SEQ ID NO: 2481140 - RNA, 13 nt, Human
uccccucacugga

SEQ ID NO: 2481141 - RNA, 12 nt, Human
uccccucacugg

SEQ ID NO: 2481142 - RNA, 19 nt, Human
uccccucacugauggacaa

SEQ ID NO: 2481143 - RNA, 21 nt, Human
uccccucacagccucugaccc

SEQ ID NO: 2481144 - RNA, 12 nt, Human
uccccucagcuc

SEQ ID NO: 2481145 - RNA, 14 nt, Human
uccccucagcucca

SEQ ID NO: 2481146 - RNA, 16 nt, Human
acucaagaagcaggcu

SEQ ID NO: 2481147 - RNA, 15 nt, Human
acucaagaagcaggc

SEQ ID NO: 2481148 - RNA, 14 nt, Human
acucaagaagcagg

SEQ ID NO: 2481149 - RNA, 13 nt, Human
acucaagaagcag

SEQ ID NO: 2481150 - RNA, 15 nt, Human
acucaacccucucag

SEQ ID NO: 2481151 - RNA, 13 nt, Human
acucaacccucuc

SEQ ID NO: 2481152 - RNA, 19 nt, Human
acucaagaagcaggcuaca

SEQ ID NO: 2481153 - RNA, 16 nt, Human
uccccucacagccucu

SEQ ID NO: 2481154 - RNA, 21 nt, Human
ucccggacugcaagcagggcu

SEQ ID NO: 2481155 - RNA, 15 nt, Human
ucccgcugcugcugc

SEQ ID NO: 2481156 - RNA, 13 nt, Human
ucccgcugcugcu

SEQ ID NO: 2481157 - RNA, 21 nt, Human
ucccggagggcccugagcuga

SEQ ID NO: 2481158 - RNA, 16 nt, Human
ucccggagggcccuga

SEQ ID NO: 2481159 - RNA, 18 nt, Human
ucccggagguuggguggg

SEQ ID NO: 2481160 - RNA, 18 nt, Human
ucccuauuagagaagaga

SEQ ID NO: 2481161 - RNA, 21 nt, Human
ucccuauuuuuuuucuguuau

SEQ ID NO: 2481162 - RNA, 22 nt, Human
ucccuauuuuuuuucuguuaua

SEQ ID NO: 2481163 - RNA, 22 nt, Human
ucccucaacaagggagagaccu

SEQ ID NO: 2481164 - RNA, 18 nt, Human
ucccucaacaagggagag

SEQ ID NO: 2481165 - RNA, 20 nt, Human
ucccucaaaugacccaaaga

SEQ ID NO: 2481166 - RNA, 19 nt, Human
ucccucaaaugacccaaag

SEQ ID NO: 2481167 - RNA, 17 nt, Human
ucccggcacuccaugcu

SEQ ID NO: 2481168 - RNA, 20 nt, Human
ucccucaaagcacacgucau

SEQ ID NO: 2481169 - RNA, 13 nt, Human
ucccucaaaugac

SEQ ID NO: 2481170 - RNA, 20 nt, Human
ucccucaccuguagcagcca

SEQ ID NO: 2481171 - RNA, 14 nt, Human
ucccucaccuguag

SEQ ID NO: 2481172 - RNA, 13 nt, Human
ucccucaccugua

SEQ ID NO: 2481173 - RNA, 12 nt, Human
ucccucaccugu

SEQ ID NO: 2481174 - RNA, 21 nt, Human
ucccucacccugagccccuuc

SEQ ID NO: 2481175 - RNA, 20 nt, Human
ucccucacccugagccccuu

SEQ ID NO: 2481176 - RNA, 19 nt, Human
ucccucacccugagccccu

SEQ ID NO: 2481177 - RNA, 17 nt, Human
ucccucacccugagccc

SEQ ID NO: 2481178 - RNA, 15 nt, Human
ucccucacccugagc

SEQ ID NO: 2481179 - RNA, 22 nt, Human
ucccucacccacuuuggccucc

SEQ ID NO: 2481180 - RNA, 17 nt, Human
ucccucacccacccaca

SEQ ID NO: 2481181 - RNA, 23 nt, Human
ucccucaacaagggagagaccuc

SEQ ID NO: 2481182 - RNA, 16 nt, Human
ucccucaauucccccu

SEQ ID NO: 2481183 - RNA, 16 nt, Human
ucccucaaccccacca

SEQ ID NO: 2481184 - RNA, 20 nt, Human
ucccgcucagcccucccugc

SEQ ID NO: 2481185 - RNA, 16 nt, Human
ucccgcucagcccucc

SEQ ID NO: 2481186 - RNA, 15 nt, Human
ucccgcucagcccuc

SEQ ID NO: 2481187 - RNA, 14 nt, Human
ucccgcucagcccu

SEQ ID NO: 2481188 - RNA, 15 nt, Human
ucccgccccuucccc

SEQ ID NO: 2481189 - RNA, 21 nt, Human
ucccgccccuucccacucacc

SEQ ID NO: 2481190 - RNA, 13 nt, Human
ucccgcucagccc

SEQ ID NO: 2481191 - RNA, 19 nt, Human
ucccgccucuucuucuuca

SEQ ID NO: 2481192 - RNA, 21 nt, Human
ucccgccucuucuucuucaga

SEQ ID NO: 2481193 - RNA, 18 nt, Human
ucccgaauagcugggacu

SEQ ID NO: 2481194 - RNA, 20 nt, Human
ucccgaguagcugggacuac

SEQ ID NO: 2481195 - RNA, 18 nt, Human
ucccgccagacuguuaga

SEQ ID NO: 2481196 - RNA, 22 nt, Human
ucccgcaaacccccuuugugcu

SEQ ID NO: 2481197 - RNA, 21 nt, Human
ucccgcaaacccccuuugugc

SEQ ID NO: 2481198 - RNA, 19 nt, Human
ucccgauucacccugucca

SEQ ID NO: 2481199 - RNA, 23 nt, Human
ucccgaaccccaaggagggagau

SEQ ID NO: 2481200 - RNA, 22 nt, Human
uccccuuuucuuuucuacccua

SEQ ID NO: 2481201 - RNA, 22 nt, Human
acuauccauaguggacauuguu

SEQ ID NO: 2481202 - RNA, 18 nt, Human
acuaucccggcugcccuu

SEQ ID NO: 2481203 - RNA, 16 nt, Human
acuaucuuggugaauu

SEQ ID NO: 2481204 - RNA, 22 nt, Human
acuaucuuuuugcuuacaguuu

SEQ ID NO: 2481205 - RNA, 16 nt, Human
acuaucccggcugccc

SEQ ID NO: 2481206 - RNA, 17 nt, Human
acuaucccggcugcccu

SEQ ID NO: 2481207 - RNA, 22 nt, Human
acuaucaguuuguccuguagag

SEQ ID NO: 2481208 - RNA, 20 nt, Human
acuaucagcccaagaugcuu

SEQ ID NO: 2481209 - RNA, 22 nt, Human
acuaucaugucaaacgugaaaa

SEQ ID NO: 2481210 - RNA, 22 nt, Human
acuaugaaguuuuuuuuauaca

SEQ ID NO: 2481211 - RNA, 18 nt, Human
acuaugaacuacaaagcu

SEQ ID NO: 2481212 - RNA, 18 nt, Human
acuauguugcccaggcag

SEQ ID NO: 2481213 - RNA, 17 nt, Human
acuauguugcccaggca

SEQ ID NO: 2481214 - RNA, 23 nt, Human
acucaacauguuacugaccagca

SEQ ID NO: 2481215 - RNA, 17 nt, Human
acucaacauguuacuga

SEQ ID NO: 2481216 - RNA, 20 nt, Human
acucaacauguuacugacca

SEQ ID NO: 2481217 - RNA, 21 nt, Human
acucaacauguuacugaccag

SEQ ID NO: 2481218 - RNA, 22 nt, Human
acucaacauguuacugaccagc

SEQ ID NO: 2481219 - RNA, 19 nt, Human
acucaaauuaaucuuucuu

SEQ ID NO: 2481220 - RNA, 19 nt, Human
acucaacaugagucaagag

SEQ ID NO: 2481221 - RNA, 16 nt, Human
acucaacaugagucaa

SEQ ID NO: 2481222 - RNA, 15 nt, Human
acucaacaugaguca

SEQ ID NO: 2481223 - RNA, 14 nt, Human
acuauuaagaggca

SEQ ID NO: 2481224 - RNA, 18 nt, Human
acuauuauccccauuucu

SEQ ID NO: 2481225 - RNA, 21 nt, Human
acuauuauaauuuaaugcaug

SEQ ID NO: 2481226 - RNA, 21 nt, Human
acuauuaagaggcagaaaauu

SEQ ID NO: 2481227 - RNA, 17 nt, Human
acuauuauaauuuaaug

SEQ ID NO: 2481228 - RNA, 23 nt, Human
acuaugaaugggcaaaacugaau

SEQ ID NO: 2481229 - RNA, 22 nt, Human
acuaugaaucuauuauacugua

SEQ ID NO: 2481230 - RNA, 13 nt, Human
acuaugaaucuau

SEQ ID NO: 2481231 - RNA, 21 nt, Human
acuaugaacuucucucagacu

SEQ ID NO: 2481232 - RNA, 19 nt, Human
acuaugaacuucucucaga

SEQ ID NO: 2481233 - RNA, 18 nt, Human
acuaugaacuucucucag

SEQ ID NO: 2481234 - RNA, 23 nt, Human
acuauguugcccaggcaggucuu

SEQ ID NO: 2481235 - RNA, 20 nt, Human
acuauguugcccaggcaggu

SEQ ID NO: 2481236 - RNA, 19 nt, Human
acuauguugcccaggcagg

SEQ ID NO: 2481237 - RNA, 24 nt, Human
uccccaccgcagacaggaccaggg

SEQ ID NO: 2481238 - RNA, 10 nt, Human
uccccacacu

SEQ ID NO: 2481239 - RNA, 14 nt, Human
uccccaccugggac

SEQ ID NO: 2481240 - RNA, 13 nt, Human
uccccaccuggga

SEQ ID NO: 2481241 - RNA, 18 nt, Human
uccccaccuucaauuccu

SEQ ID NO: 2481242 - RNA, 20 nt, Human
uccccaccuucaauuccugg

SEQ ID NO: 2481243 - RNA, 22 nt, Human
uccccaccuucaauuccugggc

SEQ ID NO: 2481244 - RNA, 23 nt, Human
uccccaccuucaauuccugggcc

SEQ ID NO: 2481245 - RNA, 20 nt, Human
uccccaccuucuucagccac

SEQ ID NO: 2481246 - RNA, 12 nt, Human
uccccaggccag

SEQ ID NO: 2481247 - RNA, 14 nt, Human
uccccacgcccucc

SEQ ID NO: 2481248 - RNA, 16 nt, Human
uccccaggcaccucac

SEQ ID NO: 2481249 - RNA, 23 nt, Human
uccccaggaggccagccuugacc

SEQ ID NO: 2481250 - RNA, 22 nt, Human
uccccaggccaggccaccagga

SEQ ID NO: 2481251 - RNA, 19 nt, Human
uccccaggccaggccacca

SEQ ID NO: 2481252 - RNA, 16 nt, Human
uccccaggccaggcca

SEQ ID NO: 2481253 - RNA, 14 nt, Human
uccccaggccaggc

SEQ ID NO: 2481254 - RNA, 23 nt, Human
uccccaggccaggccaccaggau

SEQ ID NO: 2481255 - RNA, 11 nt, Human
uccccaggccc

SEQ ID NO: 2481256 - RNA, 13 nt, Human
uccccaggcccca

SEQ ID NO: 2481257 - RNA, 19 nt, Human
uccccaggccccaggaagc

SEQ ID NO: 2481258 - RNA, 23 nt, Human
uccccaggccguggcugcccaca

SEQ ID NO: 2481259 - RNA, 21 nt, Human
uccccaggccguggcugccca

SEQ ID NO: 2481260 - RNA, 20 nt, Human
uccccaggccccaggaagcc

SEQ ID NO: 2481261 - RNA, 21 nt, Human
uccccaggccccaggaagccg

SEQ ID NO: 2481262 - RNA, 19 nt, Human
uccccaggccguggcugcc

SEQ ID NO: 2481263 - RNA, 23 nt, Human
acuauaauuuaccugaagucuuu

SEQ ID NO: 2481264 - RNA, 17 nt, Human
acuauagccuaggugac

SEQ ID NO: 2481265 - RNA, 21 nt, Human
acuauaguccagcuuuguucu

SEQ ID NO: 2481266 - RNA, 17 nt, Human
acuauauagagauguuu

SEQ ID NO: 2481267 - RNA, 16 nt, Human
acuauauagagauguu

SEQ ID NO: 2481268 - RNA, 20 nt, Human
acuauagcccagguccucug

SEQ ID NO: 2481269 - RNA, 14 nt, Human
acuauagcccaggu

SEQ ID NO: 2481270 - RNA, 18 nt, Human
acuauaucuguauauaaa

SEQ ID NO: 2481271 - RNA, 17 nt, Human
acuauaucuguauauaa

SEQ ID NO: 2481272 - RNA, 14 nt, Human
acuauaucuguaua

SEQ ID NO: 2481273 - RNA, 18 nt, Human
acuauauagagauguuuu

SEQ ID NO: 2481274 - RNA, 13 nt, Human
acuauauauguga

SEQ ID NO: 2481275 - RNA, 22 nt, Human
acuauaucuguauauaaaauau

SEQ ID NO: 2481276 - RNA, 13 nt, Human
acuauaugugaau

SEQ ID NO: 2481277 - RNA, 18 nt, Human
acuauauuaucaugcaaa

SEQ ID NO: 2481278 - RNA, 15 nt, Human
acuauauuguacaca

SEQ ID NO: 2481279 - RNA, 17 nt, Human
acuaaccagcagaaaug

SEQ ID NO: 2481280 - RNA, 23 nt, Human
acuacaggugugagucaccaagc

SEQ ID NO: 2481281 - RNA, 15 nt, Human
acuacaguccuccca

SEQ ID NO: 2481282 - RNA, 17 nt, Human
acuaaaucucuaauaug

SEQ ID NO: 2481283 - RNA, 16 nt, Human
acuaaaucucuaauau

SEQ ID NO: 2481284 - RNA, 14 nt, Human
acuaaaucucuaau

SEQ ID NO: 2481285 - RNA, 23 nt, Human
acuaaccagggaagcugucccuc

SEQ ID NO: 2481286 - RNA, 23 nt, Human
acuaaauagcauguauugugucu

SEQ ID NO: 2481287 - RNA, 20 nt, Human
acuaaauagcauguauugug

SEQ ID NO: 2481288 - RNA, 19 nt, Human
acuaaauagcauguauugu

SEQ ID NO: 2481289 - RNA, 18 nt, Human
acuaaauagcauguauug

SEQ ID NO: 2481290 - RNA, 16 nt, Human
acuaaauagcauguau

SEQ ID NO: 2481291 - RNA, 15 nt, Human
acuaaauagcaugua

SEQ ID NO: 2481292 - RNA, 16 nt, Human
acuaaccagcagaaau

SEQ ID NO: 2481293 - RNA, 13 nt, Human
acuaaccacgcug

SEQ ID NO: 2481294 - RNA, 14 nt, Human
acuaaaauauuuau

SEQ ID NO: 2481295 - RNA, 21 nt, Human
acuaaaagauauaagugcugu

SEQ ID NO: 2481296 - RNA, 20 nt, Human
acuaaaagauauaagugcug

SEQ ID NO: 2481297 - RNA, 19 nt, Human
acuaaaagauauaagugcu

SEQ ID NO: 2481298 - RNA, 16 nt, Human
acuaaaagauauaagu

SEQ ID NO: 2481299 - RNA, 20 nt, Human
acuaaaaguucuucuccaau

SEQ ID NO: 2481300 - RNA, 23 nt, Human
acuaaaagauauaagugcuguau

SEQ ID NO: 2481301 - RNA, 12 nt, Human
acuaaaagaucg

SEQ ID NO: 2481302 - RNA, 22 nt, Human
acuaaaguauguaaaguaugua

SEQ ID NO: 2481303 - RNA, 14 nt, Human
acuaaaguauguaa

SEQ ID NO: 2481304 - RNA, 20 nt, Human
acuaaagcaguggacaccag

SEQ ID NO: 2481305 - RNA, 13 nt, Human
acuaaacauuuug

SEQ ID NO: 2481306 - RNA, 14 nt, Human
acuaaacauuuugu

SEQ ID NO: 2481307 - RNA, 12 nt, Human
acuaaacucauu

SEQ ID NO: 2481308 - RNA, 14 nt, Human
acuaaacucauuua

SEQ ID NO: 2481309 - RNA, 16 nt, Human
acuaaacucauuuaua

SEQ ID NO: 2481310 - RNA, 16 nt, Human
acuaaacucucuuugg

SEQ ID NO: 2481311 - RNA, 15 nt, Human
acuaaacucucuuug

SEQ ID NO: 2481312 - RNA, 23 nt, Human
acuaaacucucuuugggaauguu

SEQ ID NO: 2481313 - RNA, 23 nt, Human
acuaaacugguuuguugcagcca

SEQ ID NO: 2481314 - RNA, 15 nt, Human
acguuuccugagaag

SEQ ID NO: 2481315 - RNA, 14 nt, Human
acguuuuauugugu

SEQ ID NO: 2481316 - RNA, 15 nt, Human
acguuuuauuguguu

SEQ ID NO: 2481317 - RNA, 16 nt, Human
acguuuuauuguguuu

SEQ ID NO: 2481318 - RNA, 18 nt, Human
acguuuuauuguguuuuu

SEQ ID NO: 2481319 - RNA, 14 nt, Human
acguuucuaaaggc

SEQ ID NO: 2481320 - RNA, 16 nt, Human
acguuuacuuaucuua

SEQ ID NO: 2481321 - RNA, 12 nt, Human
acguuuccauca

SEQ ID NO: 2481322 - RNA, 13 nt, Human
acuaaaaauacaa

SEQ ID NO: 2481323 - RNA, 22 nt, Human
acguuuuuguaaauuaaucuuu

SEQ ID NO: 2481324 - RNA, 14 nt, Human
acguuuuuccuuua

SEQ ID NO: 2481325 - RNA, 13 nt, Human
acguuuuuccuuu

SEQ ID NO: 2481326 - RNA, 20 nt, Human
acguuuuuaauauaaagccu

SEQ ID NO: 2481327 - RNA, 17 nt, Human
acuaaaaagaaggaaaa

SEQ ID NO: 2481328 - RNA, 13 nt, Human
acuaaaaauauua

SEQ ID NO: 2481329 - RNA, 11 nt, Human
acuaaaagaua

SEQ ID NO: 2481330 - RNA, 16 nt, Human
acuaaaaagaaggaaa

SEQ ID NO: 2481331 - RNA, 12 nt, Human
acuaaaaauaca

SEQ ID NO: 2481332 - RNA, 13 nt, Human
uccagccugggug

SEQ ID NO: 2481333 - RNA, 17 nt, Human
uccagccuggggucugg

SEQ ID NO: 2481334 - RNA, 17 nt, Human
uccagccugggcgacag

SEQ ID NO: 2481335 - RNA, 20 nt, Human
uccagccugggcgacagagc

SEQ ID NO: 2481336 - RNA, 24 nt, Human
uccagccugggugacagagcaagu

SEQ ID NO: 2481337 - RNA, 20 nt, Human
uccagcuauaacaguaggga

SEQ ID NO: 2481338 - RNA, 12 nt, Human
uccagccugggu

SEQ ID NO: 2481339 - RNA, 14 nt, Human
uccagcucaccagc

SEQ ID NO: 2481340 - RNA, 21 nt, Human
uccagcuauuuuuauuuguuu

SEQ ID NO: 2481341 - RNA, 12 nt, Human
acguuucuaaag

SEQ ID NO: 2481342 - RNA, 18 nt, Human
acguuuacaagccccccc

SEQ ID NO: 2481343 - RNA, 14 nt, Human
uccccacacuccua

SEQ ID NO: 2481344 - RNA, 20 nt, Human
uccccaauaauugcagaacu

SEQ ID NO: 2481345 - RNA, 21 nt, Human
uccccaauaauugcagaacua

SEQ ID NO: 2481346 - RNA, 23 nt, Human
uccccaagauucacaccugacuc

SEQ ID NO: 2481347 - RNA, 15 nt, Human
uccccaagccuggca

SEQ ID NO: 2481348 - RNA, 17 nt, Human
uccccaagaaagccuca

SEQ ID NO: 2481349 - RNA, 19 nt, Human
uccccaacccugccccugc

SEQ ID NO: 2481350 - RNA, 23 nt, Human
uccccaacagugugaaguuagaa

SEQ ID NO: 2481351 - RNA, 16 nt, Human
uccccaacccugcccc

SEQ ID NO: 2481352 - RNA, 17 nt, Human
uccccaacccugccccu

SEQ ID NO: 2481353 - RNA, 18 nt, Human
uccccaacccugccccug

SEQ ID NO: 2481354 - RNA, 20 nt, Human
uccccaacccugccccugcc

SEQ ID NO: 2481355 - RNA, 19 nt, Human
uccccaacagugugaaguu

SEQ ID NO: 2481356 - RNA, 18 nt, Human
uccccaacagugugaagu

SEQ ID NO: 2481357 - RNA, 16 nt, Human
uccccaacagugugaa

SEQ ID NO: 2481358 - RNA, 15 nt, Human
uccccaacaguguga

SEQ ID NO: 2481359 - RNA, 21 nt, Human
uccccaacagugugaaguuag

SEQ ID NO: 2481360 - RNA, 20 nt, Human
uccccaacagugugaaguua

SEQ ID NO: 2481361 - RNA, 18 nt, Human
uccccaacauguaauaag

SEQ ID NO: 2481362 - RNA, 14 nt, Human
uccccaacagugug

SEQ ID NO: 2481363 - RNA, 23 nt, Human
uccccaacagcgacauagcccau

SEQ ID NO: 2481364 - RNA, 14 nt, Human
uccccaaauccgaa

SEQ ID NO: 2481365 - RNA, 19 nt, Human
uccccaaauccgaaccucc

SEQ ID NO: 2481366 - RNA, 16 nt, Human
uccccaaaccugcaag

SEQ ID NO: 2481367 - RNA, 23 nt, Human
uccccaaaucaauacacuaguug

SEQ ID NO: 2481368 - RNA, 18 nt, Human
uccccaaaucaauacacu

SEQ ID NO: 2481369 - RNA, 18 nt, Human
uccccaaagucuuaaaau

SEQ ID NO: 2481370 - RNA, 20 nt, Human
ucccauuuuggaaguuuuca

SEQ ID NO: 2481371 - RNA, 16 nt, Human
uccccaaaaaccucac

SEQ ID NO: 2481372 - RNA, 22 nt, Human
uccccaaaaaccucacccgagg

SEQ ID NO: 2481373 - RNA, 19 nt, Human
ucccaucucacacaugagc

SEQ ID NO: 2481374 - RNA, 14 nt, Human
ucccaucucacaca

SEQ ID NO: 2481375 - RNA, 18 nt, Human
ucccauauccugccucag

SEQ ID NO: 2481376 - RNA, 15 nt, Human
ucccauauccugccu

SEQ ID NO: 2481377 - RNA, 13 nt, Human
ucccaucgcuguc

SEQ ID NO: 2481378 - RNA, 13 nt, Human
ucccaucucacac

SEQ ID NO: 2481379 - RNA, 15 nt, Human
ucccauaugccuggg

SEQ ID NO: 2481380 - RNA, 15 nt, Human
ucccauaggcccagu

SEQ ID NO: 2481381 - RNA, 14 nt, Human
ucccauaccaccca

SEQ ID NO: 2481382 - RNA, 17 nt, Human
ucccauagccaggaaac

SEQ ID NO: 2481383 - RNA, 22 nt, Human
ucccauaaccgcugauucucag

SEQ ID NO: 2481384 - RNA, 15 nt, Human
ucccauaagcuauag

SEQ ID NO: 2481385 - RNA, 22 nt, Human
ucccauaauuuucuucaugcaa

SEQ ID NO: 2481386 - RNA, 18 nt, Human
ucccauaaccgcugauuc

SEQ ID NO: 2481387 - RNA, 20 nt, Human
ucccagugucuuccuguggg

SEQ ID NO: 2481388 - RNA, 20 nt, Human
ucccaguucaggagucccaa

SEQ ID NO: 2481389 - RNA, 23 nt, Human
ucccaguucaggagucccaagga

SEQ ID NO: 2481390 - RNA, 16 nt, Human
acuacaguccucccau

SEQ ID NO: 2481391 - RNA, 16 nt, Human
acuacauaaacugacu

SEQ ID NO: 2481392 - RNA, 13 nt, Human
acuacauaaacug

SEQ ID NO: 2481393 - RNA, 15 nt, Human
acuacagucaggaaa

SEQ ID NO: 2481394 - RNA, 23 nt, Human
acuacauaaacugacuuuauccu

SEQ ID NO: 2481395 - RNA, 17 nt, Human
acuacauaaacugacuu

SEQ ID NO: 2481396 - RNA, 17 nt, Human
acuacaucgcccuccac

SEQ ID NO: 2481397 - RNA, 20 nt, Human
acuacaugagaacaaacaga

SEQ ID NO: 2481398 - RNA, 19 nt, Human
acuacaucgcccuccacau

SEQ ID NO: 2481399 - RNA, 12 nt, Human
acuacaugcacu

SEQ ID NO: 2481400 - RNA, 14 nt, Human
acuacaugcacuug

SEQ ID NO: 2481401 - RNA, 18 nt, Human
acuacaugugguuuauag

SEQ ID NO: 2481402 - RNA, 15 nt, Human
acuacaugugguuua

SEQ ID NO: 2481403 - RNA, 20 nt, Human
acuacaugcagcccaugccc

SEQ ID NO: 2481404 - RNA, 18 nt, Human
ucccagguaccagcugcg

SEQ ID NO: 2481405 - RNA, 17 nt, Human
ucccagguaccagcugc

SEQ ID NO: 2481406 - RNA, 16 nt, Human
ucccagguaccagcug

SEQ ID NO: 2481407 - RNA, 19 nt, Human
ucccagguaagcaggagga

SEQ ID NO: 2481408 - RNA, 18 nt, Human
ucccagguaagcaggagg

SEQ ID NO: 2481409 - RNA, 18 nt, Human
ucccaggguagcccgccu

SEQ ID NO: 2481410 - RNA, 16 nt, Human
ucccaggguagcccgc

SEQ ID NO: 2481411 - RNA, 22 nt, Human
ucccaggggcccaaggcggccc

SEQ ID NO: 2481412 - RNA, 21 nt, Human
ucccaggggcccaaggcggcc

SEQ ID NO: 2481413 - RNA, 22 nt, Human
ucccaggguagcccgccugcca

SEQ ID NO: 2481414 - RNA, 21 nt, Human
ucccaggguagcccgccugcc

SEQ ID NO: 2481415 - RNA, 23 nt, Human
ucccaggguagcccgccugccag

SEQ ID NO: 2481416 - RNA, 19 nt, Human
acuacaugugguuuauaga

SEQ ID NO: 2481417 - RNA, 18 nt, Human
ucccaggggcuggcuuca

SEQ ID NO: 2481418 - RNA, 13 nt, Human
acuacauucauuu

SEQ ID NO: 2481419 - RNA, 18 nt, Human
ucccaggggaccacaccu

SEQ ID NO: 2481420 - RNA, 15 nt, Human
ucccagugacacuuc

SEQ ID NO: 2481421 - RNA, 19 nt, Human
ucccagugacacuucagag

SEQ ID NO: 2481422 - RNA, 22 nt, Human
ucccagugacacuucagagagc

SEQ ID NO: 2481423 - RNA, 20 nt, Human
ucccagugacacuucagaga

SEQ ID NO: 2481424 - RNA, 14 nt, Human
ucccaguggccuca

SEQ ID NO: 2481425 - RNA, 18 nt, Human
ucccaguggccucaaccc

SEQ ID NO: 2481426 - RNA, 19 nt, Human
ucccaguggccucaacccu

SEQ ID NO: 2481427 - RNA, 21 nt, Human
ucccaguggcugcugcccagg

SEQ ID NO: 2481428 - RNA, 19 nt, Human
ucccaguggcugcugccca

SEQ ID NO: 2481429 - RNA, 18 nt, Human
ucccaguggcugcugccc

SEQ ID NO: 2481430 - RNA, 17 nt, Human
ucccaguggcugcugcc

SEQ ID NO: 2481431 - RNA, 16 nt, Human
ucccaguggcugcugc

SEQ ID NO: 2481432 - RNA, 15 nt, Human
ucccaguggcugcug

SEQ ID NO: 2481433 - RNA, 20 nt, Human
ucccaguggccucaacccuc

SEQ ID NO: 2481434 - RNA, 22 nt, Human
ucccaguggccucaacccuccc

SEQ ID NO: 2481435 - RNA, 20 nt, Human
ucccagugggaggggcaggc

SEQ ID NO: 2481436 - RNA, 17 nt, Human
ucccagugggaggggca

SEQ ID NO: 2481437 - RNA, 15 nt, Human
ucccagugggagggg

SEQ ID NO: 2481438 - RNA, 14 nt, Human
ucccagugggaggg

SEQ ID NO: 2481439 - RNA, 15 nt, Human
ucccagugggaggcg

SEQ ID NO: 2481440 - RNA, 10 nt, Human
ucccaguggg

SEQ ID NO: 2481441 - RNA, 23 nt, Human
ucccaguggcugcugcccaggcc

SEQ ID NO: 2481442 - RNA, 22 nt, Human
ucccaguggcugcugcccaggc

SEQ ID NO: 2481443 - RNA, 15 nt, Human
ucccagugucuuccu

SEQ ID NO: 2481444 - RNA, 23 nt, Human
ucccagugggaggggcaggcuga

SEQ ID NO: 2481445 - RNA, 22 nt, Human
ucccagugggaggggcaggcug

SEQ ID NO: 2481446 - RNA, 21 nt, Human
ucccagugggaggggcaggcu

SEQ ID NO: 2481447 - RNA, 19 nt, Human
ucccagugucuuccugugg

SEQ ID NO: 2481448 - RNA, 17 nt, Human
ucccagugucuuccugu

SEQ ID NO: 2481449 - RNA, 15 nt, Human
ucccaguucaggagu

SEQ ID NO: 2481450 - RNA, 19 nt, Human
ucccagugccgagaaggaa

SEQ ID NO: 2481451 - RNA, 22 nt, Human
ucccagugccgagaaggaagcc

SEQ ID NO: 2481452 - RNA, 16 nt, Human
ucccagucucuggcag

SEQ ID NO: 2481453 - RNA, 22 nt, Human
ucccagucuacccagagaagcc

SEQ ID NO: 2481454 - RNA, 15 nt, Human
ucccagugaauucuu

SEQ ID NO: 2481455 - RNA, 19 nt, Human
ucccagguaccagcugcgc

SEQ ID NO: 2481456 - RNA, 21 nt, Human
ucccagguaccagcugcgcuu

SEQ ID NO: 2481457 - RNA, 20 nt, Human
acuguacagacagaaaaaac

SEQ ID NO: 2481458 - RNA, 17 nt, Human
acuguaauuuuauauga

SEQ ID NO: 2481459 - RNA, 14 nt, Human
acuguacaaaguag

SEQ ID NO: 2481460 - RNA, 15 nt, Human
acuguacaaaguaga

SEQ ID NO: 2481461 - RNA, 16 nt, Human
acuguaauaaagauga

SEQ ID NO: 2481462 - RNA, 22 nt, Human
acuguaaugaaccgcugaauau

SEQ ID NO: 2481463 - RNA, 21 nt, Human
acuguaagacucauucccuag

SEQ ID NO: 2481464 - RNA, 23 nt, Human
acuguaaugaaccgcugaauaug

SEQ ID NO: 2481465 - RNA, 12 nt, Human
acuguaauuuag

SEQ ID NO: 2481466 - RNA, 19 nt, Human
acuguaauuugugauacaa

SEQ ID NO: 2481467 - RNA, 13 nt, Human
acuguacaaagua

SEQ ID NO: 2481468 - RNA, 23 nt, Human
acuguacaugaaaacacauuuuu

SEQ ID NO: 2481469 - RNA, 13 nt, Human
acuguacaugaaa

SEQ ID NO: 2481470 - RNA, 14 nt, Human
acuguacaugaaaa

SEQ ID NO: 2481471 - RNA, 19 nt, Human
acuguagaaugauuucaug

SEQ ID NO: 2481472 - RNA, 20 nt, Human
acuguagaaugauuucaugc

SEQ ID NO: 2481473 - RNA, 18 nt, Human
acuguagaaugauuucau

SEQ ID NO: 2481474 - RNA, 15 nt, Human
acuguagaaaugaug

SEQ ID NO: 2481475 - RNA, 23 nt, Human
acuguagaaaagggaacugaaca

SEQ ID NO: 2481476 - RNA, 14 nt, Human
acuguacuccuccc

SEQ ID NO: 2481477 - RNA, 13 nt, Human
acuguacuccucc

SEQ ID NO: 2481478 - RNA, 16 nt, Human
acugggaugagccgcu

SEQ ID NO: 2481479 - RNA, 17 nt, Human
acuggggagcccgucuc

SEQ ID NO: 2481480 - RNA, 13 nt, Human
acuggggagcccg

SEQ ID NO: 2481481 - RNA, 21 nt, Human
acuggggagcccgucucagug

SEQ ID NO: 2481482 - RNA, 17 nt, Human
acuggggaugugggagg

SEQ ID NO: 2481483 - RNA, 16 nt, Human
acuggggaugugggag

SEQ ID NO: 2481484 - RNA, 18 nt, Human
acuggggaugugggaggg

SEQ ID NO: 2481485 - RNA, 17 nt, Human
acuggggauuggguggg

SEQ ID NO: 2481486 - RNA, 19 nt, Human
acuggguacuuguggacac

SEQ ID NO: 2481487 - RNA, 12 nt, Human
acuggggcacuu

SEQ ID NO: 2481488 - RNA, 21 nt, Human
acuggggauugggugggcagg

SEQ ID NO: 2481489 - RNA, 16 nt, Human
acuguaaggcaaucau

SEQ ID NO: 2481490 - RNA, 23 nt, Human
acuggguacuuguggacacagcu

SEQ ID NO: 2481491 - RNA, 20 nt, Human
acuggguacuuguggacaca

SEQ ID NO: 2481492 - RNA, 17 nt, Human
acugggagaaaugaaaa

SEQ ID NO: 2481493 - RNA, 13 nt, Human
ucgcuccuguguc

SEQ ID NO: 2481494 - RNA, 14 nt, Human
ucgcuccugcccac

SEQ ID NO: 2481495 - RNA, 12 nt, Human
ucgcuccugugu

SEQ ID NO: 2481496 - RNA, 23 nt, Human
acugggagaggugccagcaacug

SEQ ID NO: 2481497 - RNA, 22 nt, Human
acugggagaggugccagcaacu

SEQ ID NO: 2481498 - RNA, 19 nt, Human
acugggagaggugccagca

SEQ ID NO: 2481499 - RNA, 12 nt, Human
acugggagccua

SEQ ID NO: 2481500 - RNA, 23 nt, Human
acugggagccuacccacccccag

SEQ ID NO: 2481501 - RNA, 13 nt, Human
acugggcaaugau

SEQ ID NO: 2481502 - RNA, 18 nt, Human
acugggcaaugauggcaa

SEQ ID NO: 2481503 - RNA, 22 nt, Human
acugggcuuggggaccagagcu

SEQ ID NO: 2481504 - RNA, 22 nt, Human
acugggaugggaggagaggaca

SEQ ID NO: 2481505 - RNA, 13 nt, Human
ucgcgacaaugca

SEQ ID NO: 2481506 - RNA, 14 nt, Human
ucgcgacaaugcaa

SEQ ID NO: 2481507 - RNA, 23 nt, Human
ucgccuuucccaggugcuacacc

SEQ ID NO: 2481508 - RNA, 21 nt, Human
ucgccuuagcauguuugcuga

SEQ ID NO: 2481509 - RNA, 20 nt, Human
ucgccuuagcauguuugcug

SEQ ID NO: 2481510 - RNA, 17 nt, Human
ucgaggacagggaggug

SEQ ID NO: 2481511 - RNA, 14 nt, Human
ucgaggacagggag

SEQ ID NO: 2481512 - RNA, 16 nt, Human
ucgccuguaaucucac

SEQ ID NO: 2481513 - RNA, 14 nt, Human
ucgccuuagcaugu

SEQ ID NO: 2481514 - RNA, 22 nt, Human
ucgccuuagcacuaccacuccu

SEQ ID NO: 2481515 - RNA, 20 nt, Human
ucgaggacuguauuugugac

SEQ ID NO: 2481516 - RNA, 18 nt, Human
ucgaggcccagcgaccuc

SEQ ID NO: 2481517 - RNA, 19 nt, Human
ucgaggacuguauuuguga

SEQ ID NO: 2481518 - RNA, 20 nt, Human
ucgagcagggugcugugggu

SEQ ID NO: 2481519 - RNA, 22 nt, Human
ucgagcaguccugccucagccu

SEQ ID NO: 2481520 - RNA, 14 nt, Human
ucgagcaugccugg

SEQ ID NO: 2481521 - RNA, 13 nt, Human
ucgaggacaggga

SEQ ID NO: 2481522 - RNA, 14 nt, Human
ucgagcagggugcu

SEQ ID NO: 2481523 - RNA, 17 nt, Human
ucgagcaguccugccuc

SEQ ID NO: 2481524 - RNA, 21 nt, Human
ucgagcaguccugccucagcc

SEQ ID NO: 2481525 - RNA, 13 nt, Human
ucgaccugccucg

SEQ ID NO: 2481526 - RNA, 22 nt, Human
ucgaccugcggcugcugugugc

SEQ ID NO: 2481527 - RNA, 20 nt, Human
ucgaccugcggcugcugugu

SEQ ID NO: 2481528 - RNA, 14 nt, Human
ucgacucagccuca

SEQ ID NO: 2481529 - RNA, 21 nt, Human
ucgacucaggauccagucccu

SEQ ID NO: 2481530 - RNA, 16 nt, Human
ucgacucaggauccag

SEQ ID NO: 2481531 - RNA, 14 nt, Human
ucgacucaggaucc

SEQ ID NO: 2481532 - RNA, 16 nt, Human
ucgacucagccucagg

SEQ ID NO: 2481533 - RNA, 16 nt, Human
ucgacugugaccugug

SEQ ID NO: 2481534 - RNA, 17 nt, Human
ucgacugugaccugugg

SEQ ID NO: 2481535 - RNA, 19 nt, Human
ucgaccugauuuacaguuu

SEQ ID NO: 2481536 - RNA, 18 nt, Human
ucgaccugauuuacaguu

SEQ ID NO: 2481537 - RNA, 19 nt, Human
ucgaccccaaagccccuug

SEQ ID NO: 2481538 - RNA, 14 nt, Human
ucgaccccaaagcc

SEQ ID NO: 2481539 - RNA, 17 nt, Human
ucgaccaauucaacccu

SEQ ID NO: 2481540 - RNA, 12 nt, Human
ucgacacagagu

SEQ ID NO: 2481541 - RNA, 20 nt, Human
ucgaauuuuuauuauuuguu

SEQ ID NO: 2481542 - RNA, 13 nt, Human
uccuuuauaauga

SEQ ID NO: 2481543 - RNA, 23 nt, Human
uccuuuaggagggaguuaucuaa

SEQ ID NO: 2481544 - RNA, 14 nt, Human
uccuuccuguucug

SEQ ID NO: 2481545 - RNA, 17 nt, Human
uccuuccugucuuccug

SEQ ID NO: 2481546 - RNA, 19 nt, Human
uccuuccugucuuccugca

SEQ ID NO: 2481547 - RNA, 12 nt, Human
uccuuccugucu

SEQ ID NO: 2481548 - RNA, 13 nt, Human
uccuuccugucuu

SEQ ID NO: 2481549 - RNA, 14 nt, Human
uccuuccugucuuc

SEQ ID NO: 2481550 - RNA, 19 nt, Human
uccuuucacaaccuucugu

SEQ ID NO: 2481551 - RNA, 18 nt, Human
uccuuucacaaccuucug

SEQ ID NO: 2481552 - RNA, 16 nt, Human
uccuuucacaaccuuc

SEQ ID NO: 2481553 - RNA, 21 nt, Human
uccuuuauguggaaaacagaa

SEQ ID NO: 2481554 - RNA, 16 nt, Human
uccuuuauauuuagug

SEQ ID NO: 2481555 - RNA, 18 nt, Human
uccuuucaccccagggcc

SEQ ID NO: 2481556 - RNA, 19 nt, Human
uccuuucaccccagggccu

SEQ ID NO: 2481557 - RNA, 21 nt, Human
uccuuucaccccagggccuga

SEQ ID NO: 2481558 - RNA, 23 nt, Human
uccuuucagggaauuucaggaac

SEQ ID NO: 2481559 - RNA, 21 nt, Human
uccuuucagggaauuucagga

SEQ ID NO: 2481560 - RNA, 22 nt, Human
uccuuucagggaauuucaggaa

SEQ ID NO: 2481561 - RNA, 15 nt, Human
uccuuucaccacaug

SEQ ID NO: 2481562 - RNA, 20 nt, Human
uccuuucacaaccuucugug

SEQ ID NO: 2481563 - RNA, 17 nt, Human
uccuuucaccccagggc

SEQ ID NO: 2481564 - RNA, 19 nt, Human
uccuuucaaugguuugcaa

SEQ ID NO: 2481565 - RNA, 22 nt, Human
uccuuucuaacaaaaaaauaua

SEQ ID NO: 2481566 - RNA, 14 nt, Human
uccuuucuaaacaa

SEQ ID NO: 2481567 - RNA, 18 nt, Human
uccuuuccccagcccagg

SEQ ID NO: 2481568 - RNA, 13 nt, Human
uccuuucccucca

SEQ ID NO: 2481569 - RNA, 20 nt, Human
uccuuuccccagcccagggu

SEQ ID NO: 2481570 - RNA, 17 nt, Human
uccuuuccccagcccag

SEQ ID NO: 2481571 - RNA, 16 nt, Human
uccuuuccccagccca

SEQ ID NO: 2481572 - RNA, 14 nt, Human
uccuuucccuccac

SEQ ID NO: 2481573 - RNA, 20 nt, Human
uccuuucauuuacuguggcu

SEQ ID NO: 2481574 - RNA, 16 nt, Human
uccuuucauuuacugu

SEQ ID NO: 2481575 - RNA, 18 nt, Human
uccuuuccaaggcuucuc

SEQ ID NO: 2481576 - RNA, 17 nt, Human
uccuuuccaaggcuucu

SEQ ID NO: 2481577 - RNA, 15 nt, Human
uccuuuccccagccc

SEQ ID NO: 2481578 - RNA, 14 nt, Human
uccuuuccccagcc

SEQ ID NO: 2481579 - RNA, 13 nt, Human
uccuuuccccagc

SEQ ID NO: 2481580 - RNA, 13 nt, Human
ucgaacuggcugc

SEQ ID NO: 2481581 - RNA, 14 nt, Human
ucgaacuggcugca

SEQ ID NO: 2481582 - RNA, 15 nt, Human
ucgaacuggcugcaa

SEQ ID NO: 2481583 - RNA, 15 nt, Human
uccuuucuaaacaag

SEQ ID NO: 2481584 - RNA, 23 nt, Human
ucgaagcgcgccacucgcuuccc

SEQ ID NO: 2481585 - RNA, 14 nt, Human
ucgaagcucagccc

SEQ ID NO: 2481586 - RNA, 15 nt, Human
ucgaagcucagccca

SEQ ID NO: 2481587 - RNA, 16 nt, Human
ucgaagcucagcccac

SEQ ID NO: 2481588 - RNA, 15 nt, Human
ucgaauuuuuauuau

SEQ ID NO: 2481589 - RNA, 18 nt, Human
acugcugcaaggccuuuc

SEQ ID NO: 2481590 - RNA, 15 nt, Human
acugcugcaaggccu

SEQ ID NO: 2481591 - RNA, 11 nt, Human
acugcugcaag

SEQ ID NO: 2481592 - RNA, 18 nt, Human
acugcucuuguuucuuuu

SEQ ID NO: 2481593 - RNA, 15 nt, Human
acugcucuuguuucu

SEQ ID NO: 2481594 - RNA, 12 nt, Human
acugcucugaug

SEQ ID NO: 2481595 - RNA, 18 nt, Human
acugcuccccagcccugg

SEQ ID NO: 2481596 - RNA, 19 nt, Human
acugcucaucauuccuuga

SEQ ID NO: 2481597 - RNA, 23 nt, Human
acugcucaucauuccuugagaaa

SEQ ID NO: 2481598 - RNA, 16 nt, Human
acugcucaagaagaca

SEQ ID NO: 2481599 - RNA, 18 nt, Human
acugcucaagaagacaug

SEQ ID NO: 2481600 - RNA, 19 nt, Human
acugcuagucuuaagaacu

SEQ ID NO: 2481601 - RNA, 22 nt, Human
acugcuaggugggccagccccu

SEQ ID NO: 2481602 - RNA, 23 nt, Human
acugcuaggugggccagccccuc

SEQ ID NO: 2481603 - RNA, 16 nt, Human
acugcuaggugggcca

SEQ ID NO: 2481604 - RNA, 17 nt, Human
acugcuaggugggccag

SEQ ID NO: 2481605 - RNA, 20 nt, Human
acugcuaggugggccagccc

SEQ ID NO: 2481606 - RNA, 21 nt, Human
acugcuaggugggccagcccc

SEQ ID NO: 2481607 - RNA, 23 nt, Human
acugcuaggcgagugccaggacu

SEQ ID NO: 2481608 - RNA, 22 nt, Human
acugcuaggcgagugccaggac

SEQ ID NO: 2481609 - RNA, 21 nt, Human
acugcuaggcgagugccagga

SEQ ID NO: 2481610 - RNA, 20 nt, Human
acugcuaggcgagugccagg

SEQ ID NO: 2481611 - RNA, 19 nt, Human
acugcuaggcgagugccag

SEQ ID NO: 2481612 - RNA, 18 nt, Human
acugcuaggcgagugcca

SEQ ID NO: 2481613 - RNA, 18 nt, Human
acugcuacuguaauuuua

SEQ ID NO: 2481614 - RNA, 22 nt, Human
acugcuacuguaauuuuauaug

SEQ ID NO: 2481615 - RNA, 20 nt, Human
acugcgggaugguccugggg

SEQ ID NO: 2481616 - RNA, 21 nt, Human
acugcgggaugguccuggggc

SEQ ID NO: 2481617 - RNA, 18 nt, Human
acugcggggcuuggcuga

SEQ ID NO: 2481618 - RNA, 16 nt, Human
acugcggggcuuggcu

SEQ ID NO: 2481619 - RNA, 22 nt, Human
acugcgggaugguccuggggcu

SEQ ID NO: 2481620 - RNA, 23 nt, Human
acugcgacuuucugccuggagug

SEQ ID NO: 2481621 - RNA, 22 nt, Human
acugcgacuuucugccuggagu

SEQ ID NO: 2481622 - RNA, 21 nt, Human
acugcgacuuucugccuggag

SEQ ID NO: 2481623 - RNA, 19 nt, Human
acugcgacuuucugccugg

SEQ ID NO: 2481624 - RNA, 19 nt, Human
acugcgaucuucagagcag

SEQ ID NO: 2481625 - RNA, 18 nt, Human
acugcgaucuucagagca

SEQ ID NO: 2481626 - RNA, 23 nt, Human
acugcggagaaccuugugccugg

SEQ ID NO: 2481627 - RNA, 20 nt, Human
acugcggaaaaggaaggaaa

SEQ ID NO: 2481628 - RNA, 19 nt, Human
acugcgggaugguccuggg

SEQ ID NO: 2481629 - RNA, 18 nt, Human
acugcgacuuucugccug

SEQ ID NO: 2481630 - RNA, 17 nt, Human
acugcgacuuucugccu

SEQ ID NO: 2481631 - RNA, 15 nt, Human
acugcgacuuucugc

SEQ ID NO: 2481632 - RNA, 13 nt, Human
acugccuuugacc

SEQ ID NO: 2481633 - RNA, 16 nt, Human
acugccuuuggcagag

SEQ ID NO: 2481634 - RNA, 19 nt, Human
acugccuuuggcagaguuc

SEQ ID NO: 2481635 - RNA, 22 nt, Human
acugccuucucaacuccaaacu

SEQ ID NO: 2481636 - RNA, 21 nt, Human
acugccuugaauauccccucc

SEQ ID NO: 2481637 - RNA, 18 nt, Human
acugccuugaauaucccc

SEQ ID NO: 2481638 - RNA, 17 nt, Human
acugccuugaauauccc

SEQ ID NO: 2481639 - RNA, 11 nt, Human
acugccuuuga

SEQ ID NO: 2481640 - RNA, 22 nt, Human
acugccuugaauauccccuccc

SEQ ID NO: 2481641 - RNA, 18 nt, Human
acugccuuggcuucaggg

SEQ ID NO: 2481642 - RNA, 15 nt, Human
acugcaggggccgag

SEQ ID NO: 2481643 - RNA, 22 nt, Human
acugcagggccaggacugagcc

SEQ ID NO: 2481644 - RNA, 22 nt, Human
acugcagugaaagacaagcugc

SEQ ID NO: 2481645 - RNA, 21 nt, Human
acugcagugaaagacaagcug

SEQ ID NO: 2481646 - RNA, 14 nt, Human
acugcauacaaucu

SEQ ID NO: 2481647 - RNA, 16 nt, Human
acugcauaccaaccug

SEQ ID NO: 2481648 - RNA, 14 nt, Human
acugcuugaggaaa

SEQ ID NO: 2481649 - RNA, 15 nt, Human
acugcuugaggaaaa

SEQ ID NO: 2481650 - RNA, 18 nt, Human
acugcuugaggaaaacaa

SEQ ID NO: 2481651 - RNA, 20 nt, Human
acugcuucccauccuacccu

SEQ ID NO: 2481652 - RNA, 19 nt, Human
acugcuucccauccuaccc

SEQ ID NO: 2481653 - RNA, 17 nt, Human
acugcuucccauccuac

SEQ ID NO: 2481654 - RNA, 16 nt, Human
acugcuucccauccua

SEQ ID NO: 2481655 - RNA, 15 nt, Human
acugcuucccauccu

SEQ ID NO: 2481656 - RNA, 13 nt, Human
acugcuggcugcc

SEQ ID NO: 2481657 - RNA, 22 nt, Human
acuggauuaaacuuaaucuaaa

SEQ ID NO: 2481658 - RNA, 22 nt, Human
acuggcaaaaggaucuuugugg

SEQ ID NO: 2481659 - RNA, 12 nt, Human
acuggcaaaagg

SEQ ID NO: 2481660 - RNA, 13 nt, Human
acuggcaaacuuc

SEQ ID NO: 2481661 - RNA, 16 nt, Human
acuggcaaacuucaga

SEQ ID NO: 2481662 - RNA, 20 nt, Human
acuggcaaacuucagacuga

SEQ ID NO: 2481663 - RNA, 23 nt, Human
acugcuuccagugaggcucugcc

SEQ ID NO: 2481664 - RNA, 22 nt, Human
acugcuuccagugaggcucugc

SEQ ID NO: 2481665 - RNA, 21 nt, Human
acugcuuccagugaggcucug

SEQ ID NO: 2481666 - RNA, 18 nt, Human
acugcuuccagugaggcu

SEQ ID NO: 2481667 - RNA, 12 nt, Human
acugcugcuuuu

SEQ ID NO: 2481668 - RNA, 14 nt, Human
acugcugcuucucc

SEQ ID NO: 2481669 - RNA, 13 nt, Human
acugcugcugccu

SEQ ID NO: 2481670 - RNA, 21 nt, Human
acugcugcuuuuugagguggc

SEQ ID NO: 2481671 - RNA, 12 nt, Human
acugcuggcugc

SEQ ID NO: 2481672 - RNA, 18 nt, Human
acugcugcccagccucca

SEQ ID NO: 2481673 - RNA, 16 nt, Human
acugcugcccagccuc

SEQ ID NO: 2481674 - RNA, 21 nt, Human
acugcugcccagccuccaagc

SEQ ID NO: 2481675 - RNA, 17 nt, Human
acugcugcuagagccag

SEQ ID NO: 2481676 - RNA, 20 nt, Human
uccuucagugccuuauggaa

SEQ ID NO: 2481677 - RNA, 13 nt, Human
uccuucagugccu

SEQ ID NO: 2481678 - RNA, 11 nt, Human
uccuucauuuc

SEQ ID NO: 2481679 - RNA, 14 nt, Human
uccuucauuuccuc

SEQ ID NO: 2481680 - RNA, 22 nt, Human
uccuucagugccuuauggaaca

SEQ ID NO: 2481681 - RNA, 13 nt, Human
uccuucagccuga

SEQ ID NO: 2481682 - RNA, 11 nt, Human
uccuucagugc

SEQ ID NO: 2481683 - RNA, 12 nt, Human
uccuucagugcc

SEQ ID NO: 2481684 - RNA, 21 nt, Human
uccuucagcccucaccccugg

SEQ ID NO: 2481685 - RNA, 18 nt, Human
uccuucagcuuccauuuc

SEQ ID NO: 2481686 - RNA, 23 nt, Human
uccuucagggugaugccagguuc

SEQ ID NO: 2481687 - RNA, 18 nt, Human
uccuucagggugaugcca

SEQ ID NO: 2481688 - RNA, 12 nt, Human
uccuucagugca

SEQ ID NO: 2481689 - RNA, 19 nt, Human
uccuucccugggcugugcu

SEQ ID NO: 2481690 - RNA, 12 nt, Human
uccuucccuggg

SEQ ID NO: 2481691 - RNA, 15 nt, Human
uccuucccuucucca

SEQ ID NO: 2481692 - RNA, 20 nt, Human
uccuucccugggcugugcua

SEQ ID NO: 2481693 - RNA, 12 nt, Human
uccuucccuggc

SEQ ID NO: 2481694 - RNA, 14 nt, Human
uccuucccuggcuu

SEQ ID NO: 2481695 - RNA, 15 nt, Human
uccuucccuggcuug

SEQ ID NO: 2481696 - RNA, 15 nt, Human
uccuucauuuccucc

SEQ ID NO: 2481697 - RNA, 14 nt, Human
uccuuccaacagga

SEQ ID NO: 2481698 - RNA, 20 nt, Human
uccuuccaacaggagcuggg

SEQ ID NO: 2481699 - RNA, 21 nt, Human
uccuuccaacaggagcuggga

SEQ ID NO: 2481700 - RNA, 20 nt, Human
uccuucccaggaguggagga

SEQ ID NO: 2481701 - RNA, 17 nt, Human
uccuuccccuuucccca

SEQ ID NO: 2481702 - RNA, 12 nt, Human
uccuucccucuc

SEQ ID NO: 2481703 - RNA, 20 nt, Human
uccuuccuggagcccagagg

SEQ ID NO: 2481704 - RNA, 23 nt, Human
uccuuccuacacccuuggacuug

SEQ ID NO: 2481705 - RNA, 22 nt, Human
uccuuccuacacccuuggacuu

SEQ ID NO: 2481706 - RNA, 17 nt, Human
uccuuccucugagccuu

SEQ ID NO: 2481707 - RNA, 16 nt, Human
uccuuccucugaggcu

SEQ ID NO: 2481708 - RNA, 21 nt, Human
uccuuccuacacccuuggacu

SEQ ID NO: 2481709 - RNA, 16 nt, Human
uccuuccucacaccag

SEQ ID NO: 2481710 - RNA, 16 nt, Human
uccuuccucugagccu

SEQ ID NO: 2481711 - RNA, 21 nt, Human
uccuuccucacaccaggcuug

SEQ ID NO: 2481712 - RNA, 16 nt, Human
acuggcugccuccacu

SEQ ID NO: 2481713 - RNA, 14 nt, Human
acuggcugccucca

SEQ ID NO: 2481714 - RNA, 12 nt, Human
acuggcugccuc

SEQ ID NO: 2481715 - RNA, 20 nt, Human
acuggcugccagcuauuuuu

SEQ ID NO: 2481716 - RNA, 19 nt, Human
acuggcugccagcuauuuu

SEQ ID NO: 2481717 - RNA, 23 nt, Human
acuggcucucuccaggauccaga

SEQ ID NO: 2481718 - RNA, 17 nt, Human
acuggcucucuccagga

SEQ ID NO: 2481719 - RNA, 16 nt, Human
acuggcucucuccagg

SEQ ID NO: 2481720 - RNA, 22 nt, Human
acuggcugcaaaggguaucagg

SEQ ID NO: 2481721 - RNA, 22 nt, Human
acuggcucuccaagugccagag

SEQ ID NO: 2481722 - RNA, 21 nt, Human
acuggcucuccaagugccaga

SEQ ID NO: 2481723 - RNA, 20 nt, Human
acuggcucuccaagugccag

SEQ ID NO: 2481724 - RNA, 17 nt, Human
acuggcucuccaagugc

SEQ ID NO: 2481725 - RNA, 15 nt, Human
acuggcucucuccag

SEQ ID NO: 2481726 - RNA, 14 nt, Human
acuggcucucucca

SEQ ID NO: 2481727 - RNA, 16 nt, Human
acuggcucuccaagug

SEQ ID NO: 2481728 - RNA, 15 nt, Human
acuggcucuccaagu

SEQ ID NO: 2481729 - RNA, 14 nt, Human
acuggcucuccaag

SEQ ID NO: 2481730 - RNA, 13 nt, Human
acuggcucuccaa

SEQ ID NO: 2481731 - RNA, 12 nt, Human
acuggcucucca

SEQ ID NO: 2481732 - RNA, 22 nt, Human
acuggcucauauuccugcagcc

SEQ ID NO: 2481733 - RNA, 19 nt, Human
uccuucagcccucaccccu

SEQ ID NO: 2481734 - RNA, 15 nt, Human
uccuucagcccucac

SEQ ID NO: 2481735 - RNA, 14 nt, Human
uccuucagcccuca

SEQ ID NO: 2481736 - RNA, 13 nt, Human
uccuucagcccuc

SEQ ID NO: 2481737 - RNA, 23 nt, Human
uccuucagacacccucaaccucu

SEQ ID NO: 2481738 - RNA, 22 nt, Human
acuggcugccuccacucccacu

SEQ ID NO: 2481739 - RNA, 21 nt, Human
acuggcugccuccacucccac

SEQ ID NO: 2481740 - RNA, 19 nt, Human
acuggcugccuccacuccc

SEQ ID NO: 2481741 - RNA, 17 nt, Human
acuggcugccuccacuc

SEQ ID NO: 2481742 - RNA, 16 nt, Human
acuggcuggcugcagu

SEQ ID NO: 2481743 - RNA, 17 nt, Human
acuggcuggcugcagug

SEQ ID NO: 2481744 - RNA, 21 nt, Human
acuggcacaguuuucugagaa

SEQ ID NO: 2481745 - RNA, 22 nt, Human
acuggcacaguuuucugagaaa

SEQ ID NO: 2481746 - RNA, 20 nt, Human
acuggcacugaauuaaucau

SEQ ID NO: 2481747 - RNA, 21 nt, Human
acuggcaaacuucagacugaa

SEQ ID NO: 2481748 - RNA, 16 nt, Human
acuggcacugaauuaa

SEQ ID NO: 2481749 - RNA, 14 nt, Human
acuggcagcaucuu

SEQ ID NO: 2481750 - RNA, 16 nt, Human
acuggcaguuuuccau

SEQ ID NO: 2481751 - RNA, 22 nt, Human
acuggcaguuuuccauugguuu

SEQ ID NO: 2481752 - RNA, 19 nt, Human
acuggcgacacguagcagc

SEQ ID NO: 2481753 - RNA, 16 nt, Human
acuggccucugcugau

SEQ ID NO: 2481754 - RNA, 23 nt, Human
acuggcguagaaguuuuuguacu

SEQ ID NO: 2481755 - RNA, 18 nt, Human
acuggcuagaguccucac

SEQ ID NO: 2481756 - RNA, 21 nt, Human
acuggcuagaguccucacucc

SEQ ID NO: 2481757 - RNA, 23 nt, Human
acuggccucugcugauccuccca

SEQ ID NO: 2481758 - RNA, 22 nt, Human
acuggccugcacggugggccuu

SEQ ID NO: 2481759 - RNA, 21 nt, Human
acuggcauggauauaguuuua

SEQ ID NO: 2481760 - RNA, 23 nt, Human
acuggcauggauauaguuuuacu

SEQ ID NO: 2481761 - RNA, 22 nt, Human
acugcaggcccuggccuccccu

SEQ ID NO: 2481762 - RNA, 19 nt, Human
acugcaggcccuggccucc

SEQ ID NO: 2481763 - RNA, 18 nt, Human
acugcaggcccuggccuc

SEQ ID NO: 2481764 - RNA, 17 nt, Human
acugcaggcccuggccu

SEQ ID NO: 2481765 - RNA, 10 nt, Human
acugcaggga

SEQ ID NO: 2481766 - RNA, 23 nt, Human
acugcagggaaaauuauuugcau

SEQ ID NO: 2481767 - RNA, 16 nt, Human
acugcagggacugcca

SEQ ID NO: 2481768 - RNA, 18 nt, Human
acugcagggacugccagu

SEQ ID NO: 2481769 - RNA, 17 nt, Human
acugcagggacugccag

SEQ ID NO: 2481770 - RNA, 20 nt, Human
acugcagggccaggacugag

SEQ ID NO: 2481771 - RNA, 17 nt, Human
acugcagggccaggacu

SEQ ID NO: 2481772 - RNA, 16 nt, Human
acugcagggccaggac

SEQ ID NO: 2481773 - RNA, 15 nt, Human
acugcagggccagga

SEQ ID NO: 2481774 - RNA, 13 nt, Human
acugcagggccag

SEQ ID NO: 2481775 - RNA, 23 nt, Human
acugcaggccccgcuuguccagc

SEQ ID NO: 2481776 - RNA, 23 nt, Human
acugcagaccuguccuccuggug

SEQ ID NO: 2481777 - RNA, 21 nt, Human
acugcagaccuguccuccugg

SEQ ID NO: 2481778 - RNA, 20 nt, Human
acugcagaccuguccuccug

SEQ ID NO: 2481779 - RNA, 23 nt, Human
acugcagccucaaccuccugggc

SEQ ID NO: 2481780 - RNA, 16 nt, Human
acugcaggcccuggcc

SEQ ID NO: 2481781 - RNA, 15 nt, Human
acugcaggcccuggc

SEQ ID NO: 2481782 - RNA, 14 nt, Human
acugcaggcccugg

SEQ ID NO: 2481783 - RNA, 13 nt, Human
acugcaggcccug

SEQ ID NO: 2481784 - RNA, 12 nt, Human
acugcaggcccu

SEQ ID NO: 2481785 - RNA, 15 nt, Human
acugcaggccccgcu

SEQ ID NO: 2481786 - RNA, 21 nt, Human
acugcaggccccgcuugucca

SEQ ID NO: 2481787 - RNA, 15 nt, Human
acugcagcuuuacau

SEQ ID NO: 2481788 - RNA, 19 nt, Human
acugcaggcaucacagcua

SEQ ID NO: 2481789 - RNA, 12 nt, Human
acugcaggcccc

SEQ ID NO: 2481790 - RNA, 22 nt, Human
acugcagccucaaccuccuggg

SEQ ID NO: 2481791 - RNA, 21 nt, Human
acugcagccucaaccuccugg

SEQ ID NO: 2481792 - RNA, 18 nt, Human
acugcagaccuguccucc

SEQ ID NO: 2481793 - RNA, 16 nt, Human
acugcagaccuguccu

SEQ ID NO: 2481794 - RNA, 21 nt, Human
acugcagaauacaguaagcug

SEQ ID NO: 2481795 - RNA, 23 nt, Human
uccuuaaaggcaccaucuaauag

SEQ ID NO: 2481796 - RNA, 19 nt, Human
acugcagccucaaccuccu

SEQ ID NO: 2481797 - RNA, 22 nt, Human
uccuuaaaggcaccaucuaaua

SEQ ID NO: 2481798 - RNA, 23 nt, Human
uccuuaaauaaacucaaugagcu

SEQ ID NO: 2481799 - RNA, 13 nt, Human
acugcacuguuuu

SEQ ID NO: 2481800 - RNA, 17 nt, Human
uccuuaaacugugugga

SEQ ID NO: 2481801 - RNA, 23 nt, Human
uccuuaaacuguguggacuguga

SEQ ID NO: 2481802 - RNA, 23 nt, Human
uccuuaaacagggcaucuccagg

SEQ ID NO: 2481803 - RNA, 14 nt, Human
uccuuaaacugugu

SEQ ID NO: 2481804 - RNA, 15 nt, Human
uccuuaaacugugug

SEQ ID NO: 2481805 - RNA, 16 nt, Human
uccuuaaacugugugg

SEQ ID NO: 2481806 - RNA, 20 nt, Human
uccuguuuuucuggguggcc

SEQ ID NO: 2481807 - RNA, 17 nt, Human
uccuguuuuucugggug

SEQ ID NO: 2481808 - RNA, 16 nt, Human
uccuguuuuucugggu

SEQ ID NO: 2481809 - RNA, 15 nt, Human
uccuuaaacagggca

SEQ ID NO: 2481810 - RNA, 24 nt, Human
uccugugucuugcaauggcagccu

SEQ ID NO: 2481811 - RNA, 23 nt, Human
uccugugucuugcaauggcagcc

SEQ ID NO: 2481812 - RNA, 23 nt, Human
uccuguguaaucauuucuugggc

SEQ ID NO: 2481813 - RNA, 15 nt, Human
uccugugugcaguga

SEQ ID NO: 2481814 - RNA, 19 nt, Human
uccugugugauugacagcu

SEQ ID NO: 2481815 - RNA, 22 nt, Human
uccuguguguccaaaacugccu

SEQ ID NO: 2481816 - RNA, 14 nt, Human
uccugugugugcgc

SEQ ID NO: 2481817 - RNA, 13 nt, Human
uccugugugugcg

SEQ ID NO: 2481818 - RNA, 18 nt, Human
uccugugugugcgccuac

SEQ ID NO: 2481819 - RNA, 12 nt, Human
uccuguguuucu

SEQ ID NO: 2481820 - RNA, 22 nt, Human
uccuguuugggccccucuccca

SEQ ID NO: 2481821 - RNA, 18 nt, Human
uccuguuugggccccucu

SEQ ID NO: 2481822 - RNA, 14 nt, Human
uccuguuuuucaca

SEQ ID NO: 2481823 - RNA, 19 nt, Human
uccuguuguuguuaaugaa

SEQ ID NO: 2481824 - RNA, 20 nt, Human
uccuguuguuauggaaacug

SEQ ID NO: 2481825 - RNA, 21 nt, Human
uccuguuguuguuaaugaaaa

SEQ ID NO: 2481826 - RNA, 19 nt, Human
uccuguucccaugagauga

SEQ ID NO: 2481827 - RNA, 20 nt, Human
uccuguguuuuuucugccac

SEQ ID NO: 2481828 - RNA, 19 nt, Human
uccuguguuucuagggaaa

SEQ ID NO: 2481829 - RNA, 18 nt, Human
uccuguuacuuaccuaaa

SEQ ID NO: 2481830 - RNA, 22 nt, Human
uccuguuagguauuagaaagug

SEQ ID NO: 2481831 - RNA, 23 nt, Human
uccuguuagcuguuauuucuauu

SEQ ID NO: 2481832 - RNA, 21 nt, Human
uccuguuggauuuguuuaaaa

SEQ ID NO: 2481833 - RNA, 22 nt, Human
uccuguugcacccagcccuggu

SEQ ID NO: 2481834 - RNA, 21 nt, Human
uccuguugcacccagcccugg

SEQ ID NO: 2481835 - RNA, 20 nt, Human
uccuguugcacccagcccug

SEQ ID NO: 2481836 - RNA, 19 nt, Human
uccuguugcacccagcccu

SEQ ID NO: 2481837 - RNA, 16 nt, Human
uccuguugcacccagc

SEQ ID NO: 2481838 - RNA, 13 nt, Human
uccuguugcaccc

SEQ ID NO: 2481839 - RNA, 12 nt, Human
uccuguucugaa

SEQ ID NO: 2481840 - RNA, 19 nt, Human
uccuguucuuaagacguga

SEQ ID NO: 2481841 - RNA, 16 nt, Human
uccugcugcagagggg

SEQ ID NO: 2481842 - RNA, 22 nt, Human
uccugcugcaccaacccagccg

SEQ ID NO: 2481843 - RNA, 21 nt, Human
uccugcugcaccaacccagcc

SEQ ID NO: 2481844 - RNA, 20 nt, Human
uccugcugcaccaacccagc

SEQ ID NO: 2481845 - RNA, 19 nt, Human
uccugcugcaccaacccag

SEQ ID NO: 2481846 - RNA, 17 nt, Human
uccugcugcaccaaccc

SEQ ID NO: 2481847 - RNA, 13 nt, Human
uccugcugcacca

SEQ ID NO: 2481848 - RNA, 12 nt, Human
uccugcugcacc

SEQ ID NO: 2481849 - RNA, 13 nt, Human
uccugcugcaguu

SEQ ID NO: 2481850 - RNA, 17 nt, Human
uccugggcccucucugc

SEQ ID NO: 2481851 - RNA, 21 nt, Human
uccugggcccucucugcucug

SEQ ID NO: 2481852 - RNA, 23 nt, Human
uccugggcccucucugcucugcg

SEQ ID NO: 2481853 - RNA, 12 nt, Human
uccugggccugc

SEQ ID NO: 2481854 - RNA, 21 nt, Human
uccugcugcagaggggcaggc

SEQ ID NO: 2481855 - RNA, 18 nt, Human
uccugcugcagaggggca

SEQ ID NO: 2481856 - RNA, 16 nt, Human
uccugggcccucucug

SEQ ID NO: 2481857 - RNA, 23 nt, Human
uccuggggguucuuucuuccucu

SEQ ID NO: 2481858 - RNA, 22 nt, Human
uccuggggguucuuucuuccuc

SEQ ID NO: 2481859 - RNA, 21 nt, Human
uccuggggguucuuucuuccu

SEQ ID NO: 2481860 - RNA, 19 nt, Human
uccuggggcucugugcagg

SEQ ID NO: 2481861 - RNA, 21 nt, Human
uccuggggccucggagccuca

SEQ ID NO: 2481862 - RNA, 22 nt, Human
uccuggggccucggagccucau

SEQ ID NO: 2481863 - RNA, 14 nt, Human
uccuggggcucccu

SEQ ID NO: 2481864 - RNA, 15 nt, Human
uccuggggccucuug

SEQ ID NO: 2481865 - RNA, 16 nt, Human
uccuggggcucccuuc

SEQ ID NO: 2481866 - RNA, 15 nt, Human
uccuggggcucccuu

SEQ ID NO: 2481867 - RNA, 15 nt, Human
uccuggggcucugug

SEQ ID NO: 2481868 - RNA, 16 nt, Human
uccuggggcucugugc

SEQ ID NO: 2481869 - RNA, 18 nt, Human
uccuggggcucugugcag

SEQ ID NO: 2481870 - RNA, 18 nt, Human
uccuggggaaccugaccc

SEQ ID NO: 2481871 - RNA, 19 nt, Human
uccuggggaaccugacccc

SEQ ID NO: 2481872 - RNA, 12 nt, Human
uccugggcuggu

SEQ ID NO: 2481873 - RNA, 13 nt, Human
uccuggggccucg

SEQ ID NO: 2481874 - RNA, 13 nt, Human
uccugggccugca

SEQ ID NO: 2481875 - RNA, 15 nt, Human
uccugggccugcaga

SEQ ID NO: 2481876 - RNA, 14 nt, Human
uccugggcgcccug

SEQ ID NO: 2481877 - RNA, 13 nt, Human
uccugggcgcccu

SEQ ID NO: 2481878 - RNA, 16 nt, Human
uccugggccugcagaa

SEQ ID NO: 2481879 - RNA, 20 nt, Human
uccugggcgcccuggaagcc

SEQ ID NO: 2481880 - RNA, 19 nt, Human
uccugggcgcccuggaagc

SEQ ID NO: 2481881 - RNA, 18 nt, Human
uccugggcgcccuggaag

SEQ ID NO: 2481882 - RNA, 16 nt, Human
uccugggcgcccugga

SEQ ID NO: 2481883 - RNA, 12 nt, Human
uccugggcucag

SEQ ID NO: 2481884 - RNA, 13 nt, Human
uccugggcucagg

SEQ ID NO: 2481885 - RNA, 18 nt, Human
uccugguacccagccauc

SEQ ID NO: 2481886 - RNA, 17 nt, Human
uccugguacccagccau

SEQ ID NO: 2481887 - RNA, 13 nt, Human
uccugguagaaua

SEQ ID NO: 2481888 - RNA, 16 nt, Human
uccugguacccagcca

SEQ ID NO: 2481889 - RNA, 15 nt, Human
uccugguacccagcc

SEQ ID NO: 2481890 - RNA, 23 nt, Human
uccuggguuuuguauucucugag

SEQ ID NO: 2481891 - RNA, 17 nt, Human
uccuggguuuuguauuc

SEQ ID NO: 2481892 - RNA, 20 nt, Human
uccuggguuuuguauucucu

SEQ ID NO: 2481893 - RNA, 21 nt, Human
uccuggguuuuguauucucug

SEQ ID NO: 2481894 - RNA, 22 nt, Human
uccuggguuuuguauucucuga

SEQ ID NO: 2481895 - RNA, 23 nt, Human
uccuggguuuucuuaaccaucuu

SEQ ID NO: 2481896 - RNA, 21 nt, Human
uccuggguggucugcaggcag

SEQ ID NO: 2481897 - RNA, 22 nt, Human
uccuggguggucugcaggcagg

SEQ ID NO: 2481898 - RNA, 15 nt, Human
uccuggguggucugc

SEQ ID NO: 2481899 - RNA, 19 nt, Human
uccuggguggucugcaggc

SEQ ID NO: 2481900 - RNA, 23 nt, Human
uccugggguauaaaacuuuccuc

SEQ ID NO: 2481901 - RNA, 16 nt, Human
uccugucuucccaggg

SEQ ID NO: 2481902 - RNA, 15 nt, Human
uccugucuucccagg

SEQ ID NO: 2481903 - RNA, 17 nt, Human
uccugucuucccagggu

SEQ ID NO: 2481904 - RNA, 15 nt, Human
uccugucuuccugca

SEQ ID NO: 2481905 - RNA, 14 nt, Human
uccugucuucccag

SEQ ID NO: 2481906 - RNA, 12 nt, Human
uccugucuuccc

SEQ ID NO: 2481907 - RNA, 11 nt, Human
uccugucuucc

SEQ ID NO: 2481908 - RNA, 22 nt, Human
uccugucugccagccagcagcc

SEQ ID NO: 2481909 - RNA, 21 nt, Human
uccugucuuuaaagccugccu

SEQ ID NO: 2481910 - RNA, 17 nt, Human
uccugucuuuaaggaaa

SEQ ID NO: 2481911 - RNA, 18 nt, Human
uccugucuuuaaggaaaa

SEQ ID NO: 2481912 - RNA, 22 nt, Human
uccugucuuucugagcacacuu

SEQ ID NO: 2481913 - RNA, 16 nt, Human
uccugugaaugccacu

SEQ ID NO: 2481914 - RNA, 15 nt, Human
uccugucuuucugag

SEQ ID NO: 2481915 - RNA, 19 nt, Human
uccugucuuuaaggaaaaa

SEQ ID NO: 2481916 - RNA, 23 nt, Human
uccugugggggaagagcacagcc

SEQ ID NO: 2481917 - RNA, 22 nt, Human
uccugugggggaagagcacagc

SEQ ID NO: 2481918 - RNA, 13 nt, Human
uccuguguacagg

SEQ ID NO: 2481919 - RNA, 18 nt, Human
uccuguguaaucauuucu

SEQ ID NO: 2481920 - RNA, 22 nt, Human
uccuguguaaucauuucuuggg

SEQ ID NO: 2481921 - RNA, 23 nt, Human
uccuguggccccacccugggccc

SEQ ID NO: 2481922 - RNA, 22 nt, Human
uccuguggccccacccugggcc

SEQ ID NO: 2481923 - RNA, 21 nt, Human
uccuguggcaggcagcgccaa

SEQ ID NO: 2481924 - RNA, 12 nt, Human
uccuguggcccc

SEQ ID NO: 2481925 - RNA, 20 nt, Human
uccuguggcaggcagcgcca

SEQ ID NO: 2481926 - RNA, 19 nt, Human
uccuguggcaggcagcgcc

SEQ ID NO: 2481927 - RNA, 16 nt, Human
uccuguggcaggcagc

SEQ ID NO: 2481928 - RNA, 15 nt, Human
uccuguggcaggcag

SEQ ID NO: 2481929 - RNA, 17 nt, Human
uccugugcccacauccc

SEQ ID NO: 2481930 - RNA, 14 nt, Human
uccuguggcaggca

SEQ ID NO: 2481931 - RNA, 15 nt, Human
uccugugacauguaa

SEQ ID NO: 2481932 - RNA, 14 nt, Human
uccugugacaugua

SEQ ID NO: 2481933 - RNA, 22 nt, Human
uccugugaaugccacugccuuc

SEQ ID NO: 2481934 - RNA, 20 nt, Human
uccugugaaugccacugccu

SEQ ID NO: 2481935 - RNA, 18 nt, Human
uccugugacuucagcucu

SEQ ID NO: 2481936 - RNA, 18 nt, Human
uccugugacauguaacag

SEQ ID NO: 2481937 - RNA, 15 nt, Human
uccugugcaugggug

SEQ ID NO: 2481938 - RNA, 16 nt, Human
uccugugcauggguga

SEQ ID NO: 2481939 - RNA, 18 nt, Human
uccugugcaugggugaag

SEQ ID NO: 2481940 - RNA, 20 nt, Human
uccugugcaugggugaaggg

SEQ ID NO: 2481941 - RNA, 18 nt, Human
uccugugcuacuuugccu

SEQ ID NO: 2481942 - RNA, 17 nt, Human
acugaggggaggggagc

SEQ ID NO: 2481943 - RNA, 22 nt, Human
acugaggggaggggagcauggg

SEQ ID NO: 2481944 - RNA, 14 nt, Human
acugaggccugagc

SEQ ID NO: 2481945 - RNA, 13 nt, Human
acugaggccugag

SEQ ID NO: 2481946 - RNA, 20 nt, Human
acugagggaccaacugggcc

SEQ ID NO: 2481947 - RNA, 21 nt, Human
acugagggaccaacugggccc

SEQ ID NO: 2481948 - RNA, 18 nt, Human
acugagggacucugaagc

SEQ ID NO: 2481949 - RNA, 17 nt, Human
acugagggacucugaag

SEQ ID NO: 2481950 - RNA, 12 nt, Human
acugagggcagu

SEQ ID NO: 2481951 - RNA, 14 nt, Human
acugagggacucug

SEQ ID NO: 2481952 - RNA, 21 nt, Human
acugaggccuaaaaguaaaca

SEQ ID NO: 2481953 - RNA, 22 nt, Human
acugagggaccaacugggccca

SEQ ID NO: 2481954 - RNA, 22 nt, Human
acugaggccaaaagaggccuga

SEQ ID NO: 2481955 - RNA, 15 nt, Human
acugaggcagggaag

SEQ ID NO: 2481956 - RNA, 23 nt, Human
acugaggcagacagcagcucagg

SEQ ID NO: 2481957 - RNA, 12 nt, Human
acugaggcaggg

SEQ ID NO: 2481958 - RNA, 14 nt, Human
acugaggcagggaa

SEQ ID NO: 2481959 - RNA, 13 nt, Human
acugaggcagaca

SEQ ID NO: 2481960 - RNA, 15 nt, Human
acugaggcagacagc

SEQ ID NO: 2481961 - RNA, 19 nt, Human
acugaggcagacagcagcu

SEQ ID NO: 2481962 - RNA, 22 nt, Human
acugaggcagacagcagcucag

SEQ ID NO: 2481963 - RNA, 14 nt, Human
acugaggaucagag

SEQ ID NO: 2481964 - RNA, 15 nt, Human
acugaggaccagcca

SEQ ID NO: 2481965 - RNA, 20 nt, Human
acugaggaauuuucuuugug

SEQ ID NO: 2481966 - RNA, 15 nt, Human
acugaggcacgagca

SEQ ID NO: 2481967 - RNA, 19 nt, Human
uccucuccaccuaguggcu

SEQ ID NO: 2481968 - RNA, 17 nt, Human
uccucuccaccuagugg

SEQ ID NO: 2481969 - RNA, 14 nt, Human
uccucuccccagcc

SEQ ID NO: 2481970 - RNA, 15 nt, Human
uccucuccccagccc

SEQ ID NO: 2481971 - RNA, 16 nt, Human
uccucuccccagccca

SEQ ID NO: 2481972 - RNA, 15 nt, Human
uccucuccccagcaa

SEQ ID NO: 2481973 - RNA, 17 nt, Human
uccucuccccagcccag

SEQ ID NO: 2481974 - RNA, 18 nt, Human
uccucuccccagcccaga

SEQ ID NO: 2481975 - RNA, 19 nt, Human
uccucuccccagcccagag

SEQ ID NO: 2481976 - RNA, 14 nt, Human
acugagccuuguaa

SEQ ID NO: 2481977 - RNA, 16 nt, Human
acugagcuucucugug

SEQ ID NO: 2481978 - RNA, 16 nt, Human
acugagcuccucuggg

SEQ ID NO: 2481979 - RNA, 19 nt, Human
acugagcuccucugggcag

SEQ ID NO: 2481980 - RNA, 23 nt, Human
acugagcuccaugugcccccucu

SEQ ID NO: 2481981 - RNA, 16 nt, Human
acugagcuccaugugc

SEQ ID NO: 2481982 - RNA, 13 nt, Human
acugagcuccucu

SEQ ID NO: 2481983 - RNA, 14 nt, Human
acugagcuccucug

SEQ ID NO: 2481984 - RNA, 22 nt, Human
acugaggaagaacggggcucuu

SEQ ID NO: 2481985 - RNA, 13 nt, Human
acugaggaagaac

SEQ ID NO: 2481986 - RNA, 17 nt, Human
acugagcuuggaagcuu

SEQ ID NO: 2481987 - RNA, 19 nt, Human
acugaggaauuucaccugu

SEQ ID NO: 2481988 - RNA, 16 nt, Human
acugaggaauuuucuu

SEQ ID NO: 2481989 - RNA, 17 nt, Human
acugaggaauuucaccu

SEQ ID NO: 2481990 - RNA, 21 nt, Human
acugagcuccucugggcagga

SEQ ID NO: 2481991 - RNA, 18 nt, Human
acugaggaaugaugaagc

SEQ ID NO: 2481992 - RNA, 13 nt, Human
acugagcuuggaa

SEQ ID NO: 2481993 - RNA, 16 nt, Human
acugagcuuggaagcu

SEQ ID NO: 2481994 - RNA, 12 nt, Human
acugagcuugga

SEQ ID NO: 2481995 - RNA, 18 nt, Human
acugagcuucucugugaa

SEQ ID NO: 2481996 - RNA, 17 nt, Human
acugagcuucucuguga

SEQ ID NO: 2481997 - RNA, 19 nt, Human
acugaguacguugugcauu

SEQ ID NO: 2481998 - RNA, 21 nt, Human
acugaguacguugugcauuug

SEQ ID NO: 2481999 - RNA, 22 nt, Human
acugagggccacacuauuacca

SEQ ID NO: 2482000 - RNA, 12 nt, Human
acugagggccac

SEQ ID NO: 2482001 - RNA, 22 nt, Human
acugagggacucugaagccucu

SEQ ID NO: 2482002 - RNA, 23 nt, Human
acugagggcagucgauagagcug

SEQ ID NO: 2482003 - RNA, 18 nt, Human
acugaguacguugugcau

SEQ ID NO: 2482004 - RNA, 22 nt, Human
acugaguacguugugcauuugg

SEQ ID NO: 2482005 - RNA, 23 nt, Human
acugaguacguugugcauuuggu

SEQ ID NO: 2482006 - RNA, 16 nt, Human
acugagugccuuuugg

SEQ ID NO: 2482007 - RNA, 20 nt, Human
acugaguaagaaaugcugcc

SEQ ID NO: 2482008 - RNA, 16 nt, Human
acugaguccuuaaaca

SEQ ID NO: 2482009 - RNA, 18 nt, Human
acugaggggucuccagga

SEQ ID NO: 2482010 - RNA, 21 nt, Human
acugaggggucuccaggagga

SEQ ID NO: 2482011 - RNA, 18 nt, Human
acugaguuacauugucau

SEQ ID NO: 2482012 - RNA, 15 nt, Human
acugaguuacauugu

SEQ ID NO: 2482013 - RNA, 21 nt, Human
acugaguuaaauuauacugga

SEQ ID NO: 2482014 - RNA, 21 nt, Human
acugcaaaugucaucagaacu

SEQ ID NO: 2482015 - RNA, 22 nt, Human
acugcaaaugucaucagaacuu

SEQ ID NO: 2482016 - RNA, 18 nt, Human
acugcaacaggcuugugc

SEQ ID NO: 2482017 - RNA, 14 nt, Human
acugcaaccuccgc

SEQ ID NO: 2482018 - RNA, 13 nt, Human
acugcaaccuccg

SEQ ID NO: 2482019 - RNA, 20 nt, Human
acugcaaccuucgccaccug

SEQ ID NO: 2482020 - RNA, 22 nt, Human
acugcaaccuccgccucuuggg

SEQ ID NO: 2482021 - RNA, 16 nt, Human
acugcaaccuccgccu

SEQ ID NO: 2482022 - RNA, 18 nt, Human
uccugcaacucaaggacu

SEQ ID NO: 2482023 - RNA, 15 nt, Human
uccugcaaugaaguc

SEQ ID NO: 2482024 - RNA, 18 nt, Human
uccugcaaugaagucucu

SEQ ID NO: 2482025 - RNA, 20 nt, Human
uccugcaaugaagucucuga

SEQ ID NO: 2482026 - RNA, 19 nt, Human
uccugauggucagcucccu

SEQ ID NO: 2482027 - RNA, 18 nt, Human
uccugauggucagcuccc

SEQ ID NO: 2482028 - RNA, 17 nt, Human
uccugauggucagcucc

SEQ ID NO: 2482029 - RNA, 23 nt, Human
uccugaugguacaggaaagcuca

SEQ ID NO: 2482030 - RNA, 21 nt, Human
uccugauggucagcucccuuc

SEQ ID NO: 2482031 - RNA, 20 nt, Human
uccugauggucagcucccuu

SEQ ID NO: 2482032 - RNA, 17 nt, Human
uccugcaacucaaggac

SEQ ID NO: 2482033 - RNA, 17 nt, Human
uccugcaaaauuuuaua

SEQ ID NO: 2482034 - RNA, 19 nt, Human
uccugcaaaauuuuauagc

SEQ ID NO: 2482035 - RNA, 22 nt, Human
uccugcagccuccuccugacca

SEQ ID NO: 2482036 - RNA, 19 nt, Human
uccugcagccuccuccuga

SEQ ID NO: 2482037 - RNA, 18 nt, Human
uccugcagccuccuccug

SEQ ID NO: 2482038 - RNA, 16 nt, Human
uccugcagccuccucc

SEQ ID NO: 2482039 - RNA, 15 nt, Human
uccugcagccuccuc

SEQ ID NO: 2482040 - RNA, 12 nt, Human
uccugcagccuc

SEQ ID NO: 2482041 - RNA, 15 nt, Human
uccugcaggcagcca

SEQ ID NO: 2482042 - RNA, 17 nt, Human
uccugcagaccacgccc

SEQ ID NO: 2482043 - RNA, 21 nt, Human
uccugcacuuacuugcuuauu

SEQ ID NO: 2482044 - RNA, 19 nt, Human
acugcacagagcucuccag

SEQ ID NO: 2482045 - RNA, 18 nt, Human
acugcacagagcucucca

SEQ ID NO: 2482046 - RNA, 17 nt, Human
acugcacagagcucucc

SEQ ID NO: 2482047 - RNA, 16 nt, Human
acugcacagagcucuc

SEQ ID NO: 2482048 - RNA, 15 nt, Human
acugcacagagcucu

SEQ ID NO: 2482049 - RNA, 12 nt, Human
acugcacagagc

SEQ ID NO: 2482050 - RNA, 21 nt, Human
acugcaauccugucuuucuga

SEQ ID NO: 2482051 - RNA, 17 nt, Human
acugcaauuaaagugau

SEQ ID NO: 2482052 - RNA, 20 nt, Human
acugcaauccugucuuucug

SEQ ID NO: 2482053 - RNA, 18 nt, Human
acugcacagugcaucuca

SEQ ID NO: 2482054 - RNA, 20 nt, Human
uccugaggggcaucugcccc

SEQ ID NO: 2482055 - RNA, 16 nt, Human
acugcacagcguccug

SEQ ID NO: 2482056 - RNA, 22 nt, Human
acugcacagcggccccugcauc

SEQ ID NO: 2482057 - RNA, 20 nt, Human
acugcacagcggccccugca

SEQ ID NO: 2482058 - RNA, 23 nt, Human
acugcacagagcucuccagcucc

SEQ ID NO: 2482059 - RNA, 16 nt, Human
acugcacagugcaucu

SEQ ID NO: 2482060 - RNA, 15 nt, Human
uccugaguggugcca

SEQ ID NO: 2482061 - RNA, 17 nt, Human
uccugauaauaauugau

SEQ ID NO: 2482062 - RNA, 18 nt, Human
uccugaugguacaggaaa

SEQ ID NO: 2482063 - RNA, 21 nt, Human
uccugauggcaggauggccug

SEQ ID NO: 2482064 - RNA, 24 nt, Human
uccugauaugauuuaaaacaugua

SEQ ID NO: 2482065 - RNA, 19 nt, Human
uccugauaauaauugauca

SEQ ID NO: 2482066 - RNA, 18 nt, Human
uccugauaauaauugauc

SEQ ID NO: 2482067 - RNA, 23 nt, Human
uccugauaugauuuaaaacaugu

SEQ ID NO: 2482068 - RNA, 22 nt, Human
uccugaggguccccaccuggga

SEQ ID NO: 2482069 - RNA, 19 nt, Human
uccugaggguccccaccug

SEQ ID NO: 2482070 - RNA, 17 nt, Human
uccugaggguccccacc

SEQ ID NO: 2482071 - RNA, 18 nt, Human
acugcacagcguccuguc

SEQ ID NO: 2482072 - RNA, 21 nt, Human
uccugaggggcaucugccccu

SEQ ID NO: 2482073 - RNA, 22 nt, Human
uccugaggggcaucugccccuc

SEQ ID NO: 2482074 - RNA, 20 nt, Human
uccugaguagcugggauuac

SEQ ID NO: 2482075 - RNA, 19 nt, Human
uccugaguagcuggauuac

SEQ ID NO: 2482076 - RNA, 18 nt, Human
uccugcuccacaguguug

SEQ ID NO: 2482077 - RNA, 15 nt, Human
uccugcuccacagug

SEQ ID NO: 2482078 - RNA, 14 nt, Human
uccugcuccacagu

SEQ ID NO: 2482079 - RNA, 18 nt, Human
uccugcuccacagccauc

SEQ ID NO: 2482080 - RNA, 14 nt, Human
uccugcuccacagc

SEQ ID NO: 2482081 - RNA, 13 nt, Human
uccugcuccacag

SEQ ID NO: 2482082 - RNA, 13 nt, Human
uccugcucugccc

SEQ ID NO: 2482083 - RNA, 16 nt, Human
uccugcuccacagugu

SEQ ID NO: 2482084 - RNA, 21 nt, Human
uccugcuacaacuucagcagu

SEQ ID NO: 2482085 - RNA, 20 nt, Human
uccugcuacaacuucagcag

SEQ ID NO: 2482086 - RNA, 14 nt, Human
uccugcuacucugu

SEQ ID NO: 2482087 - RNA, 19 nt, Human
uccugcuacaacuucagca

SEQ ID NO: 2482088 - RNA, 15 nt, Human
uccugcucauauugu

SEQ ID NO: 2482089 - RNA, 16 nt, Human
uccugcucauauugug

SEQ ID NO: 2482090 - RNA, 18 nt, Human
uccugcuacucuguuccu

SEQ ID NO: 2482091 - RNA, 20 nt, Human
uccugccucgaacuggcugc

SEQ ID NO: 2482092 - RNA, 14 nt, Human
uccugccuccgccu

SEQ ID NO: 2482093 - RNA, 17 nt, Human
uccugccucagccuccg

SEQ ID NO: 2482094 - RNA, 15 nt, Human
uccugcguccuccuc

SEQ ID NO: 2482095 - RNA, 14 nt, Human
uccugcguccuccu

SEQ ID NO: 2482096 - RNA, 13 nt, Human
uccugcguccucc

SEQ ID NO: 2482097 - RNA, 18 nt, Human
uccugcguccuccucacc

SEQ ID NO: 2482098 - RNA, 16 nt, Human
uccugcguccuccuca

SEQ ID NO: 2482099 - RNA, 21 nt, Human
uccugcguccuccucaccuca

SEQ ID NO: 2482100 - RNA, 14 nt, Human
uccugcgggugggg

SEQ ID NO: 2482101 - RNA, 13 nt, Human
uccugcggguggg

SEQ ID NO: 2482102 - RNA, 23 nt, Human
uccugcgggcuuuuccccggucc

SEQ ID NO: 2482103 - RNA, 20 nt, Human
uccugcaggcagccaggcca

SEQ ID NO: 2482104 - RNA, 19 nt, Human
uccugcaggcagccaggcc

SEQ ID NO: 2482105 - RNA, 17 nt, Human
uccugcaggcagccagg

SEQ ID NO: 2482106 - RNA, 16 nt, Human
uccugcaggcagccag

SEQ ID NO: 2482107 - RNA, 21 nt, Human
uccugcagucuggcugagccc

SEQ ID NO: 2482108 - RNA, 18 nt, Human
uccugcagguaaacaguu

SEQ ID NO: 2482109 - RNA, 22 nt, Human
uccugcagggccagaccugccu

SEQ ID NO: 2482110 - RNA, 22 nt, Human
uccugcauucacccagacagcu

SEQ ID NO: 2482111 - RNA, 16 nt, Human
uccugcauucacccag

SEQ ID NO: 2482112 - RNA, 19 nt, Human
uccugccucagccucccaa

SEQ ID NO: 2482113 - RNA, 22 nt, Human
uccugcaggcagccaggccaca

SEQ ID NO: 2482114 - RNA, 14 nt, Human
uccugcaggccagg

SEQ ID NO: 2482115 - RNA, 19 nt, Human
uccugcaggccaggccagc

SEQ ID NO: 2482116 - RNA, 20 nt, Human
uccugcaggccaggccagcu

SEQ ID NO: 2482117 - RNA, 22 nt, Human
uccaccaagccuggucagccca

SEQ ID NO: 2482118 - RNA, 23 nt, Human
uccaccaagccuggucagcccaa

SEQ ID NO: 2482119 - RNA, 22 nt, Human
uccaccaccacuggccaccagg

SEQ ID NO: 2482120 - RNA, 21 nt, Human
uccaccaccacuggccaccag

SEQ ID NO: 2482121 - RNA, 19 nt, Human
uccaccaccacuggccacc

SEQ ID NO: 2482122 - RNA, 18 nt, Human
uccaccaccacuggccac

SEQ ID NO: 2482123 - RNA, 14 nt, Human
uccaccaccacugg

SEQ ID NO: 2482124 - RNA, 13 nt, Human
uccaccaccacug

SEQ ID NO: 2482125 - RNA, 17 nt, Human
uccaccaagaaagcagg

SEQ ID NO: 2482126 - RNA, 22 nt, Human
uccaccaccucccucaccaaca

SEQ ID NO: 2482127 - RNA, 15 nt, Human
uccaccaggaaccuc

SEQ ID NO: 2482128 - RNA, 16 nt, Human
uccaccagccugcacu

SEQ ID NO: 2482129 - RNA, 14 nt, Human
uccaccagccugca

SEQ ID NO: 2482130 - RNA, 15 nt, Human
uccaccagccugcac

SEQ ID NO: 2482131 - RNA, 18 nt, Human
uccaccaccucccucacc

SEQ ID NO: 2482132 - RNA, 17 nt, Human
uccaccaccucccucac

SEQ ID NO: 2482133 - RNA, 16 nt, Human
uccaccaccucccuca

SEQ ID NO: 2482134 - RNA, 14 nt, Human
uccaccaccucccu

SEQ ID NO: 2482135 - RNA, 23 nt, Human
uccaccaccacuggccaccaggc

SEQ ID NO: 2482136 - RNA, 13 nt, Human
uccaccacccaaa

SEQ ID NO: 2482137 - RNA, 17 nt, Human
uccaccacccaaaaguc

SEQ ID NO: 2482138 - RNA, 18 nt, Human
uccaccaagccuggucag

SEQ ID NO: 2482139 - RNA, 16 nt, Human
uccaccaacccaucag

SEQ ID NO: 2482140 - RNA, 18 nt, Human
uccaccaacccaucagaa

SEQ ID NO: 2482141 - RNA, 23 nt, Human
uccacaguucaguggcagggcuc

SEQ ID NO: 2482142 - RNA, 22 nt, Human
uccacaguucgaccugcggcug

SEQ ID NO: 2482143 - RNA, 16 nt, Human
uccacaguucaguggc

SEQ ID NO: 2482144 - RNA, 15 nt, Human
uccacaguucagugg

SEQ ID NO: 2482145 - RNA, 18 nt, Human
uccacauaaggaaacugg

SEQ ID NO: 2482146 - RNA, 13 nt, Human
uccacaguucagu

SEQ ID NO: 2482147 - RNA, 12 nt, Human
uccaagcuggga

SEQ ID NO: 2482148 - RNA, 22 nt, Human
uccaagcugggagauucaaggg

SEQ ID NO: 2482149 - RNA, 13 nt, Human
uccaagugugcau

SEQ ID NO: 2482150 - RNA, 11 nt, Human
uccaagugugc

SEQ ID NO: 2482151 - RNA, 11 nt, Human
uccaagcuggu

SEQ ID NO: 2482152 - RNA, 17 nt, Human
uccaauaaaaugccuca

SEQ ID NO: 2482153 - RNA, 21 nt, Human
uccaaguuuacucaacccucu

SEQ ID NO: 2482154 - RNA, 20 nt, Human
uccaagugugcauauuguac

SEQ ID NO: 2482155 - RNA, 19 nt, Human
uccaagugugcauauugua

SEQ ID NO: 2482156 - RNA, 15 nt, Human
uccaagugugcauau

SEQ ID NO: 2482157 - RNA, 14 nt, Human
uccaagugugcaua

SEQ ID NO: 2482158 - RNA, 21 nt, Human
uccaagugugcauauuguaca

SEQ ID NO: 2482159 - RNA, 13 nt, Human
uccaagugugugu

SEQ ID NO: 2482160 - RNA, 14 nt, Human
uccaagugugugug

SEQ ID NO: 2482161 - RNA, 18 nt, Human
uccaagugugugugcgug

SEQ ID NO: 2482162 - RNA, 14 nt, Human
uccaauaaacagga

SEQ ID NO: 2482163 - RNA, 13 nt, Human
uccaauaaacagg

SEQ ID NO: 2482164 - RNA, 12 nt, Human
uccaauaaacag

SEQ ID NO: 2482165 - RNA, 23 nt, Human
uccaauaaaugugaaauucuguc

SEQ ID NO: 2482166 - RNA, 14 nt, Human
uccaauaaaccagg

SEQ ID NO: 2482167 - RNA, 14 nt, Human
uccacagugacucc

SEQ ID NO: 2482168 - RNA, 22 nt, Human
uccaacuaaugccuuacucuuc

SEQ ID NO: 2482169 - RNA, 21 nt, Human
uccaacuaucucauuuccaag

SEQ ID NO: 2482170 - RNA, 13 nt, Human
uccaagcucccag

SEQ ID NO: 2482171 - RNA, 12 nt, Human
uccaagcuccca

SEQ ID NO: 2482172 - RNA, 15 nt, Human
uccaagcucccaggc

SEQ ID NO: 2482173 - RNA, 14 nt, Human
uccaagcucccagg

SEQ ID NO: 2482174 - RNA, 16 nt, Human
uccaagcucccaggca

SEQ ID NO: 2482175 - RNA, 18 nt, Human
uccaagcuccaucuccac

SEQ ID NO: 2482176 - RNA, 14 nt, Human
uccaaccuucccaa

SEQ ID NO: 2482177 - RNA, 17 nt, Human
uccaacagaagaacugu

SEQ ID NO: 2482178 - RNA, 19 nt, Human
uccaacagcucaagucuuc

SEQ ID NO: 2482179 - RNA, 14 nt, Human
uccaacaggagcug

SEQ ID NO: 2482180 - RNA, 16 nt, Human
uccaacaggagcuggg

SEQ ID NO: 2482181 - RNA, 13 nt, Human
uccaacagugagu

SEQ ID NO: 2482182 - RNA, 17 nt, Human
uccaacaggagcuggga

SEQ ID NO: 2482183 - RNA, 16 nt, Human
uccaacguggcccaga

SEQ ID NO: 2482184 - RNA, 14 nt, Human
uccaacguggccca

SEQ ID NO: 2482185 - RNA, 18 nt, Human
uccaacguggggcagcac

SEQ ID NO: 2482186 - RNA, 17 nt, Human
uccaacguggggcagca

SEQ ID NO: 2482187 - RNA, 15 nt, Human
uccaacuaaugccuu

SEQ ID NO: 2482188 - RNA, 19 nt, Human
uccaacuaaugccuuacuc

SEQ ID NO: 2482189 - RNA, 19 nt, Human
uccaacguggggcagcaca

SEQ ID NO: 2482190 - RNA, 14 nt, Human
uccaaaugcagcuu

SEQ ID NO: 2482191 - RNA, 15 nt, Human
uccaaaugcagcuuu

SEQ ID NO: 2482192 - RNA, 18 nt, Human
uccaaauaaaaacuaaau

SEQ ID NO: 2482193 - RNA, 17 nt, Human
uccaaauaaaaacuaaa

SEQ ID NO: 2482194 - RNA, 17 nt, Human
uccaaauaagaaaccua

SEQ ID NO: 2482195 - RNA, 16 nt, Human
uccaaaugaaugaccu

SEQ ID NO: 2482196 - RNA, 19 nt, Human
uccaaaugaaugaccuugu

SEQ ID NO: 2482197 - RNA, 17 nt, Human
uccaacaccaagcacag

SEQ ID NO: 2482198 - RNA, 21 nt, Human
uccaacaccaagcacagcagc

SEQ ID NO: 2482199 - RNA, 16 nt, Human
uccaacaccacagaca

SEQ ID NO: 2482200 - RNA, 20 nt, Human
uccaaaugaauguugucugu

SEQ ID NO: 2482201 - RNA, 23 nt, Human
uccaacaccaagcacagcagccu

SEQ ID NO: 2482202 - RNA, 20 nt, Human
uccaacaccacagacacaca

SEQ ID NO: 2482203 - RNA, 19 nt, Human
uccaacaccacagacacac

SEQ ID NO: 2482204 - RNA, 18 nt, Human
uccaacaccacagacaca

SEQ ID NO: 2482205 - RNA, 17 nt, Human
uccaacaccacagacac

SEQ ID NO: 2482206 - RNA, 22 nt, Human
uccaacaccacagacacacaca

SEQ ID NO: 2482207 - RNA, 21 nt, Human
uccaacaccacagacacacac

SEQ ID NO: 2482208 - RNA, 14 nt, Human
accuggaauauaua

SEQ ID NO: 2482209 - RNA, 17 nt, Human
accuggaauauauaacc

SEQ ID NO: 2482210 - RNA, 16 nt, Human
ucauuugaacaacuag

SEQ ID NO: 2482211 - RNA, 21 nt, Human
accuggaagggcuagaaccug

SEQ ID NO: 2482212 - RNA, 19 nt, Human
ucauuugagcagggcucag

SEQ ID NO: 2482213 - RNA, 19 nt, Human
accugcugaagggcagagg

SEQ ID NO: 2482214 - RNA, 16 nt, Human
accugcugagagaccc

SEQ ID NO: 2482215 - RNA, 19 nt, Human
accugcugagagacccaag

SEQ ID NO: 2482216 - RNA, 16 nt, Human
accugcucucuuguaa

SEQ ID NO: 2482217 - RNA, 13 nt, Human
accugcucucuug

SEQ ID NO: 2482218 - RNA, 19 nt, Human
accugcucuccucuugcca

SEQ ID NO: 2482219 - RNA, 23 nt, Human
accugcuuggguggagaagccau

SEQ ID NO: 2482220 - RNA, 22 nt, Human
accugcuuggguggagaagcca

SEQ ID NO: 2482221 - RNA, 18 nt, Human
accuggaacuuggggagu

SEQ ID NO: 2482222 - RNA, 22 nt, Human
accugcugagagacccaaggag

SEQ ID NO: 2482223 - RNA, 15 nt, Human
accugaaguucacca

SEQ ID NO: 2482224 - RNA, 13 nt, Human
accugaaguucac

SEQ ID NO: 2482225 - RNA, 18 nt, Human
accugcggugcuaucucc

SEQ ID NO: 2482226 - RNA, 22 nt, Human
accugaagucuuuguacagaca

SEQ ID NO: 2482227 - RNA, 15 nt, Human
accugaagucuuugu

SEQ ID NO: 2482228 - RNA, 22 nt, Human
accugcggugcuaucuccccca

SEQ ID NO: 2482229 - RNA, 19 nt, Human
accugcggugcuaucuccc

SEQ ID NO: 2482230 - RNA, 23 nt, Human
accugcggugcuaucucccccag

SEQ ID NO: 2482231 - RNA, 17 nt, Human
accugcucuccucuugc

SEQ ID NO: 2482232 - RNA, 18 nt, Human
accugcucuccucuugcc

SEQ ID NO: 2482233 - RNA, 16 nt, Human
ucauuuuuuuccaggc

SEQ ID NO: 2482234 - RNA, 13 nt, Human
ucauuuuuuucca

SEQ ID NO: 2482235 - RNA, 18 nt, Human
ucauuuuuuuccaggcug

SEQ ID NO: 2482236 - RNA, 13 nt, Human
ucauuuuuuuuaa

SEQ ID NO: 2482237 - RNA, 13 nt, Human
uccaaauaaaaac

SEQ ID NO: 2482238 - RNA, 10 nt, Human
uccaaauaaa

SEQ ID NO: 2482239 - RNA, 23 nt, Human
uccaaagucucuggaauuugaaa

SEQ ID NO: 2482240 - RNA, 23 nt, Human
ucauuuuuguacaguuugcugua

SEQ ID NO: 2482241 - RNA, 22 nt, Human
ucauuuuuguacaguuugcugu

SEQ ID NO: 2482242 - RNA, 21 nt, Human
ucauuuuuguacaguuugcug

SEQ ID NO: 2482243 - RNA, 16 nt, Human
ucauuuuuguacaguu

SEQ ID NO: 2482244 - RNA, 20 nt, Human
ucauuuuuguuucuaccucc

SEQ ID NO: 2482245 - RNA, 19 nt, Human
ucauuuuuguuucuaccuc

SEQ ID NO: 2482246 - RNA, 17 nt, Human
ucauuuuuuuaauuuau

SEQ ID NO: 2482247 - RNA, 13 nt, Human
ucauuuuuucuua

SEQ ID NO: 2482248 - RNA, 21 nt, Human
ucauuuuauaugucaaagcag

SEQ ID NO: 2482249 - RNA, 17 nt, Human
ucauuuuauaugucaaa

SEQ ID NO: 2482250 - RNA, 16 nt, Human
ucauuuuauaugucaa

SEQ ID NO: 2482251 - RNA, 15 nt, Human
ucauuuuauguuaag

SEQ ID NO: 2482252 - RNA, 18 nt, Human
ucauuuuauaugucaaag

SEQ ID NO: 2482253 - RNA, 15 nt, Human
ucauuuuccccccac

SEQ ID NO: 2482254 - RNA, 19 nt, Human
ucauuuuccccccacucuc

SEQ ID NO: 2482255 - RNA, 18 nt, Human
ucauuugugccagaaugc

SEQ ID NO: 2482256 - RNA, 12 nt, Human
ucauuuguguca

SEQ ID NO: 2482257 - RNA, 15 nt, Human
ucauuugugucaaug

SEQ ID NO: 2482258 - RNA, 13 nt, Human
ucauuugugucaa

SEQ ID NO: 2482259 - RNA, 21 nt, Human
ucauuugagcagggcucagcg

SEQ ID NO: 2482260 - RNA, 16 nt, Human
ucauuugaugcuaaau

SEQ ID NO: 2482261 - RNA, 21 nt, Human
ucauuugcccuuaaggacaaa

SEQ ID NO: 2482262 - RNA, 19 nt, Human
ucauuugcccuuaaggaca

SEQ ID NO: 2482263 - RNA, 20 nt, Human
ucauuugcuaacuagcuugg

SEQ ID NO: 2482264 - RNA, 20 nt, Human
ucauuuuaacaucugagaaa

SEQ ID NO: 2482265 - RNA, 13 nt, Human
ucauuuuaauuau

SEQ ID NO: 2482266 - RNA, 14 nt, Human
ucauuuuaauuauu

SEQ ID NO: 2482267 - RNA, 18 nt, Human
ucauuuuacccuuggcuc

SEQ ID NO: 2482268 - RNA, 15 nt, Human
ucauuuguuggaaug

SEQ ID NO: 2482269 - RNA, 22 nt, Human
ucauuuuaacaucugagaaaag

SEQ ID NO: 2482270 - RNA, 21 nt, Human
uccagccccuggaugcagccu

SEQ ID NO: 2482271 - RNA, 19 nt, Human
uccagccccuggaugcagc

SEQ ID NO: 2482272 - RNA, 17 nt, Human
uccagccccuggaugca

SEQ ID NO: 2482273 - RNA, 16 nt, Human
uccagccccuggaugc

SEQ ID NO: 2482274 - RNA, 14 nt, Human
uccagccccuggau

SEQ ID NO: 2482275 - RNA, 15 nt, Human
uccagccccuggaug

SEQ ID NO: 2482276 - RNA, 18 nt, Human
uccagaccccuggcuuuu

SEQ ID NO: 2482277 - RNA, 17 nt, Human
uccagaccccuggcuuu

SEQ ID NO: 2482278 - RNA, 16 nt, Human
uccagaccccuggcuu

SEQ ID NO: 2482279 - RNA, 15 nt, Human
uccagaccccuggcu

SEQ ID NO: 2482280 - RNA, 21 nt, Human
uccagccucuguuccccuagu

SEQ ID NO: 2482281 - RNA, 16 nt, Human
uccagccucuguuccc

SEQ ID NO: 2482282 - RNA, 12 nt, Human
uccagccucugu

SEQ ID NO: 2482283 - RNA, 21 nt, Human
uccagccccuucucagaaucu

SEQ ID NO: 2482284 - RNA, 22 nt, Human
uccagccccuucucagaaucua

SEQ ID NO: 2482285 - RNA, 20 nt, Human
uccagccugagcgacaguga

SEQ ID NO: 2482286 - RNA, 22 nt, Human
uccagccccuggaugcagccuc

SEQ ID NO: 2482287 - RNA, 18 nt, Human
uccagccccuucucagaa

SEQ ID NO: 2482288 - RNA, 17 nt, Human
uccagccccuucucaga

SEQ ID NO: 2482289 - RNA, 23 nt, Human
uccagaccccuggcuuuucacug

SEQ ID NO: 2482290 - RNA, 11 nt, Human
uccagccugcc

SEQ ID NO: 2482291 - RNA, 21 nt, Human
uccagccugagcgacagugag

SEQ ID NO: 2482292 - RNA, 13 nt, Human
uccagccugagca

SEQ ID NO: 2482293 - RNA, 12 nt, Human
uccagccugggc

SEQ ID NO: 2482294 - RNA, 13 nt, Human
uccagccugggca

SEQ ID NO: 2482295 - RNA, 20 nt, Human
uccagccugggcaacagagc

SEQ ID NO: 2482296 - RNA, 19 nt, Human
uccagccugggcagccagg

SEQ ID NO: 2482297 - RNA, 22 nt, Human
uccagccugggcagccaggcug

SEQ ID NO: 2482298 - RNA, 23 nt, Human
uccagccugggcagccaggcugc

SEQ ID NO: 2482299 - RNA, 20 nt, Human
uccacucugcuucucugacu

SEQ ID NO: 2482300 - RNA, 19 nt, Human
uccacucugcuucucugac

SEQ ID NO: 2482301 - RNA, 15 nt, Human
uccacucugcuucuc

SEQ ID NO: 2482302 - RNA, 14 nt, Human
uccacucugcuucu

SEQ ID NO: 2482303 - RNA, 17 nt, Human
uccacucuccuugcuac

SEQ ID NO: 2482304 - RNA, 18 nt, Human
uccacuagugcaaaucau

SEQ ID NO: 2482305 - RNA, 22 nt, Human
uccacucucccccacccccucc

SEQ ID NO: 2482306 - RNA, 12 nt, Human
uccacucugcuu

SEQ ID NO: 2482307 - RNA, 19 nt, Human
uccacucuccuugcuaccc

SEQ ID NO: 2482308 - RNA, 14 nt, Human
uccacugagcucca

SEQ ID NO: 2482309 - RNA, 13 nt, Human
uccacugagcucc

SEQ ID NO: 2482310 - RNA, 23 nt, Human
uccacucugcuucucugacuucu

SEQ ID NO: 2482311 - RNA, 21 nt, Human
uccacucugcuucucugacuu

SEQ ID NO: 2482312 - RNA, 24 nt, Human
uccacucugcuucucugacuucug

SEQ ID NO: 2482313 - RNA, 13 nt, Human
uccagaaugcugu

SEQ ID NO: 2482314 - RNA, 15 nt, Human
uccagaaugcuguac

SEQ ID NO: 2482315 - RNA, 16 nt, Human
uccagaaugcuguaca

SEQ ID NO: 2482316 - RNA, 13 nt, Human
uccagaccccugg

SEQ ID NO: 2482317 - RNA, 14 nt, Human
uccagaaucuaaag

SEQ ID NO: 2482318 - RNA, 23 nt, Human
uccagaauaucugggauucuacu

SEQ ID NO: 2482319 - RNA, 14 nt, Human
uccagaauaucugg

SEQ ID NO: 2482320 - RNA, 12 nt, Human
uccagaauaucu

SEQ ID NO: 2482321 - RNA, 19 nt, Human
uccagaaucuaaagccagu

SEQ ID NO: 2482322 - RNA, 18 nt, Human
uccagaaucuaaagccag

SEQ ID NO: 2482323 - RNA, 22 nt, Human
uccagaauaaaacgcaaagggc

SEQ ID NO: 2482324 - RNA, 15 nt, Human
uccagaagugugauu

SEQ ID NO: 2482325 - RNA, 23 nt, Human
uccagaagggguuuggucuggga

SEQ ID NO: 2482326 - RNA, 22 nt, Human
uccagaaguuugagaucagccu

SEQ ID NO: 2482327 - RNA, 15 nt, Human
accuuuguauucucu

SEQ ID NO: 2482328 - RNA, 19 nt, Human
accuuuguauucucuccug

SEQ ID NO: 2482329 - RNA, 23 nt, Human
accuuuguauucucuccuguacc

SEQ ID NO: 2482330 - RNA, 11 nt, Human
accuuugucac

SEQ ID NO: 2482331 - RNA, 15 nt, Human
uccacuacaccuggc

SEQ ID NO: 2482332 - RNA, 19 nt, Human
uccacuaaccccgggcggg

SEQ ID NO: 2482333 - RNA, 16 nt, Human
uccacuaaccccgggc

SEQ ID NO: 2482334 - RNA, 11 nt, Human
uccacuaaccc

SEQ ID NO: 2482335 - RNA, 20 nt, Human
uccacguucugcucaucauu

SEQ ID NO: 2482336 - RNA, 21 nt, Human
uccacguucugcucaucauuc

SEQ ID NO: 2482337 - RNA, 18 nt, Human
uccacuacaccuggcuga

SEQ ID NO: 2482338 - RNA, 17 nt, Human
uccacuacaccuggcug

SEQ ID NO: 2482339 - RNA, 16 nt, Human
uccacuacaccuggcu

SEQ ID NO: 2482340 - RNA, 17 nt, Human
uccacuagugcaaauca

SEQ ID NO: 2482341 - RNA, 15 nt, Human
uccacuagugcaaau

SEQ ID NO: 2482342 - RNA, 13 nt, Human
uccacuacugcua

SEQ ID NO: 2482343 - RNA, 16 nt, Human
uccacggucuguucuu

SEQ ID NO: 2482344 - RNA, 18 nt, Human
uccacgucccccuggggc

SEQ ID NO: 2482345 - RNA, 17 nt, Human
uccacgucccccugggg

SEQ ID NO: 2482346 - RNA, 16 nt, Human
uccacgucccccuggg

SEQ ID NO: 2482347 - RNA, 18 nt, Human
uccacggucuguucuuga

SEQ ID NO: 2482348 - RNA, 19 nt, Human
uccacguucugcucaucau

SEQ ID NO: 2482349 - RNA, 17 nt, Human
uccacguucaccccucc

SEQ ID NO: 2482350 - RNA, 12 nt, Human
accuucuccuuc

SEQ ID NO: 2482351 - RNA, 23 nt, Human
accuucucccucauuucaggagc

SEQ ID NO: 2482352 - RNA, 17 nt, Human
accuucuccccauucug

SEQ ID NO: 2482353 - RNA, 12 nt, Human
accuucccagcu

SEQ ID NO: 2482354 - RNA, 14 nt, Human
accuucuccaaaug

SEQ ID NO: 2482355 - RNA, 19 nt, Human
accuucccaaacgccuccc

SEQ ID NO: 2482356 - RNA, 21 nt, Human
accuucccaaacgccuccccu

SEQ ID NO: 2482357 - RNA, 22 nt, Human
accuucccaaacgccuccccug

SEQ ID NO: 2482358 - RNA, 17 nt, Human
accuuccagucaggaug

SEQ ID NO: 2482359 - RNA, 11 nt, Human
accuucccagc

SEQ ID NO: 2482360 - RNA, 17 nt, Human
accuuccaagagccuga

SEQ ID NO: 2482361 - RNA, 13 nt, Human
accuuaucugugc

SEQ ID NO: 2482362 - RNA, 22 nt, Human
accuuagauguucuaagucuuu

SEQ ID NO: 2482363 - RNA, 22 nt, Human
accuuaguguuucugugcaugg

SEQ ID NO: 2482364 - RNA, 11 nt, Human
accuuaucugu

SEQ ID NO: 2482365 - RNA, 14 nt, Human
accuuccagcuccu

SEQ ID NO: 2482366 - RNA, 13 nt, Human
accuuccagcucc

SEQ ID NO: 2482367 - RNA, 14 nt, Human
accuucccaaacgc

SEQ ID NO: 2482368 - RNA, 17 nt, Human
accuuccagcuccugua

SEQ ID NO: 2482369 - RNA, 19 nt, Human
accuuccauggcucuuuuu

SEQ ID NO: 2482370 - RNA, 15 nt, Human
accuugaaugaugcc

SEQ ID NO: 2482371 - RNA, 14 nt, Human
accuugacagggca

SEQ ID NO: 2482372 - RNA, 15 nt, Human
accuugacagggcac

SEQ ID NO: 2482373 - RNA, 16 nt, Human
accuucuguggcucac

SEQ ID NO: 2482374 - RNA, 19 nt, Human
accuucuucagccaccucu

SEQ ID NO: 2482375 - RNA, 20 nt, Human
accuucuucagccaccucuc

SEQ ID NO: 2482376 - RNA, 15 nt, Human
accuucuguggcuca

SEQ ID NO: 2482377 - RNA, 13 nt, Human
accuucuguggcu

SEQ ID NO: 2482378 - RNA, 13 nt, Human
accuucuccuuca

SEQ ID NO: 2482379 - RNA, 13 nt, Human
accuucuguaguu

SEQ ID NO: 2482380 - RNA, 12 nt, Human
accuucuguggc

SEQ ID NO: 2482381 - RNA, 22 nt, Human
accuuaaguaagcaacagcaua

SEQ ID NO: 2482382 - RNA, 15 nt, Human
accuuaccaacuuuc

SEQ ID NO: 2482383 - RNA, 18 nt, Human
accuuaccaacuuucugu

SEQ ID NO: 2482384 - RNA, 17 nt, Human
accuuaccaacuuucug

SEQ ID NO: 2482385 - RNA, 16 nt, Human
accuuaccaacuuucu

SEQ ID NO: 2482386 - RNA, 20 nt, Human
accuuaccaacuuucuguaa

SEQ ID NO: 2482387 - RNA, 15 nt, Human
accuuacuguggagg

SEQ ID NO: 2482388 - RNA, 19 nt, Human
accuuaccaacuuucugua

SEQ ID NO: 2482389 - RNA, 21 nt, Human
accuuacuguggaggaaggau

SEQ ID NO: 2482390 - RNA, 16 nt, Human
accuggugcugccucu

SEQ ID NO: 2482391 - RNA, 13 nt, Human
accuggugcugga

SEQ ID NO: 2482392 - RNA, 14 nt, Human
accuggugcuggau

SEQ ID NO: 2482393 - RNA, 14 nt, Human
accuggucucuccu

SEQ ID NO: 2482394 - RNA, 10 nt, Human
accuggugcu

SEQ ID NO: 2482395 - RNA, 11 nt, Human
accuggugcug

SEQ ID NO: 2482396 - RNA, 21 nt, Human
accuuaaguaagcaacagcau

SEQ ID NO: 2482397 - RNA, 22 nt, Human
accuggugcuggauauuuucaa

SEQ ID NO: 2482398 - RNA, 15 nt, Human
accugguggccucug

SEQ ID NO: 2482399 - RNA, 22 nt, Human
accugguuccggaauccugucc

SEQ ID NO: 2482400 - RNA, 23 nt, Human
accuggucacaggacucugccuc

SEQ ID NO: 2482401 - RNA, 22 nt, Human
accuggucacaggacucugccu

SEQ ID NO: 2482402 - RNA, 15 nt, Human
uccaccaucaagcca

SEQ ID NO: 2482403 - RNA, 19 nt, Human
uccaccaggaaccucuuca

SEQ ID NO: 2482404 - RNA, 21 nt, Human
uccaccaggaaccucuucaga

SEQ ID NO: 2482405 - RNA, 21 nt, Human
accuuaguguuucugugcaug

SEQ ID NO: 2482406 - RNA, 20 nt, Human
accuuaguguuucugugcau

SEQ ID NO: 2482407 - RNA, 19 nt, Human
accuuaguguuucugugca

SEQ ID NO: 2482408 - RNA, 15 nt, Human
accuuaguguuucug

SEQ ID NO: 2482409 - RNA, 14 nt, Human
accuuaguguuucu

SEQ ID NO: 2482410 - RNA, 14 nt, Human
accuuaguggcuuu

SEQ ID NO: 2482411 - RNA, 21 nt, Human
accuuaggccuuccucucucc

SEQ ID NO: 2482412 - RNA, 18 nt, Human
accuuaggccuuccucuc

SEQ ID NO: 2482413 - RNA, 20 nt, Human
accuuaggccuuccucucuc

SEQ ID NO: 2482414 - RNA, 14 nt, Human
accuuaggccuucc

SEQ ID NO: 2482415 - RNA, 15 nt, Human
accuuaggccuuccu

SEQ ID NO: 2482416 - RNA, 16 nt, Human
accuuaggccuuccuc

SEQ ID NO: 2482417 - RNA, 17 nt, Human
accuuaggccuuccucu

SEQ ID NO: 2482418 - RNA, 17 nt, Human
accuuagacagucccug

SEQ ID NO: 2482419 - RNA, 14 nt, Human
accuuagccugccc

SEQ ID NO: 2482420 - RNA, 17 nt, Human
accuuagauuagcucug

SEQ ID NO: 2482421 - RNA, 19 nt, Human
accuuagauuagcucugga

SEQ ID NO: 2482422 - RNA, 18 nt, Human
accuuagauuagcucugg

SEQ ID NO: 2482423 - RNA, 21 nt, Human
accuuagcuggcauuacagcu

SEQ ID NO: 2482424 - RNA, 22 nt, Human
accuuagcuggcauuacagcug

SEQ ID NO: 2482425 - RNA, 13 nt, Human
accuuaggccuuc

SEQ ID NO: 2482426 - RNA, 16 nt, Human
accuuaggcagggaag

SEQ ID NO: 2482427 - RNA, 13 nt, Human
accuuaggcaggg

SEQ ID NO: 2482428 - RNA, 15 nt, Human
accuuaggcagggaa

SEQ ID NO: 2482429 - RNA, 23 nt, Human
accuuaggaauaaucuccuguua

SEQ ID NO: 2482430 - RNA, 18 nt, Human
accucacagaaaugagau

SEQ ID NO: 2482431 - RNA, 11 nt, Human
accucacccca

SEQ ID NO: 2482432 - RNA, 15 nt, Human
accucaccccacuua

SEQ ID NO: 2482433 - RNA, 12 nt, Human
accucaccccac

SEQ ID NO: 2482434 - RNA, 21 nt, Human
accucacugggguccuggggc

SEQ ID NO: 2482435 - RNA, 23 nt, Human
accucacugggguccuggggccu

SEQ ID NO: 2482436 - RNA, 19 nt, Human
accucaaguuuuuguuuug

SEQ ID NO: 2482437 - RNA, 16 nt, Human
accucaagcugcaucu

SEQ ID NO: 2482438 - RNA, 10 nt, Human
accucaaggg

SEQ ID NO: 2482439 - RNA, 15 nt, Human
accucaagggggacu

SEQ ID NO: 2482440 - RNA, 20 nt, Human
accucaagggggacugucuu

SEQ ID NO: 2482441 - RNA, 21 nt, Human
accucaagggggacugucuuu

SEQ ID NO: 2482442 - RNA, 19 nt, Human
accuccccagccccuagcc

SEQ ID NO: 2482443 - RNA, 16 nt, Human
accuccccagccccua

SEQ ID NO: 2482444 - RNA, 15 nt, Human
accuccccagccccu

SEQ ID NO: 2482445 - RNA, 13 nt, Human
accucagccuaga

SEQ ID NO: 2482446 - RNA, 15 nt, Human
accucagccuagacc

SEQ ID NO: 2482447 - RNA, 14 nt, Human
accucagccaugag

SEQ ID NO: 2482448 - RNA, 22 nt, Human
accucagccaugaggaguugcu

SEQ ID NO: 2482449 - RNA, 23 nt, Human
accucagccaugaggaguugcug

SEQ ID NO: 2482450 - RNA, 10 nt, Human
accucagccu

SEQ ID NO: 2482451 - RNA, 22 nt, Human
accucagacuuaccaggaagca

SEQ ID NO: 2482452 - RNA, 20 nt, Human
accucacugaaaacaucugg

SEQ ID NO: 2482453 - RNA, 18 nt, Human
accucagaguauggagcu

SEQ ID NO: 2482454 - RNA, 22 nt, Human
accucagaggcuguucuugggg

SEQ ID NO: 2482455 - RNA, 20 nt, Human
accucagaguccaggcccca

SEQ ID NO: 2482456 - RNA, 17 nt, Human
accucagaguccaggcc

SEQ ID NO: 2482457 - RNA, 19 nt, Human
accucagaguccaggcccc

SEQ ID NO: 2482458 - RNA, 13 nt, Human
accuccucaggga

SEQ ID NO: 2482459 - RNA, 23 nt, Human
accuccucagggauggccguugg

SEQ ID NO: 2482460 - RNA, 14 nt, Human
accuccucagggau

SEQ ID NO: 2482461 - RNA, 16 nt, Human
accuccuccacaccag

SEQ ID NO: 2482462 - RNA, 20 nt, Human
accucccccucccccuucuc

SEQ ID NO: 2482463 - RNA, 16 nt, Human
accuccgccucccggg

SEQ ID NO: 2482464 - RNA, 22 nt, Human
accuccccccacugcaggcccc

SEQ ID NO: 2482465 - RNA, 19 nt, Human
accucccccucccccuucu

SEQ ID NO: 2482466 - RNA, 23 nt, Human
accuccuacgucaaacaugaagu

SEQ ID NO: 2482467 - RNA, 13 nt, Human
accuccccccacu

SEQ ID NO: 2482468 - RNA, 14 nt, Human
accuccccccacug

SEQ ID NO: 2482469 - RNA, 15 nt, Human
accuccccccacugc

SEQ ID NO: 2482470 - RNA, 16 nt, Human
accuccccccacugca

SEQ ID NO: 2482471 - RNA, 17 nt, Human
accuccccccacugcag

SEQ ID NO: 2482472 - RNA, 18 nt, Human
accuccccccacugcagg

SEQ ID NO: 2482473 - RNA, 20 nt, Human
accuccgccucuuggguuca

SEQ ID NO: 2482474 - RNA, 23 nt, Human
accuccccagccccuagcccagg

SEQ ID NO: 2482475 - RNA, 13 nt, Human
accuccccagccu

SEQ ID NO: 2482476 - RNA, 20 nt, Human
accuccccaggccguggcug

SEQ ID NO: 2482477 - RNA, 19 nt, Human
accuccccaggccguggcu

SEQ ID NO: 2482478 - RNA, 14 nt, Human
accuccccaggccg

SEQ ID NO: 2482479 - RNA, 13 nt, Human
accuccccaggcc

SEQ ID NO: 2482480 - RNA, 20 nt, Human
accgugggcggggccuugcg

SEQ ID NO: 2482481 - RNA, 19 nt, Human
accgugggcggggccuugc

SEQ ID NO: 2482482 - RNA, 17 nt, Human
accgugggcggggccuu

SEQ ID NO: 2482483 - RNA, 15 nt, Human
accgugggcggggcc

SEQ ID NO: 2482484 - RNA, 14 nt, Human
accgugggcucccu

SEQ ID NO: 2482485 - RNA, 16 nt, Human
accgugggcucccuga

SEQ ID NO: 2482486 - RNA, 14 nt, Human
accguguaaaccaa

SEQ ID NO: 2482487 - RNA, 21 nt, Human
accguguugguuuugacugga

SEQ ID NO: 2482488 - RNA, 14 nt, Human
accguucugugcac

SEQ ID NO: 2482489 - RNA, 13 nt, Human
accguuucuuccc

SEQ ID NO: 2482490 - RNA, 18 nt, Human
accguuggggauugggga

SEQ ID NO: 2482491 - RNA, 19 nt, Human
accuaacgcccuauuuuug

SEQ ID NO: 2482492 - RNA, 17 nt, Human
accuaaccccuuuccug

SEQ ID NO: 2482493 - RNA, 13 nt, Human
accuaaaaaagau

SEQ ID NO: 2482494 - RNA, 14 nt, Human
accguuucuucccu

SEQ ID NO: 2482495 - RNA, 18 nt, Human
accuaaccccuuuccugc

SEQ ID NO: 2482496 - RNA, 20 nt, Human
accuaauccaggcagaucca

SEQ ID NO: 2482497 - RNA, 11 nt, Human
accuaauccaa

SEQ ID NO: 2482498 - RNA, 15 nt, Human
accuaauccaggcag

SEQ ID NO: 2482499 - RNA, 17 nt, Human
accuaaucaggcugagg

SEQ ID NO: 2482500 - RNA, 16 nt, Human
accuaaucaggcugag

SEQ ID NO: 2482501 - RNA, 16 nt, Human
accuaagggacauguu

SEQ ID NO: 2482502 - RNA, 15 nt, Human
accuaagggacaugu

SEQ ID NO: 2482503 - RNA, 21 nt, Human
accuaacucaccuaacucaua

SEQ ID NO: 2482504 - RNA, 23 nt, Human
accuaagggacauguuuugauaa

SEQ ID NO: 2482505 - RNA, 18 nt, Human
accuaaguccuuuaugug

SEQ ID NO: 2482506 - RNA, 20 nt, Human
accuaaguuucaguugauuu

SEQ ID NO: 2482507 - RNA, 14 nt, Human
accuagcagcaccg

SEQ ID NO: 2482508 - RNA, 21 nt, Human
accuagcagcaccguucugug

SEQ ID NO: 2482509 - RNA, 22 nt, Human
accuagcagcaccguucugugc

SEQ ID NO: 2482510 - RNA, 13 nt, Human
accuagccuuaga

SEQ ID NO: 2482511 - RNA, 16 nt, Human
accuagcgucaguauu

SEQ ID NO: 2482512 - RNA, 23 nt, Human
accuagcagcaccguucugugca

SEQ ID NO: 2482513 - RNA, 19 nt, Human
accuauaaaguaaagcuaa

SEQ ID NO: 2482514 - RNA, 16 nt, Human
accuaugucauuucau

SEQ ID NO: 2482515 - RNA, 18 nt, Human
accuaugucauuucauuu

SEQ ID NO: 2482516 - RNA, 14 nt, Human
accucaagcugcau

SEQ ID NO: 2482517 - RNA, 12 nt, Human
accuaugucauu

SEQ ID NO: 2482518 - RNA, 15 nt, Human
accuaugucauuuca

SEQ ID NO: 2482519 - RNA, 19 nt, Human
accuaugauauuuucugug

SEQ ID NO: 2482520 - RNA, 22 nt, Human
accuaugguauaaugguugacu

SEQ ID NO: 2482521 - RNA, 15 nt, Human
accuauagucccagc

SEQ ID NO: 2482522 - RNA, 16 nt, Human
accuauagucccagcu

SEQ ID NO: 2482523 - RNA, 13 nt, Human
accuauaugauuu

SEQ ID NO: 2482524 - RNA, 22 nt, Human
accuauauaauaaagcuacuga

SEQ ID NO: 2482525 - RNA, 22 nt, Human
accuauagucccagcuacucag

SEQ ID NO: 2482526 - RNA, 18 nt, Human
accuaucucgugggagag

SEQ ID NO: 2482527 - RNA, 17 nt, Human
accuaucucgugggaga

SEQ ID NO: 2482528 - RNA, 15 nt, Human
accuaucucguggga

SEQ ID NO: 2482529 - RNA, 17 nt, Human
accuauaugauuuauag

SEQ ID NO: 2482530 - RNA, 17 nt, Human
accgccaaggcuggggg

SEQ ID NO: 2482531 - RNA, 12 nt, Human
accgcaggaagc

SEQ ID NO: 2482532 - RNA, 13 nt, Human
accgcaggaagcu

SEQ ID NO: 2482533 - RNA, 14 nt, Human
accgcaggaagcug

SEQ ID NO: 2482534 - RNA, 17 nt, Human
accgccagauggggccu

SEQ ID NO: 2482535 - RNA, 17 nt, Human
accgccacauggcuucc

SEQ ID NO: 2482536 - RNA, 20 nt, Human
accgccagauggggccucug

SEQ ID NO: 2482537 - RNA, 21 nt, Human
accgccacacacacaggagca

SEQ ID NO: 2482538 - RNA, 22 nt, Human
accgcaugcccccucgugccag

SEQ ID NO: 2482539 - RNA, 14 nt, Human
accgcaugcccccu

SEQ ID NO: 2482540 - RNA, 23 nt, Human
accgcagucgucgcacagucucu

SEQ ID NO: 2482541 - RNA, 22 nt, Human
accgcagucgucgcacagucuc

SEQ ID NO: 2482542 - RNA, 21 nt, Human
accgcagucgucgcacagucu

SEQ ID NO: 2482543 - RNA, 16 nt, Human
accgcaggaagcugcu

SEQ ID NO: 2482544 - RNA, 19 nt, Human
accgcaggaagcugcuccg

SEQ ID NO: 2482545 - RNA, 14 nt, Human
accgagugaaccua

SEQ ID NO: 2482546 - RNA, 23 nt, Human
accgagccucugucacugcaggc

SEQ ID NO: 2482547 - RNA, 19 nt, Human
accgagcaaagaucaaaau

SEQ ID NO: 2482548 - RNA, 17 nt, Human
accgagcaaagaucaaa

SEQ ID NO: 2482549 - RNA, 24 nt, Human
accgagucucuucuccacuggaug

SEQ ID NO: 2482550 - RNA, 21 nt, Human
accgagucucuucuccacugg

SEQ ID NO: 2482551 - RNA, 20 nt, Human
accgagucucuucuccacug

SEQ ID NO: 2482552 - RNA, 20 nt, Human
accgcagacaggaccaggga

SEQ ID NO: 2482553 - RNA, 21 nt, Human
accgagugaaccuaccuucau

SEQ ID NO: 2482554 - RNA, 13 nt, Human
accgaugcuccag

SEQ ID NO: 2482555 - RNA, 15 nt, Human
accgaugcuccagcc

SEQ ID NO: 2482556 - RNA, 22 nt, Human
accgauucaucucucagaaggg

SEQ ID NO: 2482557 - RNA, 23 nt, Human
accgaugcuccagccaaccccug

SEQ ID NO: 2482558 - RNA, 18 nt, Human
accgccgacuuuguaccc

SEQ ID NO: 2482559 - RNA, 19 nt, Human
accgcccccuccucuagcu

SEQ ID NO: 2482560 - RNA, 14 nt, Human
accgcccccuccuc

SEQ ID NO: 2482561 - RNA, 12 nt, Human
accgcccccucc

SEQ ID NO: 2482562 - RNA, 11 nt, Human
accgcccccuc

SEQ ID NO: 2482563 - RNA, 12 nt, Human
accgccuucucu

SEQ ID NO: 2482564 - RNA, 15 nt, Human
accgcuccccagccc

SEQ ID NO: 2482565 - RNA, 17 nt, Human
accgcuccccagcccag

SEQ ID NO: 2482566 - RNA, 18 nt, Human
accgcuccccagcccagg

SEQ ID NO: 2482567 - RNA, 19 nt, Human
accgcuccccagcccaggg

SEQ ID NO: 2482568 - RNA, 20 nt, Human
accgcuccccagcccagggu

SEQ ID NO: 2482569 - RNA, 16 nt, Human
accgccuccuacagcc

SEQ ID NO: 2482570 - RNA, 21 nt, Human
accgccgacuuuguacccccc

SEQ ID NO: 2482571 - RNA, 16 nt, Human
accgugggcagggagc

SEQ ID NO: 2482572 - RNA, 18 nt, Human
accgugggcagggagcgg

SEQ ID NO: 2482573 - RNA, 15 nt, Human
accggacuuuucugc

SEQ ID NO: 2482574 - RNA, 16 nt, Human
accggacuuuucugca

SEQ ID NO: 2482575 - RNA, 16 nt, Human
accgcuuccggcuccu

SEQ ID NO: 2482576 - RNA, 21 nt, Human
accgcugccuaaguggcugcu

SEQ ID NO: 2482577 - RNA, 22 nt, Human
accgcuuccggcuccugugcuu

SEQ ID NO: 2482578 - RNA, 17 nt, Human
accgcugauucucaggg

SEQ ID NO: 2482579 - RNA, 13 nt, Human
accgcugaauaug

SEQ ID NO: 2482580 - RNA, 19 nt, Human
accgcugccuaaguggcug

SEQ ID NO: 2482581 - RNA, 20 nt, Human
accgcugccuaaguggcugc

SEQ ID NO: 2482582 - RNA, 12 nt, Human
ucauauuauaca

SEQ ID NO: 2482583 - RNA, 16 nt, Human
ucauauucugucugga

SEQ ID NO: 2482584 - RNA, 17 nt, Human
ucauauuccugcagccu

SEQ ID NO: 2482585 - RNA, 19 nt, Human
ucauauguugcucagucuc

SEQ ID NO: 2482586 - RNA, 18 nt, Human
ucauauguugcucagucu

SEQ ID NO: 2482587 - RNA, 20 nt, Human
ucauauguugcucagucucc

SEQ ID NO: 2482588 - RNA, 15 nt, Human
ucauauguugcucag

SEQ ID NO: 2482589 - RNA, 14 nt, Human
ucauauguugcuca

SEQ ID NO: 2482590 - RNA, 13 nt, Human
ucauauguugcuc

SEQ ID NO: 2482591 - RNA, 23 nt, Human
acccuuuuggcccccgagcuggg

SEQ ID NO: 2482592 - RNA, 10 nt, Human
acccuuuucu

SEQ ID NO: 2482593 - RNA, 14 nt, Human
acccuuuuggcccc

SEQ ID NO: 2482594 - RNA, 23 nt, Human
acccuuugguuuuuuucuucugu

SEQ ID NO: 2482595 - RNA, 21 nt, Human
acccuuugguuuuuuucuucu

SEQ ID NO: 2482596 - RNA, 12 nt, Human
acccuuuuccag

SEQ ID NO: 2482597 - RNA, 23 nt, Human
acccuuugcugugaggcuguccu

SEQ ID NO: 2482598 - RNA, 22 nt, Human
acccuuugcugugaggcugucc

SEQ ID NO: 2482599 - RNA, 23 nt, Human
acccuuuggggggggcccgccug

SEQ ID NO: 2482600 - RNA, 12 nt, Human
acccuuugguuu

SEQ ID NO: 2482601 - RNA, 12 nt, Human
acccuuuggggg

SEQ ID NO: 2482602 - RNA, 23 nt, Human
accgaaguggacuggccccuggg

SEQ ID NO: 2482603 - RNA, 21 nt, Human
accgaaguggacuggccccug

SEQ ID NO: 2482604 - RNA, 20 nt, Human
accgaaguggacuggccccu

SEQ ID NO: 2482605 - RNA, 16 nt, Human
accgacgcgucuccug

SEQ ID NO: 2482606 - RNA, 23 nt, Human
accgaccugguuuuuaaauagag

SEQ ID NO: 2482607 - RNA, 18 nt, Human
accgacguugccaucaaa

SEQ ID NO: 2482608 - RNA, 18 nt, Human
accgacgcgucuccuguu

SEQ ID NO: 2482609 - RNA, 17 nt, Human
accgacgcgucuccugu

SEQ ID NO: 2482610 - RNA, 18 nt, Human
accgagucucuucuccac

SEQ ID NO: 2482611 - RNA, 17 nt, Human
accgagaguagccgaga

SEQ ID NO: 2482612 - RNA, 15 nt, Human
accgagcaaagauca

SEQ ID NO: 2482613 - RNA, 23 nt, Human
accgagaguagccgagagccugc

SEQ ID NO: 2482614 - RNA, 20 nt, Human
ucauauuuacuucuuauaca

SEQ ID NO: 2482615 - RNA, 21 nt, Human
ucauauuuacuucuuauacau

SEQ ID NO: 2482616 - RNA, 22 nt, Human
ucauauuuacuucuuauacauu

SEQ ID NO: 2482617 - RNA, 16 nt, Human
ucauauuuacuucuua

SEQ ID NO: 2482618 - RNA, 12 nt, Human
ucauauugaaua

SEQ ID NO: 2482619 - RNA, 13 nt, Human
ucauguuccaaau

SEQ ID NO: 2482620 - RNA, 14 nt, Human
ucauguuccuucaa

SEQ ID NO: 2482621 - RNA, 13 nt, Human
ucauguuccucaa

SEQ ID NO: 2482622 - RNA, 16 nt, Human
ucauguguguccacga

SEQ ID NO: 2482623 - RNA, 21 nt, Human
ucauguguguccacgacuguc

SEQ ID NO: 2482624 - RNA, 23 nt, Human
ucauguguguccacgacugucuc

SEQ ID NO: 2482625 - RNA, 17 nt, Human
ucauguguuugaacuuc

SEQ ID NO: 2482626 - RNA, 16 nt, Human
ucaugugugcucuucu

SEQ ID NO: 2482627 - RNA, 20 nt, Human
ucaugugugcaacaggguau

SEQ ID NO: 2482628 - RNA, 14 nt, Human
ucaugugugcucuu

SEQ ID NO: 2482629 - RNA, 12 nt, Human
ucaugugugucc

SEQ ID NO: 2482630 - RNA, 14 nt, Human
ucaugugaaaucau

SEQ ID NO: 2482631 - RNA, 13 nt, Human
ucaugucuggcua

SEQ ID NO: 2482632 - RNA, 16 nt, Human
ucauguuuaagaaauu

SEQ ID NO: 2482633 - RNA, 15 nt, Human
ucauguuuuaacaaa

SEQ ID NO: 2482634 - RNA, 14 nt, Human
ucauguuuaagaaa

SEQ ID NO: 2482635 - RNA, 22 nt, Human
ucauguuuuccauuguuugaaa

SEQ ID NO: 2482636 - RNA, 16 nt, Human
ucauguuuuaacaaaa

SEQ ID NO: 2482637 - RNA, 18 nt, Human
ucauguuuuaacaaaaac

SEQ ID NO: 2482638 - RNA, 13 nt, Human
ucauguuggucaa

SEQ ID NO: 2482639 - RNA, 17 nt, Human
ucauguuggccaggcug

SEQ ID NO: 2482640 - RNA, 21 nt, Human
ucauguuccuucaagaucaug

SEQ ID NO: 2482641 - RNA, 22 nt, Human
ucauguugcacacccacucagc

SEQ ID NO: 2482642 - RNA, 11 nt, Human
ucauguucuua

SEQ ID NO: 2482643 - RNA, 17 nt, Human
ucauguucuuaauucuu

SEQ ID NO: 2482644 - RNA, 15 nt, Human
ucauuaaauggggcu

SEQ ID NO: 2482645 - RNA, 19 nt, Human
ucauuaagcccucuuccau

SEQ ID NO: 2482646 - RNA, 18 nt, Human
ucauuaagcccucuucca

SEQ ID NO: 2482647 - RNA, 23 nt, Human
ucauuccuugagaaaaacaauga

SEQ ID NO: 2482648 - RNA, 17 nt, Human
ucauguuuugugacuau

SEQ ID NO: 2482649 - RNA, 16 nt, Human
ucauguuuugugacua

SEQ ID NO: 2482650 - RNA, 15 nt, Human
ucauguuuugugacu

SEQ ID NO: 2482651 - RNA, 14 nt, Human
ucauguuuugugac

SEQ ID NO: 2482652 - RNA, 21 nt, Human
ucauuaaaauaaauaaaugca

SEQ ID NO: 2482653 - RNA, 13 nt, Human
ucauuaaaguucu

SEQ ID NO: 2482654 - RNA, 12 nt, Human
ucauuaaaguuc

SEQ ID NO: 2482655 - RNA, 14 nt, Human
ucauuaaaguucua

SEQ ID NO: 2482656 - RNA, 21 nt, Human
ucauguuuuugaaacagaacc

SEQ ID NO: 2482657 - RNA, 18 nt, Human
ucauuaaaggcuucucuc

SEQ ID NO: 2482658 - RNA, 15 nt, Human
ucauuaaagcauuua

SEQ ID NO: 2482659 - RNA, 21 nt, Human
ucauguccccaaaccugcaag

SEQ ID NO: 2482660 - RNA, 20 nt, Human
ucauguccccaaaccugcaa

SEQ ID NO: 2482661 - RNA, 17 nt, Human
ucauguccccaaaccug

SEQ ID NO: 2482662 - RNA, 19 nt, Human
ucaugucaggccugugugu

SEQ ID NO: 2482663 - RNA, 17 nt, Human
ucaugucaggccugugu

SEQ ID NO: 2482664 - RNA, 16 nt, Human
ucaugucaggccugug

SEQ ID NO: 2482665 - RNA, 14 nt, Human
ucaugucaggccug

SEQ ID NO: 2482666 - RNA, 21 nt, Human
ucaugucaacuucuggcuccu

SEQ ID NO: 2482667 - RNA, 18 nt, Human
ucaugucaacuucuggcu

SEQ ID NO: 2482668 - RNA, 17 nt, Human
ucaugucaacuucuggc

SEQ ID NO: 2482669 - RNA, 22 nt, Human
ucaugcccacccccugcccugc

SEQ ID NO: 2482670 - RNA, 21 nt, Human
ucaugcccacccccugcccug

SEQ ID NO: 2482671 - RNA, 20 nt, Human
ucaugcccacccccugcccu

SEQ ID NO: 2482672 - RNA, 19 nt, Human
ucaugcccacccccugccc

SEQ ID NO: 2482673 - RNA, 18 nt, Human
ucaugcccacccccugcc

SEQ ID NO: 2482674 - RNA, 16 nt, Human
ucaugcccacccccug

SEQ ID NO: 2482675 - RNA, 16 nt, Human
ucaugccaagcauuua

SEQ ID NO: 2482676 - RNA, 19 nt, Human
ucaugccaccauggccagc

SEQ ID NO: 2482677 - RNA, 12 nt, Human
ucaugccagcua

SEQ ID NO: 2482678 - RNA, 22 nt, Human
ucaugccaccauggccagccaa

SEQ ID NO: 2482679 - RNA, 23 nt, Human
ucaugccagcuacuuccuccucc

SEQ ID NO: 2482680 - RNA, 21 nt, Human
ucaugccagcuacuuccuccu

SEQ ID NO: 2482681 - RNA, 15 nt, Human
ucaugcccacccccu

SEQ ID NO: 2482682 - RNA, 21 nt, Human
ucaugccaagcauuuaaugua

SEQ ID NO: 2482683 - RNA, 13 nt, Human
ucaugcccacccc

SEQ ID NO: 2482684 - RNA, 14 nt, Human
ucaugcauggaaau

SEQ ID NO: 2482685 - RNA, 22 nt, Human
ucaugauagaaggcuaugggga

SEQ ID NO: 2482686 - RNA, 15 nt, Human
ucaugcauggaaauu

SEQ ID NO: 2482687 - RNA, 18 nt, Human
ucaugcauguccuguaaa

SEQ ID NO: 2482688 - RNA, 12 nt, Human
ucaugcauuguu

SEQ ID NO: 2482689 - RNA, 18 nt, Human
ucaugagugaauaaaugu

SEQ ID NO: 2482690 - RNA, 16 nt, Human
ucaugagcugagcagg

SEQ ID NO: 2482691 - RNA, 18 nt, Human
ucaugacuuuuccaugua

SEQ ID NO: 2482692 - RNA, 17 nt, Human
ucaugacuuuuccaugu

SEQ ID NO: 2482693 - RNA, 22 nt, Human
ucaugaauuaguuuuauaugcu

SEQ ID NO: 2482694 - RNA, 23 nt, Human
ucauccacugugccaugugccag

SEQ ID NO: 2482695 - RNA, 21 nt, Human
ucauccacugugccaugugcc

SEQ ID NO: 2482696 - RNA, 19 nt, Human
ucauccacugugccaugug

SEQ ID NO: 2482697 - RNA, 20 nt, Human
ucaugaauucuuaugcuuau

SEQ ID NO: 2482698 - RNA, 19 nt, Human
ucaugacaaagacugagua

SEQ ID NO: 2482699 - RNA, 17 nt, Human
ucaugacauguuauaua

SEQ ID NO: 2482700 - RNA, 14 nt, Human
ucaugacauguuau

SEQ ID NO: 2482701 - RNA, 21 nt, Human
ucaugacauguuauauauuuu

SEQ ID NO: 2482702 - RNA, 19 nt, Human
ucaugacauguuauauauu

SEQ ID NO: 2482703 - RNA, 22 nt, Human
ucaugacauuccuaaacuaucu

SEQ ID NO: 2482704 - RNA, 21 nt, Human
ucauugcuuugaagcaguugu

SEQ ID NO: 2482705 - RNA, 13 nt, Human
ucauugcuuacaa

SEQ ID NO: 2482706 - RNA, 17 nt, Human
ucauugauaugaaaaau

SEQ ID NO: 2482707 - RNA, 18 nt, Human
ucauugauaugaaaaaua

SEQ ID NO: 2482708 - RNA, 19 nt, Human
ucauugagaguuuugucuu

SEQ ID NO: 2482709 - RNA, 13 nt, Human
ucauugauaugaa

SEQ ID NO: 2482710 - RNA, 15 nt, Human
ucauugauaugaaaa

SEQ ID NO: 2482711 - RNA, 16 nt, Human
ucauugauaugaaaaa

SEQ ID NO: 2482712 - RNA, 22 nt, Human
ucauugaccugaggcccuucuc

SEQ ID NO: 2482713 - RNA, 18 nt, Human
ucauugagaguuuugucu

SEQ ID NO: 2482714 - RNA, 14 nt, Human
ucauugagaguuuu

SEQ ID NO: 2482715 - RNA, 20 nt, Human
ucauugacuaucaaacugaa

SEQ ID NO: 2482716 - RNA, 21 nt, Human
ucauugacuaucaaacugaag

SEQ ID NO: 2482717 - RNA, 21 nt, Human
ucauucuccuuguguuacuaa

SEQ ID NO: 2482718 - RNA, 16 nt, Human
ucauucuccugccugu

SEQ ID NO: 2482719 - RNA, 15 nt, Human
ucauucuccugccug

SEQ ID NO: 2482720 - RNA, 14 nt, Human
ucauucuccugccu

SEQ ID NO: 2482721 - RNA, 13 nt, Human
ucauucuccugcc

SEQ ID NO: 2482722 - RNA, 19 nt, Human
ucauugaccugaggcccuu

SEQ ID NO: 2482723 - RNA, 22 nt, Human
ucauuaagcccucuuccaucau

SEQ ID NO: 2482724 - RNA, 15 nt, Human
ucauucguucugugg

SEQ ID NO: 2482725 - RNA, 12 nt, Human
ucauucuccugc

SEQ ID NO: 2482726 - RNA, 20 nt, Human
accuccuuucucuucucugu

SEQ ID NO: 2482727 - RNA, 18 nt, Human
accuccuuucucuucucu

SEQ ID NO: 2482728 - RNA, 14 nt, Human
accucgcuggacuc

SEQ ID NO: 2482729 - RNA, 16 nt, Human
accucgcuggacucuc

SEQ ID NO: 2482730 - RNA, 18 nt, Human
accucgcuggacucucag

SEQ ID NO: 2482731 - RNA, 17 nt, Human
accucggugccuuccuc

SEQ ID NO: 2482732 - RNA, 17 nt, Human
ucauuggcuuuauccuc

SEQ ID NO: 2482733 - RNA, 16 nt, Human
ucauuggcuuuauccu

SEQ ID NO: 2482734 - RNA, 14 nt, Human
ucauuggcuuuauc

SEQ ID NO: 2482735 - RNA, 11 nt, Human
ucauuggcuuu

SEQ ID NO: 2482736 - RNA, 23 nt, Human
ucauugcuuugaagcaguugugu

SEQ ID NO: 2482737 - RNA, 21 nt, Human
ucauuggauucugagagcugu

SEQ ID NO: 2482738 - RNA, 13 nt, Human
ucauuguaaucac

SEQ ID NO: 2482739 - RNA, 17 nt, Human
accuccuuucucuucuc

SEQ ID NO: 2482740 - RNA, 16 nt, Human
accuccuuucucuucu

SEQ ID NO: 2482741 - RNA, 16 nt, Human
ucauuguaauguuacu

SEQ ID NO: 2482742 - RNA, 12 nt, Human
accucugcacaa

SEQ ID NO: 2482743 - RNA, 22 nt, Human
accugaagcuaucguaaaauua

SEQ ID NO: 2482744 - RNA, 15 nt, Human
accucugauaccuca

SEQ ID NO: 2482745 - RNA, 13 nt, Human
accucugauaccu

SEQ ID NO: 2482746 - RNA, 23 nt, Human
accucucuuauagaauauuuauu

SEQ ID NO: 2482747 - RNA, 22 nt, Human
accucucuuauagaauauuuau

SEQ ID NO: 2482748 - RNA, 20 nt, Human
accucugaaacccuggacca

SEQ ID NO: 2482749 - RNA, 14 nt, Human
accucucuuuuuca

SEQ ID NO: 2482750 - RNA, 20 nt, Human
accucugaaaacggcccucu

SEQ ID NO: 2482751 - RNA, 14 nt, Human
accucucucacucc

SEQ ID NO: 2482752 - RNA, 23 nt, Human
accucucccuuggauuguccccg

SEQ ID NO: 2482753 - RNA, 19 nt, Human
accucucucacuccuugaa

SEQ ID NO: 2482754 - RNA, 23 nt, Human
accucucuccuuugcugaggccu

SEQ ID NO: 2482755 - RNA, 15 nt, Human
accucucccucaaca

SEQ ID NO: 2482756 - RNA, 20 nt, Human
accucuccuuuggccauucc

SEQ ID NO: 2482757 - RNA, 14 nt, Human
accucuccucaugu

SEQ ID NO: 2482758 - RNA, 23 nt, Human
accucuacuaaaaagaaggaaaa

SEQ ID NO: 2482759 - RNA, 22 nt, Human
accucuacuaaaaagaaggaaa

SEQ ID NO: 2482760 - RNA, 12 nt, Human
accucucccuca

SEQ ID NO: 2482761 - RNA, 21 nt, Human
accucuccccuggaacugucu

SEQ ID NO: 2482762 - RNA, 18 nt, Human
accucuaauuuauuuugu

SEQ ID NO: 2482763 - RNA, 15 nt, Human
accucucccuuggau

SEQ ID NO: 2482764 - RNA, 14 nt, Human
accucucccuugga

SEQ ID NO: 2482765 - RNA, 13 nt, Human
accucucccuugg

SEQ ID NO: 2482766 - RNA, 23 nt, Human
accucucccugacccuguauaua

SEQ ID NO: 2482767 - RNA, 22 nt, Human
accucucccugacccuguauau

SEQ ID NO: 2482768 - RNA, 17 nt, Human
accucucccugacccug

SEQ ID NO: 2482769 - RNA, 14 nt, Human
accucucccugacc

SEQ ID NO: 2482770 - RNA, 14 nt, Human
accagcgcccgcug

SEQ ID NO: 2482771 - RNA, 13 nt, Human
accagcgcccgcu

SEQ ID NO: 2482772 - RNA, 14 nt, Human
accagcgaagggag

SEQ ID NO: 2482773 - RNA, 23 nt, Human
accagcgaggaggcuccagaggg

SEQ ID NO: 2482774 - RNA, 19 nt, Human
accagccuuucucccaggc

SEQ ID NO: 2482775 - RNA, 22 nt, Human
accagccuuucucccaggccag

SEQ ID NO: 2482776 - RNA, 17 nt, Human
accaggacucccuccuc

SEQ ID NO: 2482777 - RNA, 18 nt, Human
accaggacucccuccuca

SEQ ID NO: 2482778 - RNA, 21 nt, Human
accaggacucccuccucaccu

SEQ ID NO: 2482779 - RNA, 14 nt, Human
accaggagaaccac

SEQ ID NO: 2482780 - RNA, 18 nt, Human
accaggagaaccacuaca

SEQ ID NO: 2482781 - RNA, 19 nt, Human
accaggagaaccacuacau

SEQ ID NO: 2482782 - RNA, 20 nt, Human
accaggagaaccacuacaug

SEQ ID NO: 2482783 - RNA, 14 nt, Human
accaggagcugcuc

SEQ ID NO: 2482784 - RNA, 18 nt, Human
accaggagggcacuggag

SEQ ID NO: 2482785 - RNA, 16 nt, Human
accaggagcugcucac

SEQ ID NO: 2482786 - RNA, 15 nt, Human
accaggagcugcuca

SEQ ID NO: 2482787 - RNA, 16 nt, Human
accaggacucccuccu

SEQ ID NO: 2482788 - RNA, 17 nt, Human
accaggagucccuggua

SEQ ID NO: 2482789 - RNA, 22 nt, Human
accaggagucccugguaauaag

SEQ ID NO: 2482790 - RNA, 20 nt, Human
accaggcacgaacccaccug

SEQ ID NO: 2482791 - RNA, 21 nt, Human
accaggcacgaacccaccugc

SEQ ID NO: 2482792 - RNA, 12 nt, Human
accaggccaccu

SEQ ID NO: 2482793 - RNA, 22 nt, Human
accaggcacgaacccaccugcu

SEQ ID NO: 2482794 - RNA, 23 nt, Human
accaggcacgaacccaccugcug

SEQ ID NO: 2482795 - RNA, 14 nt, Human
accaggauggcccu

SEQ ID NO: 2482796 - RNA, 19 nt, Human
accaggcaacuugggaacu

SEQ ID NO: 2482797 - RNA, 23 nt, Human
ucaccugaagacucauucuucug

SEQ ID NO: 2482798 - RNA, 22 nt, Human
ucaccugagcaggaccucugaa

SEQ ID NO: 2482799 - RNA, 21 nt, Human
ucaccugagcccggaugcuuc

SEQ ID NO: 2482800 - RNA, 22 nt, Human
ucaccugagcccggaugcuucu

SEQ ID NO: 2482801 - RNA, 23 nt, Human
ucaccugagcccggaugcuucuc

SEQ ID NO: 2482802 - RNA, 19 nt, Human
ucaccugaagacucauucu

SEQ ID NO: 2482803 - RNA, 13 nt, Human
ucaccucccccau

SEQ ID NO: 2482804 - RNA, 15 nt, Human
ucaccucccccaucu

SEQ ID NO: 2482805 - RNA, 17 nt, Human
accaggccaccucccca

SEQ ID NO: 2482806 - RNA, 14 nt, Human
accaggccaccucc

SEQ ID NO: 2482807 - RNA, 19 nt, Human
accaggccgccccagccuc

SEQ ID NO: 2482808 - RNA, 22 nt, Human
ucaccuccucuaagguugggca

SEQ ID NO: 2482809 - RNA, 12 nt, Human
ucaccuccucua

SEQ ID NO: 2482810 - RNA, 16 nt, Human
accaggccgccccagc

SEQ ID NO: 2482811 - RNA, 13 nt, Human
ucaccuccccucc

SEQ ID NO: 2482812 - RNA, 14 nt, Human
ucaccuccccuccu

SEQ ID NO: 2482813 - RNA, 15 nt, Human
ucaccuccccuccuu

SEQ ID NO: 2482814 - RNA, 23 nt, Human
ucaccuccggucgugucucuggu

SEQ ID NO: 2482815 - RNA, 21 nt, Human
ucaccuccggucgugucucug

SEQ ID NO: 2482816 - RNA, 17 nt, Human
ucaccuccccuccuugc

SEQ ID NO: 2482817 - RNA, 23 nt, Human
accacuuguguuuugcaagccag

SEQ ID NO: 2482818 - RNA, 19 nt, Human
accacuuguguuuugcaag

SEQ ID NO: 2482819 - RNA, 12 nt, Human
accacuuuuguu

SEQ ID NO: 2482820 - RNA, 17 nt, Human
accagacaccuugacag

SEQ ID NO: 2482821 - RNA, 18 nt, Human
accagagaccguccucac

SEQ ID NO: 2482822 - RNA, 16 nt, Human
accagagaccguccuc

SEQ ID NO: 2482823 - RNA, 23 nt, Human
accagacaccuugacagggcaca

SEQ ID NO: 2482824 - RNA, 22 nt, Human
accagacaccuugacagggcac

SEQ ID NO: 2482825 - RNA, 22 nt, Human
accagagcccaccuuggcucaa

SEQ ID NO: 2482826 - RNA, 19 nt, Human
accagagcccaccuuggcu

SEQ ID NO: 2482827 - RNA, 12 nt, Human
accagagcagau

SEQ ID NO: 2482828 - RNA, 15 nt, Human
accagagcagaugca

SEQ ID NO: 2482829 - RNA, 20 nt, Human
accagagauaauaugagaau

SEQ ID NO: 2482830 - RNA, 20 nt, Human
accagagcauuuccaacacc

SEQ ID NO: 2482831 - RNA, 22 nt, Human
accagagcagaugcagagagcc

SEQ ID NO: 2482832 - RNA, 17 nt, Human
accagagcagaugcaga

SEQ ID NO: 2482833 - RNA, 16 nt, Human
accagagcagaugcag

SEQ ID NO: 2482834 - RNA, 13 nt, Human
accagagccaugg

SEQ ID NO: 2482835 - RNA, 14 nt, Human
accagagccaugga

SEQ ID NO: 2482836 - RNA, 17 nt, Human
accagagccauggacuc

SEQ ID NO: 2482837 - RNA, 23 nt, Human
accagagccauggacucuacacu

SEQ ID NO: 2482838 - RNA, 14 nt, Human
accagagccccaca

SEQ ID NO: 2482839 - RNA, 17 nt, Human
accagagccccacacgg

SEQ ID NO: 2482840 - RNA, 17 nt, Human
accagagcccaccuugg

SEQ ID NO: 2482841 - RNA, 20 nt, Human
accagagccccacacggagg

SEQ ID NO: 2482842 - RNA, 23 nt, Human
accagccucucuugguuuccuuc

SEQ ID NO: 2482843 - RNA, 11 nt, Human
accagccuggc

SEQ ID NO: 2482844 - RNA, 12 nt, Human
accagccuggcc

SEQ ID NO: 2482845 - RNA, 20 nt, Human
accagccuggucaacauggu

SEQ ID NO: 2482846 - RNA, 14 nt, Human
accagccugggcag

SEQ ID NO: 2482847 - RNA, 23 nt, Human
accagccuguuggacccgcucug

SEQ ID NO: 2482848 - RNA, 14 nt, Human
accagccuguugga

SEQ ID NO: 2482849 - RNA, 16 nt, Human
accagccuuucuccca

SEQ ID NO: 2482850 - RNA, 17 nt, Human
accagccuuucucccag

SEQ ID NO: 2482851 - RNA, 20 nt, Human
accagccugaccaacauggu

SEQ ID NO: 2482852 - RNA, 13 nt, Human
accagccugggca

SEQ ID NO: 2482853 - RNA, 15 nt, Human
accagccuggccaac

SEQ ID NO: 2482854 - RNA, 20 nt, Human
accagccuggccaacauggu

SEQ ID NO: 2482855 - RNA, 15 nt, Human
accacuucagcugac

SEQ ID NO: 2482856 - RNA, 18 nt, Human
accacuuaaaaaaugucc

SEQ ID NO: 2482857 - RNA, 13 nt, Human
accacuucagcug

SEQ ID NO: 2482858 - RNA, 14 nt, Human
accacuucagcuga

SEQ ID NO: 2482859 - RNA, 14 nt, Human
accacugcagaaga

SEQ ID NO: 2482860 - RNA, 19 nt, Human
accacugcagaagacagua

SEQ ID NO: 2482861 - RNA, 13 nt, Human
accacugcagaag

SEQ ID NO: 2482862 - RNA, 24 nt, Human
accacaucuugcucugcugacaga

SEQ ID NO: 2482863 - RNA, 21 nt, Human
accacaucuugcucugcugac

SEQ ID NO: 2482864 - RNA, 20 nt, Human
accacaucuugcucugcuga

SEQ ID NO: 2482865 - RNA, 16 nt, Human
accacaucuugcucug

SEQ ID NO: 2482866 - RNA, 21 nt, Human
accacauccuccguccagccg

SEQ ID NO: 2482867 - RNA, 22 nt, Human
accacauccuccguccagccgc

SEQ ID NO: 2482868 - RNA, 20 nt, Human
accacucuaucaaguauuau

SEQ ID NO: 2482869 - RNA, 23 nt, Human
accacauccacacacgcaggaac

SEQ ID NO: 2482870 - RNA, 16 nt, Human
accacaucuaagccug

SEQ ID NO: 2482871 - RNA, 17 nt, Human
accacaucuuuaucugu

SEQ ID NO: 2482872 - RNA, 20 nt, Human
accacaucuaagccugaagg

SEQ ID NO: 2482873 - RNA, 20 nt, Human
accacucaaauuaaucuuuc

SEQ ID NO: 2482874 - RNA, 21 nt, Human
accacagcaaggcaccugcag

SEQ ID NO: 2482875 - RNA, 19 nt, Human
accacagcaaggcaccugc

SEQ ID NO: 2482876 - RNA, 15 nt, Human
accacagcacagcca

SEQ ID NO: 2482877 - RNA, 21 nt, Human
accacagcagcugaacagcca

SEQ ID NO: 2482878 - RNA, 16 nt, Human
accacagcagcugaac

SEQ ID NO: 2482879 - RNA, 16 nt, Human
accacagcacagccaa

SEQ ID NO: 2482880 - RNA, 18 nt, Human
accacagacacacacacg

SEQ ID NO: 2482881 - RNA, 16 nt, Human
accacagacacacaca

SEQ ID NO: 2482882 - RNA, 20 nt, Human
accacagacacacacacgca

SEQ ID NO: 2482883 - RNA, 10 nt, Human
accacagcaa

SEQ ID NO: 2482884 - RNA, 18 nt, Human
accacagcaaggcaccug

SEQ ID NO: 2482885 - RNA, 21 nt, Human
accacagacauacuaaccagc

SEQ ID NO: 2482886 - RNA, 22 nt, Human
accacagacauacuaaccagca

SEQ ID NO: 2482887 - RNA, 11 nt, Human
accacagcagu

SEQ ID NO: 2482888 - RNA, 11 nt, Human
accacaguguc

SEQ ID NO: 2482889 - RNA, 16 nt, Human
accacagccagcaccu

SEQ ID NO: 2482890 - RNA, 16 nt, Human
accacagcaucauuuu

SEQ ID NO: 2482891 - RNA, 19 nt, Human
accacagcaggugucauau

SEQ ID NO: 2482892 - RNA, 19 nt, Human
accacauagcaugaggcca

SEQ ID NO: 2482893 - RNA, 12 nt, Human
accacagugucu

SEQ ID NO: 2482894 - RNA, 13 nt, Human
accacagugucug

SEQ ID NO: 2482895 - RNA, 14 nt, Human
accacauccuccgu

SEQ ID NO: 2482896 - RNA, 20 nt, Human
accacauccuccguccagcc

SEQ ID NO: 2482897 - RNA, 14 nt, Human
accacaucuugcuc

SEQ ID NO: 2482898 - RNA, 12 nt, Human
uauuucauuucu

SEQ ID NO: 2482899 - RNA, 21 nt, Human
uauuucaugcugggaaugaga

SEQ ID NO: 2482900 - RNA, 15 nt, Human
accacagacacacac

SEQ ID NO: 2482901 - RNA, 14 nt, Human
accacagacacaca

SEQ ID NO: 2482902 - RNA, 13 nt, Human
accacagacacac

SEQ ID NO: 2482903 - RNA, 12 nt, Human
accacagacaca

SEQ ID NO: 2482904 - RNA, 21 nt, Human
accacacuuccuguccagaga

SEQ ID NO: 2482905 - RNA, 22 nt, Human
accacacuuccuguccagagag

SEQ ID NO: 2482906 - RNA, 13 nt, Human
accacacuuccug

SEQ ID NO: 2482907 - RNA, 16 nt, Human
accacacuuccugucc

SEQ ID NO: 2482908 - RNA, 17 nt, Human
accacacuuccugucca

SEQ ID NO: 2482909 - RNA, 22 nt, Human
accacacuggacuccggcccuc

SEQ ID NO: 2482910 - RNA, 21 nt, Human
accacacuggacuccggcccu

SEQ ID NO: 2482911 - RNA, 17 nt, Human
uauuucaugaaaauugu

SEQ ID NO: 2482912 - RNA, 20 nt, Human
uauuucaucauauuauacag

SEQ ID NO: 2482913 - RNA, 21 nt, Human
uauuucaucauauuauacaga

SEQ ID NO: 2482914 - RNA, 20 nt, Human
uauuucauaaacaacuuaau

SEQ ID NO: 2482915 - RNA, 17 nt, Human
ucaccugcuggccccuc

SEQ ID NO: 2482916 - RNA, 19 nt, Human
ucaccugcuggccccucac

SEQ ID NO: 2482917 - RNA, 20 nt, Human
ucaccugcuggccccucacc

SEQ ID NO: 2482918 - RNA, 21 nt, Human
ucaccugcuggccccucaccu

SEQ ID NO: 2482919 - RNA, 16 nt, Human
ucaccugccccucaac

SEQ ID NO: 2482920 - RNA, 15 nt, Human
ucaccugaggucggg

SEQ ID NO: 2482921 - RNA, 11 nt, Human
ucaccugcugg

SEQ ID NO: 2482922 - RNA, 15 nt, Human
ucaccugcuggcccc

SEQ ID NO: 2482923 - RNA, 16 nt, Human
ucaccugcuggccccu

SEQ ID NO: 2482924 - RNA, 15 nt, Human
ucacugagacagccc

SEQ ID NO: 2482925 - RNA, 14 nt, Human
ucacugagacagcc

SEQ ID NO: 2482926 - RNA, 13 nt, Human
ucacugagacagc

SEQ ID NO: 2482927 - RNA, 17 nt, Human
ucaccugggcaccuggg

SEQ ID NO: 2482928 - RNA, 22 nt, Human
ucacugaaugccucaaugugac

SEQ ID NO: 2482929 - RNA, 23 nt, Human
ucacugaaugcuucugacuucau

SEQ ID NO: 2482930 - RNA, 24 nt, Human
ucacugcacagugcaucucagccc

SEQ ID NO: 2482931 - RNA, 22 nt, Human
ucacugcacagugcaucucagc

SEQ ID NO: 2482932 - RNA, 20 nt, Human
ucacugcacagugcaucuca

SEQ ID NO: 2482933 - RNA, 19 nt, Human
ucacugacacaaaaaguag

SEQ ID NO: 2482934 - RNA, 12 nt, Human
ucacugcagccu

SEQ ID NO: 2482935 - RNA, 21 nt, Human
ucacuguagaaugauuucaug

SEQ ID NO: 2482936 - RNA, 15 nt, Human
ucacugcacagugca

SEQ ID NO: 2482937 - RNA, 24 nt, Human
ucacuguauaaauaggagaggaug

SEQ ID NO: 2482938 - RNA, 23 nt, Human
ucacuguauaaauaggagaggau

SEQ ID NO: 2482939 - RNA, 19 nt, Human
ucacuguauaaauaggaga

SEQ ID NO: 2482940 - RNA, 17 nt, Human
ucacuguauaaauagga

SEQ ID NO: 2482941 - RNA, 16 nt, Human
ucacuguauaaauagg

SEQ ID NO: 2482942 - RNA, 15 nt, Human
ucacuguauaaauag

SEQ ID NO: 2482943 - RNA, 14 nt, Human
ucacuguauaaaua

SEQ ID NO: 2482944 - RNA, 14 nt, Human
ucaccugggcaccu

SEQ ID NO: 2482945 - RNA, 18 nt, Human
ucacugucccucaaauga

SEQ ID NO: 2482946 - RNA, 18 nt, Human
ucacugucaggaagaaau

SEQ ID NO: 2482947 - RNA, 15 nt, Human
ucacuguccuccaag

SEQ ID NO: 2482948 - RNA, 16 nt, Human
ucacuguccuccaagc

SEQ ID NO: 2482949 - RNA, 16 nt, Human
ucacuguugcccaggc

SEQ ID NO: 2482950 - RNA, 12 nt, Human
ucacugucuuuc

SEQ ID NO: 2482951 - RNA, 20 nt, Human
ucacugucugagaguuuagu

SEQ ID NO: 2482952 - RNA, 15 nt, Human
ucacugucugagagu

SEQ ID NO: 2482953 - RNA, 20 nt, Human
ucacugucaggaagaaauca

SEQ ID NO: 2482954 - RNA, 19 nt, Human
ucacuguccuccaagccag

SEQ ID NO: 2482955 - RNA, 24 nt, Human
accaugaagagauuuuucaugauu

SEQ ID NO: 2482956 - RNA, 20 nt, Human
accaugaagagauuuuucau

SEQ ID NO: 2482957 - RNA, 15 nt, Human
accaguucugggcaa

SEQ ID NO: 2482958 - RNA, 21 nt, Human
accaguugcacuuggccucug

SEQ ID NO: 2482959 - RNA, 21 nt, Human
accaguguagccuugcccgga

SEQ ID NO: 2482960 - RNA, 17 nt, Human
accaguuaugugaauga

SEQ ID NO: 2482961 - RNA, 22 nt, Human
accagugcccaaagucugugug

SEQ ID NO: 2482962 - RNA, 23 nt, Human
accagugcccaaagucuguguga

SEQ ID NO: 2482963 - RNA, 18 nt, Human
accagugcaacagcacug

SEQ ID NO: 2482964 - RNA, 18 nt, Human
accagugcgauucuggau

SEQ ID NO: 2482965 - RNA, 21 nt, Human
accaguguuguggauuuaaca

SEQ ID NO: 2482966 - RNA, 12 nt, Human
accaguggucuc

SEQ ID NO: 2482967 - RNA, 17 nt, Human
accaguggucucacaug

SEQ ID NO: 2482968 - RNA, 13 nt, Human
accaguguagccu

SEQ ID NO: 2482969 - RNA, 16 nt, Human
accaguguagccuugc

SEQ ID NO: 2482970 - RNA, 17 nt, Human
accagugcaacagcacu

SEQ ID NO: 2482971 - RNA, 20 nt, Human
accaggggcaggcacagcac

SEQ ID NO: 2482972 - RNA, 19 nt, Human
accaggggcaggcacagca

SEQ ID NO: 2482973 - RNA, 18 nt, Human
accaggggcaggcacagc

SEQ ID NO: 2482974 - RNA, 12 nt, Human
accagugacuuu

SEQ ID NO: 2482975 - RNA, 17 nt, Human
accaggggcaggcacag

SEQ ID NO: 2482976 - RNA, 16 nt, Human
accaggggcaggcaca

SEQ ID NO: 2482977 - RNA, 15 nt, Human
accaggggcaggcac

SEQ ID NO: 2482978 - RNA, 22 nt, Human
accagggcgaacgacaauagcu

SEQ ID NO: 2482979 - RNA, 23 nt, Human
accagggcgaacgacaauagcuu

SEQ ID NO: 2482980 - RNA, 19 nt, Human
accagggccugagccaagc

SEQ ID NO: 2482981 - RNA, 15 nt, Human
accagggcagggcca

SEQ ID NO: 2482982 - RNA, 14 nt, Human
accagggcagggcc

SEQ ID NO: 2482983 - RNA, 18 nt, Human
ucacuguugcccaggcug

SEQ ID NO: 2482984 - RNA, 17 nt, Human
ucacuguugcccaggcu

SEQ ID NO: 2482985 - RNA, 19 nt, Human
ucacuguugcccaggcugg

SEQ ID NO: 2482986 - RNA, 14 nt, Human
ucacugucuuuccu

SEQ ID NO: 2482987 - RNA, 20 nt, Human
accagggagccccuuugaug

SEQ ID NO: 2482988 - RNA, 21 nt, Human
accagggagaccgagcgcuuu

SEQ ID NO: 2482989 - RNA, 12 nt, Human
accauuccccau

SEQ ID NO: 2482990 - RNA, 15 nt, Human
accauuccccauggg

SEQ ID NO: 2482991 - RNA, 23 nt, Human
accaugauuaaccacuucagcug

SEQ ID NO: 2482992 - RNA, 22 nt, Human
accaugauuaaccacuucagcu

SEQ ID NO: 2482993 - RNA, 18 nt, Human
accaugagcaauucuccu

SEQ ID NO: 2482994 - RNA, 23 nt, Human
accaugagaauaagagaaagaaa

SEQ ID NO: 2482995 - RNA, 21 nt, Human
accaugagaagagggccugug

SEQ ID NO: 2482996 - RNA, 20 nt, Human
accaugagaagagggccugu

SEQ ID NO: 2482997 - RNA, 18 nt, Human
accaugagaagagggccu

SEQ ID NO: 2482998 - RNA, 16 nt, Human
accauucuccaccugc

SEQ ID NO: 2482999 - RNA, 13 nt, Human
accauucuccacc

SEQ ID NO: 2483000 - RNA, 18 nt, Human
accauucuccaccugcca

SEQ ID NO: 2483001 - RNA, 17 nt, Human
accauugucuuguucug

SEQ ID NO: 2483002 - RNA, 22 nt, Human
accaugaguggcauggccacca

SEQ ID NO: 2483003 - RNA, 19 nt, Human
accaugaguggcauggcca

SEQ ID NO: 2483004 - RNA, 21 nt, Human
accauugucuuguucugugau

SEQ ID NO: 2483005 - RNA, 13 nt, Human
acccaaaaggcag

SEQ ID NO: 2483006 - RNA, 15 nt, Human
acccaaaaggcagaa

SEQ ID NO: 2483007 - RNA, 22 nt, Human
accauuuuuuaaggaaacaaua

SEQ ID NO: 2483008 - RNA, 20 nt, Human
accauuuuuuaaggaaacaa

SEQ ID NO: 2483009 - RNA, 23 nt, Human
accauuuugggguacccacugcu

SEQ ID NO: 2483010 - RNA, 20 nt, Human
accauuucagagaggccuuu

SEQ ID NO: 2483011 - RNA, 22 nt, Human
accauuuugggguacccacugc

SEQ ID NO: 2483012 - RNA, 11 nt, Human
accauuucaga

SEQ ID NO: 2483013 - RNA, 14 nt, Human
accauuucagagag

SEQ ID NO: 2483014 - RNA, 23 nt, Human
accauuuauacaaauuagaaaau

SEQ ID NO: 2483015 - RNA, 16 nt, Human
accauuuauacaaauu

SEQ ID NO: 2483016 - RNA, 19 nt, Human
accauuuauacaaauuaga

SEQ ID NO: 2483017 - RNA, 21 nt, Human
accauuuauacaaauuagaaa

SEQ ID NO: 2483018 - RNA, 22 nt, Human
accauuuauacaaauuagaaaa

SEQ ID NO: 2483019 - RNA, 13 nt, Human
accauuuauacaa

SEQ ID NO: 2483020 - RNA, 15 nt, Human
ucagaacccuuggcu

SEQ ID NO: 2483021 - RNA, 16 nt, Human
ucagaacccuuggcuu

SEQ ID NO: 2483022 - RNA, 22 nt, Human
ucagaaccauccauaguaguau

SEQ ID NO: 2483023 - RNA, 16 nt, Human
ucagaacagagccuuu

SEQ ID NO: 2483024 - RNA, 11 nt, Human
acccagcccau

SEQ ID NO: 2483025 - RNA, 18 nt, Human
acccagcccacuucugcc

SEQ ID NO: 2483026 - RNA, 21 nt, Human
acccagacagcucccucugcc

SEQ ID NO: 2483027 - RNA, 22 nt, Human
acccagacagcucccucugccu

SEQ ID NO: 2483028 - RNA, 15 nt, Human
acccagacagcuccc

SEQ ID NO: 2483029 - RNA, 17 nt, Human
acccagcccacuucugc

SEQ ID NO: 2483030 - RNA, 16 nt, Human
acccagcccacuucug

SEQ ID NO: 2483031 - RNA, 18 nt, Human
acccaaaaggcagaagca

SEQ ID NO: 2483032 - RNA, 21 nt, Human
acccaaaagcucagccagccc

SEQ ID NO: 2483033 - RNA, 23 nt, Human
acccaaaagucaaaaggugccug

SEQ ID NO: 2483034 - RNA, 21 nt, Human
acccaaauguucaucaaugaa

SEQ ID NO: 2483035 - RNA, 22 nt, Human
acccaaaagcucagccagcccc

SEQ ID NO: 2483036 - RNA, 12 nt, Human
acccaaccacuc

SEQ ID NO: 2483037 - RNA, 16 nt, Human
acccagaagaaaauag

SEQ ID NO: 2483038 - RNA, 19 nt, Human
acccacuugcuuuuaaaau

SEQ ID NO: 2483039 - RNA, 16 nt, Human
acccaacucuccugga

SEQ ID NO: 2483040 - RNA, 15 nt, Human
acccaacucuccugg

SEQ ID NO: 2483041 - RNA, 13 nt, Human
acccaacucuccu

SEQ ID NO: 2483042 - RNA, 19 nt, Human
acccaacuagcucuauguu

SEQ ID NO: 2483043 - RNA, 15 nt, Human
acccaagcaaggcca

SEQ ID NO: 2483044 - RNA, 15 nt, Human
accccuggcuuuuca

SEQ ID NO: 2483045 - RNA, 14 nt, Human
accccuuagccucc

SEQ ID NO: 2483046 - RNA, 15 nt, Human
accccuuagccuccc

SEQ ID NO: 2483047 - RNA, 15 nt, Human
accccuuccaugugg

SEQ ID NO: 2483048 - RNA, 18 nt, Human
accccuuauccaggacuc

SEQ ID NO: 2483049 - RNA, 17 nt, Human
accccuuauccaggacu

SEQ ID NO: 2483050 - RNA, 16 nt, Human
accccuuagccucccu

SEQ ID NO: 2483051 - RNA, 17 nt, Human
accccuuagccucccug

SEQ ID NO: 2483052 - RNA, 16 nt, Human
accccuuauccaggac

SEQ ID NO: 2483053 - RNA, 15 nt, Human
accccuuauccagga

SEQ ID NO: 2483054 - RNA, 18 nt, Human
accccuuagccucccuga

SEQ ID NO: 2483055 - RNA, 19 nt, Human
ucagccuggcuucaaauug

SEQ ID NO: 2483056 - RNA, 19 nt, Human
accccuuccauguggagaa

SEQ ID NO: 2483057 - RNA, 18 nt, Human
accccuuccauguggaga

SEQ ID NO: 2483058 - RNA, 14 nt, Human
accccuuccccacu

SEQ ID NO: 2483059 - RNA, 15 nt, Human
accccuuccccacug

SEQ ID NO: 2483060 - RNA, 16 nt, Human
accccuuccccacugc

SEQ ID NO: 2483061 - RNA, 18 nt, Human
accccuuccccacugccu

SEQ ID NO: 2483062 - RNA, 20 nt, Human
accccuuccccacugccugc

SEQ ID NO: 2483063 - RNA, 10 nt, Human
ucagccuggg

SEQ ID NO: 2483064 - RNA, 12 nt, Human
ucagccugggca

SEQ ID NO: 2483065 - RNA, 14 nt, Human
accccuggccuccg

SEQ ID NO: 2483066 - RNA, 13 nt, Human
accccuggccucc

SEQ ID NO: 2483067 - RNA, 12 nt, Human
accccuggccuc

SEQ ID NO: 2483068 - RNA, 17 nt, Human
accccuccuuccuugac

SEQ ID NO: 2483069 - RNA, 23 nt, Human
accccuccucccuuuuuccuugu

SEQ ID NO: 2483070 - RNA, 18 nt, Human
accccuccucccuuuuuc

SEQ ID NO: 2483071 - RNA, 15 nt, Human
accccuccucccuuu

SEQ ID NO: 2483072 - RNA, 12 nt, Human
accccuccuucc

SEQ ID NO: 2483073 - RNA, 16 nt, Human
accccuccuuccuuga

SEQ ID NO: 2483074 - RNA, 19 nt, Human
accccuggcuccaggccag

SEQ ID NO: 2483075 - RNA, 20 nt, Human
accccuggcuccaggccagg

SEQ ID NO: 2483076 - RNA, 22 nt, Human
accccuggcuccaggccagggg

SEQ ID NO: 2483077 - RNA, 12 nt, Human
accccuggcuuu

SEQ ID NO: 2483078 - RNA, 23 nt, Human
accccuccucacuggccaucccu

SEQ ID NO: 2483079 - RNA, 21 nt, Human
accccuccucacuggccaucc

SEQ ID NO: 2483080 - RNA, 19 nt, Human
accccuccucacuggccau

SEQ ID NO: 2483081 - RNA, 18 nt, Human
accccuccucacuggcca

SEQ ID NO: 2483082 - RNA, 17 nt, Human
accccuccucacuggcc

SEQ ID NO: 2483083 - RNA, 16 nt, Human
accccuccucacuggc

SEQ ID NO: 2483084 - RNA, 14 nt, Human
accccuccucacug

SEQ ID NO: 2483085 - RNA, 13 nt, Human
accccuccucacu

SEQ ID NO: 2483086 - RNA, 23 nt, Human
accccucccuuucuccccugccc

SEQ ID NO: 2483087 - RNA, 19 nt, Human
accccucccuuucuccccu

SEQ ID NO: 2483088 - RNA, 18 nt, Human
accccucccuuucucccc

SEQ ID NO: 2483089 - RNA, 16 nt, Human
accccucccuuucucc

SEQ ID NO: 2483090 - RNA, 15 nt, Human
acccccuccccgccc

SEQ ID NO: 2483091 - RNA, 13 nt, Human
acccccuccccag

SEQ ID NO: 2483092 - RNA, 14 nt, Human
acccccuccccagg

SEQ ID NO: 2483093 - RNA, 19 nt, Human
acccccucaagccaauccc

SEQ ID NO: 2483094 - RNA, 12 nt, Human
acccccucccca

SEQ ID NO: 2483095 - RNA, 14 nt, Human
accccucccuuucu

SEQ ID NO: 2483096 - RNA, 13 nt, Human
accccucccuuuc

SEQ ID NO: 2483097 - RNA, 16 nt, Human
acccccuccccagggg

SEQ ID NO: 2483098 - RNA, 14 nt, Human
acccccucccuggc

SEQ ID NO: 2483099 - RNA, 15 nt, Human
acccccucccuggcc

SEQ ID NO: 2483100 - RNA, 21 nt, Human
acccccagcucaauggacugg

SEQ ID NO: 2483101 - RNA, 20 nt, Human
acccccagcucaauggacug

SEQ ID NO: 2483102 - RNA, 13 nt, Human
acccccagcucaa

SEQ ID NO: 2483103 - RNA, 12 nt, Human
acccccagcuca

SEQ ID NO: 2483104 - RNA, 22 nt, Human
acccccagcuuugcccaacacc

SEQ ID NO: 2483105 - RNA, 19 nt, Human
acccccagcugcuuguguc

SEQ ID NO: 2483106 - RNA, 14 nt, Human
acccccagcuuugc

SEQ ID NO: 2483107 - RNA, 18 nt, Human
acccccagcuccggccug

SEQ ID NO: 2483108 - RNA, 21 nt, Human
acccccaggccucagucuccc

SEQ ID NO: 2483109 - RNA, 16 nt, Human
acccccagcuuugcua

SEQ ID NO: 2483110 - RNA, 16 nt, Human
acccccaggaccccug

SEQ ID NO: 2483111 - RNA, 17 nt, Human
acccccaucucucccuc

SEQ ID NO: 2483112 - RNA, 18 nt, Human
acccccauuucuauuuau

SEQ ID NO: 2483113 - RNA, 17 nt, Human
acccccauuucuauuua

SEQ ID NO: 2483114 - RNA, 20 nt, Human
accccccaaccccugaggaa

SEQ ID NO: 2483115 - RNA, 19 nt, Human
accccccaaccccugagga

SEQ ID NO: 2483116 - RNA, 14 nt, Human
accccccaagcugu

SEQ ID NO: 2483117 - RNA, 12 nt, Human
accccccaccug

SEQ ID NO: 2483118 - RNA, 13 nt, Human
accccccaccugc

SEQ ID NO: 2483119 - RNA, 16 nt, Human
accccccacucugugc

SEQ ID NO: 2483120 - RNA, 22 nt, Human
accccccacacucacuccugag

SEQ ID NO: 2483121 - RNA, 19 nt, Human
accccccacucugugccug

SEQ ID NO: 2483122 - RNA, 18 nt, Human
accccccagaaccugucc

SEQ ID NO: 2483123 - RNA, 13 nt, Human
acccccgcccccu

SEQ ID NO: 2483124 - RNA, 14 nt, Human
acccccgcccccug

SEQ ID NO: 2483125 - RNA, 16 nt, Human
acccccucauuguuua

SEQ ID NO: 2483126 - RNA, 19 nt, Human
accccccagaaccuguccu

SEQ ID NO: 2483127 - RNA, 21 nt, Human
acccccgcccccugcccuccc

SEQ ID NO: 2483128 - RNA, 20 nt, Human
acccccgcccccugcccucc

SEQ ID NO: 2483129 - RNA, 19 nt, Human
acccccgcccccugcccuc

SEQ ID NO: 2483130 - RNA, 18 nt, Human
acccccgcccccugcccu

SEQ ID NO: 2483131 - RNA, 15 nt, Human
acccccgcccccugc

SEQ ID NO: 2483132 - RNA, 22 nt, Human
accccaugcuguugauugcuaa

SEQ ID NO: 2483133 - RNA, 20 nt, Human
accccaugcuguugauugcu

SEQ ID NO: 2483134 - RNA, 23 nt, Human
accccaugcuguugauugcuaaa

SEQ ID NO: 2483135 - RNA, 17 nt, Human
accccaugcuguugauu

SEQ ID NO: 2483136 - RNA, 16 nt, Human
accccaugcuguugau

SEQ ID NO: 2483137 - RNA, 12 nt, Human
accccaugcugu

SEQ ID NO: 2483138 - RNA, 17 nt, Human
accccaucugcccagga

SEQ ID NO: 2483139 - RNA, 16 nt, Human
accccaugccaaagcu

SEQ ID NO: 2483140 - RNA, 16 nt, Human
accccaucugcccagg

SEQ ID NO: 2483141 - RNA, 15 nt, Human
accccaucugcccag

SEQ ID NO: 2483142 - RNA, 15 nt, Human
accccaucugugaau

SEQ ID NO: 2483143 - RNA, 16 nt, Human
accccaucugugaaua

SEQ ID NO: 2483144 - RNA, 18 nt, Human
accccaucugugaauaag

SEQ ID NO: 2483145 - RNA, 15 nt, Human
acccagugcccccac

SEQ ID NO: 2483146 - RNA, 18 nt, Human
acccagugcccccacuga

SEQ ID NO: 2483147 - RNA, 14 nt, Human
acccagugagcacu

SEQ ID NO: 2483148 - RNA, 16 nt, Human
acccagucuguucccc

SEQ ID NO: 2483149 - RNA, 14 nt, Human
acccagucccuggg

SEQ ID NO: 2483150 - RNA, 14 nt, Human
acccccagccugcu

SEQ ID NO: 2483151 - RNA, 23 nt, Human
accccaugucaccggauccuggg

SEQ ID NO: 2483152 - RNA, 15 nt, Human
acccccagccugcua

SEQ ID NO: 2483153 - RNA, 16 nt, Human
accccauuuucugugg

SEQ ID NO: 2483154 - RNA, 18 nt, Human
acccaguaacucaucugu

SEQ ID NO: 2483155 - RNA, 16 nt, Human
acccaguccacaaaau

SEQ ID NO: 2483156 - RNA, 17 nt, Human
acccaguaacucaucug

SEQ ID NO: 2483157 - RNA, 17 nt, Human
acccaguccccgugccc

SEQ ID NO: 2483158 - RNA, 21 nt, Human
acccaguccccgugccccgcc

SEQ ID NO: 2483159 - RNA, 13 nt, Human
acccagucccugg

SEQ ID NO: 2483160 - RNA, 15 nt, Human
acccagucccugggg

SEQ ID NO: 2483161 - RNA, 15 nt, Human
acccagcucuggucc

SEQ ID NO: 2483162 - RNA, 13 nt, Human
acccagcucuggu

SEQ ID NO: 2483163 - RNA, 22 nt, Human
acccagcuaugguucucucgca

SEQ ID NO: 2483164 - RNA, 18 nt, Human
ucagcccugggccccacc

SEQ ID NO: 2483165 - RNA, 19 nt, Human
ucagcccugggccccacca

SEQ ID NO: 2483166 - RNA, 14 nt, Human
ucagcccuggaggu

SEQ ID NO: 2483167 - RNA, 13 nt, Human
ucagcccuggagg

SEQ ID NO: 2483168 - RNA, 12 nt, Human
ucagcccuggag

SEQ ID NO: 2483169 - RNA, 19 nt, Human
ucagcccuggaggugccag

SEQ ID NO: 2483170 - RNA, 17 nt, Human
ucagcccuggaggugcc

SEQ ID NO: 2483171 - RNA, 21 nt, Human
ucagcccuggaggugccagca

SEQ ID NO: 2483172 - RNA, 12 nt, Human
ucagcccugggc

SEQ ID NO: 2483173 - RNA, 17 nt, Human
ucagcccaccccccuca

SEQ ID NO: 2483174 - RNA, 16 nt, Human
ucagcccauauuucau

SEQ ID NO: 2483175 - RNA, 18 nt, Human
ucagcccaccccccucau

SEQ ID NO: 2483176 - RNA, 20 nt, Human
ucagccccaccccagguccu

SEQ ID NO: 2483177 - RNA, 18 nt, Human
ucagcccucccugccccu

SEQ ID NO: 2483178 - RNA, 14 nt, Human
ucagccccuccucu

SEQ ID NO: 2483179 - RNA, 15 nt, Human
ucagccccuccucug

SEQ ID NO: 2483180 - RNA, 16 nt, Human
ucagccccuccucugc

SEQ ID NO: 2483181 - RNA, 17 nt, Human
ucagccccuccucugcc

SEQ ID NO: 2483182 - RNA, 12 nt, Human
ucagccccuccu

SEQ ID NO: 2483183 - RNA, 13 nt, Human
ucagccccuccuc

SEQ ID NO: 2483184 - RNA, 18 nt, Human
ucagccccuccucugcca

SEQ ID NO: 2483185 - RNA, 23 nt, Human
ucagcccugaggugaaagggagc

SEQ ID NO: 2483186 - RNA, 13 nt, Human
ucagcccugaggu

SEQ ID NO: 2483187 - RNA, 16 nt, Human
ucagcccugacccugu

SEQ ID NO: 2483188 - RNA, 19 nt, Human
ucagcccucccugccccuc

SEQ ID NO: 2483189 - RNA, 17 nt, Human
ucagcccucccugcccc

SEQ ID NO: 2483190 - RNA, 13 nt, Human
ucagcccugaccc

SEQ ID NO: 2483191 - RNA, 21 nt, Human
ucagauuuuaaaaagucuuca

SEQ ID NO: 2483192 - RNA, 19 nt, Human
ucagauuuuaaaaagucuu

SEQ ID NO: 2483193 - RNA, 14 nt, Human
ucagauucccagag

SEQ ID NO: 2483194 - RNA, 22 nt, Human
ucagaugucuucugccuguuau

SEQ ID NO: 2483195 - RNA, 22 nt, Human
ucagauuugccuuauuggcagc

SEQ ID NO: 2483196 - RNA, 14 nt, Human
ucagaugcccagag

SEQ ID NO: 2483197 - RNA, 22 nt, Human
ucagauggauugauaauugcau

SEQ ID NO: 2483198 - RNA, 21 nt, Human
ucagaugucuucugccuguua

SEQ ID NO: 2483199 - RNA, 20 nt, Human
ucagaugucuucugccuguu

SEQ ID NO: 2483200 - RNA, 19 nt, Human
ucagaugucuucugccugu

SEQ ID NO: 2483201 - RNA, 17 nt, Human
ucagaugucuucugccu

SEQ ID NO: 2483202 - RNA, 16 nt, Human
ucagaugucuucugcc

SEQ ID NO: 2483203 - RNA, 15 nt, Human
ucagaugucuucugc

SEQ ID NO: 2483204 - RNA, 14 nt, Human
ucagaugucuucug

SEQ ID NO: 2483205 - RNA, 13 nt, Human
ucagaugucuucu

SEQ ID NO: 2483206 - RNA, 15 nt, Human
ucagaugggaagaca

SEQ ID NO: 2483207 - RNA, 18 nt, Human
ucagaugggaagacauga

SEQ ID NO: 2483208 - RNA, 15 nt, Human
ucagaacuagaauuu

SEQ ID NO: 2483209 - RNA, 21 nt, Human
ucagaacucaaauggggccag

SEQ ID NO: 2483210 - RNA, 22 nt, Human
ucagaacucaaauggggccaga

SEQ ID NO: 2483211 - RNA, 18 nt, Human
ucagaacccuuggcuugc

SEQ ID NO: 2483212 - RNA, 20 nt, Human
ucagaacccuuggcuugccc

SEQ ID NO: 2483213 - RNA, 24 nt, Human
ucagaacccuuggcuugcccacgu

SEQ ID NO: 2483214 - RNA, 15 nt, Human
ucagaaccucuuccc

SEQ ID NO: 2483215 - RNA, 16 nt, Human
ucagaaccucuucccc

SEQ ID NO: 2483216 - RNA, 17 nt, Human
ucagaaccucuucccca

SEQ ID NO: 2483217 - RNA, 18 nt, Human
ucagaaccucuuccccag

SEQ ID NO: 2483218 - RNA, 20 nt, Human
ucagaaccucuuccccagaa

SEQ ID NO: 2483219 - RNA, 12 nt, Human
ucagaagaaaga

SEQ ID NO: 2483220 - RNA, 13 nt, Human
ucagaagacacug

SEQ ID NO: 2483221 - RNA, 13 nt, Human
ucagaucuucugu

SEQ ID NO: 2483222 - RNA, 21 nt, Human
ucagaugaacucuuagaaaug

SEQ ID NO: 2483223 - RNA, 14 nt, Human
ucagaucugucuga

SEQ ID NO: 2483224 - RNA, 13 nt, Human
ucagaucugucug

SEQ ID NO: 2483225 - RNA, 22 nt, Human
ucaggaagaaaucacagaauca

SEQ ID NO: 2483226 - RNA, 15 nt, Human
ucaggaagaaaucac

SEQ ID NO: 2483227 - RNA, 23 nt, Human
ucaggaagaaaucacagaaucau

SEQ ID NO: 2483228 - RNA, 13 nt, Human
ucaggaagaacac

SEQ ID NO: 2483229 - RNA, 23 nt, Human
ucaggaagaaaggagucugcaca

SEQ ID NO: 2483230 - RNA, 12 nt, Human
ucaggaagaaau

SEQ ID NO: 2483231 - RNA, 14 nt, Human
ucagccuggugggc

SEQ ID NO: 2483232 - RNA, 17 nt, Human
ucagcggggacagcucc

SEQ ID NO: 2483233 - RNA, 16 nt, Human
ucagcggggacagcuc

SEQ ID NO: 2483234 - RNA, 15 nt, Human
ucagcggggacagcu

SEQ ID NO: 2483235 - RNA, 20 nt, Human
ucagccuggccagacacagg

SEQ ID NO: 2483236 - RNA, 19 nt, Human
ucagccuggccagacacag

SEQ ID NO: 2483237 - RNA, 21 nt, Human
accccuuccccacugccugcc

SEQ ID NO: 2483238 - RNA, 22 nt, Human
accccuuccccacugccugccc

SEQ ID NO: 2483239 - RNA, 20 nt, Human
ucaggaagcucagggccugg

SEQ ID NO: 2483240 - RNA, 19 nt, Human
ucaggaagcucagggccug

SEQ ID NO: 2483241 - RNA, 17 nt, Human
ucaggaagcucagggcc

SEQ ID NO: 2483242 - RNA, 16 nt, Human
ucaggaagcucagggc

SEQ ID NO: 2483243 - RNA, 23 nt, Human
ucaggccaaacucaccugccccu

SEQ ID NO: 2483244 - RNA, 20 nt, Human
ucaggccaaacucaccugcc

SEQ ID NO: 2483245 - RNA, 16 nt, Human
ucaggcaugccugugu

SEQ ID NO: 2483246 - RNA, 17 nt, Human
ucaggcaugccugugug

SEQ ID NO: 2483247 - RNA, 19 nt, Human
ucaggcaugaacauguacu
